United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 32

SEQ ID NO: 1331698 - DNA, 14 bp, Homo sapiens
cagagtccctgcct

SEQ ID NO: 1331699 - DNA, 18 bp, Homo sapiens
caggaaccgaggcaggga

SEQ ID NO: 1331700 - DNA, 23 bp, Homo sapiens
caggagacaggttagctgctccc

SEQ ID NO: 1331701 - DNA, 20 bp, Homo sapiens
caggcatcggggagccggga

SEQ ID NO: 1331702 - DNA, 21 bp, Homo sapiens
caggcatcggggagccgggag

SEQ ID NO: 1331703 - DNA, 13 bp, Homo sapiens
cagggaaggatcc

SEQ ID NO: 1331704 - DNA, 18 bp, Homo sapiens
cagtctgagagaggccat

SEQ ID NO: 1331705 - DNA, 18 bp, Homo sapiens
cagtggctggatctgtga

SEQ ID NO: 1331706 - DNA, 13 bp, Homo sapiens
catcatgtttaca

SEQ ID NO: 1331707 - DNA, 13 bp, Homo sapiens
catccagagtccc

SEQ ID NO: 1331708 - DNA, 17 bp, Homo sapiens
catccagagtccctgcc

SEQ ID NO: 1331709 - DNA, 15 bp, Homo sapiens
catcctaccccctgt

SEQ ID NO: 1331710 - DNA, 23 bp, Homo sapiens
catgagctccttaaggctctttt

SEQ ID NO: 1331711 - DNA, 17 bp, Homo sapiens
catgtgactctttccaa

SEQ ID NO: 1331712 - DNA, 21 bp, Homo sapiens
cattacctcagtgagaagcca

SEQ ID NO: 1331713 - DNA, 16 bp, Homo sapiens
ccaaacaggctcagag

SEQ ID NO: 1331714 - DNA, 20 bp, Homo sapiens
ccacacagacttgggcaggg

SEQ ID NO: 1331715 - DNA, 20 bp, Homo sapiens
ccacctgaataaagaatgaa

SEQ ID NO: 1331716 - DNA, 23 bp, Homo sapiens
ccagacttcccacggctcctcga

SEQ ID NO: 1331717 - DNA, 19 bp, Homo sapiens
ccagagtcaacaaattaaa

SEQ ID NO: 1331718 - DNA, 22 bp, Homo sapiens
ccagagtcaacaaattaaataa

SEQ ID NO: 1331719 - DNA, 17 bp, Homo sapiens
ccagatatggaaacaga

SEQ ID NO: 1331720 - DNA, 16 bp, Homo sapiens
ccagcatttcccttcc

SEQ ID NO: 1331721 - DNA, 21 bp, Homo sapiens
ccagcatttcccttccttcct

SEQ ID NO: 1331722 - DNA, 13 bp, Homo sapiens
ccaggagacaggt

SEQ ID NO: 1331723 - DNA, 12 bp, Homo sapiens
ccatgagctcct

SEQ ID NO: 1331724 - DNA, 15 bp, Homo sapiens
cccaacactgccagc

SEQ ID NO: 1331725 - DNA, 15 bp, Homo sapiens
cccacggctcctcga

SEQ ID NO: 1331726 - DNA, 18 bp, Homo sapiens
cccagatatggaaacaga

SEQ ID NO: 1331727 - DNA, 20 bp, Homo sapiens
cccagatatggaaacagaag

SEQ ID NO: 1331728 - DNA, 13 bp, Homo sapiens
cccatgagctcct

SEQ ID NO: 1331729 - DNA, 14 bp, Homo sapiens
cccatgagctcctt

SEQ ID NO: 1331730 - DNA, 22 bp, Homo sapiens
cccatgagctccttaaggctct

SEQ ID NO: 1331731 - DNA, 22 bp, Homo sapiens
ccccctgtgccttgtcacgcca

SEQ ID NO: 1331732 - DNA, 14 bp, Homo sapiens
ccctcatctttctt

SEQ ID NO: 1331733 - DNA, 20 bp, Homo sapiens
ccctgccatcatgtttacag

SEQ ID NO: 1331734 - DNA, 12 bp, Homo sapiens
ccctgcctggac

SEQ ID NO: 1331735 - DNA, 24 bp, Homo sapiens
ccctgtgccttggtgtgctgtatc

SEQ ID NO: 1331736 - DNA, 20 bp, Homo sapiens
ccgagagtccatcagcctcc

SEQ ID NO: 1331737 - DNA, 16 bp, Homo sapiens
ccggctttgtggcact

SEQ ID NO: 1331738 - DNA, 16 bp, Homo sapiens
cctaggctagggtggg

SEQ ID NO: 1331739 - DNA, 18 bp, Homo sapiens
cctcagccccgcgtggaa

SEQ ID NO: 1331740 - DNA, 18 bp, Homo sapiens
cctctcattccagaggaa

SEQ ID NO: 1331741 - DNA, 15 bp, Homo sapiens
cctcttggctgcctt

SEQ ID NO: 1331742 - DNA, 23 bp, Homo sapiens
cctcttggggagtttagggtggg

SEQ ID NO: 1331743 - DNA, 14 bp, Homo sapiens
cctgactctcagca

SEQ ID NO: 1331744 - DNA, 19 bp, Homo sapiens
cctgaggaagagggactgt

SEQ ID NO: 1331745 - DNA, 15 bp, Homo sapiens
cctgcaccggggcct

SEQ ID NO: 1331746 - DNA, 12 bp, Homo sapiens
cctgcctggacc

SEQ ID NO: 1331747 - DNA, 15 bp, Homo sapiens
cctggaccagcctct

SEQ ID NO: 1331748 - DNA, 16 bp, Homo sapiens
cctggaccagcctctc

SEQ ID NO: 1331749 - DNA, 12 bp, Homo sapiens
cctgggcaggag

SEQ ID NO: 1331750 - DNA, 18 bp, Homo sapiens
ccttgtcacgccagactt

SEQ ID NO: 1331751 - DNA, 22 bp, Homo sapiens
cgagatcccaacactgccagca

SEQ ID NO: 1331752 - DNA, 16 bp, Homo sapiens
cgcggctgggaggagg

SEQ ID NO: 1331753 - DNA, 12 bp, Homo sapiens
cggctgggagga

SEQ ID NO: 1331754 - DNA, 23 bp, Homo sapiens
cggctgggaggagggcaggcatc

SEQ ID NO: 1331755 - DNA, 18 bp, Homo sapiens
cgggacacctaggctagg

SEQ ID NO: 1331756 - DNA, 21 bp, Homo sapiens
cgggggcagtctgagagaggc

SEQ ID NO: 1331757 - DNA, 15 bp, Homo sapiens
cgggtcatctgtacc

SEQ ID NO: 1331758 - DNA, 14 bp, Homo sapiens
cgtgtctggcacag

SEQ ID NO: 1331759 - DNA, 16 bp, Homo sapiens
cgttgtcctcagcccc

SEQ ID NO: 1331760 - DNA, 19 bp, Homo sapiens
ctaacctgccgagagtcca

SEQ ID NO: 1331761 - DNA, 22 bp, Homo sapiens
ctaattctttgacctgttggga

SEQ ID NO: 1331762 - DNA, 14 bp, Homo sapiens
ctaccccctgtgcc

SEQ ID NO: 1331763 - DNA, 15 bp, Homo sapiens
ctagttctgccagga

SEQ ID NO: 1331764 - DNA, 16 bp, Homo sapiens
ctagttctgccaggag

SEQ ID NO: 1331765 - DNA, 14 bp, Homo sapiens
ctattgtagagcca

SEQ ID NO: 1331766 - DNA, 18 bp, Homo sapiens
ctcatgtgactctttcca

SEQ ID NO: 1331767 - DNA, 23 bp, Homo sapiens
ctccatcctaccccctgtgcctt

SEQ ID NO: 1331768 - DNA, 22 bp, Homo sapiens
ctcgagatcccaacactgccag

SEQ ID NO: 1331769 - DNA, 23 bp, Homo sapiens
ctcgagatcccaacactgccagc

SEQ ID NO: 1331770 - DNA, 22 bp, Homo sapiens
ctctccactcatgtgactcttt

SEQ ID NO: 1331771 - DNA, 23 bp, Homo sapiens
ctcttggggagtttagggtgggg

SEQ ID NO: 1331772 - DNA, 13 bp, Homo sapiens
ctgagagaggcca

SEQ ID NO: 1331773 - DNA, 13 bp, Homo sapiens
ctgattgtattta

SEQ ID NO: 1331774 - DNA, 16 bp, Homo sapiens
ctgcaccggggcctgg

SEQ ID NO: 1331775 - DNA, 18 bp, Homo sapiens
ctgcaccggggcctgggc

SEQ ID NO: 1331776 - DNA, 19 bp, Homo sapiens
ctgcaccggggcctgggca

SEQ ID NO: 1331777 - DNA, 11 bp, Homo sapiens
ctgccaggaga

SEQ ID NO: 1331778 - DNA, 22 bp, Homo sapiens
ctgccatcatgtttacagagga

SEQ ID NO: 1331779 - DNA, 18 bp, Homo sapiens
ctgcccgggagctcagga

SEQ ID NO: 1331780 - DNA, 17 bp, Homo sapiens
ctgcctggaccagcctc

SEQ ID NO: 1331781 - DNA, 11 bp, Homo sapiens
ctgctgggctt

SEQ ID NO: 1331782 - DNA, 16 bp, Homo sapiens
ctggcacagcctggct

SEQ ID NO: 1331783 - DNA, 21 bp, Homo sapiens
ctggcacagcctggctgtggc

SEQ ID NO: 1331784 - DNA, 21 bp, Homo sapiens
ctggccagtggctggatctgt

SEQ ID NO: 1331785 - DNA, 13 bp, Homo sapiens
ctgggcaggaggg

SEQ ID NO: 1331786 - DNA, 16 bp, Homo sapiens
ctggggatgtctctca

SEQ ID NO: 1331787 - DNA, 22 bp, Homo sapiens
ctggggatgtctctcatgacca

SEQ ID NO: 1331788 - DNA, 14 bp, Homo sapiens
ctgtacctctgcct

SEQ ID NO: 1331789 - DNA, 20 bp, Homo sapiens
ctgtgccttgtcacgccaga

SEQ ID NO: 1331790 - DNA, 16 bp, Homo sapiens
ctgtgccttttgccat

SEQ ID NO: 1331791 - DNA, 15 bp, Homo sapiens
ctgtgtgtgtgtatg

SEQ ID NO: 1331792 - DNA, 18 bp, Homo sapiens
ctgtgtgtgtgtatgtgg

SEQ ID NO: 1331793 - DNA, 18 bp, Homo sapiens
cttattggcagctctact

SEQ ID NO: 1331794 - DNA, 14 bp, Homo sapiens
cttccttcctctcc

SEQ ID NO: 1331795 - DNA, 11 bp, Homo sapiens
cttctaatgac

SEQ ID NO: 1331796 - DNA, 17 bp, Homo sapiens
cttctacctcttggctg

SEQ ID NO: 1331797 - DNA, 16 bp, Homo sapiens
cttctagttctgccag

SEQ ID NO: 1331798 - DNA, 17 bp, Homo sapiens
cttctagttctgccagg

SEQ ID NO: 1331799 - DNA, 20 bp, Homo sapiens
cttggggagtttagggtggg

SEQ ID NO: 1331800 - DNA, 13 bp, Homo sapiens
cttgtcacgccag

SEQ ID NO: 1331801 - DNA, 14 bp, Homo sapiens
cttttgtcccagaa

SEQ ID NO: 1331802 - DNA, 17 bp, Homo sapiens
gaaaagggatgatggga

SEQ ID NO: 1331803 - DNA, 14 bp, Homo sapiens
gaaacagaagacaa

SEQ ID NO: 1331804 - DNA, 13 bp, Homo sapiens
gaactattagagc

SEQ ID NO: 1331805 - DNA, 15 bp, Homo sapiens
gaaggctatggggat

SEQ ID NO: 1331806 - DNA, 18 bp, Homo sapiens
gaagggaaaagggatgat

SEQ ID NO: 1331807 - DNA, 19 bp, Homo sapiens
gaaggggcttctaatgacc

SEQ ID NO: 1331808 - DNA, 23 bp, Homo sapiens
gaaggggcttctaatgacccaga

SEQ ID NO: 1331809 - DNA, 16 bp, Homo sapiens
gaatgtcagtatgtgg

SEQ ID NO: 1331810 - DNA, 18 bp, Homo sapiens
gaatgtcagtatgtggaa

SEQ ID NO: 1331811 - DNA, 15 bp, Homo sapiens
gacagtatttgtggg

SEQ ID NO: 1331812 - DNA, 17 bp, Homo sapiens
gacccagatatggaaac

SEQ ID NO: 1331813 - DNA, 22 bp, Homo sapiens
gacccagatatggaaacagaag

SEQ ID NO: 1331814 - DNA, 20 bp, Homo sapiens
gaccctcatctttcttccaa

SEQ ID NO: 1331815 - DNA, 17 bp, Homo sapiens
gacctttcctgaggaag

SEQ ID NO: 1331816 - DNA, 13 bp, Homo sapiens
gagagaggccatt

SEQ ID NO: 1331817 - DNA, 21 bp, Homo sapiens
gagcctgaccctcatctttct

SEQ ID NO: 1331818 - DNA, 21 bp, Homo sapiens
gagctcaggaaccgaggcagg

SEQ ID NO: 1331819 - DNA, 22 bp, Homo sapiens
gaggacagtatttgtggggagg

SEQ ID NO: 1331820 - DNA, 13 bp, Homo sapiens
gaggagggcaggc

SEQ ID NO: 1331821 - DNA, 15 bp, Homo sapiens
gaggagggcaggcat

SEQ ID NO: 1331822 - DNA, 9 bp, Homo sapiens
gagggctgc

SEQ ID NO: 1331823 - DNA, 20 bp, Homo sapiens
gagtcaacaaattaaataaa

SEQ ID NO: 1331824 - DNA, 18 bp, Homo sapiens
gagtcagggagagctgaa

SEQ ID NO: 1331825 - DNA, 15 bp, Homo sapiens
gagtccatcagcctc

SEQ ID NO: 1331826 - DNA, 14 bp, Homo sapiens
gagtccctgccatc

SEQ ID NO: 1331827 - DNA, 15 bp, Homo sapiens
gagtccctgcctgga

SEQ ID NO: 1331828 - DNA, 23 bp, Homo sapiens
gagtccctgcctggaccagcctc

SEQ ID NO: 1331829 - DNA, 13 bp, Homo sapiens
gagtgtgtaattt

SEQ ID NO: 1331830 - DNA, 22 bp, Homo sapiens
gagtgtgtaatttaaaattgtg

SEQ ID NO: 1331831 - DNA, 13 bp, Homo sapiens
gatagatgtgtgg

SEQ ID NO: 1331832 - DNA, 17 bp, Homo sapiens
gatatggaaacagaaga

SEQ ID NO: 1331833 - DNA, 22 bp, Homo sapiens
gatatggaaacagaagacaaaa

SEQ ID NO: 1331834 - DNA, 14 bp, Homo sapiens
gatcattatcagcc

SEQ ID NO: 1331835 - DNA, 18 bp, Homo sapiens
gatcccaacactgccagc

SEQ ID NO: 1331836 - DNA, 17 bp, Homo sapiens
gatcccatgagctcctt

SEQ ID NO: 1331837 - DNA, 15 bp, Homo sapiens
gatgggtcagttgta

SEQ ID NO: 1331838 - DNA, 19 bp, Homo sapiens
gattgaaggggcttctaat

SEQ ID NO: 1331839 - DNA, 20 bp, Homo sapiens
gatttggggctcagagtggg

SEQ ID NO: 1331840 - DNA, 12 bp, Homo sapiens
gcacagcctggc

SEQ ID NO: 1331841 - DNA, 23 bp, Homo sapiens
gcactggggcaggggccgggggc

SEQ ID NO: 1331842 - DNA, 21 bp, Homo sapiens
gcatccagagtccctgcctgg

SEQ ID NO: 1331843 - DNA, 22 bp, Homo sapiens
gcatccagagtccctgcctgga

SEQ ID NO: 1331844 - DNA, 23 bp, Homo sapiens
gcatccagagtccctgcctggac

SEQ ID NO: 1331845 - DNA, 16 bp, Homo sapiens
gccacctgaataaaga

SEQ ID NO: 1331846 - DNA, 13 bp, Homo sapiens
gccgggagcctga

SEQ ID NO: 1331847 - DNA, 14 bp, Homo sapiens
gccgggagcctgac

SEQ ID NO: 1331848 - DNA, 18 bp, Homo sapiens
gctagggtggggagagac

SEQ ID NO: 1331849 - DNA, 16 bp, Homo sapiens
gctcaggaaccgaggc

SEQ ID NO: 1331850 - DNA, 23 bp, Homo sapiens
gctgggacaccccgacttttgtt

SEQ ID NO: 1331851 - DNA, 22 bp, Homo sapiens
gctgggcttggcagcccgggtc

SEQ ID NO: 1331852 - DNA, 14 bp, Homo sapiens
gctggggatgtctc

SEQ ID NO: 1331853 - DNA, 16 bp, Homo sapiens
gcttctaatgacccag

SEQ ID NO: 1331854 - DNA, 18 bp, Homo sapiens
gcttctagttctgccagg

SEQ ID NO: 1331855 - DNA, 21 bp, Homo sapiens
gcttctagttctgccaggaga

SEQ ID NO: 1331856 - DNA, 19 bp, Homo sapiens
gctttcctcatcaggccat

SEQ ID NO: 1331857 - DNA, 14 bp, Homo sapiens
ggaactgctgggct

SEQ ID NO: 1331858 - DNA, 23 bp, Homo sapiens
ggaagggacaccaagccttggct

SEQ ID NO: 1331859 - DNA, 15 bp, Homo sapiens
ggaggagggcaggca

SEQ ID NO: 1331860 - DNA, 12 bp, Homo sapiens
ggagggatttgg

SEQ ID NO: 1331861 - DNA, 14 bp, Homo sapiens
ggagggggagaggg

SEQ ID NO: 1331862 - DNA, 22 bp, Homo sapiens
ggagtgtgtaatttaaaattgt

SEQ ID NO: 1331863 - DNA, 13 bp, Homo sapiens
ggatgtctgggcc

SEQ ID NO: 1331864 - DNA, 23 bp, Homo sapiens
ggcaggcatcggggagccgggag

SEQ ID NO: 1331865 - DNA, 16 bp, Homo sapiens
ggcatccagagtccct

SEQ ID NO: 1331866 - DNA, 23 bp, Homo sapiens
ggcatcggggagccgggagcctg

SEQ ID NO: 1331867 - DNA, 21 bp, Homo sapiens
ggcctaacctgccgagagtcc

SEQ ID NO: 1331868 - DNA, 20 bp, Homo sapiens
ggctcctcgagatcccaaca

SEQ ID NO: 1331869 - DNA, 13 bp, Homo sapiens
ggctgggaggagg

SEQ ID NO: 1331870 - DNA, 23 bp, Homo sapiens
ggctgtggcatccagagtccctg

SEQ ID NO: 1331871 - DNA, 14 bp, Homo sapiens
gggacacctaggct

SEQ ID NO: 1331872 - DNA, 13 bp, Homo sapiens
gggagccgggagc

SEQ ID NO: 1331873 - DNA, 14 bp, Homo sapiens
gggatagatgtgtg

SEQ ID NO: 1331874 - DNA, 18 bp, Homo sapiens
gggcagtctgagagaggc

SEQ ID NO: 1331875 - DNA, 20 bp, Homo sapiens
gggcagtctgagagaggcca

SEQ ID NO: 1331876 - DNA, 12 bp, Homo sapiens
gggcctgggcag

SEQ ID NO: 1331877 - DNA, 15 bp, Homo sapiens
gggcctgggcaggag

SEQ ID NO: 1331878 - DNA, 17 bp, Homo sapiens
ggggccgggggcagtct

SEQ ID NO: 1331879 - DNA, 22 bp, Homo sapiens
gggggcagtctgagagaggcca

SEQ ID NO: 1331880 - DNA, 14 bp, Homo sapiens
gggtggggagagac

SEQ ID NO: 1331881 - DNA, 17 bp, Homo sapiens
gggtgtcctgcaccggg

SEQ ID NO: 1331882 - DNA, 22 bp, Homo sapiens
ggtggggggggggcgcggctgg

SEQ ID NO: 1331883 - DNA, 21 bp, Homo sapiens
ggtgtcctgcaccggggcctg

SEQ ID NO: 1331884 - DNA, 15 bp, Homo sapiens
gtaagccagagtcaa

SEQ ID NO: 1331885 - DNA, 16 bp, Homo sapiens
gtaggaactgctgggc

SEQ ID NO: 1331886 - DNA, 19 bp, Homo sapiens
gtatgtgggggtctgtgtg

SEQ ID NO: 1331887 - DNA, 22 bp, Homo sapiens
gtccctgcctggaccagcctct

SEQ ID NO: 1331888 - DNA, 19 bp, Homo sapiens
gtcctgcaccggggcctgg

SEQ ID NO: 1331889 - DNA, 15 bp, Homo sapiens
gtctgagagaggcca

SEQ ID NO: 1331890 - DNA, 19 bp, Homo sapiens
gtgatttttatgccacctg

SEQ ID NO: 1331891 - DNA, 20 bp, Homo sapiens
gtgatttttatgccacctga

SEQ ID NO: 1331892 - DNA, 14 bp, Homo sapiens
gtgccttttgccat

SEQ ID NO: 1331893 - DNA, 20 bp, Homo sapiens
gtggaagtgtgggtctgtgt

SEQ ID NO: 1331894 - DNA, 21 bp, Homo sapiens
gtggaagtgtgggtctgtgtg

SEQ ID NO: 1331895 - DNA, 22 bp, Homo sapiens
gtggaagtgtgggtctgtgtgt

SEQ ID NO: 1331896 - DNA, 16 bp, Homo sapiens
gtggctcgggaggcga

SEQ ID NO: 1331897 - DNA, 14 bp, Homo sapiens
gtgggagtgtgtaa

SEQ ID NO: 1331898 - DNA, 15 bp, Homo sapiens
gtgggggtctgtgtg

SEQ ID NO: 1331899 - DNA, 16 bp, Homo sapiens
gtgggggtctgtgtgt

SEQ ID NO: 1331900 - DNA, 19 bp, Homo sapiens
gtggggtaggttgggagaa

SEQ ID NO: 1331901 - DNA, 13 bp, Homo sapiens
gtgggtctgtgtg

SEQ ID NO: 1331902 - DNA, 20 bp, Homo sapiens
gtgtaatttaaaattgtgat

SEQ ID NO: 1331903 - DNA, 14 bp, Homo sapiens
gtgtgggtctgtgt

SEQ ID NO: 1331904 - DNA, 12 bp, Homo sapiens
gtgtgtatgtgg

SEQ ID NO: 1331905 - DNA, 13 bp, Homo sapiens
gtgtgtgtatgtg

SEQ ID NO: 1331906 - DNA, 13 bp, Homo sapiens
gttgtgtgtggga

SEQ ID NO: 1331907 - DNA, 14 bp, Homo sapiens
gttgtgtgtgggag

SEQ ID NO: 1331908 - DNA, 15 bp, Homo sapiens
taaaattgtgatgtg

SEQ ID NO: 1331909 - DNA, 12 bp, Homo sapiens
taagccagagtc

SEQ ID NO: 1331910 - DNA, 15 bp, Homo sapiens
taagccagagtcaac

SEQ ID NO: 1331911 - DNA, 22 bp, Homo sapiens
taagtgccaggatggaatgatg

SEQ ID NO: 1331912 - DNA, 21 bp, Homo sapiens
taatgacccagatatggaaac

SEQ ID NO: 1331913 - DNA, 15 bp, Homo sapiens
taatttaaaattgtg

SEQ ID NO: 1331914 - DNA, 15 bp, Homo sapiens
taccccctgtgcctt

SEQ ID NO: 1331915 - DNA, 11 bp, Homo sapiens
tagatgtgtgg

SEQ ID NO: 1331916 - DNA, 15 bp, Homo sapiens
taggctagggtgggg

SEQ ID NO: 1331917 - DNA, 20 bp, Homo sapiens
tagtgatttttatgccacct

SEQ ID NO: 1331918 - DNA, 14 bp, Homo sapiens
tagttctgccagga

SEQ ID NO: 1331919 - DNA, 17 bp, Homo sapiens
tatggggatagatgtgt

SEQ ID NO: 1331920 - DNA, 18 bp, Homo sapiens
tatggggatagatgtgtg

SEQ ID NO: 1331921 - DNA, 16 bp, Homo sapiens
tatgtggaagtgtggg

SEQ ID NO: 1331922 - DNA, 19 bp, Homo sapiens
tatgtgggggtctgtgtgt

SEQ ID NO: 1331923 - DNA, 11 bp, Homo sapiens
tatgtgtgtgt

SEQ ID NO: 1331924 - DNA, 23 bp, Homo sapiens
tcacagcaagtcactggccagtg

SEQ ID NO: 1331925 - DNA, 16 bp, Homo sapiens
tcagccccgcgtggaa

SEQ ID NO: 1331926 - DNA, 14 bp, Homo sapiens
tcagtatgtggaag

SEQ ID NO: 1331927 - DNA, 12 bp, Homo sapiens
tcatctttcttc

SEQ ID NO: 1331928 - DNA, 22 bp, Homo sapiens
tcatgatagaaggctatgggga

SEQ ID NO: 1331929 - DNA, 18 bp, Homo sapiens
tcatgtgactctttccaa

SEQ ID NO: 1331930 - DNA, 21 bp, Homo sapiens
tccactcatgtgactctttcc

SEQ ID NO: 1331931 - DNA, 19 bp, Homo sapiens
tccagagtccctgcctgga

SEQ ID NO: 1331932 - DNA, 15 bp, Homo sapiens
tcccaacactgccag

SEQ ID NO: 1331933 - DNA, 16 bp, Homo sapiens
tccctcctctgcccgg

SEQ ID NO: 1331934 - DNA, 13 bp, Homo sapiens
tccctgcctggac

SEQ ID NO: 1331935 - DNA, 16 bp, Homo sapiens
tcctaccccctgtgcc

SEQ ID NO: 1331936 - DNA, 16 bp, Homo sapiens
tcctcgagatcccaac

SEQ ID NO: 1331937 - DNA, 23 bp, Homo sapiens
tcctcgagatcccaacactgcca

SEQ ID NO: 1331938 - DNA, 20 bp, Homo sapiens
tcctgcaccggggcctgggc

SEQ ID NO: 1331939 - DNA, 23 bp, Homo sapiens
tcctgtctccctcctctgcccgg

SEQ ID NO: 1331940 - DNA, 19 bp, Homo sapiens
tccttaaggctcttttgta

SEQ ID NO: 1331941 - DNA, 18 bp, Homo sapiens
tcgagatcccaacactgc

SEQ ID NO: 1331942 - DNA, 21 bp, Homo sapiens
tcgagatcccaacactgccag

SEQ ID NO: 1331943 - DNA, 21 bp, Homo sapiens
tcgtgtctggcacagcctggc

SEQ ID NO: 1331944 - DNA, 16 bp, Homo sapiens
tctagttctgccagga

SEQ ID NO: 1331945 - DNA, 14 bp, Homo sapiens
tctgagagaggcca

SEQ ID NO: 1331946 - DNA, 15 bp, Homo sapiens
tctgtgtgtttatgt

SEQ ID NO: 1331947 - DNA, 23 bp, Homo sapiens
tcttggggagtttagggtggggg

SEQ ID NO: 1331948 - DNA, 19 bp, Homo sapiens
tctttccaaccggctttgt

SEQ ID NO: 1331949 - DNA, 19 bp, Homo sapiens
tcttttgtaaggtttttgt

SEQ ID NO: 1331950 - DNA, 17 bp, Homo sapiens
tgaaggggcttctaatg

SEQ ID NO: 1331951 - DNA, 21 bp, Homo sapiens
tgaaggggcttctaatgaccc

SEQ ID NO: 1331952 - DNA, 21 bp, Homo sapiens
tgacccagatatggaaacaga

SEQ ID NO: 1331953 - DNA, 14 bp, Homo sapiens
tgactctttccaac

SEQ ID NO: 1331954 - DNA, 20 bp, Homo sapiens
tgagctggggatgtctctca

SEQ ID NO: 1331955 - DNA, 22 bp, Homo sapiens
tgagggtgactatggagctgag

SEQ ID NO: 1331956 - DNA, 14 bp, Homo sapiens
tgagttggctggga

SEQ ID NO: 1331957 - DNA, 16 bp, Homo sapiens
tgagttggctgggaat

SEQ ID NO: 1331958 - DNA, 22 bp, Homo sapiens
tgccatcatgtttacagaggac

SEQ ID NO: 1331959 - DNA, 18 bp, Homo sapiens
tgcccgggagctcaggaa

SEQ ID NO: 1331960 - DNA, 16 bp, Homo sapiens
tgccttggtgtgctgt

SEQ ID NO: 1331961 - DNA, 15 bp, Homo sapiens
tgccttgtcacgcca

SEQ ID NO: 1331962 - DNA, 22 bp, Homo sapiens
tgctatgagctggggatgtctc

SEQ ID NO: 1331963 - DNA, 20 bp, Homo sapiens
tgcttctagttctgccagga

SEQ ID NO: 1331964 - DNA, 14 bp, Homo sapiens
tggaagtgtgggtc

SEQ ID NO: 1331965 - DNA, 22 bp, Homo sapiens
tggaccagcctctccactcatg

SEQ ID NO: 1331966 - DNA, 21 bp, Homo sapiens
tggcatccagagtccctgcct

SEQ ID NO: 1331967 - DNA, 23 bp, Homo sapiens
tggccagtggctggatctgtgag

SEQ ID NO: 1331968 - DNA, 17 bp, Homo sapiens
tggctgtggcatccaga

SEQ ID NO: 1331969 - DNA, 18 bp, Homo sapiens
tgggaggagggcaggcat

SEQ ID NO: 1331970 - DNA, 11 bp, Homo sapiens
tgggagtgtgt

SEQ ID NO: 1331971 - DNA, 13 bp, Homo sapiens
tgggcaggaggga

SEQ ID NO: 1331972 - DNA, 18 bp, Homo sapiens
tgggcaggagggaggtgc

SEQ ID NO: 1331973 - DNA, 22 bp, Homo sapiens
tggggagggatttggggctcag

SEQ ID NO: 1331974 - DNA, 20 bp, Homo sapiens
tggggagtttagggtggggg

SEQ ID NO: 1331975 - DNA, 16 bp, Homo sapiens
tggggatagatgtgtg

SEQ ID NO: 1331976 - DNA, 20 bp, Homo sapiens
tggggatagatgtgtggaca

SEQ ID NO: 1331977 - DNA, 21 bp, Homo sapiens
tggggtaggttgggagaatgt

SEQ ID NO: 1331978 - DNA, 13 bp, Homo sapiens
tgggtctgtgtgt

SEQ ID NO: 1331979 - DNA, 15 bp, Homo sapiens
tgggtctgtgtgtgt

SEQ ID NO: 1331980 - DNA, 13 bp, Homo sapiens
tggtaggaactgc

SEQ ID NO: 1331981 - DNA, 13 bp, Homo sapiens
tgtaagccagagt

SEQ ID NO: 1331982 - DNA, 16 bp, Homo sapiens
tgtaagccagagtcaa

SEQ ID NO: 1331983 - DNA, 18 bp, Homo sapiens
tgtaagccagagtcaaca

SEQ ID NO: 1331984 - DNA, 17 bp, Homo sapiens
tgtaatttaaaattgtg

SEQ ID NO: 1331985 - DNA, 18 bp, Homo sapiens
tgtaatttaaaattgtga

SEQ ID NO: 1331986 - DNA, 22 bp, Homo sapiens
tgtaatttaaaattgtgatgtg

SEQ ID NO: 1331987 - DNA, 20 bp, Homo sapiens
tgtagtgatttttatgccac

SEQ ID NO: 1331988 - DNA, 13 bp, Homo sapiens
tgtcctcagcccc

SEQ ID NO: 1331989 - DNA, 12 bp, Homo sapiens
tgtgactctttc

SEQ ID NO: 1331990 - DNA, 20 bp, Homo sapiens
tgtgccttgtcacgccagac

SEQ ID NO: 1331991 - DNA, 14 bp, Homo sapiens
tgtgggtctgtgtg

SEQ ID NO: 1331992 - DNA, 16 bp, Homo sapiens
tgtgggtctgtgtgtg

SEQ ID NO: 1331993 - DNA, 23 bp, Homo sapiens
tgtgtaatttaaaattgtgatgt

SEQ ID NO: 1331994 - DNA, 12 bp, Homo sapiens
tgtgtatgtggg

SEQ ID NO: 1331995 - DNA, 13 bp, Homo sapiens
tgtgtatgtgggg

SEQ ID NO: 1331996 - DNA, 16 bp, Homo sapiens
tgtgtgggagtgtgta

SEQ ID NO: 1331997 - DNA, 16 bp, Homo sapiens
tgtgtgtgtgtatgtg

SEQ ID NO: 1331998 - DNA, 13 bp, Homo sapiens
tgtgtttatgtgt

SEQ ID NO: 1331999 - DNA, 15 bp, Homo sapiens
tgtgtttatgtgtgt

SEQ ID NO: 1332000 - DNA, 14 bp, Homo sapiens
tgtttacagaggac

SEQ ID NO: 1332001 - DNA, 21 bp, Homo sapiens
tgtttacagaggacagtattt

SEQ ID NO: 1332002 - DNA, 16 bp, Homo sapiens
tgtttagaagaagtgt

SEQ ID NO: 1332003 - DNA, 13 bp, Homo sapiens
tgtttatgtgtgt

SEQ ID NO: 1332004 - DNA, 13 bp, Homo sapiens
ttaaaattgtgat

SEQ ID NO: 1332005 - DNA, 11 bp, Homo sapiens
ttaaataaatt

SEQ ID NO: 1332006 - DNA, 12 bp, Homo sapiens
ttaactcagtct

SEQ ID NO: 1332007 - DNA, 10 bp, Homo sapiens
ttatgtgtgt

SEQ ID NO: 1332008 - DNA, 21 bp, Homo sapiens
ttcctgaggaagagggactgt

SEQ ID NO: 1332009 - DNA, 11 bp, Homo sapiens
ttctaatgacc

SEQ ID NO: 1332010 - DNA, 16 bp, Homo sapiens
ttctaatgacccagat

SEQ ID NO: 1332011 - DNA, 23 bp, Homo sapiens
ttctaatgacccagatatggaaa

SEQ ID NO: 1332012 - DNA, 12 bp, Homo sapiens
ttctgccaggag

SEQ ID NO: 1332013 - DNA, 13 bp, Homo sapiens
ttctgccaggaga

SEQ ID NO: 1332014 - DNA, 18 bp, Homo sapiens
ttgaaggggcttctaatg

SEQ ID NO: 1332015 - DNA, 19 bp, Homo sapiens
ttgaaggggcttctaatga

SEQ ID NO: 1332016 - DNA, 21 bp, Homo sapiens
ttgaaggggcttctaatgacc

SEQ ID NO: 1332017 - DNA, 16 bp, Homo sapiens
ttggacttgtcccggg

SEQ ID NO: 1332018 - DNA, 14 bp, Homo sapiens
ttgtaagccagagt

SEQ ID NO: 1332019 - DNA, 16 bp, Homo sapiens
ttgtaagccagagtca

SEQ ID NO: 1332020 - DNA, 19 bp, Homo sapiens
ttgtaagccagagtcaaca

SEQ ID NO: 1332021 - DNA, 12 bp, Homo sapiens
ttgtgatgtgtc

SEQ ID NO: 1332022 - DNA, 13 bp, Homo sapiens
ttgtgtgtgggag

SEQ ID NO: 1332023 - DNA, 16 bp, Homo sapiens
ttgtgtgtgggagtgt

SEQ ID NO: 1332024 - DNA, 18 bp, Homo sapiens
ttgtttagaagaagtgtg

SEQ ID NO: 1332025 - DNA, 19 bp, Homo sapiens
tttagaagaagtgtgtcac

SEQ ID NO: 1332026 - DNA, 13 bp, Homo sapiens
tttatgtgtgtgt

SEQ ID NO: 1332027 - DNA, 19 bp, Homo sapiens
tttccaaccggctttgtgg

SEQ ID NO: 1332028 - DNA, 17 bp, Homo sapiens
tttgtaaatttatgtga

SEQ ID NO: 1332029 - DNA, 18 bp, Homo sapiens
tttgtaaggtttttgtag

SEQ ID NO: 1332030 - DNA, 15 bp, Homo sapiens
tttgtagtgattttt

SEQ ID NO: 1332031 - DNA, 22 bp, Homo sapiens
tttgtagtgatttttatgccac

SEQ ID NO: 1332032 - DNA, 15 bp, Homo sapiens
aaaaagggaggggga

SEQ ID NO: 1332033 - DNA, 19 bp, Homo sapiens
aaaattgtaagccagagtc

SEQ ID NO: 1332034 - DNA, 22 bp, Homo sapiens
aaaattgtaagccagagtcaac

SEQ ID NO: 1332035 - DNA, 16 bp, Homo sapiens
aaaattgtgatgtgtc

SEQ ID NO: 1332036 - DNA, 17 bp, Homo sapiens
aaacagaagacaaaatt

SEQ ID NO: 1332037 - DNA, 23 bp, Homo sapiens
aaacagaagacaaaattgtaagc

SEQ ID NO: 1332038 - DNA, 23 bp, Homo sapiens
aaattaccccctcctccagatca

SEQ ID NO: 1332039 - DNA, 20 bp, Homo sapiens
catccagagtccctgcctgg

SEQ ID NO: 1332040 - DNA, 19 bp, Homo sapiens
catcctaccccctgtgcct

SEQ ID NO: 1332041 - DNA, 17 bp, Homo sapiens
catctgtacctctgcct

SEQ ID NO: 1332042 - DNA, 16 bp, Homo sapiens
catgtgactctttcca

SEQ ID NO: 1332043 - DNA, 22 bp, Homo sapiens
cattacctcagtgagaagccag

SEQ ID NO: 1332044 - DNA, 14 bp, Homo sapiens
cattccagaggaag

SEQ ID NO: 1332045 - DNA, 16 bp, Homo sapiens
ccaacactgccagcat

SEQ ID NO: 1332046 - DNA, 18 bp, Homo sapiens
ccagagaaaaagggaggg

SEQ ID NO: 1332047 - DNA, 20 bp, Homo sapiens
ccagatatggaaacagaaga

SEQ ID NO: 1332048 - DNA, 20 bp, Homo sapiens
ccatcatgtttacagaggac

SEQ ID NO: 1332049 - DNA, 17 bp, Homo sapiens
ccatcctaccccctgtg

SEQ ID NO: 1332050 - DNA, 13 bp, Homo sapiens
cccaacacctctt

SEQ ID NO: 1332051 - DNA, 16 bp, Homo sapiens
cccaacactgccagca

SEQ ID NO: 1332052 - DNA, 18 bp, Homo sapiens
cccagaatgcctcctgca

SEQ ID NO: 1332053 - DNA, 21 bp, Homo sapiens
cccagctatggttctctcgca

SEQ ID NO: 1332054 - DNA, 14 bp, Homo sapiens
ccccgacttttgtt

SEQ ID NO: 1332055 - DNA, 15 bp, Homo sapiens
cccctcctccagatc

SEQ ID NO: 1332056 - DNA, 15 bp, Homo sapiens
ccctcctccagatca

SEQ ID NO: 1332057 - DNA, 13 bp, Homo sapiens
ccctgcctggacc

SEQ ID NO: 1332058 - DNA, 18 bp, Homo sapiens
ccctgcctggaccagcct

SEQ ID NO: 1332059 - DNA, 15 bp, Homo sapiens
ccctgtgccttgtca

SEQ ID NO: 1332060 - DNA, 22 bp, Homo sapiens
ccctgtgccttgtcacgccaga

SEQ ID NO: 1332061 - DNA, 20 bp, Homo sapiens
ccgggacacctaggctaggg

SEQ ID NO: 1332062 - DNA, 19 bp, Homo sapiens
ccggggcctgggcaggagg

SEQ ID NO: 1332063 - DNA, 21 bp, Homo sapiens
ccgggggcagtctgagagagg

SEQ ID NO: 1332064 - DNA, 22 bp, Homo sapiens
cctccatcctaccccctgtgcc

SEQ ID NO: 1332065 - DNA, 14 bp, Homo sapiens
cctcctctgcccgg

SEQ ID NO: 1332066 - DNA, 15 bp, Homo sapiens
cctcctctgcccggg

SEQ ID NO: 1332067 - DNA, 21 bp, Homo sapiens
cctctgcccgggagctcagga

SEQ ID NO: 1332068 - DNA, 14 bp, Homo sapiens
cctggaccagcctc

SEQ ID NO: 1332069 - DNA, 14 bp, Homo sapiens
cctgggcaggaggg

SEQ ID NO: 1332070 - DNA, 21 bp, Homo sapiens
cctgtctccctcctctgcccg

SEQ ID NO: 1332071 - DNA, 16 bp, Homo sapiens
ccttaaggctcttttg

SEQ ID NO: 1332072 - DNA, 18 bp, Homo sapiens
ccttaaggctcttttgta

SEQ ID NO: 1332073 - DNA, 14 bp, Homo sapiens
cctttgtcccagaa

SEQ ID NO: 1332074 - DNA, 16 bp, Homo sapiens
cgaagcgttgtcctca

SEQ ID NO: 1332075 - DNA, 17 bp, Homo sapiens
cgaagcgttgtcctcag

SEQ ID NO: 1332076 - DNA, 15 bp, Homo sapiens
cgagatcccaacact

SEQ ID NO: 1332077 - DNA, 23 bp, Homo sapiens
cggctcctcgagatcccaacact

SEQ ID NO: 1332078 - DNA, 22 bp, Homo sapiens
cggctgggaggagggcaggcat

SEQ ID NO: 1332079 - DNA, 17 bp, Homo sapiens
cgggagcctgaccctca

SEQ ID NO: 1332080 - DNA, 19 bp, Homo sapiens
cggggcctgggcaggaggg

SEQ ID NO: 1332081 - DNA, 17 bp, Homo sapiens
cgggggcagtctgagag

SEQ ID NO: 1332082 - DNA, 19 bp, Homo sapiens
cgtcagctgggacaccccg

SEQ ID NO: 1332083 - DNA, 21 bp, Homo sapiens
ctaattctttgacctgttggg

SEQ ID NO: 1332084 - DNA, 13 bp, Homo sapiens
ctaccccctgtgc

SEQ ID NO: 1332085 - DNA, 21 bp, Homo sapiens
ctatggggatagatgtgtgga

SEQ ID NO: 1332086 - DNA, 16 bp, Homo sapiens
ctcagagggtgtcctg

SEQ ID NO: 1332087 - DNA, 17 bp, Homo sapiens
ctcaggaaccgaggcag

SEQ ID NO: 1332088 - DNA, 18 bp, Homo sapiens
ctcaggaaccgaggcagg

SEQ ID NO: 1332089 - DNA, 23 bp, Homo sapiens
ctcaggccgaaggaggagtcagg

SEQ ID NO: 1332090 - DNA, 16 bp, Homo sapiens
ctcatctttcttccaa

SEQ ID NO: 1332091 - DNA, 16 bp, Homo sapiens
ctccactcatgtgact

SEQ ID NO: 1332092 - DNA, 18 bp, Homo sapiens
ctccatcctaccccctgt

SEQ ID NO: 1332093 - DNA, 22 bp, Homo sapiens
ctccatcctaccccctgtgcct

SEQ ID NO: 1332094 - DNA, 21 bp, Homo sapiens
ctcctcgagatcccaacactg

SEQ ID NO: 1332095 - DNA, 22 bp, Homo sapiens
ctcctctgcccgggagctcagg

SEQ ID NO: 1332096 - DNA, 16 bp, Homo sapiens
ctcctgtctccctcct

SEQ ID NO: 1332097 - DNA, 18 bp, Homo sapiens
ctgaggaagagggactgt

SEQ ID NO: 1332098 - DNA, 23 bp, Homo sapiens
ctgaggaagagggactgttcttt

SEQ ID NO: 1332099 - DNA, 23 bp, Homo sapiens
ctgccatcatgtttacagaggac

SEQ ID NO: 1332100 - DNA, 12 bp, Homo sapiens
gatcccaacact

SEQ ID NO: 1332101 - DNA, 16 bp, Homo sapiens
gatcccaacactgcca

SEQ ID NO: 1332102 - DNA, 19 bp, Homo sapiens
gatcccaacactgccagca

SEQ ID NO: 1332103 - DNA, 15 bp, Homo sapiens
gatcccatgagctcc

SEQ ID NO: 1332104 - DNA, 20 bp, Homo sapiens
gatggcaaagaaggagagca

SEQ ID NO: 1332105 - DNA, 21 bp, Homo sapiens
gatgtgtcctgataagctgag

SEQ ID NO: 1332106 - DNA, 20 bp, Homo sapiens
gattgaaggggcttctaatg

SEQ ID NO: 1332107 - DNA, 22 bp, Homo sapiens
gattgaaggggcttctaatgac

SEQ ID NO: 1332108 - DNA, 23 bp, Homo sapiens
gattgcaggagtccctgccatca

SEQ ID NO: 1332109 - DNA, 14 bp, Homo sapiens
gcaccggggcctgg

SEQ ID NO: 1332110 - DNA, 16 bp, Homo sapiens
gcaccggggcctgggc

SEQ ID NO: 1332111 - DNA, 15 bp, Homo sapiens
gcactggggcagggg

SEQ ID NO: 1332112 - DNA, 21 bp, Homo sapiens
gcaggcatcggggagccggga

SEQ ID NO: 1332113 - DNA, 12 bp, Homo sapiens
gccagagtcaac

SEQ ID NO: 1332114 - DNA, 21 bp, Homo sapiens
gccagagtcaacaaattaaat

SEQ ID NO: 1332115 - DNA, 14 bp, Homo sapiens
gccaggatggaatg

SEQ ID NO: 1332116 - DNA, 19 bp, Homo sapiens
gccattctttcccaacacc

SEQ ID NO: 1332117 - DNA, 13 bp, Homo sapiens
gccccgcgtggaa

SEQ ID NO: 1332118 - DNA, 17 bp, Homo sapiens
gcccgggagctcaggaa

SEQ ID NO: 1332119 - DNA, 23 bp, Homo sapiens
gccctggtggtggctcgggaggc

SEQ ID NO: 1332120 - DNA, 21 bp, Homo sapiens
gccgagagtccatcagcctcc

SEQ ID NO: 1332121 - DNA, 17 bp, Homo sapiens
gcctaacctgccgagag

SEQ ID NO: 1332122 - DNA, 19 bp, Homo sapiens
gcctctcattccagaggaa

SEQ ID NO: 1332123 - DNA, 24 bp, Homo sapiens
gcctctccactcatgtgactcttt

SEQ ID NO: 1332124 - DNA, 16 bp, Homo sapiens
gcctggaccagcctct

SEQ ID NO: 1332125 - DNA, 15 bp, Homo sapiens
gccttgtcacgccag

SEQ ID NO: 1332126 - DNA, 16 bp, Homo sapiens
gccttgtcacgccaga

SEQ ID NO: 1332127 - DNA, 17 bp, Homo sapiens
gcgaagcgttgtcctca

SEQ ID NO: 1332128 - DNA, 12 bp, Homo sapiens
gcgcggctggga

SEQ ID NO: 1332129 - DNA, 19 bp, Homo sapiens
gcggctgggaggagggcag

SEQ ID NO: 1332130 - DNA, 21 bp, Homo sapiens
gcgtggaactcgtgtctggca

SEQ ID NO: 1332131 - DNA, 19 bp, Homo sapiens
gctatggggatagatgtgt

SEQ ID NO: 1332132 - DNA, 18 bp, Homo sapiens
gctcagagggtgtcctgc

SEQ ID NO: 1332133 - DNA, 21 bp, Homo sapiens
gctcagagggtgtcctgcacc

SEQ ID NO: 1332134 - DNA, 21 bp, Homo sapiens
gctcaggaaccgaggcaggga

SEQ ID NO: 1332135 - DNA, 15 bp, Homo sapiens
gctccttaaggctct

SEQ ID NO: 1332136 - DNA, 17 bp, Homo sapiens
gctccttaaggctcttt

SEQ ID NO: 1332137 - DNA, 21 bp, Homo sapiens
gctccttaaggctcttttgta

SEQ ID NO: 1332138 - DNA, 14 bp, Homo sapiens
gctgattgtattta

SEQ ID NO: 1332139 - DNA, 13 bp, Homo sapiens
gctgctccccacg

SEQ ID NO: 1332140 - DNA, 17 bp, Homo sapiens
gctgggaggagggcagg

SEQ ID NO: 1332141 - DNA, 19 bp, Homo sapiens
gctgggaggagggcaggca

SEQ ID NO: 1332142 - DNA, 13 bp, Homo sapiens
gcttctaatgacc

SEQ ID NO: 1332143 - DNA, 18 bp, Homo sapiens
gcttctaatgacccagat

SEQ ID NO: 1332144 - DNA, 16 bp, Homo sapiens
gcttctagttctgcca

SEQ ID NO: 1332145 - DNA, 19 bp, Homo sapiens
gcttctagttctgccagga

SEQ ID NO: 1332146 - DNA, 22 bp, Homo sapiens
gctttgtggcactggggcaggg

SEQ ID NO: 1332147 - DNA, 12 bp, Homo sapiens
ggaaacagaaga

SEQ ID NO: 1332148 - DNA, 16 bp, Homo sapiens
ggaaccgaggcaggga

SEQ ID NO: 1332149 - DNA, 20 bp, Homo sapiens
ggaaccgaggcagggaagga

SEQ ID NO: 1332150 - DNA, 20 bp, Homo sapiens
ggaactgctgggcttggcag

SEQ ID NO: 1332151 - DNA, 19 bp, Homo sapiens
ggacagtatttgtggggag

SEQ ID NO: 1332152 - DNA, 22 bp, Homo sapiens
ggagaatgtcagtatgtggaag

SEQ ID NO: 1332153 - DNA, 15 bp, Homo sapiens
ggagagacgggccct

SEQ ID NO: 1332154 - DNA, 16 bp, Homo sapiens
ggagccgggagcctga

SEQ ID NO: 1332155 - DNA, 21 bp, Homo sapiens
ggagctcaggaaccgaggcag

SEQ ID NO: 1332156 - DNA, 11 bp, Homo sapiens
ggagtgtgtaa

SEQ ID NO: 1332157 - DNA, 22 bp, Homo sapiens
ggattgaaggggcttctaatga

SEQ ID NO: 1332158 - DNA, 15 bp, Homo sapiens
ggcactggggcaggg

SEQ ID NO: 1332159 - DNA, 14 bp, Homo sapiens
ggcaggagggaggt

SEQ ID NO: 1332160 - DNA, 15 bp, Homo sapiens
ggcagggctgaggcc

SEQ ID NO: 1332161 - DNA, 22 bp, Homo sapiens
ggcatcggggagccgggagcct

SEQ ID NO: 1332162 - DNA, 18 bp, Homo sapiens
ggccagcaccatctcttt

SEQ ID NO: 1332163 - DNA, 20 bp, Homo sapiens
ggccattctttcccaacacc

SEQ ID NO: 1332164 - DNA, 15 bp, Homo sapiens
ggcctaacctgccga

SEQ ID NO: 1332165 - DNA, 12 bp, Homo sapiens
ctaatgacccag

SEQ ID NO: 1332166 - DNA, 13 bp, Homo sapiens
ctaatgacccaga

SEQ ID NO: 1332167 - DNA, 14 bp, Homo sapiens
ctaatgacccagat

SEQ ID NO: 1332168 - DNA, 15 bp, Homo sapiens
ctagggtggggagag

SEQ ID NO: 1332169 - DNA, 20 bp, Homo sapiens
ctatggggatagatgtgtgg

SEQ ID NO: 1332170 - DNA, 17 bp, Homo sapiens
ctcagccccgcgtggaa

SEQ ID NO: 1332171 - DNA, 19 bp, Homo sapiens
ctcaggaaccgaggcaggg

SEQ ID NO: 1332172 - DNA, 15 bp, Homo sapiens
ctcattccagaggaa

SEQ ID NO: 1332173 - DNA, 17 bp, Homo sapiens
ctcattccagaggaagg

SEQ ID NO: 1332174 - DNA, 22 bp, Homo sapiens
ctccactcatgtgactctttcc

SEQ ID NO: 1332175 - DNA, 20 bp, Homo sapiens
ctccatcctaccccctgtgc

SEQ ID NO: 1332176 - DNA, 17 bp, Homo sapiens
ctccattggtgttgaca

SEQ ID NO: 1332177 - DNA, 13 bp, Homo sapiens
ctccttaaggctc

SEQ ID NO: 1332178 - DNA, 13 bp, Homo sapiens
ctcgagatcccaa

SEQ ID NO: 1332179 - DNA, 19 bp, Homo sapiens
ctctccactcatgtgactc

SEQ ID NO: 1332180 - DNA, 21 bp, Homo sapiens
ctctccactcatgtgactctt

SEQ ID NO: 1332181 - DNA, 17 bp, Homo sapiens
ctctcctgtctccctcc

SEQ ID NO: 1332182 - DNA, 21 bp, Homo sapiens
ctcttggggagtttagggtgg

SEQ ID NO: 1332183 - DNA, 21 bp, Homo sapiens
ctgaagagaagggcagggctg

SEQ ID NO: 1332184 - DNA, 18 bp, Homo sapiens
ctgaccctcatctttctt

SEQ ID NO: 1332185 - DNA, 14 bp, Homo sapiens
ctgagagaggccat

SEQ ID NO: 1332186 - DNA, 21 bp, Homo sapiens
ctgagagaggccattctttcc

SEQ ID NO: 1332187 - DNA, 22 bp, Homo sapiens
ctgagagaggccattctttccc

SEQ ID NO: 1332188 - DNA, 14 bp, Homo sapiens
ctgcaccggggcct

SEQ ID NO: 1332189 - DNA, 20 bp, Homo sapiens
ctgccagcatttcccttcct

SEQ ID NO: 1332190 - DNA, 23 bp, Homo sapiens
ctgccgagagtccatcagcctcc

SEQ ID NO: 1332191 - DNA, 15 bp, Homo sapiens
ctggcacagcctggc

SEQ ID NO: 1332192 - DNA, 23 bp, Homo sapiens
ctggcacagcctggctgtggcct

SEQ ID NO: 1332193 - DNA, 19 bp, Homo sapiens
ctgggaggagggcaggcat

SEQ ID NO: 1332194 - DNA, 17 bp, Homo sapiens
ctggggatgtctctcat

SEQ ID NO: 1332195 - DNA, 21 bp, Homo sapiens
ctgtctccctcctctgcccgg

SEQ ID NO: 1332196 - DNA, 20 bp, Homo sapiens
ctgtgtgtgtgtatgtgggg

SEQ ID NO: 1332197 - DNA, 12 bp, Homo sapiens
cttctaatgacc

SEQ ID NO: 1332198 - DNA, 13 bp, Homo sapiens
cttctaatgaccc

SEQ ID NO: 1332199 - DNA, 17 bp, Homo sapiens
cttctaatgacccagat

SEQ ID NO: 1332200 - DNA, 12 bp, Homo sapiens
ctttggacttgt

SEQ ID NO: 1332201 - DNA, 22 bp, Homo sapiens
gaagacaaaattgtaagccaga

SEQ ID NO: 1332202 - DNA, 23 bp, Homo sapiens
gaagacaaaattgtaagccagag

SEQ ID NO: 1332203 - DNA, 21 bp, Homo sapiens
gaaggatcccatgagctcctt

SEQ ID NO: 1332204 - DNA, 14 bp, Homo sapiens
gaaggggcttctaa

SEQ ID NO: 1332205 - DNA, 17 bp, Homo sapiens
gaagtgtgggtctgtgt

SEQ ID NO: 1332206 - DNA, 18 bp, Homo sapiens
gaagtgtgggtctgtgtg

SEQ ID NO: 1332207 - DNA, 19 bp, Homo sapiens
gaagtgtgggtctgtgtgt

SEQ ID NO: 1332208 - DNA, 17 bp, Homo sapiens
gaataaagaatgaatgg

SEQ ID NO: 1332209 - DNA, 13 bp, Homo sapiens
gaatgtcagtatg

SEQ ID NO: 1332210 - DNA, 15 bp, Homo sapiens
gacaaaattgtaagc

SEQ ID NO: 1332211 - DNA, 20 bp, Homo sapiens
gacccagatatggaaacaga

SEQ ID NO: 1332212 - DNA, 15 bp, Homo sapiens
gaccctcatctttct

SEQ ID NO: 1332213 - DNA, 19 bp, Homo sapiens
gaccctcatctttcttcca

SEQ ID NO: 1332214 - DNA, 15 bp, Homo sapiens
gactatggagctgag

SEQ ID NO: 1332215 - DNA, 18 bp, Homo sapiens
gacttcccacggctcctc

SEQ ID NO: 1332216 - DNA, 18 bp, Homo sapiens
gacttgtcccgggacacc

SEQ ID NO: 1332217 - DNA, 22 bp, Homo sapiens
gagaagccagctttcctcatca

SEQ ID NO: 1332218 - DNA, 16 bp, Homo sapiens
gagacgggccctggtg

SEQ ID NO: 1332219 - DNA, 13 bp, Homo sapiens
gagagacgggccc

SEQ ID NO: 1332220 - DNA, 21 bp, Homo sapiens
gagagaggccattctttccca

SEQ ID NO: 1332221 - DNA, 20 bp, Homo sapiens
gagatcccaacactgccagc

SEQ ID NO: 1332222 - DNA, 20 bp, Homo sapiens
gagctcaggaaccgaggcag

SEQ ID NO: 1332223 - DNA, 23 bp, Homo sapiens
gagctcaggaaccgaggcaggga

SEQ ID NO: 1332224 - DNA, 15 bp, Homo sapiens
gaggatgtctgggcc

SEQ ID NO: 1332225 - DNA, 14 bp, Homo sapiens
gaggcagggaagga

SEQ ID NO: 1332226 - DNA, 14 bp, Homo sapiens
gagggggagagggc

SEQ ID NO: 1332227 - DNA, 14 bp, Homo sapiens
gagtcaacaaatta

SEQ ID NO: 1332228 - DNA, 17 bp, Homo sapiens
gagtccatcagcctcca

SEQ ID NO: 1332229 - DNA, 21 bp, Homo sapiens
gagtccctgcctggaccagcc

SEQ ID NO: 1332230 - DNA, 13 bp, Homo sapiens
gagttggctggga

SEQ ID NO: 1332231 - DNA, 14 bp, Homo sapiens
gagtttagggtggg

SEQ ID NO: 1332232 - DNA, 14 bp, Homo sapiens
gatagatgtgtgga

SEQ ID NO: 1332233 - DNA, 12 bp, Homo sapiens
gatgatgggatt

SEQ ID NO: 1332234 - DNA, 13 bp, Homo sapiens
gatggaatgatgg

SEQ ID NO: 1332235 - DNA, 21 bp, Homo sapiens
gatgggtcagttgtatcagca

SEQ ID NO: 1332236 - DNA, 19 bp, Homo sapiens
gcaccggggcctgggcagg

SEQ ID NO: 1332237 - DNA, 15 bp, Homo sapiens
gcaggagggaggtgc

SEQ ID NO: 1332238 - DNA, 22 bp, Homo sapiens
gcaggcatcggggagccgggag

SEQ ID NO: 1332239 - DNA, 23 bp, Homo sapiens
gcaggcatcggggagccgggagc

SEQ ID NO: 1332240 - DNA, 18 bp, Homo sapiens
gcattatatttgtaaatt

SEQ ID NO: 1332241 - DNA, 21 bp, Homo sapiens
gccagacttcccacggctcct

SEQ ID NO: 1332242 - DNA, 14 bp, Homo sapiens
gccagagtcaacaa

SEQ ID NO: 1332243 - DNA, 23 bp, Homo sapiens
gccagtggctggatctgtgaggg

SEQ ID NO: 1332244 - DNA, 21 bp, Homo sapiens
gccatcatgtttacagaggac

SEQ ID NO: 1332245 - DNA, 12 bp, Homo sapiens
gccattctttcc

SEQ ID NO: 1332246 - DNA, 15 bp, Homo sapiens
gcccgggagctcagg

SEQ ID NO: 1332247 - DNA, 19 bp, Homo sapiens
gcccgggagctcaggaacc

SEQ ID NO: 1332248 - DNA, 23 bp, Homo sapiens
gcctccatcctaccccctgtgcc

SEQ ID NO: 1332249 - DNA, 20 bp, Homo sapiens
gcctctcattccagaggaag

SEQ ID NO: 1332250 - DNA, 21 bp, Homo sapiens
gcctctccactcatgtgactc

SEQ ID NO: 1332251 - DNA, 17 bp, Homo sapiens
gcctgaccctcatcttt

SEQ ID NO: 1332252 - DNA, 17 bp, Homo sapiens
gcctggaccagcctctc

SEQ ID NO: 1332253 - DNA, 16 bp, Homo sapiens
gcctgggcaggaggga

SEQ ID NO: 1332254 - DNA, 18 bp, Homo sapiens
gcctttggacttgtcccg

SEQ ID NO: 1332255 - DNA, 18 bp, Homo sapiens
gcgcggctgggaggaggg

SEQ ID NO: 1332256 - DNA, 14 bp, Homo sapiens
gcggctgggaggag

SEQ ID NO: 1332257 - DNA, 22 bp, Homo sapiens
gcggctgggaggagggcaggca

SEQ ID NO: 1332258 - DNA, 22 bp, Homo sapiens
gctaattctttgacctgttggg

SEQ ID NO: 1332259 - DNA, 21 bp, Homo sapiens
gctatggggatagatgtgtgg

SEQ ID NO: 1332260 - DNA, 19 bp, Homo sapiens
gctcagagggtgtcctgca

SEQ ID NO: 1332261 - DNA, 20 bp, Homo sapiens
gctcaggaaccgaggcaggg

SEQ ID NO: 1332262 - DNA, 18 bp, Homo sapiens
gctcctcgagatcccaac

SEQ ID NO: 1332263 - DNA, 15 bp, Homo sapiens
gctgcctttggactt

SEQ ID NO: 1332264 - DNA, 22 bp, Homo sapiens
gctgctccccacgtcagctggg

SEQ ID NO: 1332265 - DNA, 20 bp, Homo sapiens
gctgggaataagtgccagga

SEQ ID NO: 1332266 - DNA, 21 bp, Homo sapiens
gctgggaggagggcaggcatc

SEQ ID NO: 1332267 - DNA, 20 bp, Homo sapiens
gctgtagacatttgctatga

SEQ ID NO: 1332268 - DNA, 19 bp, Homo sapiens
gctgtggcctaacctgccg

SEQ ID NO: 1332269 - DNA, 20 bp, Homo sapiens
gctgtggcctaacctgccga

SEQ ID NO: 1332270 - DNA, 22 bp, Homo sapiens
gcttttcctcaaagggagagag

SEQ ID NO: 1332271 - DNA, 21 bp, Homo sapiens
ggaagtgtgggtctgtgtgtg

SEQ ID NO: 1332272 - DNA, 16 bp, Homo sapiens
ggacaccccgactttt

SEQ ID NO: 1332273 - DNA, 16 bp, Homo sapiens
ggacacctaggctagg

SEQ ID NO: 1332274 - DNA, 18 bp, Homo sapiens
ggacagtatttgtgggga

SEQ ID NO: 1332275 - DNA, 12 bp, Homo sapiens
ggaccagcctct

SEQ ID NO: 1332276 - DNA, 21 bp, Homo sapiens
aagtcactggccagtggctgg

SEQ ID NO: 1332277 - DNA, 13 bp, Homo sapiens
aatgacccagata

SEQ ID NO: 1332278 - DNA, 15 bp, Homo sapiens
aattaaataaattac

SEQ ID NO: 1332279 - DNA, 18 bp, Homo sapiens
aattaccccctcctccag

SEQ ID NO: 1332280 - DNA, 15 bp, Homo sapiens
aattgtaagccagag

SEQ ID NO: 1332281 - DNA, 19 bp, Homo sapiens
aattgtaagccagagtcaa

SEQ ID NO: 1332282 - DNA, 20 bp, Homo sapiens
aattgtaagccagagtcaac

SEQ ID NO: 1332283 - DNA, 14 bp, Homo sapiens
aattgtgatgtgtc

SEQ ID NO: 1332284 - DNA, 15 bp, Homo sapiens
aattgtgatgtgtcc

SEQ ID NO: 1332285 - DNA, 16 bp, Homo sapiens
acaaaattgtaagcca

SEQ ID NO: 1332286 - DNA, 19 bp, Homo sapiens
acaaaattgtaagccagag

SEQ ID NO: 1332287 - DNA, 23 bp, Homo sapiens
acaaaattgtaagccagagtcaa

SEQ ID NO: 1332288 - DNA, 17 bp, Homo sapiens
acaaattaaataaatta

SEQ ID NO: 1332289 - DNA, 20 bp, Homo sapiens
acacctaggctagggtgggg

SEQ ID NO: 1332290 - DNA, 16 bp, Homo sapiens
acacctcttggggagt

SEQ ID NO: 1332291 - DNA, 21 bp, Homo sapiens
acagacactcccacttggcat

SEQ ID NO: 1332292 - DNA, 12 bp, Homo sapiens
acagcctggctg

SEQ ID NO: 1332293 - DNA, 14 bp, Homo sapiens
accatctctttacc

SEQ ID NO: 1332294 - DNA, 22 bp, Homo sapiens
acccagctatggttctctcgca

SEQ ID NO: 1332295 - DNA, 12 bp, Homo sapiens
accccgactttt

SEQ ID NO: 1332296 - DNA, 13 bp, Homo sapiens
accctcatctttc

SEQ ID NO: 1332297 - DNA, 14 bp, Homo sapiens
accctcatctttct

SEQ ID NO: 1332298 - DNA, 13 bp, Homo sapiens
accggggcctggg

SEQ ID NO: 1332299 - DNA, 19 bp, Homo sapiens
accggggcctgggcaggag

SEQ ID NO: 1332300 - DNA, 17 bp, Homo sapiens
acctaggctagggtggg

SEQ ID NO: 1332301 - DNA, 22 bp, Homo sapiens
ccactcatgtgactctttccaa

SEQ ID NO: 1332302 - DNA, 12 bp, Homo sapiens
ccagagtcaaca

SEQ ID NO: 1332303 - DNA, 17 bp, Homo sapiens
ccagagtcaacaaatta

SEQ ID NO: 1332304 - DNA, 23 bp, Homo sapiens
ccagagtcaacaaattaaataaa

SEQ ID NO: 1332305 - DNA, 16 bp, Homo sapiens
ccagagtccctgcctg

SEQ ID NO: 1332306 - DNA, 17 bp, Homo sapiens
ccagagtccctgcctgg

SEQ ID NO: 1332307 - DNA, 18 bp, Homo sapiens
ccagagtccctgcctgga

SEQ ID NO: 1332308 - DNA, 22 bp, Homo sapiens
ccagagtccctgcctggaccag

SEQ ID NO: 1332309 - DNA, 14 bp, Homo sapiens
ccagatatggaaac

SEQ ID NO: 1332310 - DNA, 16 bp, Homo sapiens
ccagatatggaaacag

SEQ ID NO: 1332311 - DNA, 18 bp, Homo sapiens
ccagatatggaaacagaa

SEQ ID NO: 1332312 - DNA, 13 bp, Homo sapiens
ccatcagcctcca

SEQ ID NO: 1332313 - DNA, 22 bp, Homo sapiens
ccatcatgtttacagaggacag

SEQ ID NO: 1332314 - DNA, 18 bp, Homo sapiens
ccatcctaccccctgtgc

SEQ ID NO: 1332315 - DNA, 12 bp, Homo sapiens
ccattctttccc

SEQ ID NO: 1332316 - DNA, 14 bp, Homo sapiens
ccattctttcccaa

SEQ ID NO: 1332317 - DNA, 20 bp, Homo sapiens
ccattctttcccaacacctc

SEQ ID NO: 1332318 - DNA, 13 bp, Homo sapiens
ccattggtgttga

SEQ ID NO: 1332319 - DNA, 15 bp, Homo sapiens
cccacgtcagctggg

SEQ ID NO: 1332320 - DNA, 14 bp, Homo sapiens
ccctcctccagatc

SEQ ID NO: 1332321 - DNA, 15 bp, Homo sapiens
ccgaggcagggaagg

SEQ ID NO: 1332322 - DNA, 15 bp, Homo sapiens
ccggggcctgggcag

SEQ ID NO: 1332323 - DNA, 22 bp, Homo sapiens
ccgggtcatctgtacctctgcc

SEQ ID NO: 1332324 - DNA, 23 bp, Homo sapiens
ccgtggctgtggcatccagagtc

SEQ ID NO: 1332325 - DNA, 17 bp, Homo sapiens
cctccatcctaccccct

SEQ ID NO: 1332326 - DNA, 23 bp, Homo sapiens
cctccatcctaccccctgtgcct

SEQ ID NO: 1332327 - DNA, 18 bp, Homo sapiens
cctctccactcatgtgac

SEQ ID NO: 1332328 - DNA, 23 bp, Homo sapiens
cctctccactcatgtgactcttt

SEQ ID NO: 1332329 - DNA, 22 bp, Homo sapiens
cctcttggggagtttagggtgg

SEQ ID NO: 1332330 - DNA, 19 bp, Homo sapiens
cctgaagagaagggcaggg

SEQ ID NO: 1332331 - DNA, 19 bp, Homo sapiens
cctgaccctcatctttctt

SEQ ID NO: 1332332 - DNA, 14 bp, Homo sapiens
cctgccgagagtcc

SEQ ID NO: 1332333 - DNA, 19 bp, Homo sapiens
cctgcctggaccagcctct

SEQ ID NO: 1332334 - DNA, 18 bp, Homo sapiens
cctggtggtggctcggga

SEQ ID NO: 1332335 - DNA, 17 bp, Homo sapiens
cctgtgccttttgccat

SEQ ID NO: 1332336 - DNA, 13 bp, Homo sapiens
ccttaaggctctt

SEQ ID NO: 1332337 - DNA, 15 bp, Homo sapiens
ccttgtcacgccaga

SEQ ID NO: 1332338 - DNA, 15 bp, Homo sapiens
cgaagcgttgtcctc

SEQ ID NO: 1332339 - DNA, 21 bp, Homo sapiens
cgaagcgttgtcctcagcccc

SEQ ID NO: 1332340 - DNA, 21 bp, Homo sapiens
cgattgcaggagtccctgcca

SEQ ID NO: 1332341 - DNA, 11 bp, Homo sapiens
cgcggctggga

SEQ ID NO: 1332342 - DNA, 12 bp, Homo sapiens
cgcggctgggag

SEQ ID NO: 1332343 - DNA, 18 bp, Homo sapiens
cggctgggaggagggcag

SEQ ID NO: 1332344 - DNA, 22 bp, Homo sapiens
cgggtcatctgtacctctgcct

SEQ ID NO: 1332345 - DNA, 23 bp, Homo sapiens
cgtggctgtggcatccagagtcc

SEQ ID NO: 1332346 - DNA, 13 bp, Homo sapiens
cgtgtctggcaca

SEQ ID NO: 1332347 - DNA, 12 bp, Homo sapiens
ctaacctgccga

SEQ ID NO: 1332348 - DNA, 21 bp, Homo sapiens
ctaacctgccgagagtccatc

SEQ ID NO: 1332349 - DNA, 22 bp, Homo sapiens
ctactctggaggtttgtttaga

SEQ ID NO: 1332350 - DNA, 15 bp, Homo sapiens
ctaggctagggtggg

SEQ ID NO: 1332351 - DNA, 13 bp, Homo sapiens
ctagttctgccag

SEQ ID NO: 1332352 - DNA, 14 bp, Homo sapiens
ctagttctgccagg

SEQ ID NO: 1332353 - DNA, 19 bp, Homo sapiens
ctatggggatagatgtgtg

SEQ ID NO: 1332354 - DNA, 20 bp, Homo sapiens
ctcaggcctgactctcagca

SEQ ID NO: 1332355 - DNA, 23 bp, Homo sapiens
ctcatgatagaaggctatgggga

SEQ ID NO: 1332356 - DNA, 14 bp, Homo sapiens
ctcatgtgactctt

SEQ ID NO: 1332357 - DNA, 20 bp, Homo sapiens
ctccccacgtcagctgggac

SEQ ID NO: 1332358 - DNA, 13 bp, Homo sapiens
ctccctcctctgc

SEQ ID NO: 1332359 - DNA, 14 bp, Homo sapiens
ctccctcctctgcc

SEQ ID NO: 1332360 - DNA, 17 bp, Homo sapiens
ctcctcgagatcccaac

SEQ ID NO: 1332361 - DNA, 24 bp, Homo sapiens
ctcctcgagatcccaacactgcca

SEQ ID NO: 1332362 - DNA, 24 bp, Homo sapiens
ctcctctgcccgggagctcaggaa

SEQ ID NO: 1332363 - DNA, 22 bp, Homo sapiens
ctccttaaggctcttttgtaag

SEQ ID NO: 1332364 - DNA, 15 bp, Homo sapiens
ctcgtgtctggcaca

SEQ ID NO: 1332365 - DNA, 15 bp, Homo sapiens
ctctcctgtctccct

SEQ ID NO: 1332366 - DNA, 14 bp, Homo sapiens
ctctgcccgggagc

SEQ ID NO: 1332367 - DNA, 20 bp, Homo sapiens
ctctgcccgggagctcagga

SEQ ID NO: 1332368 - DNA, 12 bp, Homo sapiens
ctgagaggccac

SEQ ID NO: 1332369 - DNA, 12 bp, Homo sapiens
ctgagcaggtgt

SEQ ID NO: 1332370 - DNA, 16 bp, Homo sapiens
ctgccaggagacaggt

SEQ ID NO: 1332371 - DNA, 19 bp, Homo sapiens
ctgcccgggagctcaggaa

SEQ ID NO: 1332372 - DNA, 22 bp, Homo sapiens
ctgccgagagtccatcagcctc

SEQ ID NO: 1332373 - DNA, 14 bp, Homo sapiens
ctggcacagcctgg

SEQ ID NO: 1332374 - DNA, 23 bp, Homo sapiens
ctggccctatgcttccggcctcc

SEQ ID NO: 1332375 - DNA, 13 bp, Homo sapiens
ctggccctgtgcc

SEQ ID NO: 1332376 - DNA, 18 bp, Homo sapiens
ctggctgtggcctaacct

SEQ ID NO: 1332377 - DNA, 18 bp, Homo sapiens
ctgggaataagtgccagg

SEQ ID NO: 1332378 - DNA, 22 bp, Homo sapiens
ctggtggtggctcgggaggcga

SEQ ID NO: 1332379 - DNA, 19 bp, Homo sapiens
ctgtgaggggctctctcat

SEQ ID NO: 1332380 - DNA, 18 bp, Homo sapiens
ctgtggcctaacctgccg

SEQ ID NO: 1332381 - DNA, 14 bp, Homo sapiens
ctgtgtgtgtgtat

SEQ ID NO: 1332382 - DNA, 16 bp, Homo sapiens
ctgtgtgtttatgtgt

SEQ ID NO: 1332383 - DNA, 18 bp, Homo sapiens
ctgtgtgtttatgtgtgt

SEQ ID NO: 1332384 - DNA, 20 bp, Homo sapiens
ctgtgtgtttatgtgtgtgt

SEQ ID NO: 1332385 - DNA, 15 bp, Homo sapiens
cttaggccagcacca

SEQ ID NO: 1332386 - DNA, 15 bp, Homo sapiens
cttcctctcctgtct

SEQ ID NO: 1332387 - DNA, 21 bp, Homo sapiens
cttggggagtttagggtgggg

SEQ ID NO: 1332388 - DNA, 16 bp, Homo sapiens
cttgtcacgccagact

SEQ ID NO: 1332389 - DNA, 23 bp, Homo sapiens
cttgtcacgccagacttcccacg

SEQ ID NO: 1332390 - DNA, 17 bp, Homo sapiens
ctttcccaacacctctt

SEQ ID NO: 1332391 - DNA, 19 bp, Homo sapiens
ctttcttccaaacaggctc

SEQ ID NO: 1332392 - DNA, 22 bp, Homo sapiens
ctttcttccaaacaggctcaga

SEQ ID NO: 1332393 - DNA, 17 bp, Homo sapiens
agtgtgggtctgtgtgt

SEQ ID NO: 1332394 - DNA, 19 bp, Homo sapiens
agtgtgggtctgtgtgtgt

SEQ ID NO: 1332395 - DNA, 23 bp, Homo sapiens
agtgtgggtctgtgtgtgtgtat

SEQ ID NO: 1332396 - DNA, 9 bp, Homo sapiens
agtgtgtaa

SEQ ID NO: 1332397 - DNA, 12 bp, Homo sapiens
agttctgccagg

SEQ ID NO: 1332398 - DNA, 13 bp, Homo sapiens
agttctgccagga

SEQ ID NO: 1332399 - DNA, 23 bp, Homo sapiens
agttgtatcagcacgtgtggcct

SEQ ID NO: 1332400 - DNA, 14 bp, Homo sapiens
agtttagggtgggg

SEQ ID NO: 1332401 - DNA, 20 bp, Homo sapiens
ataaattaccccctcctcca

SEQ ID NO: 1332402 - DNA, 12 bp, Homo sapiens
atagatgtgtgg

SEQ ID NO: 1332403 - DNA, 14 bp, Homo sapiens
atcagcctgtgcca

SEQ ID NO: 1332404 - DNA, 20 bp, Homo sapiens
atcattatcagcctgtgcca

SEQ ID NO: 1332405 - DNA, 20 bp, Homo sapiens
atccatggggctgattgtat

SEQ ID NO: 1332406 - DNA, 16 bp, Homo sapiens
atcggggagccgggag

SEQ ID NO: 1332407 - DNA, 20 bp, Homo sapiens
atctgagaggccacagtgca

SEQ ID NO: 1332408 - DNA, 19 bp, Homo sapiens
atgacccagatatggaaac

SEQ ID NO: 1332409 - DNA, 14 bp, Homo sapiens
atggaaacagaaga

SEQ ID NO: 1332410 - DNA, 20 bp, Homo sapiens
atggggatagatgtgtggac

SEQ ID NO: 1332411 - DNA, 13 bp, Homo sapiens
atgtcagtatgtg

SEQ ID NO: 1332412 - DNA, 15 bp, Homo sapiens
atgtggaagtgtggg

SEQ ID NO: 1332413 - DNA, 16 bp, Homo sapiens
atgtggaagtgtgggt

SEQ ID NO: 1332414 - DNA, 18 bp, Homo sapiens
atgtgggggtctgtgtgt

SEQ ID NO: 1332415 - DNA, 10 bp, Homo sapiens
atgtgtgtgt

SEQ ID NO: 1332416 - DNA, 21 bp, Homo sapiens
attaccccctcctccagatca

SEQ ID NO: 1332417 - DNA, 19 bp, Homo sapiens
attctttcccaacacctct

SEQ ID NO: 1332418 - DNA, 21 bp, Homo sapiens
attgaaggggcttctaatgac

SEQ ID NO: 1332419 - DNA, 15 bp, Homo sapiens
attgtaagccagagt

SEQ ID NO: 1332420 - DNA, 16 bp, Homo sapiens
attgtaagccagagtc

SEQ ID NO: 1332421 - DNA, 19 bp, Homo sapiens
attgtaagccagagtcaac

SEQ ID NO: 1332422 - DNA, 20 bp, Homo sapiens
attgtaagccagagtcaaca

SEQ ID NO: 1332423 - DNA, 20 bp, Homo sapiens
atttaaaattgtgatgtgtc

SEQ ID NO: 1332424 - DNA, 16 bp, Homo sapiens
atttcccttccttcct

SEQ ID NO: 1332425 - DNA, 20 bp, Homo sapiens
atttcccttccttcctctcc

SEQ ID NO: 1332426 - DNA, 12 bp, Homo sapiens
atttttctcatg

SEQ ID NO: 1332427 - DNA, 17 bp, Homo sapiens
caaaattgtaagccaga

SEQ ID NO: 1332428 - DNA, 18 bp, Homo sapiens
caaaattgtaagccagag

SEQ ID NO: 1332429 - DNA, 20 bp, Homo sapiens
caaaattgtaagccagagtc

SEQ ID NO: 1332430 - DNA, 23 bp, Homo sapiens
caaaattgtaagccagagtcaac

SEQ ID NO: 1332431 - DNA, 13 bp, Homo sapiens
caaattaaataaa

SEQ ID NO: 1332432 - DNA, 17 bp, Homo sapiens
caaattaaataaattac

SEQ ID NO: 1332433 - DNA, 19 bp, Homo sapiens
caacaaattaaataaatta

SEQ ID NO: 1332434 - DNA, 12 bp, Homo sapiens
caacactgccag

SEQ ID NO: 1332435 - DNA, 22 bp, Homo sapiens
caaccggctttgtggcactggg

SEQ ID NO: 1332436 - DNA, 16 bp, Homo sapiens
caccccgacttttgtt

SEQ ID NO: 1332437 - DNA, 22 bp, Homo sapiens
cactcatgtgactctttccaac

SEQ ID NO: 1332438 - DNA, 18 bp, Homo sapiens
cactgccagcatttccct

SEQ ID NO: 1332439 - DNA, 19 bp, Homo sapiens
cactggggcaggggccggg

SEQ ID NO: 1332440 - DNA, 22 bp, Homo sapiens
cagaagacaaaattgtaagcca

SEQ ID NO: 1332441 - DNA, 17 bp, Homo sapiens
cagagggtgtcctgcac

SEQ ID NO: 1332442 - DNA, 22 bp, Homo sapiens
cagagtcaacaaattaaataaa

SEQ ID NO: 1332443 - DNA, 13 bp, Homo sapiens
cagatatggaaac

SEQ ID NO: 1332444 - DNA, 14 bp, Homo sapiens
cagatatggaaaca

SEQ ID NO: 1332445 - DNA, 18 bp, Homo sapiens
cagatatggaaacagaag

SEQ ID NO: 1332446 - DNA, 20 bp, Homo sapiens
cagatatggaaacagaagac

SEQ ID NO: 1332447 - DNA, 23 bp, Homo sapiens
cagatcattatcagcctgtgcca

SEQ ID NO: 1332448 - DNA, 17 bp, Homo sapiens
cagcacgtgtggcctgt

SEQ ID NO: 1332449 - DNA, 18 bp, Homo sapiens
cagcctccatcctacccc

SEQ ID NO: 1332450 - DNA, 24 bp, Homo sapiens
cagcctctccactcatgtgactct

SEQ ID NO: 1332451 - DNA, 15 bp, Homo sapiens
caggagtccctgcca

SEQ ID NO: 1332452 - DNA, 21 bp, Homo sapiens
caggagtccctgccatcatgt

SEQ ID NO: 1332453 - DNA, 15 bp, Homo sapiens
caggcctgactctca

SEQ ID NO: 1332454 - DNA, 15 bp, Homo sapiens
caggctcagagggtg

SEQ ID NO: 1332455 - DNA, 12 bp, Homo sapiens
caggtgttcttc

SEQ ID NO: 1332456 - DNA, 17 bp, Homo sapiens
cagtctgagagaggcca

SEQ ID NO: 1332457 - DNA, 18 bp, Homo sapiens
cataatcacaacccttca

SEQ ID NO: 1332458 - DNA, 19 bp, Homo sapiens
catcatgtttacagaggac

SEQ ID NO: 1332459 - DNA, 18 bp, Homo sapiens
catccagagtccctgcct

SEQ ID NO: 1332460 - DNA, 21 bp, Homo sapiens
catccagagtccctgcctgga

SEQ ID NO: 1332461 - DNA, 19 bp, Homo sapiens
catccatggggctgattgt

SEQ ID NO: 1332462 - DNA, 18 bp, Homo sapiens
catcctaccccctgtgcc

SEQ ID NO: 1332463 - DNA, 19 bp, Homo sapiens
catgagttggctgggaata

SEQ ID NO: 1332464 - DNA, 19 bp, Homo sapiens
cattgtccctgaagagaag

SEQ ID NO: 1332465 - DNA, 14 bp, Homo sapiens
ccaacactgccagc

SEQ ID NO: 1332466 - DNA, 19 bp, Homo sapiens
ccaagccttggctctaccc

SEQ ID NO: 1332467 - DNA, 21 bp, Homo sapiens
ccacgtcagctgggacacccc

SEQ ID NO: 1332468 - DNA, 19 bp, Homo sapiens
ccactcatgtgactctttc

SEQ ID NO: 1332469 - DNA, 19 bp, Homo sapiens
ccagagtccctgcctggac

SEQ ID NO: 1332470 - DNA, 21 bp, Homo sapiens
ccatgagctccttaaggctct

SEQ ID NO: 1332471 - DNA, 14 bp, Homo sapiens
cccaacactgccag

SEQ ID NO: 1332472 - DNA, 19 bp, Homo sapiens
cccagatatggaaacagaa

SEQ ID NO: 1332473 - DNA, 15 bp, Homo sapiens
cccatgagctcctta

SEQ ID NO: 1332474 - DNA, 21 bp, Homo sapiens
ccccgcgtggaactcgtgtct

SEQ ID NO: 1332475 - DNA, 14 bp, Homo sapiens
cccctgtgccttgt

SEQ ID NO: 1332476 - DNA, 14 bp, Homo sapiens
cccgggagctcagg

SEQ ID NO: 1332477 - DNA, 22 bp, Homo sapiens
ccgacttttgtttaccagagaa

SEQ ID NO: 1332478 - DNA, 21 bp, Homo sapiens
ccgagagtccatcagcctcca

SEQ ID NO: 1332479 - DNA, 17 bp, Homo sapiens
ccggctttgtggcactg

SEQ ID NO: 1332480 - DNA, 19 bp, Homo sapiens
ccggctttgtggcactggg

SEQ ID NO: 1332481 - DNA, 19 bp, Homo sapiens
ccgggacacctaggctagg

SEQ ID NO: 1332482 - DNA, 13 bp, Homo sapiens
ccgggagctcagg

SEQ ID NO: 1332483 - DNA, 15 bp, Homo sapiens
ccgggagctcaggaa

SEQ ID NO: 1332484 - DNA, 20 bp, Homo sapiens
ccggggcctgggcaggaggg

SEQ ID NO: 1332485 - DNA, 12 bp, Homo sapiens
cctaacctgccg

SEQ ID NO: 1332486 - DNA, 13 bp, Homo sapiens
cctaacctgccga

SEQ ID NO: 1332487 - DNA, 22 bp, Homo sapiens
cctctgcccgggagctcaggaa

SEQ ID NO: 1332488 - DNA, 18 bp, Homo sapiens
cctgaccctcatctttct

SEQ ID NO: 1332489 - DNA, 22 bp, Homo sapiens
cctgaccctcatctttcttcca

SEQ ID NO: 1332490 - DNA, 17 bp, Homo sapiens
cctgcaccggggcctgg

SEQ ID NO: 1332491 - DNA, 18 bp, Homo sapiens
cctgccatcatgtttaca

SEQ ID NO: 1332492 - DNA, 20 bp, Homo sapiens
cctgccatcatgtttacaga

SEQ ID NO: 1332493 - DNA, 22 bp, Homo sapiens
cctgccgagagtccatcagcct

SEQ ID NO: 1332494 - DNA, 23 bp, Homo sapiens
cctgccgagagtccatcagcctc

SEQ ID NO: 1332495 - DNA, 21 bp, Homo sapiens
cctggtggtggctcgggaggc

SEQ ID NO: 1332496 - DNA, 13 bp, Homo sapiens
cgagatcccaaca

SEQ ID NO: 1332497 - DNA, 21 bp, Homo sapiens
cgagatcccaacactgccagc

SEQ ID NO: 1332498 - DNA, 23 bp, Homo sapiens
cgattgcaggagtccctgccatc

SEQ ID NO: 1332499 - DNA, 19 bp, Homo sapiens
cgggacacctaggctaggg

SEQ ID NO: 1332500 - DNA, 16 bp, Homo sapiens
cgggagctcaggaacc

SEQ ID NO: 1332501 - DNA, 17 bp, Homo sapiens
cggggcctgggcaggag

SEQ ID NO: 1332502 - DNA, 18 bp, Homo sapiens
cgggggcagtctgagaga

SEQ ID NO: 1332503 - DNA, 21 bp, Homo sapiens
cgtgtctggcacagcctggct

SEQ ID NO: 1332504 - DNA, 19 bp, Homo sapiens
ggagacaggttagctgctc

SEQ ID NO: 1332505 - DNA, 17 bp, Homo sapiens
ggagagacgggccctgg

SEQ ID NO: 1332506 - DNA, 20 bp, Homo sapiens
ggaggagggcaggcatcggg

SEQ ID NO: 1332507 - DNA, 13 bp, Homo sapiens
ggagggcaggcat

SEQ ID NO: 1332508 - DNA, 14 bp, Homo sapiens
ggagggcaggcatc

SEQ ID NO: 1332509 - DNA, 14 bp, Homo sapiens
ggatagatgtgtgg

SEQ ID NO: 1332510 - DNA, 17 bp, Homo sapiens
ggatcccatgagctcct

SEQ ID NO: 1332511 - DNA, 12 bp, Homo sapiens
ggcacagcctgg

SEQ ID NO: 1332512 - DNA, 12 bp, Homo sapiens
ggcaggggccgg

SEQ ID NO: 1332513 - DNA, 17 bp, Homo sapiens
ggccctgtgccttggtg

SEQ ID NO: 1332514 - DNA, 16 bp, Homo sapiens
ggcctaacctgccgag

SEQ ID NO: 1332515 - DNA, 15 bp, Homo sapiens
ggcctgggcaggagg

SEQ ID NO: 1332516 - DNA, 17 bp, Homo sapiens
ggcctgggcaggaggga

SEQ ID NO: 1332517 - DNA, 22 bp, Homo sapiens
ggcgaagcgttgtcctcagccc

SEQ ID NO: 1332518 - DNA, 21 bp, Homo sapiens
ggctatggggatagatgtgtg

SEQ ID NO: 1332519 - DNA, 20 bp, Homo sapiens
ggctcagagggtgtcctgca

SEQ ID NO: 1332520 - DNA, 17 bp, Homo sapiens
ggctggatctgtgaggg

SEQ ID NO: 1332521 - DNA, 21 bp, Homo sapiens
ggctgtggcatccagagtccc

SEQ ID NO: 1332522 - DNA, 14 bp, Homo sapiens
ggcttctaatgacc

SEQ ID NO: 1332523 - DNA, 20 bp, Homo sapiens
gggacaccaagccttggctc

SEQ ID NO: 1332524 - DNA, 23 bp, Homo sapiens
gggagctcaggaaccgaggcagg

SEQ ID NO: 1332525 - DNA, 12 bp, Homo sapiens
gggaggagggca

SEQ ID NO: 1332526 - DNA, 14 bp, Homo sapiens
gggagggggagagg

SEQ ID NO: 1332527 - DNA, 11 bp, Homo sapiens
gggagtgtgta

SEQ ID NO: 1332528 - DNA, 22 bp, Homo sapiens
gggccctggtggtggctcggga

SEQ ID NO: 1332529 - DNA, 13 bp, Homo sapiens
gggcctgggcagg

SEQ ID NO: 1332530 - DNA, 13 bp, Homo sapiens
gggcttctaatga

SEQ ID NO: 1332531 - DNA, 20 bp, Homo sapiens
gggcttctaatgacccagat

SEQ ID NO: 1332532 - DNA, 13 bp, Homo sapiens
ggggatagatgtg

SEQ ID NO: 1332533 - DNA, 12 bp, Homo sapiens
ggggcctgggca

SEQ ID NO: 1332534 - DNA, 15 bp, Homo sapiens
ggggcctgggcagga

SEQ ID NO: 1332535 - DNA, 16 bp, Homo sapiens
ggggcgcggctgggag

SEQ ID NO: 1332536 - DNA, 20 bp, Homo sapiens
ggggcttctaatgacccaga

SEQ ID NO: 1332537 - DNA, 21 bp, Homo sapiens
ggggcttctaatgacccagat

SEQ ID NO: 1332538 - DNA, 18 bp, Homo sapiens
gggggcgcggctgggagg

SEQ ID NO: 1332539 - DNA, 18 bp, Homo sapiens
gggtggggagagacgggc

SEQ ID NO: 1332540 - DNA, 16 bp, Homo sapiens
ggtaggaactgctggg

SEQ ID NO: 1332541 - DNA, 18 bp, Homo sapiens
ggtaggaactgctgggct

SEQ ID NO: 1332542 - DNA, 15 bp, Homo sapiens
ggtggtggctcggga

SEQ ID NO: 1332543 - DNA, 19 bp, Homo sapiens
ggttgggagaatgtcagta

SEQ ID NO: 1332544 - DNA, 11 bp, Homo sapiens
gtaagccagag

SEQ ID NO: 1332545 - DNA, 14 bp, Homo sapiens
gtaagccagagtca

SEQ ID NO: 1332546 - DNA, 14 bp, Homo sapiens
gtaggttgggagaa

SEQ ID NO: 1332547 - DNA, 15 bp, Homo sapiens
gtatgtggaagtgtg

SEQ ID NO: 1332548 - DNA, 16 bp, Homo sapiens
gtatgtggaagtgtgg

SEQ ID NO: 1332549 - DNA, 15 bp, Homo sapiens
gtcaacaaattaaat

SEQ ID NO: 1332550 - DNA, 18 bp, Homo sapiens
gtcaacaaattaaataaa

SEQ ID NO: 1332551 - DNA, 14 bp, Homo sapiens
gtcacgccagactt

SEQ ID NO: 1332552 - DNA, 22 bp, Homo sapiens
gtcagctgggacaccccgactt

SEQ ID NO: 1332553 - DNA, 20 bp, Homo sapiens
gtcccagaatgcctcctgca

SEQ ID NO: 1332554 - DNA, 13 bp, Homo sapiens
gtccctgcctgga

SEQ ID NO: 1332555 - DNA, 20 bp, Homo sapiens
gtccctgcctggaccagcct

SEQ ID NO: 1332556 - DNA, 12 bp, Homo sapiens
gtcctcagcccc

SEQ ID NO: 1332557 - DNA, 20 bp, Homo sapiens
gtcctgcaccggggcctggg

SEQ ID NO: 1332558 - DNA, 14 bp, Homo sapiens
gtctgagagaggcc

SEQ ID NO: 1332559 - DNA, 19 bp, Homo sapiens
gtctggcacagcctggctg

SEQ ID NO: 1332560 - DNA, 21 bp, Homo sapiens
gtctgtgtgtttatgtgtgtg

SEQ ID NO: 1332561 - DNA, 22 bp, Homo sapiens
gtctgtgtgtttatgtgtgtgt

SEQ ID NO: 1332562 - DNA, 10 bp, Homo sapiens
gtgatgtgtc

SEQ ID NO: 1332563 - DNA, 17 bp, Homo sapiens
gtgatttttatgccacc

SEQ ID NO: 1332564 - DNA, 20 bp, Homo sapiens
gtgcttctagttctgccagg

SEQ ID NO: 1332565 - DNA, 15 bp, Homo sapiens
gtggaagtgtgggtc

SEQ ID NO: 1332566 - DNA, 19 bp, Homo sapiens
gtggaagtgtgggtctgtg

SEQ ID NO: 1332567 - DNA, 18 bp, Homo sapiens
gtggcactggggcagggg

SEQ ID NO: 1332568 - DNA, 23 bp, Homo sapiens
gtggggggggggcgcggctggga

SEQ ID NO: 1332569 - DNA, 23 bp, Homo sapiens
gtgtaatttaaaattgtgatgtg

SEQ ID NO: 1332570 - DNA, 21 bp, Homo sapiens
gtgtatgtgggggtctgtgtg

SEQ ID NO: 1332571 - DNA, 14 bp, Homo sapiens
gtgtgtaatttaaa

SEQ ID NO: 1332572 - DNA, 20 bp, Homo sapiens
gtgtgtcacccttaggccag

SEQ ID NO: 1332573 - DNA, 17 bp, Homo sapiens
gtgtgttgtgtgtggga

SEQ ID NO: 1332574 - DNA, 16 bp, Homo sapiens
gtgtgtttatgtgtgt

SEQ ID NO: 1332575 - DNA, 12 bp, Homo sapiens
gttctgccagga

SEQ ID NO: 1332576 - DNA, 22 bp, Homo sapiens
gttgtgtgtgggagtgtgtaat

SEQ ID NO: 1332577 - DNA, 16 bp, Homo sapiens
gtttatgtgtgtgtgt

SEQ ID NO: 1332578 - DNA, 13 bp, Homo sapiens
taagccagagtca

SEQ ID NO: 1332579 - DNA, 22 bp, Homo sapiens
tacttacctgttttctcctccc

SEQ ID NO: 1332580 - DNA, 14 bp, Homo sapiens
tagaagaagtgtgt

SEQ ID NO: 1332581 - DNA, 21 bp, Homo sapiens
tagacatttgctatgagctgg

SEQ ID NO: 1332582 - DNA, 16 bp, Homo sapiens
taggctagggtgggga

SEQ ID NO: 1332583 - DNA, 21 bp, Homo sapiens
tagtgatttttatgccacctg

SEQ ID NO: 1332584 - DNA, 22 bp, Homo sapiens
tagtgatttttatgccacctga

SEQ ID NO: 1332585 - DNA, 12 bp, Homo sapiens
tatggaaacaga

SEQ ID NO: 1332586 - DNA, 12 bp, Homo sapiens
tatgtggaagtg

SEQ ID NO: 1332587 - DNA, 20 bp, Homo sapiens
tatgtgggggtctgtgtgtt

SEQ ID NO: 1332588 - DNA, 12 bp, Homo sapiens
tattcccatgag

SEQ ID NO: 1332589 - DNA, 17 bp, Homo sapiens
tatttgtaaatttatgt

SEQ ID NO: 1332590 - DNA, 22 bp, Homo sapiens
tatttgtaaatttatgtgatgg

SEQ ID NO: 1332591 - DNA, 17 bp, Homo sapiens
tcaacaaattaaataaa

SEQ ID NO: 1332592 - DNA, 23 bp, Homo sapiens
tcagcctccatcctaccccctgt

SEQ ID NO: 1332593 - DNA, 12 bp, Homo sapiens
tcagtatgtgga

SEQ ID NO: 1332594 - DNA, 16 bp, Homo sapiens
tcagtatgtggaagtg

SEQ ID NO: 1332595 - DNA, 22 bp, Homo sapiens
tcagtctttaatctgagaggcc

SEQ ID NO: 1332596 - DNA, 17 bp, Homo sapiens
tcatctttcttccaaac

SEQ ID NO: 1332597 - DNA, 14 bp, Homo sapiens
tcatgtgactcttt

SEQ ID NO: 1332598 - DNA, 14 bp, Homo sapiens
tccaaacaggctca

SEQ ID NO: 1332599 - DNA, 21 bp, Homo sapiens
tccagagtccctgcctggacc

SEQ ID NO: 1332600 - DNA, 16 bp, Homo sapiens
tccatcctaccccctg

SEQ ID NO: 1332601 - DNA, 20 bp, Homo sapiens
tccatcctaccccctgtgcc

SEQ ID NO: 1332602 - DNA, 11 bp, Homo sapiens
tcctcagcccc

SEQ ID NO: 1332603 - DNA, 22 bp, Homo sapiens
tcctctgcccgggagctcagga

SEQ ID NO: 1332604 - DNA, 16 bp, Homo sapiens
tccttaaggctctttt

SEQ ID NO: 1332605 - DNA, 15 bp, Homo sapiens
tctacctcttggctg

SEQ ID NO: 1332606 - DNA, 15 bp, Homo sapiens
tctagttctgccagg

SEQ ID NO: 1332607 - DNA, 20 bp, Homo sapiens
tctgagagaggccattcttt

SEQ ID NO: 1332608 - DNA, 13 bp, Homo sapiens
tctgtgtgtgtgt

SEQ ID NO: 1332609 - DNA, 21 bp, Homo sapiens
tctgtgtgtgtgtatgtgggg

SEQ ID NO: 1332610 - DNA, 22 bp, Homo sapiens
tcttcattacctcagtgagaag

SEQ ID NO: 1332611 - DNA, 13 bp, Homo sapiens
tctttcttccaaa

SEQ ID NO: 1332612 - DNA, 16 bp, Homo sapiens
tgaaggggcttctaat

SEQ ID NO: 1332613 - DNA, 18 bp, Homo sapiens
tgaaggggcttctaatga

SEQ ID NO: 1332614 - DNA, 17 bp, Homo sapiens
tgacatacatccaacat

SEQ ID NO: 1332615 - DNA, 18 bp, Homo sapiens
tgacccagatatggaaac

SEQ ID NO: 1332616 - DNA, 20 bp, Homo sapiens
cactgcaacttctacctccg

SEQ ID NO: 1332617 - DNA, 23 bp, Homo sapiens
cacttttaacaaaaaaggaaaat

SEQ ID NO: 1332618 - DNA, 16 bp, Homo sapiens
cagggctgaggcctct

SEQ ID NO: 1332619 - DNA, 12 bp, Homo sapiens
caggtgttcttc

SEQ ID NO: 1332620 - DNA, 12 bp, Homo sapiens
cagtatgtggaa

SEQ ID NO: 1332621 - DNA, 15 bp, Homo sapiens
catacctggccctgt

SEQ ID NO: 1332622 - DNA, 19 bp, Homo sapiens
catcatgtttacagaggac

SEQ ID NO: 1332623 - DNA, 19 bp, Homo sapiens
catccatggggctgattgt

SEQ ID NO: 1332624 - DNA, 23 bp, Homo sapiens
cattatttcaaccgcttgccata

SEQ ID NO: 1332625 - DNA, 13 bp, Homo sapiens
cattcagtactta

SEQ ID NO: 1332626 - DNA, 19 bp, Homo sapiens
cattgtccctgaagagaag

SEQ ID NO: 1332627 - DNA, 17 bp, Homo sapiens
catttgttcattaaacg

SEQ ID NO: 1332628 - DNA, 17 bp, Homo sapiens
ccaactgccagaacatg

SEQ ID NO: 1332629 - DNA, 14 bp, Homo sapiens
ccaattcctcattt

SEQ ID NO: 1332630 - DNA, 22 bp, Homo sapiens
ccatcatgtttacagaggacag

SEQ ID NO: 1332631 - DNA, 18 bp, Homo sapiens
cccagaatgcctcctgca

SEQ ID NO: 1332632 - DNA, 17 bp, Homo sapiens
cctgtgccttttgccat

SEQ ID NO: 1332633 - DNA, 19 bp, Homo sapiens
cgtccacagagtataaata

SEQ ID NO: 1332634 - DNA, 22 bp, Homo sapiens
ctaattctttgacctgttggga

SEQ ID NO: 1332635 - DNA, 21 bp, Homo sapiens
ctatgaattgctaattctgag

SEQ ID NO: 1332636 - DNA, 14 bp, Homo sapiens
ctattgtagagcca

SEQ ID NO: 1332637 - DNA, 17 bp, Homo sapiens
ctgaaatagagtgaatt

SEQ ID NO: 1332638 - DNA, 17 bp, Homo sapiens
ctgctttcgaataaagt

SEQ ID NO: 1332639 - DNA, 21 bp, Homo sapiens
ctggccagtggctggatctgt

SEQ ID NO: 1332640 - DNA, 23 bp, Homo sapiens
ctggccctatgcttccggcctcc

SEQ ID NO: 1332641 - DNA, 13 bp, Homo sapiens
ctggccctgtgcc

SEQ ID NO: 1332642 - DNA, 16 bp, Homo sapiens
ctggggatgtctctca

SEQ ID NO: 1332643 - DNA, 17 bp, Homo sapiens
ctggggatgtctctcat

SEQ ID NO: 1332644 - DNA, 18 bp, Homo sapiens
ctgtgtgtgtgtatgtgg

SEQ ID NO: 1332645 - DNA, 19 bp, Homo sapiens
cttagctgaacaatgaatg

SEQ ID NO: 1332646 - DNA, 18 bp, Homo sapiens
cttattggcagctctact

SEQ ID NO: 1332647 - DNA, 13 bp, Homo sapiens
cttgctttttcaa

SEQ ID NO: 1332648 - DNA, 18 bp, Homo sapiens
ctttcgaataaagtgaat

SEQ ID NO: 1332649 - DNA, 19 bp, Homo sapiens
cttttggcatgaaagtgcg

SEQ ID NO: 1332650 - DNA, 14 bp, Homo sapiens
cttttgtcccagaa

SEQ ID NO: 1332651 - DNA, 16 bp, Homo sapiens
gaaatagagtgaatta

SEQ ID NO: 1332652 - DNA, 17 bp, Homo sapiens
gaactgctgggcttggc

SEQ ID NO: 1332653 - DNA, 19 bp, Homo sapiens
gaagtgtgggtctgtgtgt

SEQ ID NO: 1332654 - DNA, 16 bp, Homo sapiens
gaatgtcagtatgtgg

SEQ ID NO: 1332655 - DNA, 19 bp, Homo sapiens
gaatgtcagtatgtggaag

SEQ ID NO: 1332656 - DNA, 12 bp, Homo sapiens
gactaactaaaa

SEQ ID NO: 1332657 - DNA, 15 bp, Homo sapiens
gactatggagctgag

SEQ ID NO: 1332658 - DNA, 15 bp, Homo sapiens
gagggaatttaacca

SEQ ID NO: 1332659 - DNA, 22 bp, Homo sapiens
gaggtttgtttagaagaagtgt

SEQ ID NO: 1332660 - DNA, 13 bp, Homo sapiens
gagtgtgtaattt

SEQ ID NO: 1332661 - DNA, 22 bp, Homo sapiens
gagtgtgtaatttaaaattgtg

SEQ ID NO: 1332662 - DNA, 15 bp, Homo sapiens
gagttatattaaaga

SEQ ID NO: 1332663 - DNA, 13 bp, Homo sapiens
gagttggctggga

SEQ ID NO: 1332664 - DNA, 15 bp, Homo sapiens
gatacagaatgaatc

SEQ ID NO: 1332665 - DNA, 14 bp, Homo sapiens
gatagatgtgtgga

SEQ ID NO: 1332666 - DNA, 23 bp, Homo sapiens
gattgcaggagtccctgccatca

SEQ ID NO: 1332667 - DNA, 21 bp, Homo sapiens
gcacttttaacaaaaaaggaa

SEQ ID NO: 1332668 - DNA, 14 bp, Homo sapiens
gccaggatggaatg

SEQ ID NO: 1332669 - DNA, 21 bp, Homo sapiens
gccatcatgtttacagaggac

SEQ ID NO: 1332670 - DNA, 19 bp, Homo sapiens
gcccaggctggagtgcagt

SEQ ID NO: 1332671 - DNA, 20 bp, Homo sapiens
gcccaggctggagtgcagtg

SEQ ID NO: 1332672 - DNA, 17 bp, Homo sapiens
gctatgagctggggatg

SEQ ID NO: 1332673 - DNA, 19 bp, Homo sapiens
gctatggggatagatgtgt

SEQ ID NO: 1332674 - DNA, 16 bp, Homo sapiens
gctgaacaatgaatgc

SEQ ID NO: 1332675 - DNA, 14 bp, Homo sapiens
gctgattgtattta

SEQ ID NO: 1332676 - DNA, 14 bp, Homo sapiens
gctgccttgccatg

SEQ ID NO: 1332677 - DNA, 21 bp, Homo sapiens
gctgctttcgaataaagtgaa

SEQ ID NO: 1332678 - DNA, 20 bp, Homo sapiens
gctgggaataagtgccagga

SEQ ID NO: 1332679 - DNA, 15 bp, Homo sapiens
ggaactgctgggctt

SEQ ID NO: 1332680 - DNA, 14 bp, Homo sapiens
ggacatcatgaagc

SEQ ID NO: 1332681 - DNA, 13 bp, Homo sapiens
ggactccagttca

SEQ ID NO: 1332682 - DNA, 11 bp, Homo sapiens
ggagtgtgtaa

SEQ ID NO: 1332683 - DNA, 22 bp, Homo sapiens
ggagtgtgtaatttaaaattgt

SEQ ID NO: 1332684 - DNA, 15 bp, Homo sapiens
ggatagatgtgtgga

SEQ ID NO: 1332685 - DNA, 11 bp, Homo sapiens
ggcatgaaagt

SEQ ID NO: 1332686 - DNA, 19 bp, Homo sapiens
ggccagtggctggatctgt

SEQ ID NO: 1332687 - DNA, 19 bp, Homo sapiens
gggagaatgtcagtatgtg

SEQ ID NO: 1332688 - DNA, 11 bp, Homo sapiens
gggagtgtgta

SEQ ID NO: 1332689 - DNA, 21 bp, Homo sapiens
gggtcatctgtacctctgcct

SEQ ID NO: 1332690 - DNA, 17 bp, Homo sapiens
gggtgttaaggcagtga

SEQ ID NO: 1332691 - DNA, 16 bp, Homo sapiens
gtaaatttatgtgatg

SEQ ID NO: 1332692 - DNA, 18 bp, Homo sapiens
gtactcttgctttttcaa

SEQ ID NO: 1332693 - DNA, 19 bp, Homo sapiens
gtatcgctgccttgccatg

SEQ ID NO: 1332694 - DNA, 15 bp, Homo sapiens
gtatgtggaagtgtg

SEQ ID NO: 1332695 - DNA, 18 bp, Homo sapiens
gtatgtggaagtgtgggt

SEQ ID NO: 1332696 - DNA, 19 bp, Homo sapiens
gtatgtgggggtctgtgtg

SEQ ID NO: 1332697 - DNA, 20 bp, Homo sapiens
gtatgtgggggtctgtgtgt

SEQ ID NO: 1332698 - DNA, 16 bp, Homo sapiens
gtccctgaagagaagg

SEQ ID NO: 1332699 - DNA, 22 bp, Homo sapiens
gtctgtgtgtttatgtgtgtgt

SEQ ID NO: 1332700 - DNA, 18 bp, Homo sapiens
gtgaatacattttgcaca

SEQ ID NO: 1332701 - DNA, 21 bp, Homo sapiens
gtgactatggagctgagcagg

SEQ ID NO: 1332702 - DNA, 10 bp, Homo sapiens
gtgatgtgtc

SEQ ID NO: 1332703 - DNA, 19 bp, Homo sapiens
gtggaagtgtgggtctgtg

SEQ ID NO: 1332704 - DNA, 14 bp, Homo sapiens
gtgggggtctgtgt

SEQ ID NO: 1332705 - DNA, 16 bp, Homo sapiens
gtgggggtctgtgtgt

SEQ ID NO: 1332706 - DNA, 17 bp, Homo sapiens
gtgtagttaattttatt

SEQ ID NO: 1332707 - DNA, 15 bp, Homo sapiens
gtgtgtatgtggggg

SEQ ID NO: 1332708 - DNA, 14 bp, Homo sapiens
gtgtgtgtatgtgg

SEQ ID NO: 1332709 - DNA, 14 bp, Homo sapiens
gtgtgttgtgtgtg

SEQ ID NO: 1332710 - DNA, 17 bp, Homo sapiens
gtgtgttgtgtgtggga

SEQ ID NO: 1332711 - DNA, 14 bp, Homo sapiens
gtgtgtttatgtgt

SEQ ID NO: 1332712 - DNA, 15 bp, Homo sapiens
gtgttgtgtgtggga

SEQ ID NO: 1332713 - DNA, 18 bp, Homo sapiens
gttcattaaacgtcattc

SEQ ID NO: 1332714 - DNA, 14 bp, Homo sapiens
gttgggagaatgtc

SEQ ID NO: 1332715 - DNA, 20 bp, Homo sapiens
taatttaaaattgtgatgtg

SEQ ID NO: 1332716 - DNA, 13 bp, Homo sapiens
tacagaatgaatc

SEQ ID NO: 1332717 - DNA, 18 bp, Homo sapiens
tacagaggacagtatttg

SEQ ID NO: 1332718 - DNA, 21 bp, Homo sapiens
tacattttgcacaaagtaagc

SEQ ID NO: 1332719 - DNA, 11 bp, Homo sapiens
tagatgtgtgg

SEQ ID NO: 1332720 - DNA, 19 bp, Homo sapiens
tatggggatagatgtgtgg

SEQ ID NO: 1332721 - DNA, 17 bp, Homo sapiens
tatttgtaaatttatgt

SEQ ID NO: 1332722 - DNA, 16 bp, Homo sapiens
tcaaccgcttgccata

SEQ ID NO: 1332723 - DNA, 15 bp, Homo sapiens
tcaggccgaaggagg

SEQ ID NO: 1332724 - DNA, 14 bp, Homo sapiens
tcagtatgtggaag

SEQ ID NO: 1332725 - DNA, 14 bp, Homo sapiens
tcattccagaggaa

SEQ ID NO: 1332726 - DNA, 21 bp, Homo sapiens
tccactgaaatagagtgaatt

SEQ ID NO: 1332727 - DNA, 22 bp, Homo sapiens
tcctcatttgttcattaaacgt

SEQ ID NO: 1332728 - DNA, 16 bp, Homo sapiens
tcgctgccttgccatg

SEQ ID NO: 1332729 - DNA, 15 bp, Homo sapiens
tctacctcttggctg

SEQ ID NO: 1332730 - DNA, 16 bp, Homo sapiens
tctcattccagaggaa

SEQ ID NO: 1332731 - DNA, 21 bp, Homo sapiens
tctgtgtgtgtgtatgtgggg

SEQ ID NO: 1332732 - DNA, 15 bp, Homo sapiens
tctgtgtgtttatgt

SEQ ID NO: 1332733 - DNA, 19 bp, Homo sapiens
tctgtgtgtttatgtgtgt

SEQ ID NO: 1332734 - DNA, 20 bp, Homo sapiens
tctgtgtgtttatgtgtgtg

SEQ ID NO: 1332735 - DNA, 17 bp, Homo sapiens
tgaattgctaattctga

SEQ ID NO: 1332736 - DNA, 18 bp, Homo sapiens
tgaattgctaattctgag

SEQ ID NO: 1332737 - DNA, 16 bp, Homo sapiens
tgacctcacttctggc

SEQ ID NO: 1332738 - DNA, 17 bp, Homo sapiens
tgaggaagagggactgt

SEQ ID NO: 1332739 - DNA, 18 bp, Homo sapiens
tgagtgacctcacttctg

SEQ ID NO: 1332740 - DNA, 19 bp, Homo sapiens
tgagtgacctcacttctgg

SEQ ID NO: 1332741 - DNA, 14 bp, Homo sapiens
tgagttggctggga

SEQ ID NO: 1332742 - DNA, 16 bp, Homo sapiens
tgagttggctgggaat

SEQ ID NO: 1332743 - DNA, 21 bp, Homo sapiens
tgcattatatttgtaaattta

SEQ ID NO: 1332744 - DNA, 17 bp, Homo sapiens
tgccagagccttaataa

SEQ ID NO: 1332745 - DNA, 18 bp, Homo sapiens
tgccaggatggaatgatg

SEQ ID NO: 1332746 - DNA, 16 bp, Homo sapiens
tgccttggtgtgctgt

SEQ ID NO: 1332747 - DNA, 19 bp, Homo sapiens
tgctatgagctggggatgt

SEQ ID NO: 1332748 - DNA, 21 bp, Homo sapiens
tggaagtgtgggtctgtgtgt

SEQ ID NO: 1332749 - DNA, 19 bp, Homo sapiens
tgggagaatgtcagtatgt

SEQ ID NO: 1332750 - DNA, 22 bp, Homo sapiens
tgggagaatgtcagtatgtgga

SEQ ID NO: 1332751 - DNA, 22 bp, Homo sapiens
tgggagtgaggatgtctgggcc

SEQ ID NO: 1332752 - DNA, 13 bp, Homo sapiens
tgggagtgtgtaa

SEQ ID NO: 1332753 - DNA, 18 bp, Homo sapiens
tggggatagatgtgtgga

SEQ ID NO: 1332754 - DNA, 14 bp, Homo sapiens
tgggggtctgtgtg

SEQ ID NO: 1332755 - DNA, 18 bp, Homo sapiens
tgtaatttaaaattgtga

SEQ ID NO: 1332756 - DNA, 20 bp, Homo sapiens
tgtaatttaaaattgtgatg

SEQ ID NO: 1332757 - DNA, 14 bp, Homo sapiens
tgtacctctgcctc

SEQ ID NO: 1332758 - DNA, 18 bp, Homo sapiens
tgtcagtatgtggaagtg

SEQ ID NO: 1332759 - DNA, 19 bp, Homo sapiens
tgtcagtatgtggaagtgt

SEQ ID NO: 1332760 - DNA, 20 bp, Homo sapiens
tgtcagtatgtggaagtgtg

SEQ ID NO: 1332761 - DNA, 22 bp, Homo sapiens
tgtcagtatgtggaagtgtggg

SEQ ID NO: 1332762 - DNA, 15 bp, Homo sapiens
tgtgggagtgtgtaa

SEQ ID NO: 1332763 - DNA, 14 bp, Homo sapiens
tgtgggtctgtgtg

SEQ ID NO: 1332764 - DNA, 20 bp, Homo sapiens
tgtgggtctgtgtgtgtgta

SEQ ID NO: 1332765 - DNA, 18 bp, Homo sapiens
tgtgtaatttaaaattgt

SEQ ID NO: 1332766 - DNA, 23 bp, Homo sapiens
tgtgtaatttaaaattgtgatgt

SEQ ID NO: 1332767 - DNA, 14 bp, Homo sapiens
tgtgtatgtggggg

SEQ ID NO: 1332768 - DNA, 12 bp, Homo sapiens
tgtgtgtgggag

SEQ ID NO: 1332769 - DNA, 18 bp, Homo sapiens
tgtgtgttgtgtgtggga

SEQ ID NO: 1332770 - DNA, 23 bp, Homo sapiens
tgtgttgtgtgtgggagtgtgta

SEQ ID NO: 1332771 - DNA, 18 bp, Homo sapiens
tgttgggagtgaggatgt

SEQ ID NO: 1332772 - DNA, 19 bp, Homo sapiens
tgtttagaagaagtgtgtc

SEQ ID NO: 1332773 - DNA, 18 bp, Homo sapiens
ttaaaattgtgatgtgtc

SEQ ID NO: 1332774 - DNA, 16 bp, Homo sapiens
ttaacctgaattattc

SEQ ID NO: 1332775 - DNA, 14 bp, Homo sapiens
ttaaggcagtgact

SEQ ID NO: 1332776 - DNA, 15 bp, Homo sapiens
ttagaagaagtgtgt

SEQ ID NO: 1332777 - DNA, 18 bp, Homo sapiens
ttcaaccgcttgccatat

SEQ ID NO: 1332778 - DNA, 18 bp, Homo sapiens
ttcatgatgaattacttc

SEQ ID NO: 1332779 - DNA, 13 bp, Homo sapiens
ttcctcatttgtt

SEQ ID NO: 1332780 - DNA, 22 bp, Homo sapiens
ttccttaaaatgtgagtgacct

SEQ ID NO: 1332781 - DNA, 19 bp, Homo sapiens
ttgtactcttgctttttca

SEQ ID NO: 1332782 - DNA, 12 bp, Homo sapiens
ttgtgatgtgtc

SEQ ID NO: 1332783 - DNA, 10 bp, Homo sapiens
ttgtgtgtgg

SEQ ID NO: 1332784 - DNA, 15 bp, Homo sapiens
ttgtttagaagaagt

SEQ ID NO: 1332785 - DNA, 23 bp, Homo sapiens
tttaaaatgccaagcaagggaca

SEQ ID NO: 1332786 - DNA, 16 bp, Homo sapiens
tttaaaattgtgatgt

SEQ ID NO: 1332787 - DNA, 19 bp, Homo sapiens
tttaacaaaaaaggaaaat

SEQ ID NO: 1332788 - DNA, 16 bp, Homo sapiens
tttaccattaaaaagt

SEQ ID NO: 1332789 - DNA, 16 bp, Homo sapiens
tttcgaataaagtgaa

SEQ ID NO: 1332790 - DNA, 17 bp, Homo sapiens
tttcgaataaagtgaat

SEQ ID NO: 1332791 - DNA, 14 bp, Homo sapiens
tttggcatgaaagt

SEQ ID NO: 1332792 - DNA, 17 bp, Homo sapiens
tttgtaaatttatgtga

SEQ ID NO: 1332793 - DNA, 20 bp, Homo sapiens
ttttaacaaaaaaggaaaat

SEQ ID NO: 1332794 - DNA, 21 bp, Homo sapiens
ttttatttttctcatgatgag

SEQ ID NO: 1332795 - DNA, 15 bp, Homo sapiens
atgtggaagtgtggg

SEQ ID NO: 1332796 - DNA, 17 bp, Homo sapiens
atgtgggggtctgtgtg

SEQ ID NO: 1332797 - DNA, 18 bp, Homo sapiens
atgtgggggtctgtgtgt

SEQ ID NO: 1332798 - DNA, 21 bp, Homo sapiens
attccactgaaatagagtgaa

SEQ ID NO: 1332799 - DNA, 13 bp, Homo sapiens
attctgagggaat

SEQ ID NO: 1332800 - DNA, 20 bp, Homo sapiens
attctgagggaatttaacca

SEQ ID NO: 1332801 - DNA, 21 bp, Homo sapiens
attgctaattctgagggaatt

SEQ ID NO: 1332802 - DNA, 15 bp, Homo sapiens
attgtgatgtgtcct

SEQ ID NO: 1332803 - DNA, 19 bp, Homo sapiens
atttaaaattgtgatgtgt

SEQ ID NO: 1332804 - DNA, 12 bp, Homo sapiens
atttttctcatg

SEQ ID NO: 1332805 - DNA, 15 bp, Homo sapiens
caagggacagaaaag

SEQ ID NO: 1332806 - DNA, 21 bp, Homo sapiens
caattcctcatttgttcatta

SEQ ID NO: 1332807 - DNA, 22 bp, Homo sapiens
caattcctcatttgttcattaa

SEQ ID NO: 1332808 - DNA, 14 bp, Homo sapiens
cacccatgccatag

SEQ ID NO: 1332809 - DNA, 19 bp, Homo sapiens
cactgtttaactgggagtg

SEQ ID NO: 1332810 - DNA, 23 bp, Homo sapiens
cagaaatgtatggcatgtgtagt

SEQ ID NO: 1332811 - DNA, 11 bp, Homo sapiens
cagaatgaatc

SEQ ID NO: 1332812 - DNA, 21 bp, Homo sapiens
caggagtccctgccatcatgt

SEQ ID NO: 1332813 - DNA, 12 bp, Homo sapiens
caggccagaaaa

SEQ ID NO: 1332814 - DNA, 17 bp, Homo sapiens
catctgtacctctgcct

SEQ ID NO: 1332815 - DNA, 19 bp, Homo sapiens
catgagttggctgggaata

SEQ ID NO: 1332816 - DNA, 13 bp, Homo sapiens
cattccagaggaa

SEQ ID NO: 1332817 - DNA, 14 bp, Homo sapiens
cattccagaggaag

SEQ ID NO: 1332818 - DNA, 13 bp, Homo sapiens
catttgagtgtct

SEQ ID NO: 1332819 - DNA, 19 bp, Homo sapiens
ccaagccttggctctaccc

SEQ ID NO: 1332820 - DNA, 16 bp, Homo sapiens
ccacaccctcactgct

SEQ ID NO: 1332821 - DNA, 22 bp, Homo sapiens
ccagaacatggattccactgaa

SEQ ID NO: 1332822 - DNA, 15 bp, Homo sapiens
ccagagccttaataa

SEQ ID NO: 1332823 - DNA, 21 bp, Homo sapiens
cccagctatggttctctcgca

SEQ ID NO: 1332824 - DNA, 18 bp, Homo sapiens
cctctcattccagaggaa

SEQ ID NO: 1332825 - DNA, 18 bp, Homo sapiens
cctgccatcatgtttaca

SEQ ID NO: 1332826 - DNA, 23 bp, Homo sapiens
cgattgcaggagtccctgccatc

SEQ ID NO: 1332827 - DNA, 15 bp, Homo sapiens
cgggtcatctgtacc

SEQ ID NO: 1332828 - DNA, 22 bp, Homo sapiens
ctaaatgtggacatcatgaagc

SEQ ID NO: 1332829 - DNA, 21 bp, Homo sapiens
ctactgataacgtattttgat

SEQ ID NO: 1332830 - DNA, 23 bp, Homo sapiens
ctcaggccgaaggaggagtcagg

SEQ ID NO: 1332831 - DNA, 20 bp, Homo sapiens
ctcaggcctgactctcagca

SEQ ID NO: 1332832 - DNA, 17 bp, Homo sapiens
ctcattccagaggaagg

SEQ ID NO: 1332833 - DNA, 18 bp, Homo sapiens
ctgaggaagagggactgt

SEQ ID NO: 1332834 - DNA, 22 bp, Homo sapiens
ctgccatcatgtttacagagga

SEQ ID NO: 1332835 - DNA, 23 bp, Homo sapiens
ctgccatcatgtttacagaggac

SEQ ID NO: 1332836 - DNA, 13 bp, Homo sapiens
ctgccttgccatg

SEQ ID NO: 1332837 - DNA, 19 bp, Homo sapiens
ctgtgaggggctctctcat

SEQ ID NO: 1332838 - DNA, 16 bp, Homo sapiens
ctgtgtgtgtgtatgt

SEQ ID NO: 1332839 - DNA, 20 bp, Homo sapiens
ctgtgtgtgtgtatgtgggg

SEQ ID NO: 1332840 - DNA, 16 bp, Homo sapiens
ctgtgtgtttatgtgt

SEQ ID NO: 1332841 - DNA, 19 bp, Homo sapiens
cttgaaaacctcatttacc

SEQ ID NO: 1332842 - DNA, 22 bp, Homo sapiens
cttgaaaacctcatttaccata

SEQ ID NO: 1332843 - DNA, 19 bp, Homo sapiens
gaaaacctcatttaccata

SEQ ID NO: 1332844 - DNA, 13 bp, Homo sapiens
gaactattagagc

SEQ ID NO: 1332845 - DNA, 20 bp, Homo sapiens
gaactgctgggcttggcagc

SEQ ID NO: 1332846 - DNA, 24 bp, Homo sapiens
gaagtgtgggtctgtgtgtgtgta

SEQ ID NO: 1332847 - DNA, 14 bp, Homo sapiens
gaataaagtgaata

SEQ ID NO: 1332848 - DNA, 18 bp, Homo sapiens
gaatacattttgcacaaa

SEQ ID NO: 1332849 - DNA, 18 bp, Homo sapiens
gaatgtcagtatgtggaa

SEQ ID NO: 1332850 - DNA, 22 bp, Homo sapiens
gaggacagtatttgtggggagg

SEQ ID NO: 1332851 - DNA, 14 bp, Homo sapiens
gagtccctgccatc

SEQ ID NO: 1332852 - DNA, 24 bp, Homo sapiens
gagtgacctcacttctggcactgt

SEQ ID NO: 1332853 - DNA, 21 bp, Homo sapiens
gagtgtgtaatttaaaattgt

SEQ ID NO: 1332854 - DNA, 12 bp, Homo sapiens
gatacagaatga

SEQ ID NO: 1332855 - DNA, 22 bp, Homo sapiens
gatagatgtgtggacacattgg

SEQ ID NO: 1332856 - DNA, 15 bp, Homo sapiens
gatgggtcagttgta

SEQ ID NO: 1332857 - DNA, 21 bp, Homo sapiens
gatgtgtcctgataagctgag

SEQ ID NO: 1332858 - DNA, 15 bp, Homo sapiens
gcacttttaacaaaa

SEQ ID NO: 1332859 - DNA, 20 bp, Homo sapiens
gcctctcattccagaggaag

SEQ ID NO: 1332860 - DNA, 21 bp, Homo sapiens
gctatggggatagatgtgtgg

SEQ ID NO: 1332861 - DNA, 20 bp, Homo sapiens
gctgtagacatttgctatga

SEQ ID NO: 1332862 - DNA, 22 bp, Homo sapiens
gcttttcctcaaagggagagag

SEQ ID NO: 1332863 - DNA, 14 bp, Homo sapiens
ggaactgctgggct

SEQ ID NO: 1332864 - DNA, 20 bp, Homo sapiens
ggaactgctgggcttggcag

SEQ ID NO: 1332865 - DNA, 23 bp, Homo sapiens
ggaagggacaccaagccttggct

SEQ ID NO: 1332866 - DNA, 12 bp, Homo sapiens
ggaagtgtgggt

SEQ ID NO: 1332867 - DNA, 22 bp, Homo sapiens
ggacagaaaagaaagctgcttt

SEQ ID NO: 1332868 - DNA, 22 bp, Homo sapiens
ggagaatgtcagtatgtggaag

SEQ ID NO: 1332869 - DNA, 12 bp, Homo sapiens
ggagggatttgg

SEQ ID NO: 1332870 - DNA, 12 bp, Homo sapiens
ggagtgcagtgg

SEQ ID NO: 1332871 - DNA, 13 bp, Homo sapiens
ggatagatgtgtg

SEQ ID NO: 1332872 - DNA, 14 bp, Homo sapiens
ggatagatgtgtgg

SEQ ID NO: 1332873 - DNA, 13 bp, Homo sapiens
ggatgtctgggcc

SEQ ID NO: 1332874 - DNA, 18 bp, Homo sapiens
ggccagcaccatctcttt

SEQ ID NO: 1332875 - DNA, 12 bp, Homo sapiens
ggccctgtgcct

SEQ ID NO: 1332876 - DNA, 17 bp, Homo sapiens
ggccctgtgccttggtg

SEQ ID NO: 1332877 - DNA, 20 bp, Homo sapiens
ggctggagtgcagtggtgcg

SEQ ID NO: 1332878 - DNA, 20 bp, Homo sapiens
gggacaccaagccttggctc

SEQ ID NO: 1332879 - DNA, 16 bp, Homo sapiens
ggtaggaactgctggg

SEQ ID NO: 1332880 - DNA, 11 bp, Homo sapiens
ggtctgtgtgt

SEQ ID NO: 1332881 - DNA, 20 bp, Homo sapiens
ggtctgtgtgtgtgtatgtg

SEQ ID NO: 1332882 - DNA, 22 bp, Homo sapiens
ggtttgtttagaagaagtgtgt

SEQ ID NO: 1332883 - DNA, 22 bp, Homo sapiens
gtacttacatctttgtttacca

SEQ ID NO: 1332884 - DNA, 21 bp, Homo sapiens
gtatgtggaagtgtgggtctg

SEQ ID NO: 1332885 - DNA, 11 bp, Homo sapiens
gtctgtgtgtt

SEQ ID NO: 1332886 - DNA, 21 bp, Homo sapiens
gtgccaggatggaatgatggg

SEQ ID NO: 1332887 - DNA, 23 bp, Homo sapiens
gtgctattgtagagccagaggtc

SEQ ID NO: 1332888 - DNA, 14 bp, Homo sapiens
gtggaagtgtgggt

SEQ ID NO: 1332889 - DNA, 20 bp, Homo sapiens
gtggaagtgtgggtctgtgt

SEQ ID NO: 1332890 - DNA, 13 bp, Homo sapiens
gtgggagtgtgta

SEQ ID NO: 1332891 - DNA, 14 bp, Homo sapiens
gtgggagtgtgtaa

SEQ ID NO: 1332892 - DNA, 16 bp, Homo sapiens
gtgggtctgtgtgtgt

SEQ ID NO: 1332893 - DNA, 20 bp, Homo sapiens
gtgtaatttaaaattgtgat

SEQ ID NO: 1332894 - DNA, 22 bp, Homo sapiens
gtgtaatttaaaattgtgatgt

SEQ ID NO: 1332895 - DNA, 21 bp, Homo sapiens
gtgtatgtgggggtctgtgtg

SEQ ID NO: 1332896 - DNA, 14 bp, Homo sapiens
gtgtgtaatttaaa

SEQ ID NO: 1332897 - DNA, 20 bp, Homo sapiens
gtgtgtcacccttaggccag

SEQ ID NO: 1332898 - DNA, 17 bp, Homo sapiens
gtgtgtgttgtgtgtgg

SEQ ID NO: 1332899 - DNA, 16 bp, Homo sapiens
gtgtttatgtgtgtgt

SEQ ID NO: 1332900 - DNA, 20 bp, Homo sapiens
gttcattaaacgtcattcag

SEQ ID NO: 1332901 - DNA, 21 bp, Homo sapiens
gttgggagaatgtcagtatgt

SEQ ID NO: 1332902 - DNA, 18 bp, Homo sapiens
gttgtatcagcacgtgtg

SEQ ID NO: 1332903 - DNA, 14 bp, Homo sapiens
gttgtgtgtgggag

SEQ ID NO: 1332904 - DNA, 16 bp, Homo sapiens
gtttatgtgtgtgtgt

SEQ ID NO: 1332905 - DNA, 16 bp, Homo sapiens
gttttcttaacttaaa

SEQ ID NO: 1332906 - DNA, 19 bp, Homo sapiens
taaccaattcctcatttgt

SEQ ID NO: 1332907 - DNA, 19 bp, Homo sapiens
taattctttgacctgttgg

SEQ ID NO: 1332908 - DNA, 14 bp, Homo sapiens
tacagaggacagta

SEQ ID NO: 1332909 - DNA, 14 bp, Homo sapiens
tactatggctgttt

SEQ ID NO: 1332910 - DNA, 16 bp, Homo sapiens
tacttttggcatgaaa

SEQ ID NO: 1332911 - DNA, 21 bp, Homo sapiens
tagacatttgctatgagctgg

SEQ ID NO: 1332912 - DNA, 16 bp, Homo sapiens
tagagcacttttaaca

SEQ ID NO: 1332913 - DNA, 15 bp, Homo sapiens
taggaactgctgggc

SEQ ID NO: 1332914 - DNA, 22 bp, Homo sapiens
tataaacatgcttgcattatat

SEQ ID NO: 1332915 - DNA, 15 bp, Homo sapiens
tatcagcacgtgtgg

SEQ ID NO: 1332916 - DNA, 23 bp, Homo sapiens
tatgagctggggatgtctctcat

SEQ ID NO: 1332917 - DNA, 16 bp, Homo sapiens
tatgtggaagtgtggg

SEQ ID NO: 1332918 - DNA, 19 bp, Homo sapiens
tatgtgggggtctgtgtgt

SEQ ID NO: 1332919 - DNA, 22 bp, Homo sapiens
tatgtgtgtgtgttgtgtgtgg

SEQ ID NO: 1332920 - DNA, 12 bp, Homo sapiens
tattcccatgag

SEQ ID NO: 1332921 - DNA, 17 bp, Homo sapiens
tcaaccgcttgccatat

SEQ ID NO: 1332922 - DNA, 15 bp, Homo sapiens
tcagacttacttact

SEQ ID NO: 1332923 - DNA, 17 bp, Homo sapiens
tcagatttgccttattg

SEQ ID NO: 1332924 - DNA, 22 bp, Homo sapiens
tcagatttgccttattggcagc

SEQ ID NO: 1332925 - DNA, 16 bp, Homo sapiens
tcagtatgtggaagtg

SEQ ID NO: 1332926 - DNA, 22 bp, Homo sapiens
tcagtctttaatctgagaggcc

SEQ ID NO: 1332927 - DNA, 22 bp, Homo sapiens
tcatgatagaaggctatgggga

SEQ ID NO: 1332928 - DNA, 17 bp, Homo sapiens
tcatgtttacagaggac

SEQ ID NO: 1332929 - DNA, 16 bp, Homo sapiens
tcatttgttcattaaa

SEQ ID NO: 1332930 - DNA, 14 bp, Homo sapiens
tccacagagtataa

SEQ ID NO: 1332931 - DNA, 12 bp, Homo sapiens
tcctcatttgtt

SEQ ID NO: 1332932 - DNA, 19 bp, Homo sapiens
tctactccatgcacatagt

SEQ ID NO: 1332933 - DNA, 15 bp, Homo sapiens
tctgtgtgtgtgtat

SEQ ID NO: 1332934 - DNA, 16 bp, Homo sapiens
tctgtgtgtttatgtg

SEQ ID NO: 1332935 - DNA, 22 bp, Homo sapiens
tcttcattacctcagtgagaag

SEQ ID NO: 1332936 - DNA, 13 bp, Homo sapiens
tgaatacattttg

SEQ ID NO: 1332937 - DNA, 14 bp, Homo sapiens
tgactttagaaaca

SEQ ID NO: 1332938 - DNA, 15 bp, Homo sapiens
tgaggccattatttc

SEQ ID NO: 1332939 - DNA, 16 bp, Homo sapiens
tgaggccattatttca

SEQ ID NO: 1332940 - DNA, 22 bp, Homo sapiens
tgagggtgactatggagctgag

SEQ ID NO: 1332941 - DNA, 17 bp, Homo sapiens
tgataacgtattttgat

SEQ ID NO: 1332942 - DNA, 15 bp, Homo sapiens
tgatgggtcagttgt

SEQ ID NO: 1332943 - DNA, 20 bp, Homo sapiens
tgcccaggctggagtgcagt

SEQ ID NO: 1332944 - DNA, 19 bp, Homo sapiens
tgccttgtgaaggaattat

SEQ ID NO: 1332945 - DNA, 12 bp, Homo sapiens
tgctaattctga

SEQ ID NO: 1332946 - DNA, 13 bp, Homo sapiens
tgctaattctgag

SEQ ID NO: 1332947 - DNA, 21 bp, Homo sapiens
tgctttcgaataaagtgaata

SEQ ID NO: 1332948 - DNA, 20 bp, Homo sapiens
tggaagtgtgggtctgtgtg

SEQ ID NO: 1332949 - DNA, 22 bp, Homo sapiens
tggacctttcctgaggaagagg

SEQ ID NO: 1332950 - DNA, 19 bp, Homo sapiens
tggatctgtgaggggctct

SEQ ID NO: 1332951 - DNA, 16 bp, Homo sapiens
tggccagtggctggat

SEQ ID NO: 1332952 - DNA, 20 bp, Homo sapiens
tgggagaatgtcagtatgtg

SEQ ID NO: 1332953 - DNA, 14 bp, Homo sapiens
tggggctgattgta

SEQ ID NO: 1332954 - DNA, 15 bp, Homo sapiens
tgggggtctgtgtgt

SEQ ID NO: 1332955 - DNA, 13 bp, Homo sapiens
tgggtctgtgtgt

SEQ ID NO: 1332956 - DNA, 13 bp, Homo sapiens
tggtaggaactgc

SEQ ID NO: 1332957 - DNA, 20 bp, Homo sapiens
tggtaggaactgctgggctt

SEQ ID NO: 1332958 - DNA, 17 bp, Homo sapiens
tgtaaatttatgtgatg

SEQ ID NO: 1332959 - DNA, 22 bp, Homo sapiens
tgtcacccttaggccagcacca

SEQ ID NO: 1332960 - DNA, 11 bp, Homo sapiens
tgtgatgtgtc

SEQ ID NO: 1332961 - DNA, 16 bp, Homo sapiens
tgtgggggtctgtgtg

SEQ ID NO: 1332962 - DNA, 19 bp, Homo sapiens
tgtgtaatttaaaattgtg

SEQ ID NO: 1332963 - DNA, 20 bp, Homo sapiens
tgtgtgtgggagtgtgtaat

SEQ ID NO: 1332964 - DNA, 14 bp, Homo sapiens
tgtgttgtgtgtgg

SEQ ID NO: 1332965 - DNA, 16 bp, Homo sapiens
tgttgtgtgtgggagt

SEQ ID NO: 1332966 - DNA, 16 bp, Homo sapiens
tgtttagaactactga

SEQ ID NO: 1332967 - DNA, 16 bp, Homo sapiens
tgtttagaagaagtgt

SEQ ID NO: 1332968 - DNA, 16 bp, Homo sapiens
tgtttatgtgtgtgtg

SEQ ID NO: 1332969 - DNA, 13 bp, Homo sapiens
ttaaaattgtgat

SEQ ID NO: 1332970 - DNA, 22 bp, Homo sapiens
ttaacaaaaaaggaaaatgaac

SEQ ID NO: 1332971 - DNA, 12 bp, Homo sapiens
ttaactcagtct

SEQ ID NO: 1332972 - DNA, 23 bp, Homo sapiens
ttaataaacgtccacagagtata

SEQ ID NO: 1332973 - DNA, 19 bp, Homo sapiens
ttacatctttgtttaccat

SEQ ID NO: 1332974 - DNA, 18 bp, Homo sapiens
ttaccctaaaacatgtgt

SEQ ID NO: 1332975 - DNA, 12 bp, Homo sapiens
ttatgtgtgtgt

SEQ ID NO: 1332976 - DNA, 14 bp, Homo sapiens
ttatgtgtgtgtgt

SEQ ID NO: 1332977 - DNA, 23 bp, Homo sapiens
ttcctcatttgttcattaaacgt

SEQ ID NO: 1332978 - DNA, 20 bp, Homo sapiens
ttgcccaggctggagtgcag

SEQ ID NO: 1332979 - DNA, 18 bp, Homo sapiens
ttgtccctgaagagaagg

SEQ ID NO: 1332980 - DNA, 18 bp, Homo sapiens
ttgtttagaagaagtgtg

SEQ ID NO: 1332981 - DNA, 14 bp, Homo sapiens
tttaacaaaaaagg

SEQ ID NO: 1332982 - DNA, 20 bp, Homo sapiens
tttacagaggacagtatttg

SEQ ID NO: 1332983 - DNA, 14 bp, Homo sapiens
tttagaactactga

SEQ ID NO: 1332984 - DNA, 12 bp, Homo sapiens
tttatgtgatgg

SEQ ID NO: 1332985 - DNA, 18 bp, Homo sapiens
tttcaaccgcttgccata

SEQ ID NO: 1332986 - DNA, 18 bp, Homo sapiens
tttgcacccatgccatag

SEQ ID NO: 1332987 - DNA, 15 bp, Homo sapiens
ttttaacaaaaaagg

SEQ ID NO: 1332988 - DNA, 15 bp, Homo sapiens
atcttaaaattcttg

SEQ ID NO: 1332989 - DNA, 13 bp, Homo sapiens
atgaatgctgacc

SEQ ID NO: 1332990 - DNA, 16 bp, Homo sapiens
atggcctgggggatgt

SEQ ID NO: 1332991 - DNA, 13 bp, Homo sapiens
atgtatggcatgt

SEQ ID NO: 1332992 - DNA, 14 bp, Homo sapiens
atgtcagtatgtgg

SEQ ID NO: 1332993 - DNA, 16 bp, Homo sapiens
atgtcagtatgtggaa

SEQ ID NO: 1332994 - DNA, 16 bp, Homo sapiens
atgtgggggtctgtgt

SEQ ID NO: 1332995 - DNA, 15 bp, Homo sapiens
atgtttacagaggac

SEQ ID NO: 1332996 - DNA, 21 bp, Homo sapiens
attatttcaaccgcttgccat

SEQ ID NO: 1332997 - DNA, 20 bp, Homo sapiens
attccactgaaatagagtga

SEQ ID NO: 1332998 - DNA, 17 bp, Homo sapiens
attctgagggaatttaa

SEQ ID NO: 1332999 - DNA, 20 bp, Homo sapiens
attgtacttttggcatgaaa

SEQ ID NO: 1333000 - DNA, 17 bp, Homo sapiens
attgtagagccagaggt

SEQ ID NO: 1333001 - DNA, 13 bp, Homo sapiens
attgtgatgtgtc

SEQ ID NO: 1333002 - DNA, 14 bp, Homo sapiens
attgtgatgtgtcc

SEQ ID NO: 1333003 - DNA, 15 bp, Homo sapiens
atttaaaattgtgat

SEQ ID NO: 1333004 - DNA, 19 bp, Homo sapiens
atttgtaaatttatgtgat

SEQ ID NO: 1333005 - DNA, 15 bp, Homo sapiens
atttgttcattaaac

SEQ ID NO: 1333006 - DNA, 16 bp, Homo sapiens
atttgttcattaaacg

SEQ ID NO: 1333007 - DNA, 17 bp, Homo sapiens
cagaaaagaaagctgct

SEQ ID NO: 1333008 - DNA, 17 bp, Homo sapiens
cagcacgtgtggcctgt

SEQ ID NO: 1333009 - DNA, 14 bp, Homo sapiens
caggagtccctgcc

SEQ ID NO: 1333010 - DNA, 15 bp, Homo sapiens
caggagtccctgcca

SEQ ID NO: 1333011 - DNA, 15 bp, Homo sapiens
caggcctgactctca

SEQ ID NO: 1333012 - DNA, 18 bp, Homo sapiens
cagggctgaggcctctca

SEQ ID NO: 1333013 - DNA, 16 bp, Homo sapiens
cagtggctggatctgt

SEQ ID NO: 1333014 - DNA, 20 bp, Homo sapiens
cagtggctggatctgtgagg

SEQ ID NO: 1333015 - DNA, 17 bp, Homo sapiens
catggattccactgaaa

SEQ ID NO: 1333016 - DNA, 17 bp, Homo sapiens
cattaaacgtcattcag

SEQ ID NO: 1333017 - DNA, 21 bp, Homo sapiens
cattacctcagtgagaagcca

SEQ ID NO: 1333018 - DNA, 14 bp, Homo sapiens
catttgttcattaa

SEQ ID NO: 1333019 - DNA, 16 bp, Homo sapiens
ccaaaagtacttaccc

SEQ ID NO: 1333020 - DNA, 23 bp, Homo sapiens
ccaattcctcatttgttcattaa

SEQ ID NO: 1333021 - DNA, 20 bp, Homo sapiens
ccacacagacttgggcaggg

SEQ ID NO: 1333022 - DNA, 13 bp, Homo sapiens
ccacagagtataa

SEQ ID NO: 1333023 - DNA, 20 bp, Homo sapiens
ccatcatgtttacagaggac

SEQ ID NO: 1333024 - DNA, 20 bp, Homo sapiens
ccctgccatcatgtttacag

SEQ ID NO: 1333025 - DNA, 20 bp, Homo sapiens
cctgccatcatgtttacaga

SEQ ID NO: 1333026 - DNA, 14 bp, Homo sapiens
cctttgtcccagaa

SEQ ID NO: 1333027 - DNA, 20 bp, Homo sapiens
cgatcttggctcactgcaac

SEQ ID NO: 1333028 - DNA, 21 bp, Homo sapiens
cgattgcaggagtccctgcca

SEQ ID NO: 1333029 - DNA, 15 bp, Homo sapiens
cgctgccttgccatg

SEQ ID NO: 1333030 - DNA, 13 bp, Homo sapiens
cggggacacaggc

SEQ ID NO: 1333031 - DNA, 22 bp, Homo sapiens
cgggtcatctgtacctctgcct

SEQ ID NO: 1333032 - DNA, 21 bp, Homo sapiens
ctaattctttgacctgttggg

SEQ ID NO: 1333033 - DNA, 22 bp, Homo sapiens
ctactctggaggtttgtttaga

SEQ ID NO: 1333034 - DNA, 19 bp, Homo sapiens
ctatggggatagatgtgtg

SEQ ID NO: 1333035 - DNA, 20 bp, Homo sapiens
ctatggggatagatgtgtgg

SEQ ID NO: 1333036 - DNA, 17 bp, Homo sapiens
ctcatttgttcattaaa

SEQ ID NO: 1333037 - DNA, 22 bp, Homo sapiens
ctctgttgcccaggctggagtg

SEQ ID NO: 1333038 - DNA, 12 bp, Homo sapiens
ctgagcaggtgt

SEQ ID NO: 1333039 - DNA, 23 bp, Homo sapiens
ctgaggaagagggactgttcttt

SEQ ID NO: 1333040 - DNA, 13 bp, Homo sapiens
ctgattgtattta

SEQ ID NO: 1333041 - DNA, 12 bp, Homo sapiens
ctggaggtttgt

SEQ ID NO: 1333042 - DNA, 14 bp, Homo sapiens
ctggagtgcagtgg

SEQ ID NO: 1333043 - DNA, 22 bp, Homo sapiens
ctggggatgtctctcatgacca

SEQ ID NO: 1333044 - DNA, 14 bp, Homo sapiens
ctgtacctctgcct

SEQ ID NO: 1333045 - DNA, 16 bp, Homo sapiens
ctgtgccttttgccat

SEQ ID NO: 1333046 - DNA, 14 bp, Homo sapiens
ctgtgtgtgtgtat

SEQ ID NO: 1333047 - DNA, 15 bp, Homo sapiens
ctgtgtgtgtgtatg

SEQ ID NO: 1333048 - DNA, 21 bp, Homo sapiens
ctgtgtgtgtgtatgtggggg

SEQ ID NO: 1333049 - DNA, 18 bp, Homo sapiens
ctgtgtgtttatgtgtgt

SEQ ID NO: 1333050 - DNA, 19 bp, Homo sapiens
cttacatctttgtttacca

SEQ ID NO: 1333051 - DNA, 20 bp, Homo sapiens
cttagctgaacaatgaatgc

SEQ ID NO: 1333052 - DNA, 15 bp, Homo sapiens
cttaggccagcacca

SEQ ID NO: 1333053 - DNA, 17 bp, Homo sapiens
cttctacctcttggctg

SEQ ID NO: 1333054 - DNA, 16 bp, Homo sapiens
cttcttctcggggaca

SEQ ID NO: 1333055 - DNA, 14 bp, Homo sapiens
ctttgacctgttgg

SEQ ID NO: 1333056 - DNA, 13 bp, Homo sapiens
ctttgccttccaa

SEQ ID NO: 1333057 - DNA, 23 bp, Homo sapiens
cttttaacaaaaaaggaaaatga

SEQ ID NO: 1333058 - DNA, 12 bp, Homo sapiens
gaaagctgcttt

SEQ ID NO: 1333059 - DNA, 22 bp, Homo sapiens
gaaagctgctttcgaataaagt

SEQ ID NO: 1333060 - DNA, 19 bp, Homo sapiens
gaagggcagggctgaggcc

SEQ ID NO: 1333061 - DNA, 18 bp, Homo sapiens
gaagtgtgggtctgtgtg

SEQ ID NO: 1333062 - DNA, 21 bp, Homo sapiens
gaagtgtgggtctgtgtgtgt

SEQ ID NO: 1333063 - DNA, 23 bp, Homo sapiens
gaattgctaattctgagggaatt

SEQ ID NO: 1333064 - DNA, 17 bp, Homo sapiens
gacagaaaagaaagctg

SEQ ID NO: 1333065 - DNA, 22 bp, Homo sapiens
gagaagccagctttcctcatca

SEQ ID NO: 1333066 - DNA, 18 bp, Homo sapiens
gagtcagggagagctgaa

SEQ ID NO: 1333067 - DNA, 18 bp, Homo sapiens
gagtgaggatgtctgggc

SEQ ID NO: 1333068 - DNA, 14 bp, Homo sapiens
gatcattatcagcc

SEQ ID NO: 1333069 - DNA, 13 bp, Homo sapiens
gatggaatgatgg

SEQ ID NO: 1333070 - DNA, 21 bp, Homo sapiens
gatgggtcagttgtatcagca

SEQ ID NO: 1333071 - DNA, 20 bp, Homo sapiens
gatttggggctcagagtggg

SEQ ID NO: 1333072 - DNA, 13 bp, Homo sapiens
gcacttttaacaa

SEQ ID NO: 1333073 - DNA, 17 bp, Homo sapiens
gccatcatgtttacaga

SEQ ID NO: 1333074 - DNA, 15 bp, Homo sapiens
gccatgtcttgttca

SEQ ID NO: 1333075 - DNA, 15 bp, Homo sapiens
gcgataacttaacaa

SEQ ID NO: 1333076 - DNA, 22 bp, Homo sapiens
gctaattctttgacctgttggg

SEQ ID NO: 1333077 - DNA, 14 bp, Homo sapiens
gctgaggcctctca

SEQ ID NO: 1333078 - DNA, 15 bp, Homo sapiens
gctggagtgcagtgg

SEQ ID NO: 1333079 - DNA, 22 bp, Homo sapiens
gctgggcttggcagcccgggtc

SEQ ID NO: 1333080 - DNA, 14 bp, Homo sapiens
gctggggatgtctc

SEQ ID NO: 1333081 - DNA, 18 bp, Homo sapiens
ggacagtatttgtgggga

SEQ ID NO: 1333082 - DNA, 15 bp, Homo sapiens
ggcagggctgaggcc

SEQ ID NO: 1333083 - DNA, 12 bp, Homo sapiens
ggcatgaaagtg

SEQ ID NO: 1333084 - DNA, 18 bp, Homo sapiens
ggcatgtgtagttaattt

SEQ ID NO: 1333085 - DNA, 20 bp, Homo sapiens
ggcctctcattccagaggaa

SEQ ID NO: 1333086 - DNA, 14 bp, Homo sapiens
ggctcagagtgggg

SEQ ID NO: 1333087 - DNA, 14 bp, Homo sapiens
gggatagatgtgtg

SEQ ID NO: 1333088 - DNA, 18 bp, Homo sapiens
gggctcagagtggggtag

SEQ ID NO: 1333089 - DNA, 23 bp, Homo sapiens
ggggtctgtgtgtttatgtgtgt

SEQ ID NO: 1333090 - DNA, 17 bp, Homo sapiens
ggtctgtgtgtgtgtat

SEQ ID NO: 1333091 - DNA, 21 bp, Homo sapiens
gtaaggaacggcccttttagt

SEQ ID NO: 1333092 - DNA, 23 bp, Homo sapiens
gtaatttaaaattgtgatgtgtc

SEQ ID NO: 1333093 - DNA, 14 bp, Homo sapiens
gtaggttgggagaa

SEQ ID NO: 1333094 - DNA, 18 bp, Homo sapiens
gtagttaattttattcca

SEQ ID NO: 1333095 - DNA, 18 bp, Homo sapiens
gtatcgctgccttgccat

SEQ ID NO: 1333096 - DNA, 20 bp, Homo sapiens
gtcccagaatgcctcctgca

SEQ ID NO: 1333097 - DNA, 11 bp, Homo sapiens
gtctgtgtgtg

SEQ ID NO: 1333098 - DNA, 16 bp, Homo sapiens
gtctgtgtgtgtgtat

SEQ ID NO: 1333099 - DNA, 21 bp, Homo sapiens
gtctgtgtgtttatgtgtgtg

SEQ ID NO: 1333100 - DNA, 15 bp, Homo sapiens
gtgaggatgtctggg

SEQ ID NO: 1333101 - DNA, 15 bp, Homo sapiens
gtggaagtgtgggtc

SEQ ID NO: 1333102 - DNA, 17 bp, Homo sapiens
gtggctggatctgtgag

SEQ ID NO: 1333103 - DNA, 15 bp, Homo sapiens
gtgggggtctgtgtg

SEQ ID NO: 1333104 - DNA, 19 bp, Homo sapiens
gtggggtaggttgggagaa

SEQ ID NO: 1333105 - DNA, 23 bp, Homo sapiens
gtgtaatttaaaattgtgatgtg

SEQ ID NO: 1333106 - DNA, 17 bp, Homo sapiens
gtgtgggagtgtgtaat

SEQ ID NO: 1333107 - DNA, 14 bp, Homo sapiens
gtgtgggtctgtgt

SEQ ID NO: 1333108 - DNA, 12 bp, Homo sapiens
gtgtgtatgtgg

SEQ ID NO: 1333109 - DNA, 16 bp, Homo sapiens
gtgtgtgggagtgtgt

SEQ ID NO: 1333110 - DNA, 12 bp, Homo sapiens
gtgtgttgtgtg

SEQ ID NO: 1333111 - DNA, 15 bp, Homo sapiens
gtgtgtttatgtgtg

SEQ ID NO: 1333112 - DNA, 16 bp, Homo sapiens
gtgtgtttatgtgtgt

SEQ ID NO: 1333113 - DNA, 22 bp, Homo sapiens
gttcttagctgaacaatgaatg

SEQ ID NO: 1333114 - DNA, 22 bp, Homo sapiens
gttgtgtgtgggagtgtgtaat

SEQ ID NO: 1333115 - DNA, 17 bp, Homo sapiens
gtttagaactactgata

SEQ ID NO: 1333116 - DNA, 13 bp, Homo sapiens
gtttatgtgtgtg

SEQ ID NO: 1333117 - DNA, 15 bp, Homo sapiens
taaaattgtgatgtg

SEQ ID NO: 1333118 - DNA, 16 bp, Homo sapiens
taaaattgtgatgtgt

SEQ ID NO: 1333119 - DNA, 23 bp, Homo sapiens
taaataaccaattcctcatttgt

SEQ ID NO: 1333120 - DNA, 18 bp, Homo sapiens
taacaattaattttctat

SEQ ID NO: 1333121 - DNA, 17 bp, Homo sapiens
taaccaattcctcattt

SEQ ID NO: 1333122 - DNA, 15 bp, Homo sapiens
taacgtattttgatg

SEQ ID NO: 1333123 - DNA, 22 bp, Homo sapiens
taacttaaaagaacatgtatat

SEQ ID NO: 1333124 - DNA, 22 bp, Homo sapiens
taacttaacaattaattttcta

SEQ ID NO: 1333125 - DNA, 15 bp, Homo sapiens
taatttaaaattgtg

SEQ ID NO: 1333126 - DNA, 16 bp, Homo sapiens
taatttaaaattgtga

SEQ ID NO: 1333127 - DNA, 13 bp, Homo sapiens
tacctcttggctg

SEQ ID NO: 1333128 - DNA, 18 bp, Homo sapiens
tacttacatctttgttta

SEQ ID NO: 1333129 - DNA, 14 bp, Homo sapiens
tagaagaagtgtgt

SEQ ID NO: 1333130 - DNA, 18 bp, Homo sapiens
taggaactgctgggcttg

SEQ ID NO: 1333131 - DNA, 20 bp, Homo sapiens
tatatttgtaaatttatgtg

SEQ ID NO: 1333132 - DNA, 14 bp, Homo sapiens
tatcagcacgtgtg

SEQ ID NO: 1333133 - DNA, 18 bp, Homo sapiens
tatggggatagatgtgtg

SEQ ID NO: 1333134 - DNA, 21 bp, Homo sapiens
tatggtaggaactgctgggct

SEQ ID NO: 1333135 - DNA, 12 bp, Homo sapiens
tatgtggaagtg

SEQ ID NO: 1333136 - DNA, 18 bp, Homo sapiens
tatgtgggggtctgtgtg

SEQ ID NO: 1333137 - DNA, 20 bp, Homo sapiens
tatgtgggggtctgtgtgtt

SEQ ID NO: 1333138 - DNA, 11 bp, Homo sapiens
tatgtgtgtgt

SEQ ID NO: 1333139 - DNA, 14 bp, Homo sapiens
tatgtgtgtgtgtt

SEQ ID NO: 1333140 - DNA, 22 bp, Homo sapiens
tatttgtaaatttatgtgatgg

SEQ ID NO: 1333141 - DNA, 23 bp, Homo sapiens
tcacagcaagtcactggccagtg

SEQ ID NO: 1333142 - DNA, 16 bp, Homo sapiens
tcataaatttatggtt

SEQ ID NO: 1333143 - DNA, 14 bp, Homo sapiens
tcattaaacgtcat

SEQ ID NO: 1333144 - DNA, 22 bp, Homo sapiens
tcatttaccataaaaatccttc

SEQ ID NO: 1333145 - DNA, 12 bp, Homo sapiens
tcatttgttcat

SEQ ID NO: 1333146 - DNA, 13 bp, Homo sapiens
tcatttgttcatt

SEQ ID NO: 1333147 - DNA, 18 bp, Homo sapiens
tcctcatttgttcattaa

SEQ ID NO: 1333148 - DNA, 17 bp, Homo sapiens
tctactgagacatgact

SEQ ID NO: 1333149 - DNA, 11 bp, Homo sapiens
tctggccctat

SEQ ID NO: 1333150 - DNA, 11 bp, Homo sapiens
tctgtgtgtgt

SEQ ID NO: 1333151 - DNA, 18 bp, Homo sapiens
tctgtgtgtgtgtatgtg

SEQ ID NO: 1333152 - DNA, 19 bp, Homo sapiens
tgaacaggttctttaaaat

SEQ ID NO: 1333153 - DNA, 20 bp, Homo sapiens
tgaagagaagggcagggctg

SEQ ID NO: 1333154 - DNA, 22 bp, Homo sapiens
tgaagagaagggcagggctgag

SEQ ID NO: 1333155 - DNA, 17 bp, Homo sapiens
tgacatacatccaacat

SEQ ID NO: 1333156 - DNA, 18 bp, Homo sapiens
tgactactatggctgttt

SEQ ID NO: 1333157 - DNA, 17 bp, Homo sapiens
tgactaggaagaaaaca

SEQ ID NO: 1333158 - DNA, 20 bp, Homo sapiens
tgagctggggatgtctctca

SEQ ID NO: 1333159 - DNA, 18 bp, Homo sapiens
tgagttcataaatttatg

SEQ ID NO: 1333160 - DNA, 17 bp, Homo sapiens
tgagttggctgggaata

SEQ ID NO: 1333161 - DNA, 21 bp, Homo sapiens
tgatagaaggctatggggata

SEQ ID NO: 1333162 - DNA, 22 bp, Homo sapiens
tgccatcatgtttacagaggac

SEQ ID NO: 1333163 - DNA, 22 bp, Homo sapiens
tgccatgtcttgttcagaagac

SEQ ID NO: 1333164 - DNA, 16 bp, Homo sapiens
tgctatgagctgggga

SEQ ID NO: 1333165 - DNA, 20 bp, Homo sapiens
tgctatgagctggggatgtc

SEQ ID NO: 1333166 - DNA, 18 bp, Homo sapiens
tgctattgtagagccaga

SEQ ID NO: 1333167 - DNA, 15 bp, Homo sapiens
tgctgtagacatttg

SEQ ID NO: 1333168 - DNA, 23 bp, Homo sapiens
tgctgtatccatccatggggctg

SEQ ID NO: 1333169 - DNA, 13 bp, Homo sapiens
tggaagtgtgggt

SEQ ID NO: 1333170 - DNA, 14 bp, Homo sapiens
tggaagtgtgggtc

SEQ ID NO: 1333171 - DNA, 23 bp, Homo sapiens
tggaagtgtgggtctgtgtgtgt

SEQ ID NO: 1333172 - DNA, 15 bp, Homo sapiens
tggatctgtgagggg

SEQ ID NO: 1333173 - DNA, 16 bp, Homo sapiens
tggattccactgaaat

SEQ ID NO: 1333174 - DNA, 21 bp, Homo sapiens
tggcctgttcttctatgggtt

SEQ ID NO: 1333175 - DNA, 20 bp, Homo sapiens
tggctccattggtgttgaca

SEQ ID NO: 1333176 - DNA, 22 bp, Homo sapiens
tggctgccttgtgaaggaatta

SEQ ID NO: 1333177 - DNA, 21 bp, Homo sapiens
tgggagtgaggatgtctgggc

SEQ ID NO: 1333178 - DNA, 15 bp, Homo sapiens
tggggtaggttggga

SEQ ID NO: 1333179 - DNA, 12 bp, Homo sapiens
tgggtctgtgtg

SEQ ID NO: 1333180 - DNA, 15 bp, Homo sapiens
tgggtctgtgtgtgt

SEQ ID NO: 1333181 - DNA, 16 bp, Homo sapiens
tgtaaatttatgtgat

SEQ ID NO: 1333182 - DNA, 17 bp, Homo sapiens
tgtaatttaaaattgtg

SEQ ID NO: 1333183 - DNA, 12 bp, Homo sapiens
tgtatgtggggg

SEQ ID NO: 1333184 - DNA, 18 bp, Homo sapiens
tgtgaggggctctctcat

SEQ ID NO: 1333185 - DNA, 17 bp, Homo sapiens
tgtgccttggtgtgctg

SEQ ID NO: 1333186 - DNA, 16 bp, Homo sapiens
tgtgccttttgccatc

SEQ ID NO: 1333187 - DNA, 15 bp, Homo sapiens
tgtggaagtgtgggt

SEQ ID NO: 1333188 - DNA, 14 bp, Homo sapiens
tgtgggagtgtgta

SEQ ID NO: 1333189 - DNA, 12 bp, Homo sapiens
tgtgtatgtggg

SEQ ID NO: 1333190 - DNA, 16 bp, Homo sapiens
tgtgtgggagtgtgta

SEQ ID NO: 1333191 - DNA, 13 bp, Homo sapiens
tgtgtgtgtgtat

SEQ ID NO: 1333192 - DNA, 16 bp, Homo sapiens
tgtgtgtgtgtatgtg

SEQ ID NO: 1333193 - DNA, 15 bp, Homo sapiens
tgttgtgtgtgggag

SEQ ID NO: 1333194 - DNA, 14 bp, Homo sapiens
tgtttacagaggac

SEQ ID NO: 1333195 - DNA, 21 bp, Homo sapiens
tgtttacagaggacagtattt

SEQ ID NO: 1333196 - DNA, 20 bp, Homo sapiens
ttaacaattaattttctatg

SEQ ID NO: 1333197 - DNA, 18 bp, Homo sapiens
ttaacctgaattattcca

SEQ ID NO: 1333198 - DNA, 15 bp, Homo sapiens
ttaattttctatgaa

SEQ ID NO: 1333199 - DNA, 10 bp, Homo sapiens
ttatgtgtgt

SEQ ID NO: 1333200 - DNA, 23 bp, Homo sapiens
ttcacttcgatgactggatacag

SEQ ID NO: 1333201 - DNA, 17 bp, Homo sapiens
ttcctcatttgttcatt

SEQ ID NO: 1333202 - DNA, 20 bp, Homo sapiens
ttcctcatttgttcattaaa

SEQ ID NO: 1333203 - DNA, 15 bp, Homo sapiens
ttgccagagccttaa

SEQ ID NO: 1333204 - DNA, 19 bp, Homo sapiens
ttgtaaatttatgtgatgg

SEQ ID NO: 1333205 - DNA, 20 bp, Homo sapiens
ttgtacttttggcatgaaag

SEQ ID NO: 1333206 - DNA, 16 bp, Homo sapiens
ttgtgtgtgggagtgt

SEQ ID NO: 1333207 - DNA, 17 bp, Homo sapiens
tttagaagaagtgtgtc

SEQ ID NO: 1333208 - DNA, 13 bp, Homo sapiens
tttatgtgtgtgt

SEQ ID NO: 1333209 - DNA, 19 bp, Homo sapiens
tttgctatgagctggggat

SEQ ID NO: 1333210 - DNA, 14 bp, Homo sapiens
tttgttcattaaac

SEQ ID NO: 1333211 - DNA, 17 bp, Homo sapiens
ttttggcatgaaagtgc

SEQ ID NO: 1333212 - DNA, 16 bp, Homo sapiens
aaaattgtgatgtgtc

SEQ ID NO: 1333213 - DNA, 20 bp, Homo sapiens
aaactgaggccattatttca

SEQ ID NO: 1333214 - DNA, 17 bp, Homo sapiens
aacaattaattttctat

SEQ ID NO: 1333215 - DNA, 17 bp, Homo sapiens
aaccaattcctcatttg

SEQ ID NO: 1333216 - DNA, 14 bp, Homo sapiens
aaccgcttgccata

SEQ ID NO: 1333217 - DNA, 16 bp, Homo sapiens
aacctcatttaccata

SEQ ID NO: 1333218 - DNA, 14 bp, Homo sapiens
aacgtattttgatg

SEQ ID NO: 1333219 - DNA, 22 bp, Homo sapiens
aacttaacaattaattttctat

SEQ ID NO: 1333220 - DNA, 13 bp, Homo sapiens
aagaaagctgctt

SEQ ID NO: 1333221 - DNA, 14 bp, Homo sapiens
aagaaagctgcttt

SEQ ID NO: 1333222 - DNA, 18 bp, Homo sapiens
aagagaagggcagggctg

SEQ ID NO: 1333223 - DNA, 21 bp, Homo sapiens
aagtcactggccagtggctgg

SEQ ID NO: 1333224 - DNA, 17 bp, Homo sapiens
aagtgtgggtctgtgtg

SEQ ID NO: 1333225 - DNA, 20 bp, Homo sapiens
aagtgtgggtctgtgtgtgt

SEQ ID NO: 1333226 - DNA, 14 bp, Homo sapiens
aatagagtgaatta

SEQ ID NO: 1333227 - DNA, 14 bp, Homo sapiens
aatgtatggcatgt

SEQ ID NO: 1333228 - DNA, 16 bp, Homo sapiens
aattccacaccctcac

SEQ ID NO: 1333229 - DNA, 20 bp, Homo sapiens
aattcctcatttgttcatta

SEQ ID NO: 1333230 - DNA, 21 bp, Homo sapiens
aattctgagggaatttaacca

SEQ ID NO: 1333231 - DNA, 15 bp, Homo sapiens
aattgtgatgtgtcc

SEQ ID NO: 1333232 - DNA, 16 bp, Homo sapiens
acagaaaagaaagctg

SEQ ID NO: 1333233 - DNA, 19 bp, Homo sapiens
acattgacccagaaatgta

SEQ ID NO: 1333234 - DNA, 14 bp, Homo sapiens
accatctctttacc

SEQ ID NO: 1333235 - DNA, 22 bp, Homo sapiens
acccagctatggttctctcgca

SEQ ID NO: 1333236 - DNA, 19 bp, Homo sapiens
acgtattttgatgttttgt

SEQ ID NO: 1333237 - DNA, 19 bp, Homo sapiens
actgcaacttctacctccg

SEQ ID NO: 1333238 - DNA, 16 bp, Homo sapiens
acttactcccattttc

SEQ ID NO: 1333239 - DNA, 19 bp, Homo sapiens
acttttggcatgaaagtgc

SEQ ID NO: 1333240 - DNA, 22 bp, Homo sapiens
agaacatggattccactgaaat

SEQ ID NO: 1333241 - DNA, 15 bp, Homo sapiens
agaatgtcagtatgt

SEQ ID NO: 1333242 - DNA, 14 bp, Homo sapiens
agagccttaataaa

SEQ ID NO: 1333243 - DNA, 22 bp, Homo sapiens
agagggactgttcttttgtccc

SEQ ID NO: 1333244 - DNA, 19 bp, Homo sapiens
agagtggggtaggttggga

SEQ ID NO: 1333245 - DNA, 13 bp, Homo sapiens
agccagaggtctg

SEQ ID NO: 1333246 - DNA, 16 bp, Homo sapiens
agctgaacaatgaatg

SEQ ID NO: 1333247 - DNA, 19 bp, Homo sapiens
aggacagtatttgtgggga

SEQ ID NO: 1333248 - DNA, 16 bp, Homo sapiens
agtcttggaatacttg

SEQ ID NO: 1333249 - DNA, 18 bp, Homo sapiens
agtgccaggatggaatga

SEQ ID NO: 1333250 - DNA, 16 bp, Homo sapiens
agtggctggatctgtg

SEQ ID NO: 1333251 - DNA, 15 bp, Homo sapiens
agtgtgggtctgtgt

SEQ ID NO: 1333252 - DNA, 9 bp, Homo sapiens
agtgtgtaa

SEQ ID NO: 1333253 - DNA, 22 bp, Homo sapiens
agttcttagagcacttttaaca

SEQ ID NO: 1333254 - DNA, 12 bp, Homo sapiens
ataaagtgaata

SEQ ID NO: 1333255 - DNA, 18 bp, Homo sapiens
ataatcacaacccttcag

SEQ ID NO: 1333256 - DNA, 14 bp, Homo sapiens
atagatgtgtggac

SEQ ID NO: 1333257 - DNA, 13 bp, Homo sapiens
atcaggccattgt

SEQ ID NO: 1333258 - DNA, 18 bp, Homo sapiens
atcatgtttacagaggac

SEQ ID NO: 1333259 - DNA, 23 bp, Homo sapiens
atcatgtttacagaggacagtat

SEQ ID NO: 1333260 - DNA, 20 bp, Homo sapiens
atccatggggctgattgtat

SEQ ID NO: 1333261 - DNA, 20 bp, Homo sapiens
atctgagaggccacagtgca

SEQ ID NO: 1333262 - DNA, 22 bp, Homo sapiens
atgactggatacagaatgaatc

SEQ ID NO: 1333263 - DNA, 16 bp, Homo sapiens
atgatgggtcagttgt

SEQ ID NO: 1333264 - DNA, 21 bp, Homo sapiens
atggaatgatgggtcagttgt

SEQ ID NO: 1333265 - DNA, 12 bp, Homo sapiens
aaaaggaaaatg

SEQ ID NO: 1333266 - DNA, 18 bp, Homo sapiens
aaaagttggagttatatt

SEQ ID NO: 1333267 - DNA, 17 bp, Homo sapiens
aaaatgaacaggttctt

SEQ ID NO: 1333268 - DNA, 14 bp, Homo sapiens
aaatcagtcttgga

SEQ ID NO: 1333269 - DNA, 12 bp, Homo sapiens
aaattgtgatgt

SEQ ID NO: 1333270 - DNA, 15 bp, Homo sapiens
aaattgtgatgtgtc

SEQ ID NO: 1333271 - DNA, 14 bp, Homo sapiens
aacctgaattattc

SEQ ID NO: 1333272 - DNA, 17 bp, Homo sapiens
aacgtccacagagtata

SEQ ID NO: 1333273 - DNA, 23 bp, Homo sapiens
aaggctatggggatagatgtgtg

SEQ ID NO: 1333274 - DNA, 19 bp, Homo sapiens
aagggacagaaaagaaagc

SEQ ID NO: 1333275 - DNA, 13 bp, Homo sapiens
aataaagtgaata

SEQ ID NO: 1333276 - DNA, 14 bp, Homo sapiens
aataaagtgaatac

SEQ ID NO: 1333277 - DNA, 23 bp, Homo sapiens
aatacattttgcacaaagtaagc

SEQ ID NO: 1333278 - DNA, 22 bp, Homo sapiens
aatgtcagtatgtggaagtgtg

SEQ ID NO: 1333279 - DNA, 13 bp, Homo sapiens
aattcctcatttg

SEQ ID NO: 1333280 - DNA, 13 bp, Homo sapiens
aattctgagggaa

SEQ ID NO: 1333281 - DNA, 18 bp, Homo sapiens
aattctttgacctgttgg

SEQ ID NO: 1333282 - DNA, 15 bp, Homo sapiens
aattgctaattctga

SEQ ID NO: 1333283 - DNA, 11 bp, Homo sapiens
aattgtgatgt

SEQ ID NO: 1333284 - DNA, 14 bp, Homo sapiens
aatttatgtgatgg

SEQ ID NO: 1333285 - DNA, 15 bp, Homo sapiens
acaaacaaataaata

SEQ ID NO: 1333286 - DNA, 21 bp, Homo sapiens
acagacactcccacttggcat

SEQ ID NO: 1333287 - DNA, 23 bp, Homo sapiens
acagaggacagtatttgtgggga

SEQ ID NO: 1333288 - DNA, 17 bp, Homo sapiens
acatggattccactgaa

SEQ ID NO: 1333289 - DNA, 11 bp, Homo sapiens
acgtcattcag

SEQ ID NO: 1333290 - DNA, 14 bp, Homo sapiens
actactatggctgt

SEQ ID NO: 1333291 - DNA, 14 bp, Homo sapiens
actatggctgttta

SEQ ID NO: 1333292 - DNA, 21 bp, Homo sapiens
actctggaggtttgtttagaa

SEQ ID NO: 1333293 - DNA, 18 bp, Homo sapiens
actgaaatagagtgaatt

SEQ ID NO: 1333294 - DNA, 19 bp, Homo sapiens
actgataacgtattttgat

SEQ ID NO: 1333295 - DNA, 16 bp, Homo sapiens
agaatgtcagtatgtg

SEQ ID NO: 1333296 - DNA, 19 bp, Homo sapiens
agaatgtcagtatgtggaa

SEQ ID NO: 1333297 - DNA, 19 bp, Homo sapiens
agagcacttttaacaaaaa

SEQ ID NO: 1333298 - DNA, 20 bp, Homo sapiens
agaggacagtatttgtgggg

SEQ ID NO: 1333299 - DNA, 19 bp, Homo sapiens
agctaattctttgacctgt

SEQ ID NO: 1333300 - DNA, 21 bp, Homo sapiens
agctgctttcgaataaagtga

SEQ ID NO: 1333301 - DNA, 16 bp, Homo sapiens
aggaactgctgggctt

SEQ ID NO: 1333302 - DNA, 13 bp, Homo sapiens
aggatgtctgggc

SEQ ID NO: 1333303 - DNA, 16 bp, Homo sapiens
aggcctgactctcagc

SEQ ID NO: 1333304 - DNA, 19 bp, Homo sapiens
aggctatggggatagatgt

SEQ ID NO: 1333305 - DNA, 22 bp, Homo sapiens
aggctatggggatagatgtgtg

SEQ ID NO: 1333306 - DNA, 17 bp, Homo sapiens
agtatgtggaagtgtgg

SEQ ID NO: 1333307 - DNA, 16 bp, Homo sapiens
agtggggtaggttggg

SEQ ID NO: 1333308 - DNA, 23 bp, Homo sapiens
agttgtatcagcacgtgtggcct

SEQ ID NO: 1333309 - DNA, 20 bp, Homo sapiens
ataaccaattcctcatttgt

SEQ ID NO: 1333310 - DNA, 19 bp, Homo sapiens
atagaaggctatggggata

SEQ ID NO: 1333311 - DNA, 11 bp, Homo sapiens
atagatgtgtg

SEQ ID NO: 1333312 - DNA, 21 bp, Homo sapiens
atattaaagactaactaaaat

SEQ ID NO: 1333313 - DNA, 16 bp, Homo sapiens
atcaggccattgtccc

SEQ ID NO: 1333314 - DNA, 20 bp, Homo sapiens
atcattatcagcctgtgcca

SEQ ID NO: 1333315 - DNA, 21 bp, Homo sapiens
atctgtgaggggctctctcat

SEQ ID NO: 1333316 - DNA, 22 bp, Homo sapiens
atctgtgaggggctctctcatg

SEQ ID NO: 1333317 - DNA, 18 bp, Homo sapiens
atgagttggctgggaata

SEQ ID NO: 1333318 - DNA, 17 bp, Homo sapiens
atgtatataaacatgct

SEQ ID NO: 1333319 - DNA, 13 bp, Homo sapiens
atgtcagtatgtg

SEQ ID NO: 1333320 - DNA, 16 bp, Homo sapiens
atgtggaagtgtgggt

SEQ ID NO: 1333321 - DNA, 22 bp, Homo sapiens
atgtggaagtgtgggtctgtgt

SEQ ID NO: 1333322 - DNA, 10 bp, Homo sapiens
atgtgtgtgt

SEQ ID NO: 1333323 - DNA, 18 bp, Homo sapiens
atgtgtgtgtgttgtgtg

SEQ ID NO: 1333324 - DNA, 22 bp, Homo sapiens
atgtgtgtgtgttgtgtgtggg

SEQ ID NO: 1333325 - DNA, 23 bp, Homo sapiens
atgtgtgtgtgttgtgtgtggga

SEQ ID NO: 1333326 - DNA, 17 bp, Homo sapiens
atgtttacagaggacag

SEQ ID NO: 1333327 - DNA, 19 bp, Homo sapiens
atgtttacagaggacagta

SEQ ID NO: 1333328 - DNA, 21 bp, Homo sapiens
attaaataacagtgtgtgacc

SEQ ID NO: 1333329 - DNA, 20 bp, Homo sapiens
attatgagtctctatgatct

SEQ ID NO: 1333330 - DNA, 22 bp, Homo sapiens
attatttcaaccgcttgccata

SEQ ID NO: 1333331 - DNA, 18 bp, Homo sapiens
attcctcatttgttcatt

SEQ ID NO: 1333332 - DNA, 15 bp, Homo sapiens
attgctaattctgag

SEQ ID NO: 1333333 - DNA, 18 bp, Homo sapiens
atttcaaccgcttgccat

SEQ ID NO: 1333334 - DNA, 20 bp, Homo sapiens
atttgctatgagctggggat

SEQ ID NO: 1333335 - DNA, 18 bp, Homo sapiens
atttgtaaatttatgtga

SEQ ID NO: 1333336 - DNA, 17 bp, Homo sapiens
caagccttggctctacc

SEQ ID NO: 1333337 - DNA, 18 bp, Homo sapiens
cactgaaatagagtgaat

SEQ ID NO: 1333338 - DNA, 16 bp, Homo sapiens
cagaaaagaaagctgc

SEQ ID NO: 1333339 - DNA, 20 bp, Homo sapiens
cagaaaagaaagctgctttc

SEQ ID NO: 1333340 - DNA, 22 bp, Homo sapiens
cagaggacagtatttgtgggga

SEQ ID NO: 1333341 - DNA, 23 bp, Homo sapiens
cagatcattatcagcctgtgcca

SEQ ID NO: 1333342 - DNA, 15 bp, Homo sapiens
cagtatttgtgggga

SEQ ID NO: 1333343 - DNA, 22 bp, Homo sapiens
cagtctttaatctgagaggcca

SEQ ID NO: 1333344 - DNA, 18 bp, Homo sapiens
cagtggctggatctgtga

SEQ ID NO: 1333345 - DNA, 18 bp, Homo sapiens
cataatcacaacccttca

SEQ ID NO: 1333346 - DNA, 13 bp, Homo sapiens
catcatgtttaca

SEQ ID NO: 1333347 - DNA, 21 bp, Homo sapiens
catcatgtttacagaggacag

SEQ ID NO: 1333348 - DNA, 19 bp, Homo sapiens
catggggctgattgtattt

SEQ ID NO: 1333349 - DNA, 22 bp, Homo sapiens
cattacctcagtgagaagccag

SEQ ID NO: 1333350 - DNA, 13 bp, Homo sapiens
ccattggtgttga

SEQ ID NO: 1333351 - DNA, 19 bp, Homo sapiens
cccaggctggagtgcagtg

SEQ ID NO: 1333352 - DNA, 17 bp, Homo sapiens
ccccaaaagtacttacc

SEQ ID NO: 1333353 - DNA, 24 bp, Homo sapiens
ccctgtgccttggtgtgctgtatc

SEQ ID NO: 1333354 - DNA, 22 bp, Homo sapiens
ccgggtcatctgtacctctgcc

SEQ ID NO: 1333355 - DNA, 15 bp, Homo sapiens
cctcatttgttcatt

SEQ ID NO: 1333356 - DNA, 15 bp, Homo sapiens
cctcttggctgcctt

SEQ ID NO: 1333357 - DNA, 19 bp, Homo sapiens
cctgaagagaagggcaggg

SEQ ID NO: 1333358 - DNA, 15 bp, Homo sapiens
cctgaattattccaa

SEQ ID NO: 1333359 - DNA, 14 bp, Homo sapiens
cctgactctcagca

SEQ ID NO: 1333360 - DNA, 19 bp, Homo sapiens
cctgaggaagagggactgt

SEQ ID NO: 1333361 - DNA, 18 bp, Homo sapiens
ccttaataaacgtccaca

SEQ ID NO: 1333362 - DNA, 16 bp, Homo sapiens
ctactatggctgttta

SEQ ID NO: 1333363 - DNA, 21 bp, Homo sapiens
ctatggggatagatgtgtgga

SEQ ID NO: 1333364 - DNA, 11 bp, Homo sapiens
ctcacttctgg

SEQ ID NO: 1333365 - DNA, 23 bp, Homo sapiens
ctcatgatagaaggctatgggga

SEQ ID NO: 1333366 - DNA, 15 bp, Homo sapiens
ctcattccagaggaa

SEQ ID NO: 1333367 - DNA, 17 bp, Homo sapiens
ctccattggtgttgaca

SEQ ID NO: 1333368 - DNA, 14 bp, Homo sapiens
ctgaacaatgaatg

SEQ ID NO: 1333369 - DNA, 21 bp, Homo sapiens
ctgaagagaagggcagggctg

SEQ ID NO: 1333370 - DNA, 12 bp, Homo sapiens
ctgagaggccac

SEQ ID NO: 1333371 - DNA, 18 bp, Homo sapiens
ctgaggccattatttcaa

SEQ ID NO: 1333372 - DNA, 11 bp, Homo sapiens
ctgctgggctt

SEQ ID NO: 1333373 - DNA, 18 bp, Homo sapiens
ctggatacagaatgaatc

SEQ ID NO: 1333374 - DNA, 14 bp, Homo sapiens
ctggatctgtgagg

SEQ ID NO: 1333375 - DNA, 18 bp, Homo sapiens
ctgggaataagtgccagg

SEQ ID NO: 1333376 - DNA, 21 bp, Homo sapiens
ctgtgactactatggctgttt

SEQ ID NO: 1333377 - DNA, 17 bp, Homo sapiens
ctgtgtgtttatgtgtg

SEQ ID NO: 1333378 - DNA, 20 bp, Homo sapiens
ctgtgtgtttatgtgtgtgt

SEQ ID NO: 1333379 - DNA, 23 bp, Homo sapiens
ctgttgttgaggtggtggtagtg

SEQ ID NO: 1333380 - DNA, 18 bp, Homo sapiens
ctgtttagaactactgat

SEQ ID NO: 1333381 - DNA, 13 bp, Homo sapiens
cttgttgtggagg

SEQ ID NO: 1333382 - DNA, 16 bp, Homo sapiens
cttttggcatgaaagt

SEQ ID NO: 1333383 - DNA, 17 bp, Homo sapiens
gaaaagaaagctgcttt

SEQ ID NO: 1333384 - DNA, 17 bp, Homo sapiens
gaaacaaatttttttct

SEQ ID NO: 1333385 - DNA, 21 bp, Homo sapiens
gaaagctgctttcgaataaag

SEQ ID NO: 1333386 - DNA, 13 bp, Homo sapiens
gaacaatgaatgc

SEQ ID NO: 1333387 - DNA, 17 bp, Homo sapiens
gaacatggattccactg

SEQ ID NO: 1333388 - DNA, 13 bp, Homo sapiens
gaagaagtgtgtc

SEQ ID NO: 1333389 - DNA, 17 bp, Homo sapiens
gaagagaagggcagggc

SEQ ID NO: 1333390 - DNA, 15 bp, Homo sapiens
gaaggctatggggat

SEQ ID NO: 1333391 - DNA, 17 bp, Homo sapiens
gaagtgtgggtctgtgt

SEQ ID NO: 1333392 - DNA, 20 bp, Homo sapiens
gaataagtgccaggatggaa

SEQ ID NO: 1333393 - DNA, 13 bp, Homo sapiens
gaatgtcagtatg

SEQ ID NO: 1333394 - DNA, 21 bp, Homo sapiens
gacagaaaagaaagctgcttt

SEQ ID NO: 1333395 - DNA, 15 bp, Homo sapiens
gacagtatttgtggg

SEQ ID NO: 1333396 - DNA, 17 bp, Homo sapiens
gacctttcctgaggaag

SEQ ID NO: 1333397 - DNA, 17 bp, Homo sapiens
gagaatgtcagtatgtg

SEQ ID NO: 1333398 - DNA, 16 bp, Homo sapiens
gagcacttttaacaaa

SEQ ID NO: 1333399 - DNA, 15 bp, Homo sapiens
gaggatgtctgggcc

SEQ ID NO: 1333400 - DNA, 22 bp, Homo sapiens
gaggcctctcattccagaggaa

SEQ ID NO: 1333401 - DNA, 23 bp, Homo sapiens
gagtgacctcacttctggcactg

SEQ ID NO: 1333402 - DNA, 13 bp, Homo sapiens
gatagatgtgtgg

SEQ ID NO: 1333403 - DNA, 20 bp, Homo sapiens
gatggcaaagaaggagagca

SEQ ID NO: 1333404 - DNA, 18 bp, Homo sapiens
gcattatatttgtaaatt

SEQ ID NO: 1333405 - DNA, 15 bp, Homo sapiens
gccacgattgcagga

SEQ ID NO: 1333406 - DNA, 17 bp, Homo sapiens
gccagagccttaataaa

SEQ ID NO: 1333407 - DNA, 14 bp, Homo sapiens
gccagtggctggat

SEQ ID NO: 1333408 - DNA, 23 bp, Homo sapiens
gccagtggctggatctgtgaggg

SEQ ID NO: 1333409 - DNA, 19 bp, Homo sapiens
gcctctcattccagaggaa

SEQ ID NO: 1333410 - DNA, 20 bp, Homo sapiens
gctatctactgagacatgac

SEQ ID NO: 1333411 - DNA, 20 bp, Homo sapiens
gctggagtgcagtggtgcga

SEQ ID NO: 1333412 - DNA, 13 bp, Homo sapiens
gctggatctgtga

SEQ ID NO: 1333413 - DNA, 19 bp, Homo sapiens
gctttcctcatcaggccat

SEQ ID NO: 1333414 - DNA, 18 bp, Homo sapiens
gcttttttttgagaatac

SEQ ID NO: 1333415 - DNA, 21 bp, Homo sapiens
ggaagtgtgggtctgtgtgtg

SEQ ID NO: 1333416 - DNA, 22 bp, Homo sapiens
ggaagtgtgggtctgtgtgtgt

SEQ ID NO: 1333417 - DNA, 19 bp, Homo sapiens
ggacagtatttgtggggag

SEQ ID NO: 1333418 - DNA, 17 bp, Homo sapiens
ggatggaatgatgggtc

SEQ ID NO: 1333419 - DNA, 16 bp, Homo sapiens
ggcctgactctcagca

SEQ ID NO: 1333420 - DNA, 21 bp, Homo sapiens
ggctatggggatagatgtgtg

SEQ ID NO: 1333421 - DNA, 17 bp, Homo sapiens
ggctggatctgtgaggg

SEQ ID NO: 1333422 - DNA, 20 bp, Homo sapiens
gggacagaaaagaaagctgc

SEQ ID NO: 1333423 - DNA, 22 bp, Homo sapiens
gggagaatgtcagtatgtggaa

SEQ ID NO: 1333424 - DNA, 13 bp, Homo sapiens
gggatagatgtgt

SEQ ID NO: 1333425 - DNA, 14 bp, Homo sapiens
gggatgtctctcat

SEQ ID NO: 1333426 - DNA, 13 bp, Homo sapiens
ggggatagatgtg

SEQ ID NO: 1333427 - DNA, 18 bp, Homo sapiens
gggtcattcatggcctgg

SEQ ID NO: 1333428 - DNA, 18 bp, Homo sapiens
ggtaggaactgctgggct

SEQ ID NO: 1333429 - DNA, 21 bp, Homo sapiens
ggtctgtgtgtgtgtatgtgg

SEQ ID NO: 1333430 - DNA, 19 bp, Homo sapiens
ggttgggagaatgtcagta

SEQ ID NO: 1333431 - DNA, 17 bp, Homo sapiens
gtaaatttatgtgatgg

SEQ ID NO: 1333432 - DNA, 19 bp, Homo sapiens
gtaatttaaaattgtgatg

SEQ ID NO: 1333433 - DNA, 20 bp, Homo sapiens
gtaatttaaaattgtgatgt

SEQ ID NO: 1333434 - DNA, 19 bp, Homo sapiens
gtacttttggcatgaaagt

SEQ ID NO: 1333435 - DNA, 15 bp, Homo sapiens
gtagagccagaggtc

SEQ ID NO: 1333436 - DNA, 16 bp, Homo sapiens
gtaggaactgctgggc

SEQ ID NO: 1333437 - DNA, 16 bp, Homo sapiens
gtatgtggaagtgtgg

SEQ ID NO: 1333438 - DNA, 17 bp, Homo sapiens
gtatgtggaagtgtggg

SEQ ID NO: 1333439 - DNA, 17 bp, Homo sapiens
gtcagtatgtggaagtg

SEQ ID NO: 1333440 - DNA, 21 bp, Homo sapiens
gtcagtatgtggaagtgtggg

SEQ ID NO: 1333441 - DNA, 13 bp, Homo sapiens
gtcagttgtatca

SEQ ID NO: 1333442 - DNA, 12 bp, Homo sapiens
gtctgtgtgtgt

SEQ ID NO: 1333443 - DNA, 20 bp, Homo sapiens
gtctgtgtgtgtgtatgtgg

SEQ ID NO: 1333444 - DNA, 14 bp, Homo sapiens
gtgccttttgccat

SEQ ID NO: 1333445 - DNA, 21 bp, Homo sapiens
gtggaagtgtgggtctgtgtg

SEQ ID NO: 1333446 - DNA, 22 bp, Homo sapiens
gtggaagtgtgggtctgtgtgt

SEQ ID NO: 1333447 - DNA, 16 bp, Homo sapiens
gtggacatcatgaagc

SEQ ID NO: 1333448 - DNA, 13 bp, Homo sapiens
gtgggtctgtgtg

SEQ ID NO: 1333449 - DNA, 13 bp, Homo sapiens
gtgtatgtggggg

SEQ ID NO: 1333450 - DNA, 13 bp, Homo sapiens
gtgtgtatgtggg

SEQ ID NO: 1333451 - DNA, 13 bp, Homo sapiens
gtgtgtgtatgtg

SEQ ID NO: 1333452 - DNA, 12 bp, Homo sapiens
gtgtttatgtgt

SEQ ID NO: 1333453 - DNA, 20 bp, Homo sapiens
gttaaaggaagtttgttcac

SEQ ID NO: 1333454 - DNA, 10 bp, Homo sapiens
gttcattaaa

SEQ ID NO: 1333455 - DNA, 12 bp, Homo sapiens
gttgtgtgtggg

SEQ ID NO: 1333456 - DNA, 13 bp, Homo sapiens
gttgtgtgtggga

SEQ ID NO: 1333457 - DNA, 16 bp, Homo sapiens
gttgtgtgtgggagtg

SEQ ID NO: 1333458 - DNA, 16 bp, Homo sapiens
gtttagaagaagtgtg

SEQ ID NO: 1333459 - DNA, 17 bp, Homo sapiens
taaaattcttgggagtg

SEQ ID NO: 1333460 - DNA, 13 bp, Homo sapiens
taaatttatgtga

SEQ ID NO: 1333461 - DNA, 14 bp, Homo sapiens
taacgtattttgat

SEQ ID NO: 1333462 - DNA, 22 bp, Homo sapiens
taagtgccaggatggaatgatg

SEQ ID NO: 1333463 - DNA, 19 bp, Homo sapiens
taatttaaaattgtgatgt

SEQ ID NO: 1333464 - DNA, 17 bp, Homo sapiens
tagctgaacaatgaatg

SEQ ID NO: 1333465 - DNA, 17 bp, Homo sapiens
tatggggatagatgtgt

SEQ ID NO: 1333466 - DNA, 20 bp, Homo sapiens
tatggggatagatgtgtgga

SEQ ID NO: 1333467 - DNA, 23 bp, Homo sapiens
tatgtgtgtgtgttgtgtgtggg

SEQ ID NO: 1333468 - DNA, 12 bp, Homo sapiens
tatttccttaaa

SEQ ID NO: 1333469 - DNA, 16 bp, Homo sapiens
tatttgtaaatttatg

SEQ ID NO: 1333470 - DNA, 22 bp, Homo sapiens
tcacttctggcactgtgactac

SEQ ID NO: 1333471 - DNA, 20 bp, Homo sapiens
tcagatcattatcagcctgt

SEQ ID NO: 1333472 - DNA, 12 bp, Homo sapiens
tcagtatgtgga

SEQ ID NO: 1333473 - DNA, 18 bp, Homo sapiens
tcatttgttcattaaacg

SEQ ID NO: 1333474 - DNA, 23 bp, Homo sapiens
tccagttcacaggccagaaaaca

SEQ ID NO: 1333475 - DNA, 19 bp, Homo sapiens
tcctgtccctcatccatag

SEQ ID NO: 1333476 - DNA, 22 bp, Homo sapiens
tccttaaaatgtgagtgacctc

SEQ ID NO: 1333477 - DNA, 18 bp, Homo sapiens
tctgagggaatttaacca

SEQ ID NO: 1333478 - DNA, 13 bp, Homo sapiens
tctgtgtgtgtgt

SEQ ID NO: 1333479 - DNA, 19 bp, Homo sapiens
tctgtgtgtgtgtatgtgg

SEQ ID NO: 1333480 - DNA, 22 bp, Homo sapiens
tctgtgtgtgtgtatgtggggg

SEQ ID NO: 1333481 - DNA, 13 bp, Homo sapiens
tcttctcggggac

SEQ ID NO: 1333482 - DNA, 16 bp, Homo sapiens
tgaattgctaattctg

SEQ ID NO: 1333483 - DNA, 15 bp, Homo sapiens
tgacctcacttctgg

SEQ ID NO: 1333484 - DNA, 24 bp, Homo sapiens
tgataagcagtcatcctcagatca

SEQ ID NO: 1333485 - DNA, 16 bp, Homo sapiens
tgcacccatgccatag

SEQ ID NO: 1333486 - DNA, 16 bp, Homo sapiens
tgccatcatgtttaca

SEQ ID NO: 1333487 - DNA, 14 bp, Homo sapiens
tgctaattctgagg

SEQ ID NO: 1333488 - DNA, 22 bp, Homo sapiens
tgctatgagctggggatgtctc

SEQ ID NO: 1333489 - DNA, 22 bp, Homo sapiens
tgctattgtagagccagaggtc

SEQ ID NO: 1333490 - DNA, 20 bp, Homo sapiens
tggaatgatgggtcagttgt

SEQ ID NO: 1333491 - DNA, 14 bp, Homo sapiens
tggccagtggctgg

SEQ ID NO: 1333492 - DNA, 15 bp, Homo sapiens
tggccagtggctgga

SEQ ID NO: 1333493 - DNA, 23 bp, Homo sapiens
tggccagtggctggatctgtgag

SEQ ID NO: 1333494 - DNA, 23 bp, Homo sapiens
tgggaataagtgccaggatggaa

SEQ ID NO: 1333495 - DNA, 11 bp, Homo sapiens
tgggagtgtgt

SEQ ID NO: 1333496 - DNA, 14 bp, Homo sapiens
tggggagggatttg

SEQ ID NO: 1333497 - DNA, 22 bp, Homo sapiens
tggggagggatttggggctcag

SEQ ID NO: 1333498 - DNA, 16 bp, Homo sapiens
tggggatagatgtgtg

SEQ ID NO: 1333499 - DNA, 17 bp, Homo sapiens
tggggatagatgtgtgg

SEQ ID NO: 1333500 - DNA, 20 bp, Homo sapiens
tggggatagatgtgtggaca

SEQ ID NO: 1333501 - DNA, 15 bp, Homo sapiens
tggggctcagagtgg

SEQ ID NO: 1333502 - DNA, 11 bp, Homo sapiens
tgggggatgta

SEQ ID NO: 1333503 - DNA, 18 bp, Homo sapiens
tgggggtctgtgtgttta

SEQ ID NO: 1333504 - DNA, 21 bp, Homo sapiens
tggggtaggttgggagaatgt

SEQ ID NO: 1333505 - DNA, 15 bp, Homo sapiens
tgtaaatttatgtga

SEQ ID NO: 1333506 - DNA, 21 bp, Homo sapiens
tgtaatttaaaattgtgatgt

SEQ ID NO: 1333507 - DNA, 22 bp, Homo sapiens
tgtaatttaaaattgtgatgtg

SEQ ID NO: 1333508 - DNA, 22 bp, Homo sapiens
tgtatccatccatggggctgat

SEQ ID NO: 1333509 - DNA, 20 bp, Homo sapiens
tgtatgtgggggtctgtgtg

SEQ ID NO: 1333510 - DNA, 21 bp, Homo sapiens
tgtatgtgggggtctgtgtgt

SEQ ID NO: 1333511 - DNA, 22 bp, Homo sapiens
tgtatgtgggggtctgtgtgtt

SEQ ID NO: 1333512 - DNA, 16 bp, Homo sapiens
tgtgggtctgtgtgtg

SEQ ID NO: 1333513 - DNA, 11 bp, Homo sapiens
tgtgtaattta

SEQ ID NO: 1333514 - DNA, 22 bp, Homo sapiens
tgtgtaatttaaaattgtgatg

SEQ ID NO: 1333515 - DNA, 20 bp, Homo sapiens
tgtgtagggcttttttttga

SEQ ID NO: 1333516 - DNA, 11 bp, Homo sapiens
tgtgtatgtgg

SEQ ID NO: 1333517 - DNA, 13 bp, Homo sapiens
tgtgtatgtgggg

SEQ ID NO: 1333518 - DNA, 23 bp, Homo sapiens
tgtgtatgtgggggtctgtgtgt

SEQ ID NO: 1333519 - DNA, 14 bp, Homo sapiens
tgtgtgggagtgtg

SEQ ID NO: 1333520 - DNA, 15 bp, Homo sapiens
tgtgtgggagtgtgt

SEQ ID NO: 1333521 - DNA, 11 bp, Homo sapiens
tgtgtgtatgt

SEQ ID NO: 1333522 - DNA, 14 bp, Homo sapiens
tgtgtgtgtatgtg

SEQ ID NO: 1333523 - DNA, 13 bp, Homo sapiens
tgtgtttatgtgt

SEQ ID NO: 1333524 - DNA, 15 bp, Homo sapiens
tgtgtttatgtgtgt

SEQ ID NO: 1333525 - DNA, 21 bp, Homo sapiens
tgttcattaaacgtcattcag

SEQ ID NO: 1333526 - DNA, 16 bp, Homo sapiens
tgttcttttgtcccag

SEQ ID NO: 1333527 - DNA, 14 bp, Homo sapiens
tgttgtgtgtggga

SEQ ID NO: 1333528 - DNA, 19 bp, Homo sapiens
tgtttagaactactgataa

SEQ ID NO: 1333529 - DNA, 13 bp, Homo sapiens
tgtttatgtgtgt

SEQ ID NO: 1333530 - DNA, 15 bp, Homo sapiens
ttacagaggacagta

SEQ ID NO: 1333531 - DNA, 23 bp, Homo sapiens
ttagaaacaaatttttttcttgt

SEQ ID NO: 1333532 - DNA, 14 bp, Homo sapiens
ttagaagaagtgtg

SEQ ID NO: 1333533 - DNA, 16 bp, Homo sapiens
ttagaagaagtgtgtc

SEQ ID NO: 1333534 - DNA, 16 bp, Homo sapiens
ttagcctttgtcccag

SEQ ID NO: 1333535 - DNA, 14 bp, Homo sapiens
ttatcaacatttgt

SEQ ID NO: 1333536 - DNA, 22 bp, Homo sapiens
ttatttcaaccgcttgccatat

SEQ ID NO: 1333537 - DNA, 22 bp, Homo sapiens
ttcagaagacacaggggagcag

SEQ ID NO: 1333538 - DNA, 16 bp, Homo sapiens
ttcagatttgccttat

SEQ ID NO: 1333539 - DNA, 21 bp, Homo sapiens
ttccactgaaatagagtgaat

SEQ ID NO: 1333540 - DNA, 12 bp, Homo sapiens
ttcctcatttgt

SEQ ID NO: 1333541 - DNA, 21 bp, Homo sapiens
ttcctgaggaagagggactgt

SEQ ID NO: 1333542 - DNA, 17 bp, Homo sapiens
ttcgaataaagtgaata

SEQ ID NO: 1333543 - DNA, 22 bp, Homo sapiens
ttctatgaattgctaattctga

SEQ ID NO: 1333544 - DNA, 20 bp, Homo sapiens
ttgctatgagctggggatgt

SEQ ID NO: 1333545 - DNA, 16 bp, Homo sapiens
ttggcagctctactct

SEQ ID NO: 1333546 - DNA, 21 bp, Homo sapiens
ttgtacttttggcatgaaagt

SEQ ID NO: 1333547 - DNA, 13 bp, Homo sapiens
ttgtgtgtgggag

SEQ ID NO: 1333548 - DNA, 19 bp, Homo sapiens
tttagaagaagtgtgtcac

SEQ ID NO: 1333549 - DNA, 11 bp, Homo sapiens
tttatgtgtgt

SEQ ID NO: 1333550 - DNA, 23 bp, Homo sapiens
tttgacctgttgggagtgaggat

SEQ ID NO: 1333551 - DNA, 11 bp, Homo sapiens
tttgtggggag

SEQ ID NO: 1333552 - DNA, 21 bp, Homo sapiens
aggctatggggatagatgtgt

SEQ ID NO: 1333553 - DNA, 22 bp, Homo sapiens
agggatttggggctcagagtgg

SEQ ID NO: 1333554 - DNA, 23 bp, Homo sapiens
aggtttgtttagaagaagtgtgt

SEQ ID NO: 1333555 - DNA, 15 bp, Homo sapiens
agtatgtggaagtgt

SEQ ID NO: 1333556 - DNA, 14 bp, Homo sapiens
agtatttgtgggga

SEQ ID NO: 1333557 - DNA, 17 bp, Homo sapiens
agtgacctcacttctgg

SEQ ID NO: 1333558 - DNA, 22 bp, Homo sapiens
agtgcagtggtgcgatcttggc

SEQ ID NO: 1333559 - DNA, 18 bp, Homo sapiens
agtgtccccaaagactac

SEQ ID NO: 1333560 - DNA, 16 bp, Homo sapiens
agtgtgggtctgtgtg

SEQ ID NO: 1333561 - DNA, 17 bp, Homo sapiens
agtgtgggtctgtgtgt

SEQ ID NO: 1333562 - DNA, 18 bp, Homo sapiens
agttcataaatttatggt

SEQ ID NO: 1333563 - DNA, 20 bp, Homo sapiens
agttgtatcagcacgtgtgg

SEQ ID NO: 1333564 - DNA, 16 bp, Homo sapiens
ataaccttcatgatga

SEQ ID NO: 1333565 - DNA, 14 bp, Homo sapiens
atacagaatgaatc

SEQ ID NO: 1333566 - DNA, 12 bp, Homo sapiens
atagagtgaatt

SEQ ID NO: 1333567 - DNA, 14 bp, Homo sapiens
atcagcctgtgcca

SEQ ID NO: 1333568 - DNA, 23 bp, Homo sapiens
atgtggaagtgtgggtctgtgtg

SEQ ID NO: 1333569 - DNA, 14 bp, Homo sapiens
atgtgtagttaatt

SEQ ID NO: 1333570 - DNA, 16 bp, Homo sapiens
attaaacgtcattcag

SEQ ID NO: 1333571 - DNA, 17 bp, Homo sapiens
attcatggcctggggga

SEQ ID NO: 1333572 - DNA, 12 bp, Homo sapiens
attccagaggaa

SEQ ID NO: 1333573 - DNA, 13 bp, Homo sapiens
attcctcatttgt

SEQ ID NO: 1333574 - DNA, 19 bp, Homo sapiens
attcctcatttgttcatta

SEQ ID NO: 1333575 - DNA, 23 bp, Homo sapiens
attcctcatttgttcattaaacg

SEQ ID NO: 1333576 - DNA, 19 bp, Homo sapiens
attctttgacctgttggga

SEQ ID NO: 1333577 - DNA, 23 bp, Homo sapiens
attgcaggagtccctgccatcat

SEQ ID NO: 1333578 - DNA, 12 bp, Homo sapiens
attggtgttgac

SEQ ID NO: 1333579 - DNA, 18 bp, Homo sapiens
attgtagagccagaggtc

SEQ ID NO: 1333580 - DNA, 20 bp, Homo sapiens
atttaaaattgtgatgtgtc

SEQ ID NO: 1333581 - DNA, 16 bp, Homo sapiens
atttgctatgagctgg

SEQ ID NO: 1333582 - DNA, 22 bp, Homo sapiens
atttgtggggagggatttgggg

SEQ ID NO: 1333583 - DNA, 16 bp, Homo sapiens
caaccgcttgccatat

SEQ ID NO: 1333584 - DNA, 16 bp, Homo sapiens
cacagagtataaataa

SEQ ID NO: 1333585 - DNA, 19 bp, Homo sapiens
cacgtgtggcctgttcttc

SEQ ID NO: 1333586 - DNA, 14 bp, Homo sapiens
cactgaaatagagt

SEQ ID NO: 1333587 - DNA, 20 bp, Homo sapiens
atggggatagatgtgtggac

SEQ ID NO: 1333588 - DNA, 16 bp, Homo sapiens
atggttctcaggcctg

SEQ ID NO: 1333589 - DNA, 13 bp, Homo sapiens
atgtggaagtgtg

SEQ ID NO: 1333590 - DNA, 10 bp, Homo sapiens
aaaagaaagc

SEQ ID NO: 1333591 - DNA, 16 bp, Homo sapiens
aaagactaactaaaat

SEQ ID NO: 1333592 - DNA, 16 bp, Homo sapiens
aaatcagttatgtcaa

SEQ ID NO: 1333593 - DNA, 15 bp, Homo sapiens
aaatttatgtgatgg

SEQ ID NO: 1333594 - DNA, 11 bp, Homo sapiens
aacaatgaatg

SEQ ID NO: 1333595 - DNA, 22 bp, Homo sapiens
aacaattaattttctatgaatt

SEQ ID NO: 1333596 - DNA, 22 bp, Homo sapiens
aacgtattttgatgttttgtac

SEQ ID NO: 1333597 - DNA, 18 bp, Homo sapiens
aacgtcattcagtactta

SEQ ID NO: 1333598 - DNA, 10 bp, Homo sapiens
aagtgtgggt

SEQ ID NO: 1333599 - DNA, 18 bp, Homo sapiens
aagtgtgggtctgtgtgt

SEQ ID NO: 1333600 - DNA, 13 bp, Homo sapiens
aatgtcagtatgt

SEQ ID NO: 1333601 - DNA, 15 bp, Homo sapiens
aatgtcagtatgtgg

SEQ ID NO: 1333602 - DNA, 16 bp, Homo sapiens
aatgtcagtatgtgga

SEQ ID NO: 1333603 - DNA, 14 bp, Homo sapiens
aattcctcatttgt

SEQ ID NO: 1333604 - DNA, 23 bp, Homo sapiens
aattcctcatttgttcattaaac

SEQ ID NO: 1333605 - DNA, 17 bp, Homo sapiens
aattctgagggaattta

SEQ ID NO: 1333606 - DNA, 22 bp, Homo sapiens
aattctttgacctgttgggagt

SEQ ID NO: 1333607 - DNA, 14 bp, Homo sapiens
aattgctaattctg

SEQ ID NO: 1333608 - DNA, 16 bp, Homo sapiens
aattgctaattctgag

SEQ ID NO: 1333609 - DNA, 14 bp, Homo sapiens
aattgtgatgtgtc

SEQ ID NO: 1333610 - DNA, 20 bp, Homo sapiens
acgtccacagagtataaata

SEQ ID NO: 1333611 - DNA, 17 bp, Homo sapiens
acgtgtctttagaactc

SEQ ID NO: 1333612 - DNA, 20 bp, Homo sapiens
acttacatctttgtttacca

SEQ ID NO: 1333613 - DNA, 18 bp, Homo sapiens
agaaaagaaagctgcttt

SEQ ID NO: 1333614 - DNA, 14 bp, Homo sapiens
agaagaagtgtgtc

SEQ ID NO: 1333615 - DNA, 17 bp, Homo sapiens
agaatgtcagtatgtgg

SEQ ID NO: 1333616 - DNA, 21 bp, Homo sapiens
agacatttgctatgagctggg

SEQ ID NO: 1333617 - DNA, 13 bp, Homo sapiens
agcatctcccagt

SEQ ID NO: 1333618 - DNA, 12 bp, Homo sapiens
agccttaataaa

SEQ ID NO: 1333619 - DNA, 14 bp, Homo sapiens
agctgagcaggtgt

SEQ ID NO: 1333620 - DNA, 19 bp, Homo sapiens
agctgctttcgaataaagt

SEQ ID NO: 1333621 - DNA, 22 bp, Homo sapiens
aggaactgctgggcttggcagc

SEQ ID NO: 1333622 - DNA, 12 bp, Homo sapiens
aggacagtattt

SEQ ID NO: 1333623 - DNA, 21 bp, Homo sapiens
aggagtccctgccatcatgtt

SEQ ID NO: 1333624 - DNA, 21 bp, Homo sapiens
aggcctctcattccagaggaa

SEQ ID NO: 1333625 - DNA, 12 bp, Homo sapiens
aaaaaaataata

SEQ ID NO: 1333626 - DNA, 19 bp, Homo sapiens
aaactgaggccattatttc

SEQ ID NO: 1333627 - DNA, 12 bp, Homo sapiens
aaatttatgtga

SEQ ID NO: 1333628 - DNA, 17 bp, Homo sapiens
aacctgaattattccaa

SEQ ID NO: 1333629 - DNA, 22 bp, Homo sapiens
aaccttcatgatgaattacttc

SEQ ID NO: 1333630 - DNA, 13 bp, Homo sapiens
aacgtattttgat

SEQ ID NO: 1333631 - DNA, 12 bp, Homo sapiens
aacgtcattcag

SEQ ID NO: 1333632 - DNA, 19 bp, Homo sapiens
aagaagtgtgtcaccctta

SEQ ID NO: 1333633 - DNA, 15 bp, Homo sapiens
aagactaactaaaat

SEQ ID NO: 1333634 - DNA, 22 bp, Homo sapiens
aagcactgtttaactgggagtg

SEQ ID NO: 1333635 - DNA, 15 bp, Homo sapiens
aagggacagaaaaga

SEQ ID NO: 1333636 - DNA, 16 bp, Homo sapiens
aataaagtgaatacat

SEQ ID NO: 1333637 - DNA, 20 bp, Homo sapiens
aataaccaattcctcatttg

SEQ ID NO: 1333638 - DNA, 17 bp, Homo sapiens
aataagtgccaggatgg

SEQ ID NO: 1333639 - DNA, 23 bp, Homo sapiens
aatgtgagtgacctcacttctgg

SEQ ID NO: 1333640 - DNA, 15 bp, Homo sapiens
aattcctcatttgtt

SEQ ID NO: 1333641 - DNA, 17 bp, Homo sapiens
aatttaaccagcaacat

SEQ ID NO: 1333642 - DNA, 14 bp, Homo sapiens
acagaaaagaaagc

SEQ ID NO: 1333643 - DNA, 17 bp, Homo sapiens
accaattcctcatttgt

SEQ ID NO: 1333644 - DNA, 13 bp, Homo sapiens
acccatgccatag

SEQ ID NO: 1333645 - DNA, 19 bp, Homo sapiens
acctcacttctggcactgt

SEQ ID NO: 1333646 - DNA, 22 bp, Homo sapiens
actactgataacgtattttgat

SEQ ID NO: 1333647 - DNA, 13 bp, Homo sapiens
actcagtctttaa

SEQ ID NO: 1333648 - DNA, 15 bp, Homo sapiens
actgaggccattatt

SEQ ID NO: 1333649 - DNA, 23 bp, Homo sapiens
actggccagtggctggatctgtg

SEQ ID NO: 1333650 - DNA, 18 bp, Homo sapiens
acttttggcatgaaagtg

SEQ ID NO: 1333651 - DNA, 14 bp, Homo sapiens
agaactactgataa

SEQ ID NO: 1333652 - DNA, 13 bp, Homo sapiens
agaatgtcagtat

SEQ ID NO: 1333653 - DNA, 14 bp, Homo sapiens
agacttatcaacat

SEQ ID NO: 1333654 - DNA, 15 bp, Homo sapiens
agagtgaattatatt

SEQ ID NO: 1333655 - DNA, 18 bp, Homo sapiens
agcaagggacagaaaaga

SEQ ID NO: 1333656 - DNA, 14 bp, Homo sapiens
agctgcctgtgcct

SEQ ID NO: 1333657 - DNA, 15 bp, Homo sapiens
agctggggatgtctc

SEQ ID NO: 1333658 - DNA, 18 bp, Homo sapiens
agggacagaaaagaaagc

SEQ ID NO: 1333659 - DNA, 21 bp, Homo sapiens
agggcttttttttgagaatac

SEQ ID NO: 1333660 - DNA, 23 bp, Homo sapiens
aggttgggagaatgtcagtatgt

SEQ ID NO: 1333661 - DNA, 19 bp, Homo sapiens
agtatgtggaagtgtgggt

SEQ ID NO: 1333662 - DNA, 18 bp, Homo sapiens
agtctctatgatcttggc

SEQ ID NO: 1333663 - DNA, 17 bp, Homo sapiens
agtgaatacattttgca

SEQ ID NO: 1333664 - DNA, 14 bp, Homo sapiens
agtgaggatgtctg

SEQ ID NO: 1333665 - DNA, 19 bp, Homo sapiens
agtgtgggtctgtgtgtgt

SEQ ID NO: 1333666 - DNA, 23 bp, Homo sapiens
agtgtgggtctgtgtgtgtgtat

SEQ ID NO: 1333667 - DNA, 12 bp, Homo sapiens
atagatgtgtgg

SEQ ID NO: 1333668 - DNA, 13 bp, Homo sapiens
atagatgtgtgga

SEQ ID NO: 1333669 - DNA, 20 bp, Homo sapiens
atatttgtaaatttatgtga

SEQ ID NO: 1333670 - DNA, 19 bp, Homo sapiens
atccatagcacctccacat

SEQ ID NO: 1333671 - DNA, 17 bp, Homo sapiens
atcgctgccttgccatg

SEQ ID NO: 1333672 - DNA, 16 bp, Homo sapiens
atctgtacctctgcct

SEQ ID NO: 1333673 - DNA, 19 bp, Homo sapiens
aggctggcgagagtctggc

SEQ ID NO: 1333674 - DNA, 20 bp, Homo sapiens
aggctggcgagagtctggcc

SEQ ID NO: 1333675 - DNA, 12 bp, Homo sapiens
aggctgggccat

SEQ ID NO: 1333676 - DNA, 17 bp, Homo sapiens
aggctgtgctgccctga

SEQ ID NO: 1333677 - DNA, 21 bp, Homo sapiens
aggctgtgctgccctgaagaa

SEQ ID NO: 1333678 - DNA, 16 bp, Homo sapiens
aggctgtggtcacagc

SEQ ID NO: 1333679 - DNA, 20 bp, Homo sapiens
aggctgttcccatgtagccc

SEQ ID NO: 1333680 - DNA, 10 bp, Homo sapiens
aggcttcctg

SEQ ID NO: 1333681 - DNA, 15 bp, Homo sapiens
aggcttctccgccag

SEQ ID NO: 1333682 - DNA, 19 bp, Homo sapiens
aggcttctccgccagcctc

SEQ ID NO: 1333683 - DNA, 22 bp, Homo sapiens
aggcttctccgccagcctcctc

SEQ ID NO: 1333684 - DNA, 13 bp, Homo sapiens
agggaaaaatata

SEQ ID NO: 1333685 - DNA, 15 bp, Homo sapiens
agggaaaggggtgct

SEQ ID NO: 1333686 - DNA, 18 bp, Homo sapiens
agggaaaggggtgctttt

SEQ ID NO: 1333687 - DNA, 13 bp, Homo sapiens
agggaaatgtttt

SEQ ID NO: 1333688 - DNA, 18 bp, Homo sapiens
agggaaatgttttgtaaa

SEQ ID NO: 1333689 - DNA, 20 bp, Homo sapiens
agggaacaagttgagctatg

SEQ ID NO: 1333690 - DNA, 13 bp, Homo sapiens
agggaactgggga

SEQ ID NO: 1333691 - DNA, 12 bp, Homo sapiens
agggaagaaact

SEQ ID NO: 1333692 - DNA, 22 bp, Homo sapiens
agggaccggcggaccccagcca

SEQ ID NO: 1333693 - DNA, 19 bp, Homo sapiens
agggacggccaagaatgta

SEQ ID NO: 1333694 - DNA, 11 bp, Homo sapiens
agggagagaga

SEQ ID NO: 1333695 - DNA, 22 bp, Homo sapiens
agggagagagagagagagagga

SEQ ID NO: 1333696 - DNA, 23 bp, Homo sapiens
agggagagagagagagagaggac

SEQ ID NO: 1333697 - DNA, 14 bp, Homo sapiens
agggagctgggccc

SEQ ID NO: 1333698 - DNA, 16 bp, Homo sapiens
agggagctgggcccga

SEQ ID NO: 1333699 - DNA, 16 bp, Homo sapiens
agggaggccccagggg

SEQ ID NO: 1333700 - DNA, 18 bp, Homo sapiens
agggaggcgggggctgcc

SEQ ID NO: 1333701 - DNA, 19 bp, Homo sapiens
agggaggggccggccctgt

SEQ ID NO: 1333702 - DNA, 23 bp, Homo sapiens
agggaggggccggccctgtgtgc

SEQ ID NO: 1333703 - DNA, 21 bp, Homo sapiens
agggataaagaaaaaaatact

SEQ ID NO: 1333704 - DNA, 19 bp, Homo sapiens
agggcaagctccgcaggac

SEQ ID NO: 1333705 - DNA, 21 bp, Homo sapiens
agggcaagctccgcaggactt

SEQ ID NO: 1333706 - DNA, 13 bp, Homo sapiens
agggcataaagta

SEQ ID NO: 1333707 - DNA, 15 bp, Homo sapiens
agggcataaagtaaa

SEQ ID NO: 1333708 - DNA, 22 bp, Homo sapiens
agggccatgctgaggcctgggc

SEQ ID NO: 1333709 - DNA, 14 bp, Homo sapiens
agggccatggctca

SEQ ID NO: 1333710 - DNA, 13 bp, Homo sapiens
agggcccccacag

SEQ ID NO: 1333711 - DNA, 15 bp, Homo sapiens
agggccttttctggc

SEQ ID NO: 1333712 - DNA, 20 bp, Homo sapiens
agggccttttctggcaccgc

SEQ ID NO: 1333713 - DNA, 13 bp, Homo sapiens
agggcggcagggg

SEQ ID NO: 1333714 - DNA, 16 bp, Homo sapiens
agggcggcaggggcct

SEQ ID NO: 1333715 - DNA, 18 bp, Homo sapiens
agggcggcaggggcctgg

SEQ ID NO: 1333716 - DNA, 19 bp, Homo sapiens
agggcggcaggggcctgga

SEQ ID NO: 1333717 - DNA, 12 bp, Homo sapiens
agggctgcagtt

SEQ ID NO: 1333718 - DNA, 17 bp, Homo sapiens
agggctggctcctgatc

SEQ ID NO: 1333719 - DNA, 15 bp, Homo sapiens
agggctgtcattgca

SEQ ID NO: 1333720 - DNA, 12 bp, Homo sapiens
agggcttcctct

SEQ ID NO: 1333721 - DNA, 20 bp, Homo sapiens
agggcttcctctagaagcca

SEQ ID NO: 1333722 - DNA, 14 bp, Homo sapiens
agggcttgtagttc

SEQ ID NO: 1333723 - DNA, 19 bp, Homo sapiens
agggcttgtagttctttaa

SEQ ID NO: 1333724 - DNA, 22 bp, Homo sapiens
aggggaaaatcagcctgctcca

SEQ ID NO: 1333725 - DNA, 13 bp, Homo sapiens
aggggaagaatga

SEQ ID NO: 1333726 - DNA, 22 bp, Homo sapiens
aggggacaagggatttgaggtg

SEQ ID NO: 1333727 - DNA, 15 bp, Homo sapiens
aggggagactttgat

SEQ ID NO: 1333728 - DNA, 16 bp, Homo sapiens
aggggagagcctgctg

SEQ ID NO: 1333729 - DNA, 15 bp, Homo sapiens
aggggccggccctgt

SEQ ID NO: 1333730 - DNA, 14 bp, Homo sapiens
aggggcctggagat

SEQ ID NO: 1333731 - DNA, 20 bp, Homo sapiens
aggggctgcttcctcctgga

SEQ ID NO: 1333732 - DNA, 21 bp, Homo sapiens
aggggctgcttcctcctggaa

SEQ ID NO: 1333733 - DNA, 19 bp, Homo sapiens
agggggatccgactgcttt

SEQ ID NO: 1333734 - DNA, 21 bp, Homo sapiens
aggggtatcatgtatggtgat

SEQ ID NO: 1333735 - DNA, 18 bp, Homo sapiens
aggggtctccctggctcc

SEQ ID NO: 1333736 - DNA, 20 bp, Homo sapiens
aggggttcctcaaatttttt

SEQ ID NO: 1333737 - DNA, 22 bp, Homo sapiens
agggtaaataaaccactgtgcg

SEQ ID NO: 1333738 - DNA, 13 bp, Homo sapiens
agggtattccaga

SEQ ID NO: 1333739 - DNA, 12 bp, Homo sapiens
agggtccctctg

SEQ ID NO: 1333740 - DNA, 20 bp, Homo sapiens
agggtccctctgtgtatttg

SEQ ID NO: 1333741 - DNA, 12 bp, Homo sapiens
agggtgggaagg

SEQ ID NO: 1333742 - DNA, 13 bp, Homo sapiens
aggtaccagctgc

SEQ ID NO: 1333743 - DNA, 16 bp, Homo sapiens
aggtaccagctgcgct

SEQ ID NO: 1333744 - DNA, 23 bp, Homo sapiens
aggtaccagctgcgcttgctttt

SEQ ID NO: 1333745 - DNA, 12 bp, Homo sapiens
aggtaccctggg

SEQ ID NO: 1333746 - DNA, 14 bp, Homo sapiens
aggtaccctgggtg

SEQ ID NO: 1333747 - DNA, 13 bp, Homo sapiens
aggtattatacat

SEQ ID NO: 1333748 - DNA, 16 bp, Homo sapiens
aggtcaagttgtcagg

SEQ ID NO: 1333749 - DNA, 19 bp, Homo sapiens
aggtcaagttgtcaggtta

SEQ ID NO: 1333750 - DNA, 16 bp, Homo sapiens
aggtcactggaaaggg

SEQ ID NO: 1333751 - DNA, 13 bp, Homo sapiens
aggtcctaaggca

SEQ ID NO: 1333752 - DNA, 16 bp, Homo sapiens
aggtcctcagaaagtg

SEQ ID NO: 1333753 - DNA, 14 bp, Homo sapiens
aggtcgaggcagga

SEQ ID NO: 1333754 - DNA, 21 bp, Homo sapiens
aggtctatttaaaaaaaaagt

SEQ ID NO: 1333755 - DNA, 21 bp, Homo sapiens
aggtctccagttggctttact

SEQ ID NO: 1333756 - DNA, 18 bp, Homo sapiens
aggtctttcagtactttt

SEQ ID NO: 1333757 - DNA, 18 bp, Homo sapiens
aggtgaccctgatgaaaa

SEQ ID NO: 1333758 - DNA, 16 bp, Homo sapiens
aggtgagaagcagagg

SEQ ID NO: 1333759 - DNA, 23 bp, Homo sapiens
aggtgagaagcagaggaaggaga

SEQ ID NO: 1333760 - DNA, 19 bp, Homo sapiens
aggtgagtttgagctgcct

SEQ ID NO: 1333761 - DNA, 12 bp, Homo sapiens
aggtgcagaggt

SEQ ID NO: 1333762 - DNA, 21 bp, Homo sapiens
aggtgcagaggtaccctgggt

SEQ ID NO: 1333763 - DNA, 23 bp, Homo sapiens
aggtgccactttacccacctaga

SEQ ID NO: 1333764 - DNA, 15 bp, Homo sapiens
aggtggaagaaggga

SEQ ID NO: 1333765 - DNA, 14 bp, Homo sapiens
aggtggagggaggg

SEQ ID NO: 1333766 - DNA, 15 bp, Homo sapiens
aggtgggctggactt

SEQ ID NO: 1333767 - DNA, 17 bp, Homo sapiens
aggtggttatggagagg

SEQ ID NO: 1333768 - DNA, 20 bp, Homo sapiens
aggtgtggagccgaggccta

SEQ ID NO: 1333769 - DNA, 13 bp, Homo sapiens
aggtgtttgaaaa

SEQ ID NO: 1333770 - DNA, 15 bp, Homo sapiens
aggtgtttgaaaata

SEQ ID NO: 1333771 - DNA, 19 bp, Homo sapiens
aggttataattttttttaa

SEQ ID NO: 1333772 - DNA, 20 bp, Homo sapiens
aggttataattttttttaaa

SEQ ID NO: 1333773 - DNA, 16 bp, Homo sapiens
aggttcctctgcctgc

SEQ ID NO: 1333774 - DNA, 20 bp, Homo sapiens
aggttcctctgcctgccccg

SEQ ID NO: 1333775 - DNA, 19 bp, Homo sapiens
aggttctccgttagctcct

SEQ ID NO: 1333776 - DNA, 13 bp, Homo sapiens
aggttgaaaaaca

SEQ ID NO: 1333777 - DNA, 14 bp, Homo sapiens
aggtttaagctgtt

SEQ ID NO: 1333778 - DNA, 19 bp, Homo sapiens
aggtttattgttaatacaa

SEQ ID NO: 1333779 - DNA, 14 bp, Homo sapiens
agtaaacgggaaca

SEQ ID NO: 1333780 - DNA, 18 bp, Homo sapiens
agtaacattcatgttcta

SEQ ID NO: 1333781 - DNA, 19 bp, Homo sapiens
agtaacccccttaaattta

SEQ ID NO: 1333782 - DNA, 22 bp, Homo sapiens
agtaactcatttgttaaaatta

SEQ ID NO: 1333783 - DNA, 23 bp, Homo sapiens
agtaagaataccacatcaaataa

SEQ ID NO: 1333784 - DNA, 15 bp, Homo sapiens
agtaagatcactgtt

SEQ ID NO: 1333785 - DNA, 21 bp, Homo sapiens
agtaagatcactgtttagatt

SEQ ID NO: 1333786 - DNA, 16 bp, Homo sapiens
agtaagttatctttga

SEQ ID NO: 1333787 - DNA, 19 bp, Homo sapiens
agtaatatttattaaattt

SEQ ID NO: 1333788 - DNA, 17 bp, Homo sapiens
agtaatcatctaagtca

SEQ ID NO: 1333789 - DNA, 22 bp, Homo sapiens
agtaatgaatttttatgatatt

SEQ ID NO: 1333790 - DNA, 16 bp, Homo sapiens
agtaattgtgaaaaag

SEQ ID NO: 1333791 - DNA, 14 bp, Homo sapiens
agtaatttcttttt

SEQ ID NO: 1333792 - DNA, 21 bp, Homo sapiens
agtaatttctttttttccttt

SEQ ID NO: 1333793 - DNA, 22 bp, Homo sapiens
agtacccaccaccttcttctcc

SEQ ID NO: 1333794 - DNA, 17 bp, Homo sapiens
agcttgttgactcagct

SEQ ID NO: 1333795 - DNA, 12 bp, Homo sapiens
agctttgaaaat

SEQ ID NO: 1333796 - DNA, 16 bp, Homo sapiens
agctttgaaaattcag

SEQ ID NO: 1333797 - DNA, 17 bp, Homo sapiens
agctttgagaagccttc

SEQ ID NO: 1333798 - DNA, 21 bp, Homo sapiens
agctttgcaaacccattaagg

SEQ ID NO: 1333799 - DNA, 17 bp, Homo sapiens
agctttggtctgtgtgt

SEQ ID NO: 1333800 - DNA, 19 bp, Homo sapiens
agctttgtcgtatttggca

SEQ ID NO: 1333801 - DNA, 22 bp, Homo sapiens
agctttgtttgttgtcagctga

SEQ ID NO: 1333802 - DNA, 19 bp, Homo sapiens
aggaaaaacacaagcaaaa

SEQ ID NO: 1333803 - DNA, 16 bp, Homo sapiens
aggaaaattcttaaaa

SEQ ID NO: 1333804 - DNA, 14 bp, Homo sapiens
aggaaacaagtgaa

SEQ ID NO: 1333805 - DNA, 16 bp, Homo sapiens
aggaaactccacatct

SEQ ID NO: 1333806 - DNA, 19 bp, Homo sapiens
aggaaactccacatctgcc

SEQ ID NO: 1333807 - DNA, 17 bp, Homo sapiens
aggaaagaggaagcaaa

SEQ ID NO: 1333808 - DNA, 16 bp, Homo sapiens
aggaaattctccactg

SEQ ID NO: 1333809 - DNA, 19 bp, Homo sapiens
aggaacatatgaaaataca

SEQ ID NO: 1333810 - DNA, 20 bp, Homo sapiens
aggaagcccaggagcctcac

SEQ ID NO: 1333811 - DNA, 14 bp, Homo sapiens
aggaaggcaagagg

SEQ ID NO: 1333812 - DNA, 19 bp, Homo sapiens
aggaataaataaaaatgga

SEQ ID NO: 1333813 - DNA, 15 bp, Homo sapiens
aggaatattttccaa

SEQ ID NO: 1333814 - DNA, 20 bp, Homo sapiens
aggaatattttccaaagagt

SEQ ID NO: 1333815 - DNA, 17 bp, Homo sapiens
aggaatcattcagaaat

SEQ ID NO: 1333816 - DNA, 22 bp, Homo sapiens
aggaatcattcagaaatgttga

SEQ ID NO: 1333817 - DNA, 15 bp, Homo sapiens
aggaatcctggcagc

SEQ ID NO: 1333818 - DNA, 16 bp, Homo sapiens
aggaatgaaaaaagct

SEQ ID NO: 1333819 - DNA, 17 bp, Homo sapiens
aggacaaagtgccaaag

SEQ ID NO: 1333820 - DNA, 18 bp, Homo sapiens
aggacaaagtgccaaaga

SEQ ID NO: 1333821 - DNA, 20 bp, Homo sapiens
aggacaaagtgccaaagaaa

SEQ ID NO: 1333822 - DNA, 17 bp, Homo sapiens
aggaccaagcatcttgg

SEQ ID NO: 1333823 - DNA, 19 bp, Homo sapiens
aggaccaagcatcttgggg

SEQ ID NO: 1333824 - DNA, 20 bp, Homo sapiens
aggacctcaggtgagaagca

SEQ ID NO: 1333825 - DNA, 22 bp, Homo sapiens
aggacctttccaccacagccag

SEQ ID NO: 1333826 - DNA, 15 bp, Homo sapiens
aggactgactgaggc

SEQ ID NO: 1333827 - DNA, 21 bp, Homo sapiens
aggacttccccggagggctgc

SEQ ID NO: 1333828 - DNA, 15 bp, Homo sapiens
aggactttgtacatt

SEQ ID NO: 1333829 - DNA, 18 bp, Homo sapiens
aggagaggggcacagggt

SEQ ID NO: 1333830 - DNA, 14 bp, Homo sapiens
aggagcctgcccag

SEQ ID NO: 1333831 - DNA, 16 bp, Homo sapiens
aggagcctttttaaaa

SEQ ID NO: 1333832 - DNA, 19 bp, Homo sapiens
aggagctgccttggctcag

SEQ ID NO: 1333833 - DNA, 21 bp, Homo sapiens
aggagctgccttggctcagac

SEQ ID NO: 1333834 - DNA, 13 bp, Homo sapiens
aggagggagaggg

SEQ ID NO: 1333835 - DNA, 19 bp, Homo sapiens
aggagggggccgggcgcgg

SEQ ID NO: 1333836 - DNA, 17 bp, Homo sapiens
aggagtggtgatttgaa

SEQ ID NO: 1333837 - DNA, 16 bp, Homo sapiens
aggagtgtggccacgt

SEQ ID NO: 1333838 - DNA, 23 bp, Homo sapiens
aggatagctaactgtaaatcatg

SEQ ID NO: 1333839 - DNA, 19 bp, Homo sapiens
aggatattcagatgtatgt

SEQ ID NO: 1333840 - DNA, 16 bp, Homo sapiens
aggatcccctccaagc

SEQ ID NO: 1333841 - DNA, 17 bp, Homo sapiens
aggatctctaaagagca

SEQ ID NO: 1333842 - DNA, 19 bp, Homo sapiens
aggatctctaaagagcatc

SEQ ID NO: 1333843 - DNA, 12 bp, Homo sapiens
aggatctcttga

SEQ ID NO: 1333844 - DNA, 18 bp, Homo sapiens
aggatctcttgagcctgg

SEQ ID NO: 1333845 - DNA, 19 bp, Homo sapiens
aggatctcttgagcctggg

SEQ ID NO: 1333846 - DNA, 16 bp, Homo sapiens
aggatgggcttctgtg

SEQ ID NO: 1333847 - DNA, 17 bp, Homo sapiens
aggatgggcttctgtgc

SEQ ID NO: 1333848 - DNA, 21 bp, Homo sapiens
aggattgaaaatgtccaggaa

SEQ ID NO: 1333849 - DNA, 24 bp, Homo sapiens
aggattgaaaatgtccaggaaagt

SEQ ID NO: 1333850 - DNA, 17 bp, Homo sapiens
aggcaactcatcttagg

SEQ ID NO: 1333851 - DNA, 17 bp, Homo sapiens
aggcaagagggggtgga

SEQ ID NO: 1333852 - DNA, 14 bp, Homo sapiens
aggcaagccaggct

SEQ ID NO: 1333853 - DNA, 16 bp, Homo sapiens
aggcaagccaggctca

SEQ ID NO: 1333854 - DNA, 22 bp, Homo sapiens
aggcaagccaggctcactcaca

SEQ ID NO: 1333855 - DNA, 20 bp, Homo sapiens
aggcaaggaaagaaatacag

SEQ ID NO: 1333856 - DNA, 18 bp, Homo sapiens
aggcaaggctatgtgatt

SEQ ID NO: 1333857 - DNA, 22 bp, Homo sapiens
aggcaatgattgttaatttaca

SEQ ID NO: 1333858 - DNA, 16 bp, Homo sapiens
aggcaccaggaagccg

SEQ ID NO: 1333859 - DNA, 13 bp, Homo sapiens
aggcacctcttcc

SEQ ID NO: 1333860 - DNA, 16 bp, Homo sapiens
aggcaccttttactgt

SEQ ID NO: 1333861 - DNA, 17 bp, Homo sapiens
aggcaccttttactgtg

SEQ ID NO: 1333862 - DNA, 12 bp, Homo sapiens
aggcaggatggc

SEQ ID NO: 1333863 - DNA, 15 bp, Homo sapiens
aggcaggcatggccc

SEQ ID NO: 1333864 - DNA, 17 bp, Homo sapiens
aggcaggcatggccctg

SEQ ID NO: 1333865 - DNA, 18 bp, Homo sapiens
aggcaggcatggccctgg

SEQ ID NO: 1333866 - DNA, 23 bp, Homo sapiens
aggcagggagacggtttccaggg

SEQ ID NO: 1333867 - DNA, 16 bp, Homo sapiens
aggcagggaggcagcc

SEQ ID NO: 1333868 - DNA, 15 bp, Homo sapiens
aggcaggggtggggg

SEQ ID NO: 1333869 - DNA, 22 bp, Homo sapiens
aggcaggggtgggggtggaggc

SEQ ID NO: 1333870 - DNA, 17 bp, Homo sapiens
aggcaggtgggatggat

SEQ ID NO: 1333871 - DNA, 12 bp, Homo sapiens
aggcatggccct

SEQ ID NO: 1333872 - DNA, 15 bp, Homo sapiens
aggcatggccctggg

SEQ ID NO: 1333873 - DNA, 16 bp, Homo sapiens
aggcatggccctgggc

SEQ ID NO: 1333874 - DNA, 22 bp, Homo sapiens
aggccagaggcccccagcccag

SEQ ID NO: 1333875 - DNA, 11 bp, Homo sapiens
aggccagcctc

SEQ ID NO: 1333876 - DNA, 13 bp, Homo sapiens
aggccagcctccg

SEQ ID NO: 1333877 - DNA, 23 bp, Homo sapiens
aggccagcctccgagagggagag

SEQ ID NO: 1333878 - DNA, 22 bp, Homo sapiens
aggccatggcatccctttttca

SEQ ID NO: 1333879 - DNA, 14 bp, Homo sapiens
aggccatgtgcata

SEQ ID NO: 1333880 - DNA, 20 bp, Homo sapiens
aggccatgtgcatagtttct

SEQ ID NO: 1333881 - DNA, 20 bp, Homo sapiens
aggcccccacttgcctcttc

SEQ ID NO: 1333882 - DNA, 22 bp, Homo sapiens
aggcccccagcccagggctcct

SEQ ID NO: 1333883 - DNA, 13 bp, Homo sapiens
aggccctttgctg

SEQ ID NO: 1333884 - DNA, 15 bp, Homo sapiens
aggccctttgctgtc

SEQ ID NO: 1333885 - DNA, 16 bp, Homo sapiens
aggccgcgccctttcc

SEQ ID NO: 1333886 - DNA, 20 bp, Homo sapiens
aggccgcgcgtccagctgcc

SEQ ID NO: 1333887 - DNA, 22 bp, Homo sapiens
aggccggcagccccagcctgct

SEQ ID NO: 1333888 - DNA, 18 bp, Homo sapiens
aggccgttgctgacttag

SEQ ID NO: 1333889 - DNA, 23 bp, Homo sapiens
aggccgttgctgacttagaatcc

SEQ ID NO: 1333890 - DNA, 18 bp, Homo sapiens
aggcctgcgaccctgggg

SEQ ID NO: 1333891 - DNA, 20 bp, Homo sapiens
aggcctgcgaccctgggggc

SEQ ID NO: 1333892 - DNA, 12 bp, Homo sapiens
aggcctgctccc

SEQ ID NO: 1333893 - DNA, 15 bp, Homo sapiens
aggccttcctctctc

SEQ ID NO: 1333894 - DNA, 16 bp, Homo sapiens
aggccttcctctctcc

SEQ ID NO: 1333895 - DNA, 18 bp, Homo sapiens
aggccttcctctctccag

SEQ ID NO: 1333896 - DNA, 19 bp, Homo sapiens
aggcgctgagactgtgctg

SEQ ID NO: 1333897 - DNA, 22 bp, Homo sapiens
aggcgctgcccacctgccggcc

SEQ ID NO: 1333898 - DNA, 17 bp, Homo sapiens
aggcgggggctgccctt

SEQ ID NO: 1333899 - DNA, 18 bp, Homo sapiens
aggctagcttctgctttt

SEQ ID NO: 1333900 - DNA, 16 bp, Homo sapiens
aggctatgtataaaat

SEQ ID NO: 1333901 - DNA, 18 bp, Homo sapiens
aggctatgtataaaatac

SEQ ID NO: 1333902 - DNA, 14 bp, Homo sapiens
aggctatgtgatta

SEQ ID NO: 1333903 - DNA, 17 bp, Homo sapiens
aggctattttctaaaga

SEQ ID NO: 1333904 - DNA, 19 bp, Homo sapiens
aggctattttctaaagact

SEQ ID NO: 1333905 - DNA, 17 bp, Homo sapiens
aggctcactgccaggcc

SEQ ID NO: 1333906 - DNA, 21 bp, Homo sapiens
aggctcactgccaggccagcc

SEQ ID NO: 1333907 - DNA, 22 bp, Homo sapiens
aggctcactgccaggccagcct

SEQ ID NO: 1333908 - DNA, 23 bp, Homo sapiens
aggctcactgccaggccagcctc

SEQ ID NO: 1333909 - DNA, 24 bp, Homo sapiens
aggctcactgccaggccagcctcc

SEQ ID NO: 1333910 - DNA, 18 bp, Homo sapiens
aggctcgtggactgagtg

SEQ ID NO: 1333911 - DNA, 23 bp, Homo sapiens
aggctggatcttggagaatgtga

SEQ ID NO: 1333912 - DNA, 18 bp, Homo sapiens
aggctggccagtccaggc

SEQ ID NO: 1333913 - DNA, 18 bp, Homo sapiens
aggctggcgagagtctgg

SEQ ID NO: 1333914 - DNA, 22 bp, Homo sapiens
agccctcccactttgctgttcc

SEQ ID NO: 1333915 - DNA, 19 bp, Homo sapiens
agccctccccatggagcca

SEQ ID NO: 1333916 - DNA, 19 bp, Homo sapiens
agccctgctggggatcccc

SEQ ID NO: 1333917 - DNA, 12 bp, Homo sapiens
agcccttgcctc

SEQ ID NO: 1333918 - DNA, 16 bp, Homo sapiens
agcccttgcctcccca

SEQ ID NO: 1333919 - DNA, 16 bp, Homo sapiens
agccgggcccctgggc

SEQ ID NO: 1333920 - DNA, 23 bp, Homo sapiens
agccggggaagagatccaaagac

SEQ ID NO: 1333921 - DNA, 16 bp, Homo sapiens
agccggtaactgtcct

SEQ ID NO: 1333922 - DNA, 17 bp, Homo sapiens
agccggtaactgtcctg

SEQ ID NO: 1333923 - DNA, 17 bp, Homo sapiens
agcctagaagagcttct

SEQ ID NO: 1333924 - DNA, 16 bp, Homo sapiens
agcctatggcagaaaa

SEQ ID NO: 1333925 - DNA, 19 bp, Homo sapiens
agcctatggcagaaaaaat

SEQ ID NO: 1333926 - DNA, 23 bp, Homo sapiens
agcctcactggggcagacaataa

SEQ ID NO: 1333927 - DNA, 13 bp, Homo sapiens
agcctccacagcg

SEQ ID NO: 1333928 - DNA, 21 bp, Homo sapiens
agcctccacagcgagggcagc

SEQ ID NO: 1333929 - DNA, 18 bp, Homo sapiens
agcctccgagagggagag

SEQ ID NO: 1333930 - DNA, 18 bp, Homo sapiens
agcctcctctggacggca

SEQ ID NO: 1333931 - DNA, 19 bp, Homo sapiens
agcctcctctggacggcag

SEQ ID NO: 1333932 - DNA, 20 bp, Homo sapiens
agcctctcagtgccctccag

SEQ ID NO: 1333933 - DNA, 16 bp, Homo sapiens
agcctctccccaggtc

SEQ ID NO: 1333934 - DNA, 22 bp, Homo sapiens
agcctctccccaggtccagctc

SEQ ID NO: 1333935 - DNA, 23 bp, Homo sapiens
agcctctccccaggtccagctct

SEQ ID NO: 1333936 - DNA, 14 bp, Homo sapiens
agcctgctccagct

SEQ ID NO: 1333937 - DNA, 15 bp, Homo sapiens
agcctgctccagctg

SEQ ID NO: 1333938 - DNA, 16 bp, Homo sapiens
agcctgctccagctgt

SEQ ID NO: 1333939 - DNA, 19 bp, Homo sapiens
agcctgctccagctgttca

SEQ ID NO: 1333940 - DNA, 10 bp, Homo sapiens
agcctgctgg

SEQ ID NO: 1333941 - DNA, 12 bp, Homo sapiens
agcctgggaggt

SEQ ID NO: 1333942 - DNA, 20 bp, Homo sapiens
agcctgggaggtcaaggctg

SEQ ID NO: 1333943 - DNA, 11 bp, Homo sapiens
agcctgggccc

SEQ ID NO: 1333944 - DNA, 15 bp, Homo sapiens
agcctggtgctgctg

SEQ ID NO: 1333945 - DNA, 16 bp, Homo sapiens
agcctggtgctgctgc

SEQ ID NO: 1333946 - DNA, 20 bp, Homo sapiens
agccttcaaaactatagctt

SEQ ID NO: 1333947 - DNA, 14 bp, Homo sapiens
agccttcagctcca

SEQ ID NO: 1333948 - DNA, 18 bp, Homo sapiens
agccttctcagaagcaca

SEQ ID NO: 1333949 - DNA, 12 bp, Homo sapiens
agccttctccct

SEQ ID NO: 1333950 - DNA, 16 bp, Homo sapiens
agccttctccctagct

SEQ ID NO: 1333951 - DNA, 17 bp, Homo sapiens
agccttgagccctggct

SEQ ID NO: 1333952 - DNA, 19 bp, Homo sapiens
agcctttaccttttatgca

SEQ ID NO: 1333953 - DNA, 16 bp, Homo sapiens
agcctttttaaaacac

SEQ ID NO: 1333954 - DNA, 21 bp, Homo sapiens
agcctttttaaaacacatgtt

SEQ ID NO: 1333955 - DNA, 12 bp, Homo sapiens
agcgactaaact

SEQ ID NO: 1333956 - DNA, 16 bp, Homo sapiens
agcgactccgttggcc

SEQ ID NO: 1333957 - DNA, 23 bp, Homo sapiens
agcgaggcacccttactggctta

SEQ ID NO: 1333958 - DNA, 14 bp, Homo sapiens
agcgagggcagctg

SEQ ID NO: 1333959 - DNA, 15 bp, Homo sapiens
agcgagggcagctgc

SEQ ID NO: 1333960 - DNA, 16 bp, Homo sapiens
agcgagggcagctgct

SEQ ID NO: 1333961 - DNA, 17 bp, Homo sapiens
agcgatctctcctggcc

SEQ ID NO: 1333962 - DNA, 18 bp, Homo sapiens
agcgatctctcctggcct

SEQ ID NO: 1333963 - DNA, 22 bp, Homo sapiens
agcgcctccatccaaggccagg

SEQ ID NO: 1333964 - DNA, 23 bp, Homo sapiens
agcgcctccatccaaggccaggt

SEQ ID NO: 1333965 - DNA, 13 bp, Homo sapiens
agcgcctccctcc

SEQ ID NO: 1333966 - DNA, 15 bp, Homo sapiens
agcgcctccctccac

SEQ ID NO: 1333967 - DNA, 20 bp, Homo sapiens
agcgcctccctccaccccag

SEQ ID NO: 1333968 - DNA, 18 bp, Homo sapiens
agcgcggccctcccgagt

SEQ ID NO: 1333969 - DNA, 13 bp, Homo sapiens
agcgggcgcctgt

SEQ ID NO: 1333970 - DNA, 13 bp, Homo sapiens
agcgtccctggcg

SEQ ID NO: 1333971 - DNA, 15 bp, Homo sapiens
agctactagcaaaat

SEQ ID NO: 1333972 - DNA, 17 bp, Homo sapiens
agctactagcaaaataa

SEQ ID NO: 1333973 - DNA, 18 bp, Homo sapiens
agctacttgggaggctga

SEQ ID NO: 1333974 - DNA, 21 bp, Homo sapiens
agctacttgggaggctgaggc

SEQ ID NO: 1333975 - DNA, 16 bp, Homo sapiens
agctagttgaatactt

SEQ ID NO: 1333976 - DNA, 20 bp, Homo sapiens
agctagttgaatacttgaac

SEQ ID NO: 1333977 - DNA, 22 bp, Homo sapiens
agctagttgaatacttgaacca

SEQ ID NO: 1333978 - DNA, 24 bp, Homo sapiens
agctagttgaatacttgaaccata

SEQ ID NO: 1333979 - DNA, 15 bp, Homo sapiens
agctcagaaccacag

SEQ ID NO: 1333980 - DNA, 17 bp, Homo sapiens
agctcaggaggcgccct

SEQ ID NO: 1333981 - DNA, 16 bp, Homo sapiens
agctcattaaactttt

SEQ ID NO: 1333982 - DNA, 18 bp, Homo sapiens
agctcattaaactttttt

SEQ ID NO: 1333983 - DNA, 19 bp, Homo sapiens
agctcattaaactttttta

SEQ ID NO: 1333984 - DNA, 11 bp, Homo sapiens
agctccactct

SEQ ID NO: 1333985 - DNA, 12 bp, Homo sapiens
agctccactctg

SEQ ID NO: 1333986 - DNA, 16 bp, Homo sapiens
agctccactctgcttc

SEQ ID NO: 1333987 - DNA, 19 bp, Homo sapiens
agctccactctgcttctct

SEQ ID NO: 1333988 - DNA, 23 bp, Homo sapiens
agctccactctgcttctctgact

SEQ ID NO: 1333989 - DNA, 24 bp, Homo sapiens
agctccactctgcttctctgactt

SEQ ID NO: 1333990 - DNA, 14 bp, Homo sapiens
agctccagctttct

SEQ ID NO: 1333991 - DNA, 17 bp, Homo sapiens
agctcccacttctgcca

SEQ ID NO: 1333992 - DNA, 15 bp, Homo sapiens
agctccgcaggactt

SEQ ID NO: 1333993 - DNA, 23 bp, Homo sapiens
agctccgcaggacttccccggag

SEQ ID NO: 1333994 - DNA, 19 bp, Homo sapiens
agctcctccccttcctctt

SEQ ID NO: 1333995 - DNA, 13 bp, Homo sapiens
agctcctggggcg

SEQ ID NO: 1333996 - DNA, 22 bp, Homo sapiens
agctcctggggcgtccaggccg

SEQ ID NO: 1333997 - DNA, 17 bp, Homo sapiens
agctctgccgtctctgg

SEQ ID NO: 1333998 - DNA, 12 bp, Homo sapiens
agctctggaggg

SEQ ID NO: 1333999 - DNA, 17 bp, Homo sapiens
agctctggaggggaggg

SEQ ID NO: 1334000 - DNA, 18 bp, Homo sapiens
agctctggaggggagggg

SEQ ID NO: 1334001 - DNA, 19 bp, Homo sapiens
agctcttcctatccctctc

SEQ ID NO: 1334002 - DNA, 21 bp, Homo sapiens
agctgaacaataggctgttcc

SEQ ID NO: 1334003 - DNA, 17 bp, Homo sapiens
agctgcaattccctgga

SEQ ID NO: 1334004 - DNA, 19 bp, Homo sapiens
agctgcaccctcaggcagg

SEQ ID NO: 1334005 - DNA, 17 bp, Homo sapiens
agctgccttccctagct

SEQ ID NO: 1334006 - DNA, 19 bp, Homo sapiens
agctgccttccctagcttt

SEQ ID NO: 1334007 - DNA, 17 bp, Homo sapiens
agctgccttggctcaga

SEQ ID NO: 1334008 - DNA, 20 bp, Homo sapiens
agctgccttggctcagacat

SEQ ID NO: 1334009 - DNA, 18 bp, Homo sapiens
agctgcgcttgcttttct

SEQ ID NO: 1334010 - DNA, 18 bp, Homo sapiens
agctgctatccccatctc

SEQ ID NO: 1334011 - DNA, 18 bp, Homo sapiens
agctgctccgaggaccca

SEQ ID NO: 1334012 - DNA, 19 bp, Homo sapiens
agctgctccgaggacccag

SEQ ID NO: 1334013 - DNA, 22 bp, Homo sapiens
agctgctccgaggacccaggaa

SEQ ID NO: 1334014 - DNA, 16 bp, Homo sapiens
agctggcctctctagc

SEQ ID NO: 1334015 - DNA, 15 bp, Homo sapiens
agctggcctggacag

SEQ ID NO: 1334016 - DNA, 13 bp, Homo sapiens
agctggctctgag

SEQ ID NO: 1334017 - DNA, 19 bp, Homo sapiens
agctggctctgagcgcctc

SEQ ID NO: 1334018 - DNA, 16 bp, Homo sapiens
agctgggcccgacatg

SEQ ID NO: 1334019 - DNA, 22 bp, Homo sapiens
agctgggcccgacatggctccg

SEQ ID NO: 1334020 - DNA, 15 bp, Homo sapiens
agctgggccgggacc

SEQ ID NO: 1334021 - DNA, 18 bp, Homo sapiens
agctgggccgggacccag

SEQ ID NO: 1334022 - DNA, 16 bp, Homo sapiens
agctggttgaggtttc

SEQ ID NO: 1334023 - DNA, 18 bp, Homo sapiens
agctgttactgtcttcag

SEQ ID NO: 1334024 - DNA, 19 bp, Homo sapiens
agctgttactgtcttcagt

SEQ ID NO: 1334025 - DNA, 16 bp, Homo sapiens
agctgttcctgttcag

SEQ ID NO: 1334026 - DNA, 19 bp, Homo sapiens
agctgttcctgttcagtaa

SEQ ID NO: 1334027 - DNA, 12 bp, Homo sapiens
agcttatctcag

SEQ ID NO: 1334028 - DNA, 15 bp, Homo sapiens
agcttatctcagggg

SEQ ID NO: 1334029 - DNA, 17 bp, Homo sapiens
agcttcatataccagca

SEQ ID NO: 1334030 - DNA, 18 bp, Homo sapiens
agcttctgaggcgctgct

SEQ ID NO: 1334031 - DNA, 20 bp, Homo sapiens
agcttctgcttttctgccct

SEQ ID NO: 1334032 - DNA, 22 bp, Homo sapiens
agcttctgcttttctgccctgg

SEQ ID NO: 1334033 - DNA, 16 bp, Homo sapiens
agcttgacctgaggct

SEQ ID NO: 1334034 - DNA, 19 bp, Homo sapiens
aagctagttgaatacttga

SEQ ID NO: 1334035 - DNA, 20 bp, Homo sapiens
aagctagttgaatacttgaa

SEQ ID NO: 1334036 - DNA, 21 bp, Homo sapiens
aagctagttgaatacttgaac

SEQ ID NO: 1334037 - DNA, 15 bp, Homo sapiens
aagctataaagcagt

SEQ ID NO: 1334038 - DNA, 20 bp, Homo sapiens
aagctataaagcagtatttt

SEQ ID NO: 1334039 - DNA, 22 bp, Homo sapiens
aagctatttatgggcccctggc

SEQ ID NO: 1334040 - DNA, 13 bp, Homo sapiens
aagctccaagccc

SEQ ID NO: 1334041 - DNA, 13 bp, Homo sapiens
aagctgcaccctc

SEQ ID NO: 1334042 - DNA, 20 bp, Homo sapiens
aagctgcaccctcaggcagg

SEQ ID NO: 1334043 - DNA, 15 bp, Homo sapiens
aagctgcagagattt

SEQ ID NO: 1334044 - DNA, 20 bp, Homo sapiens
aagctgcccactgtttctct

SEQ ID NO: 1334045 - DNA, 18 bp, Homo sapiens
aagctggcttacactggc

SEQ ID NO: 1334046 - DNA, 16 bp, Homo sapiens
aagcttcagttgcttg

SEQ ID NO: 1334047 - DNA, 16 bp, Homo sapiens
aagcttggttctgtga

SEQ ID NO: 1334048 - DNA, 17 bp, Homo sapiens
aagctttcctgttgaat

SEQ ID NO: 1334049 - DNA, 19 bp, Homo sapiens
aagctttgaatactaaatt

SEQ ID NO: 1334050 - DNA, 17 bp, Homo sapiens
aaggaaaatagtaatgt

SEQ ID NO: 1334051 - DNA, 19 bp, Homo sapiens
aaggaagccggggaagaga

SEQ ID NO: 1334052 - DNA, 17 bp, Homo sapiens
aaggaaggtggatggcc

SEQ ID NO: 1334053 - DNA, 21 bp, Homo sapiens
aaggaattaccaagaatatcc

SEQ ID NO: 1334054 - DNA, 16 bp, Homo sapiens
aaggacaaagtgccaa

SEQ ID NO: 1334055 - DNA, 12 bp, Homo sapiens
aaggaccttaag

SEQ ID NO: 1334056 - DNA, 12 bp, Homo sapiens
aaggactgactg

SEQ ID NO: 1334057 - DNA, 19 bp, Homo sapiens
aaggactgactgaggcagt

SEQ ID NO: 1334058 - DNA, 12 bp, Homo sapiens
aaggataaagaa

SEQ ID NO: 1334059 - DNA, 16 bp, Homo sapiens
aaggctaaaacttaac

SEQ ID NO: 1334060 - DNA, 16 bp, Homo sapiens
aaggctgggggaagaa

SEQ ID NO: 1334061 - DNA, 13 bp, Homo sapiens
aaggcttgaagct

SEQ ID NO: 1334062 - DNA, 14 bp, Homo sapiens
aaggcttgaagctg

SEQ ID NO: 1334063 - DNA, 15 bp, Homo sapiens
aaggctttatctcag

SEQ ID NO: 1334064 - DNA, 12 bp, Homo sapiens
aagggaaaaata

SEQ ID NO: 1334065 - DNA, 15 bp, Homo sapiens
aagggaaaaatatat

SEQ ID NO: 1334066 - DNA, 15 bp, Homo sapiens
aagggaaagaaaatg

SEQ ID NO: 1334067 - DNA, 15 bp, Homo sapiens
aagggaacctgtgtc

SEQ ID NO: 1334068 - DNA, 19 bp, Homo sapiens
aagggaccctttgggggtt

SEQ ID NO: 1334069 - DNA, 12 bp, Homo sapiens
aagggatatttt

SEQ ID NO: 1334070 - DNA, 16 bp, Homo sapiens
aagggatgcaggctcc

SEQ ID NO: 1334071 - DNA, 14 bp, Homo sapiens
aagggcataaagta

SEQ ID NO: 1334072 - DNA, 15 bp, Homo sapiens
aagggcataaagtaa

SEQ ID NO: 1334073 - DNA, 14 bp, Homo sapiens
aaggggttcctcaa

SEQ ID NO: 1334074 - DNA, 19 bp, Homo sapiens
aaggggttcctcaaatttt

SEQ ID NO: 1334075 - DNA, 14 bp, Homo sapiens
aagggtttctctat

SEQ ID NO: 1334076 - DNA, 13 bp, Homo sapiens
aaggtaatgtgtg

SEQ ID NO: 1334077 - DNA, 16 bp, Homo sapiens
aaggtattatacatgt

SEQ ID NO: 1334078 - DNA, 18 bp, Homo sapiens
aaggtcactgtttcctgg

SEQ ID NO: 1334079 - DNA, 18 bp, Homo sapiens
aaggtctttaaaatattg

SEQ ID NO: 1334080 - DNA, 18 bp, Homo sapiens
aaggtctttcagtacttt

SEQ ID NO: 1334081 - DNA, 19 bp, Homo sapiens
aaggtctttcagtactttt

SEQ ID NO: 1334082 - DNA, 21 bp, Homo sapiens
aaggtgagtttgagctgcctt

SEQ ID NO: 1334083 - DNA, 19 bp, Homo sapiens
aaggtggatggccccagca

SEQ ID NO: 1334084 - DNA, 15 bp, Homo sapiens
aaggtgtttgaaaat

SEQ ID NO: 1334085 - DNA, 13 bp, Homo sapiens
aaggtttattgtt

SEQ ID NO: 1334086 - DNA, 21 bp, Homo sapiens
aaggtttattgttaatacaag

SEQ ID NO: 1334087 - DNA, 23 bp, Homo sapiens
aagtaactgggattacaggcatg

SEQ ID NO: 1334088 - DNA, 17 bp, Homo sapiens
aagtaatcatctaagtc

SEQ ID NO: 1334089 - DNA, 17 bp, Homo sapiens
aagtagaactttgtata

SEQ ID NO: 1334090 - DNA, 23 bp, Homo sapiens
aagtagaactttgtatagttatg

SEQ ID NO: 1334091 - DNA, 19 bp, Homo sapiens
aagtagttctgtatttgaa

SEQ ID NO: 1334092 - DNA, 23 bp, Homo sapiens
aagtagttctgtatttgaaagtg

SEQ ID NO: 1334093 - DNA, 22 bp, Homo sapiens
aagtataaaatagtatgaaaat

SEQ ID NO: 1334094 - DNA, 19 bp, Homo sapiens
aagtatgtatattaaaaaa

SEQ ID NO: 1334095 - DNA, 13 bp, Homo sapiens
aagtatttataat

SEQ ID NO: 1334096 - DNA, 11 bp, Homo sapiens
aagtattttct

SEQ ID NO: 1334097 - DNA, 12 bp, Homo sapiens
aagtcagagaca

SEQ ID NO: 1334098 - DNA, 15 bp, Homo sapiens
aagtcagagacagat

SEQ ID NO: 1334099 - DNA, 15 bp, Homo sapiens
aagtcagctccagct

SEQ ID NO: 1334100 - DNA, 20 bp, Homo sapiens
aagtcagctccagctttctg

SEQ ID NO: 1334101 - DNA, 17 bp, Homo sapiens
aagtcagtacccaccac

SEQ ID NO: 1334102 - DNA, 17 bp, Homo sapiens
aagtcatgtatgtttct

SEQ ID NO: 1334103 - DNA, 14 bp, Homo sapiens
aagtcattaaactg

SEQ ID NO: 1334104 - DNA, 15 bp, Homo sapiens
aagtcattaaagaca

SEQ ID NO: 1334105 - DNA, 22 bp, Homo sapiens
aagtctgtctttcctgaaccat

SEQ ID NO: 1334106 - DNA, 15 bp, Homo sapiens
aagtctttcatggct

SEQ ID NO: 1334107 - DNA, 16 bp, Homo sapiens
aagtcttttttgatca

SEQ ID NO: 1334108 - DNA, 15 bp, Homo sapiens
aagtcttttttttcc

SEQ ID NO: 1334109 - DNA, 21 bp, Homo sapiens
aagtgaaaaaggaggaagaga

SEQ ID NO: 1334110 - DNA, 15 bp, Homo sapiens
aagtgagaagatggt

SEQ ID NO: 1334111 - DNA, 22 bp, Homo sapiens
aagtgatctacatgaggaactg

SEQ ID NO: 1334112 - DNA, 13 bp, Homo sapiens
aagtgccaaagaa

SEQ ID NO: 1334113 - DNA, 23 bp, Homo sapiens
aagtgctggcaaccactaagaat

SEQ ID NO: 1334114 - DNA, 14 bp, Homo sapiens
aagtgctttaaaaa

SEQ ID NO: 1334115 - DNA, 19 bp, Homo sapiens
aagtggtcttaagaaatgt

SEQ ID NO: 1334116 - DNA, 22 bp, Homo sapiens
aagtgtaaaatattttgaatca

SEQ ID NO: 1334117 - DNA, 15 bp, Homo sapiens
aagtgtgtatatatt

SEQ ID NO: 1334118 - DNA, 15 bp, Homo sapiens
aatcatagttactgt

SEQ ID NO: 1334119 - DNA, 19 bp, Homo sapiens
aatcatagttactgtgtaa

SEQ ID NO: 1334120 - DNA, 22 bp, Homo sapiens
aatcatagttactgtgtaaact

SEQ ID NO: 1334121 - DNA, 14 bp, Homo sapiens
aatcatctaagtca

SEQ ID NO: 1334122 - DNA, 19 bp, Homo sapiens
aatcatgaatctttgtttc

SEQ ID NO: 1334123 - DNA, 17 bp, Homo sapiens
aatcatgtccatacact

SEQ ID NO: 1334124 - DNA, 19 bp, Homo sapiens
aatcatgtccatacacttt

SEQ ID NO: 1334125 - DNA, 16 bp, Homo sapiens
aatcattcagaaatgt

SEQ ID NO: 1334126 - DNA, 18 bp, Homo sapiens
aatcattttcattcctaa

SEQ ID NO: 1334127 - DNA, 22 bp, Homo sapiens
aatccaagcctccacagcgagg

SEQ ID NO: 1334128 - DNA, 23 bp, Homo sapiens
aatccaagcctccacagcgaggg

SEQ ID NO: 1334129 - DNA, 20 bp, Homo sapiens
aatcccagcactttgggagg

SEQ ID NO: 1334130 - DNA, 14 bp, Homo sapiens
aatcccctaaaata

SEQ ID NO: 1334131 - DNA, 14 bp, Homo sapiens
aatccctgcttttt

SEQ ID NO: 1334132 - DNA, 19 bp, Homo sapiens
aatccctgtgttaatttaa

SEQ ID NO: 1334133 - DNA, 23 bp, Homo sapiens
aatccctttattaccccctcctt

SEQ ID NO: 1334134 - DNA, 17 bp, Homo sapiens
aatcctgattcctctct

SEQ ID NO: 1334135 - DNA, 21 bp, Homo sapiens
aatcctggagagggtattttt

SEQ ID NO: 1334136 - DNA, 22 bp, Homo sapiens
aatcctttgttttctgactaat

SEQ ID NO: 1334137 - DNA, 23 bp, Homo sapiens
aatcctttgttttctgactaatt

SEQ ID NO: 1334138 - DNA, 21 bp, Homo sapiens
aatcgagtgccgcatctcaca

SEQ ID NO: 1334139 - DNA, 19 bp, Homo sapiens
aatcggggtataataggct

SEQ ID NO: 1334140 - DNA, 17 bp, Homo sapiens
aatctaaatctatttat

SEQ ID NO: 1334141 - DNA, 20 bp, Homo sapiens
aatctaagcagcttattgtt

SEQ ID NO: 1334142 - DNA, 21 bp, Homo sapiens
aatctaagcagcttattgttt

SEQ ID NO: 1334143 - DNA, 20 bp, Homo sapiens
aatctacaatctctttttgt

SEQ ID NO: 1334144 - DNA, 15 bp, Homo sapiens
aatctcttcattatt

SEQ ID NO: 1334145 - DNA, 17 bp, Homo sapiens
aatctctttttgtttgc

SEQ ID NO: 1334146 - DNA, 15 bp, Homo sapiens
aatctgagggaaatg

SEQ ID NO: 1334147 - DNA, 19 bp, Homo sapiens
aatctgagggaaatgtttt

SEQ ID NO: 1334148 - DNA, 20 bp, Homo sapiens
aatctgatggccttaatttc

SEQ ID NO: 1334149 - DNA, 21 bp, Homo sapiens
aatctgatggccttaatttcc

SEQ ID NO: 1334150 - DNA, 22 bp, Homo sapiens
aatctgatggccttaatttcct

SEQ ID NO: 1334151 - DNA, 14 bp, Homo sapiens
aatctggagaccag

SEQ ID NO: 1334152 - DNA, 14 bp, Homo sapiens
aatcttaatgttcc

SEQ ID NO: 1334153 - DNA, 14 bp, Homo sapiens
aatcttactttgta

SEQ ID NO: 1334154 - DNA, 18 bp, Homo sapiens
aatcttactttgtaaatt

SEQ ID NO: 1334155 - DNA, 19 bp, Homo sapiens
aatcttactttgtaaattc

SEQ ID NO: 1334156 - DNA, 15 bp, Homo sapiens
aatcttataattgtt

SEQ ID NO: 1334157 - DNA, 18 bp, Homo sapiens
aatcttgttggttcacca

SEQ ID NO: 1334158 - DNA, 19 bp, Homo sapiens
aatcttgtttctgaaaaga

SEQ ID NO: 1334159 - DNA, 17 bp, Homo sapiens
aacttgtattaaagaca

SEQ ID NO: 1334160 - DNA, 12 bp, Homo sapiens
aactttgggaaa

SEQ ID NO: 1334161 - DNA, 14 bp, Homo sapiens
aactttgtaaaaat

SEQ ID NO: 1334162 - DNA, 21 bp, Homo sapiens
aactttgtaaaaatcttttga

SEQ ID NO: 1334163 - DNA, 14 bp, Homo sapiens
aactttgtatagtt

SEQ ID NO: 1334164 - DNA, 20 bp, Homo sapiens
aactttgtatagttatgtaa

SEQ ID NO: 1334165 - DNA, 21 bp, Homo sapiens
aactttgtatagttatgtaaa

SEQ ID NO: 1334166 - DNA, 14 bp, Homo sapiens
aacttttatctatt

SEQ ID NO: 1334167 - DNA, 17 bp, Homo sapiens
aacttttgtactgaatt

SEQ ID NO: 1334168 - DNA, 18 bp, Homo sapiens
aacttttgtactgaattt

SEQ ID NO: 1334169 - DNA, 20 bp, Homo sapiens
aacttttgtgtaatgaaaat

SEQ ID NO: 1334170 - DNA, 14 bp, Homo sapiens
aagaaaaaaatact

SEQ ID NO: 1334171 - DNA, 14 bp, Homo sapiens
aagaaaagatgaaa

SEQ ID NO: 1334172 - DNA, 22 bp, Homo sapiens
aagaaagtggtcttaagaaatg

SEQ ID NO: 1334173 - DNA, 17 bp, Homo sapiens
aagaaataaaccaaagg

SEQ ID NO: 1334174 - DNA, 14 bp, Homo sapiens
aagaaataatagaa

SEQ ID NO: 1334175 - DNA, 19 bp, Homo sapiens
aagaaataatgctacaatt

SEQ ID NO: 1334176 - DNA, 16 bp, Homo sapiens
aagaaatcatgtccat

SEQ ID NO: 1334177 - DNA, 12 bp, Homo sapiens
aagaaatgatgt

SEQ ID NO: 1334178 - DNA, 15 bp, Homo sapiens
aagaaatgatgttgg

SEQ ID NO: 1334179 - DNA, 14 bp, Homo sapiens
aagaaatgtataaa

SEQ ID NO: 1334180 - DNA, 19 bp, Homo sapiens
aagaacacacacatataca

SEQ ID NO: 1334181 - DNA, 23 bp, Homo sapiens
aagaactattgtgctcagagaca

SEQ ID NO: 1334182 - DNA, 22 bp, Homo sapiens
aagaagcagtggccttattgca

SEQ ID NO: 1334183 - DNA, 22 bp, Homo sapiens
aagaagcctgtaacactcctct

SEQ ID NO: 1334184 - DNA, 14 bp, Homo sapiens
aagaaggcaatatt

SEQ ID NO: 1334185 - DNA, 20 bp, Homo sapiens
aagaagtatttttagaataa

SEQ ID NO: 1334186 - DNA, 20 bp, Homo sapiens
aagaatatcctttaaaattt

SEQ ID NO: 1334187 - DNA, 21 bp, Homo sapiens
aagaatatcctttaaaattta

SEQ ID NO: 1334188 - DNA, 12 bp, Homo sapiens
aagaatattgca

SEQ ID NO: 1334189 - DNA, 16 bp, Homo sapiens
aagaatgactatataa

SEQ ID NO: 1334190 - DNA, 20 bp, Homo sapiens
aagaatgttagagtaatgaa

SEQ ID NO: 1334191 - DNA, 19 bp, Homo sapiens
aagaattcaaactggggcc

SEQ ID NO: 1334192 - DNA, 19 bp, Homo sapiens
aagaattctgattgatttg

SEQ ID NO: 1334193 - DNA, 19 bp, Homo sapiens
aagaattgaaaagtttttg

SEQ ID NO: 1334194 - DNA, 14 bp, Homo sapiens
aagaatttaaagaa

SEQ ID NO: 1334195 - DNA, 16 bp, Homo sapiens
aagaatttagtattat

SEQ ID NO: 1334196 - DNA, 14 bp, Homo sapiens
aagacaaaagtctg

SEQ ID NO: 1334197 - DNA, 16 bp, Homo sapiens
aagacaaaagtctgtc

SEQ ID NO: 1334198 - DNA, 13 bp, Homo sapiens
aagacaaatattc

SEQ ID NO: 1334199 - DNA, 20 bp, Homo sapiens
aagacaaatattcctttgca

SEQ ID NO: 1334200 - DNA, 14 bp, Homo sapiens
aagacacctggttg

SEQ ID NO: 1334201 - DNA, 15 bp, Homo sapiens
aagacactgcctggg

SEQ ID NO: 1334202 - DNA, 18 bp, Homo sapiens
aagacagtgtatgtagaa

SEQ ID NO: 1334203 - DNA, 21 bp, Homo sapiens
aagacagtgtatgtagaagca

SEQ ID NO: 1334204 - DNA, 21 bp, Homo sapiens
aagaccctcttgcccatcctg

SEQ ID NO: 1334205 - DNA, 15 bp, Homo sapiens
aagaccgccccccgc

SEQ ID NO: 1334206 - DNA, 17 bp, Homo sapiens
aagacctcacctagaaa

SEQ ID NO: 1334207 - DNA, 23 bp, Homo sapiens
aagacctggggctgctgtgaagc

SEQ ID NO: 1334208 - DNA, 12 bp, Homo sapiens
aagactaaaagt

SEQ ID NO: 1334209 - DNA, 14 bp, Homo sapiens
aagactatatatat

SEQ ID NO: 1334210 - DNA, 21 bp, Homo sapiens
aagactatatatataaatgta

SEQ ID NO: 1334211 - DNA, 13 bp, Homo sapiens
aagagaaaaaata

SEQ ID NO: 1334212 - DNA, 20 bp, Homo sapiens
aagagaactcgcgctcagta

SEQ ID NO: 1334213 - DNA, 11 bp, Homo sapiens
aagagaatgag

SEQ ID NO: 1334214 - DNA, 16 bp, Homo sapiens
aagagaatgagtcctt

SEQ ID NO: 1334215 - DNA, 22 bp, Homo sapiens
aagagagtatttttatacaaac

SEQ ID NO: 1334216 - DNA, 15 bp, Homo sapiens
aagagataagtcttt

SEQ ID NO: 1334217 - DNA, 18 bp, Homo sapiens
aagagccctaagtttgta

SEQ ID NO: 1334218 - DNA, 13 bp, Homo sapiens
aagagcccttgcc

SEQ ID NO: 1334219 - DNA, 13 bp, Homo sapiens
aagagccttaaaa

SEQ ID NO: 1334220 - DNA, 19 bp, Homo sapiens
aagaggaattacgtgctct

SEQ ID NO: 1334221 - DNA, 15 bp, Homo sapiens
aagaggcaccaggaa

SEQ ID NO: 1334222 - DNA, 18 bp, Homo sapiens
aagaggcaccaggaagcc

SEQ ID NO: 1334223 - DNA, 19 bp, Homo sapiens
aagagtttcagtttgttgg

SEQ ID NO: 1334224 - DNA, 21 bp, Homo sapiens
aagagtttcagtttgttggaa

SEQ ID NO: 1334225 - DNA, 21 bp, Homo sapiens
aagataatattaaggaagaca

SEQ ID NO: 1334226 - DNA, 13 bp, Homo sapiens
aagatactttgta

SEQ ID NO: 1334227 - DNA, 14 bp, Homo sapiens
aagatactttgtat

SEQ ID NO: 1334228 - DNA, 16 bp, Homo sapiens
aagatactttgtattg

SEQ ID NO: 1334229 - DNA, 12 bp, Homo sapiens
aagatagacagg

SEQ ID NO: 1334230 - DNA, 17 bp, Homo sapiens
aagatagacaggtcctg

SEQ ID NO: 1334231 - DNA, 19 bp, Homo sapiens
aagatagacaggtcctgat

SEQ ID NO: 1334232 - DNA, 21 bp, Homo sapiens
aagatcaaaaaggcttataaa

SEQ ID NO: 1334233 - DNA, 23 bp, Homo sapiens
aagatcaaaaaggcttataaaac

SEQ ID NO: 1334234 - DNA, 12 bp, Homo sapiens
aagatcactgtt

SEQ ID NO: 1334235 - DNA, 21 bp, Homo sapiens
aagatgaaaggcaggcctatt

SEQ ID NO: 1334236 - DNA, 19 bp, Homo sapiens
aagatgcttctcactgcca

SEQ ID NO: 1334237 - DNA, 12 bp, Homo sapiens
aagatgtgaatt

SEQ ID NO: 1334238 - DNA, 23 bp, Homo sapiens
aagatgtgaattattgacactga

SEQ ID NO: 1334239 - DNA, 20 bp, Homo sapiens
aagattcttctgtgtttata

SEQ ID NO: 1334240 - DNA, 20 bp, Homo sapiens
aagattgatatctataaaat

SEQ ID NO: 1334241 - DNA, 19 bp, Homo sapiens
aagattgcttaataaattg

SEQ ID NO: 1334242 - DNA, 20 bp, Homo sapiens
aagattttcctcttgtgatt

SEQ ID NO: 1334243 - DNA, 18 bp, Homo sapiens
aagattttttaattgttt

SEQ ID NO: 1334244 - DNA, 19 bp, Homo sapiens
aagattttttaattgttta

SEQ ID NO: 1334245 - DNA, 17 bp, Homo sapiens
aagcaaatcagaaactt

SEQ ID NO: 1334246 - DNA, 17 bp, Homo sapiens
aagcaaatgttaaaagt

SEQ ID NO: 1334247 - DNA, 21 bp, Homo sapiens
actatataatttatttccact

SEQ ID NO: 1334248 - DNA, 17 bp, Homo sapiens
actatatatataaatgt

SEQ ID NO: 1334249 - DNA, 19 bp, Homo sapiens
actatattagtatgtatgt

SEQ ID NO: 1334250 - DNA, 14 bp, Homo sapiens
actatctgtctggt

SEQ ID NO: 1334251 - DNA, 17 bp, Homo sapiens
actatctgtctggtggc

SEQ ID NO: 1334252 - DNA, 19 bp, Homo sapiens
actatgcgtggctggaacc

SEQ ID NO: 1334253 - DNA, 19 bp, Homo sapiens
actatttattgactctggg

SEQ ID NO: 1334254 - DNA, 17 bp, Homo sapiens
actcaagcgggtggctc

SEQ ID NO: 1334255 - DNA, 19 bp, Homo sapiens
actcaatgctttatttgta

SEQ ID NO: 1334256 - DNA, 20 bp, Homo sapiens
actcaatgctttatttgtaa

SEQ ID NO: 1334257 - DNA, 17 bp, Homo sapiens
actcacagagtcaaggc

SEQ ID NO: 1334258 - DNA, 21 bp, Homo sapiens
actcacagagtcaaggcctgc

SEQ ID NO: 1334259 - DNA, 21 bp, Homo sapiens
actcagagaaaaatgctcccc

SEQ ID NO: 1334260 - DNA, 14 bp, Homo sapiens
actcagagctctct

SEQ ID NO: 1334261 - DNA, 20 bp, Homo sapiens
actcagagctctctctacag

SEQ ID NO: 1334262 - DNA, 19 bp, Homo sapiens
actcaggtgggccctctga

SEQ ID NO: 1334263 - DNA, 19 bp, Homo sapiens
actcatattacaaaaacaa

SEQ ID NO: 1334264 - DNA, 20 bp, Homo sapiens
actcatcaatcaaataagta

SEQ ID NO: 1334265 - DNA, 13 bp, Homo sapiens
actcatctgaaat

SEQ ID NO: 1334266 - DNA, 16 bp, Homo sapiens
actcatctgaaatgtt

SEQ ID NO: 1334267 - DNA, 12 bp, Homo sapiens
actcatcttagg

SEQ ID NO: 1334268 - DNA, 17 bp, Homo sapiens
actcatttcatctcatt

SEQ ID NO: 1334269 - DNA, 13 bp, Homo sapiens
actccacatctgc

SEQ ID NO: 1334270 - DNA, 11 bp, Homo sapiens
actccagccag

SEQ ID NO: 1334271 - DNA, 15 bp, Homo sapiens
actccagccagcgcc

SEQ ID NO: 1334272 - DNA, 16 bp, Homo sapiens
actccagccagcgcct

SEQ ID NO: 1334273 - DNA, 21 bp, Homo sapiens
actccagccagcgcctccctc

SEQ ID NO: 1334274 - DNA, 12 bp, Homo sapiens
actccagcctgg

SEQ ID NO: 1334275 - DNA, 18 bp, Homo sapiens
actccaggccctcctctc

SEQ ID NO: 1334276 - DNA, 14 bp, Homo sapiens
actccctgcagatg

SEQ ID NO: 1334277 - DNA, 17 bp, Homo sapiens
actccctgcagatgcca

SEQ ID NO: 1334278 - DNA, 17 bp, Homo sapiens
actcccttgctggcccc

SEQ ID NO: 1334279 - DNA, 19 bp, Homo sapiens
actcccttgctggccccag

SEQ ID NO: 1334280 - DNA, 22 bp, Homo sapiens
actcccttgctggccccagccc

SEQ ID NO: 1334281 - DNA, 23 bp, Homo sapiens
actcccttgctggccccagccct

SEQ ID NO: 1334282 - DNA, 23 bp, Homo sapiens
actcctctgcgtctatcctgtgt

SEQ ID NO: 1334283 - DNA, 16 bp, Homo sapiens
actcggctctgcagtc

SEQ ID NO: 1334284 - DNA, 16 bp, Homo sapiens
actcggtttctccaaa

SEQ ID NO: 1334285 - DNA, 15 bp, Homo sapiens
actcgtgtgtttcta

SEQ ID NO: 1334286 - DNA, 19 bp, Homo sapiens
actctaagtcatgtatgtt

SEQ ID NO: 1334287 - DNA, 13 bp, Homo sapiens
actctaccctctt

SEQ ID NO: 1334288 - DNA, 18 bp, Homo sapiens
actctaccctcttagaaa

SEQ ID NO: 1334289 - DNA, 21 bp, Homo sapiens
actctacttaatccaatgggt

SEQ ID NO: 1334290 - DNA, 23 bp, Homo sapiens
actctatcggagaacatgaatca

SEQ ID NO: 1334291 - DNA, 22 bp, Homo sapiens
actctcacactggttctcaatg

SEQ ID NO: 1334292 - DNA, 20 bp, Homo sapiens
actctgcttctctgacttct

SEQ ID NO: 1334293 - DNA, 17 bp, Homo sapiens
actctggcttttggaag

SEQ ID NO: 1334294 - DNA, 11 bp, Homo sapiens
actcttaaaac

SEQ ID NO: 1334295 - DNA, 12 bp, Homo sapiens
actcttctcatt

SEQ ID NO: 1334296 - DNA, 21 bp, Homo sapiens
actcttgagttgtttttgtat

SEQ ID NO: 1334297 - DNA, 12 bp, Homo sapiens
actctttgagag

SEQ ID NO: 1334298 - DNA, 16 bp, Homo sapiens
actgaaaggcttttca

SEQ ID NO: 1334299 - DNA, 17 bp, Homo sapiens
actgaaaggcttttcaa

SEQ ID NO: 1334300 - DNA, 23 bp, Homo sapiens
actgaaagttttgtaaaagaaat

SEQ ID NO: 1334301 - DNA, 17 bp, Homo sapiens
actgaaatgcctgcttt

SEQ ID NO: 1334302 - DNA, 19 bp, Homo sapiens
actgaaccacttgtagatt

SEQ ID NO: 1334303 - DNA, 20 bp, Homo sapiens
actgaaccacttgtagattt

SEQ ID NO: 1334304 - DNA, 23 bp, Homo sapiens
actgaagtcttactacagaaatg

SEQ ID NO: 1334305 - DNA, 16 bp, Homo sapiens
actgaatttttttgta

SEQ ID NO: 1334306 - DNA, 12 bp, Homo sapiens
actgactgaggc

SEQ ID NO: 1334307 - DNA, 15 bp, Homo sapiens
actgactgaggcagt

SEQ ID NO: 1334308 - DNA, 18 bp, Homo sapiens
actgaggcagtttgagga

SEQ ID NO: 1334309 - DNA, 13 bp, Homo sapiens
actgagtgggaag

SEQ ID NO: 1334310 - DNA, 14 bp, Homo sapiens
actgagtgggaagc

SEQ ID NO: 1334311 - DNA, 15 bp, Homo sapiens
actgagtgggaagcc

SEQ ID NO: 1334312 - DNA, 20 bp, Homo sapiens
actgcactccagcctgggtg

SEQ ID NO: 1334313 - DNA, 14 bp, Homo sapiens
actgcaggccctgg

SEQ ID NO: 1334314 - DNA, 15 bp, Homo sapiens
actgcaggccctggc

SEQ ID NO: 1334315 - DNA, 18 bp, Homo sapiens
actgcaggccctggcctc

SEQ ID NO: 1334316 - DNA, 19 bp, Homo sapiens
actgcatttagggagtatt

SEQ ID NO: 1334317 - DNA, 13 bp, Homo sapiens
actgccagcagca

SEQ ID NO: 1334318 - DNA, 16 bp, Homo sapiens
actgccagcagcagca

SEQ ID NO: 1334319 - DNA, 15 bp, Homo sapiens
actgccaggccagcc

SEQ ID NO: 1334320 - DNA, 19 bp, Homo sapiens
actgccaggccagcctccg

SEQ ID NO: 1334321 - DNA, 15 bp, Homo sapiens
actgcccggcagggt

SEQ ID NO: 1334322 - DNA, 15 bp, Homo sapiens
actgcctgaataaag

SEQ ID NO: 1334323 - DNA, 17 bp, Homo sapiens
actgcctgaataaagag

SEQ ID NO: 1334324 - DNA, 14 bp, Homo sapiens
actgcctgccttaa

SEQ ID NO: 1334325 - DNA, 15 bp, Homo sapiens
actgccttcgcttct

SEQ ID NO: 1334326 - DNA, 21 bp, Homo sapiens
actgcgaagaccctcttgccc

SEQ ID NO: 1334327 - DNA, 15 bp, Homo sapiens
actgcgactttctgc

SEQ ID NO: 1334328 - DNA, 19 bp, Homo sapiens
actgcgactttctgcctgg

SEQ ID NO: 1334329 - DNA, 23 bp, Homo sapiens
actgcgactttctgcctggagtg

SEQ ID NO: 1334330 - DNA, 15 bp, Homo sapiens
actgctaaataaaat

SEQ ID NO: 1334331 - DNA, 17 bp, Homo sapiens
actgctaaataaaattt

SEQ ID NO: 1334332 - DNA, 13 bp, Homo sapiens
actgcttgaataa

SEQ ID NO: 1334333 - DNA, 23 bp, Homo sapiens
actggaaaggggagagcctgctg

SEQ ID NO: 1334334 - DNA, 16 bp, Homo sapiens
actggaggttgaagcc

SEQ ID NO: 1334335 - DNA, 18 bp, Homo sapiens
actggatgcagaaacagt

SEQ ID NO: 1334336 - DNA, 23 bp, Homo sapiens
actggcaatggtagtttctgtgg

SEQ ID NO: 1334337 - DNA, 21 bp, Homo sapiens
actggcccctactttgtggca

SEQ ID NO: 1334338 - DNA, 20 bp, Homo sapiens
actggcttttattaatgcac

SEQ ID NO: 1334339 - DNA, 16 bp, Homo sapiens
actggggcagacaata

SEQ ID NO: 1334340 - DNA, 12 bp, Homo sapiens
actggggcctcc

SEQ ID NO: 1334341 - DNA, 15 bp, Homo sapiens
actggggttgagggc

SEQ ID NO: 1334342 - DNA, 15 bp, Homo sapiens
actgggttgcgggac

SEQ ID NO: 1334343 - DNA, 14 bp, Homo sapiens
actggttctcaatg

SEQ ID NO: 1334344 - DNA, 18 bp, Homo sapiens
actggttctcaatgaaaa

SEQ ID NO: 1334345 - DNA, 13 bp, Homo sapiens
actggttgcatgg

SEQ ID NO: 1334346 - DNA, 15 bp, Homo sapiens
actggttgcatggaa

SEQ ID NO: 1334347 - DNA, 19 bp, Homo sapiens
actggttttctgccaatga

SEQ ID NO: 1334348 - DNA, 15 bp, Homo sapiens
actgtagatatgtat

SEQ ID NO: 1334349 - DNA, 19 bp, Homo sapiens
actgtagcttttaggaata

SEQ ID NO: 1334350 - DNA, 13 bp, Homo sapiens
actgtagggaggg

SEQ ID NO: 1334351 - DNA, 13 bp, Homo sapiens
actgtcttcctca

SEQ ID NO: 1334352 - DNA, 18 bp, Homo sapiens
actgtcttcctcaaaata

SEQ ID NO: 1334353 - DNA, 22 bp, Homo sapiens
actgtgcgtcttggtgtaattt

SEQ ID NO: 1334354 - DNA, 17 bp, Homo sapiens
actgtgctgttgttctc

SEQ ID NO: 1334355 - DNA, 12 bp, Homo sapiens
actgtgtaaact

SEQ ID NO: 1334356 - DNA, 13 bp, Homo sapiens
actgtgtatattt

SEQ ID NO: 1334357 - DNA, 19 bp, Homo sapiens
actgtgtatatttgattta

SEQ ID NO: 1334358 - DNA, 18 bp, Homo sapiens
actgtgttttataaaata

SEQ ID NO: 1334359 - DNA, 15 bp, Homo sapiens
actgttactgggccc

SEQ ID NO: 1334360 - DNA, 23 bp, Homo sapiens
actgttcggaaggggttcctcaa

SEQ ID NO: 1334361 - DNA, 14 bp, Homo sapiens
actgttgtaagaat

SEQ ID NO: 1334362 - DNA, 19 bp, Homo sapiens
actgttgtagaagacaaaa

SEQ ID NO: 1334363 - DNA, 20 bp, Homo sapiens
actgtttaatcatagttact

SEQ ID NO: 1334364 - DNA, 13 bp, Homo sapiens
actgtttcctggg

SEQ ID NO: 1334365 - DNA, 21 bp, Homo sapiens
actgtttgtttttatttaaat

SEQ ID NO: 1334366 - DNA, 22 bp, Homo sapiens
actgtttgtttttatttaaatt

SEQ ID NO: 1334367 - DNA, 15 bp, Homo sapiens
acttaaagaagtatt

SEQ ID NO: 1334368 - DNA, 22 bp, Homo sapiens
aatttctttttttcctttttaa

SEQ ID NO: 1334369 - DNA, 16 bp, Homo sapiens
aatttgcactgtttaa

SEQ ID NO: 1334370 - DNA, 14 bp, Homo sapiens
aatttgcatactta

SEQ ID NO: 1334371 - DNA, 17 bp, Homo sapiens
aattttaaagtgcaaaa

SEQ ID NO: 1334372 - DNA, 18 bp, Homo sapiens
aattttcacttttggcaa

SEQ ID NO: 1334373 - DNA, 21 bp, Homo sapiens
aattttgaaaagtaatattta

SEQ ID NO: 1334374 - DNA, 22 bp, Homo sapiens
aattttgaaaagtaatatttat

SEQ ID NO: 1334375 - DNA, 16 bp, Homo sapiens
aattttgtatgaaaaa

SEQ ID NO: 1334376 - DNA, 20 bp, Homo sapiens
aattttgtatgttaaagaga

SEQ ID NO: 1334377 - DNA, 14 bp, Homo sapiens
aatttttaagagaa

SEQ ID NO: 1334378 - DNA, 12 bp, Homo sapiens
aatttttattgt

SEQ ID NO: 1334379 - DNA, 17 bp, Homo sapiens
aatttttgtattatttt

SEQ ID NO: 1334380 - DNA, 15 bp, Homo sapiens
acaaaaagcttcccc

SEQ ID NO: 1334381 - DNA, 20 bp, Homo sapiens
acaaaattaagcaaatgtta

SEQ ID NO: 1334382 - DNA, 21 bp, Homo sapiens
acaaacctaccaaaatggaat

SEQ ID NO: 1334383 - DNA, 15 bp, Homo sapiens
acaaacgggctcagc

SEQ ID NO: 1334384 - DNA, 17 bp, Homo sapiens
acaaagacaaaagtctg

SEQ ID NO: 1334385 - DNA, 18 bp, Homo sapiens
acaaagttaaaattgtta

SEQ ID NO: 1334386 - DNA, 15 bp, Homo sapiens
acaaatgactttatt

SEQ ID NO: 1334387 - DNA, 17 bp, Homo sapiens
acaaatgactttattat

SEQ ID NO: 1334388 - DNA, 18 bp, Homo sapiens
acaaatgactttattatt

SEQ ID NO: 1334389 - DNA, 21 bp, Homo sapiens
acaaatgactttattatttat

SEQ ID NO: 1334390 - DNA, 17 bp, Homo sapiens
acaaatgctcaaagaaa

SEQ ID NO: 1334391 - DNA, 17 bp, Homo sapiens
acaacaaaaagcttccc

SEQ ID NO: 1334392 - DNA, 18 bp, Homo sapiens
acaacaattggtaaaact

SEQ ID NO: 1334393 - DNA, 19 bp, Homo sapiens
acaacatgtttaataaata

SEQ ID NO: 1334394 - DNA, 20 bp, Homo sapiens
acaagattttttaattgttt

SEQ ID NO: 1334395 - DNA, 13 bp, Homo sapiens
acaagctgcaccc

SEQ ID NO: 1334396 - DNA, 22 bp, Homo sapiens
acaagctgcaccctcaggcagg

SEQ ID NO: 1334397 - DNA, 18 bp, Homo sapiens
acaagggaagatttatgt

SEQ ID NO: 1334398 - DNA, 20 bp, Homo sapiens
acaagggaagatttatgttt

SEQ ID NO: 1334399 - DNA, 16 bp, Homo sapiens
acaagtagttctgtat

SEQ ID NO: 1334400 - DNA, 21 bp, Homo sapiens
acaagttgagctatgacttaa

SEQ ID NO: 1334401 - DNA, 18 bp, Homo sapiens
acaagttgcttttacctg

SEQ ID NO: 1334402 - DNA, 14 bp, Homo sapiens
acaataaaattttt

SEQ ID NO: 1334403 - DNA, 22 bp, Homo sapiens
acaataggagtggtgatttgaa

SEQ ID NO: 1334404 - DNA, 23 bp, Homo sapiens
acaataggagtggtgatttgaaa

SEQ ID NO: 1334405 - DNA, 17 bp, Homo sapiens
acaatattccagatctt

SEQ ID NO: 1334406 - DNA, 22 bp, Homo sapiens
acaatccacgcttctccggatc

SEQ ID NO: 1334407 - DNA, 17 bp, Homo sapiens
acaatgaagttgaaaat

SEQ ID NO: 1334408 - DNA, 21 bp, Homo sapiens
acaatgatcaccgactgaaaa

SEQ ID NO: 1334409 - DNA, 17 bp, Homo sapiens
acaatgctgatttggtg

SEQ ID NO: 1334410 - DNA, 15 bp, Homo sapiens
acaatggagtattct

SEQ ID NO: 1334411 - DNA, 17 bp, Homo sapiens
acaatgtgaaaagaaaa

SEQ ID NO: 1334412 - DNA, 17 bp, Homo sapiens
acaattctgtttttaat

SEQ ID NO: 1334413 - DNA, 15 bp, Homo sapiens
acaattttgtacaaa

SEQ ID NO: 1334414 - DNA, 13 bp, Homo sapiens
acacagaaacact

SEQ ID NO: 1334415 - DNA, 16 bp, Homo sapiens
acacagaatgcaacca

SEQ ID NO: 1334416 - DNA, 21 bp, Homo sapiens
acacagacactaacgaaatat

SEQ ID NO: 1334417 - DNA, 14 bp, Homo sapiens
acacagcagcagtt

SEQ ID NO: 1334418 - DNA, 19 bp, Homo sapiens
acacagcctgggccccagc

SEQ ID NO: 1334419 - DNA, 17 bp, Homo sapiens
acacatagcatgtaatg

SEQ ID NO: 1334420 - DNA, 14 bp, Homo sapiens
acacattacaaagt

SEQ ID NO: 1334421 - DNA, 18 bp, Homo sapiens
acaccctcaacctcttct

SEQ ID NO: 1334422 - DNA, 18 bp, Homo sapiens
acacctctgcacaagctg

SEQ ID NO: 1334423 - DNA, 19 bp, Homo sapiens
acacctctgcacaagctgc

SEQ ID NO: 1334424 - DNA, 22 bp, Homo sapiens
acaccttggacatcctcctccc

SEQ ID NO: 1334425 - DNA, 22 bp, Homo sapiens
acacggagcccagccctcccca

SEQ ID NO: 1334426 - DNA, 17 bp, Homo sapiens
acacgttttaaggactg

SEQ ID NO: 1334427 - DNA, 19 bp, Homo sapiens
acactaactcaccagcccc

SEQ ID NO: 1334428 - DNA, 14 bp, Homo sapiens
acactccagggaca

SEQ ID NO: 1334429 - DNA, 12 bp, Homo sapiens
acactcctctgc

SEQ ID NO: 1334430 - DNA, 13 bp, Homo sapiens
acactgaaagttt

SEQ ID NO: 1334431 - DNA, 18 bp, Homo sapiens
acactgaaagttttgtaa

SEQ ID NO: 1334432 - DNA, 15 bp, Homo sapiens
acactgcctgcctta

SEQ ID NO: 1334433 - DNA, 16 bp, Homo sapiens
acactgcctgccttaa

SEQ ID NO: 1334434 - DNA, 12 bp, Homo sapiens
acactgcctggg

SEQ ID NO: 1334435 - DNA, 16 bp, Homo sapiens
acactgcctgggctga

SEQ ID NO: 1334436 - DNA, 19 bp, Homo sapiens
tttcatgaaaataccattt

SEQ ID NO: 1334437 - DNA, 20 bp, Homo sapiens
tttcatggctgctgttgctt

SEQ ID NO: 1334438 - DNA, 14 bp, Homo sapiens
tttcatgtaaaaca

SEQ ID NO: 1334439 - DNA, 22 bp, Homo sapiens
tttcattgctgggcttgtctgt

SEQ ID NO: 1334440 - DNA, 19 bp, Homo sapiens
tttcatttaagggaaagaa

SEQ ID NO: 1334441 - DNA, 19 bp, Homo sapiens
tttccaccacagccagcac

SEQ ID NO: 1334442 - DNA, 18 bp, Homo sapiens
tttccagacttccttgag

SEQ ID NO: 1334443 - DNA, 22 bp, Homo sapiens
tttccaggctatgtataaaata

SEQ ID NO: 1334444 - DNA, 23 bp, Homo sapiens
tttcccacttcccaccctgcccc

SEQ ID NO: 1334445 - DNA, 19 bp, Homo sapiens
ttatttgcatgttatgttt

SEQ ID NO: 1334446 - DNA, 21 bp, Homo sapiens
ttatttgcatgttatgtttaa

SEQ ID NO: 1334447 - DNA, 19 bp, Homo sapiens
ttatttgtaaatttagtgt

SEQ ID NO: 1334448 - DNA, 17 bp, Homo sapiens
ttattttacacagaaac

SEQ ID NO: 1334449 - DNA, 20 bp, Homo sapiens
ttattttacagctcattaaa

SEQ ID NO: 1334450 - DNA, 21 bp, Homo sapiens
ttattttggagattataataa

SEQ ID NO: 1334451 - DNA, 21 bp, Homo sapiens
ttatttttataattgtacaaa

SEQ ID NO: 1334452 - DNA, 21 bp, Homo sapiens
ttattttttggacttcaaagc

SEQ ID NO: 1334453 - DNA, 13 bp, Homo sapiens
ttatttttttgaa

SEQ ID NO: 1334454 - DNA, 21 bp, Homo sapiens
ttcaaactggggcctccagaa

SEQ ID NO: 1334455 - DNA, 12 bp, Homo sapiens
ttcaaagccttc

SEQ ID NO: 1334456 - DNA, 17 bp, Homo sapiens
ttcaaagccttctccct

SEQ ID NO: 1334457 - DNA, 14 bp, Homo sapiens
ttcaaaggaacatt

SEQ ID NO: 1334458 - DNA, 22 bp, Homo sapiens
ttcaacaaatattcactggccc

SEQ ID NO: 1334459 - DNA, 20 bp, Homo sapiens
ttcaacagcaagtgtgaata

SEQ ID NO: 1334460 - DNA, 13 bp, Homo sapiens
ttcaagatcaaaa

SEQ ID NO: 1334461 - DNA, 17 bp, Homo sapiens
ttcaagcagtcgtgcct

SEQ ID NO: 1334462 - DNA, 19 bp, Homo sapiens
ttcaagtgtaaaatatttt

SEQ ID NO: 1334463 - DNA, 22 bp, Homo sapiens
ttcaagttgtaaataatttatt

SEQ ID NO: 1334464 - DNA, 15 bp, Homo sapiens
ttcacagtagagcca

SEQ ID NO: 1334465 - DNA, 17 bp, Homo sapiens
ttcacagtagagccagc

SEQ ID NO: 1334466 - DNA, 18 bp, Homo sapiens
ttcacagtagagccagct

SEQ ID NO: 1334467 - DNA, 19 bp, Homo sapiens
ttcacagtagagccagctt

SEQ ID NO: 1334468 - DNA, 15 bp, Homo sapiens
ttcacattcttggct

SEQ ID NO: 1334469 - DNA, 16 bp, Homo sapiens
ttcacattcttggctt

SEQ ID NO: 1334470 - DNA, 17 bp, Homo sapiens
ttcacattgttaagaaa

SEQ ID NO: 1334471 - DNA, 19 bp, Homo sapiens
ttcaccatcaatcctgatt

SEQ ID NO: 1334472 - DNA, 13 bp, Homo sapiens
ttcaccattcgta

SEQ ID NO: 1334473 - DNA, 14 bp, Homo sapiens
ttcaccttgaagaa

SEQ ID NO: 1334474 - DNA, 18 bp, Homo sapiens
ttcactctaagtcatgta

SEQ ID NO: 1334475 - DNA, 15 bp, Homo sapiens
ttcagaaatataaca

SEQ ID NO: 1334476 - DNA, 20 bp, Homo sapiens
ttcagaaatataacacattt

SEQ ID NO: 1334477 - DNA, 21 bp, Homo sapiens
ttcagaaatataacacatttt

SEQ ID NO: 1334478 - DNA, 20 bp, Homo sapiens
ttcagaagtgcccttcctgc

SEQ ID NO: 1334479 - DNA, 20 bp, Homo sapiens
ttcagcagcaaattttcagc

SEQ ID NO: 1334480 - DNA, 17 bp, Homo sapiens
ttcagctctgcaagaat

SEQ ID NO: 1334481 - DNA, 23 bp, Homo sapiens
ttcagggtaaataggaatcattc

SEQ ID NO: 1334482 - DNA, 15 bp, Homo sapiens
ttcagtaactgtcag

SEQ ID NO: 1334483 - DNA, 21 bp, Homo sapiens
ttcagtacttttttaaatatt

SEQ ID NO: 1334484 - DNA, 17 bp, Homo sapiens
ttcagtcccttccccat

SEQ ID NO: 1334485 - DNA, 20 bp, Homo sapiens
ttcagttctttggattctaa

SEQ ID NO: 1334486 - DNA, 23 bp, Homo sapiens
ttcatactccttttaagcagtga

SEQ ID NO: 1334487 - DNA, 17 bp, Homo sapiens
ttcatagtaagattgat

SEQ ID NO: 1334488 - DNA, 19 bp, Homo sapiens
ttcatagtatccatatttt

SEQ ID NO: 1334489 - DNA, 23 bp, Homo sapiens
ttcatctcatttaagggaaaaat

SEQ ID NO: 1334490 - DNA, 17 bp, Homo sapiens
ttcatgaaaataccatt

SEQ ID NO: 1334491 - DNA, 16 bp, Homo sapiens
ttcatgaccagtaaag

SEQ ID NO: 1334492 - DNA, 19 bp, Homo sapiens
ttcatgcacttaaagaagt

SEQ ID NO: 1334493 - DNA, 18 bp, Homo sapiens
ttcatggctgctgttgct

SEQ ID NO: 1334494 - DNA, 13 bp, Homo sapiens
ttcattattctct

SEQ ID NO: 1334495 - DNA, 15 bp, Homo sapiens
ttccaaaccttatct

SEQ ID NO: 1334496 - DNA, 20 bp, Homo sapiens
ttccaaaccttatctccaca

SEQ ID NO: 1334497 - DNA, 14 bp, Homo sapiens
ttccaaataaataa

SEQ ID NO: 1334498 - DNA, 15 bp, Homo sapiens
ttccaataaactatg

SEQ ID NO: 1334499 - DNA, 22 bp, Homo sapiens
ttccaccacagccagcacctgg

SEQ ID NO: 1334500 - DNA, 15 bp, Homo sapiens
ttccaccccaagaga

SEQ ID NO: 1334501 - DNA, 14 bp, Homo sapiens
ttccactaaaaata

SEQ ID NO: 1334502 - DNA, 17 bp, Homo sapiens
ttccactacacctggct

SEQ ID NO: 1334503 - DNA, 20 bp, Homo sapiens
ttccagacttccttgagaca

SEQ ID NO: 1334504 - DNA, 23 bp, Homo sapiens
ttccagatggtcatccagactca

SEQ ID NO: 1334505 - DNA, 14 bp, Homo sapiens
ttccagatgtggat

SEQ ID NO: 1334506 - DNA, 16 bp, Homo sapiens
ttccagcccctctggt

SEQ ID NO: 1334507 - DNA, 20 bp, Homo sapiens
ttccagcccctctggtcgct

SEQ ID NO: 1334508 - DNA, 21 bp, Homo sapiens
ttccaggaaactccacatctg

SEQ ID NO: 1334509 - DNA, 24 bp, Homo sapiens
ttccaggaaactccacatctgcct

SEQ ID NO: 1334510 - DNA, 15 bp, Homo sapiens
ttccagggaggggcc

SEQ ID NO: 1334511 - DNA, 18 bp, Homo sapiens
ttccagtggatcataaga

SEQ ID NO: 1334512 - DNA, 23 bp, Homo sapiens
ttcccaaaggcattataaaaaga

SEQ ID NO: 1334513 - DNA, 23 bp, Homo sapiens
ttcccaagccttcgggcgtctgt

SEQ ID NO: 1334514 - DNA, 23 bp, Homo sapiens
ttcccatggggagggattctggt

SEQ ID NO: 1334515 - DNA, 17 bp, Homo sapiens
ttcccatgtagccccct

SEQ ID NO: 1334516 - DNA, 17 bp, Homo sapiens
ttcccatttgtgccaga

SEQ ID NO: 1334517 - DNA, 22 bp, Homo sapiens
ttcccccaccggtccagctggc

SEQ ID NO: 1334518 - DNA, 23 bp, Homo sapiens
ttcccccaccggtccagctggcc

SEQ ID NO: 1334519 - DNA, 15 bp, Homo sapiens
ttccctgcttccagg

SEQ ID NO: 1334520 - DNA, 16 bp, Homo sapiens
ttccctgcttccagga

SEQ ID NO: 1334521 - DNA, 22 bp, Homo sapiens
ttccgaagaagatgctccagca

SEQ ID NO: 1334522 - DNA, 17 bp, Homo sapiens
ttccgtgaaaacggagc

SEQ ID NO: 1334523 - DNA, 14 bp, Homo sapiens
ttccgtgcgtggca

SEQ ID NO: 1334524 - DNA, 14 bp, Homo sapiens
ttcctatatcctgt

SEQ ID NO: 1334525 - DNA, 15 bp, Homo sapiens
ttcctctagaagcca

SEQ ID NO: 1334526 - DNA, 14 bp, Homo sapiens
ttcctctctccaga

SEQ ID NO: 1334527 - DNA, 12 bp, Homo sapiens
ttcctctgcctg

SEQ ID NO: 1334528 - DNA, 16 bp, Homo sapiens
ttcctctgcctgcccc

SEQ ID NO: 1334529 - DNA, 22 bp, Homo sapiens
ttcctctttttatttagttcct

SEQ ID NO: 1334530 - DNA, 14 bp, Homo sapiens
ttcctgaaccatgt

SEQ ID NO: 1334531 - DNA, 16 bp, Homo sapiens
ttcctgcgtcctcctc

SEQ ID NO: 1334532 - DNA, 17 bp, Homo sapiens
ttcctgcgtcctcctca

SEQ ID NO: 1334533 - DNA, 22 bp, Homo sapiens
ttcctggaattgccagctgaca

SEQ ID NO: 1334534 - DNA, 21 bp, Homo sapiens
ttcctggcactggaccccagc

SEQ ID NO: 1334535 - DNA, 20 bp, Homo sapiens
ttgtgttcctacagacactt

SEQ ID NO: 1334536 - DNA, 15 bp, Homo sapiens
ttgttaatacaaggt

SEQ ID NO: 1334537 - DNA, 12 bp, Homo sapiens
ttgttatcaaaa

SEQ ID NO: 1334538 - DNA, 15 bp, Homo sapiens
ttgttcatagcccag

SEQ ID NO: 1334539 - DNA, 23 bp, Homo sapiens
ttgttccttggagaaatgaaaac

SEQ ID NO: 1334540 - DNA, 19 bp, Homo sapiens
ttgttcttggcaataaatt

SEQ ID NO: 1334541 - DNA, 21 bp, Homo sapiens
ttgttcttggcaataaatttt

SEQ ID NO: 1334542 - DNA, 14 bp, Homo sapiens
ttgttctttcagaa

SEQ ID NO: 1334543 - DNA, 15 bp, Homo sapiens
ttgttctttcagaaa

SEQ ID NO: 1334544 - DNA, 18 bp, Homo sapiens
ttgttgcaagatgtgaat

SEQ ID NO: 1334545 - DNA, 20 bp, Homo sapiens
ttgttgcaagatgtgaatta

SEQ ID NO: 1334546 - DNA, 21 bp, Homo sapiens
ttgttgtaaaacaaaatttga

SEQ ID NO: 1334547 - DNA, 21 bp, Homo sapiens
ttgtttaaaaaccgaataaat

SEQ ID NO: 1334548 - DNA, 12 bp, Homo sapiens
ttgtttggagac

SEQ ID NO: 1334549 - DNA, 13 bp, Homo sapiens
ttaatttaagttt

SEQ ID NO: 1334550 - DNA, 15 bp, Homo sapiens
ttaatttaagttttg

SEQ ID NO: 1334551 - DNA, 16 bp, Homo sapiens
ttaatttaagttttga

SEQ ID NO: 1334552 - DNA, 15 bp, Homo sapiens
ttaatttcctttttg

SEQ ID NO: 1334553 - DNA, 18 bp, Homo sapiens
ttaatttcctttttgaca

SEQ ID NO: 1334554 - DNA, 13 bp, Homo sapiens
ttaattttaaagt

SEQ ID NO: 1334555 - DNA, 17 bp, Homo sapiens
ttaatttttaatgatga

SEQ ID NO: 1334556 - DNA, 16 bp, Homo sapiens
ttacaagggaagattt

SEQ ID NO: 1334557 - DNA, 21 bp, Homo sapiens
ttacaatattgattgggaaaa

SEQ ID NO: 1334558 - DNA, 13 bp, Homo sapiens
ttacacagaaaca

SEQ ID NO: 1334559 - DNA, 18 bp, Homo sapiens
ttacacagaaacactgcc

SEQ ID NO: 1334560 - DNA, 19 bp, Homo sapiens
ttacacagaaacactgcct

SEQ ID NO: 1334561 - DNA, 22 bp, Homo sapiens
ttacactggcaatggtagtttc

SEQ ID NO: 1334562 - DNA, 18 bp, Homo sapiens
ttacagaaaaagacttta

SEQ ID NO: 1334563 - DNA, 20 bp, Homo sapiens
ttacagaatcttccttttat

SEQ ID NO: 1334564 - DNA, 16 bp, Homo sapiens
ttacccacctagaaca

SEQ ID NO: 1334565 - DNA, 13 bp, Homo sapiens
ttacctagtgaaa

SEQ ID NO: 1334566 - DNA, 21 bp, Homo sapiens
ttacctagtgaaacttttcta

SEQ ID NO: 1334567 - DNA, 22 bp, Homo sapiens
ttacctagtgaaacttttctag

SEQ ID NO: 1334568 - DNA, 15 bp, Homo sapiens
ttacctgtatacagt

SEQ ID NO: 1334569 - DNA, 19 bp, Homo sapiens
ttacctgtatacagtgcag

SEQ ID NO: 1334570 - DNA, 14 bp, Homo sapiens
ttacctttctctct

SEQ ID NO: 1334571 - DNA, 20 bp, Homo sapiens
ttacgaagttcaagatcaaa

SEQ ID NO: 1334572 - DNA, 20 bp, Homo sapiens
ttacggttttccaggtttaa

SEQ ID NO: 1334573 - DNA, 17 bp, Homo sapiens
ttactaaaaagtataaa

SEQ ID NO: 1334574 - DNA, 15 bp, Homo sapiens
ttactgcagctttgt

SEQ ID NO: 1334575 - DNA, 14 bp, Homo sapiens
ttactgccttgaaa

SEQ ID NO: 1334576 - DNA, 23 bp, Homo sapiens
ttactggggctggggaaggaagc

SEQ ID NO: 1334577 - DNA, 18 bp, Homo sapiens
ttactggttgcatggaaa

SEQ ID NO: 1334578 - DNA, 14 bp, Homo sapiens
ttactgtgtaaact

SEQ ID NO: 1334579 - DNA, 23 bp, Homo sapiens
ttactgtttattacttccatgaa

SEQ ID NO: 1334580 - DNA, 23 bp, Homo sapiens
ttacttgttgcctataagccaaa

SEQ ID NO: 1334581 - DNA, 15 bp, Homo sapiens
ttacttgttttggat

SEQ ID NO: 1334582 - DNA, 20 bp, Homo sapiens
ttactttactgcctgaataa

SEQ ID NO: 1334583 - DNA, 13 bp, Homo sapiens
ttactttgtaaat

SEQ ID NO: 1334584 - DNA, 15 bp, Homo sapiens
ttagaacaggttttt

SEQ ID NO: 1334585 - DNA, 16 bp, Homo sapiens
ttagaataagaatttg

SEQ ID NO: 1334586 - DNA, 17 bp, Homo sapiens
ttagaattaaaaaagca

SEQ ID NO: 1334587 - DNA, 13 bp, Homo sapiens
ttagaccctgggt

SEQ ID NO: 1334588 - DNA, 12 bp, Homo sapiens
ttagacttgaaa

SEQ ID NO: 1334589 - DNA, 19 bp, Homo sapiens
ttagccaggtaatgtgaat

SEQ ID NO: 1334590 - DNA, 13 bp, Homo sapiens
ttagctcctgtgg

SEQ ID NO: 1334591 - DNA, 16 bp, Homo sapiens
ttaggattttcacatt

SEQ ID NO: 1334592 - DNA, 18 bp, Homo sapiens
ttagggagtattctaata

SEQ ID NO: 1334593 - DNA, 19 bp, Homo sapiens
ttaggggaaggagaagtaa

SEQ ID NO: 1334594 - DNA, 19 bp, Homo sapiens
ttagtatttatttatgtac

SEQ ID NO: 1334595 - DNA, 16 bp, Homo sapiens
ttagtgtttttttatt

SEQ ID NO: 1334596 - DNA, 16 bp, Homo sapiens
ttagtttagaacaggt

SEQ ID NO: 1334597 - DNA, 15 bp, Homo sapiens
ttagtttgtatatat

SEQ ID NO: 1334598 - DNA, 19 bp, Homo sapiens
ttagtttttggttgggaat

SEQ ID NO: 1334599 - DNA, 22 bp, Homo sapiens
ttataaaacagagtaatcttgt

SEQ ID NO: 1334600 - DNA, 20 bp, Homo sapiens
ttataaaatataaacaaaga

SEQ ID NO: 1334601 - DNA, 20 bp, Homo sapiens
ttataaaatcctgtgcaata

SEQ ID NO: 1334602 - DNA, 13 bp, Homo sapiens
ttataaaatggct

SEQ ID NO: 1334603 - DNA, 18 bp, Homo sapiens
ttataaatcttatgctct

SEQ ID NO: 1334604 - DNA, 15 bp, Homo sapiens
ttataataaatatat

SEQ ID NO: 1334605 - DNA, 23 bp, Homo sapiens
ttatactactttgttaggatttt

SEQ ID NO: 1334606 - DNA, 21 bp, Homo sapiens
ttatagaggctagcttctgct

SEQ ID NO: 1334607 - DNA, 16 bp, Homo sapiens
ttatagtcaatggctt

SEQ ID NO: 1334608 - DNA, 13 bp, Homo sapiens
ttatatgaacata

SEQ ID NO: 1334609 - DNA, 17 bp, Homo sapiens
ttatatgaacatacaaa

SEQ ID NO: 1334610 - DNA, 12 bp, Homo sapiens
ttatatgtatgt

SEQ ID NO: 1334611 - DNA, 17 bp, Homo sapiens
ttatatgtatgtgttta

SEQ ID NO: 1334612 - DNA, 19 bp, Homo sapiens
ttatatgtatgtgtttaga

SEQ ID NO: 1334613 - DNA, 21 bp, Homo sapiens
ttatatgtatgtgtttagaat

SEQ ID NO: 1334614 - DNA, 16 bp, Homo sapiens
ttatatttcctttatg

SEQ ID NO: 1334615 - DNA, 21 bp, Homo sapiens
ttatatttcctttatgtgaat

SEQ ID NO: 1334616 - DNA, 22 bp, Homo sapiens
ttatatttcctttatgtgaatt

SEQ ID NO: 1334617 - DNA, 20 bp, Homo sapiens
ttatcaaaatagtctaaggc

SEQ ID NO: 1334618 - DNA, 19 bp, Homo sapiens
ttatcaatatctaatatat

SEQ ID NO: 1334619 - DNA, 18 bp, Homo sapiens
ttatcattcaagtgtaaa

SEQ ID NO: 1334620 - DNA, 15 bp, Homo sapiens
ttatcgtttttgtat

SEQ ID NO: 1334621 - DNA, 14 bp, Homo sapiens
ttatctttgaatat

SEQ ID NO: 1334622 - DNA, 13 bp, Homo sapiens
ttatgagaaactt

SEQ ID NO: 1334623 - DNA, 23 bp, Homo sapiens
ttatgatgacgtacaagtagttc

SEQ ID NO: 1334624 - DNA, 13 bp, Homo sapiens
ttatggaaaactg

SEQ ID NO: 1334625 - DNA, 20 bp, Homo sapiens
ttatggttacttcttctctt

SEQ ID NO: 1334626 - DNA, 16 bp, Homo sapiens
ttatggttatgttttt

SEQ ID NO: 1334627 - DNA, 17 bp, Homo sapiens
ttatggttttgtgatgt

SEQ ID NO: 1334628 - DNA, 16 bp, Homo sapiens
ttatgtaaataattct

SEQ ID NO: 1334629 - DNA, 15 bp, Homo sapiens
ttatgtgacattaac

SEQ ID NO: 1334630 - DNA, 14 bp, Homo sapiens
ttatgtttaataag

SEQ ID NO: 1334631 - DNA, 21 bp, Homo sapiens
ttattaaatttttttgtatga

SEQ ID NO: 1334632 - DNA, 14 bp, Homo sapiens
ttattaacttaata

SEQ ID NO: 1334633 - DNA, 17 bp, Homo sapiens
ttattaacttaataatc

SEQ ID NO: 1334634 - DNA, 18 bp, Homo sapiens
ttattaatatttaacatt

SEQ ID NO: 1334635 - DNA, 14 bp, Homo sapiens
ttattaatcactgt

SEQ ID NO: 1334636 - DNA, 18 bp, Homo sapiens
taagatcactgtttagat

SEQ ID NO: 1334637 - DNA, 19 bp, Homo sapiens
tacagttgaaataactgga

SEQ ID NO: 1334638 - DNA, 18 bp, Homo sapiens
tgcttttctgccctggct

SEQ ID NO: 1334639 - DNA, 17 bp, Homo sapiens
tggaaaaatagcctgcc

SEQ ID NO: 1334640 - DNA, 20 bp, Homo sapiens
tggaaaaatagcctgcctct

SEQ ID NO: 1334641 - DNA, 19 bp, Homo sapiens
tggaaagcagagttttcat

SEQ ID NO: 1334642 - DNA, 22 bp, Homo sapiens
tggaaaggggagagcctgctgg

SEQ ID NO: 1334643 - DNA, 23 bp, Homo sapiens
tggaaaggggagagcctgctggc

SEQ ID NO: 1334644 - DNA, 18 bp, Homo sapiens
tggaaatcagccaagttt

SEQ ID NO: 1334645 - DNA, 16 bp, Homo sapiens
tggaaattgacgaggg

SEQ ID NO: 1334646 - DNA, 17 bp, Homo sapiens
tggaaccacattgaaga

SEQ ID NO: 1334647 - DNA, 12 bp, Homo sapiens
tggaagaaggga

SEQ ID NO: 1334648 - DNA, 13 bp, Homo sapiens
tggaagaagggag

SEQ ID NO: 1334649 - DNA, 17 bp, Homo sapiens
tggaagaagggagaaga

SEQ ID NO: 1334650 - DNA, 17 bp, Homo sapiens
tggaagatcattttgaa

SEQ ID NO: 1334651 - DNA, 22 bp, Homo sapiens
tggaagtgtatttattttacag

SEQ ID NO: 1334652 - DNA, 23 bp, Homo sapiens
tggaatcccactaatgcaaactg

SEQ ID NO: 1334653 - DNA, 15 bp, Homo sapiens
tggaattttgcaaag

SEQ ID NO: 1334654 - DNA, 18 bp, Homo sapiens
tggaatttttttgtacga

SEQ ID NO: 1334655 - DNA, 23 bp, Homo sapiens
tggacactccagggacacacagc

SEQ ID NO: 1334656 - DNA, 24 bp, Homo sapiens
tggacactccagggacacacagcc

SEQ ID NO: 1334657 - DNA, 21 bp, Homo sapiens
tggacagattgcctgtttctg

SEQ ID NO: 1334658 - DNA, 14 bp, Homo sapiens
tggacatcctcctc

SEQ ID NO: 1334659 - DNA, 23 bp, Homo sapiens
tggacctgtatatttgtaaagct

SEQ ID NO: 1334660 - DNA, 21 bp, Homo sapiens
tggaccttaggccttcctctc

SEQ ID NO: 1334661 - DNA, 23 bp, Homo sapiens
tggacggcaggctcactgccagg

SEQ ID NO: 1334662 - DNA, 14 bp, Homo sapiens
tggactatctgtct

SEQ ID NO: 1334663 - DNA, 19 bp, Homo sapiens
tggactgagtgggaagccc

SEQ ID NO: 1334664 - DNA, 22 bp, Homo sapiens
tggactgctacctttcaaagct

SEQ ID NO: 1334665 - DNA, 14 bp, Homo sapiens
tggagaagctgcag

SEQ ID NO: 1334666 - DNA, 12 bp, Homo sapiens
tggagcactggg

SEQ ID NO: 1334667 - DNA, 21 bp, Homo sapiens
tggagcactgggctcccgggc

SEQ ID NO: 1334668 - DNA, 12 bp, Homo sapiens
tggagccgaggc

SEQ ID NO: 1334669 - DNA, 17 bp, Homo sapiens
tggagccgaggcctacc

SEQ ID NO: 1334670 - DNA, 23 bp, Homo sapiens
tggagcggaatttacctgatttc

SEQ ID NO: 1334671 - DNA, 17 bp, Homo sapiens
tggaggcttcctgcgtc

SEQ ID NO: 1334672 - DNA, 11 bp, Homo sapiens
tggagggaggc

SEQ ID NO: 1334673 - DNA, 16 bp, Homo sapiens
tggagggaggccccag

SEQ ID NO: 1334674 - DNA, 18 bp, Homo sapiens
tggagggaggccccaggg

SEQ ID NO: 1334675 - DNA, 11 bp, Homo sapiens
tggaggggtgt

SEQ ID NO: 1334676 - DNA, 14 bp, Homo sapiens
tggaggggtgtggc

SEQ ID NO: 1334677 - DNA, 19 bp, Homo sapiens
tggaggggtgtggcagtgg

SEQ ID NO: 1334678 - DNA, 17 bp, Homo sapiens
tggaggttgaagccaag

SEQ ID NO: 1334679 - DNA, 18 bp, Homo sapiens
tggaggttgaagccaagt

SEQ ID NO: 1334680 - DNA, 22 bp, Homo sapiens
tggaggttgaagccaagtgggg

SEQ ID NO: 1334681 - DNA, 17 bp, Homo sapiens
tggagtgtatgactgca

SEQ ID NO: 1334682 - DNA, 19 bp, Homo sapiens
tggagtgtatgactgcaca

SEQ ID NO: 1334683 - DNA, 19 bp, Homo sapiens
tggatatataggctatttt

SEQ ID NO: 1334684 - DNA, 18 bp, Homo sapiens
tggatgcggccattcaag

SEQ ID NO: 1334685 - DNA, 18 bp, Homo sapiens
tggatggccccagcacag

SEQ ID NO: 1334686 - DNA, 23 bp, Homo sapiens
tggatggcttgtctatactcctt

SEQ ID NO: 1334687 - DNA, 17 bp, Homo sapiens
tggcaaacgctaaagag

SEQ ID NO: 1334688 - DNA, 17 bp, Homo sapiens
tggcaaaggaaggtgga

SEQ ID NO: 1334689 - DNA, 16 bp, Homo sapiens
tggcaacattcattgc

SEQ ID NO: 1334690 - DNA, 13 bp, Homo sapiens
tggcaaggacttt

SEQ ID NO: 1334691 - DNA, 16 bp, Homo sapiens
tgttctctcttctcca

SEQ ID NO: 1334692 - DNA, 23 bp, Homo sapiens
tgttctggggggacccagtgcag

SEQ ID NO: 1334693 - DNA, 15 bp, Homo sapiens
tgttctttcagaaag

SEQ ID NO: 1334694 - DNA, 20 bp, Homo sapiens
tgttcttttaaatgattgaa

SEQ ID NO: 1334695 - DNA, 18 bp, Homo sapiens
tgttgacaactgtgactg

SEQ ID NO: 1334696 - DNA, 16 bp, Homo sapiens
tgttgacgcacctgtg

SEQ ID NO: 1334697 - DNA, 13 bp, Homo sapiens
tgttgagaggttc

SEQ ID NO: 1334698 - DNA, 20 bp, Homo sapiens
tgttgatttttactgtgttt

SEQ ID NO: 1334699 - DNA, 17 bp, Homo sapiens
tgttgcaagatgtgaat

SEQ ID NO: 1334700 - DNA, 18 bp, Homo sapiens
tgttgcaagatgtgaatt

SEQ ID NO: 1334701 - DNA, 18 bp, Homo sapiens
tgttgccaagctccaagc

SEQ ID NO: 1334702 - DNA, 23 bp, Homo sapiens
tgttgcctataagccaaaattaa

SEQ ID NO: 1334703 - DNA, 19 bp, Homo sapiens
tgttgctcaaaaaatgagc

SEQ ID NO: 1334704 - DNA, 12 bp, Homo sapiens
tgttggcaggct

SEQ ID NO: 1334705 - DNA, 13 bp, Homo sapiens
tgttgtaaaacaa

SEQ ID NO: 1334706 - DNA, 22 bp, Homo sapiens
tgttgtaaaacaaaatttgact

SEQ ID NO: 1334707 - DNA, 21 bp, Homo sapiens
tgttgtacatacgatttaagg

SEQ ID NO: 1334708 - DNA, 13 bp, Homo sapiens
tgttgtcagctga

SEQ ID NO: 1334709 - DNA, 14 bp, Homo sapiens
tgttgtcagctgaa

SEQ ID NO: 1334710 - DNA, 17 bp, Homo sapiens
tgttgtccaactattta

SEQ ID NO: 1334711 - DNA, 23 bp, Homo sapiens
tgttgttcttggcaataaatttt

SEQ ID NO: 1334712 - DNA, 18 bp, Homo sapiens
tgttgttctttcagaaag

SEQ ID NO: 1334713 - DNA, 12 bp, Homo sapiens
tgtttaaaacac

SEQ ID NO: 1334714 - DNA, 12 bp, Homo sapiens
tgtttactgaaa

SEQ ID NO: 1334715 - DNA, 12 bp, Homo sapiens
tgtttagatttg

SEQ ID NO: 1334716 - DNA, 22 bp, Homo sapiens
tgtttataaaatataaacaaag

SEQ ID NO: 1334717 - DNA, 19 bp, Homo sapiens
tgtttataaatcttatgct

SEQ ID NO: 1334718 - DNA, 21 bp, Homo sapiens
tgtttattacttccatgaatt

SEQ ID NO: 1334719 - DNA, 22 bp, Homo sapiens
tgtttattttctacgtttcttt

SEQ ID NO: 1334720 - DNA, 16 bp, Homo sapiens
tgtttctattttttga

SEQ ID NO: 1334721 - DNA, 22 bp, Homo sapiens
tgtttctattttttgaaaagca

SEQ ID NO: 1334722 - DNA, 20 bp, Homo sapiens
tgtttctcttgagctggcct

SEQ ID NO: 1334723 - DNA, 22 bp, Homo sapiens
tgtttctctttgattatttgca

SEQ ID NO: 1334724 - DNA, 23 bp, Homo sapiens
tgtttctggacccttataaaatc

SEQ ID NO: 1334725 - DNA, 19 bp, Homo sapiens
tgtttgaaaatagtttatt

SEQ ID NO: 1334726 - DNA, 15 bp, Homo sapiens
tgtttgtcccttcta

SEQ ID NO: 1334727 - DNA, 16 bp, Homo sapiens
tgtttgttgtcagctg

SEQ ID NO: 1334728 - DNA, 13 bp, Homo sapiens
tgttttacaatag

SEQ ID NO: 1334729 - DNA, 21 bp, Homo sapiens
tgttttacaatagttctgtgg

SEQ ID NO: 1334730 - DNA, 16 bp, Homo sapiens
tgttttctgactaatt

SEQ ID NO: 1334731 - DNA, 17 bp, Homo sapiens
tgttttcttttggtaaa

SEQ ID NO: 1334732 - DNA, 18 bp, Homo sapiens
tgttttggctgaaattct

SEQ ID NO: 1334733 - DNA, 23 bp, Homo sapiens
tgttttggctgaaattctcctgg

SEQ ID NO: 1334734 - DNA, 18 bp, Homo sapiens
tgttttgtaaacatttat

SEQ ID NO: 1334735 - DNA, 22 bp, Homo sapiens
tgtttttctgtgtgtcagtttt

SEQ ID NO: 1334736 - DNA, 13 bp, Homo sapiens
tgtttttgtatat

SEQ ID NO: 1334737 - DNA, 12 bp, Homo sapiens
tgttttttaaga

SEQ ID NO: 1334738 - DNA, 20 bp, Homo sapiens
tgttttttaagatagtgtaa

SEQ ID NO: 1334739 - DNA, 16 bp, Homo sapiens
tgtttttttgttatta

SEQ ID NO: 1334740 - DNA, 22 bp, Homo sapiens
ttaaaaaaaaagtcagagacag

SEQ ID NO: 1334741 - DNA, 14 bp, Homo sapiens
ttaaaaaataaata

SEQ ID NO: 1334742 - DNA, 18 bp, Homo sapiens
ttaaaaaccgaataaatg

SEQ ID NO: 1334743 - DNA, 16 bp, Homo sapiens
ttaaaaagaatgacgt

SEQ ID NO: 1334744 - DNA, 18 bp, Homo sapiens
ttaaaaagtggaaaaata

SEQ ID NO: 1334745 - DNA, 19 bp, Homo sapiens
ttaaaaatatcaaattaat

SEQ ID NO: 1334746 - DNA, 23 bp, Homo sapiens
ttaaaacacgttttaaggactga

SEQ ID NO: 1334747 - DNA, 14 bp, Homo sapiens
ttaaaacccaagtg

SEQ ID NO: 1334748 - DNA, 13 bp, Homo sapiens
ttaaaactaaatt

SEQ ID NO: 1334749 - DNA, 16 bp, Homo sapiens
ttaaaactaaatttca

SEQ ID NO: 1334750 - DNA, 15 bp, Homo sapiens
ttaaaataaaatgaa

SEQ ID NO: 1334751 - DNA, 17 bp, Homo sapiens
ttaaaataaaatgaaaa

SEQ ID NO: 1334752 - DNA, 21 bp, Homo sapiens
ttaaaataaaatgaaaattgt

SEQ ID NO: 1334753 - DNA, 17 bp, Homo sapiens
ttaaaatgtaatttaaa

SEQ ID NO: 1334754 - DNA, 21 bp, Homo sapiens
ttaaaatgtaatttaaatgaa

SEQ ID NO: 1334755 - DNA, 20 bp, Homo sapiens
ttaaaattttgtatgttaaa

SEQ ID NO: 1334756 - DNA, 23 bp, Homo sapiens
ttaaagaaaaaaatgtcaaaagt

SEQ ID NO: 1334757 - DNA, 19 bp, Homo sapiens
ttaaagaagtatttttaga

SEQ ID NO: 1334758 - DNA, 12 bp, Homo sapiens
ttaaagacagag

SEQ ID NO: 1334759 - DNA, 14 bp, Homo sapiens
ttaaagagaatgag

SEQ ID NO: 1334760 - DNA, 16 bp, Homo sapiens
ttaaatacatatggat

SEQ ID NO: 1334761 - DNA, 13 bp, Homo sapiens
ttaaatcctttta

SEQ ID NO: 1334762 - DNA, 20 bp, Homo sapiens
ttaaatctaaatctatttat

SEQ ID NO: 1334763 - DNA, 14 bp, Homo sapiens
ttaaatcttaatgt

SEQ ID NO: 1334764 - DNA, 13 bp, Homo sapiens
ttaaatgttatta

SEQ ID NO: 1334765 - DNA, 12 bp, Homo sapiens
ttaaattacaat

SEQ ID NO: 1334766 - DNA, 18 bp, Homo sapiens
ttaaattacaattttatc

SEQ ID NO: 1334767 - DNA, 15 bp, Homo sapiens
ttaaatttaatacca

SEQ ID NO: 1334768 - DNA, 17 bp, Homo sapiens
ttaaatttttttgtatg

SEQ ID NO: 1334769 - DNA, 19 bp, Homo sapiens
ttaacagaaattgtatatt

SEQ ID NO: 1334770 - DNA, 13 bp, Homo sapiens
ttaacatcagttt

SEQ ID NO: 1334771 - DNA, 17 bp, Homo sapiens
ttaaccacttcagctga

SEQ ID NO: 1334772 - DNA, 14 bp, Homo sapiens
ttaacctgcataaa

SEQ ID NO: 1334773 - DNA, 13 bp, Homo sapiens
tgaaactatattt

SEQ ID NO: 1334774 - DNA, 21 bp, Homo sapiens
tgaaactatattttgtcatat

SEQ ID NO: 1334775 - DNA, 16 bp, Homo sapiens
tgaaactttgggaaaa

SEQ ID NO: 1334776 - DNA, 17 bp, Homo sapiens
tgaaacttttctagaat

SEQ ID NO: 1334777 - DNA, 21 bp, Homo sapiens
tgaaacttttctagaattatt

SEQ ID NO: 1334778 - DNA, 19 bp, Homo sapiens
tgaaaggcaggcctatttc

SEQ ID NO: 1334779 - DNA, 21 bp, Homo sapiens
tgaaaggcaggcctatttcat

SEQ ID NO: 1334780 - DNA, 21 bp, Homo sapiens
tgaaaggcttttcaaccacaa

SEQ ID NO: 1334781 - DNA, 15 bp, Homo sapiens
tgaaagtagggggct

SEQ ID NO: 1334782 - DNA, 21 bp, Homo sapiens
tgaaagtgcatttttgtaaat

SEQ ID NO: 1334783 - DNA, 15 bp, Homo sapiens
tgaaataagaattca

SEQ ID NO: 1334784 - DNA, 15 bp, Homo sapiens
tgaaataggaaacaa

SEQ ID NO: 1334785 - DNA, 17 bp, Homo sapiens
tgaaataggaaacaagt

SEQ ID NO: 1334786 - DNA, 13 bp, Homo sapiens
tgaaatgcatatt

SEQ ID NO: 1334787 - DNA, 17 bp, Homo sapiens
tgaaatgcctgctttga

SEQ ID NO: 1334788 - DNA, 12 bp, Homo sapiens
tgaaatgtgaat

SEQ ID NO: 1334789 - DNA, 20 bp, Homo sapiens
tgaaatgttacaaaaataaa

SEQ ID NO: 1334790 - DNA, 14 bp, Homo sapiens
tgaaattctcctgg

SEQ ID NO: 1334791 - DNA, 15 bp, Homo sapiens
tgaaattctcctgga

SEQ ID NO: 1334792 - DNA, 17 bp, Homo sapiens
tgaaattgcatactttg

SEQ ID NO: 1334793 - DNA, 14 bp, Homo sapiens
tgaacaatgaagtt

SEQ ID NO: 1334794 - DNA, 23 bp, Homo sapiens
tgaacaatgaagttgaaaatcat

SEQ ID NO: 1334795 - DNA, 16 bp, Homo sapiens
tgaaccacttgtagat

SEQ ID NO: 1334796 - DNA, 13 bp, Homo sapiens
tgaaccataaaat

SEQ ID NO: 1334797 - DNA, 15 bp, Homo sapiens
tgaaccataaaatgt

SEQ ID NO: 1334798 - DNA, 18 bp, Homo sapiens
tgaaccataaaatgtcca

SEQ ID NO: 1334799 - DNA, 23 bp, Homo sapiens
tgaaccatggtgaagtgcttgga

SEQ ID NO: 1334800 - DNA, 18 bp, Homo sapiens
tgaactcttctcattact

SEQ ID NO: 1334801 - DNA, 15 bp, Homo sapiens
tgaagaactgcaggc

SEQ ID NO: 1334802 - DNA, 23 bp, Homo sapiens
tgaagaactgcaggccctggcct

SEQ ID NO: 1334803 - DNA, 14 bp, Homo sapiens
tgaagaagcctgta

SEQ ID NO: 1334804 - DNA, 23 bp, Homo sapiens
tgaagaatgttagagtaatgaaa

SEQ ID NO: 1334805 - DNA, 12 bp, Homo sapiens
tgaagatacttt

SEQ ID NO: 1334806 - DNA, 14 bp, Homo sapiens
tgaagatactttgt

SEQ ID NO: 1334807 - DNA, 17 bp, Homo sapiens
tgaagatactttgtatt

SEQ ID NO: 1334808 - DNA, 18 bp, Homo sapiens
tgaagcaaatcagaaact

SEQ ID NO: 1334809 - DNA, 15 bp, Homo sapiens
tgaagcagcctctcc

SEQ ID NO: 1334810 - DNA, 12 bp, Homo sapiens
tgaagccaaaga

SEQ ID NO: 1334811 - DNA, 14 bp, Homo sapiens
tgaagccaaagaaa

SEQ ID NO: 1334812 - DNA, 14 bp, Homo sapiens
tgaagccaagtggg

SEQ ID NO: 1334813 - DNA, 22 bp, Homo sapiens
tgaagccaagtggggtgctggg

SEQ ID NO: 1334814 - DNA, 23 bp, Homo sapiens
tgaagccaagtggggtgctggga

SEQ ID NO: 1334815 - DNA, 14 bp, Homo sapiens
tgaagcttcatgca

SEQ ID NO: 1334816 - DNA, 21 bp, Homo sapiens
tgaagcttcatgcacttaaag

SEQ ID NO: 1334817 - DNA, 21 bp, Homo sapiens
tgaaggaaaaacacaagcaaa

SEQ ID NO: 1334818 - DNA, 17 bp, Homo sapiens
tgaagggaccctttggg

SEQ ID NO: 1334819 - DNA, 21 bp, Homo sapiens
tgaagggggtaccttaagaga

SEQ ID NO: 1334820 - DNA, 13 bp, Homo sapiens
tgaagtgcttgga

SEQ ID NO: 1334821 - DNA, 12 bp, Homo sapiens
tgaataaatgtg

SEQ ID NO: 1334822 - DNA, 15 bp, Homo sapiens
tgaatactgcttgaa

SEQ ID NO: 1334823 - DNA, 16 bp, Homo sapiens
tgaatacttgaaccat

SEQ ID NO: 1334824 - DNA, 17 bp, Homo sapiens
tgaatatctattaatat

SEQ ID NO: 1334825 - DNA, 15 bp, Homo sapiens
tgaatatgattaaaa

SEQ ID NO: 1334826 - DNA, 16 bp, Homo sapiens
tgaatcaaaagtgcct

SEQ ID NO: 1334827 - DNA, 22 bp, Homo sapiens
tgaatcaataatatattttctg

SEQ ID NO: 1334828 - DNA, 12 bp, Homo sapiens
tgaatgacaaag

SEQ ID NO: 1334829 - DNA, 23 bp, Homo sapiens
tgaatgagtctgttgtgtgtcat

SEQ ID NO: 1334830 - DNA, 23 bp, Homo sapiens
tgaatgatgatcctaggcatttg

SEQ ID NO: 1334831 - DNA, 15 bp, Homo sapiens
tgaatgccactgcct

SEQ ID NO: 1334832 - DNA, 22 bp, Homo sapiens
tgaatgccactgccttcgcttc

SEQ ID NO: 1334833 - DNA, 14 bp, Homo sapiens
tgaatgctgggact

SEQ ID NO: 1334834 - DNA, 15 bp, Homo sapiens
tgaatgctgggactc

SEQ ID NO: 1334835 - DNA, 23 bp, Homo sapiens
tgaatgtatttatttgggagacc

SEQ ID NO: 1334836 - DNA, 12 bp, Homo sapiens
tgaatgtgtcag

SEQ ID NO: 1334837 - DNA, 16 bp, Homo sapiens
tgaattaaattaggaa

SEQ ID NO: 1334838 - DNA, 21 bp, Homo sapiens
tgaattatccacatgaaaata

SEQ ID NO: 1334839 - DNA, 22 bp, Homo sapiens
tgaattatccacatgaaaataa

SEQ ID NO: 1334840 - DNA, 21 bp, Homo sapiens
tgaatttacttccttgcatgt

SEQ ID NO: 1334841 - DNA, 17 bp, Homo sapiens
tgaattttaaatctaaa

SEQ ID NO: 1334842 - DNA, 16 bp, Homo sapiens
tgaatttttattgttg

SEQ ID NO: 1334843 - DNA, 22 bp, Homo sapiens
tgaatttttttgtaataagcaa

SEQ ID NO: 1334844 - DNA, 21 bp, Homo sapiens
tgacaaaaaatgttttaaaga

SEQ ID NO: 1334845 - DNA, 12 bp, Homo sapiens
tgacaactgtga

SEQ ID NO: 1334846 - DNA, 14 bp, Homo sapiens
tgccaccctagcca

SEQ ID NO: 1334847 - DNA, 15 bp, Homo sapiens
tgccaccctgctgag

SEQ ID NO: 1334848 - DNA, 16 bp, Homo sapiens
tgccacgaatttctgt

SEQ ID NO: 1334849 - DNA, 22 bp, Homo sapiens
tgccacgttggagaagcccgtg

SEQ ID NO: 1334850 - DNA, 19 bp, Homo sapiens
tgccactaaactacattgt

SEQ ID NO: 1334851 - DNA, 18 bp, Homo sapiens
tgccactcactaggcccc

SEQ ID NO: 1334852 - DNA, 21 bp, Homo sapiens
tgccactgccttcgcttcttg

SEQ ID NO: 1334853 - DNA, 15 bp, Homo sapiens
tgccacttcctttta

SEQ ID NO: 1334854 - DNA, 16 bp, Homo sapiens
tgccacttctaagaaa

SEQ ID NO: 1334855 - DNA, 23 bp, Homo sapiens
tgccacttctaagaaaagcctaa

SEQ ID NO: 1334856 - DNA, 23 bp, Homo sapiens
tgccagaggaatcctggcagccc

SEQ ID NO: 1334857 - DNA, 21 bp, Homo sapiens
tgccagatgtcctaatggtga

SEQ ID NO: 1334858 - DNA, 15 bp, Homo sapiens
tgccagcagcagcag

SEQ ID NO: 1334859 - DNA, 16 bp, Homo sapiens
tgccagcagcagcagg

SEQ ID NO: 1334860 - DNA, 21 bp, Homo sapiens
tgccagccttgagccctggct

SEQ ID NO: 1334861 - DNA, 15 bp, Homo sapiens
tgccagctgacatct

SEQ ID NO: 1334862 - DNA, 19 bp, Homo sapiens
tgccagctggcctttgtaa

SEQ ID NO: 1334863 - DNA, 15 bp, Homo sapiens
tgccaggcaggggtg

SEQ ID NO: 1334864 - DNA, 16 bp, Homo sapiens
tgccaggcaggggtgg

SEQ ID NO: 1334865 - DNA, 10 bp, Homo sapiens
tgccaggcat

SEQ ID NO: 1334866 - DNA, 14 bp, Homo sapiens
tgccaggcatggtg

SEQ ID NO: 1334867 - DNA, 17 bp, Homo sapiens
tgccaggtgagaaactg

SEQ ID NO: 1334868 - DNA, 17 bp, Homo sapiens
tgccagttacttgcttt

SEQ ID NO: 1334869 - DNA, 12 bp, Homo sapiens
tgccatttattt

SEQ ID NO: 1334870 - DNA, 14 bp, Homo sapiens
tgccatttatttat

SEQ ID NO: 1334871 - DNA, 11 bp, Homo sapiens
tgcccaagcca

SEQ ID NO: 1334872 - DNA, 20 bp, Homo sapiens
tgcccaagccagaggctggg

SEQ ID NO: 1334873 - DNA, 11 bp, Homo sapiens
tgcccaccccc

SEQ ID NO: 1334874 - DNA, 16 bp, Homo sapiens
tgcccaccccctgccc

SEQ ID NO: 1334875 - DNA, 17 bp, Homo sapiens
tgcccagaataagttat

SEQ ID NO: 1334876 - DNA, 14 bp, Homo sapiens
tgcccagaatactg

SEQ ID NO: 1334877 - DNA, 21 bp, Homo sapiens
tgcccatcgtgaagaagcctg

SEQ ID NO: 1334878 - DNA, 14 bp, Homo sapiens
tgccccacagtctc

SEQ ID NO: 1334879 - DNA, 14 bp, Homo sapiens
tgcccccagccccg

SEQ ID NO: 1334880 - DNA, 13 bp, Homo sapiens
tgccccggagctg

SEQ ID NO: 1334881 - DNA, 13 bp, Homo sapiens
tgccctaataaaa

SEQ ID NO: 1334882 - DNA, 15 bp, Homo sapiens
tgccctaataaaaag

SEQ ID NO: 1334883 - DNA, 18 bp, Homo sapiens
tgccgccccctcctgaac

SEQ ID NO: 1334884 - DNA, 19 bp, Homo sapiens
tgccgccccctcctgaacc

SEQ ID NO: 1334885 - DNA, 22 bp, Homo sapiens
tgccgccgctaggtagagtctg

SEQ ID NO: 1334886 - DNA, 16 bp, Homo sapiens
tgccgcctgcactcct

SEQ ID NO: 1334887 - DNA, 14 bp, Homo sapiens
tgccgtcaccacca

SEQ ID NO: 1334888 - DNA, 15 bp, Homo sapiens
tgccgtcaccaccac

SEQ ID NO: 1334889 - DNA, 16 bp, Homo sapiens
tgccgtcaccaccacc

SEQ ID NO: 1334890 - DNA, 17 bp, Homo sapiens
tgccgtcaccaccaccc

SEQ ID NO: 1334891 - DNA, 18 bp, Homo sapiens
tgccgtcaccaccacccc

SEQ ID NO: 1334892 - DNA, 22 bp, Homo sapiens
tgcctaagtccagtgtttcttt

SEQ ID NO: 1334893 - DNA, 16 bp, Homo sapiens
tgcctataagccaaaa

SEQ ID NO: 1334894 - DNA, 15 bp, Homo sapiens
tgcctcaagaggaat

SEQ ID NO: 1334895 - DNA, 17 bp, Homo sapiens
tgcctcaagaggaatga

SEQ ID NO: 1334896 - DNA, 14 bp, Homo sapiens
tgcctccaggtgca

SEQ ID NO: 1334897 - DNA, 20 bp, Homo sapiens
tgcctccccatttcccatct

SEQ ID NO: 1334898 - DNA, 23 bp, Homo sapiens
tgcctccccatttcccatctgca

SEQ ID NO: 1334899 - DNA, 19 bp, Homo sapiens
tgcctcccttgtggcagca

SEQ ID NO: 1334900 - DNA, 11 bp, Homo sapiens
tgcctctgtgc

SEQ ID NO: 1334901 - DNA, 11 bp, Homo sapiens
tgcctctttcc

SEQ ID NO: 1334902 - DNA, 16 bp, Homo sapiens
tgcctgatgacaataa

SEQ ID NO: 1334903 - DNA, 17 bp, Homo sapiens
tgcctgcagggccatgg

SEQ ID NO: 1334904 - DNA, 12 bp, Homo sapiens
tattgtttctgc

SEQ ID NO: 1334905 - DNA, 15 bp, Homo sapiens
tattgttttacaata

SEQ ID NO: 1334906 - DNA, 18 bp, Homo sapiens
tatttaaattacaatttt

SEQ ID NO: 1334907 - DNA, 13 bp, Homo sapiens
tatttaacagaaa

SEQ ID NO: 1334908 - DNA, 16 bp, Homo sapiens
tatttaacagaaattg

SEQ ID NO: 1334909 - DNA, 14 bp, Homo sapiens
tatttacatttaat

SEQ ID NO: 1334910 - DNA, 15 bp, Homo sapiens
tatttagacaagaga

SEQ ID NO: 1334911 - DNA, 19 bp, Homo sapiens
tatttagacaagagatggg

SEQ ID NO: 1334912 - DNA, 15 bp, Homo sapiens
tatttataattccta

SEQ ID NO: 1334913 - DNA, 15 bp, Homo sapiens
tatttatatgtactg

SEQ ID NO: 1334914 - DNA, 16 bp, Homo sapiens
tatttatatttattga

SEQ ID NO: 1334915 - DNA, 18 bp, Homo sapiens
tatttatatttattgact

SEQ ID NO: 1334916 - DNA, 21 bp, Homo sapiens
tatttatccagaaaactgtga

SEQ ID NO: 1334917 - DNA, 15 bp, Homo sapiens
tatttatctgattaa

SEQ ID NO: 1334918 - DNA, 11 bp, Homo sapiens
tatttattaaa

SEQ ID NO: 1334919 - DNA, 15 bp, Homo sapiens
gtgttttataaaata

SEQ ID NO: 1334920 - DNA, 14 bp, Homo sapiens
gtgttttttaagat

SEQ ID NO: 1334921 - DNA, 21 bp, Homo sapiens
gtgttttttaagatagtgtaa

SEQ ID NO: 1334922 - DNA, 23 bp, Homo sapiens
gtgttttttctttttttttaagt

SEQ ID NO: 1334923 - DNA, 15 bp, Homo sapiens
gttaatacaaggtat

SEQ ID NO: 1334924 - DNA, 12 bp, Homo sapiens
gttaatttaagt

SEQ ID NO: 1334925 - DNA, 14 bp, Homo sapiens
gttacttcttctct

SEQ ID NO: 1334926 - DNA, 21 bp, Homo sapiens
gttagtttgtatatattatta

SEQ ID NO: 1334927 - DNA, 13 bp, Homo sapiens
gttatgcatcatt

SEQ ID NO: 1334928 - DNA, 17 bp, Homo sapiens
gttatgtttaataagct

SEQ ID NO: 1334929 - DNA, 17 bp, Homo sapiens
ggtggccacagcgccag

SEQ ID NO: 1334930 - DNA, 19 bp, Homo sapiens
ggtggcccacgcctgtaat

SEQ ID NO: 1334931 - DNA, 12 bp, Homo sapiens
ggtggggaaagg

SEQ ID NO: 1334932 - DNA, 13 bp, Homo sapiens
ggtgggggcctcg

SEQ ID NO: 1334933 - DNA, 16 bp, Homo sapiens
ggtgggggtggaggct

SEQ ID NO: 1334934 - DNA, 22 bp, Homo sapiens
ggtggtctgttggcaggctggc

SEQ ID NO: 1334935 - DNA, 21 bp, Homo sapiens
ggtggttatggagagggtgtc

SEQ ID NO: 1334936 - DNA, 17 bp, Homo sapiens
ggtgtagccctcccact

SEQ ID NO: 1334937 - DNA, 24 bp, Homo sapiens
ggtgtcacccaaaccggcaggtgc

SEQ ID NO: 1334938 - DNA, 20 bp, Homo sapiens
ggtgtccccgctgctgtgca

SEQ ID NO: 1334939 - DNA, 12 bp, Homo sapiens
ggtgtgctggga

SEQ ID NO: 1334940 - DNA, 16 bp, Homo sapiens
ggtgtggagccgaggc

SEQ ID NO: 1334941 - DNA, 18 bp, Homo sapiens
ggtgtggcccatggctgt

SEQ ID NO: 1334942 - DNA, 13 bp, Homo sapiens
ggtgtgggggaag

SEQ ID NO: 1334943 - DNA, 22 bp, Homo sapiens
ggttagacagccaaaggctggc

SEQ ID NO: 1334944 - DNA, 18 bp, Homo sapiens
ggttagatgttgccatgt

SEQ ID NO: 1334945 - DNA, 12 bp, Homo sapiens
ggttataatttt

SEQ ID NO: 1334946 - DNA, 11 bp, Homo sapiens
ggttatgtttt

SEQ ID NO: 1334947 - DNA, 19 bp, Homo sapiens
ggttctccgttagctcctg

SEQ ID NO: 1334948 - DNA, 18 bp, Homo sapiens
ggttggcaaaaaggcagg

SEQ ID NO: 1334949 - DNA, 19 bp, Homo sapiens
ggttggctgggaaatcgag

SEQ ID NO: 1334950 - DNA, 17 bp, Homo sapiens
ggtttcgaagtcattaa

SEQ ID NO: 1334951 - DNA, 21 bp, Homo sapiens
ggtttctcgcataggaccttt

SEQ ID NO: 1334952 - DNA, 21 bp, Homo sapiens
ggtttgccaaaattcatttct

SEQ ID NO: 1334953 - DNA, 14 bp, Homo sapiens
ggttttaaactttc

SEQ ID NO: 1334954 - DNA, 16 bp, Homo sapiens
ggttttatactgaagg

SEQ ID NO: 1334955 - DNA, 11 bp, Homo sapiens
ggttttatgat

SEQ ID NO: 1334956 - DNA, 17 bp, Homo sapiens
ggttttgtgccatctgt

SEQ ID NO: 1334957 - DNA, 12 bp, Homo sapiens
ggtttttccctg

SEQ ID NO: 1334958 - DNA, 13 bp, Homo sapiens
gtaaaaaaaccac

SEQ ID NO: 1334959 - DNA, 23 bp, Homo sapiens
gtaaaaaaaccaccaaaaacaaa

SEQ ID NO: 1334960 - DNA, 14 bp, Homo sapiens
gtaaaagaaatcat

SEQ ID NO: 1334961 - DNA, 21 bp, Homo sapiens
gtaaaatattttgaatcaata

SEQ ID NO: 1334962 - DNA, 15 bp, Homo sapiens
gtaaacaaaatgaag

SEQ ID NO: 1334963 - DNA, 20 bp, Homo sapiens
gtaaacagtttttattaaaa

SEQ ID NO: 1334964 - DNA, 19 bp, Homo sapiens
gtaaactcatctgaaatgt

SEQ ID NO: 1334965 - DNA, 19 bp, Homo sapiens
gtaaagactggcttttatt

SEQ ID NO: 1334966 - DNA, 14 bp, Homo sapiens
gtaaagtgtcagaa

SEQ ID NO: 1334967 - DNA, 17 bp, Homo sapiens
gtaaatacatgcatata

SEQ ID NO: 1334968 - DNA, 17 bp, Homo sapiens
gtaaataggaatcattc

SEQ ID NO: 1334969 - DNA, 15 bp, Homo sapiens
gtaaattctgatttc

SEQ ID NO: 1334970 - DNA, 12 bp, Homo sapiens
gtaactgtcagg

SEQ ID NO: 1334971 - DNA, 20 bp, Homo sapiens
gtaagaaagtgaagcaaatc

SEQ ID NO: 1334972 - DNA, 11 bp, Homo sapiens
gtaagaaggca

SEQ ID NO: 1334973 - DNA, 13 bp, Homo sapiens
gtaagaattctga

SEQ ID NO: 1334974 - DNA, 17 bp, Homo sapiens
gtaagattgatatctat

SEQ ID NO: 1334975 - DNA, 14 bp, Homo sapiens
gtaagcgtatggct

SEQ ID NO: 1334976 - DNA, 12 bp, Homo sapiens
gtaagtcttttt

SEQ ID NO: 1334977 - DNA, 14 bp, Homo sapiens
gtaagtgggcccac

SEQ ID NO: 1334978 - DNA, 17 bp, Homo sapiens
gtaagtgggcccacccg

SEQ ID NO: 1334979 - DNA, 15 bp, Homo sapiens
gtaataaactttaat

SEQ ID NO: 1334980 - DNA, 21 bp, Homo sapiens
gtaataagcactgtaaacttc

SEQ ID NO: 1334981 - DNA, 13 bp, Homo sapiens
gtaataatagact

SEQ ID NO: 1334982 - DNA, 15 bp, Homo sapiens
gtaatatttattaaa

SEQ ID NO: 1334983 - DNA, 17 bp, Homo sapiens
gtaatatttattaaatt

SEQ ID NO: 1334984 - DNA, 15 bp, Homo sapiens
gtaatcatttgttta

SEQ ID NO: 1334985 - DNA, 18 bp, Homo sapiens
gtaatcatttgtttacat

SEQ ID NO: 1334986 - DNA, 15 bp, Homo sapiens
gtaatcccagcactt

SEQ ID NO: 1334987 - DNA, 13 bp, Homo sapiens
gtaatccctgctt

SEQ ID NO: 1334988 - DNA, 18 bp, Homo sapiens
gtaatccctgctttttgt

SEQ ID NO: 1334989 - DNA, 17 bp, Homo sapiens
gtaatgaaaatgaatat

SEQ ID NO: 1334990 - DNA, 21 bp, Homo sapiens
gtaatgaatttttatgatatt

SEQ ID NO: 1334991 - DNA, 14 bp, Homo sapiens
gtacaaaattaagc

SEQ ID NO: 1334992 - DNA, 21 bp, Homo sapiens
gtacaagtagttctgtatttg

SEQ ID NO: 1334993 - DNA, 22 bp, Homo sapiens
gtacaagtagttctgtatttga

SEQ ID NO: 1334994 - DNA, 13 bp, Homo sapiens
gtacaggctggcg

SEQ ID NO: 1334995 - DNA, 18 bp, Homo sapiens
gtacataatactgaacca

SEQ ID NO: 1334996 - DNA, 19 bp, Homo sapiens
gtaccagctgcgcttgctt

SEQ ID NO: 1334997 - DNA, 13 bp, Homo sapiens
gtacctaagggag

SEQ ID NO: 1334998 - DNA, 12 bp, Homo sapiens
gtactgaatttt

SEQ ID NO: 1334999 - DNA, 14 bp, Homo sapiens
gtactgaatttttt

SEQ ID NO: 1335000 - DNA, 19 bp, Homo sapiens
gtactgaatttttttgtaa

SEQ ID NO: 1335001 - DNA, 18 bp, Homo sapiens
gtactgttactgggccct

SEQ ID NO: 1335002 - DNA, 18 bp, Homo sapiens
gtagaaaatgtgaccctc

SEQ ID NO: 1335003 - DNA, 14 bp, Homo sapiens
gtagaactttgtat

SEQ ID NO: 1335004 - DNA, 21 bp, Homo sapiens
gtagaactttgtatagttatg

SEQ ID NO: 1335005 - DNA, 21 bp, Homo sapiens
gtagaccttgttacttctgag

SEQ ID NO: 1335006 - DNA, 22 bp, Homo sapiens
gtagaccttgttacttctgagg

SEQ ID NO: 1335007 - DNA, 12 bp, Homo sapiens
gtagagccagct

SEQ ID NO: 1335008 - DNA, 14 bp, Homo sapiens
gtagaggcttgttt

SEQ ID NO: 1335009 - DNA, 14 bp, Homo sapiens
gtagagtctgaggg

SEQ ID NO: 1335010 - DNA, 21 bp, Homo sapiens
gtagagtctgagggcttgtag

SEQ ID NO: 1335011 - DNA, 17 bp, Homo sapiens
gtagataatttcagggt

SEQ ID NO: 1335012 - DNA, 18 bp, Homo sapiens
gtagataatttcagggtg

SEQ ID NO: 1335013 - DNA, 16 bp, Homo sapiens
gtagatttgatttttt

SEQ ID NO: 1335014 - DNA, 16 bp, Homo sapiens
gtagccccctggcctc

SEQ ID NO: 1335015 - DNA, 18 bp, Homo sapiens
gtagccccctggcctctg

SEQ ID NO: 1335016 - DNA, 19 bp, Homo sapiens
gtagccccctggcctctgt

SEQ ID NO: 1335017 - DNA, 23 bp, Homo sapiens
gtagccccctggcctctgtgcct

SEQ ID NO: 1335018 - DNA, 15 bp, Homo sapiens
gtagccctcccactt

SEQ ID NO: 1335019 - DNA, 15 bp, Homo sapiens
gtaggactccttatt

SEQ ID NO: 1335020 - DNA, 16 bp, Homo sapiens
gtaggagggtgggaag

SEQ ID NO: 1335021 - DNA, 15 bp, Homo sapiens
gtaggatgaaaagat

SEQ ID NO: 1335022 - DNA, 15 bp, Homo sapiens
gtaggttcagccaag

SEQ ID NO: 1335023 - DNA, 12 bp, Homo sapiens
gtagtcccagct

SEQ ID NO: 1335024 - DNA, 16 bp, Homo sapiens
gtagttctaccggctt

SEQ ID NO: 1335025 - DNA, 20 bp, Homo sapiens
gtagttctgtatttgaaagt

SEQ ID NO: 1335026 - DNA, 23 bp, Homo sapiens
gacggtgttttgccatgttggcc

SEQ ID NO: 1335027 - DNA, 19 bp, Homo sapiens
gacgtacaagtagttctgt

SEQ ID NO: 1335028 - DNA, 21 bp, Homo sapiens
gacgtcagatgtttaaaacac

SEQ ID NO: 1335029 - DNA, 22 bp, Homo sapiens
gacgtgaccggacttttctgca

SEQ ID NO: 1335030 - DNA, 11 bp, Homo sapiens
gacgtgctggg

SEQ ID NO: 1335031 - DNA, 16 bp, Homo sapiens
gactaactcaaataca

SEQ ID NO: 1335032 - DNA, 17 bp, Homo sapiens
gactactcccccaggtg

SEQ ID NO: 1335033 - DNA, 19 bp, Homo sapiens
gactatatatataaatgta

SEQ ID NO: 1335034 - DNA, 18 bp, Homo sapiens
gactatctgtctggtggc

SEQ ID NO: 1335035 - DNA, 14 bp, Homo sapiens
gactcagccttcag

SEQ ID NO: 1335036 - DNA, 20 bp, Homo sapiens
gactcagccttcagacagag

SEQ ID NO: 1335037 - DNA, 20 bp, Homo sapiens
gactcaggtgggccctctga

SEQ ID NO: 1335038 - DNA, 16 bp, Homo sapiens
gactcgggggtgggga

SEQ ID NO: 1335039 - DNA, 18 bp, Homo sapiens
gactcggggtgcttcctt

SEQ ID NO: 1335040 - DNA, 18 bp, Homo sapiens
gactctgggtccttcctg

SEQ ID NO: 1335041 - DNA, 20 bp, Homo sapiens
gactctgggtccttcctgaa

SEQ ID NO: 1335042 - DNA, 19 bp, Homo sapiens
gactgaaattacgggtacc

SEQ ID NO: 1335043 - DNA, 14 bp, Homo sapiens
gactgactgaggca

SEQ ID NO: 1335044 - DNA, 16 bp, Homo sapiens
gactgactgaggcagt

SEQ ID NO: 1335045 - DNA, 12 bp, Homo sapiens
gactgctaaata

SEQ ID NO: 1335046 - DNA, 14 bp, Homo sapiens
gactgctaaataaa

SEQ ID NO: 1335047 - DNA, 16 bp, Homo sapiens
gactggttttctgcca

SEQ ID NO: 1335048 - DNA, 20 bp, Homo sapiens
gactgtagatatgtattctt

SEQ ID NO: 1335049 - DNA, 16 bp, Homo sapiens
gacttaaaaaaaccat

SEQ ID NO: 1335050 - DNA, 23 bp, Homo sapiens
gacttaacatagccaaaatgtga

SEQ ID NO: 1335051 - DNA, 20 bp, Homo sapiens
gacttaactgcatttttaga

SEQ ID NO: 1335052 - DNA, 21 bp, Homo sapiens
gacttagaatccctgtgttaa

SEQ ID NO: 1335053 - DNA, 16 bp, Homo sapiens
gacttagggcaccagg

SEQ ID NO: 1335054 - DNA, 12 bp, Homo sapiens
gacttcaaagca

SEQ ID NO: 1335055 - DNA, 23 bp, Homo sapiens
gacttccccggagggctgcggcg

SEQ ID NO: 1335056 - DNA, 15 bp, Homo sapiens
gacttccttgagaca

SEQ ID NO: 1335057 - DNA, 16 bp, Homo sapiens
gacttccttgagacac

SEQ ID NO: 1335058 - DNA, 20 bp, Homo sapiens
gacttccttgagacacggag

SEQ ID NO: 1335059 - DNA, 15 bp, Homo sapiens
gacttctgcctggag

SEQ ID NO: 1335060 - DNA, 11 bp, Homo sapiens
gacttgaaaag

SEQ ID NO: 1335061 - DNA, 21 bp, Homo sapiens
gacttgaaaagagacaggcag

SEQ ID NO: 1335062 - DNA, 22 bp, Homo sapiens
gacttgaaaagagacaggcagg

SEQ ID NO: 1335063 - DNA, 16 bp, Homo sapiens
gacttgtttttgcaca

SEQ ID NO: 1335064 - DNA, 18 bp, Homo sapiens
gacttgtttttgcacatg

SEQ ID NO: 1335065 - DNA, 13 bp, Homo sapiens
gactttattattt

SEQ ID NO: 1335066 - DNA, 15 bp, Homo sapiens
gactttattatttat

SEQ ID NO: 1335067 - DNA, 14 bp, Homo sapiens
gactttctgcctgg

SEQ ID NO: 1335068 - DNA, 17 bp, Homo sapiens
gactttttttgtatgtg

SEQ ID NO: 1335069 - DNA, 18 bp, Homo sapiens
gagaaaaatgctccccac

SEQ ID NO: 1335070 - DNA, 13 bp, Homo sapiens
gagaaaattgaaa

SEQ ID NO: 1335071 - DNA, 19 bp, Homo sapiens
gagaaagaggcaccaggaa

SEQ ID NO: 1335072 - DNA, 14 bp, Homo sapiens
gagaaatgaaaaca

SEQ ID NO: 1335073 - DNA, 22 bp, Homo sapiens
gagaagcaagtaaaaaggctaa

SEQ ID NO: 1335074 - DNA, 14 bp, Homo sapiens
gagaagcccgtgtg

SEQ ID NO: 1335075 - DNA, 18 bp, Homo sapiens
gagaagccttcagctcca

SEQ ID NO: 1335076 - DNA, 16 bp, Homo sapiens
gagaagcggctggcag

SEQ ID NO: 1335077 - DNA, 17 bp, Homo sapiens
gagaagtgaatgctggg

SEQ ID NO: 1335078 - DNA, 19 bp, Homo sapiens
gagaagtgaatgctgggac

SEQ ID NO: 1335079 - DNA, 20 bp, Homo sapiens
gagaagtgaatgctgggact

SEQ ID NO: 1335080 - DNA, 23 bp, Homo sapiens
gagaatgagtccttgatttcaaa

SEQ ID NO: 1335081 - DNA, 16 bp, Homo sapiens
gagacagatacctcca

SEQ ID NO: 1335082 - DNA, 22 bp, Homo sapiens
gagacagatacctccaaccctg

SEQ ID NO: 1335083 - DNA, 20 bp, Homo sapiens
gagaccgggccctgggttcc

SEQ ID NO: 1335084 - DNA, 20 bp, Homo sapiens
gagaccggggtatcctgggg

SEQ ID NO: 1335085 - DNA, 18 bp, Homo sapiens
gagacggtgttttgccat

SEQ ID NO: 1335086 - DNA, 17 bp, Homo sapiens
gagacggtttccaggga

SEQ ID NO: 1335087 - DNA, 18 bp, Homo sapiens
gagactcgactctgtgcc

SEQ ID NO: 1335088 - DNA, 15 bp, Homo sapiens
gagactgggtaggaa

SEQ ID NO: 1335089 - DNA, 13 bp, Homo sapiens
gagactttgatgt

SEQ ID NO: 1335090 - DNA, 15 bp, Homo sapiens
gagactttgatgtca

SEQ ID NO: 1335091 - DNA, 13 bp, Homo sapiens
gagactttgtaga

SEQ ID NO: 1335092 - DNA, 13 bp, Homo sapiens
gagagaggacagc

SEQ ID NO: 1335093 - DNA, 16 bp, Homo sapiens
gagagccatacataaa

SEQ ID NO: 1335094 - DNA, 13 bp, Homo sapiens
gagagcctgctgg

SEQ ID NO: 1335095 - DNA, 13 bp, Homo sapiens
gagagcctggtgc

SEQ ID NO: 1335096 - DNA, 15 bp, Homo sapiens
gagagctagcagcag

SEQ ID NO: 1335097 - DNA, 15 bp, Homo sapiens
gagaggcaggcatag

SEQ ID NO: 1335098 - DNA, 10 bp, Homo sapiens
gagagggaga

SEQ ID NO: 1335099 - DNA, 23 bp, Homo sapiens
gagagggaggtcactggaaaggg

SEQ ID NO: 1335100 - DNA, 18 bp, Homo sapiens
gagagtctggccctagac

SEQ ID NO: 1335101 - DNA, 12 bp, Homo sapiens
gagatcctcctg

SEQ ID NO: 1335102 - DNA, 14 bp, Homo sapiens
gagatcctcctgca

SEQ ID NO: 1335103 - DNA, 23 bp, Homo sapiens
gagatcctcctgcagaccacgcc

SEQ ID NO: 1335104 - DNA, 18 bp, Homo sapiens
gagatgcaccaccaagcc

SEQ ID NO: 1335105 - DNA, 18 bp, Homo sapiens
gagattgcaccactgcac

SEQ ID NO: 1335106 - DNA, 21 bp, Homo sapiens
gagattgcaccactgcactcc

SEQ ID NO: 1335107 - DNA, 21 bp, Homo sapiens
gagattgtgccacttcactcc

SEQ ID NO: 1335108 - DNA, 16 bp, Homo sapiens
ggccagtccaggctgc

SEQ ID NO: 1335109 - DNA, 14 bp, Homo sapiens
ggccagtctgtgga

SEQ ID NO: 1335110 - DNA, 18 bp, Homo sapiens
ggccagtctgtggatcag

SEQ ID NO: 1335111 - DNA, 15 bp, Homo sapiens
ggccatgagtaaaat

SEQ ID NO: 1335112 - DNA, 14 bp, Homo sapiens
ggccatgctgaggc

SEQ ID NO: 1335113 - DNA, 14 bp, Homo sapiens
ggccatggctcagg

SEQ ID NO: 1335114 - DNA, 16 bp, Homo sapiens
ggccatgtatgaagcc

SEQ ID NO: 1335115 - DNA, 20 bp, Homo sapiens
ggccattctgccgccccctc

SEQ ID NO: 1335116 - DNA, 17 bp, Homo sapiens
ggcccagggcaagctcc

SEQ ID NO: 1335117 - DNA, 19 bp, Homo sapiens
ggcccagggcaagctccgc

SEQ ID NO: 1335118 - DNA, 20 bp, Homo sapiens
ggcccagggcaagctccgca

SEQ ID NO: 1335119 - DNA, 18 bp, Homo sapiens
ggcccagtgcatggtggc

SEQ ID NO: 1335120 - DNA, 22 bp, Homo sapiens
ggcccagtgcatggtggccaga

SEQ ID NO: 1335121 - DNA, 23 bp, Homo sapiens
ggcccatggctgttggtgggacc

SEQ ID NO: 1335122 - DNA, 15 bp, Homo sapiens
ggccccaccctgggc

SEQ ID NO: 1335123 - DNA, 23 bp, Homo sapiens
ggccccaccctgggccctgggct

SEQ ID NO: 1335124 - DNA, 23 bp, Homo sapiens
ggccccactcccttgctggcccc

SEQ ID NO: 1335125 - DNA, 16 bp, Homo sapiens
ggcccccaacctcagg

SEQ ID NO: 1335126 - DNA, 21 bp, Homo sapiens
ggcccccaacctcagggctcc

SEQ ID NO: 1335127 - DNA, 23 bp, Homo sapiens
ggcccccaacctcagggctccca

SEQ ID NO: 1335128 - DNA, 16 bp, Homo sapiens
ggcccccacttgcctc

SEQ ID NO: 1335129 - DNA, 18 bp, Homo sapiens
ggcccccacttgcctctt

SEQ ID NO: 1335130 - DNA, 23 bp, Homo sapiens
ggcccccagcccagggctcctgc

SEQ ID NO: 1335131 - DNA, 13 bp, Homo sapiens
ggccccctgcccg

SEQ ID NO: 1335132 - DNA, 14 bp, Homo sapiens
ggcccctcccacac

SEQ ID NO: 1335133 - DNA, 22 bp, Homo sapiens
ggcccctcccacacccaaagct

SEQ ID NO: 1335134 - DNA, 20 bp, Homo sapiens
ggcccctgggcttggcctgc

SEQ ID NO: 1335135 - DNA, 22 bp, Homo sapiens
ggcccctgggcttggcctgctg

SEQ ID NO: 1335136 - DNA, 14 bp, Homo sapiens
ggccctggcctccc

SEQ ID NO: 1335137 - DNA, 16 bp, Homo sapiens
ggccgcggagcctgca

SEQ ID NO: 1335138 - DNA, 14 bp, Homo sapiens
ggccgctccaccag

SEQ ID NO: 1335139 - DNA, 16 bp, Homo sapiens
ggccgctccaccagca

SEQ ID NO: 1335140 - DNA, 14 bp, Homo sapiens
ggccggccctgtgt

SEQ ID NO: 1335141 - DNA, 15 bp, Homo sapiens
ggccggccctgtgtg

SEQ ID NO: 1335142 - DNA, 23 bp, Homo sapiens
gggccatgctgaggcctgggccg

SEQ ID NO: 1335143 - DNA, 13 bp, Homo sapiens
gggccatggctca

SEQ ID NO: 1335144 - DNA, 19 bp, Homo sapiens
gggccatggctcagggtgg

SEQ ID NO: 1335145 - DNA, 14 bp, Homo sapiens
gggccatgtccaaa

SEQ ID NO: 1335146 - DNA, 14 bp, Homo sapiens
gggcccagattcta

SEQ ID NO: 1335147 - DNA, 11 bp, Homo sapiens
gggcccctggc

SEQ ID NO: 1335148 - DNA, 13 bp, Homo sapiens
gggccctgggctg

SEQ ID NO: 1335149 - DNA, 14 bp, Homo sapiens
gggccctgggctgg

SEQ ID NO: 1335150 - DNA, 14 bp, Homo sapiens
gggccgactaagag

SEQ ID NO: 1335151 - DNA, 12 bp, Homo sapiens
gggccggccctg

SEQ ID NO: 1335152 - DNA, 19 bp, Homo sapiens
gggccggccctgtgtgcag

SEQ ID NO: 1335153 - DNA, 19 bp, Homo sapiens
gggccgtatctccggctcc

SEQ ID NO: 1335154 - DNA, 21 bp, Homo sapiens
gggcctagcgatctctcctgg

SEQ ID NO: 1335155 - DNA, 22 bp, Homo sapiens
gggcctcggtgtggagaagcgg

SEQ ID NO: 1335156 - DNA, 17 bp, Homo sapiens
gggcggcaggggcctgg

SEQ ID NO: 1335157 - DNA, 21 bp, Homo sapiens
gggcgtggagggaggccccag

SEQ ID NO: 1335158 - DNA, 22 bp, Homo sapiens
gggctcagcaaaagatgcttct

SEQ ID NO: 1335159 - DNA, 11 bp, Homo sapiens
gggctcccagg

SEQ ID NO: 1335160 - DNA, 14 bp, Homo sapiens
gggctcccaggggt

SEQ ID NO: 1335161 - DNA, 23 bp, Homo sapiens
gggctcccaggggtctccctggc

SEQ ID NO: 1335162 - DNA, 15 bp, Homo sapiens
gggctcccgggcccc

SEQ ID NO: 1335163 - DNA, 16 bp, Homo sapiens
gggctgaggtgggagg

SEQ ID NO: 1335164 - DNA, 12 bp, Homo sapiens
gggctgcttcct

SEQ ID NO: 1335165 - DNA, 17 bp, Homo sapiens
gggctgcttcctcctgg

SEQ ID NO: 1335166 - DNA, 18 bp, Homo sapiens
gggctggacttctacctg

SEQ ID NO: 1335167 - DNA, 14 bp, Homo sapiens
gggctggctcctga

SEQ ID NO: 1335168 - DNA, 19 bp, Homo sapiens
gggcttcctctagaagcca

SEQ ID NO: 1335169 - DNA, 16 bp, Homo sapiens
ggggaaaatcagcctg

SEQ ID NO: 1335170 - DNA, 21 bp, Homo sapiens
ggggaaaatcagcctgctcca

SEQ ID NO: 1335171 - DNA, 24 bp, Homo sapiens
ggggaaaatcagcctgctccagct

SEQ ID NO: 1335172 - DNA, 19 bp, Homo sapiens
ggggaagagatccaaagac

SEQ ID NO: 1335173 - DNA, 21 bp, Homo sapiens
ggggacccaatgtaggagctg

SEQ ID NO: 1335174 - DNA, 18 bp, Homo sapiens
ggggagccaaaatctcaa

SEQ ID NO: 1335175 - DNA, 13 bp, Homo sapiens
ggggatccccgcc

SEQ ID NO: 1335176 - DNA, 21 bp, Homo sapiens
ggggatccccgcctggccagg

SEQ ID NO: 1335177 - DNA, 13 bp, Homo sapiens
ggggcaggctggg

SEQ ID NO: 1335178 - DNA, 15 bp, Homo sapiens
ggggcaggctgggcc

SEQ ID NO: 1335179 - DNA, 17 bp, Homo sapiens
ggggcagggagctgggc

SEQ ID NO: 1335180 - DNA, 18 bp, Homo sapiens
ggggccaccaaagctgcc

SEQ ID NO: 1335181 - DNA, 21 bp, Homo sapiens
ggggccatttgcaataacagc

SEQ ID NO: 1335182 - DNA, 14 bp, Homo sapiens
ggggcccagtgcat

SEQ ID NO: 1335183 - DNA, 23 bp, Homo sapiens
ggggcctacagctttgatccctg

SEQ ID NO: 1335184 - DNA, 21 bp, Homo sapiens
ggggcctagcgatctctcctg

SEQ ID NO: 1335185 - DNA, 19 bp, Homo sapiens
ggggctgaggtgggaggat

SEQ ID NO: 1335186 - DNA, 18 bp, Homo sapiens
ggggctgcccttgggcca

SEQ ID NO: 1335187 - DNA, 18 bp, Homo sapiens
ggggctgcttcctcctgg

SEQ ID NO: 1335188 - DNA, 19 bp, Homo sapiens
ggggctgcttcctcctgga

SEQ ID NO: 1335189 - DNA, 18 bp, Homo sapiens
ggggctggggaaggaagc

SEQ ID NO: 1335190 - DNA, 22 bp, Homo sapiens
gggggagccggtaactgtcctg

SEQ ID NO: 1335191 - DNA, 17 bp, Homo sapiens
gggggatcacagcctct

SEQ ID NO: 1335192 - DNA, 14 bp, Homo sapiens
gggggcaggtgctg

SEQ ID NO: 1335193 - DNA, 18 bp, Homo sapiens
gggggctagggagacgcc

SEQ ID NO: 1335194 - DNA, 23 bp, Homo sapiens
gggggtggccgctgagtggcagg

SEQ ID NO: 1335195 - DNA, 22 bp, Homo sapiens
ggggtccctagcagcccaccct

SEQ ID NO: 1335196 - DNA, 13 bp, Homo sapiens
ggggtctccctgg

SEQ ID NO: 1335197 - DNA, 20 bp, Homo sapiens
ggggtgcttttatagaggct

SEQ ID NO: 1335198 - DNA, 17 bp, Homo sapiens
ggggtggaggcttcctg

SEQ ID NO: 1335199 - DNA, 18 bp, Homo sapiens
ggggtgttagtggcaccg

SEQ ID NO: 1335200 - DNA, 17 bp, Homo sapiens
gggtaatccctgctttt

SEQ ID NO: 1335201 - DNA, 17 bp, Homo sapiens
gggtccctagcagccca

SEQ ID NO: 1335202 - DNA, 14 bp, Homo sapiens
gggtcggctgacca

SEQ ID NO: 1335203 - DNA, 14 bp, Homo sapiens
gggtctccctggct

SEQ ID NO: 1335204 - DNA, 18 bp, Homo sapiens
gggtgctgggaggaggga

SEQ ID NO: 1335205 - DNA, 15 bp, Homo sapiens
gggtggcaccagcag

SEQ ID NO: 1335206 - DNA, 20 bp, Homo sapiens
gggtggccacagcgccagcc

SEQ ID NO: 1335207 - DNA, 11 bp, Homo sapiens
gggtgggcctc

SEQ ID NO: 1335208 - DNA, 14 bp, Homo sapiens
gggtgtgggaaagc

SEQ ID NO: 1335209 - DNA, 14 bp, Homo sapiens
gggttcatttgtgt

SEQ ID NO: 1335210 - DNA, 16 bp, Homo sapiens
gggtttctctgtggct

SEQ ID NO: 1335211 - DNA, 13 bp, Homo sapiens
gggttttgtaatg

SEQ ID NO: 1335212 - DNA, 13 bp, Homo sapiens
ggtaaaatgaaga

SEQ ID NO: 1335213 - DNA, 20 bp, Homo sapiens
ggtaaaatgaagaatttaaa

SEQ ID NO: 1335214 - DNA, 15 bp, Homo sapiens
ggtaaagactggctt

SEQ ID NO: 1335215 - DNA, 12 bp, Homo sapiens
ggtaaatgtttc

SEQ ID NO: 1335216 - DNA, 13 bp, Homo sapiens
ggtaaatgtttct

SEQ ID NO: 1335217 - DNA, 12 bp, Homo sapiens
ggtaactgtcct

SEQ ID NO: 1335218 - DNA, 12 bp, Homo sapiens
ggtaccagctgc

SEQ ID NO: 1335219 - DNA, 15 bp, Homo sapiens
ggtaccagctgcgct

SEQ ID NO: 1335220 - DNA, 13 bp, Homo sapiens
ggtaccctgggtg

SEQ ID NO: 1335221 - DNA, 16 bp, Homo sapiens
ggtacttttaaaaaca

SEQ ID NO: 1335222 - DNA, 20 bp, Homo sapiens
ggtagagaggcgcggagtga

SEQ ID NO: 1335223 - DNA, 18 bp, Homo sapiens
ggtaggttcagccaaggt

SEQ ID NO: 1335224 - DNA, 13 bp, Homo sapiens
ggtagtttctgtg

SEQ ID NO: 1335225 - DNA, 13 bp, Homo sapiens
ggtatatatacat

SEQ ID NO: 1335226 - DNA, 18 bp, Homo sapiens
ggtatccccccatcttgc

SEQ ID NO: 1335227 - DNA, 23 bp, Homo sapiens
ggtcaaggcagtagaactccagg

SEQ ID NO: 1335228 - DNA, 15 bp, Homo sapiens
ggtcactggaaaggg

SEQ ID NO: 1335229 - DNA, 18 bp, Homo sapiens
ggtccagctggcctggac

SEQ ID NO: 1335230 - DNA, 20 bp, Homo sapiens
ggtccctccagaaccacccc

SEQ ID NO: 1335231 - DNA, 23 bp, Homo sapiens
ggtcctagaaattccccaccctg

SEQ ID NO: 1335232 - DNA, 11 bp, Homo sapiens
ggtccttcctg

SEQ ID NO: 1335233 - DNA, 13 bp, Homo sapiens
ggtcgaggcagga

SEQ ID NO: 1335234 - DNA, 23 bp, Homo sapiens
gctgggtggcaccagcagcctgg

SEQ ID NO: 1335235 - DNA, 14 bp, Homo sapiens
gctggtaaaatgaa

SEQ ID NO: 1335236 - DNA, 18 bp, Homo sapiens
gctggtaaaatgaagaat

SEQ ID NO: 1335237 - DNA, 15 bp, Homo sapiens
gctggtccgtgggac

SEQ ID NO: 1335238 - DNA, 20 bp, Homo sapiens
gctggtgcacagccactccc

SEQ ID NO: 1335239 - DNA, 15 bp, Homo sapiens
gctgtaatcatttgt

SEQ ID NO: 1335240 - DNA, 22 bp, Homo sapiens
gctgtaatcatttgtttacatt

SEQ ID NO: 1335241 - DNA, 18 bp, Homo sapiens
gctgtacgacacgggtgg

SEQ ID NO: 1335242 - DNA, 20 bp, Homo sapiens
gctgtcaatgggacctgtgg

SEQ ID NO: 1335243 - DNA, 22 bp, Homo sapiens
gctgtcaatgggacctgtggct

SEQ ID NO: 1335244 - DNA, 15 bp, Homo sapiens
gctgtcggcgctgcc

SEQ ID NO: 1335245 - DNA, 15 bp, Homo sapiens
gctgtgagggagggg

SEQ ID NO: 1335246 - DNA, 23 bp, Homo sapiens
gctgtgagggaggggaaaagcat

SEQ ID NO: 1335247 - DNA, 13 bp, Homo sapiens
gctgtgcaacgcc

SEQ ID NO: 1335248 - DNA, 20 bp, Homo sapiens
gctgtgcaacgccgtgggct

SEQ ID NO: 1335249 - DNA, 14 bp, Homo sapiens
gctgtgctatgaat

SEQ ID NO: 1335250 - DNA, 15 bp, Homo sapiens
gctgtgctatgaatt

SEQ ID NO: 1335251 - DNA, 13 bp, Homo sapiens
gctgtgctgccct

SEQ ID NO: 1335252 - DNA, 16 bp, Homo sapiens
gctgtgctgccctgaa

SEQ ID NO: 1335253 - DNA, 19 bp, Homo sapiens
gctgtgctgccctgaagaa

SEQ ID NO: 1335254 - DNA, 15 bp, Homo sapiens
gctgtgtgtcccagg

SEQ ID NO: 1335255 - DNA, 21 bp, Homo sapiens
gctgttcctgttcagtaataa

SEQ ID NO: 1335256 - DNA, 13 bp, Homo sapiens
gctgtttttttgt

SEQ ID NO: 1335257 - DNA, 15 bp, Homo sapiens
gcttaatcattttca

SEQ ID NO: 1335258 - DNA, 16 bp, Homo sapiens
gcttaatgctacatgt

SEQ ID NO: 1335259 - DNA, 15 bp, Homo sapiens
gcttacgtagttcta

SEQ ID NO: 1335260 - DNA, 16 bp, Homo sapiens
gcttagagaggacaat

SEQ ID NO: 1335261 - DNA, 14 bp, Homo sapiens
gcttagtttgtgtg

SEQ ID NO: 1335262 - DNA, 12 bp, Homo sapiens
gcttataaaaca

SEQ ID NO: 1335263 - DNA, 16 bp, Homo sapiens
gcttattgtttctctg

SEQ ID NO: 1335264 - DNA, 17 bp, Homo sapiens
gcttcacagtagagcca

SEQ ID NO: 1335265 - DNA, 17 bp, Homo sapiens
gcttcaccatggcctta

SEQ ID NO: 1335266 - DNA, 17 bp, Homo sapiens
gcttcacggaagagcct

SEQ ID NO: 1335267 - DNA, 20 bp, Homo sapiens
gcttcacggaagagccttgc

SEQ ID NO: 1335268 - DNA, 15 bp, Homo sapiens
gcttccaaatattgt

SEQ ID NO: 1335269 - DNA, 21 bp, Homo sapiens
gcttccaggaaactccacatc

SEQ ID NO: 1335270 - DNA, 15 bp, Homo sapiens
gcttcccttactttg

SEQ ID NO: 1335271 - DNA, 14 bp, Homo sapiens
gcttcctcccaaca

SEQ ID NO: 1335272 - DNA, 15 bp, Homo sapiens
gcttcctctagaagc

SEQ ID NO: 1335273 - DNA, 17 bp, Homo sapiens
gcttcctctagaagcca

SEQ ID NO: 1335274 - DNA, 20 bp, Homo sapiens
gcttcctctagaagccaagg

SEQ ID NO: 1335275 - DNA, 23 bp, Homo sapiens
gcttccttgtagcgactaaacta

SEQ ID NO: 1335276 - DNA, 16 bp, Homo sapiens
gcttcctttcccaagc

SEQ ID NO: 1335277 - DNA, 24 bp, Homo sapiens
gcttcctttcccaagccttcgggc

SEQ ID NO: 1335278 - DNA, 21 bp, Homo sapiens
gcttctcagatttctgaggaa

SEQ ID NO: 1335279 - DNA, 15 bp, Homo sapiens
gccggcagccccagc

SEQ ID NO: 1335280 - DNA, 13 bp, Homo sapiens
gccggccctgtgt

SEQ ID NO: 1335281 - DNA, 14 bp, Homo sapiens
gccggccctgtgtg

SEQ ID NO: 1335282 - DNA, 22 bp, Homo sapiens
gccgggaccaccctgagccggc

SEQ ID NO: 1335283 - DNA, 14 bp, Homo sapiens
gccgggcccctggg

SEQ ID NO: 1335284 - DNA, 22 bp, Homo sapiens
gccgggcgcggtggctcacgcc

SEQ ID NO: 1335285 - DNA, 16 bp, Homo sapiens
gccggtaactgtcctg

SEQ ID NO: 1335286 - DNA, 12 bp, Homo sapiens
gccggttcctgt

SEQ ID NO: 1335287 - DNA, 22 bp, Homo sapiens
gccggttcctgtccctgcgcct

SEQ ID NO: 1335288 - DNA, 17 bp, Homo sapiens
gccgtcaccaccacccc

SEQ ID NO: 1335289 - DNA, 23 bp, Homo sapiens
gccgtcaccaccacccctaccac

SEQ ID NO: 1335290 - DNA, 23 bp, Homo sapiens
gccgtctccaggggctgcttcct

SEQ ID NO: 1335291 - DNA, 12 bp, Homo sapiens
gccgtctctgga

SEQ ID NO: 1335292 - DNA, 17 bp, Homo sapiens
gccgttgctgacttaga

SEQ ID NO: 1335293 - DNA, 23 bp, Homo sapiens
gcctacagctttgatccctgaca

SEQ ID NO: 1335294 - DNA, 17 bp, Homo sapiens
gcctaccccgcagacac

SEQ ID NO: 1335295 - DNA, 17 bp, Homo sapiens
gcctagcgatctctcct

SEQ ID NO: 1335296 - DNA, 20 bp, Homo sapiens
gcctagcgatctctcctggc

SEQ ID NO: 1335297 - DNA, 11 bp, Homo sapiens
gcctatttcat

SEQ ID NO: 1335298 - DNA, 13 bp, Homo sapiens
gcctcatgtggct

SEQ ID NO: 1335299 - DNA, 15 bp, Homo sapiens
gcctcatgtggctgg

SEQ ID NO: 1335300 - DNA, 18 bp, Homo sapiens
gcctcatgtggctggaag

SEQ ID NO: 1335301 - DNA, 12 bp, Homo sapiens
gcctccacagcg

SEQ ID NO: 1335302 - DNA, 15 bp, Homo sapiens
gcctccacagcgagg

SEQ ID NO: 1335303 - DNA, 22 bp, Homo sapiens
gcctccacagcgagggcagctg

SEQ ID NO: 1335304 - DNA, 15 bp, Homo sapiens
gcctccaggtgcaga

SEQ ID NO: 1335305 - DNA, 16 bp, Homo sapiens
gcctccaggtgcagag

SEQ ID NO: 1335306 - DNA, 17 bp, Homo sapiens
gcctccaggtgcagagg

SEQ ID NO: 1335307 - DNA, 15 bp, Homo sapiens
gcctccatccaaggc

SEQ ID NO: 1335308 - DNA, 14 bp, Homo sapiens
gcctcccacgactg

SEQ ID NO: 1335309 - DNA, 17 bp, Homo sapiens
gcctccccacctccagg

SEQ ID NO: 1335310 - DNA, 13 bp, Homo sapiens
gcctccccatttc

SEQ ID NO: 1335311 - DNA, 18 bp, Homo sapiens
gcctccccatttcccatc

SEQ ID NO: 1335312 - DNA, 23 bp, Homo sapiens
gcctccccatttcccatctgcac

SEQ ID NO: 1335313 - DNA, 15 bp, Homo sapiens
gcctcccctgccacc

SEQ ID NO: 1335314 - DNA, 19 bp, Homo sapiens
gcctccctccaccccagga

SEQ ID NO: 1335315 - DNA, 19 bp, Homo sapiens
gcctccctccccagtgcaa

SEQ ID NO: 1335316 - DNA, 16 bp, Homo sapiens
gcctccgagagggaga

SEQ ID NO: 1335317 - DNA, 14 bp, Homo sapiens
gcctctccagcctc

SEQ ID NO: 1335318 - DNA, 16 bp, Homo sapiens
gcctctgaaaagtgtg

SEQ ID NO: 1335319 - DNA, 18 bp, Homo sapiens
gcctctgtgctgtgtgtg

SEQ ID NO: 1335320 - DNA, 15 bp, Homo sapiens
gcctcttctgagctt

SEQ ID NO: 1335321 - DNA, 17 bp, Homo sapiens
gcctcttgtaaagactg

SEQ ID NO: 1335322 - DNA, 23 bp, Homo sapiens
gcctcttgtatccctagtgctcc

SEQ ID NO: 1335323 - DNA, 12 bp, Homo sapiens
gcctctttccct

SEQ ID NO: 1335324 - DNA, 13 bp, Homo sapiens
gcctgcagggcca

SEQ ID NO: 1335325 - DNA, 21 bp, Homo sapiens
gcctgcatttcctcgcagcct

SEQ ID NO: 1335326 - DNA, 14 bp, Homo sapiens
gcctgcccagacaa

SEQ ID NO: 1335327 - DNA, 21 bp, Homo sapiens
gcctgccccgcccccagtccc

SEQ ID NO: 1335328 - DNA, 16 bp, Homo sapiens
gcctgcctcttctcta

SEQ ID NO: 1335329 - DNA, 21 bp, Homo sapiens
gcctgccttaagtgaggaaat

SEQ ID NO: 1335330 - DNA, 14 bp, Homo sapiens
gcctgcgaccctgg

SEQ ID NO: 1335331 - DNA, 22 bp, Homo sapiens
gcctgcgcctgctgcatgccct

SEQ ID NO: 1335332 - DNA, 22 bp, Homo sapiens
gcctgctagctagctcaactag

SEQ ID NO: 1335333 - DNA, 13 bp, Homo sapiens
gcctgctccagct

SEQ ID NO: 1335334 - DNA, 13 bp, Homo sapiens
gcctgctccctgt

SEQ ID NO: 1335335 - DNA, 21 bp, Homo sapiens
gcctgctgcatgccctctcag

SEQ ID NO: 1335336 - DNA, 22 bp, Homo sapiens
gcctgctgcatgccctctcagg

SEQ ID NO: 1335337 - DNA, 22 bp, Homo sapiens
gcctgctggcacccaccgtgga

SEQ ID NO: 1335338 - DNA, 14 bp, Homo sapiens
gcctggaccctgtg

SEQ ID NO: 1335339 - DNA, 14 bp, Homo sapiens
gcctggccaggagc

SEQ ID NO: 1335340 - DNA, 22 bp, Homo sapiens
gcctggccttgtcctcagccag

SEQ ID NO: 1335341 - DNA, 15 bp, Homo sapiens
gcctgggccccagct

SEQ ID NO: 1335342 - DNA, 22 bp, Homo sapiens
gcctgtaacactcctctgcgtc

SEQ ID NO: 1335343 - DNA, 20 bp, Homo sapiens
gcctgtaatcctagcacttt

SEQ ID NO: 1335344 - DNA, 12 bp, Homo sapiens
gcctgtgtccat

SEQ ID NO: 1335345 - DNA, 20 bp, Homo sapiens
gcctgtgtccatgcgctcag

SEQ ID NO: 1335346 - DNA, 21 bp, Homo sapiens
gcctgtgtccatgcgctcagg

SEQ ID NO: 1335347 - DNA, 19 bp, Homo sapiens
gccttaaaacatcattcct

SEQ ID NO: 1335348 - DNA, 20 bp, Homo sapiens
gccttaagtgaggaaatcaa

SEQ ID NO: 1335349 - DNA, 22 bp, Homo sapiens
gccttaagtgaggaaatcaaag

SEQ ID NO: 1335350 - DNA, 21 bp, Homo sapiens
gccttagccgcccatgcactg

SEQ ID NO: 1335351 - DNA, 22 bp, Homo sapiens
gccttcaaaactatagcttgca

SEQ ID NO: 1335352 - DNA, 23 bp, Homo sapiens
gccttcagacagagaggactgta

SEQ ID NO: 1335353 - DNA, 23 bp, Homo sapiens
gccttcagggttcagcagtacag

SEQ ID NO: 1335354 - DNA, 20 bp, Homo sapiens
gccttcgcttcttgcctctg

SEQ ID NO: 1335355 - DNA, 16 bp, Homo sapiens
gccttctcagaagcac

SEQ ID NO: 1335356 - DNA, 15 bp, Homo sapiens
gccttgagccctggc

SEQ ID NO: 1335357 - DNA, 17 bp, Homo sapiens
gccttgctgtttgtcct

SEQ ID NO: 1335358 - DNA, 15 bp, Homo sapiens
gccttggctcagaca

SEQ ID NO: 1335359 - DNA, 14 bp, Homo sapiens
gcctttcctctcta

SEQ ID NO: 1335360 - DNA, 23 bp, Homo sapiens
gcctttccttttcgcctttcctc

SEQ ID NO: 1335361 - DNA, 18 bp, Homo sapiens
gcctttttaaaacacatg

SEQ ID NO: 1335362 - DNA, 12 bp, Homo sapiens
gcgaccaccgcc

SEQ ID NO: 1335363 - DNA, 17 bp, Homo sapiens
gcgaccatgtggccaca

SEQ ID NO: 1335364 - DNA, 13 bp, Homo sapiens
gcgaccctggggg

SEQ ID NO: 1335365 - DNA, 23 bp, Homo sapiens
gcgaccctgggggcacaggaggc

SEQ ID NO: 1335366 - DNA, 18 bp, Homo sapiens
gcgactccgttggccact

SEQ ID NO: 1335367 - DNA, 20 bp, Homo sapiens
gcgactccgttggccactcc

SEQ ID NO: 1335368 - DNA, 18 bp, Homo sapiens
gcgagcatgtcgtggaca

SEQ ID NO: 1335369 - DNA, 13 bp, Homo sapiens
gcgagggcagctg

SEQ ID NO: 1335370 - DNA, 17 bp, Homo sapiens
gcgagggcagctgctat

SEQ ID NO: 1335371 - DNA, 17 bp, Homo sapiens
gcgatctctccactgtg

SEQ ID NO: 1335372 - DNA, 18 bp, Homo sapiens
gcgatctctcctggccta

SEQ ID NO: 1335373 - DNA, 18 bp, Homo sapiens
gcgcaggtgggctggact

SEQ ID NO: 1335374 - DNA, 19 bp, Homo sapiens
gcgcaggtgggctggactt

SEQ ID NO: 1335375 - DNA, 13 bp, Homo sapiens
gcgccacaggacc

SEQ ID NO: 1335376 - DNA, 22 bp, Homo sapiens
gcgccccctccgccctgccact

SEQ ID NO: 1335377 - DNA, 16 bp, Homo sapiens
gcgcccttggcttctg

SEQ ID NO: 1335378 - DNA, 23 bp, Homo sapiens
gcgccctttccccgacgcccacc

SEQ ID NO: 1335379 - DNA, 15 bp, Homo sapiens
gcgccgtctccaggg

SEQ ID NO: 1335380 - DNA, 19 bp, Homo sapiens
gcgcctccatccaaggcca

SEQ ID NO: 1335381 - DNA, 17 bp, Homo sapiens
gcgcctccctccacccc

SEQ ID NO: 1335382 - DNA, 21 bp, Homo sapiens
gcgcctccctccaccccagga

SEQ ID NO: 1335383 - DNA, 21 bp, Homo sapiens
gcgcctcgccggatctgaggg

SEQ ID NO: 1335384 - DNA, 14 bp, Homo sapiens
gcgctcagtaaacg

SEQ ID NO: 1335385 - DNA, 19 bp, Homo sapiens
gcgctctctttgcaactgt

SEQ ID NO: 1335386 - DNA, 21 bp, Homo sapiens
gcggaggtgtggagccgaggc

SEQ ID NO: 1335387 - DNA, 15 bp, Homo sapiens
gcggcaggggcctgg

SEQ ID NO: 1335388 - DNA, 15 bp, Homo sapiens
gcggtggctcacgcc

SEQ ID NO: 1335389 - DNA, 14 bp, Homo sapiens
gcgtcagctgctcc

SEQ ID NO: 1335390 - DNA, 11 bp, Homo sapiens
gcgtccctggc

SEQ ID NO: 1335391 - DNA, 19 bp, Homo sapiens
gcgtgacccgacctggccg

SEQ ID NO: 1335392 - DNA, 14 bp, Homo sapiens
gcgtggcccaaggc

SEQ ID NO: 1335393 - DNA, 15 bp, Homo sapiens
gcgtggcccaaggct

SEQ ID NO: 1335394 - DNA, 15 bp, Homo sapiens
gcgtgggagccagcc

SEQ ID NO: 1335395 - DNA, 16 bp, Homo sapiens
gcgtgggagccagcct

SEQ ID NO: 1335396 - DNA, 19 bp, Homo sapiens
gctaaataaaatttgttgc

SEQ ID NO: 1335397 - DNA, 20 bp, Homo sapiens
gctaacatggtgaaaccccg

SEQ ID NO: 1335398 - DNA, 14 bp, Homo sapiens
gctaactgtaaatc

SEQ ID NO: 1335399 - DNA, 14 bp, Homo sapiens
gaagcggctggcag

SEQ ID NO: 1335400 - DNA, 18 bp, Homo sapiens
gaagctgcatccagaggc

SEQ ID NO: 1335401 - DNA, 21 bp, Homo sapiens
gaagctgccaggtgagaaact

SEQ ID NO: 1335402 - DNA, 23 bp, Homo sapiens
gaaggagataattactgccttga

SEQ ID NO: 1335403 - DNA, 16 bp, Homo sapiens
gaagggagaagaaagg

SEQ ID NO: 1335404 - DNA, 14 bp, Homo sapiens
gaaggggttcctca

SEQ ID NO: 1335405 - DNA, 22 bp, Homo sapiens
gaaggtggatggccccagcaca

SEQ ID NO: 1335406 - DNA, 15 bp, Homo sapiens
gaagtcattaaactg

SEQ ID NO: 1335407 - DNA, 17 bp, Homo sapiens
gaagtcattaaactggt

SEQ ID NO: 1335408 - DNA, 22 bp, Homo sapiens
gaagtgcggggtaggggaagaa

SEQ ID NO: 1335409 - DNA, 19 bp, Homo sapiens
gaagtgcttggaacatact

SEQ ID NO: 1335410 - DNA, 21 bp, Homo sapiens
gaagttattttctacagtggt

SEQ ID NO: 1335411 - DNA, 12 bp, Homo sapiens
gaagttttccta

SEQ ID NO: 1335412 - DNA, 15 bp, Homo sapiens
gaataagaatttgca

SEQ ID NO: 1335413 - DNA, 16 bp, Homo sapiens
gaataagaatttgcat

SEQ ID NO: 1335414 - DNA, 17 bp, Homo sapiens
gaataagaatttgcata

SEQ ID NO: 1335415 - DNA, 15 bp, Homo sapiens
gaatactgatggaat

SEQ ID NO: 1335416 - DNA, 12 bp, Homo sapiens
gaatacttgaac

SEQ ID NO: 1335417 - DNA, 21 bp, Homo sapiens
gaatattgcaaaatacatgaa

SEQ ID NO: 1335418 - DNA, 19 bp, Homo sapiens
gaatatttttatatttcct

SEQ ID NO: 1335419 - DNA, 20 bp, Homo sapiens
gaatatttttatatttcctt

SEQ ID NO: 1335420 - DNA, 21 bp, Homo sapiens
gaatatttttatatttccttt

SEQ ID NO: 1335421 - DNA, 23 bp, Homo sapiens
gaatcaaaagtgcctcaagagga

SEQ ID NO: 1335422 - DNA, 21 bp, Homo sapiens
gaatcaataatatattttctg

SEQ ID NO: 1335423 - DNA, 14 bp, Homo sapiens
gaatccaagcctcc

SEQ ID NO: 1335424 - DNA, 17 bp, Homo sapiens
gaatccaagcctccaca

SEQ ID NO: 1335425 - DNA, 17 bp, Homo sapiens
gaatccctgtgttaatt

SEQ ID NO: 1335426 - DNA, 16 bp, Homo sapiens
gaatcccttaacagtt

SEQ ID NO: 1335427 - DNA, 13 bp, Homo sapiens
gaatcctggcagc

SEQ ID NO: 1335428 - DNA, 14 bp, Homo sapiens
gaatcctggcagcc

SEQ ID NO: 1335429 - DNA, 15 bp, Homo sapiens
gaatctctgtgcctt

SEQ ID NO: 1335430 - DNA, 18 bp, Homo sapiens
gaatctggagaccaggga

SEQ ID NO: 1335431 - DNA, 21 bp, Homo sapiens
gaatgccactgccttcgcttc

SEQ ID NO: 1335432 - DNA, 22 bp, Homo sapiens
gaatgccactgccttcgcttct

SEQ ID NO: 1335433 - DNA, 19 bp, Homo sapiens
gaatgccatctatctagtt

SEQ ID NO: 1335434 - DNA, 13 bp, Homo sapiens
gaatgctgggact

SEQ ID NO: 1335435 - DNA, 16 bp, Homo sapiens
gaatgctgggactcag

SEQ ID NO: 1335436 - DNA, 17 bp, Homo sapiens
gaatgctgggactcagc

SEQ ID NO: 1335437 - DNA, 14 bp, Homo sapiens
gaatgtacgtccag

SEQ ID NO: 1335438 - DNA, 13 bp, Homo sapiens
gaatgtatttatt

SEQ ID NO: 1335439 - DNA, 14 bp, Homo sapiens
gaatgttgggactg

SEQ ID NO: 1335440 - DNA, 19 bp, Homo sapiens
gaattaccaagaatatcct

SEQ ID NO: 1335441 - DNA, 17 bp, Homo sapiens
gaattagatttctatag

SEQ ID NO: 1335442 - DNA, 15 bp, Homo sapiens
gaattattgacactg

SEQ ID NO: 1335443 - DNA, 16 bp, Homo sapiens
gaattattgacactga

SEQ ID NO: 1335444 - DNA, 18 bp, Homo sapiens
gaattcaaactggggcct

SEQ ID NO: 1335445 - DNA, 13 bp, Homo sapiens
gaattcagacatc

SEQ ID NO: 1335446 - DNA, 15 bp, Homo sapiens
gaattctgattgatt

SEQ ID NO: 1335447 - DNA, 19 bp, Homo sapiens
gaattctgtttaattttca

SEQ ID NO: 1335448 - DNA, 18 bp, Homo sapiens
gaattgaaggtttttgat

SEQ ID NO: 1335449 - DNA, 18 bp, Homo sapiens
gaattgtggctatcctga

SEQ ID NO: 1335450 - DNA, 18 bp, Homo sapiens
gaatttagtattatcaaa

SEQ ID NO: 1335451 - DNA, 15 bp, Homo sapiens
gaatttttattgttg

SEQ ID NO: 1335452 - DNA, 17 bp, Homo sapiens
gacaaaagtctgtcttt

SEQ ID NO: 1335453 - DNA, 16 bp, Homo sapiens
gacaaagtgccaaaga

SEQ ID NO: 1335454 - DNA, 17 bp, Homo sapiens
gacaaagtgccaaagaa

SEQ ID NO: 1335455 - DNA, 19 bp, Homo sapiens
gacaaagtgccaaagaaag

SEQ ID NO: 1335456 - DNA, 12 bp, Homo sapiens
gacaactgtgac

SEQ ID NO: 1335457 - DNA, 13 bp, Homo sapiens
gacaactgtgact

SEQ ID NO: 1335458 - DNA, 18 bp, Homo sapiens
gacaagagatgggaatga

SEQ ID NO: 1335459 - DNA, 20 bp, Homo sapiens
gacaagattttttaattgtt

SEQ ID NO: 1335460 - DNA, 14 bp, Homo sapiens
gacaataaagcttg

SEQ ID NO: 1335461 - DNA, 15 bp, Homo sapiens
gacaatactggggtt

SEQ ID NO: 1335462 - DNA, 19 bp, Homo sapiens
gacaatgtgaaaagaaaaa

SEQ ID NO: 1335463 - DNA, 15 bp, Homo sapiens
gacaattgtcttttt

SEQ ID NO: 1335464 - DNA, 18 bp, Homo sapiens
gacacgggtggggaaagg

SEQ ID NO: 1335465 - DNA, 21 bp, Homo sapiens
gacactccagggacacacagc

SEQ ID NO: 1335466 - DNA, 19 bp, Homo sapiens
gacactgaaagttttgtaa

SEQ ID NO: 1335467 - DNA, 20 bp, Homo sapiens
gacactgaaagttttgtaaa

SEQ ID NO: 1335468 - DNA, 17 bp, Homo sapiens
gacactgttgataaaaa

SEQ ID NO: 1335469 - DNA, 18 bp, Homo sapiens
gacactgttgataaaaac

SEQ ID NO: 1335470 - DNA, 23 bp, Homo sapiens
gacagaaggtgccactttaccca

SEQ ID NO: 1335471 - DNA, 15 bp, Homo sapiens
gacagagaggactgt

SEQ ID NO: 1335472 - DNA, 21 bp, Homo sapiens
gacagagcaagtgagaccctg

SEQ ID NO: 1335473 - DNA, 15 bp, Homo sapiens
gacagatacctccaa

SEQ ID NO: 1335474 - DNA, 16 bp, Homo sapiens
gacagccaaaggctgg

SEQ ID NO: 1335475 - DNA, 15 bp, Homo sapiens
gacagcttgagccgg

SEQ ID NO: 1335476 - DNA, 18 bp, Homo sapiens
gacagtatcccacatcca

SEQ ID NO: 1335477 - DNA, 15 bp, Homo sapiens
gacatatcatctgtg

SEQ ID NO: 1335478 - DNA, 15 bp, Homo sapiens
gacatcctcctccca

SEQ ID NO: 1335479 - DNA, 20 bp, Homo sapiens
gacatctggaatctggagac

SEQ ID NO: 1335480 - DNA, 17 bp, Homo sapiens
gacatgcaataaaattt

SEQ ID NO: 1335481 - DNA, 21 bp, Homo sapiens
gacatggtgcctgagaggcag

SEQ ID NO: 1335482 - DNA, 23 bp, Homo sapiens
gacattgacctatttccagaaat

SEQ ID NO: 1335483 - DNA, 19 bp, Homo sapiens
gaccaccgcccctggccgc

SEQ ID NO: 1335484 - DNA, 17 bp, Homo sapiens
gaccacgcccgtcctgc

SEQ ID NO: 1335485 - DNA, 22 bp, Homo sapiens
gaccacgcccgtcctgcctgtg

SEQ ID NO: 1335486 - DNA, 17 bp, Homo sapiens
cttttctgccctggctg

SEQ ID NO: 1335487 - DNA, 19 bp, Homo sapiens
cttttctgccctggctgct

SEQ ID NO: 1335488 - DNA, 15 bp, Homo sapiens
cttttgcaaccagga

SEQ ID NO: 1335489 - DNA, 17 bp, Homo sapiens
cttttgcaaccaggaac

SEQ ID NO: 1335490 - DNA, 17 bp, Homo sapiens
cttttgtactgaatttt

SEQ ID NO: 1335491 - DNA, 23 bp, Homo sapiens
cttttgtactgaatttttttgta

SEQ ID NO: 1335492 - DNA, 16 bp, Homo sapiens
cttttgtgtaatgaaa

SEQ ID NO: 1335493 - DNA, 14 bp, Homo sapiens
cttttgtttggtaa

SEQ ID NO: 1335494 - DNA, 16 bp, Homo sapiens
cttttgtttggtaaat

SEQ ID NO: 1335495 - DNA, 17 bp, Homo sapiens
ctttttaaaacacatgt

SEQ ID NO: 1335496 - DNA, 23 bp, Homo sapiens
ctttttatgctatttctgtatat

SEQ ID NO: 1335497 - DNA, 19 bp, Homo sapiens
ctttttatttatatgtatg

SEQ ID NO: 1335498 - DNA, 14 bp, Homo sapiens
ctttttgacactga

SEQ ID NO: 1335499 - DNA, 15 bp, Homo sapiens
ctttttgacactgaa

SEQ ID NO: 1335500 - DNA, 15 bp, Homo sapiens
ctttttgtgtttttt

SEQ ID NO: 1335501 - DNA, 17 bp, Homo sapiens
cttttttattaatcact

SEQ ID NO: 1335502 - DNA, 13 bp, Homo sapiens
cttttttcaaaat

SEQ ID NO: 1335503 - DNA, 22 bp, Homo sapiens
cttttttcaaaatccaaaaaga

SEQ ID NO: 1335504 - DNA, 13 bp, Homo sapiens
ctttttttttaag

SEQ ID NO: 1335505 - DNA, 18 bp, Homo sapiens
ctttttttttaagttctt

SEQ ID NO: 1335506 - DNA, 15 bp, Homo sapiens
gaaaaacacaagcaa

SEQ ID NO: 1335507 - DNA, 16 bp, Homo sapiens
gaaaaagaaaaaatat

SEQ ID NO: 1335508 - DNA, 20 bp, Homo sapiens
gaaaaagactttaaaagtga

SEQ ID NO: 1335509 - DNA, 12 bp, Homo sapiens
gaaaaaggagga

SEQ ID NO: 1335510 - DNA, 20 bp, Homo sapiens
gaaaaatagtgtctttgtga

SEQ ID NO: 1335511 - DNA, 18 bp, Homo sapiens
ctggcaggtcaacctcgc

SEQ ID NO: 1335512 - DNA, 19 bp, Homo sapiens
ctggcatcgcaccattctg

SEQ ID NO: 1335513 - DNA, 23 bp, Homo sapiens
ctggcatcgcaccattctgactc

SEQ ID NO: 1335514 - DNA, 13 bp, Homo sapiens
ctggccaggagca

SEQ ID NO: 1335515 - DNA, 22 bp, Homo sapiens
ctggccagtccaccctgcctgc

SEQ ID NO: 1335516 - DNA, 19 bp, Homo sapiens
ctggccagtccaggctgcc

SEQ ID NO: 1335517 - DNA, 21 bp, Homo sapiens
ctggccagtccaggctgccgt

SEQ ID NO: 1335518 - DNA, 22 bp, Homo sapiens
ctggccagtccaggctgccgtg

SEQ ID NO: 1335519 - DNA, 23 bp, Homo sapiens
ctggccccagccctgctggggat

SEQ ID NO: 1335520 - DNA, 19 bp, Homo sapiens
ctggccctagactcggggt

SEQ ID NO: 1335521 - DNA, 22 bp, Homo sapiens
ctggcctatccgctgccagcct

SEQ ID NO: 1335522 - DNA, 13 bp, Homo sapiens
ctggcctctgtgc

SEQ ID NO: 1335523 - DNA, 23 bp, Homo sapiens
ctggcgagagtctggccctagac

SEQ ID NO: 1335524 - DNA, 24 bp, Homo sapiens
ctggcgcagaacgaaccttggcct

SEQ ID NO: 1335525 - DNA, 17 bp, Homo sapiens
ctggctccctcctccag

SEQ ID NO: 1335526 - DNA, 23 bp, Homo sapiens
ctggctccctcctccaggcctgc

SEQ ID NO: 1335527 - DNA, 24 bp, Homo sapiens
ctggctctgagcgcctccatccaa

SEQ ID NO: 1335528 - DNA, 12 bp, Homo sapiens
ctggctgctgcc

SEQ ID NO: 1335529 - DNA, 19 bp, Homo sapiens
ctggctgctgcccccaccc

SEQ ID NO: 1335530 - DNA, 12 bp, Homo sapiens
ctggctgtttga

SEQ ID NO: 1335531 - DNA, 18 bp, Homo sapiens
ctggcttacactggcaat

SEQ ID NO: 1335532 - DNA, 17 bp, Homo sapiens
ctgggacctgccaggca

SEQ ID NO: 1335533 - DNA, 18 bp, Homo sapiens
ctgggacctgccaggcag

SEQ ID NO: 1335534 - DNA, 14 bp, Homo sapiens
ctgggactcagcct

SEQ ID NO: 1335535 - DNA, 17 bp, Homo sapiens
ctgggaggagggagagg

SEQ ID NO: 1335536 - DNA, 19 bp, Homo sapiens
ctgggaggagggagaggga

SEQ ID NO: 1335537 - DNA, 17 bp, Homo sapiens
ctgggcagctgtccctt

SEQ ID NO: 1335538 - DNA, 19 bp, Homo sapiens
ctgggcagctgtcccttgc

SEQ ID NO: 1335539 - DNA, 20 bp, Homo sapiens
ctgggcaggttggtgggggc

SEQ ID NO: 1335540 - DNA, 12 bp, Homo sapiens
ctgggcattttc

SEQ ID NO: 1335541 - DNA, 17 bp, Homo sapiens
ctgggccatgtccaaag

SEQ ID NO: 1335542 - DNA, 19 bp, Homo sapiens
ctgggccatgtccaaagag

SEQ ID NO: 1335543 - DNA, 14 bp, Homo sapiens
ctgggccctgggct

SEQ ID NO: 1335544 - DNA, 16 bp, Homo sapiens
ctgggccctgggctgg

SEQ ID NO: 1335545 - DNA, 20 bp, Homo sapiens
ctgggccgggacccagggcc

SEQ ID NO: 1335546 - DNA, 24 bp, Homo sapiens
ctgggccgtatctccggctcccag

SEQ ID NO: 1335547 - DNA, 17 bp, Homo sapiens
ctgggcggctgtgcttc

SEQ ID NO: 1335548 - DNA, 15 bp, Homo sapiens
ctgggcttggcctgc

SEQ ID NO: 1335549 - DNA, 17 bp, Homo sapiens
ctgggcttggcctgctg

SEQ ID NO: 1335550 - DNA, 16 bp, Homo sapiens
ctggggaaagacactg

SEQ ID NO: 1335551 - DNA, 18 bp, Homo sapiens
ctggggaaagacactgcc

SEQ ID NO: 1335552 - DNA, 21 bp, Homo sapiens
ctggggacgctccgctgccgt

SEQ ID NO: 1335553 - DNA, 18 bp, Homo sapiens
ctggggcagacaataaac

SEQ ID NO: 1335554 - DNA, 18 bp, Homo sapiens
ctggggcaggctgggcca

SEQ ID NO: 1335555 - DNA, 18 bp, Homo sapiens
ctggggcatcctgtgcca

SEQ ID NO: 1335556 - DNA, 15 bp, Homo sapiens
ctggggctgctgtga

SEQ ID NO: 1335557 - DNA, 13 bp, Homo sapiens
ctgggggaagaag

SEQ ID NO: 1335558 - DNA, 15 bp, Homo sapiens
ctgggggaagaagct

SEQ ID NO: 1335559 - DNA, 20 bp, Homo sapiens
ctgggggacccaatgtagga

SEQ ID NO: 1335560 - DNA, 16 bp, Homo sapiens
ctggggggacccagtg

SEQ ID NO: 1335561 - DNA, 20 bp, Homo sapiens
ctggggggacccagtgcaga

SEQ ID NO: 1335562 - DNA, 21 bp, Homo sapiens
ctggggggacccagtgcagaa

SEQ ID NO: 1335563 - DNA, 20 bp, Homo sapiens
ctggggtgttagtggcaccg

SEQ ID NO: 1335564 - DNA, 19 bp, Homo sapiens
ctgggtaggaaagaggaag

SEQ ID NO: 1335565 - DNA, 22 bp, Homo sapiens
ctgggtggcaccagcagcctgg

SEQ ID NO: 1335566 - DNA, 13 bp, Homo sapiens
ctgggtgggctct

SEQ ID NO: 1335567 - DNA, 13 bp, Homo sapiens
ctgggttgggggc

SEQ ID NO: 1335568 - DNA, 23 bp, Homo sapiens
ctgggttgggggctagggagacg

SEQ ID NO: 1335569 - DNA, 19 bp, Homo sapiens
ctggtacaacggaggcctg

SEQ ID NO: 1335570 - DNA, 15 bp, Homo sapiens
ctggtaggaccaagc

SEQ ID NO: 1335571 - DNA, 16 bp, Homo sapiens
ctggtccgtgggacgg

SEQ ID NO: 1335572 - DNA, 13 bp, Homo sapiens
ctggtcgctcctg

SEQ ID NO: 1335573 - DNA, 15 bp, Homo sapiens
ctggtcgctcctgcc

SEQ ID NO: 1335574 - DNA, 16 bp, Homo sapiens
ctggtcgctcctgccc

SEQ ID NO: 1335575 - DNA, 18 bp, Homo sapiens
ctggtcgctcctgcccac

SEQ ID NO: 1335576 - DNA, 23 bp, Homo sapiens
ctggtcgctcctgcccacggagt

SEQ ID NO: 1335577 - DNA, 14 bp, Homo sapiens
ctggtgaatatttt

SEQ ID NO: 1335578 - DNA, 19 bp, Homo sapiens
ctggtgcacagccactccc

SEQ ID NO: 1335579 - DNA, 21 bp, Homo sapiens
ctggtggagaactctggcttt

SEQ ID NO: 1335580 - DNA, 22 bp, Homo sapiens
ctggtggccccgtttctggtgg

SEQ ID NO: 1335581 - DNA, 18 bp, Homo sapiens
ctggtggtctgttggcag

SEQ ID NO: 1335582 - DNA, 20 bp, Homo sapiens
ctggtggtctgttggcaggc

SEQ ID NO: 1335583 - DNA, 23 bp, Homo sapiens
ctggtggtctgttggcaggctgg

SEQ ID NO: 1335584 - DNA, 13 bp, Homo sapiens
ctggtgtttcttg

SEQ ID NO: 1335585 - DNA, 20 bp, Homo sapiens
ctggttattgatgtggccct

SEQ ID NO: 1335586 - DNA, 23 bp, Homo sapiens
ctggttccagggtccctctgtgt

SEQ ID NO: 1335587 - DNA, 15 bp, Homo sapiens
ctggttctcaatgaa

SEQ ID NO: 1335588 - DNA, 16 bp, Homo sapiens
ctggttctcaatgaaa

SEQ ID NO: 1335589 - DNA, 22 bp, Homo sapiens
ctggttgcatggaaatcagcca

SEQ ID NO: 1335590 - DNA, 20 bp, Homo sapiens
ctgtaacttccaaataaata

SEQ ID NO: 1335591 - DNA, 20 bp, Homo sapiens
ctgtaatcatttgtttacat

SEQ ID NO: 1335592 - DNA, 13 bp, Homo sapiens
ctgtaatcccagc

SEQ ID NO: 1335593 - DNA, 19 bp, Homo sapiens
ctgtactgttactgggccc

SEQ ID NO: 1335594 - DNA, 18 bp, Homo sapiens
ctgtagatatgtattctt

SEQ ID NO: 1335595 - DNA, 16 bp, Homo sapiens
ctgtagcacttactgg

SEQ ID NO: 1335596 - DNA, 21 bp, Homo sapiens
ctgtagggagggcggcagggg

SEQ ID NO: 1335597 - DNA, 21 bp, Homo sapiens
ctgtatacagtgcagagcctt

SEQ ID NO: 1335598 - DNA, 19 bp, Homo sapiens
ctgtatatttgtaaagcta

SEQ ID NO: 1335599 - DNA, 20 bp, Homo sapiens
ctgtatatttgtaaagctat

SEQ ID NO: 1335600 - DNA, 21 bp, Homo sapiens
ctgtatgaaaaattggggagg

SEQ ID NO: 1335601 - DNA, 18 bp, Homo sapiens
ctgtatttgaaataagaa

SEQ ID NO: 1335602 - DNA, 22 bp, Homo sapiens
ctgtatttgaaataagaattca

SEQ ID NO: 1335603 - DNA, 21 bp, Homo sapiens
ctgtatttttttttctaagag

SEQ ID NO: 1335604 - DNA, 22 bp, Homo sapiens
ctgtatttttttttctaagaga

SEQ ID NO: 1335605 - DNA, 16 bp, Homo sapiens
ctgtcaatgagagcat

SEQ ID NO: 1335606 - DNA, 14 bp, Homo sapiens
ctgtcactcattgc

SEQ ID NO: 1335607 - DNA, 22 bp, Homo sapiens
ctgtcactcattgctgagcctc

SEQ ID NO: 1335608 - DNA, 16 bp, Homo sapiens
ctgtcaggccttcagg

SEQ ID NO: 1335609 - DNA, 19 bp, Homo sapiens
ctgtcaggctgaaaacaat

SEQ ID NO: 1335610 - DNA, 19 bp, Homo sapiens
ctgtcccatagtccctgcc

SEQ ID NO: 1335611 - DNA, 23 bp, Homo sapiens
ctgtccccgcagccctggcaggg

SEQ ID NO: 1335612 - DNA, 18 bp, Homo sapiens
ctgtcccttgcttgcctg

SEQ ID NO: 1335613 - DNA, 14 bp, Homo sapiens
ctgtccgagctttg

SEQ ID NO: 1335614 - DNA, 22 bp, Homo sapiens
ctgtcctgctcattatgccact

SEQ ID NO: 1335615 - DNA, 16 bp, Homo sapiens
ctgtcctgtcctgctc

SEQ ID NO: 1335616 - DNA, 23 bp, Homo sapiens
ctgtcggcgctgccccatctccc

SEQ ID NO: 1335617 - DNA, 16 bp, Homo sapiens
ctgtctcaaaaaaaga

SEQ ID NO: 1335618 - DNA, 14 bp, Homo sapiens
ctgtctgtgaacag

SEQ ID NO: 1335619 - DNA, 23 bp, Homo sapiens
cttagggactacccatagacatg

SEQ ID NO: 1335620 - DNA, 21 bp, Homo sapiens
cttaggttggcaaaaaggcag

SEQ ID NO: 1335621 - DNA, 17 bp, Homo sapiens
cttagtttgtgtgttgt

SEQ ID NO: 1335622 - DNA, 15 bp, Homo sapiens
cttataaaacagagt

SEQ ID NO: 1335623 - DNA, 20 bp, Homo sapiens
cttataaaacagagtaatct

SEQ ID NO: 1335624 - DNA, 18 bp, Homo sapiens
cttataaaatcctgtgca

SEQ ID NO: 1335625 - DNA, 18 bp, Homo sapiens
cttataaagtggaagtat

SEQ ID NO: 1335626 - DNA, 21 bp, Homo sapiens
cttataattgttctcagaatc

SEQ ID NO: 1335627 - DNA, 21 bp, Homo sapiens
cttatagtctaagactatata

SEQ ID NO: 1335628 - DNA, 22 bp, Homo sapiens
cttatatctggcctctgctttc

SEQ ID NO: 1335629 - DNA, 19 bp, Homo sapiens
cttatgaatgatttgcata

SEQ ID NO: 1335630 - DNA, 14 bp, Homo sapiens
cttatgaggagggg

SEQ ID NO: 1335631 - DNA, 23 bp, Homo sapiens
cttatgtgacattaacaaataaa

SEQ ID NO: 1335632 - DNA, 20 bp, Homo sapiens
cttattatgtaggtaagact

SEQ ID NO: 1335633 - DNA, 14 bp, Homo sapiens
cttattgaccattt

SEQ ID NO: 1335634 - DNA, 13 bp, Homo sapiens
cttcaaagccttc

SEQ ID NO: 1335635 - DNA, 13 bp, Homo sapiens
ctgcccctctcac

SEQ ID NO: 1335636 - DNA, 17 bp, Homo sapiens
ctgcccctctcaccaaa

SEQ ID NO: 1335637 - DNA, 20 bp, Homo sapiens
ctgccctgcacgtcatggga

SEQ ID NO: 1335638 - DNA, 13 bp, Homo sapiens
ctgcccttgggcc

SEQ ID NO: 1335639 - DNA, 18 bp, Homo sapiens
ctgccgccccctcctgaa

SEQ ID NO: 1335640 - DNA, 20 bp, Homo sapiens
ctgccggtttgaaaatatgc

SEQ ID NO: 1335641 - DNA, 14 bp, Homo sapiens
ctgccgtctctgga

SEQ ID NO: 1335642 - DNA, 22 bp, Homo sapiens
ctgccgtgccgcctgcactcct

SEQ ID NO: 1335643 - DNA, 13 bp, Homo sapiens
ctgccgtggggcc

SEQ ID NO: 1335644 - DNA, 15 bp, Homo sapiens
ctgcctattgattta

SEQ ID NO: 1335645 - DNA, 14 bp, Homo sapiens
ctgcctctttccct

SEQ ID NO: 1335646 - DNA, 18 bp, Homo sapiens
ctgcctgaataaagagcc

SEQ ID NO: 1335647 - DNA, 14 bp, Homo sapiens
ctgcctgccccgcc

SEQ ID NO: 1335648 - DNA, 15 bp, Homo sapiens
ctgcctgccccgccc

SEQ ID NO: 1335649 - DNA, 19 bp, Homo sapiens
ctgcctgccccgcccccag

SEQ ID NO: 1335650 - DNA, 18 bp, Homo sapiens
ctgcctgccttaagtgag

SEQ ID NO: 1335651 - DNA, 20 bp, Homo sapiens
ctgcctgccttaagtgagga

SEQ ID NO: 1335652 - DNA, 22 bp, Homo sapiens
ctgcctgccttaagtgaggaaa

SEQ ID NO: 1335653 - DNA, 22 bp, Homo sapiens
ctgcctggagacttagggcacc

SEQ ID NO: 1335654 - DNA, 11 bp, Homo sapiens
ctgcctggccc

SEQ ID NO: 1335655 - DNA, 23 bp, Homo sapiens
ctgcctggcccccaacctcaggg

SEQ ID NO: 1335656 - DNA, 16 bp, Homo sapiens
ctgccttaaaaccaaa

SEQ ID NO: 1335657 - DNA, 17 bp, Homo sapiens
ctgccttaaaaccaaag

SEQ ID NO: 1335658 - DNA, 22 bp, Homo sapiens
ctgccttaaaaccaaagagggc

SEQ ID NO: 1335659 - DNA, 13 bp, Homo sapiens
ctgccttaagtga

SEQ ID NO: 1335660 - DNA, 12 bp, Homo sapiens
ctgccttcccta

SEQ ID NO: 1335661 - DNA, 15 bp, Homo sapiens
ctgccttccctagct

SEQ ID NO: 1335662 - DNA, 13 bp, Homo sapiens
ctgccttcgcttc

SEQ ID NO: 1335663 - DNA, 14 bp, Homo sapiens
ctgccttcgcttct

SEQ ID NO: 1335664 - DNA, 15 bp, Homo sapiens
ctgccttcgcttctt

SEQ ID NO: 1335665 - DNA, 17 bp, Homo sapiens
ctgccttcgcttcttgc

SEQ ID NO: 1335666 - DNA, 21 bp, Homo sapiens
ctgccttcgcttcttgcctct

SEQ ID NO: 1335667 - DNA, 14 bp, Homo sapiens
ctgccttggctcag

SEQ ID NO: 1335668 - DNA, 21 bp, Homo sapiens
ctgcgaagaccctcttgccca

SEQ ID NO: 1335669 - DNA, 14 bp, Homo sapiens
ctgcgaccctgggg

SEQ ID NO: 1335670 - DNA, 15 bp, Homo sapiens
ctgcgaccctggggg

SEQ ID NO: 1335671 - DNA, 22 bp, Homo sapiens
ctgcgaccctgggggcacagga

SEQ ID NO: 1335672 - DNA, 16 bp, Homo sapiens
ctgcgactttctgcct

SEQ ID NO: 1335673 - DNA, 17 bp, Homo sapiens
ctgcgactttctgcctg

SEQ ID NO: 1335674 - DNA, 18 bp, Homo sapiens
ctgcgactttctgcctgg

SEQ ID NO: 1335675 - DNA, 13 bp, Homo sapiens
ctgcgcctgctgc

SEQ ID NO: 1335676 - DNA, 20 bp, Homo sapiens
ctgcgcctgctgcatgccct

SEQ ID NO: 1335677 - DNA, 21 bp, Homo sapiens
ctgcgcctttccttttcgcct

SEQ ID NO: 1335678 - DNA, 17 bp, Homo sapiens
ctgcgctctctttgcaa

SEQ ID NO: 1335679 - DNA, 13 bp, Homo sapiens
ctgcgcttgcttt

SEQ ID NO: 1335680 - DNA, 17 bp, Homo sapiens
ctgcgcttgcttttctg

SEQ ID NO: 1335681 - DNA, 21 bp, Homo sapiens
ctgcgggtggggcttggggct

SEQ ID NO: 1335682 - DNA, 15 bp, Homo sapiens
ctgcgtcctcctcac

SEQ ID NO: 1335683 - DNA, 13 bp, Homo sapiens
ctgcgtctatcct

SEQ ID NO: 1335684 - DNA, 16 bp, Homo sapiens
ctgcgtctatcctgtg

SEQ ID NO: 1335685 - DNA, 12 bp, Homo sapiens
ctgctaaataaa

SEQ ID NO: 1335686 - DNA, 20 bp, Homo sapiens
ctgctagctagctcaactag

SEQ ID NO: 1335687 - DNA, 17 bp, Homo sapiens
ctgctatcaaagaggtt

SEQ ID NO: 1335688 - DNA, 17 bp, Homo sapiens
ctgctatttattttcct

SEQ ID NO: 1335689 - DNA, 20 bp, Homo sapiens
ctgctatttattttcctaaa

SEQ ID NO: 1335690 - DNA, 19 bp, Homo sapiens
ctgctccagctgttcagct

SEQ ID NO: 1335691 - DNA, 17 bp, Homo sapiens
ctgctctcatataagac

SEQ ID NO: 1335692 - DNA, 21 bp, Homo sapiens
ctgctcttcatcccattccag

SEQ ID NO: 1335693 - DNA, 18 bp, Homo sapiens
ctgctgactgttttctct

SEQ ID NO: 1335694 - DNA, 17 bp, Homo sapiens
ctgctgagtctgttctg

SEQ ID NO: 1335695 - DNA, 22 bp, Homo sapiens
ctgctgagtctgttctggtaat

SEQ ID NO: 1335696 - DNA, 16 bp, Homo sapiens
ctgctgcatgccctct

SEQ ID NO: 1335697 - DNA, 21 bp, Homo sapiens
ctgctgcatgccctctcaggc

SEQ ID NO: 1335698 - DNA, 14 bp, Homo sapiens
ctgctgcccccacc

SEQ ID NO: 1335699 - DNA, 15 bp, Homo sapiens
ctgctgcccccaccc

SEQ ID NO: 1335700 - DNA, 21 bp, Homo sapiens
ctgctgcccccaccccgggga

SEQ ID NO: 1335701 - DNA, 12 bp, Homo sapiens
ctgctgcctctt

SEQ ID NO: 1335702 - DNA, 22 bp, Homo sapiens
ctgctgcctctttccctaggaa

SEQ ID NO: 1335703 - DNA, 14 bp, Homo sapiens
ctgctgctgctgtg

SEQ ID NO: 1335704 - DNA, 16 bp, Homo sapiens
ctgctggcacccaccg

SEQ ID NO: 1335705 - DNA, 17 bp, Homo sapiens
ctgctggggatccccgc

SEQ ID NO: 1335706 - DNA, 22 bp, Homo sapiens
ctgctggggatccccgcctggc

SEQ ID NO: 1335707 - DNA, 20 bp, Homo sapiens
ctgctgggggcaactggcca

SEQ ID NO: 1335708 - DNA, 15 bp, Homo sapiens
ctgctggtgcacagc

SEQ ID NO: 1335709 - DNA, 16 bp, Homo sapiens
ctgctgtgattccact

SEQ ID NO: 1335710 - DNA, 22 bp, Homo sapiens
ctgctgtgattccactacacct

SEQ ID NO: 1335711 - DNA, 11 bp, Homo sapiens
ctgctgtgcaa

SEQ ID NO: 1335712 - DNA, 22 bp, Homo sapiens
ctgcttaatcttcaaagccttc

SEQ ID NO: 1335713 - DNA, 23 bp, Homo sapiens
ctgcttaatcttcaaagccttct

SEQ ID NO: 1335714 - DNA, 20 bp, Homo sapiens
ctgcttcccttactttgctg

SEQ ID NO: 1335715 - DNA, 15 bp, Homo sapiens
ctgcttctctgactt

SEQ ID NO: 1335716 - DNA, 19 bp, Homo sapiens
ctgcttctctgacttctgc

SEQ ID NO: 1335717 - DNA, 23 bp, Homo sapiens
ctgcttctctgacttctgcctgg

SEQ ID NO: 1335718 - DNA, 17 bp, Homo sapiens
ctgctttagacttgaaa

SEQ ID NO: 1335719 - DNA, 19 bp, Homo sapiens
ctgctttagacttgaaaag

SEQ ID NO: 1335720 - DNA, 13 bp, Homo sapiens
ctgctttgaataa

SEQ ID NO: 1335721 - DNA, 15 bp, Homo sapiens
ctgcttttctgccct

SEQ ID NO: 1335722 - DNA, 18 bp, Homo sapiens
ctgcttttctgccctggc

SEQ ID NO: 1335723 - DNA, 21 bp, Homo sapiens
ctgcttttctgccctggctgc

SEQ ID NO: 1335724 - DNA, 13 bp, Homo sapiens
ctggaaaggggag

SEQ ID NO: 1335725 - DNA, 16 bp, Homo sapiens
ctggaaaggggagagc

SEQ ID NO: 1335726 - DNA, 17 bp, Homo sapiens
ctggaaaggggagagcc

SEQ ID NO: 1335727 - DNA, 18 bp, Homo sapiens
ctggaaaggggagagcct

SEQ ID NO: 1335728 - DNA, 21 bp, Homo sapiens
ctggaaaggggagagcctgct

SEQ ID NO: 1335729 - DNA, 17 bp, Homo sapiens
ctggaacaaattatttt

SEQ ID NO: 1335730 - DNA, 13 bp, Homo sapiens
ctggaacaatatt

SEQ ID NO: 1335731 - DNA, 17 bp, Homo sapiens
ctggaagaacaggcctc

SEQ ID NO: 1335732 - DNA, 21 bp, Homo sapiens
ctggaagaacaggcctctcca

SEQ ID NO: 1335733 - DNA, 14 bp, Homo sapiens
ctggaagatcctgc

SEQ ID NO: 1335734 - DNA, 22 bp, Homo sapiens
ctggaagccaaaatgtaggctt

SEQ ID NO: 1335735 - DNA, 19 bp, Homo sapiens
ctggaatctggagaccagg

SEQ ID NO: 1335736 - DNA, 15 bp, Homo sapiens
ctggaattgtggcta

SEQ ID NO: 1335737 - DNA, 23 bp, Homo sapiens
ctggaattgtggctatcctgatt

SEQ ID NO: 1335738 - DNA, 17 bp, Homo sapiens
ctggacccttataaaat

SEQ ID NO: 1335739 - DNA, 15 bp, Homo sapiens
ctggacctgtatatt

SEQ ID NO: 1335740 - DNA, 16 bp, Homo sapiens
ctggacctgtatattt

SEQ ID NO: 1335741 - DNA, 13 bp, Homo sapiens
ctggacggcaggc

SEQ ID NO: 1335742 - DNA, 20 bp, Homo sapiens
ctggacggcaggctcactgc

SEQ ID NO: 1335743 - DNA, 19 bp, Homo sapiens
ctggacttctacctgccct

SEQ ID NO: 1335744 - DNA, 15 bp, Homo sapiens
ctggagacttagggc

SEQ ID NO: 1335745 - DNA, 14 bp, Homo sapiens
ctggagatcctcct

SEQ ID NO: 1335746 - DNA, 15 bp, Homo sapiens
ctggagatcctcctg

SEQ ID NO: 1335747 - DNA, 17 bp, Homo sapiens
ctggagatcctcctgca

SEQ ID NO: 1335748 - DNA, 18 bp, Homo sapiens
ctggagatcctcctgcag

SEQ ID NO: 1335749 - DNA, 16 bp, Homo sapiens
ctggagcactgggctc

SEQ ID NO: 1335750 - DNA, 17 bp, Homo sapiens
ctctttgattatttgca

SEQ ID NO: 1335751 - DNA, 16 bp, Homo sapiens
ctccccagcctgcgcc

SEQ ID NO: 1335752 - DNA, 21 bp, Homo sapiens
ctccccagcctgcgcctgctg

SEQ ID NO: 1335753 - DNA, 21 bp, Homo sapiens
ctccccatttcccatctgcac

SEQ ID NO: 1335754 - DNA, 22 bp, Homo sapiens
ctccccatttcccatctgcacc

SEQ ID NO: 1335755 - DNA, 14 bp, Homo sapiens
ctccccgcttctgc

SEQ ID NO: 1335756 - DNA, 21 bp, Homo sapiens
ctaattggtacttttaaaaac

SEQ ID NO: 1335757 - DNA, 15 bp, Homo sapiens
ctaatttctcctccc

SEQ ID NO: 1335758 - DNA, 13 bp, Homo sapiens
ctaatttttttgt

SEQ ID NO: 1335759 - DNA, 22 bp, Homo sapiens
ctacaaaacctaccctcagtga

SEQ ID NO: 1335760 - DNA, 21 bp, Homo sapiens
ctacaatctctttttgtttgc

SEQ ID NO: 1335761 - DNA, 15 bp, Homo sapiens
ctacacctggctgag

SEQ ID NO: 1335762 - DNA, 19 bp, Homo sapiens
ctacagctttgatccctga

SEQ ID NO: 1335763 - DNA, 22 bp, Homo sapiens
ctacagttgaaaaacagctgag

SEQ ID NO: 1335764 - DNA, 18 bp, Homo sapiens
ctacatatcccttccaga

SEQ ID NO: 1335765 - DNA, 20 bp, Homo sapiens
ctaccaaggtcttcttaata

SEQ ID NO: 1335766 - DNA, 18 bp, Homo sapiens
ctaccatcccctgtagag

SEQ ID NO: 1335767 - DNA, 18 bp, Homo sapiens
ctacccagcgtggcctcc

SEQ ID NO: 1335768 - DNA, 15 bp, Homo sapiens
ctaccccgcagacac

SEQ ID NO: 1335769 - DNA, 19 bp, Homo sapiens
ctactagcaaaataaaaca

SEQ ID NO: 1335770 - DNA, 22 bp, Homo sapiens
ctactcaagcgggtggctctgg

SEQ ID NO: 1335771 - DNA, 14 bp, Homo sapiens
ctactccctgcaga

SEQ ID NO: 1335772 - DNA, 23 bp, Homo sapiens
ctactctcacactggttctcaat

SEQ ID NO: 1335773 - DNA, 17 bp, Homo sapiens
ctactgcactccagcct

SEQ ID NO: 1335774 - DNA, 20 bp, Homo sapiens
ctactgcactccagcctggg

SEQ ID NO: 1335775 - DNA, 18 bp, Homo sapiens
ctactgtcaaatgatgtg

SEQ ID NO: 1335776 - DNA, 22 bp, Homo sapiens
ctactgttgtaagaattctgat

SEQ ID NO: 1335777 - DNA, 13 bp, Homo sapiens
ctacttgggaggc

SEQ ID NO: 1335778 - DNA, 20 bp, Homo sapiens
ctacttgggaggctgaggca

SEQ ID NO: 1335779 - DNA, 18 bp, Homo sapiens
ctacttttgcatgaaaat

SEQ ID NO: 1335780 - DNA, 16 bp, Homo sapiens
ctagaaattgacacaa

SEQ ID NO: 1335781 - DNA, 12 bp, Homo sapiens
ctagaaattttc

SEQ ID NO: 1335782 - DNA, 16 bp, Homo sapiens
ctagaacactaactca

SEQ ID NO: 1335783 - DNA, 22 bp, Homo sapiens
ctagaacactaactcaccagcc

SEQ ID NO: 1335784 - DNA, 13 bp, Homo sapiens
ctagactcggggt

SEQ ID NO: 1335785 - DNA, 16 bp, Homo sapiens
ctagactcggggtgct

SEQ ID NO: 1335786 - DNA, 20 bp, Homo sapiens
ctagaggccctttgctgtcc

SEQ ID NO: 1335787 - DNA, 14 bp, Homo sapiens
ctagatatcgactt

SEQ ID NO: 1335788 - DNA, 21 bp, Homo sapiens
ctagatatcgacttgtttttg

SEQ ID NO: 1335789 - DNA, 13 bp, Homo sapiens
ctagattttcact

SEQ ID NO: 1335790 - DNA, 17 bp, Homo sapiens
ctagcacaatttgcact

SEQ ID NO: 1335791 - DNA, 12 bp, Homo sapiens
ctagcagcaggg

SEQ ID NO: 1335792 - DNA, 22 bp, Homo sapiens
ctagcagcagggagggcttctg

SEQ ID NO: 1335793 - DNA, 23 bp, Homo sapiens
ctagcagcagggagggcttctgc

SEQ ID NO: 1335794 - DNA, 20 bp, Homo sapiens
ctagcagcccaccctgctgc

SEQ ID NO: 1335795 - DNA, 15 bp, Homo sapiens
ctagccggttcctgt

SEQ ID NO: 1335796 - DNA, 20 bp, Homo sapiens
ctagcctgatgagattttta

SEQ ID NO: 1335797 - DNA, 18 bp, Homo sapiens
ctagcgatctctcctggc

SEQ ID NO: 1335798 - DNA, 14 bp, Homo sapiens
ctagcttctgcttt

SEQ ID NO: 1335799 - DNA, 16 bp, Homo sapiens
ctagcttctgcttttc

SEQ ID NO: 1335800 - DNA, 21 bp, Homo sapiens
ctagcttctgcttttctgccc

SEQ ID NO: 1335801 - DNA, 22 bp, Homo sapiens
ctagcttctgcttttctgccct

SEQ ID NO: 1335802 - DNA, 15 bp, Homo sapiens
ctagctttagaccct

SEQ ID NO: 1335803 - DNA, 18 bp, Homo sapiens
ctagctttagaccctggg

SEQ ID NO: 1335804 - DNA, 19 bp, Homo sapiens
ctagctttagaccctgggt

SEQ ID NO: 1335805 - DNA, 18 bp, Homo sapiens
ctaggagaaccaaatctg

SEQ ID NO: 1335806 - DNA, 21 bp, Homo sapiens
ctaggcatttgctgaatacag

SEQ ID NO: 1335807 - DNA, 19 bp, Homo sapiens
ctagggaaaaaccagcgtg

SEQ ID NO: 1335808 - DNA, 21 bp, Homo sapiens
ctagggaaaaaccagcgtgtg

SEQ ID NO: 1335809 - DNA, 13 bp, Homo sapiens
ctagtaagaagac

SEQ ID NO: 1335810 - DNA, 21 bp, Homo sapiens
ctagtcaacagtaccctggtt

SEQ ID NO: 1335811 - DNA, 17 bp, Homo sapiens
ctagtggggtttcctgg

SEQ ID NO: 1335812 - DNA, 19 bp, Homo sapiens
ctagtggggtttcctggca

SEQ ID NO: 1335813 - DNA, 22 bp, Homo sapiens
ctagttctttgttcatagccca

SEQ ID NO: 1335814 - DNA, 20 bp, Homo sapiens
ctagttgaatacttgaacca

SEQ ID NO: 1335815 - DNA, 18 bp, Homo sapiens
ctagtttgtgagaaacat

SEQ ID NO: 1335816 - DNA, 18 bp, Homo sapiens
ctataaaaaataaaataa

SEQ ID NO: 1335817 - DNA, 15 bp, Homo sapiens
ctataaaactctgca

SEQ ID NO: 1335818 - DNA, 15 bp, Homo sapiens
ctataaaagaaacac

SEQ ID NO: 1335819 - DNA, 11 bp, Homo sapiens
ctataaaatag

SEQ ID NO: 1335820 - DNA, 14 bp, Homo sapiens
ctataaagcagtat

SEQ ID NO: 1335821 - DNA, 16 bp, Homo sapiens
ctataaagcagtattt

SEQ ID NO: 1335822 - DNA, 19 bp, Homo sapiens
ctataaagcagtatttttc

SEQ ID NO: 1335823 - DNA, 15 bp, Homo sapiens
ctatagcatcactta

SEQ ID NO: 1335824 - DNA, 21 bp, Homo sapiens
ctatagcttgcagaactgtag

SEQ ID NO: 1335825 - DNA, 14 bp, Homo sapiens
ctatataatttatt

SEQ ID NO: 1335826 - DNA, 16 bp, Homo sapiens
ctatatatataaatgt

SEQ ID NO: 1335827 - DNA, 12 bp, Homo sapiens
ctatatatttct

SEQ ID NO: 1335828 - DNA, 16 bp, Homo sapiens
ctatatatttctatta

SEQ ID NO: 1335829 - DNA, 17 bp, Homo sapiens
ctatatcctgtgactgt

SEQ ID NO: 1335830 - DNA, 15 bp, Homo sapiens
ctatattttgtcata

SEQ ID NO: 1335831 - DNA, 15 bp, Homo sapiens
ctatcaacaataaaa

SEQ ID NO: 1335832 - DNA, 17 bp, Homo sapiens
ctatccccatctccctg

SEQ ID NO: 1335833 - DNA, 19 bp, Homo sapiens
ctatccccatctccctgcc

SEQ ID NO: 1335834 - DNA, 22 bp, Homo sapiens
ctatccccatctccctgcctgg

SEQ ID NO: 1335835 - DNA, 13 bp, Homo sapiens
ctatcctctgtaa

SEQ ID NO: 1335836 - DNA, 14 bp, Homo sapiens
ctatctatttgagg

SEQ ID NO: 1335837 - DNA, 12 bp, Homo sapiens
ctatctcatcta

SEQ ID NO: 1335838 - DNA, 21 bp, Homo sapiens
ctatctcatctatctcaatcc

SEQ ID NO: 1335839 - DNA, 14 bp, Homo sapiens
ctatctcctgacag

SEQ ID NO: 1335840 - DNA, 18 bp, Homo sapiens
ctatctgtctggtggccc

SEQ ID NO: 1335841 - DNA, 12 bp, Homo sapiens
ctatctgtgcta

SEQ ID NO: 1335842 - DNA, 16 bp, Homo sapiens
ctatgacttaacatag

SEQ ID NO: 1335843 - DNA, 24 bp, Homo sapiens
ctatgtataaaatacatagtgaaa

SEQ ID NO: 1335844 - DNA, 12 bp, Homo sapiens
ctattaatatat

SEQ ID NO: 1335845 - DNA, 15 bp, Homo sapiens
ctattaatatatgta

SEQ ID NO: 1335846 - DNA, 21 bp, Homo sapiens
ctattaatatatgtattattt

SEQ ID NO: 1335847 - DNA, 18 bp, Homo sapiens
ctattacgaagttcaaga

SEQ ID NO: 1335848 - DNA, 17 bp, Homo sapiens
ctattagtgttatatga

SEQ ID NO: 1335849 - DNA, 15 bp, Homo sapiens
ctattatggaaaact

SEQ ID NO: 1335850 - DNA, 19 bp, Homo sapiens
ctattatttttataattgt

SEQ ID NO: 1335851 - DNA, 17 bp, Homo sapiens
ctattctgagaaaacaa

SEQ ID NO: 1335852 - DNA, 21 bp, Homo sapiens
ctattgcttcaccatggcctt

SEQ ID NO: 1335853 - DNA, 10 bp, Homo sapiens
ctatttaaga

SEQ ID NO: 1335854 - DNA, 14 bp, Homo sapiens
ctatttattaatat

SEQ ID NO: 1335855 - DNA, 15 bp, Homo sapiens
ctatttattaatatt

SEQ ID NO: 1335856 - DNA, 21 bp, Homo sapiens
ctatttattaatatttaacat

SEQ ID NO: 1335857 - DNA, 17 bp, Homo sapiens
ctatttattttcctaaa

SEQ ID NO: 1335858 - DNA, 18 bp, Homo sapiens
ctatttattttcctaaag

SEQ ID NO: 1335859 - DNA, 19 bp, Homo sapiens
ctatttattttcctaaaga

SEQ ID NO: 1335860 - DNA, 14 bp, Homo sapiens
ctatttcatcacaa

SEQ ID NO: 1335861 - DNA, 11 bp, Homo sapiens
ctattttaaga

SEQ ID NO: 1335862 - DNA, 19 bp, Homo sapiens
ccttagaggtcctctggag

SEQ ID NO: 1335863 - DNA, 13 bp, Homo sapiens
ccttaggccttcc

SEQ ID NO: 1335864 - DNA, 20 bp, Homo sapiens
ccttcaaaactatagcttgc

SEQ ID NO: 1335865 - DNA, 21 bp, Homo sapiens
ccttcctcttgtctgatttct

SEQ ID NO: 1335866 - DNA, 13 bp, Homo sapiens
ccttccttttccc

SEQ ID NO: 1335867 - DNA, 19 bp, Homo sapiens
ccttccttttccctgcttc

SEQ ID NO: 1335868 - DNA, 21 bp, Homo sapiens
ccttccttttccctgcttcca

SEQ ID NO: 1335869 - DNA, 16 bp, Homo sapiens
ccttcgcttcttgcct

SEQ ID NO: 1335870 - DNA, 17 bp, Homo sapiens
ccttctccctagctcct

SEQ ID NO: 1335871 - DNA, 18 bp, Homo sapiens
ccttgaagaacctctcac

SEQ ID NO: 1335872 - DNA, 22 bp, Homo sapiens
ccttgaagaactgcaggccctg

SEQ ID NO: 1335873 - DNA, 14 bp, Homo sapiens
ccttgagccctggc

SEQ ID NO: 1335874 - DNA, 17 bp, Homo sapiens
ccttgagccctggctgt

SEQ ID NO: 1335875 - DNA, 20 bp, Homo sapiens
ccttgagttgattcagctct

SEQ ID NO: 1335876 - DNA, 23 bp, Homo sapiens
ccttgagttgattcagctctgca

SEQ ID NO: 1335877 - DNA, 13 bp, Homo sapiens
ccttgatttcaaa

SEQ ID NO: 1335878 - DNA, 14 bp, Homo sapiens
ccttgcctccccat

SEQ ID NO: 1335879 - DNA, 22 bp, Homo sapiens
ccttgcctccccatttcccatc

SEQ ID NO: 1335880 - DNA, 17 bp, Homo sapiens
ccttgctggccccagcc

SEQ ID NO: 1335881 - DNA, 19 bp, Homo sapiens
ccttgctggccccagccct

SEQ ID NO: 1335882 - DNA, 22 bp, Homo sapiens
ccttgctggccccagccctgct

SEQ ID NO: 1335883 - DNA, 16 bp, Homo sapiens
ccttgcttgcctgcag

SEQ ID NO: 1335884 - DNA, 18 bp, Homo sapiens
ccttgcttgcctgcaggg

SEQ ID NO: 1335885 - DNA, 21 bp, Homo sapiens
ccttgcttgcctgcagggcca

SEQ ID NO: 1335886 - DNA, 17 bp, Homo sapiens
ccttggacatcctcctc

SEQ ID NO: 1335887 - DNA, 15 bp, Homo sapiens
ccttggctcagacat

SEQ ID NO: 1335888 - DNA, 12 bp, Homo sapiens
ccttgtgcctgg

SEQ ID NO: 1335889 - DNA, 15 bp, Homo sapiens
ccttgtgcctggggt

SEQ ID NO: 1335890 - DNA, 14 bp, Homo sapiens
cctttatgtgaatt

SEQ ID NO: 1335891 - DNA, 17 bp, Homo sapiens
cctttatgtgaattttt

SEQ ID NO: 1335892 - DNA, 12 bp, Homo sapiens
cctttcaaagct

SEQ ID NO: 1335893 - DNA, 18 bp, Homo sapiens
cctttcccccttctctta

SEQ ID NO: 1335894 - DNA, 11 bp, Homo sapiens
cctttgctgtc

SEQ ID NO: 1335895 - DNA, 21 bp, Homo sapiens
cctttggaaagctctgaccac

SEQ ID NO: 1335896 - DNA, 11 bp, Homo sapiens
cctttgggggt

SEQ ID NO: 1335897 - DNA, 12 bp, Homo sapiens
cctttgggggtt

SEQ ID NO: 1335898 - DNA, 16 bp, Homo sapiens
cctttggtttttttct

SEQ ID NO: 1335899 - DNA, 12 bp, Homo sapiens
ccttttactggt

SEQ ID NO: 1335900 - DNA, 13 bp, Homo sapiens
ccttttcagggct

SEQ ID NO: 1335901 - DNA, 15 bp, Homo sapiens
ccttttccctgcttc

SEQ ID NO: 1335902 - DNA, 22 bp, Homo sapiens
ccttttctggggaaagacactg

SEQ ID NO: 1335903 - DNA, 19 bp, Homo sapiens
cctttttcataaattattt

SEQ ID NO: 1335904 - DNA, 12 bp, Homo sapiens
ccttttttcaaa

SEQ ID NO: 1335905 - DNA, 15 bp, Homo sapiens
cgaaatatcaaagtc

SEQ ID NO: 1335906 - DNA, 17 bp, Homo sapiens
cgaaatatcaaagtcat

SEQ ID NO: 1335907 - DNA, 18 bp, Homo sapiens
cgaaccttggcctgggcc

SEQ ID NO: 1335908 - DNA, 19 bp, Homo sapiens
cgaaccttggcctgggccg

SEQ ID NO: 1335909 - DNA, 19 bp, Homo sapiens
cgaagtcattaaactggtt

SEQ ID NO: 1335910 - DNA, 10 bp, Homo sapiens
cgaataaatg

SEQ ID NO: 1335911 - DNA, 15 bp, Homo sapiens
cgaatagacatcaaa

SEQ ID NO: 1335912 - DNA, 12 bp, Homo sapiens
cgaatctctgtg

SEQ ID NO: 1335913 - DNA, 16 bp, Homo sapiens
cgaatttctgtgccct

SEQ ID NO: 1335914 - DNA, 23 bp, Homo sapiens
cgacatggctccggcctctgcct

SEQ ID NO: 1335915 - DNA, 16 bp, Homo sapiens
cgaccatgtggccaca

SEQ ID NO: 1335916 - DNA, 12 bp, Homo sapiens
cgaccctggggg

SEQ ID NO: 1335917 - DNA, 13 bp, Homo sapiens
cgacctggccgcg

SEQ ID NO: 1335918 - DNA, 14 bp, Homo sapiens
cgacgcccacccaa

SEQ ID NO: 1335919 - DNA, 11 bp, Homo sapiens
cgactccagcc

SEQ ID NO: 1335920 - DNA, 13 bp, Homo sapiens
cgactccagccag

SEQ ID NO: 1335921 - DNA, 14 bp, Homo sapiens
cgactccagccagc

SEQ ID NO: 1335922 - DNA, 16 bp, Homo sapiens
cgactccagccagcgc

SEQ ID NO: 1335923 - DNA, 17 bp, Homo sapiens
cgactccagccagcgcc

SEQ ID NO: 1335924 - DNA, 16 bp, Homo sapiens
cgactccgttggccac

SEQ ID NO: 1335925 - DNA, 19 bp, Homo sapiens
cgactccgttggccactcc

SEQ ID NO: 1335926 - DNA, 17 bp, Homo sapiens
cgactgaaaatattgtt

SEQ ID NO: 1335927 - DNA, 17 bp, Homo sapiens
cgactgcccggcagggt

SEQ ID NO: 1335928 - DNA, 21 bp, Homo sapiens
cgagaaagaggcaccaggaag

SEQ ID NO: 1335929 - DNA, 20 bp, Homo sapiens
cgagaaataaagtttgctta

SEQ ID NO: 1335930 - DNA, 14 bp, Homo sapiens
cgagaccagcctgg

SEQ ID NO: 1335931 - DNA, 17 bp, Homo sapiens
cgagaccatcctggcta

SEQ ID NO: 1335932 - DNA, 20 bp, Homo sapiens
cgagaccccggcttcctttc

SEQ ID NO: 1335933 - DNA, 13 bp, Homo sapiens
cgagagggagaga

SEQ ID NO: 1335934 - DNA, 16 bp, Homo sapiens
cgagagggagagagag

SEQ ID NO: 1335935 - DNA, 15 bp, Homo sapiens
cgagagtctggccct

SEQ ID NO: 1335936 - DNA, 15 bp, Homo sapiens
cgagcatgtcgtgga

SEQ ID NO: 1335937 - DNA, 14 bp, Homo sapiens
cgaggattttaatt

SEQ ID NO: 1335938 - DNA, 23 bp, Homo sapiens
cgaggcctaccccgcagacacct

SEQ ID NO: 1335939 - DNA, 13 bp, Homo sapiens
cgagggcagctgc

SEQ ID NO: 1335940 - DNA, 16 bp, Homo sapiens
cgagggcagctgctat

SEQ ID NO: 1335941 - DNA, 19 bp, Homo sapiens
cgaggggtgtcttgggcag

SEQ ID NO: 1335942 - DNA, 20 bp, Homo sapiens
cgagtgccgcatctcacagc

SEQ ID NO: 1335943 - DNA, 23 bp, Homo sapiens
cgatactgcgactttctgcctgg

SEQ ID NO: 1335944 - DNA, 15 bp, Homo sapiens
cgatctctcctggcc

SEQ ID NO: 1335945 - DNA, 20 bp, Homo sapiens
cgatcttggttcactgcaac

SEQ ID NO: 1335946 - DNA, 14 bp, Homo sapiens
cgcaccattctgac

SEQ ID NO: 1335947 - DNA, 23 bp, Homo sapiens
cgcacttcgggaggtcgaggcag

SEQ ID NO: 1335948 - DNA, 19 bp, Homo sapiens
cgcagagcgcgcccctagc

SEQ ID NO: 1335949 - DNA, 23 bp, Homo sapiens
cgcagccctggcagggggcatgc

SEQ ID NO: 1335950 - DNA, 13 bp, Homo sapiens
cgcaggtgggctg

SEQ ID NO: 1335951 - DNA, 12 bp, Homo sapiens
cgcatcatatgc

SEQ ID NO: 1335952 - DNA, 23 bp, Homo sapiens
cgccaaggctgggggaagaagct

SEQ ID NO: 1335953 - DNA, 14 bp, Homo sapiens
cgccactcatttca

SEQ ID NO: 1335954 - DNA, 21 bp, Homo sapiens
cgccactcatttcatctcatt

SEQ ID NO: 1335955 - DNA, 14 bp, Homo sapiens
cgccagcctcctct

SEQ ID NO: 1335956 - DNA, 18 bp, Homo sapiens
cgccagcctcctctggac

SEQ ID NO: 1335957 - DNA, 23 bp, Homo sapiens
cgccaggggaaaatcagcctgct

SEQ ID NO: 1335958 - DNA, 15 bp, Homo sapiens
cgccatgctcctggc

SEQ ID NO: 1335959 - DNA, 16 bp, Homo sapiens
cgccccatctgcccca

SEQ ID NO: 1335960 - DNA, 20 bp, Homo sapiens
cgccccctccgccctgccac

SEQ ID NO: 1335961 - DNA, 17 bp, Homo sapiens
cgcccggggtggccaca

SEQ ID NO: 1335962 - DNA, 12 bp, Homo sapiens
cgcccgtcctgc

SEQ ID NO: 1335963 - DNA, 15 bp, Homo sapiens
cgcccgtcctgcctg

SEQ ID NO: 1335964 - DNA, 11 bp, Homo sapiens
cgccctctcct

SEQ ID NO: 1335965 - DNA, 14 bp, Homo sapiens
cgcccttttcccct

SEQ ID NO: 1335966 - DNA, 19 bp, Homo sapiens
cgcctccccacctccaggc

SEQ ID NO: 1335967 - DNA, 15 bp, Homo sapiens
cgcctccctccaccc

SEQ ID NO: 1335968 - DNA, 15 bp, Homo sapiens
cgcctcttgaccagg

SEQ ID NO: 1335969 - DNA, 15 bp, Homo sapiens
cgcctgctgcatgcc

SEQ ID NO: 1335970 - DNA, 21 bp, Homo sapiens
cgcctggcagtccgtgggacg

SEQ ID NO: 1335971 - DNA, 13 bp, Homo sapiens
cgcctggccagga

SEQ ID NO: 1335972 - DNA, 14 bp, Homo sapiens
cgcctggccaggag

SEQ ID NO: 1335973 - DNA, 23 bp, Homo sapiens
cgcctttccttttcgcctttcct

SEQ ID NO: 1335974 - DNA, 21 bp, Homo sapiens
cgcgccacaggaccctcgccg

SEQ ID NO: 1335975 - DNA, 13 bp, Homo sapiens
cgcgcccctagcc

SEQ ID NO: 1335976 - DNA, 14 bp, Homo sapiens
cgcgcttgctggcc

SEQ ID NO: 1335977 - DNA, 15 bp, Homo sapiens
cgctctctttgcaac

SEQ ID NO: 1335978 - DNA, 17 bp, Homo sapiens
cgctgagactgtgctgt

SEQ ID NO: 1335979 - DNA, 14 bp, Homo sapiens
cgctgagtggcagg

SEQ ID NO: 1335980 - DNA, 14 bp, Homo sapiens
cgctgccagccttg

SEQ ID NO: 1335981 - DNA, 24 bp, Homo sapiens
cgctgccccatctcccctcagctc

SEQ ID NO: 1335982 - DNA, 14 bp, Homo sapiens
cgcttctgcctgca

SEQ ID NO: 1335983 - DNA, 15 bp, Homo sapiens
cgcttcttgcctctg

SEQ ID NO: 1335984 - DNA, 20 bp, Homo sapiens
ccatgtccaaagaggctgcc

SEQ ID NO: 1335985 - DNA, 23 bp, Homo sapiens
ccatgtccaaagaggctgcccct

SEQ ID NO: 1335986 - DNA, 19 bp, Homo sapiens
ccatgtgcatagtttcttt

SEQ ID NO: 1335987 - DNA, 24 bp, Homo sapiens
ccatgtggaaggcaagccaggctc

SEQ ID NO: 1335988 - DNA, 21 bp, Homo sapiens
ccatgtggataactttacaga

SEQ ID NO: 1335989 - DNA, 12 bp, Homo sapiens
ccatgtggccac

SEQ ID NO: 1335990 - DNA, 19 bp, Homo sapiens
ccatgttggccaggctggt

SEQ ID NO: 1335991 - DNA, 20 bp, Homo sapiens
ccattaaggggaagaatgaa

SEQ ID NO: 1335992 - DNA, 23 bp, Homo sapiens
ccattacagaggtattaaaacta

SEQ ID NO: 1335993 - DNA, 18 bp, Homo sapiens
ccattccacacagaatgc

SEQ ID NO: 1335994 - DNA, 17 bp, Homo sapiens
ccattgcttattatgta

SEQ ID NO: 1335995 - DNA, 18 bp, Homo sapiens
ccattgcttattatgtag

SEQ ID NO: 1335996 - DNA, 12 bp, Homo sapiens
ccatttatttat

SEQ ID NO: 1335997 - DNA, 13 bp, Homo sapiens
ccatttcccatct

SEQ ID NO: 1335998 - DNA, 20 bp, Homo sapiens
ccatttgcaataacagctgc

SEQ ID NO: 1335999 - DNA, 22 bp, Homo sapiens
ccatttgcaataacagctgcaa

SEQ ID NO: 1336000 - DNA, 14 bp, Homo sapiens
ccattttaatttta

SEQ ID NO: 1336001 - DNA, 18 bp, Homo sapiens
ccattttttaatttactt

SEQ ID NO: 1336002 - DNA, 14 bp, Homo sapiens
cccaaagctgagcc

SEQ ID NO: 1336003 - DNA, 16 bp, Homo sapiens
cccaaagctgagcctg

SEQ ID NO: 1336004 - DNA, 13 bp, Homo sapiens
cccaacctcaggg

SEQ ID NO: 1336005 - DNA, 22 bp, Homo sapiens
cccaagccttcgggcgtctgtg

SEQ ID NO: 1336006 - DNA, 21 bp, Homo sapiens
cccaatccctttattaccccc

SEQ ID NO: 1336007 - DNA, 16 bp, Homo sapiens
cccaatgtaggagctg

SEQ ID NO: 1336008 - DNA, 16 bp, Homo sapiens
cccacacccaaagctg

SEQ ID NO: 1336009 - DNA, 18 bp, Homo sapiens
cccacccccagccccgac

SEQ ID NO: 1336010 - DNA, 15 bp, Homo sapiens
cccaccccctgccct

SEQ ID NO: 1336011 - DNA, 17 bp, Homo sapiens
cccaccccctgccctgc

SEQ ID NO: 1336012 - DNA, 18 bp, Homo sapiens
cccaccccctgccctgca

SEQ ID NO: 1336013 - DNA, 19 bp, Homo sapiens
cccaccccctgccctgcac

SEQ ID NO: 1336014 - DNA, 14 bp, Homo sapiens
cccaccccggggac

SEQ ID NO: 1336015 - DNA, 18 bp, Homo sapiens
cccaccccggggaccctg

SEQ ID NO: 1336016 - DNA, 17 bp, Homo sapiens
cccaccctgctgctggt

SEQ ID NO: 1336017 - DNA, 13 bp, Homo sapiens
cccaccctgggcc

SEQ ID NO: 1336018 - DNA, 18 bp, Homo sapiens
cccaccggtccagctggc

SEQ ID NO: 1336019 - DNA, 21 bp, Homo sapiens
cccaccggtccagctggcctg

SEQ ID NO: 1336020 - DNA, 19 bp, Homo sapiens
cccaccgtggaggaggaag

SEQ ID NO: 1336021 - DNA, 20 bp, Homo sapiens
cccaccgtggaggaggaagg

SEQ ID NO: 1336022 - DNA, 21 bp, Homo sapiens
cccacctagaacactaactca

SEQ ID NO: 1336023 - DNA, 14 bp, Homo sapiens
cccacctccaggct

SEQ ID NO: 1336024 - DNA, 13 bp, Homo sapiens
cccacctgccggc

SEQ ID NO: 1336025 - DNA, 21 bp, Homo sapiens
cccacgactgcccggcagggt

SEQ ID NO: 1336026 - DNA, 16 bp, Homo sapiens
cccactgccagcagca

SEQ ID NO: 1336027 - DNA, 14 bp, Homo sapiens
cccacttctgccag

SEQ ID NO: 1336028 - DNA, 13 bp, Homo sapiens
cccacttgcctct

SEQ ID NO: 1336029 - DNA, 21 bp, Homo sapiens
cccacttgcctcttccttgaa

SEQ ID NO: 1336030 - DNA, 19 bp, Homo sapiens
cccagaataagttattgca

SEQ ID NO: 1336031 - DNA, 22 bp, Homo sapiens
cccagcacctcagcctgcacag

SEQ ID NO: 1336032 - DNA, 18 bp, Homo sapiens
cccagcattccagcccct

SEQ ID NO: 1336033 - DNA, 13 bp, Homo sapiens
cccagccatccag

SEQ ID NO: 1336034 - DNA, 19 bp, Homo sapiens
cccagccatgccagctggc

SEQ ID NO: 1336035 - DNA, 11 bp, Homo sapiens
cccagcccagg

SEQ ID NO: 1336036 - DNA, 16 bp, Homo sapiens
cccagccccgactcca

SEQ ID NO: 1336037 - DNA, 20 bp, Homo sapiens
cccagccccgactccagcca

SEQ ID NO: 1336038 - DNA, 22 bp, Homo sapiens
cccagccccgactccagccagc

SEQ ID NO: 1336039 - DNA, 23 bp, Homo sapiens
cccagccccgactccagccagcg

SEQ ID NO: 1336040 - DNA, 15 bp, Homo sapiens
cccagcctcagcgcg

SEQ ID NO: 1336041 - DNA, 20 bp, Homo sapiens
cccagcctcagcgcggccct

SEQ ID NO: 1336042 - DNA, 11 bp, Homo sapiens
cccagcctgcg

SEQ ID NO: 1336043 - DNA, 23 bp, Homo sapiens
cccagcctgcgcctgctgcatgc

SEQ ID NO: 1336044 - DNA, 11 bp, Homo sapiens
cccagcctgct

SEQ ID NO: 1336045 - DNA, 19 bp, Homo sapiens
cccaggaaaggcaggattg

SEQ ID NO: 1336046 - DNA, 13 bp, Homo sapiens
cccaggacgccac

SEQ ID NO: 1336047 - DNA, 19 bp, Homo sapiens
cccaggacgccactcattt

SEQ ID NO: 1336048 - DNA, 22 bp, Homo sapiens
cccaggacgccactcatttcat

SEQ ID NO: 1336049 - DNA, 19 bp, Homo sapiens
cccaggagcctgcccagcc

SEQ ID NO: 1336050 - DNA, 11 bp, Homo sapiens
cccaggcaggg

SEQ ID NO: 1336051 - DNA, 17 bp, Homo sapiens
cccaggctcgtggactg

SEQ ID NO: 1336052 - DNA, 15 bp, Homo sapiens
cccagggcaagctcc

SEQ ID NO: 1336053 - DNA, 20 bp, Homo sapiens
cccagggcaagctccgcagg

SEQ ID NO: 1336054 - DNA, 14 bp, Homo sapiens
cccagggctcctgc

SEQ ID NO: 1336055 - DNA, 18 bp, Homo sapiens
cccaggggacaagggatt

SEQ ID NO: 1336056 - DNA, 14 bp, Homo sapiens
cccaggggtctccc

SEQ ID NO: 1336057 - DNA, 20 bp, Homo sapiens
cccaggggtctccctggctc

SEQ ID NO: 1336058 - DNA, 17 bp, Homo sapiens
cccaggtccagctctgg

SEQ ID NO: 1336059 - DNA, 19 bp, Homo sapiens
cccagtccccacccctgcc

SEQ ID NO: 1336060 - DNA, 18 bp, Homo sapiens
cccagtgcatggtggcca

SEQ ID NO: 1336061 - DNA, 21 bp, Homo sapiens
cccagtgcatggtggccagag

SEQ ID NO: 1336062 - DNA, 15 bp, Homo sapiens
cccatcctgaccagc

SEQ ID NO: 1336063 - DNA, 12 bp, Homo sapiens
cccatctccctg

SEQ ID NO: 1336064 - DNA, 19 bp, Homo sapiens
cccatctgcaccccttctc

SEQ ID NO: 1336065 - DNA, 23 bp, Homo sapiens
cccatgacaatgttgtagtgtcc

SEQ ID NO: 1336066 - DNA, 22 bp, Homo sapiens
cccatgggttgtgtgtttattt

SEQ ID NO: 1336067 - DNA, 21 bp, Homo sapiens
cccatgtagccccctggcctc

SEQ ID NO: 1336068 - DNA, 23 bp, Homo sapiens
cccatgtagccccctggcctctg

SEQ ID NO: 1336069 - DNA, 12 bp, Homo sapiens
cccattccaggc

SEQ ID NO: 1336070 - DNA, 12 bp, Homo sapiens
cccattgctgtt

SEQ ID NO: 1336071 - DNA, 15 bp, Homo sapiens
cccattttcctctga

SEQ ID NO: 1336072 - DNA, 21 bp, Homo sapiens
ccccaaagatagacaggtcct

SEQ ID NO: 1336073 - DNA, 14 bp, Homo sapiens
ccccaacctcaggg

SEQ ID NO: 1336074 - DNA, 21 bp, Homo sapiens
ccccaacctttccctcacccc

SEQ ID NO: 1336075 - DNA, 22 bp, Homo sapiens
ccccacagtctccggcctctcc

SEQ ID NO: 1336076 - DNA, 13 bp, Homo sapiens
ccccacagttgct

SEQ ID NO: 1336077 - DNA, 17 bp, Homo sapiens
ccccaccccccaggcct

SEQ ID NO: 1336078 - DNA, 22 bp, Homo sapiens
ccccaccccggggaccctgtga

SEQ ID NO: 1336079 - DNA, 23 bp, Homo sapiens
ccccaccccggggaccctgtgac

SEQ ID NO: 1336080 - DNA, 17 bp, Homo sapiens
ccccacccctgccccca

SEQ ID NO: 1336081 - DNA, 12 bp, Homo sapiens
ccccaccctggg

SEQ ID NO: 1336082 - DNA, 14 bp, Homo sapiens
ccccaccctgggcc

SEQ ID NO: 1336083 - DNA, 18 bp, Homo sapiens
ccccaccggtccagctgg

SEQ ID NO: 1336084 - DNA, 19 bp, Homo sapiens
ccccaccggtccagctggc

SEQ ID NO: 1336085 - DNA, 22 bp, Homo sapiens
ccccaccggtccagctggcctg

SEQ ID NO: 1336086 - DNA, 19 bp, Homo sapiens
ccccactcccttgctggcc

SEQ ID NO: 1336087 - DNA, 21 bp, Homo sapiens
ccccacttgcctcttccttga

SEQ ID NO: 1336088 - DNA, 22 bp, Homo sapiens
ccccagccatgccagctggcct

SEQ ID NO: 1336089 - DNA, 15 bp, Homo sapiens
ccccagcccagggct

SEQ ID NO: 1336090 - DNA, 14 bp, Homo sapiens
ccccagccctgctg

SEQ ID NO: 1336091 - DNA, 12 bp, Homo sapiens
ccccaggacgcc

SEQ ID NO: 1336092 - DNA, 23 bp, Homo sapiens
ccccaggacgccactcatttcat

SEQ ID NO: 1336093 - DNA, 22 bp, Homo sapiens
ccccagggggtctcacccatgc

SEQ ID NO: 1336094 - DNA, 21 bp, Homo sapiens
ccccaggtccagctctggagg

SEQ ID NO: 1336095 - DNA, 19 bp, Homo sapiens
ccccagtccccacccctgc

SEQ ID NO: 1336096 - DNA, 19 bp, Homo sapiens
ccccatctcccctcagctc

SEQ ID NO: 1336097 - DNA, 18 bp, Homo sapiens
ccccatctccctgcctgg

SEQ ID NO: 1336098 - DNA, 19 bp, Homo sapiens
ccccatctccctgcctggc

SEQ ID NO: 1336099 - DNA, 12 bp, Homo sapiens
ccccatcttgct

SEQ ID NO: 1336100 - DNA, 24 bp, Homo sapiens
ccccatgcttccttgcctgatgac

SEQ ID NO: 1336101 - DNA, 20 bp, Homo sapiens
ccccatttcccatctgcacc

SEQ ID NO: 1336102 - DNA, 14 bp, Homo sapiens
cccccaacctcagg

SEQ ID NO: 1336103 - DNA, 21 bp, Homo sapiens
cccccaccggtccagctggcc

SEQ ID NO: 1336104 - DNA, 19 bp, Homo sapiens
ccagcagcctggaccctgt

SEQ ID NO: 1336105 - DNA, 14 bp, Homo sapiens
ccagcattccagcc

SEQ ID NO: 1336106 - DNA, 19 bp, Homo sapiens
ccagcattccagcccctct

SEQ ID NO: 1336107 - DNA, 20 bp, Homo sapiens
ccagcattccagcccctctg

SEQ ID NO: 1336108 - DNA, 17 bp, Homo sapiens
ccagcatttagctggcc

SEQ ID NO: 1336109 - DNA, 20 bp, Homo sapiens
ccagcatttagctggccaca

SEQ ID NO: 1336110 - DNA, 17 bp, Homo sapiens
ccagccagcgcctccct

SEQ ID NO: 1336111 - DNA, 22 bp, Homo sapiens
ccagccagcgcctccctccacc

SEQ ID NO: 1336112 - DNA, 19 bp, Homo sapiens
ccagcccagggctcctgca

SEQ ID NO: 1336113 - DNA, 21 bp, Homo sapiens
ccagcccagggctcctgcact

SEQ ID NO: 1336114 - DNA, 16 bp, Homo sapiens
ccagccccactgccag

SEQ ID NO: 1336115 - DNA, 19 bp, Homo sapiens
ccagccccactgccagcag

SEQ ID NO: 1336116 - DNA, 23 bp, Homo sapiens
ccagccccactgccagcagcagc

SEQ ID NO: 1336117 - DNA, 14 bp, Homo sapiens
ccagccccgactcc

SEQ ID NO: 1336118 - DNA, 16 bp, Homo sapiens
ccagccccgactccag

SEQ ID NO: 1336119 - DNA, 18 bp, Homo sapiens
ccagccccgactccagcc

SEQ ID NO: 1336120 - DNA, 17 bp, Homo sapiens
ccagcccctcttcccca

SEQ ID NO: 1336121 - DNA, 12 bp, Homo sapiens
ccagccctgctg

SEQ ID NO: 1336122 - DNA, 16 bp, Homo sapiens
ccagccctgctgggga

SEQ ID NO: 1336123 - DNA, 17 bp, Homo sapiens
ccagccctgctggggat

SEQ ID NO: 1336124 - DNA, 18 bp, Homo sapiens
ccagccgccatgctcctg

SEQ ID NO: 1336125 - DNA, 21 bp, Homo sapiens
ccagcctccgagagggagaga

SEQ ID NO: 1336126 - DNA, 11 bp, Homo sapiens
ccagcctcctc

SEQ ID NO: 1336127 - DNA, 13 bp, Homo sapiens
ccagcctcctctg

SEQ ID NO: 1336128 - DNA, 12 bp, Homo sapiens
ccagcctgctag

SEQ ID NO: 1336129 - DNA, 13 bp, Homo sapiens
ccagcctgctagc

SEQ ID NO: 1336130 - DNA, 15 bp, Homo sapiens
ccagcctgctagcta

SEQ ID NO: 1336131 - DNA, 13 bp, Homo sapiens
ccagcctgggtga

SEQ ID NO: 1336132 - DNA, 18 bp, Homo sapiens
ccagccttgagccctggc

SEQ ID NO: 1336133 - DNA, 21 bp, Homo sapiens
ccagcgatctctccactgtgc

SEQ ID NO: 1336134 - DNA, 13 bp, Homo sapiens
ccagcgcctccct

SEQ ID NO: 1336135 - DNA, 17 bp, Homo sapiens
ccagcgcctccctccac

SEQ ID NO: 1336136 - DNA, 19 bp, Homo sapiens
ccagcgcctccctccaccc

SEQ ID NO: 1336137 - DNA, 23 bp, Homo sapiens
ccagcgtcagctgctccctggca

SEQ ID NO: 1336138 - DNA, 17 bp, Homo sapiens
ccagctacttgggaggc

SEQ ID NO: 1336139 - DNA, 20 bp, Homo sapiens
ccagctacttgggaggctga

SEQ ID NO: 1336140 - DNA, 20 bp, Homo sapiens
ccagctctgccgtctctgga

SEQ ID NO: 1336141 - DNA, 17 bp, Homo sapiens
ccagctgacatcttgaa

SEQ ID NO: 1336142 - DNA, 21 bp, Homo sapiens
ccagctgacatcttgaatcct

SEQ ID NO: 1336143 - DNA, 19 bp, Homo sapiens
ccagctgggccgggaccca

SEQ ID NO: 1336144 - DNA, 17 bp, Homo sapiens
ccagctgttcagctggt

SEQ ID NO: 1336145 - DNA, 23 bp, Homo sapiens
ccaggaaactccacatctgcctt

SEQ ID NO: 1336146 - DNA, 22 bp, Homo sapiens
ccaggaagccgtcctggcgcct

SEQ ID NO: 1336147 - DNA, 20 bp, Homo sapiens
ccaggacatgcaataaaatt

SEQ ID NO: 1336148 - DNA, 23 bp, Homo sapiens
ccaggacatgcaataaaatttaa

SEQ ID NO: 1336149 - DNA, 14 bp, Homo sapiens
ccaggacgccactc

SEQ ID NO: 1336150 - DNA, 22 bp, Homo sapiens
ccaggacgccactcatttcatc

SEQ ID NO: 1336151 - DNA, 17 bp, Homo sapiens
ccaggagcctgcccagc

SEQ ID NO: 1336152 - DNA, 22 bp, Homo sapiens
ccaggaggcagggaggcagccg

SEQ ID NO: 1336153 - DNA, 22 bp, Homo sapiens
cattccagcccctctggtcgct

SEQ ID NO: 1336154 - DNA, 12 bp, Homo sapiens
cattccaggcag

SEQ ID NO: 1336155 - DNA, 19 bp, Homo sapiens
cattccaggcagcctctgt

SEQ ID NO: 1336156 - DNA, 18 bp, Homo sapiens
cattcctttttatttata

SEQ ID NO: 1336157 - DNA, 17 bp, Homo sapiens
cattcgtacataatact

SEQ ID NO: 1336158 - DNA, 17 bp, Homo sapiens
cattctaggctcactgc

SEQ ID NO: 1336159 - DNA, 21 bp, Homo sapiens
cattctcccaggtaccagctg

SEQ ID NO: 1336160 - DNA, 23 bp, Homo sapiens
cattctcccaggtaccagctgcg

SEQ ID NO: 1336161 - DNA, 14 bp, Homo sapiens
cattctcttttaat

SEQ ID NO: 1336162 - DNA, 12 bp, Homo sapiens
cattctgactcg

SEQ ID NO: 1336163 - DNA, 18 bp, Homo sapiens
cattctgccgccccctcc

SEQ ID NO: 1336164 - DNA, 18 bp, Homo sapiens
cattcttactaaaaagta

SEQ ID NO: 1336165 - DNA, 22 bp, Homo sapiens
cattgaagaatgttagagtaat

SEQ ID NO: 1336166 - DNA, 18 bp, Homo sapiens
cattgaagtaatgaattt

SEQ ID NO: 1336167 - DNA, 16 bp, Homo sapiens
cattgacttttataaa

SEQ ID NO: 1336168 - DNA, 18 bp, Homo sapiens
cattgacttttataaagc

SEQ ID NO: 1336169 - DNA, 15 bp, Homo sapiens
cattgagctgtgcaa

SEQ ID NO: 1336170 - DNA, 16 bp, Homo sapiens
cattgagtattgttta

SEQ ID NO: 1336171 - DNA, 18 bp, Homo sapiens
cattgagtattgtttaaa

SEQ ID NO: 1336172 - DNA, 21 bp, Homo sapiens
cattgcacataagcttccatt

SEQ ID NO: 1336173 - DNA, 19 bp, Homo sapiens
cattgctgttgtccaacta

SEQ ID NO: 1336174 - DNA, 19 bp, Homo sapiens
cattgttcttattctggca

SEQ ID NO: 1336175 - DNA, 20 bp, Homo sapiens
catttaagctgtggtcaagg

SEQ ID NO: 1336176 - DNA, 15 bp, Homo sapiens
catttaagggaaaaa

SEQ ID NO: 1336177 - DNA, 18 bp, Homo sapiens
catttaagggaaaaatat

SEQ ID NO: 1336178 - DNA, 20 bp, Homo sapiens
catttaagggaaagaaaatg

SEQ ID NO: 1336179 - DNA, 13 bp, Homo sapiens
catttaatagact

SEQ ID NO: 1336180 - DNA, 18 bp, Homo sapiens
catttactctaaaaactg

SEQ ID NO: 1336181 - DNA, 14 bp, Homo sapiens
catttagctggcca

SEQ ID NO: 1336182 - DNA, 20 bp, Homo sapiens
catttagggagtattctaat

SEQ ID NO: 1336183 - DNA, 21 bp, Homo sapiens
catttagggagtattctaata

SEQ ID NO: 1336184 - DNA, 14 bp, Homo sapiens
catttagtaagaat

SEQ ID NO: 1336185 - DNA, 23 bp, Homo sapiens
catttatttatccagaaaactgt

SEQ ID NO: 1336186 - DNA, 19 bp, Homo sapiens
catttattttttttaaaga

SEQ ID NO: 1336187 - DNA, 20 bp, Homo sapiens
catttattttttttaaagaa

SEQ ID NO: 1336188 - DNA, 21 bp, Homo sapiens
catttcagaagttagtttgta

SEQ ID NO: 1336189 - DNA, 16 bp, Homo sapiens
catttcatctcattta

SEQ ID NO: 1336190 - DNA, 14 bp, Homo sapiens
catttcccatctgc

SEQ ID NO: 1336191 - DNA, 20 bp, Homo sapiens
catttcccatctgcacccct

SEQ ID NO: 1336192 - DNA, 23 bp, Homo sapiens
catttcccctctgcacccagaac

SEQ ID NO: 1336193 - DNA, 23 bp, Homo sapiens
catttctaattaaccttactaat

SEQ ID NO: 1336194 - DNA, 14 bp, Homo sapiens
catttctataaata

SEQ ID NO: 1336195 - DNA, 18 bp, Homo sapiens
catttgcaataacagctg

SEQ ID NO: 1336196 - DNA, 18 bp, Homo sapiens
catttgctactgttgtaa

SEQ ID NO: 1336197 - DNA, 22 bp, Homo sapiens
catttgctactgttgtaagaat

SEQ ID NO: 1336198 - DNA, 20 bp, Homo sapiens
catttgtgctagaaattttc

SEQ ID NO: 1336199 - DNA, 21 bp, Homo sapiens
cattttgctaaatgtgaatga

SEQ ID NO: 1336200 - DNA, 24 bp, Homo sapiens
cattttgctaaatgtgaatgatga

SEQ ID NO: 1336201 - DNA, 10 bp, Homo sapiens
catttttcaa

SEQ ID NO: 1336202 - DNA, 17 bp, Homo sapiens
catttttcaatagcaca

SEQ ID NO: 1336203 - DNA, 23 bp, Homo sapiens
cattttttaatttacttgttttg

SEQ ID NO: 1336204 - DNA, 12 bp, Homo sapiens
ccaaagaggctg

SEQ ID NO: 1336205 - DNA, 17 bp, Homo sapiens
ccaaagaggctgcccct

SEQ ID NO: 1336206 - DNA, 22 bp, Homo sapiens
ccaaagaggctgcccctctcac

SEQ ID NO: 1336207 - DNA, 16 bp, Homo sapiens
ccaaagagggcttcct

SEQ ID NO: 1336208 - DNA, 17 bp, Homo sapiens
ccaaagagggcttcctc

SEQ ID NO: 1336209 - DNA, 19 bp, Homo sapiens
ccaaagagggcttcctcta

SEQ ID NO: 1336210 - DNA, 18 bp, Homo sapiens
ccaaatggagaagctgca

SEQ ID NO: 1336211 - DNA, 12 bp, Homo sapiens
ccaacacttcca

SEQ ID NO: 1336212 - DNA, 16 bp, Homo sapiens
ccaacatctccctccc

SEQ ID NO: 1336213 - DNA, 21 bp, Homo sapiens
ccaaccctgccgtcaccacca

SEQ ID NO: 1336214 - DNA, 22 bp, Homo sapiens
ccaaccctgccgtcaccaccac

SEQ ID NO: 1336215 - DNA, 16 bp, Homo sapiens
ccaaccgtgtctgtct

SEQ ID NO: 1336216 - DNA, 15 bp, Homo sapiens
ccaacctttccctca

SEQ ID NO: 1336217 - DNA, 11 bp, Homo sapiens
ccaactattta

SEQ ID NO: 1336218 - DNA, 13 bp, Homo sapiens
ccaactccagcaa

SEQ ID NO: 1336219 - DNA, 14 bp, Homo sapiens
ccaactccagcaac

SEQ ID NO: 1336220 - DNA, 21 bp, Homo sapiens
ccaactccagcaacttcttct

SEQ ID NO: 1336221 - DNA, 14 bp, Homo sapiens
ccaagaagcagtgg

SEQ ID NO: 1336222 - DNA, 15 bp, Homo sapiens
ccaagaatattgcaa

SEQ ID NO: 1336223 - DNA, 12 bp, Homo sapiens
ccaagaatgcaa

SEQ ID NO: 1336224 - DNA, 21 bp, Homo sapiens
ccaagaatgtacgtccagcct

SEQ ID NO: 1336225 - DNA, 13 bp, Homo sapiens
ccaagagaactcg

SEQ ID NO: 1336226 - DNA, 23 bp, Homo sapiens
ccaagagaactcgcgctcagtaa

SEQ ID NO: 1336227 - DNA, 19 bp, Homo sapiens
ccaagattttcctcttgtg

SEQ ID NO: 1336228 - DNA, 20 bp, Homo sapiens
ccaagattttcctcttgtga

SEQ ID NO: 1336229 - DNA, 23 bp, Homo sapiens
ccaagccaagggaacctgtgtcc

SEQ ID NO: 1336230 - DNA, 13 bp, Homo sapiens
ccaagcctccaca

SEQ ID NO: 1336231 - DNA, 17 bp, Homo sapiens
ccaagctattcaattct

SEQ ID NO: 1336232 - DNA, 11 bp, Homo sapiens
ccaaggatccc

SEQ ID NO: 1336233 - DNA, 18 bp, Homo sapiens
ccaagggaacctgtgtcc

SEQ ID NO: 1336234 - DNA, 16 bp, Homo sapiens
ccaaggtcttcttaat

SEQ ID NO: 1336235 - DNA, 21 bp, Homo sapiens
ccaagtatagcctatggcaga

SEQ ID NO: 1336236 - DNA, 16 bp, Homo sapiens
ccaagtggggtgctgg

SEQ ID NO: 1336237 - DNA, 17 bp, Homo sapiens
ccaatatttaccagacc

SEQ ID NO: 1336238 - DNA, 16 bp, Homo sapiens
ccaatcttactttgta

SEQ ID NO: 1336239 - DNA, 17 bp, Homo sapiens
ccaatcttactttgtaa

SEQ ID NO: 1336240 - DNA, 17 bp, Homo sapiens
ccaatgtaggagctgcc

SEQ ID NO: 1336241 - DNA, 20 bp, Homo sapiens
ccaatgtaggagctgccttg

SEQ ID NO: 1336242 - DNA, 22 bp, Homo sapiens
ccacaataaccaagatattttt

SEQ ID NO: 1336243 - DNA, 13 bp, Homo sapiens
ccacactctccat

SEQ ID NO: 1336244 - DNA, 16 bp, Homo sapiens
ccacactctccatcac

SEQ ID NO: 1336245 - DNA, 16 bp, Homo sapiens
ccacacttgaaacctt

SEQ ID NO: 1336246 - DNA, 23 bp, Homo sapiens
ccacagacaaaagcgcttttcct

SEQ ID NO: 1336247 - DNA, 22 bp, Homo sapiens
ccacagccagcacctggcatcg

SEQ ID NO: 1336248 - DNA, 18 bp, Homo sapiens
ccacagcgagggcagctg

SEQ ID NO: 1336249 - DNA, 19 bp, Homo sapiens
ccacagcgagggcagctgc

SEQ ID NO: 1336250 - DNA, 18 bp, Homo sapiens
ccacatccaactccagca

SEQ ID NO: 1336251 - DNA, 23 bp, Homo sapiens
ccacatctgccttaaaaccaaag

SEQ ID NO: 1336252 - DNA, 16 bp, Homo sapiens
ccaccaaagctgccca

SEQ ID NO: 1336253 - DNA, 19 bp, Homo sapiens
ccaccaaagctgcccactg

SEQ ID NO: 1336254 - DNA, 15 bp, Homo sapiens
ccaccacagccagca

SEQ ID NO: 1336255 - DNA, 16 bp, Homo sapiens
ccaccagctctgccgt

SEQ ID NO: 1336256 - DNA, 21 bp, Homo sapiens
ccacccaaccccaagccagcc

SEQ ID NO: 1336257 - DNA, 16 bp, Homo sapiens
ccacccaaccctatct

SEQ ID NO: 1336258 - DNA, 15 bp, Homo sapiens
ccaccccaagagaac

SEQ ID NO: 1336259 - DNA, 13 bp, Homo sapiens
ccacccccagccc

SEQ ID NO: 1336260 - DNA, 14 bp, Homo sapiens
ccacccccagcccc

SEQ ID NO: 1336261 - DNA, 15 bp, Homo sapiens
ccacccccagccccg

SEQ ID NO: 1336262 - DNA, 20 bp, Homo sapiens
ccaccccggggaccctgtga

SEQ ID NO: 1336263 - DNA, 13 bp, Homo sapiens
ccaccctgcccct

SEQ ID NO: 1336264 - DNA, 14 bp, Homo sapiens
ccaccctgctgctg

SEQ ID NO: 1336265 - DNA, 18 bp, Homo sapiens
ccaccctgctgctggtgc

SEQ ID NO: 1336266 - DNA, 15 bp, Homo sapiens
ccaccctgggccctg

SEQ ID NO: 1336267 - DNA, 20 bp, Homo sapiens
ccaccctgggccctgggctg

SEQ ID NO: 1336268 - DNA, 14 bp, Homo sapiens
catcaatcctgatt

SEQ ID NO: 1336269 - DNA, 16 bp, Homo sapiens
catcaatcctgattcc

SEQ ID NO: 1336270 - DNA, 14 bp, Homo sapiens
catcacaagaacac

SEQ ID NO: 1336271 - DNA, 19 bp, Homo sapiens
catcacagggtgggcctcg

SEQ ID NO: 1336272 - DNA, 22 bp, Homo sapiens
catcacagggtgggcctcggcc

SEQ ID NO: 1336273 - DNA, 15 bp, Homo sapiens
catcattccttttta

SEQ ID NO: 1336274 - DNA, 19 bp, Homo sapiens
catcattcctttttattta

SEQ ID NO: 1336275 - DNA, 22 bp, Homo sapiens
catcattcctttttatttatat

SEQ ID NO: 1336276 - DNA, 14 bp, Homo sapiens
catccaactccagc

SEQ ID NO: 1336277 - DNA, 21 bp, Homo sapiens
catccaaggccaggttctccg

SEQ ID NO: 1336278 - DNA, 16 bp, Homo sapiens
catccgcgtgtgcctg

SEQ ID NO: 1336279 - DNA, 17 bp, Homo sapiens
catccgcgtgtgcctgt

SEQ ID NO: 1336280 - DNA, 20 bp, Homo sapiens
catccgcgtgtgcctgtgtg

SEQ ID NO: 1336281 - DNA, 16 bp, Homo sapiens
catcgcaccattctga

SEQ ID NO: 1336282 - DNA, 12 bp, Homo sapiens
catctagccagc

SEQ ID NO: 1336283 - DNA, 17 bp, Homo sapiens
catctagccagcccctc

SEQ ID NO: 1336284 - DNA, 21 bp, Homo sapiens
catctagccagcccctcttcc

SEQ ID NO: 1336285 - DNA, 17 bp, Homo sapiens
catctatctagttctaa

SEQ ID NO: 1336286 - DNA, 13 bp, Homo sapiens
catctatctgtgc

SEQ ID NO: 1336287 - DNA, 22 bp, Homo sapiens
catctcatttaagggaaaaata

SEQ ID NO: 1336288 - DNA, 13 bp, Homo sapiens
catctcccctcag

SEQ ID NO: 1336289 - DNA, 16 bp, Homo sapiens
catctcccctcagctc

SEQ ID NO: 1336290 - DNA, 15 bp, Homo sapiens
catctccctgcctgg

SEQ ID NO: 1336291 - DNA, 22 bp, Homo sapiens
catctgcaaaaggcctcttgta

SEQ ID NO: 1336292 - DNA, 17 bp, Homo sapiens
catctgcaccccttctc

SEQ ID NO: 1336293 - DNA, 19 bp, Homo sapiens
catctgcaccccttctctc

SEQ ID NO: 1336294 - DNA, 22 bp, Homo sapiens
catctgcaccccttctctcctc

SEQ ID NO: 1336295 - DNA, 14 bp, Homo sapiens
catctgctggtccg

SEQ ID NO: 1336296 - DNA, 21 bp, Homo sapiens
catctggaagatcattttgaa

SEQ ID NO: 1336297 - DNA, 15 bp, Homo sapiens
catctggagttctca

SEQ ID NO: 1336298 - DNA, 22 bp, Homo sapiens
catcttaggttggcaaaaaggc

SEQ ID NO: 1336299 - DNA, 18 bp, Homo sapiens
catcttgaatccttccat

SEQ ID NO: 1336300 - DNA, 18 bp, Homo sapiens
catcttgcctccaggtgc

SEQ ID NO: 1336301 - DNA, 19 bp, Homo sapiens
catcttgcctccaggtgca

SEQ ID NO: 1336302 - DNA, 15 bp, Homo sapiens
catcttgcttcccta

SEQ ID NO: 1336303 - DNA, 11 bp, Homo sapiens
catcttggggg

SEQ ID NO: 1336304 - DNA, 16 bp, Homo sapiens
catctttgatgtgttg

SEQ ID NO: 1336305 - DNA, 18 bp, Homo sapiens
catcttttttgttaactg

SEQ ID NO: 1336306 - DNA, 24 bp, Homo sapiens
catgaaaataccatttagtaagaa

SEQ ID NO: 1336307 - DNA, 22 bp, Homo sapiens
catgaaacttgtttcactgaaa

SEQ ID NO: 1336308 - DNA, 21 bp, Homo sapiens
catgaaataaaatatatctta

SEQ ID NO: 1336309 - DNA, 13 bp, Homo sapiens
catgaaatgtgaa

SEQ ID NO: 1336310 - DNA, 14 bp, Homo sapiens
catgaaatgtgaat

SEQ ID NO: 1336311 - DNA, 23 bp, Homo sapiens
catgaaatgtgaatttttattgt

SEQ ID NO: 1336312 - DNA, 18 bp, Homo sapiens
catgaagaatagaaacaa

SEQ ID NO: 1336313 - DNA, 22 bp, Homo sapiens
catgaagggaccctttgggggt

SEQ ID NO: 1336314 - DNA, 16 bp, Homo sapiens
catgaatcaaaagtgc

SEQ ID NO: 1336315 - DNA, 18 bp, Homo sapiens
catgaatcaaaagtgcct

SEQ ID NO: 1336316 - DNA, 17 bp, Homo sapiens
catgagactcagtgcag

SEQ ID NO: 1336317 - DNA, 19 bp, Homo sapiens
catgagactcagtgcagat

SEQ ID NO: 1336318 - DNA, 17 bp, Homo sapiens
catgagatgtgtggact

SEQ ID NO: 1336319 - DNA, 18 bp, Homo sapiens
catgaggaactgtagatg

SEQ ID NO: 1336320 - DNA, 20 bp, Homo sapiens
catgaggagggtgggggagg

SEQ ID NO: 1336321 - DNA, 22 bp, Homo sapiens
catgattaaccacttcagctga

SEQ ID NO: 1336322 - DNA, 20 bp, Homo sapiens
catgcaaatgagctctgaaa

SEQ ID NO: 1336323 - DNA, 15 bp, Homo sapiens
catgcaagcagagga

SEQ ID NO: 1336324 - DNA, 17 bp, Homo sapiens
cagagctttggtctgtg

SEQ ID NO: 1336325 - DNA, 21 bp, Homo sapiens
cagaggaatcctggcagccca

SEQ ID NO: 1336326 - DNA, 15 bp, Homo sapiens
cagaggaccagggcc

SEQ ID NO: 1336327 - DNA, 14 bp, Homo sapiens
cagaggagcctttt

SEQ ID NO: 1336328 - DNA, 17 bp, Homo sapiens
cagaggcccccagccca

SEQ ID NO: 1336329 - DNA, 19 bp, Homo sapiens
cagaggcccccagcccagg

SEQ ID NO: 1336330 - DNA, 21 bp, Homo sapiens
cagaggccgcgcgtccagctg

SEQ ID NO: 1336331 - DNA, 13 bp, Homo sapiens
cagaggctgggtt

SEQ ID NO: 1336332 - DNA, 14 bp, Homo sapiens
cagaggtaccctgg

SEQ ID NO: 1336333 - DNA, 16 bp, Homo sapiens
cagaggtaccctgggt

SEQ ID NO: 1336334 - DNA, 22 bp, Homo sapiens
cagaggtattaaaactaaattt

SEQ ID NO: 1336335 - DNA, 19 bp, Homo sapiens
cagagtcaaggcctgctcc

SEQ ID NO: 1336336 - DNA, 16 bp, Homo sapiens
cagagtcagccaggac

SEQ ID NO: 1336337 - DNA, 18 bp, Homo sapiens
cagagtcagccaggacca

SEQ ID NO: 1336338 - DNA, 12 bp, Homo sapiens
cagagtggtggg

SEQ ID NO: 1336339 - DNA, 14 bp, Homo sapiens
cagagttttcatta

SEQ ID NO: 1336340 - DNA, 23 bp, Homo sapiens
cagagttttcattaaatcctttt

SEQ ID NO: 1336341 - DNA, 18 bp, Homo sapiens
cagatacctccaaccctg

SEQ ID NO: 1336342 - DNA, 23 bp, Homo sapiens
cagataccttatcttacaatatt

SEQ ID NO: 1336343 - DNA, 19 bp, Homo sapiens
cagatacttggggggctga

SEQ ID NO: 1336344 - DNA, 20 bp, Homo sapiens
cagatatactggaacccttt

SEQ ID NO: 1336345 - DNA, 15 bp, Homo sapiens
cagatcactgccaca

SEQ ID NO: 1336346 - DNA, 16 bp, Homo sapiens
cagatcactgccacac

SEQ ID NO: 1336347 - DNA, 15 bp, Homo sapiens
cagatctttcagaaa

SEQ ID NO: 1336348 - DNA, 19 bp, Homo sapiens
cagatgaatgtatttattt

SEQ ID NO: 1336349 - DNA, 12 bp, Homo sapiens
cagatgagctgt

SEQ ID NO: 1336350 - DNA, 16 bp, Homo sapiens
cagatgccaccctagc

SEQ ID NO: 1336351 - DNA, 18 bp, Homo sapiens
cagatgccaccctagcca

SEQ ID NO: 1336352 - DNA, 21 bp, Homo sapiens
cagatgcgtcccaagatgttg

SEQ ID NO: 1336353 - DNA, 15 bp, Homo sapiens
cagatggtcatccag

SEQ ID NO: 1336354 - DNA, 23 bp, Homo sapiens
cagatgtggctactgacatatct

SEQ ID NO: 1336355 - DNA, 15 bp, Homo sapiens
cagatgtttaaaaca

SEQ ID NO: 1336356 - DNA, 23 bp, Homo sapiens
cagcaaaggaaactttgcagatg

SEQ ID NO: 1336357 - DNA, 19 bp, Homo sapiens
cagcaacacagcctgggcc

SEQ ID NO: 1336358 - DNA, 16 bp, Homo sapiens
cagcaacgatcacaaa

SEQ ID NO: 1336359 - DNA, 18 bp, Homo sapiens
cagcaacgatcacaaatg

SEQ ID NO: 1336360 - DNA, 21 bp, Homo sapiens
cagcaacgatcacaaatgact

SEQ ID NO: 1336361 - DNA, 15 bp, Homo sapiens
cagcaagtgtgaata

SEQ ID NO: 1336362 - DNA, 15 bp, Homo sapiens
cagcacagcttgacc

SEQ ID NO: 1336363 - DNA, 16 bp, Homo sapiens
cagcacagcttgacct

SEQ ID NO: 1336364 - DNA, 17 bp, Homo sapiens
cagcacagcttgacctg

SEQ ID NO: 1336365 - DNA, 20 bp, Homo sapiens
cagcacagcttgacctgagg

SEQ ID NO: 1336366 - DNA, 21 bp, Homo sapiens
cagcacagcttgacctgaggc

SEQ ID NO: 1336367 - DNA, 15 bp, Homo sapiens
cagcaccttgtgcct

SEQ ID NO: 1336368 - DNA, 18 bp, Homo sapiens
cagcaccttgtgcctggg

SEQ ID NO: 1336369 - DNA, 15 bp, Homo sapiens
cagcagcaaattttc

SEQ ID NO: 1336370 - DNA, 14 bp, Homo sapiens
cagcagcagcaggt

SEQ ID NO: 1336371 - DNA, 12 bp, Homo sapiens
cagcagcaggtg

SEQ ID NO: 1336372 - DNA, 12 bp, Homo sapiens
cagcagcctgga

SEQ ID NO: 1336373 - DNA, 18 bp, Homo sapiens
cagcagcctggaccctgt

SEQ ID NO: 1336374 - DNA, 15 bp, Homo sapiens
cagcagcttataatg

SEQ ID NO: 1336375 - DNA, 18 bp, Homo sapiens
cagcagggagggcttctg

SEQ ID NO: 1336376 - DNA, 18 bp, Homo sapiens
cagcaggtgattggacca

SEQ ID NO: 1336377 - DNA, 21 bp, Homo sapiens
cagcagttgctggtaaaatga

SEQ ID NO: 1336378 - DNA, 23 bp, Homo sapiens
cagcagttgctggtaaaatgaag

SEQ ID NO: 1336379 - DNA, 19 bp, Homo sapiens
cagcatcacctgcctgtta

SEQ ID NO: 1336380 - DNA, 18 bp, Homo sapiens
cagcatttagctggccac

SEQ ID NO: 1336381 - DNA, 22 bp, Homo sapiens
cagccaagattttcctcttgtg

SEQ ID NO: 1336382 - DNA, 14 bp, Homo sapiens
cagccaagttttat

SEQ ID NO: 1336383 - DNA, 19 bp, Homo sapiens
cagccagaggcatctgagg

SEQ ID NO: 1336384 - DNA, 20 bp, Homo sapiens
cagccagcgcctccctccac

SEQ ID NO: 1336385 - DNA, 21 bp, Homo sapiens
cagccagcgcctccctccacc

SEQ ID NO: 1336386 - DNA, 16 bp, Homo sapiens
cagccatgccagctgg

SEQ ID NO: 1336387 - DNA, 17 bp, Homo sapiens
cagccatgccagctggc

SEQ ID NO: 1336388 - DNA, 18 bp, Homo sapiens
cagccatgccagctggcc

SEQ ID NO: 1336389 - DNA, 12 bp, Homo sapiens
cagcccaccctg

SEQ ID NO: 1336390 - DNA, 13 bp, Homo sapiens
cagcccaccctgc

SEQ ID NO: 1336391 - DNA, 14 bp, Homo sapiens
cagcccaccctgct

SEQ ID NO: 1336392 - DNA, 12 bp, Homo sapiens
cagcccagagac

SEQ ID NO: 1336393 - DNA, 13 bp, Homo sapiens
cagcccagagact

SEQ ID NO: 1336394 - DNA, 21 bp, Homo sapiens
cagcccagagactttgtagat

SEQ ID NO: 1336395 - DNA, 21 bp, Homo sapiens
cagcccagggctcctgcactt

SEQ ID NO: 1336396 - DNA, 13 bp, Homo sapiens
cagccccagcctg

SEQ ID NO: 1336397 - DNA, 14 bp, Homo sapiens
cagccccagcctgc

SEQ ID NO: 1336398 - DNA, 19 bp, Homo sapiens
cagccccagcctgctagct

SEQ ID NO: 1336399 - DNA, 20 bp, Homo sapiens
cagccccctgcttcagtccc

SEQ ID NO: 1336400 - DNA, 13 bp, Homo sapiens
cagccccctggtc

SEQ ID NO: 1336401 - DNA, 17 bp, Homo sapiens
cagccccgactccagcc

SEQ ID NO: 1336402 - DNA, 19 bp, Homo sapiens
cagccccgactccagccag

SEQ ID NO: 1336403 - DNA, 21 bp, Homo sapiens
cagccccgactccagccagcg

SEQ ID NO: 1336404 - DNA, 14 bp, Homo sapiens
cagcccctctggtc

SEQ ID NO: 1336405 - DNA, 16 bp, Homo sapiens
cagcccctctggtcgc

SEQ ID NO: 1336406 - DNA, 22 bp, Homo sapiens
cagcccctctggtcgctcctgc

SEQ ID NO: 1336407 - DNA, 17 bp, Homo sapiens
cagcccggccgctccac

SEQ ID NO: 1336408 - DNA, 20 bp, Homo sapiens
cagccgccccatctgcccca

SEQ ID NO: 1336409 - DNA, 15 bp, Homo sapiens
cagcctactctcctt

SEQ ID NO: 1336410 - DNA, 19 bp, Homo sapiens
cagcctagcacagcagctt

SEQ ID NO: 1336411 - DNA, 13 bp, Homo sapiens
cagcctcagactg

SEQ ID NO: 1336412 - DNA, 17 bp, Homo sapiens
cagcctcagcgcggccc

SEQ ID NO: 1336413 - DNA, 18 bp, Homo sapiens
cagcctcagcgcggccct

SEQ ID NO: 1336414 - DNA, 23 bp, Homo sapiens
cagcctcctctggacggcaggct

SEQ ID NO: 1336415 - DNA, 21 bp, Homo sapiens
cagcctctcagtgccctccag

SEQ ID NO: 1336416 - DNA, 19 bp, Homo sapiens
cagcctctccccaggtcca

SEQ ID NO: 1336417 - DNA, 17 bp, Homo sapiens
cagcctctgtcaggcct

SEQ ID NO: 1336418 - DNA, 18 bp, Homo sapiens
cagcctctgtcaggcctt

SEQ ID NO: 1336419 - DNA, 17 bp, Homo sapiens
cagcctgcgcctgctgc

SEQ ID NO: 1336420 - DNA, 13 bp, Homo sapiens
cagcctgctagct

SEQ ID NO: 1336421 - DNA, 18 bp, Homo sapiens
cagcctgctagctagctc

SEQ ID NO: 1336422 - DNA, 19 bp, Homo sapiens
cagcctggaccctgtggat

SEQ ID NO: 1336423 - DNA, 15 bp, Homo sapiens
cagcctgggccccag

SEQ ID NO: 1336424 - DNA, 16 bp, Homo sapiens
cagcctgggccccagc

SEQ ID NO: 1336425 - DNA, 23 bp, Homo sapiens
cagccttcagacagagaggactg

SEQ ID NO: 1336426 - DNA, 20 bp, Homo sapiens
cagcgatctctccactgtgc

SEQ ID NO: 1336427 - DNA, 14 bp, Homo sapiens
cagcgccagcctca

SEQ ID NO: 1336428 - DNA, 14 bp, Homo sapiens
cagcgcctccctcc

SEQ ID NO: 1336429 - DNA, 22 bp, Homo sapiens
cagcgcctccctccaccccagg

SEQ ID NO: 1336430 - DNA, 23 bp, Homo sapiens
cagcgcctccctccaccccagga

SEQ ID NO: 1336431 - DNA, 15 bp, Homo sapiens
cagcgtccctggcgc

SEQ ID NO: 1336432 - DNA, 15 bp, Homo sapiens
cagctacttgggagg

SEQ ID NO: 1336433 - DNA, 18 bp, Homo sapiens
cagctacttgggaggctg

SEQ ID NO: 1336434 - DNA, 13 bp, Homo sapiens
cagctcggctcag

SEQ ID NO: 1336435 - DNA, 21 bp, Homo sapiens
cagctctgcaagaattgaagc

SEQ ID NO: 1336436 - DNA, 18 bp, Homo sapiens
cagctctggaggggaggg

SEQ ID NO: 1336437 - DNA, 14 bp, Homo sapiens
cagctgacatcttg

SEQ ID NO: 1336438 - DNA, 21 bp, Homo sapiens
cagctgacatcttgaatcctt

SEQ ID NO: 1336439 - DNA, 19 bp, Homo sapiens
cagctgagggtgagtgggt

SEQ ID NO: 1336440 - DNA, 17 bp, Homo sapiens
cagctgcgcttgctttt

SEQ ID NO: 1336441 - DNA, 16 bp, Homo sapiens
cagctgctatccccat

SEQ ID NO: 1336442 - DNA, 18 bp, Homo sapiens
cagctgctatccccatct

SEQ ID NO: 1336443 - DNA, 23 bp, Homo sapiens
cagctgctatccccatctccctg

SEQ ID NO: 1336444 - DNA, 20 bp, Homo sapiens
caccctgctgctggtgcaca

SEQ ID NO: 1336445 - DNA, 17 bp, Homo sapiens
caccctgggccctgggc

SEQ ID NO: 1336446 - DNA, 13 bp, Homo sapiens
caccgaggggcct

SEQ ID NO: 1336447 - DNA, 16 bp, Homo sapiens
caccggtccagctggc

SEQ ID NO: 1336448 - DNA, 18 bp, Homo sapiens
caccggtccagctggcct

SEQ ID NO: 1336449 - DNA, 12 bp, Homo sapiens
cacctcagcctg

SEQ ID NO: 1336450 - DNA, 17 bp, Homo sapiens
cacctcagcctgcacag

SEQ ID NO: 1336451 - DNA, 15 bp, Homo sapiens
cacctcatgcccacc

SEQ ID NO: 1336452 - DNA, 16 bp, Homo sapiens
cacctcatgcccaccc

SEQ ID NO: 1336453 - DNA, 19 bp, Homo sapiens
cacctcatgcccaccccct

SEQ ID NO: 1336454 - DNA, 20 bp, Homo sapiens
cacctcatgcccaccccctg

SEQ ID NO: 1336455 - DNA, 22 bp, Homo sapiens
cacctcatgcccaccccctgcc

SEQ ID NO: 1336456 - DNA, 12 bp, Homo sapiens
cacctccaggct

SEQ ID NO: 1336457 - DNA, 23 bp, Homo sapiens
cacctggcatcgcaccattctga

SEQ ID NO: 1336458 - DNA, 11 bp, Homo sapiens
cacctggttgc

SEQ ID NO: 1336459 - DNA, 22 bp, Homo sapiens
cacctgtagtcccagctacttg

SEQ ID NO: 1336460 - DNA, 21 bp, Homo sapiens
caccttctagtcttggccagc

SEQ ID NO: 1336461 - DNA, 22 bp, Homo sapiens
caccttgaagaacctctcactt

SEQ ID NO: 1336462 - DNA, 13 bp, Homo sapiens
caccttgccttgc

SEQ ID NO: 1336463 - DNA, 17 bp, Homo sapiens
caccttggacatcctcc

SEQ ID NO: 1336464 - DNA, 22 bp, Homo sapiens
caccttggacatcctcctccca

SEQ ID NO: 1336465 - DNA, 15 bp, Homo sapiens
caccttgtgcctggg

SEQ ID NO: 1336466 - DNA, 23 bp, Homo sapiens
cacgaatttctgtgccctcctga

SEQ ID NO: 1336467 - DNA, 17 bp, Homo sapiens
cacgactgcccggcagg

SEQ ID NO: 1336468 - DNA, 12 bp, Homo sapiens
cacgagccacct

SEQ ID NO: 1336469 - DNA, 23 bp, Homo sapiens
cacgcactgggttgcgggacaga

SEQ ID NO: 1336470 - DNA, 21 bp, Homo sapiens
cacgcccggggtggccacagc

SEQ ID NO: 1336471 - DNA, 15 bp, Homo sapiens
cacgcccgtcctgcc

SEQ ID NO: 1336472 - DNA, 21 bp, Homo sapiens
cacgcccgtcctgcctgtggc

SEQ ID NO: 1336473 - DNA, 16 bp, Homo sapiens
cacggaagagccttgc

SEQ ID NO: 1336474 - DNA, 19 bp, Homo sapiens
cacggaggatgatgccagt

SEQ ID NO: 1336475 - DNA, 22 bp, Homo sapiens
cacgggtggggaaaggaggtgg

SEQ ID NO: 1336476 - DNA, 15 bp, Homo sapiens
cacgggtggtccccg

SEQ ID NO: 1336477 - DNA, 21 bp, Homo sapiens
cacggtttcgaagtcattaaa

SEQ ID NO: 1336478 - DNA, 23 bp, Homo sapiens
cacggtttcgaagtcattaaact

SEQ ID NO: 1336479 - DNA, 14 bp, Homo sapiens
cacgtcatgggagg

SEQ ID NO: 1336480 - DNA, 16 bp, Homo sapiens
cacgttttaaggactg

SEQ ID NO: 1336481 - DNA, 15 bp, Homo sapiens
caagtgtgaatactg

SEQ ID NO: 1336482 - DNA, 22 bp, Homo sapiens
caagtgtgtgccaccatgcctc

SEQ ID NO: 1336483 - DNA, 12 bp, Homo sapiens
caagttcaatct

SEQ ID NO: 1336484 - DNA, 16 bp, Homo sapiens
caagttgtcaggttat

SEQ ID NO: 1336485 - DNA, 15 bp, Homo sapiens
caagtttatatatat

SEQ ID NO: 1336486 - DNA, 14 bp, Homo sapiens
caataaaaatcata

SEQ ID NO: 1336487 - DNA, 13 bp, Homo sapiens
caataaaatttaa

SEQ ID NO: 1336488 - DNA, 18 bp, Homo sapiens
caataaaatttttttaaa

SEQ ID NO: 1336489 - DNA, 20 bp, Homo sapiens
caataaaccctcagagcctc

SEQ ID NO: 1336490 - DNA, 12 bp, Homo sapiens
caataaatgaat

SEQ ID NO: 1336491 - DNA, 17 bp, Homo sapiens
caataaattttgaaaag

SEQ ID NO: 1336492 - DNA, 14 bp, Homo sapiens
caataacagctgca

SEQ ID NO: 1336493 - DNA, 15 bp, Homo sapiens
caataacagctgcaa

SEQ ID NO: 1336494 - DNA, 21 bp, Homo sapiens
caataagtgtgtggtagaaac

SEQ ID NO: 1336495 - DNA, 17 bp, Homo sapiens
caataatatattttctg

SEQ ID NO: 1336496 - DNA, 20 bp, Homo sapiens
caataatatattttctgttt

SEQ ID NO: 1336497 - DNA, 17 bp, Homo sapiens
caatacactagttgttt

SEQ ID NO: 1336498 - DNA, 15 bp, Homo sapiens
caatagatctccagc

SEQ ID NO: 1336499 - DNA, 20 bp, Homo sapiens
caatatattgaacttttgta

SEQ ID NO: 1336500 - DNA, 16 bp, Homo sapiens
caatatctaatatata

SEQ ID NO: 1336501 - DNA, 24 bp, Homo sapiens
caatattaacctaatcaccatgta

SEQ ID NO: 1336502 - DNA, 20 bp, Homo sapiens
caatattgattgggaaaaca

SEQ ID NO: 1336503 - DNA, 21 bp, Homo sapiens
caatattgattgggaaaacat

SEQ ID NO: 1336504 - DNA, 22 bp, Homo sapiens
caatattgtctcccttccagca

SEQ ID NO: 1336505 - DNA, 17 bp, Homo sapiens
caatattttatggttat

SEQ ID NO: 1336506 - DNA, 22 bp, Homo sapiens
caatatttttatatcatgcaaa

SEQ ID NO: 1336507 - DNA, 17 bp, Homo sapiens
caatcaaataagtattt

SEQ ID NO: 1336508 - DNA, 20 bp, Homo sapiens
caatcaaggttataattttt

SEQ ID NO: 1336509 - DNA, 17 bp, Homo sapiens
caatccataactttagt

SEQ ID NO: 1336510 - DNA, 18 bp, Homo sapiens
caatcctgattcctctct

SEQ ID NO: 1336511 - DNA, 17 bp, Homo sapiens
caatctctttttgtttg

SEQ ID NO: 1336512 - DNA, 17 bp, Homo sapiens
caatgaaccataaattc

SEQ ID NO: 1336513 - DNA, 19 bp, Homo sapiens
caatgaaccataaattcaa

SEQ ID NO: 1336514 - DNA, 20 bp, Homo sapiens
caaaattaaggtgtttgaaa

SEQ ID NO: 1336515 - DNA, 23 bp, Homo sapiens
caaaatttgactaattttacatg

SEQ ID NO: 1336516 - DNA, 15 bp, Homo sapiens
caaacagtgactgta

SEQ ID NO: 1336517 - DNA, 19 bp, Homo sapiens
caaaccacgcctcttgacc

SEQ ID NO: 1336518 - DNA, 13 bp, Homo sapiens
caaaccggcaggt

SEQ ID NO: 1336519 - DNA, 17 bp, Homo sapiens
caaaccttatctccaca

SEQ ID NO: 1336520 - DNA, 17 bp, Homo sapiens
caaacgcctcccctgcc

SEQ ID NO: 1336521 - DNA, 19 bp, Homo sapiens
caaactgggatgaaactaa

SEQ ID NO: 1336522 - DNA, 16 bp, Homo sapiens
caaagaaaatgaaatg

SEQ ID NO: 1336523 - DNA, 18 bp, Homo sapiens
caaagaaaatgaaatgca

SEQ ID NO: 1336524 - DNA, 14 bp, Homo sapiens
caaagaaatattaa

SEQ ID NO: 1336525 - DNA, 15 bp, Homo sapiens
caaagaggctgcccc

SEQ ID NO: 1336526 - DNA, 21 bp, Homo sapiens
caaagaggctgcccctctcac

SEQ ID NO: 1336527 - DNA, 23 bp, Homo sapiens
caaagaggctgcccctctcacca

SEQ ID NO: 1336528 - DNA, 22 bp, Homo sapiens
caaagagggcttcctctagaag

SEQ ID NO: 1336529 - DNA, 14 bp, Homo sapiens
caaagatagacagg

SEQ ID NO: 1336530 - DNA, 18 bp, Homo sapiens
caaagatagacaggtcct

SEQ ID NO: 1336531 - DNA, 19 bp, Homo sapiens
caaagatagacaggtcctg

SEQ ID NO: 1336532 - DNA, 22 bp, Homo sapiens
caaagatagacaggtcctgatt

SEQ ID NO: 1336533 - DNA, 13 bp, Homo sapiens
caaagattcatga

SEQ ID NO: 1336534 - DNA, 19 bp, Homo sapiens
caaagattcatgatttata

SEQ ID NO: 1336535 - DNA, 17 bp, Homo sapiens
caaagcctcctccagcc

SEQ ID NO: 1336536 - DNA, 14 bp, Homo sapiens
caaagctgagcctg

SEQ ID NO: 1336537 - DNA, 14 bp, Homo sapiens
caaagctgcccact

SEQ ID NO: 1336538 - DNA, 21 bp, Homo sapiens
caaagcttggattaaatacat

SEQ ID NO: 1336539 - DNA, 20 bp, Homo sapiens
caaagggcctgcccagacaa

SEQ ID NO: 1336540 - DNA, 17 bp, Homo sapiens
caaagtcattaaagaca

SEQ ID NO: 1336541 - DNA, 20 bp, Homo sapiens
caaagtctgctctcatataa

SEQ ID NO: 1336542 - DNA, 15 bp, Homo sapiens
caaagtgccaaagaa

SEQ ID NO: 1336543 - DNA, 21 bp, Homo sapiens
acagttttcagaaaaagaaat

SEQ ID NO: 1336544 - DNA, 17 bp, Homo sapiens
acataagcttccatttt

SEQ ID NO: 1336545 - DNA, 18 bp, Homo sapiens
acataagcttccatttta

SEQ ID NO: 1336546 - DNA, 20 bp, Homo sapiens
acatagaaatggaaattttg

SEQ ID NO: 1336547 - DNA, 23 bp, Homo sapiens
acatagtgaaaattgtttagtga

SEQ ID NO: 1336548 - DNA, 15 bp, Homo sapiens
acatatatatatata

SEQ ID NO: 1336549 - DNA, 17 bp, Homo sapiens
acatatatatatataac

SEQ ID NO: 1336550 - DNA, 13 bp, Homo sapiens
acatatggaattt

SEQ ID NO: 1336551 - DNA, 16 bp, Homo sapiens
acatatggatgttact

SEQ ID NO: 1336552 - DNA, 17 bp, Homo sapiens
acatcaaacctttgagt

SEQ ID NO: 1336553 - DNA, 20 bp, Homo sapiens
acatcaaactcaatgcttta

SEQ ID NO: 1336554 - DNA, 14 bp, Homo sapiens
acatcacagggtgg

SEQ ID NO: 1336555 - DNA, 15 bp, Homo sapiens
acatcacagggtggg

SEQ ID NO: 1336556 - DNA, 13 bp, Homo sapiens
acatcattccttt

SEQ ID NO: 1336557 - DNA, 17 bp, Homo sapiens
acatcattcctttttat

SEQ ID NO: 1336558 - DNA, 22 bp, Homo sapiens
acatcattcctttttatttata

SEQ ID NO: 1336559 - DNA, 18 bp, Homo sapiens
acatccaactccagcaac

SEQ ID NO: 1336560 - DNA, 13 bp, Homo sapiens
acatcctcctccc

SEQ ID NO: 1336561 - DNA, 15 bp, Homo sapiens
acatcctcctcccac

SEQ ID NO: 1336562 - DNA, 21 bp, Homo sapiens
acatgaggaactgtagatgat

SEQ ID NO: 1336563 - DNA, 22 bp, Homo sapiens
acatgaggaactgtagatgatg

SEQ ID NO: 1336564 - DNA, 16 bp, Homo sapiens
acatgcaataaaattt

SEQ ID NO: 1336565 - DNA, 16 bp, Homo sapiens
acatgcatataatgaa

SEQ ID NO: 1336566 - DNA, 19 bp, Homo sapiens
acatgccacatcaaacctt

SEQ ID NO: 1336567 - DNA, 22 bp, Homo sapiens
acatggctccggcctctgcctt

SEQ ID NO: 1336568 - DNA, 13 bp, Homo sapiens
acatggtgcctga

SEQ ID NO: 1336569 - DNA, 20 bp, Homo sapiens
acatgtccagcaccttgtgc

SEQ ID NO: 1336570 - DNA, 14 bp, Homo sapiens
acatgtgatacatt

SEQ ID NO: 1336571 - DNA, 16 bp, Homo sapiens
acatgttaatgacaat

SEQ ID NO: 1336572 - DNA, 20 bp, Homo sapiens
acatgttgggaaacttggct

SEQ ID NO: 1336573 - DNA, 19 bp, Homo sapiens
acattcaaatttgtctggt

SEQ ID NO: 1336574 - DNA, 20 bp, Homo sapiens
acattcttggcttaatcatt

SEQ ID NO: 1336575 - DNA, 18 bp, Homo sapiens
acattgaagtaatgaatt

SEQ ID NO: 1336576 - DNA, 19 bp, Homo sapiens
acattgtctcctatatatt

SEQ ID NO: 1336577 - DNA, 17 bp, Homo sapiens
acattgttcttattctg

SEQ ID NO: 1336578 - DNA, 18 bp, Homo sapiens
acatttccttacagaact

SEQ ID NO: 1336579 - DNA, 12 bp, Homo sapiens
acatttctataa

SEQ ID NO: 1336580 - DNA, 20 bp, Homo sapiens
acatttgatgcatgtctttt

SEQ ID NO: 1336581 - DNA, 17 bp, Homo sapiens
acatttgctactgttgt

SEQ ID NO: 1336582 - DNA, 17 bp, Homo sapiens
acattttttaagcttca

SEQ ID NO: 1336583 - DNA, 18 bp, Homo sapiens
accaaagagggcttcctc

SEQ ID NO: 1336584 - DNA, 19 bp, Homo sapiens
accaaaggaaaatgtctgt

SEQ ID NO: 1336585 - DNA, 13 bp, Homo sapiens
accaaatctggaa

SEQ ID NO: 1336586 - DNA, 18 bp, Homo sapiens
accaaatgtttattttct

SEQ ID NO: 1336587 - DNA, 14 bp, Homo sapiens
accaaattatcttg

SEQ ID NO: 1336588 - DNA, 15 bp, Homo sapiens
accaaattatcttga

SEQ ID NO: 1336589 - DNA, 16 bp, Homo sapiens
accaaattatcttgat

SEQ ID NO: 1336590 - DNA, 14 bp, Homo sapiens
accaagcatcttgg

SEQ ID NO: 1336591 - DNA, 12 bp, Homo sapiens
accaagtcacac

SEQ ID NO: 1336592 - DNA, 14 bp, Homo sapiens
accaagtcacacgc

SEQ ID NO: 1336593 - DNA, 12 bp, Homo sapiens
accaagtgaaat

SEQ ID NO: 1336594 - DNA, 20 bp, Homo sapiens
accaatcttactttgtaaat

SEQ ID NO: 1336595 - DNA, 23 bp, Homo sapiens
accaatcttactttgtaaattct

SEQ ID NO: 1336596 - DNA, 15 bp, Homo sapiens
accaatgttctctct

SEQ ID NO: 1336597 - DNA, 16 bp, Homo sapiens
accacagccagcacct

SEQ ID NO: 1336598 - DNA, 19 bp, Homo sapiens
accacagccagcacctggc

SEQ ID NO: 1336599 - DNA, 20 bp, Homo sapiens
accacagccagcacctggca

SEQ ID NO: 1336600 - DNA, 16 bp, Homo sapiens
accaccacccctacca

SEQ ID NO: 1336601 - DNA, 14 bp, Homo sapiens
accacccctaccac

SEQ ID NO: 1336602 - DNA, 12 bp, Homo sapiens
accaccctgagc

SEQ ID NO: 1336603 - DNA, 14 bp, Homo sapiens
accaccctgagccg

SEQ ID NO: 1336604 - DNA, 20 bp, Homo sapiens
accacgcccgtcctgcctgt

SEQ ID NO: 1336605 - DNA, 22 bp, Homo sapiens
accacgggacatcacagggtgg

SEQ ID NO: 1336606 - DNA, 18 bp, Homo sapiens
agtaccctggttgtgtgt

SEQ ID NO: 1336607 - DNA, 19 bp, Homo sapiens
agtaccctggttgtgtgtc

SEQ ID NO: 1336608 - DNA, 12 bp, Homo sapiens
agtagaaaatgt

SEQ ID NO: 1336609 - DNA, 14 bp, Homo sapiens
agtagaaaatgtga

SEQ ID NO: 1336610 - DNA, 11 bp, Homo sapiens
agtagaactgt

SEQ ID NO: 1336611 - DNA, 15 bp, Homo sapiens
agtagagccagcttg

SEQ ID NO: 1336612 - DNA, 20 bp, Homo sapiens
agtagataatttcagggtgc

SEQ ID NO: 1336613 - DNA, 13 bp, Homo sapiens
agtagtcctgtga

SEQ ID NO: 1336614 - DNA, 16 bp, Homo sapiens
agtagttctgtatttg

SEQ ID NO: 1336615 - DNA, 17 bp, Homo sapiens
agtagttctgtatttga

SEQ ID NO: 1336616 - DNA, 15 bp, Homo sapiens
agtatacaaacattt

SEQ ID NO: 1336617 - DNA, 22 bp, Homo sapiens
agtatgtatattaaaaaagaga

SEQ ID NO: 1336618 - DNA, 15 bp, Homo sapiens
atttattttcctaaa

SEQ ID NO: 1336619 - DNA, 18 bp, Homo sapiens
atttcaaagttttgttgt

SEQ ID NO: 1336620 - DNA, 12 bp, Homo sapiens
atttcacttgat

SEQ ID NO: 1336621 - DNA, 23 bp, Homo sapiens
atttcatttttcaatagcacata

SEQ ID NO: 1336622 - DNA, 22 bp, Homo sapiens
atttccagaaccacacttgaaa

SEQ ID NO: 1336623 - DNA, 13 bp, Homo sapiens
atttccattgctt

SEQ ID NO: 1336624 - DNA, 13 bp, Homo sapiens
atttcccatctgc

SEQ ID NO: 1336625 - DNA, 22 bp, Homo sapiens
atttcccctctgcacccagaac

SEQ ID NO: 1336626 - DNA, 19 bp, Homo sapiens
atttcctccctctgcccct

SEQ ID NO: 1336627 - DNA, 21 bp, Homo sapiens
atttcctccctctgcccctcc

SEQ ID NO: 1336628 - DNA, 15 bp, Homo sapiens
atttcctttatgtga

SEQ ID NO: 1336629 - DNA, 17 bp, Homo sapiens
atttcctttatgtgaat

SEQ ID NO: 1336630 - DNA, 20 bp, Homo sapiens
atttcctttttgacactgaa

SEQ ID NO: 1336631 - DNA, 21 bp, Homo sapiens
atttctactgtcaaatgatgt

SEQ ID NO: 1336632 - DNA, 14 bp, Homo sapiens
atttctattattaa

SEQ ID NO: 1336633 - DNA, 22 bp, Homo sapiens
atttctattattaattgcaaaa

SEQ ID NO: 1336634 - DNA, 22 bp, Homo sapiens
atttctcattgacttttataaa

SEQ ID NO: 1336635 - DNA, 15 bp, Homo sapiens
atttctccatacgca

SEQ ID NO: 1336636 - DNA, 12 bp, Homo sapiens
atttctcctccc

SEQ ID NO: 1336637 - DNA, 19 bp, Homo sapiens
atttctgggggaggatgta

SEQ ID NO: 1336638 - DNA, 11 bp, Homo sapiens
atttctgtgcc

SEQ ID NO: 1336639 - DNA, 16 bp, Homo sapiens
atttctgtgccctcct

SEQ ID NO: 1336640 - DNA, 23 bp, Homo sapiens
atttctgtgttgccaagctccaa

SEQ ID NO: 1336641 - DNA, 17 bp, Homo sapiens
atttcttatgtgacatt

SEQ ID NO: 1336642 - DNA, 19 bp, Homo sapiens
atttcttatgtgacattaa

SEQ ID NO: 1336643 - DNA, 13 bp, Homo sapiens
ccctctcaccaaa

SEQ ID NO: 1336644 - DNA, 16 bp, Homo sapiens
ccctctgaacttgcct

SEQ ID NO: 1336645 - DNA, 20 bp, Homo sapiens
ccctctggtcgctcctgccc

SEQ ID NO: 1336646 - DNA, 18 bp, Homo sapiens
ccctctgtgtatttgctt

SEQ ID NO: 1336647 - DNA, 14 bp, Homo sapiens
ccctcttcctgtga

SEQ ID NO: 1336648 - DNA, 12 bp, Homo sapiens
ccctgagccggc

SEQ ID NO: 1336649 - DNA, 16 bp, Homo sapiens
ccctgagctttctgct

SEQ ID NO: 1336650 - DNA, 13 bp, Homo sapiens
ccctgcacgtcat

SEQ ID NO: 1336651 - DNA, 15 bp, Homo sapiens
ccctgcacgtcatgg

SEQ ID NO: 1336652 - DNA, 18 bp, Homo sapiens
ccctgcagatgccaccct

SEQ ID NO: 1336653 - DNA, 20 bp, Homo sapiens
ccctgcagatgccaccctag

SEQ ID NO: 1336654 - DNA, 20 bp, Homo sapiens
ccctgcccgttcttgaaatg

SEQ ID NO: 1336655 - DNA, 13 bp, Homo sapiens
ccctgccctgcac

SEQ ID NO: 1336656 - DNA, 15 bp, Homo sapiens
ccctgccgtcaccac

SEQ ID NO: 1336657 - DNA, 17 bp, Homo sapiens
ccctgccgtcaccacca

SEQ ID NO: 1336658 - DNA, 15 bp, Homo sapiens
ccctgcctgccgtct

SEQ ID NO: 1336659 - DNA, 17 bp, Homo sapiens
ccctgcctggcccccaa

SEQ ID NO: 1336660 - DNA, 16 bp, Homo sapiens
ccctgcgctctctttg

SEQ ID NO: 1336661 - DNA, 19 bp, Homo sapiens
ccctgctgctggtgcacag

SEQ ID NO: 1336662 - DNA, 14 bp, Homo sapiens
ccctgcttccagga

SEQ ID NO: 1336663 - DNA, 20 bp, Homo sapiens
ccctggccgcgctccgggct

SEQ ID NO: 1336664 - DNA, 13 bp, Homo sapiens
ccctggcctctgt

SEQ ID NO: 1336665 - DNA, 18 bp, Homo sapiens
ccctggcctctgtgcctt

SEQ ID NO: 1336666 - DNA, 19 bp, Homo sapiens
ccctggcctctgtgccttc

SEQ ID NO: 1336667 - DNA, 16 bp, Homo sapiens
ccctggctccctcctc

SEQ ID NO: 1336668 - DNA, 23 bp, Homo sapiens
ccctggctccctcctccaggcct

SEQ ID NO: 1336669 - DNA, 14 bp, Homo sapiens
ccctggctgccggc

SEQ ID NO: 1336670 - DNA, 15 bp, Homo sapiens
ccctggctgctgccc

SEQ ID NO: 1336671 - DNA, 22 bp, Homo sapiens
ccctggctgctgcccccacccc

SEQ ID NO: 1336672 - DNA, 18 bp, Homo sapiens
ccctgggccctgggctgg

SEQ ID NO: 1336673 - DNA, 19 bp, Homo sapiens
ccctgggccctgggctgga

SEQ ID NO: 1336674 - DNA, 14 bp, Homo sapiens
ccctgggctggaat

SEQ ID NO: 1336675 - DNA, 18 bp, Homo sapiens
ccctgggcttggcctgct

SEQ ID NO: 1336676 - DNA, 20 bp, Homo sapiens
ccctgggtgggctctgtgca

SEQ ID NO: 1336677 - DNA, 20 bp, Homo sapiens
ccctgtctcaaaaaaagaaa

SEQ ID NO: 1336678 - DNA, 19 bp, Homo sapiens
ccctgtgacatggtgcctg

SEQ ID NO: 1336679 - DNA, 20 bp, Homo sapiens
ccctgtgacatggtgcctga

SEQ ID NO: 1336680 - DNA, 13 bp, Homo sapiens
ccctgtgttaatt

SEQ ID NO: 1336681 - DNA, 17 bp, Homo sapiens
cccttccttttccctgc

SEQ ID NO: 1336682 - DNA, 19 bp, Homo sapiens
cccttccttttccctgctt

SEQ ID NO: 1336683 - DNA, 15 bp, Homo sapiens
cccttctcttagtta

SEQ ID NO: 1336684 - DNA, 18 bp, Homo sapiens
cccttgaaactttgggaa

SEQ ID NO: 1336685 - DNA, 12 bp, Homo sapiens
cccttgcctccc

SEQ ID NO: 1336686 - DNA, 13 bp, Homo sapiens
cccttgcctcccc

SEQ ID NO: 1336687 - DNA, 13 bp, Homo sapiens
cccttgctggccc

SEQ ID NO: 1336688 - DNA, 19 bp, Homo sapiens
cccttgcttgcctgcaggg

SEQ ID NO: 1336689 - DNA, 12 bp, Homo sapiens
cccttgggccac

SEQ ID NO: 1336690 - DNA, 19 bp, Homo sapiens
cccttgtttgtcccttcta

SEQ ID NO: 1336691 - DNA, 23 bp, Homo sapiens
ccctttccccgacgcccacccaa

SEQ ID NO: 1336692 - DNA, 23 bp, Homo sapiens
cggagtcgtggggtgtgctggga

SEQ ID NO: 1336693 - DNA, 20 bp, Homo sapiens
cggatagttgctatttttgt

SEQ ID NO: 1336694 - DNA, 15 bp, Homo sapiens
cggcagccccagcct

SEQ ID NO: 1336695 - DNA, 18 bp, Homo sapiens
cggcaggggcctggagat

SEQ ID NO: 1336696 - DNA, 20 bp, Homo sapiens
cggcatgagactcagtgcag

SEQ ID NO: 1336697 - DNA, 21 bp, Homo sapiens
cggcatgagactcagtgcaga

SEQ ID NO: 1336698 - DNA, 12 bp, Homo sapiens
cggccccctgcc

SEQ ID NO: 1336699 - DNA, 17 bp, Homo sapiens
cggcccgcgccacagga

SEQ ID NO: 1336700 - DNA, 16 bp, Homo sapiens
cggcccgtggctgttg

SEQ ID NO: 1336701 - DNA, 15 bp, Homo sapiens
cggccgctccaccag

SEQ ID NO: 1336702 - DNA, 20 bp, Homo sapiens
cggcctagggcccccacagt

SEQ ID NO: 1336703 - DNA, 13 bp, Homo sapiens
cggctcccagcct

SEQ ID NO: 1336704 - DNA, 14 bp, Homo sapiens
cggctcccagcctc

SEQ ID NO: 1336705 - DNA, 15 bp, Homo sapiens
cggctcccagcctca

SEQ ID NO: 1336706 - DNA, 17 bp, Homo sapiens
cggctcccagcctcagc

SEQ ID NO: 1336707 - DNA, 16 bp, Homo sapiens
cggctgaccatgctca

SEQ ID NO: 1336708 - DNA, 12 bp, Homo sapiens
cggctgcagagg

SEQ ID NO: 1336709 - DNA, 15 bp, Homo sapiens
cggctgcagaggcca

SEQ ID NO: 1336710 - DNA, 23 bp, Homo sapiens
cggctggcagcccacccctcaac

SEQ ID NO: 1336711 - DNA, 14 bp, Homo sapiens
cggcttcctttccc

SEQ ID NO: 1336712 - DNA, 21 bp, Homo sapiens
cgggaacctccccagcctgcg

SEQ ID NO: 1336713 - DNA, 22 bp, Homo sapiens
cgggaacctccccagcctgcgc

SEQ ID NO: 1336714 - DNA, 19 bp, Homo sapiens
cgggacatcacagggtggg

SEQ ID NO: 1336715 - DNA, 21 bp, Homo sapiens
cgggacatcacagggtgggcc

SEQ ID NO: 1336716 - DNA, 22 bp, Homo sapiens
cgggacatcacagggtgggcct

SEQ ID NO: 1336717 - DNA, 23 bp, Homo sapiens
cgggacatcacagggtgggcctc

SEQ ID NO: 1336718 - DNA, 17 bp, Homo sapiens
cgggaccaccctgagcc

SEQ ID NO: 1336719 - DNA, 12 bp, Homo sapiens
cgggagacagca

SEQ ID NO: 1336720 - DNA, 18 bp, Homo sapiens
cgggaggtcgaggcagga

SEQ ID NO: 1336721 - DNA, 20 bp, Homo sapiens
cgggaggtcgaggcaggagg

SEQ ID NO: 1336722 - DNA, 16 bp, Homo sapiens
cgggatggttctggct

SEQ ID NO: 1336723 - DNA, 23 bp, Homo sapiens
cgggcccctgggcttggcctgct

SEQ ID NO: 1336724 - DNA, 14 bp, Homo sapiens
cgggcgcggtggct

SEQ ID NO: 1336725 - DNA, 15 bp, Homo sapiens
cgggctcagcaaaag

SEQ ID NO: 1336726 - DNA, 19 bp, Homo sapiens
cggggctgtcggcgctgcc

SEQ ID NO: 1336727 - DNA, 21 bp, Homo sapiens
cggggctgtcggcgctgcccc

SEQ ID NO: 1336728 - DNA, 20 bp, Homo sapiens
cgggggctgcccttgggcca

SEQ ID NO: 1336729 - DNA, 15 bp, Homo sapiens
cggggtatcctgggg

SEQ ID NO: 1336730 - DNA, 23 bp, Homo sapiens
cggggtgagtccattctcccagg

SEQ ID NO: 1336731 - DNA, 15 bp, Homo sapiens
cggggtgcttccttg

SEQ ID NO: 1336732 - DNA, 14 bp, Homo sapiens
cggggtggccacag

SEQ ID NO: 1336733 - DNA, 20 bp, Homo sapiens
cgggtggggcttggggctca

SEQ ID NO: 1336734 - DNA, 17 bp, Homo sapiens
cgggttagacagccaaa

SEQ ID NO: 1336735 - DNA, 13 bp, Homo sapiens
cggtaactgtcct

SEQ ID NO: 1336736 - DNA, 15 bp, Homo sapiens
cggtaactgtcctgt

SEQ ID NO: 1336737 - DNA, 18 bp, Homo sapiens
cggtaggcgaccaccgcc

SEQ ID NO: 1336738 - DNA, 22 bp, Homo sapiens
cggtatccccccatcttgcttc

SEQ ID NO: 1336739 - DNA, 14 bp, Homo sapiens
cggtgcccaagcca

SEQ ID NO: 1336740 - DNA, 18 bp, Homo sapiens
cggtgcccaagccagagg

SEQ ID NO: 1336741 - DNA, 23 bp, Homo sapiens
cggtgcccaagccagaggctggg

SEQ ID NO: 1336742 - DNA, 16 bp, Homo sapiens
cggtgctgtgagggag

SEQ ID NO: 1336743 - DNA, 17 bp, Homo sapiens
cggtggcggccccagca

SEQ ID NO: 1336744 - DNA, 15 bp, Homo sapiens
cggtggcgggcacct

SEQ ID NO: 1336745 - DNA, 18 bp, Homo sapiens
cggtgggacccccgtggg

SEQ ID NO: 1336746 - DNA, 13 bp, Homo sapiens
cggtgtggagaag

SEQ ID NO: 1336747 - DNA, 16 bp, Homo sapiens
cggttcctgtccctgc

SEQ ID NO: 1336748 - DNA, 18 bp, Homo sapiens
cggtttcgaagtcattaa

SEQ ID NO: 1336749 - DNA, 22 bp, Homo sapiens
cggtttcgaagtcattaaactg

SEQ ID NO: 1336750 - DNA, 11 bp, Homo sapiens
cggtttctcca

SEQ ID NO: 1336751 - DNA, 18 bp, Homo sapiens
cgtatctccggctcccag

SEQ ID NO: 1336752 - DNA, 12 bp, Homo sapiens
cgtcaccaccac

SEQ ID NO: 1336753 - DNA, 13 bp, Homo sapiens
cgtcaccaccacc

SEQ ID NO: 1336754 - DNA, 15 bp, Homo sapiens
cgtcccaagatgttg

SEQ ID NO: 1336755 - DNA, 22 bp, Homo sapiens
cgtccccccccaacctttccct

SEQ ID NO: 1336756 - DNA, 14 bp, Homo sapiens
cgtccctggcgcag

SEQ ID NO: 1336757 - DNA, 17 bp, Homo sapiens
cgtcctcctcacctcat

SEQ ID NO: 1336758 - DNA, 21 bp, Homo sapiens
cgtcctcctcacctcatgccc

SEQ ID NO: 1336759 - DNA, 13 bp, Homo sapiens
cgtcctgcctgtg

SEQ ID NO: 1336760 - DNA, 16 bp, Homo sapiens
cgtcctgcctgtggcg

SEQ ID NO: 1336761 - DNA, 21 bp, Homo sapiens
cgtcggggaggctcctgcctg

SEQ ID NO: 1336762 - DNA, 13 bp, Homo sapiens
ccctttgctgtcc

SEQ ID NO: 1336763 - DNA, 20 bp, Homo sapiens
ccctttgggggttgaatagg

SEQ ID NO: 1336764 - DNA, 17 bp, Homo sapiens
ccgaccagaggagcctt

SEQ ID NO: 1336765 - DNA, 21 bp, Homo sapiens
ccgacccagggttcccgcggg

SEQ ID NO: 1336766 - DNA, 14 bp, Homo sapiens
ccgacgtcatgtat

SEQ ID NO: 1336767 - DNA, 11 bp, Homo sapiens
ccgactccagc

SEQ ID NO: 1336768 - DNA, 16 bp, Homo sapiens
ccgactccagccagcg

SEQ ID NO: 1336769 - DNA, 20 bp, Homo sapiens
ccgactgaaaatattgtttt

SEQ ID NO: 1336770 - DNA, 17 bp, Homo sapiens
ccgactgctttggacct

SEQ ID NO: 1336771 - DNA, 15 bp, Homo sapiens
ccgagaggtgggcca

SEQ ID NO: 1336772 - DNA, 15 bp, Homo sapiens
ccgagattgcaccac

SEQ ID NO: 1336773 - DNA, 21 bp, Homo sapiens
ccgagattgcaccactgcact

SEQ ID NO: 1336774 - DNA, 17 bp, Homo sapiens
ccgaggacccaggaaag

SEQ ID NO: 1336775 - DNA, 22 bp, Homo sapiens
ccgaggcctaccccgcagacac

SEQ ID NO: 1336776 - DNA, 22 bp, Homo sapiens
ccgagttaaggtgggcccggcc

SEQ ID NO: 1336777 - DNA, 12 bp, Homo sapiens
ccgcacagctca

SEQ ID NO: 1336778 - DNA, 14 bp, Homo sapiens
ccgcacagctcagg

SEQ ID NO: 1336779 - DNA, 16 bp, Homo sapiens
ccgcacagctcaggag

SEQ ID NO: 1336780 - DNA, 14 bp, Homo sapiens
ccgcagccctggca

SEQ ID NO: 1336781 - DNA, 14 bp, Homo sapiens
ccgcatctcacagc

SEQ ID NO: 1336782 - DNA, 19 bp, Homo sapiens
ccgccaccgcgggtgtggg

SEQ ID NO: 1336783 - DNA, 14 bp, Homo sapiens
ccgccagcctcctc

SEQ ID NO: 1336784 - DNA, 14 bp, Homo sapiens
ccgcccatgcactg

SEQ ID NO: 1336785 - DNA, 13 bp, Homo sapiens
ccgcccccagtcc

SEQ ID NO: 1336786 - DNA, 13 bp, Homo sapiens
ccgccctgccact

SEQ ID NO: 1336787 - DNA, 15 bp, Homo sapiens
ccgccctgccactca

SEQ ID NO: 1336788 - DNA, 14 bp, Homo sapiens
ccgcctggccagga

SEQ ID NO: 1336789 - DNA, 15 bp, Homo sapiens
ccgcctggccaggag

SEQ ID NO: 1336790 - DNA, 16 bp, Homo sapiens
ccgcctggccaggagc

SEQ ID NO: 1336791 - DNA, 17 bp, Homo sapiens
ccgcctggccaggagca

SEQ ID NO: 1336792 - DNA, 15 bp, Homo sapiens
ccgcgaccatgtggc

SEQ ID NO: 1336793 - DNA, 16 bp, Homo sapiens
ccgcgccacaggaccc

SEQ ID NO: 1336794 - DNA, 14 bp, Homo sapiens
ccgcgcgtccagct

SEQ ID NO: 1336795 - DNA, 21 bp, Homo sapiens
ccgcgctccgggctttcacgg

SEQ ID NO: 1336796 - DNA, 16 bp, Homo sapiens
ccgcgggcactgccgc

SEQ ID NO: 1336797 - DNA, 23 bp, Homo sapiens
ccgctgccgtgccgcctgcactc

SEQ ID NO: 1336798 - DNA, 17 bp, Homo sapiens
ccggaccctctaacctc

SEQ ID NO: 1336799 - DNA, 15 bp, Homo sapiens
ccggcagccccagcc

SEQ ID NO: 1336800 - DNA, 16 bp, Homo sapiens
ccggcagccccagcct

SEQ ID NO: 1336801 - DNA, 17 bp, Homo sapiens
ccggcagccccagcctg

SEQ ID NO: 1336802 - DNA, 21 bp, Homo sapiens
ccggcatgagactcagtgcag

SEQ ID NO: 1336803 - DNA, 17 bp, Homo sapiens
ccggcccgcgccacagg

SEQ ID NO: 1336804 - DNA, 18 bp, Homo sapiens
ccggcccgcgccacagga

SEQ ID NO: 1336805 - DNA, 17 bp, Homo sapiens
ccggccgctccaccagc

SEQ ID NO: 1336806 - DNA, 21 bp, Homo sapiens
ccggcctctccagcctcagcc

SEQ ID NO: 1336807 - DNA, 15 bp, Homo sapiens
ccggctgcagaggcc

SEQ ID NO: 1336808 - DNA, 19 bp, Homo sapiens
ccgggaacctccccagcct

SEQ ID NO: 1336809 - DNA, 20 bp, Homo sapiens
ccgggaacctccccagcctg

SEQ ID NO: 1336810 - DNA, 20 bp, Homo sapiens
ccgggaccaccctgagccgg

SEQ ID NO: 1336811 - DNA, 23 bp, Homo sapiens
ccgggcccctgggcttggcctgc

SEQ ID NO: 1336812 - DNA, 21 bp, Homo sapiens
ccggggaagagatccaaagac

SEQ ID NO: 1336813 - DNA, 16 bp, Homo sapiens
ccgggtcttgattcag

SEQ ID NO: 1336814 - DNA, 15 bp, Homo sapiens
ccggtccagctggcc

SEQ ID NO: 1336815 - DNA, 18 bp, Homo sapiens
ccggtggcggccccagca

SEQ ID NO: 1336816 - DNA, 22 bp, Homo sapiens
ccggtgggacccccgtggggca

SEQ ID NO: 1336817 - DNA, 20 bp, Homo sapiens
ccgtctccaggggctgcttc

SEQ ID NO: 1336818 - DNA, 14 bp, Homo sapiens
ccgtgccgcctgca

SEQ ID NO: 1336819 - DNA, 17 bp, Homo sapiens
ccgtgccgcctgcactc

SEQ ID NO: 1336820 - DNA, 20 bp, Homo sapiens
ccgtggaggaggaaggcaag

SEQ ID NO: 1336821 - DNA, 14 bp, Homo sapiens
ccgtggggcaggga

SEQ ID NO: 1336822 - DNA, 22 bp, Homo sapiens
ccgtggggcagggagctgggcc

SEQ ID NO: 1336823 - DNA, 20 bp, Homo sapiens
ccgtggggccgccgcctctt

SEQ ID NO: 1336824 - DNA, 22 bp, Homo sapiens
ccgtgtgagaagtgaatgctgg

SEQ ID NO: 1336825 - DNA, 13 bp, Homo sapiens
ccgttagctcctg

SEQ ID NO: 1336826 - DNA, 16 bp, Homo sapiens
cctgaaccgcacagct

SEQ ID NO: 1336827 - DNA, 21 bp, Homo sapiens
cctgaaccgcacagctcagga

SEQ ID NO: 1336828 - DNA, 13 bp, Homo sapiens
cctgaagagcatt

SEQ ID NO: 1336829 - DNA, 14 bp, Homo sapiens
cctgacagaaggtg

SEQ ID NO: 1336830 - DNA, 13 bp, Homo sapiens
cctgacattgtct

SEQ ID NO: 1336831 - DNA, 15 bp, Homo sapiens
cctgaccagctgctc

SEQ ID NO: 1336832 - DNA, 13 bp, Homo sapiens
cctgactggtgct

SEQ ID NO: 1336833 - DNA, 17 bp, Homo sapiens
cctgagaggcaggcata

SEQ ID NO: 1336834 - DNA, 17 bp, Homo sapiens
cctgagccctactccct

SEQ ID NO: 1336835 - DNA, 19 bp, Homo sapiens
cctgagccctactccctgc

SEQ ID NO: 1336836 - DNA, 14 bp, Homo sapiens
cctgagctttctgc

SEQ ID NO: 1336837 - DNA, 14 bp, Homo sapiens
cctgaggctgtggt

SEQ ID NO: 1336838 - DNA, 17 bp, Homo sapiens
cctgaggctgtggtcac

SEQ ID NO: 1336839 - DNA, 19 bp, Homo sapiens
cctgaggtcatcggcgtgg

SEQ ID NO: 1336840 - DNA, 16 bp, Homo sapiens
cctgatgagattttta

SEQ ID NO: 1336841 - DNA, 17 bp, Homo sapiens
cctgatgagatttttaa

SEQ ID NO: 1336842 - DNA, 20 bp, Homo sapiens
cctgcacagtgtcccccagg

SEQ ID NO: 1336843 - DNA, 23 bp, Homo sapiens
cctgcacgtcatgggagggggct

SEQ ID NO: 1336844 - DNA, 14 bp, Homo sapiens
cctgcacttacttg

SEQ ID NO: 1336845 - DNA, 12 bp, Homo sapiens
cctgcagggcca

SEQ ID NO: 1336846 - DNA, 12 bp, Homo sapiens
cctgccaccagg

SEQ ID NO: 1336847 - DNA, 18 bp, Homo sapiens
cctgccaccaggccacct

SEQ ID NO: 1336848 - DNA, 19 bp, Homo sapiens
cctgccaccaggccacctc

SEQ ID NO: 1336849 - DNA, 15 bp, Homo sapiens
cctgccactcactag

SEQ ID NO: 1336850 - DNA, 16 bp, Homo sapiens
cctgccactcactagg

SEQ ID NO: 1336851 - DNA, 21 bp, Homo sapiens
cctgccactcactaggccccc

SEQ ID NO: 1336852 - DNA, 19 bp, Homo sapiens
cctgccaggcaggggtggg

SEQ ID NO: 1336853 - DNA, 16 bp, Homo sapiens
cctgccaggcatggtg

SEQ ID NO: 1336854 - DNA, 13 bp, Homo sapiens
cctgcccagacaa

SEQ ID NO: 1336855 - DNA, 15 bp, Homo sapiens
cctgcccagacaaga

SEQ ID NO: 1336856 - DNA, 14 bp, Homo sapiens
cctgcccccagccc

SEQ ID NO: 1336857 - DNA, 18 bp, Homo sapiens
cctgcccccagccccggg

SEQ ID NO: 1336858 - DNA, 13 bp, Homo sapiens
cctgccctcaagg

SEQ ID NO: 1336859 - DNA, 17 bp, Homo sapiens
cctgccgtcaccaccac

SEQ ID NO: 1336860 - DNA, 18 bp, Homo sapiens
cctgccgtcaccaccacc

SEQ ID NO: 1336861 - DNA, 23 bp, Homo sapiens
cctgccgtcaccaccacccctac

SEQ ID NO: 1336862 - DNA, 16 bp, Homo sapiens
cctgcctcagcctccc

SEQ ID NO: 1336863 - DNA, 15 bp, Homo sapiens
cctgcctcttctcta

SEQ ID NO: 1336864 - DNA, 15 bp, Homo sapiens
cctgcgaccctgggg

SEQ ID NO: 1336865 - DNA, 14 bp, Homo sapiens
cctgcgcctgctgc

SEQ ID NO: 1336866 - DNA, 17 bp, Homo sapiens
cctgcgctctctttgca

SEQ ID NO: 1336867 - DNA, 20 bp, Homo sapiens
cctgcgggtggggcttgggg

SEQ ID NO: 1336868 - DNA, 20 bp, Homo sapiens
cctgcgtcctcctcacctca

SEQ ID NO: 1336869 - DNA, 17 bp, Homo sapiens
cctgctcattatgccac

SEQ ID NO: 1336870 - DNA, 23 bp, Homo sapiens
cctgctcattatgccacttcctt

SEQ ID NO: 1336871 - DNA, 13 bp, Homo sapiens
cctgctccagctg

SEQ ID NO: 1336872 - DNA, 22 bp, Homo sapiens
cctgctccagctgttcagctgg

SEQ ID NO: 1336873 - DNA, 20 bp, Homo sapiens
cctgctgcatgccctctcag

SEQ ID NO: 1336874 - DNA, 14 bp, Homo sapiens
cctgctgctggtgc

SEQ ID NO: 1336875 - DNA, 21 bp, Homo sapiens
cctgctggggatccccgcctg

SEQ ID NO: 1336876 - DNA, 20 bp, Homo sapiens
cctgctgtgattccactaca

SEQ ID NO: 1336877 - DNA, 14 bp, Homo sapiens
cctgcttccaggaa

SEQ ID NO: 1336878 - DNA, 20 bp, Homo sapiens
cctgctttgaataaatgtgt

SEQ ID NO: 1336879 - DNA, 17 bp, Homo sapiens
cctggaagaacaggcct

SEQ ID NO: 1336880 - DNA, 23 bp, Homo sapiens
cctggaagaacaggcctctccat

SEQ ID NO: 1336881 - DNA, 13 bp, Homo sapiens
cctggaccctgtg

SEQ ID NO: 1336882 - DNA, 14 bp, Homo sapiens
cctggaccctgtgg

SEQ ID NO: 1336883 - DNA, 14 bp, Homo sapiens
cctggactgctacc

SEQ ID NO: 1336884 - DNA, 16 bp, Homo sapiens
cctggagatcctcctg

SEQ ID NO: 1336885 - DNA, 16 bp, Homo sapiens
cctggatctaccagca

SEQ ID NO: 1336886 - DNA, 15 bp, Homo sapiens
cctggcactggaccc

SEQ ID NO: 1336887 - DNA, 21 bp, Homo sapiens
cctggcagtccgtgggacggg

SEQ ID NO: 1336888 - DNA, 16 bp, Homo sapiens
ctaagagaagttattt

SEQ ID NO: 1336889 - DNA, 22 bp, Homo sapiens
ctaagagaagttattttctaca

SEQ ID NO: 1336890 - DNA, 17 bp, Homo sapiens
ctaagcagcttattgtt

SEQ ID NO: 1336891 - DNA, 13 bp, Homo sapiens
ctaaggtcctaag

SEQ ID NO: 1336892 - DNA, 17 bp, Homo sapiens
ctaataagctagttgaa

SEQ ID NO: 1336893 - DNA, 21 bp, Homo sapiens
ctaataatcttgtttctgaaa

SEQ ID NO: 1336894 - DNA, 15 bp, Homo sapiens
ctaatatatatgaat

SEQ ID NO: 1336895 - DNA, 18 bp, Homo sapiens
ctaatatatatgaataaa

SEQ ID NO: 1336896 - DNA, 21 bp, Homo sapiens
ctaatcacagtttttcctgga

SEQ ID NO: 1336897 - DNA, 22 bp, Homo sapiens
ctaatcacagtttttcctggaa

SEQ ID NO: 1336898 - DNA, 15 bp, Homo sapiens
ctaatcaccatgtaa

SEQ ID NO: 1336899 - DNA, 17 bp, Homo sapiens
ctaattaaccttactaa

SEQ ID NO: 1336900 - DNA, 17 bp, Homo sapiens
ctaattaactgaaacat

SEQ ID NO: 1336901 - DNA, 18 bp, Homo sapiens
ctaattatactactttgt

SEQ ID NO: 1336902 - DNA, 18 bp, Homo sapiens
ctaattatttaattgtcc

SEQ ID NO: 1336903 - DNA, 20 bp, Homo sapiens
ctaatttctcctcccttcct

SEQ ID NO: 1336904 - DNA, 20 bp, Homo sapiens
ctaattttacatgtttataa

SEQ ID NO: 1336905 - DNA, 12 bp, Homo sapiens
ctacacctggct

SEQ ID NO: 1336906 - DNA, 23 bp, Homo sapiens
ctacacttcgcaccggagtgtct

SEQ ID NO: 1336907 - DNA, 22 bp, Homo sapiens
ctacagtattactcttacaaga

SEQ ID NO: 1336908 - DNA, 14 bp, Homo sapiens
ctacagtggtttta

SEQ ID NO: 1336909 - DNA, 19 bp, Homo sapiens
ctacatatcccttccagat

SEQ ID NO: 1336910 - DNA, 15 bp, Homo sapiens
ctacatgctggggtc

SEQ ID NO: 1336911 - DNA, 17 bp, Homo sapiens
ctaccctcttagaaaaa

SEQ ID NO: 1336912 - DNA, 15 bp, Homo sapiens
ctaccgacccagggt

SEQ ID NO: 1336913 - DNA, 12 bp, Homo sapiens
ctacctgccctc

SEQ ID NO: 1336914 - DNA, 20 bp, Homo sapiens
ctacctgtatttaaaaatag

SEQ ID NO: 1336915 - DNA, 21 bp, Homo sapiens
ctacctgtatttaaaaataga

SEQ ID NO: 1336916 - DNA, 20 bp, Homo sapiens
ctacgtttctttaaccttgt

SEQ ID NO: 1336917 - DNA, 15 bp, Homo sapiens
ctactagattgacta

SEQ ID NO: 1336918 - DNA, 16 bp, Homo sapiens
ctactagcaaaataaa

SEQ ID NO: 1336919 - DNA, 20 bp, Homo sapiens
ctactagcaaaataaaacat

SEQ ID NO: 1336920 - DNA, 13 bp, Homo sapiens
ctactccctgcag

SEQ ID NO: 1336921 - DNA, 19 bp, Homo sapiens
ctactgcactccagcctgg

SEQ ID NO: 1336922 - DNA, 17 bp, Homo sapiens
ctactgcatttagggag

SEQ ID NO: 1336923 - DNA, 17 bp, Homo sapiens
ctactgtcaaatgatgt

SEQ ID NO: 1336924 - DNA, 21 bp, Homo sapiens
ctactgtcaaatgatgtgcaa

SEQ ID NO: 1336925 - DNA, 19 bp, Homo sapiens
ctagaaattccccaccctg

SEQ ID NO: 1336926 - DNA, 20 bp, Homo sapiens
ctagaaattgacacaagtgg

SEQ ID NO: 1336927 - DNA, 13 bp, Homo sapiens
ctagaaattttca

SEQ ID NO: 1336928 - DNA, 20 bp, Homo sapiens
ctagaagccaagggaaaggg

SEQ ID NO: 1336929 - DNA, 22 bp, Homo sapiens
ctagactcggggtgcttccttg

SEQ ID NO: 1336930 - DNA, 23 bp, Homo sapiens
ctagcagcccaccctgctgctgg

SEQ ID NO: 1336931 - DNA, 19 bp, Homo sapiens
ctagccggttcctgtccct

SEQ ID NO: 1336932 - DNA, 14 bp, Homo sapiens
ctagctaattattt

SEQ ID NO: 1336933 - DNA, 15 bp, Homo sapiens
ctagcttctgctttt

SEQ ID NO: 1336934 - DNA, 14 bp, Homo sapiens
ctaggaaactcaca

SEQ ID NO: 1336935 - DNA, 22 bp, Homo sapiens
ctaggatagctaactgtaaatc

SEQ ID NO: 1336936 - DNA, 13 bp, Homo sapiens
ctaggcccccact

SEQ ID NO: 1336937 - DNA, 16 bp, Homo sapiens
ctaggcccccacttgc

SEQ ID NO: 1336938 - DNA, 20 bp, Homo sapiens
ctaggcccccacttgcctct

SEQ ID NO: 1336939 - DNA, 23 bp, Homo sapiens
ctaggcccccacttgcctcttcc

SEQ ID NO: 1336940 - DNA, 12 bp, Homo sapiens
ctaggcctgggg

SEQ ID NO: 1336941 - DNA, 12 bp, Homo sapiens
ctaggtctccag

SEQ ID NO: 1336942 - DNA, 13 bp, Homo sapiens
ctaggtctccagt

SEQ ID NO: 1336943 - DNA, 20 bp, Homo sapiens
ctagtcaacagtaccctggt

SEQ ID NO: 1336944 - DNA, 14 bp, Homo sapiens
ctagtcatatatta

SEQ ID NO: 1336945 - DNA, 16 bp, Homo sapiens
ctagtgaaacttttct

SEQ ID NO: 1336946 - DNA, 15 bp, Homo sapiens
ctagtggggtttcct

SEQ ID NO: 1336947 - DNA, 18 bp, Homo sapiens
ctagtggggtttcctggc

SEQ ID NO: 1336948 - DNA, 23 bp, Homo sapiens
ctagttaccacattactctgcct

SEQ ID NO: 1336949 - DNA, 17 bp, Homo sapiens
ctagttgaatacttgaa

SEQ ID NO: 1336950 - DNA, 20 bp, Homo sapiens
ctagtttgtgagaaacatct

SEQ ID NO: 1336951 - DNA, 13 bp, Homo sapiens
ctataaaatagat

SEQ ID NO: 1336952 - DNA, 21 bp, Homo sapiens
ctataaaatagatataaattt

SEQ ID NO: 1336953 - DNA, 17 bp, Homo sapiens
ctatagcatcacttaaa

SEQ ID NO: 1336954 - DNA, 20 bp, Homo sapiens
ctatagcatcacttaaaaca

SEQ ID NO: 1336955 - DNA, 15 bp, Homo sapiens
ctatagcttgcagaa

SEQ ID NO: 1336956 - DNA, 19 bp, Homo sapiens
ctatataagacaagaactc

SEQ ID NO: 1336957 - DNA, 20 bp, Homo sapiens
ctatataatttatttccact

SEQ ID NO: 1336958 - DNA, 15 bp, Homo sapiens
ctatatataaaacgg

SEQ ID NO: 1336959 - DNA, 22 bp, Homo sapiens
ctatatataaaacggtgctgtg

SEQ ID NO: 1336960 - DNA, 14 bp, Homo sapiens
ctatatatataaat

SEQ ID NO: 1336961 - DNA, 14 bp, Homo sapiens
ctatatatttctat

SEQ ID NO: 1336962 - DNA, 22 bp, Homo sapiens
ctcttgagctggcctctctagc

SEQ ID NO: 1336963 - DNA, 23 bp, Homo sapiens
ctcttgagtttgtcgctcatgtg

SEQ ID NO: 1336964 - DNA, 15 bp, Homo sapiens
ctcttgcccatcctg

SEQ ID NO: 1336965 - DNA, 23 bp, Homo sapiens
ctctttaaaaggaaagaaaacat

SEQ ID NO: 1336966 - DNA, 22 bp, Homo sapiens
ctctttccagtggatcataaga

SEQ ID NO: 1336967 - DNA, 16 bp, Homo sapiens
ctctttccctaggaaa

SEQ ID NO: 1336968 - DNA, 13 bp, Homo sapiens
ctctttgattatt

SEQ ID NO: 1336969 - DNA, 21 bp, Homo sapiens
ctctttgattatttgcatgtt

SEQ ID NO: 1336970 - DNA, 15 bp, Homo sapiens
ctctttggacactca

SEQ ID NO: 1336971 - DNA, 13 bp, Homo sapiens
ctctttttgtttg

SEQ ID NO: 1336972 - DNA, 22 bp, Homo sapiens
ctgaaaacaatggagtattctc

SEQ ID NO: 1336973 - DNA, 23 bp, Homo sapiens
ctgaaaattggacagattgcctg

SEQ ID NO: 1336974 - DNA, 12 bp, Homo sapiens
ctgaaactatat

SEQ ID NO: 1336975 - DNA, 23 bp, Homo sapiens
ctgaaagccctgagctttctgct

SEQ ID NO: 1336976 - DNA, 16 bp, Homo sapiens
ctgaaagtagggggct

SEQ ID NO: 1336977 - DNA, 16 bp, Homo sapiens
ctgaaataggaaacaa

SEQ ID NO: 1336978 - DNA, 23 bp, Homo sapiens
ctgaaatcttcccatgcattctg

SEQ ID NO: 1336979 - DNA, 15 bp, Homo sapiens
ctgaaccacttgtag

SEQ ID NO: 1336980 - DNA, 12 bp, Homo sapiens
ctgaaccatgtg

SEQ ID NO: 1336981 - DNA, 15 bp, Homo sapiens
ctgaaccgcacagct

SEQ ID NO: 1336982 - DNA, 18 bp, Homo sapiens
ctgaaccgcacagctcag

SEQ ID NO: 1336983 - DNA, 20 bp, Homo sapiens
ctgaacttaataactgtgta

SEQ ID NO: 1336984 - DNA, 13 bp, Homo sapiens
ctgaagaattgaa

SEQ ID NO: 1336985 - DNA, 15 bp, Homo sapiens
ctgaagatgggagcc

SEQ ID NO: 1336986 - DNA, 17 bp, Homo sapiens
ctgaagatgggagcctt

SEQ ID NO: 1336987 - DNA, 15 bp, Homo sapiens
ctgaagcagcctctc

SEQ ID NO: 1336988 - DNA, 18 bp, Homo sapiens
ctgaaggaaaaacacaag

SEQ ID NO: 1336989 - DNA, 17 bp, Homo sapiens
ctgaagttgcagatgtt

SEQ ID NO: 1336990 - DNA, 23 bp, Homo sapiens
ctgaagtttttttgctgctgcct

SEQ ID NO: 1336991 - DNA, 14 bp, Homo sapiens
ctgaatttttttgt

SEQ ID NO: 1336992 - DNA, 18 bp, Homo sapiens
ctgaatttttttgtaata

SEQ ID NO: 1336993 - DNA, 21 bp, Homo sapiens
ctgacagaaggtgccacttta

SEQ ID NO: 1336994 - DNA, 16 bp, Homo sapiens
ctgacagagggatgga

SEQ ID NO: 1336995 - DNA, 16 bp, Homo sapiens
ctgacatctggaatct

SEQ ID NO: 1336996 - DNA, 17 bp, Homo sapiens
ctgaccacttgaggcct

SEQ ID NO: 1336997 - DNA, 13 bp, Homo sapiens
ctgaccagctgct

SEQ ID NO: 1336998 - DNA, 19 bp, Homo sapiens
ctgaccagctgctccgagg

SEQ ID NO: 1336999 - DNA, 22 bp, Homo sapiens
ctgaccatattgtgcttcacag

SEQ ID NO: 1337000 - DNA, 22 bp, Homo sapiens
ctgaccatgctcatctgctggt

SEQ ID NO: 1337001 - DNA, 16 bp, Homo sapiens
ctgactggtgctgcag

SEQ ID NO: 1337002 - DNA, 16 bp, Homo sapiens
ctgactgttttctctt

SEQ ID NO: 1337003 - DNA, 11 bp, Homo sapiens
ctgacttctgc

SEQ ID NO: 1337004 - DNA, 14 bp, Homo sapiens
ctgacttctgcctg

SEQ ID NO: 1337005 - DNA, 12 bp, Homo sapiens
ctgagaaaacaa

SEQ ID NO: 1337006 - DNA, 21 bp, Homo sapiens
ctgagactttcagtgcactgt

SEQ ID NO: 1337007 - DNA, 14 bp, Homo sapiens
ctgagaggcaggca

SEQ ID NO: 1337008 - DNA, 22 bp, Homo sapiens
ctgagccctactccctgcagat

SEQ ID NO: 1337009 - DNA, 23 bp, Homo sapiens
ctgagccggccccaggctcgtgg

SEQ ID NO: 1337010 - DNA, 12 bp, Homo sapiens
ctgagcctctgc

SEQ ID NO: 1337011 - DNA, 18 bp, Homo sapiens
ctgagcctctgctcccca

SEQ ID NO: 1337012 - DNA, 13 bp, Homo sapiens
ctgagcgcctcca

SEQ ID NO: 1337013 - DNA, 22 bp, Homo sapiens
ctgagcgcctccatccaaggcc

SEQ ID NO: 1337014 - DNA, 14 bp, Homo sapiens
ctgagctgccagtg

SEQ ID NO: 1337015 - DNA, 21 bp, Homo sapiens
ctgaggaaattgctttgtatt

SEQ ID NO: 1337016 - DNA, 22 bp, Homo sapiens
ctgaggatattcagatgtatgt

SEQ ID NO: 1337017 - DNA, 13 bp, Homo sapiens
ctgaggcaggaga

SEQ ID NO: 1337018 - DNA, 19 bp, Homo sapiens
ctgaggctgtggtcacagc

SEQ ID NO: 1337019 - DNA, 20 bp, Homo sapiens
ctgaggctgtggtcacagcg

SEQ ID NO: 1337020 - DNA, 18 bp, Homo sapiens
ctgagggaaatgttttgt

SEQ ID NO: 1337021 - DNA, 13 bp, Homo sapiens
ctgaggtgggagg

SEQ ID NO: 1337022 - DNA, 22 bp, Homo sapiens
ctgaggtgggaggatctcttga

SEQ ID NO: 1337023 - DNA, 19 bp, Homo sapiens
ctgaggttcctctgcctgc

SEQ ID NO: 1337024 - DNA, 21 bp, Homo sapiens
ctgaggttcctctgcctgccc

SEQ ID NO: 1337025 - DNA, 22 bp, Homo sapiens
ctgagtctgggcagctgtccct

SEQ ID NO: 1337026 - DNA, 13 bp, Homo sapiens
ctgagtgggaagc

SEQ ID NO: 1337027 - DNA, 15 bp, Homo sapiens
ctgagtgggaagccc

SEQ ID NO: 1337028 - DNA, 17 bp, Homo sapiens
ctgagtgggaagcccat

SEQ ID NO: 1337029 - DNA, 22 bp, Homo sapiens
ctgagtgggggatcacagcctc

SEQ ID NO: 1337030 - DNA, 11 bp, Homo sapiens
ctgatctgccc

SEQ ID NO: 1337031 - DNA, 13 bp, Homo sapiens
ctgatctgcccat

SEQ ID NO: 1337032 - DNA, 16 bp, Homo sapiens
ctgatctgcccatcgt

SEQ ID NO: 1337033 - DNA, 18 bp, Homo sapiens
ctgatggaatttttttgt

SEQ ID NO: 1337034 - DNA, 19 bp, Homo sapiens
ctgatgtcaatttctgtgt

SEQ ID NO: 1337035 - DNA, 20 bp, Homo sapiens
ctgatgtcaatttctgtgtt

SEQ ID NO: 1337036 - DNA, 16 bp, Homo sapiens
ctgattataggatttt

SEQ ID NO: 1337037 - DNA, 15 bp, Homo sapiens
ctgattctggcttta

SEQ ID NO: 1337038 - DNA, 19 bp, Homo sapiens
ctgattctggctttaagcc

SEQ ID NO: 1337039 - DNA, 22 bp, Homo sapiens
ctgattctggctttaagccttc

SEQ ID NO: 1337040 - DNA, 13 bp, Homo sapiens
ctgatttcttttc

SEQ ID NO: 1337041 - DNA, 22 bp, Homo sapiens
ctgatttgcaataaaaatgata

SEQ ID NO: 1337042 - DNA, 22 bp, Homo sapiens
ctgcaaacaccaacatgttggg

SEQ ID NO: 1337043 - DNA, 18 bp, Homo sapiens
ctgcaagaattgaagcag

SEQ ID NO: 1337044 - DNA, 20 bp, Homo sapiens
ctgcaagaattgaagcagga

SEQ ID NO: 1337045 - DNA, 18 bp, Homo sapiens
ctgcaatatttgaatttt

SEQ ID NO: 1337046 - DNA, 19 bp, Homo sapiens
ctgcaattccctggataga

SEQ ID NO: 1337047 - DNA, 23 bp, Homo sapiens
ctgcacatgactcgggggtgggg

SEQ ID NO: 1337048 - DNA, 20 bp, Homo sapiens
ctgcaccccttctctcctcc

SEQ ID NO: 1337049 - DNA, 16 bp, Homo sapiens
ctgcaccctcaggcag

SEQ ID NO: 1337050 - DNA, 17 bp, Homo sapiens
ctgcaccctcaggcagg

SEQ ID NO: 1337051 - DNA, 13 bp, Homo sapiens
ctgcactccagcc

SEQ ID NO: 1337052 - DNA, 14 bp, Homo sapiens
ctgcactccagcct

SEQ ID NO: 1337053 - DNA, 15 bp, Homo sapiens
ctgcactccagcctg

SEQ ID NO: 1337054 - DNA, 16 bp, Homo sapiens
ctgcactccagcctgg

SEQ ID NO: 1337055 - DNA, 18 bp, Homo sapiens
ctgcactccagcctgggt

SEQ ID NO: 1337056 - DNA, 20 bp, Homo sapiens
ctgcactccagcctgggtga

SEQ ID NO: 1337057 - DNA, 14 bp, Homo sapiens
ctgcactcctcagg

SEQ ID NO: 1337058 - DNA, 15 bp, Homo sapiens
ctgcactcctcaggg

SEQ ID NO: 1337059 - DNA, 16 bp, Homo sapiens
ctgcacttacttgctt

SEQ ID NO: 1337060 - DNA, 15 bp, Homo sapiens
ctgcagaccacgccc

SEQ ID NO: 1337061 - DNA, 14 bp, Homo sapiens
ctgcagagatttct

SEQ ID NO: 1337062 - DNA, 11 bp, Homo sapiens
ctgcagaggcc

SEQ ID NO: 1337063 - DNA, 17 bp, Homo sapiens
ctgcagaggccagaggc

SEQ ID NO: 1337064 - DNA, 20 bp, Homo sapiens
ctgcagaggccagaggcccc

SEQ ID NO: 1337065 - DNA, 23 bp, Homo sapiens
ctgcaggacttgagaagacctca

SEQ ID NO: 1337066 - DNA, 21 bp, Homo sapiens
ctgcaggccctggcctcccct

SEQ ID NO: 1337067 - DNA, 19 bp, Homo sapiens
ctgcagggccatggctcag

SEQ ID NO: 1337068 - DNA, 23 bp, Homo sapiens
ctgcagggccatggctcagggtg

SEQ ID NO: 1337069 - DNA, 22 bp, Homo sapiens
ctgcaggtcaagttgtcaggtt

SEQ ID NO: 1337070 - DNA, 18 bp, Homo sapiens
ctgcagttctactcaggc

SEQ ID NO: 1337071 - DNA, 20 bp, Homo sapiens
ctgcagttctactcaggctg

SEQ ID NO: 1337072 - DNA, 22 bp, Homo sapiens
ctgcataaaaaggtctttaaaa

SEQ ID NO: 1337073 - DNA, 19 bp, Homo sapiens
ctgcatgccctctcaggcc

SEQ ID NO: 1337074 - DNA, 20 bp, Homo sapiens
ctgcatgccctctcaggccg

SEQ ID NO: 1337075 - DNA, 21 bp, Homo sapiens
ctgcatgccctctcaggccgg

SEQ ID NO: 1337076 - DNA, 23 bp, Homo sapiens
ctgcatttagggagtattctaat

SEQ ID NO: 1337077 - DNA, 23 bp, Homo sapiens
ctgccaccaggccacctccccag

SEQ ID NO: 1337078 - DNA, 16 bp, Homo sapiens
ctgccactcactaggc

SEQ ID NO: 1337079 - DNA, 19 bp, Homo sapiens
ctgccagcagcagcaggtg

SEQ ID NO: 1337080 - DNA, 17 bp, Homo sapiens
ctgccagccttgagccc

SEQ ID NO: 1337081 - DNA, 21 bp, Homo sapiens
ctgccagccttgagccctggc

SEQ ID NO: 1337082 - DNA, 18 bp, Homo sapiens
gtagttctgtatttgaaa

SEQ ID NO: 1337083 - DNA, 14 bp, Homo sapiens
gtagttctttaaac

SEQ ID NO: 1337084 - DNA, 17 bp, Homo sapiens
gtagttctttaaactgt

SEQ ID NO: 1337085 - DNA, 12 bp, Homo sapiens
gtataaaataca

SEQ ID NO: 1337086 - DNA, 18 bp, Homo sapiens
gtataaaatacatagtga

SEQ ID NO: 1337087 - DNA, 12 bp, Homo sapiens
gtataatataaa

SEQ ID NO: 1337088 - DNA, 14 bp, Homo sapiens
gtatagttatgtaa

SEQ ID NO: 1337089 - DNA, 18 bp, Homo sapiens
gtatagttatgtaaataa

SEQ ID NO: 1337090 - DNA, 18 bp, Homo sapiens
gtatatatacatatatat

SEQ ID NO: 1337091 - DNA, 13 bp, Homo sapiens
gtatattacaatg

SEQ ID NO: 1337092 - DNA, 17 bp, Homo sapiens
gtatattacaatgatca

SEQ ID NO: 1337093 - DNA, 18 bp, Homo sapiens
gtatattacaatgatcac

SEQ ID NO: 1337094 - DNA, 22 bp, Homo sapiens
gtatattgtataggggcaactg

SEQ ID NO: 1337095 - DNA, 14 bp, Homo sapiens
gtatcatatattta

SEQ ID NO: 1337096 - DNA, 15 bp, Homo sapiens
gtatccatattttat

SEQ ID NO: 1337097 - DNA, 14 bp, Homo sapiens
gtatccccccatct

SEQ ID NO: 1337098 - DNA, 17 bp, Homo sapiens
gtatccccccatcttgc

SEQ ID NO: 1337099 - DNA, 18 bp, Homo sapiens
gtatcctgggggacccaa

SEQ ID NO: 1337100 - DNA, 16 bp, Homo sapiens
gtatctccggctccca

SEQ ID NO: 1337101 - DNA, 20 bp, Homo sapiens
gtatctccggctcccagcct

SEQ ID NO: 1337102 - DNA, 22 bp, Homo sapiens
gtatctccggctcccagcctca

SEQ ID NO: 1337103 - DNA, 17 bp, Homo sapiens
gtatgaaaacatggaac

SEQ ID NO: 1337104 - DNA, 18 bp, Homo sapiens
gtatggactatctgtctg

SEQ ID NO: 1337105 - DNA, 16 bp, Homo sapiens
gtatgtagaagcatga

SEQ ID NO: 1337106 - DNA, 13 bp, Homo sapiens
gtatgtattattt

SEQ ID NO: 1337107 - DNA, 20 bp, Homo sapiens
gtatgtttctctttgattat

SEQ ID NO: 1337108 - DNA, 16 bp, Homo sapiens
gtatttaaaaatagaa

SEQ ID NO: 1337109 - DNA, 20 bp, Homo sapiens
gtatttaaaaatagaaacat

SEQ ID NO: 1337110 - DNA, 17 bp, Homo sapiens
gtatttaacagaaattg

SEQ ID NO: 1337111 - DNA, 14 bp, Homo sapiens
gtatttatttatgt

SEQ ID NO: 1337112 - DNA, 16 bp, Homo sapiens
gtatttatttatgtac

SEQ ID NO: 1337113 - DNA, 17 bp, Homo sapiens
gtatttgaaagtgcctt

SEQ ID NO: 1337114 - DNA, 21 bp, Homo sapiens
gtatttttagaataagaattt

SEQ ID NO: 1337115 - DNA, 13 bp, Homo sapiens
gtatttttcttga

SEQ ID NO: 1337116 - DNA, 22 bp, Homo sapiens
gtatttttttttctaagagaag

SEQ ID NO: 1337117 - DNA, 19 bp, Homo sapiens
gtcaagtgaaaaaggagga

SEQ ID NO: 1337118 - DNA, 15 bp, Homo sapiens
gtcaagttgtcaggt

SEQ ID NO: 1337119 - DNA, 22 bp, Homo sapiens
gtcaatttctgtgttgccaagc

SEQ ID NO: 1337120 - DNA, 19 bp, Homo sapiens
gtcaccaccacccctacca

SEQ ID NO: 1337121 - DNA, 20 bp, Homo sapiens
gtcaccaccacccctaccac

SEQ ID NO: 1337122 - DNA, 16 bp, Homo sapiens
gtcaccagagacttta

SEQ ID NO: 1337123 - DNA, 19 bp, Homo sapiens
gtcactatgggatgagaaa

SEQ ID NO: 1337124 - DNA, 20 bp, Homo sapiens
gtcactcattgctgagcctc

SEQ ID NO: 1337125 - DNA, 18 bp, Homo sapiens
gtcagacagaacttgaat

SEQ ID NO: 1337126 - DNA, 13 bp, Homo sapiens
gtcagatgtttaa

SEQ ID NO: 1337127 - DNA, 15 bp, Homo sapiens
gtcagatgtttaaaa

SEQ ID NO: 1337128 - DNA, 19 bp, Homo sapiens
gtcagatgtttaaaacacc

SEQ ID NO: 1337129 - DNA, 23 bp, Homo sapiens
gtcagcagttgctggtaaaatga

SEQ ID NO: 1337130 - DNA, 19 bp, Homo sapiens
gtcagccaggaccataccg

SEQ ID NO: 1337131 - DNA, 20 bp, Homo sapiens
gtcagctgctccctggcatt

SEQ ID NO: 1337132 - DNA, 14 bp, Homo sapiens
gtcaggtgaccctg

SEQ ID NO: 1337133 - DNA, 14 bp, Homo sapiens
gtcagtatgacatt

SEQ ID NO: 1337134 - DNA, 18 bp, Homo sapiens
gtcatactcgagtctgag

SEQ ID NO: 1337135 - DNA, 20 bp, Homo sapiens
gtccaaaaagctcctggggc

SEQ ID NO: 1337136 - DNA, 16 bp, Homo sapiens
gtccaaccagacctgg

SEQ ID NO: 1337137 - DNA, 15 bp, Homo sapiens
gtccaccctgcctgc

SEQ ID NO: 1337138 - DNA, 16 bp, Homo sapiens
gtccacgcgtgccgtg

SEQ ID NO: 1337139 - DNA, 22 bp, Homo sapiens
gtccacgcgtgccgtggcacca

SEQ ID NO: 1337140 - DNA, 19 bp, Homo sapiens
gtccagcaccttgtgcctg

SEQ ID NO: 1337141 - DNA, 14 bp, Homo sapiens
gtccagcctgcccc

SEQ ID NO: 1337142 - DNA, 12 bp, Homo sapiens
gtccagctctgg

SEQ ID NO: 1337143 - DNA, 13 bp, Homo sapiens
gtccagctctgga

SEQ ID NO: 1337144 - DNA, 21 bp, Homo sapiens
gtccagctctggaggggaggg

SEQ ID NO: 1337145 - DNA, 21 bp, Homo sapiens
gtccagctgcccttccgcagt

SEQ ID NO: 1337146 - DNA, 12 bp, Homo sapiens
gtccagctggcc

SEQ ID NO: 1337147 - DNA, 18 bp, Homo sapiens
gtccagctggcctggaca

SEQ ID NO: 1337148 - DNA, 15 bp, Homo sapiens
gtccatacactttgt

SEQ ID NO: 1337149 - DNA, 22 bp, Homo sapiens
gtccccaaccgtgtctgtctgg

SEQ ID NO: 1337150 - DNA, 19 bp, Homo sapiens
gtggccccaccctgggccc

SEQ ID NO: 1337151 - DNA, 21 bp, Homo sapiens
gtggccccaccctgggccctg

SEQ ID NO: 1337152 - DNA, 23 bp, Homo sapiens
gtggccccaccctgggccctggg

SEQ ID NO: 1337153 - DNA, 18 bp, Homo sapiens
gtggcctgtggctgtcgg

SEQ ID NO: 1337154 - DNA, 17 bp, Homo sapiens
gtggcgccgtctccagg

SEQ ID NO: 1337155 - DNA, 18 bp, Homo sapiens
gtggcgtgggagccagcc

SEQ ID NO: 1337156 - DNA, 20 bp, Homo sapiens
gtggctctgggatcctgggg

SEQ ID NO: 1337157 - DNA, 22 bp, Homo sapiens
gtggctggaaccacattgaaga

SEQ ID NO: 1337158 - DNA, 20 bp, Homo sapiens
gtgggacggtgcccaagcca

SEQ ID NO: 1337159 - DNA, 12 bp, Homo sapiens
gtgggcccaccc

SEQ ID NO: 1337160 - DNA, 22 bp, Homo sapiens
gtgggcccacccggtgggaccc

SEQ ID NO: 1337161 - DNA, 13 bp, Homo sapiens
gtggggcagggag

SEQ ID NO: 1337162 - DNA, 14 bp, Homo sapiens
gtggggcagggagc

SEQ ID NO: 1337163 - DNA, 17 bp, Homo sapiens
gtggggccgccgcctct

SEQ ID NO: 1337164 - DNA, 14 bp, Homo sapiens
gtgggggagggagg

SEQ ID NO: 1337165 - DNA, 20 bp, Homo sapiens
gtgggggtggaggcttcctg

SEQ ID NO: 1337166 - DNA, 19 bp, Homo sapiens
gtggggtgtgctgggagct

SEQ ID NO: 1337167 - DNA, 12 bp, Homo sapiens
gtggtagaaaca

SEQ ID NO: 1337168 - DNA, 22 bp, Homo sapiens
gtggtcacagcggaggtgtgga

SEQ ID NO: 1337169 - DNA, 23 bp, Homo sapiens
gtggtctcttcttggggcccagt

SEQ ID NO: 1337170 - DNA, 21 bp, Homo sapiens
gtggtctgttggcaggctggc

SEQ ID NO: 1337171 - DNA, 15 bp, Homo sapiens
gtggtggaagggtag

SEQ ID NO: 1337172 - DNA, 18 bp, Homo sapiens
gtggtggcccacgcctgt

SEQ ID NO: 1337173 - DNA, 18 bp, Homo sapiens
gtggttgaatatgattaa

SEQ ID NO: 1337174 - DNA, 20 bp, Homo sapiens
gtggttttatactgaaggaa

SEQ ID NO: 1337175 - DNA, 17 bp, Homo sapiens
gtgtaaaatattttgaa

SEQ ID NO: 1337176 - DNA, 16 bp, Homo sapiens
gtgtaactcccagtga

SEQ ID NO: 1337177 - DNA, 21 bp, Homo sapiens
gtgtaacttgcttaaatttct

SEQ ID NO: 1337178 - DNA, 14 bp, Homo sapiens
gtgtaatttgaaga

SEQ ID NO: 1337179 - DNA, 17 bp, Homo sapiens
gtgtatatttgatttat

SEQ ID NO: 1337180 - DNA, 14 bp, Homo sapiens
gtgtatgcacagta

SEQ ID NO: 1337181 - DNA, 19 bp, Homo sapiens
gtgtattctagttttgtca

SEQ ID NO: 1337182 - DNA, 14 bp, Homo sapiens
gtgtccggtccctg

SEQ ID NO: 1337183 - DNA, 18 bp, Homo sapiens
gtgtctcactaaagcatg

SEQ ID NO: 1337184 - DNA, 23 bp, Homo sapiens
gtgtcttgggcagagctggctct

SEQ ID NO: 1337185 - DNA, 15 bp, Homo sapiens
gtgtgaacttggaag

SEQ ID NO: 1337186 - DNA, 22 bp, Homo sapiens
gtgtgacaattctgtttttaat

SEQ ID NO: 1337187 - DNA, 21 bp, Homo sapiens
gtgtgagaagtgaatgctggg

SEQ ID NO: 1337188 - DNA, 12 bp, Homo sapiens
gtgtgctgggag

SEQ ID NO: 1337189 - DNA, 13 bp, Homo sapiens
gtgtggccaggct

SEQ ID NO: 1337190 - DNA, 14 bp, Homo sapiens
gtgtgtcccaggca

SEQ ID NO: 1337191 - DNA, 18 bp, Homo sapiens
gtgtgtcccaggcaggga

SEQ ID NO: 1337192 - DNA, 15 bp, Homo sapiens
gtgtgtgtgtgtgca

SEQ ID NO: 1337193 - DNA, 14 bp, Homo sapiens
gtgtgttgtctctt

SEQ ID NO: 1337194 - DNA, 14 bp, Homo sapiens
gtgttagtggcacc

SEQ ID NO: 1337195 - DNA, 18 bp, Homo sapiens
gtgttgccaagctccaag

SEQ ID NO: 1337196 - DNA, 15 bp, Homo sapiens
gtgtttagaattgaa

SEQ ID NO: 1337197 - DNA, 14 bp, Homo sapiens
gtgtttataaaata

SEQ ID NO: 1337198 - DNA, 22 bp, Homo sapiens
gtgtttataaaatataaacaaa

SEQ ID NO: 1337199 - DNA, 17 bp, Homo sapiens
gtgtttttttatttcta

SEQ ID NO: 1337200 - DNA, 14 bp, Homo sapiens
gttaaacattgaag

SEQ ID NO: 1337201 - DNA, 15 bp, Homo sapiens
gttaaagagaatgag

SEQ ID NO: 1337202 - DNA, 21 bp, Homo sapiens
gttaaagggatatttttttct

SEQ ID NO: 1337203 - DNA, 15 bp, Homo sapiens
gttaacatcagtttt

SEQ ID NO: 1337204 - DNA, 17 bp, Homo sapiens
gttaactgatttgcaat

SEQ ID NO: 1337205 - DNA, 13 bp, Homo sapiens
gttaatttaagtt

SEQ ID NO: 1337206 - DNA, 15 bp, Homo sapiens
gttactctcttgcac

SEQ ID NO: 1337207 - DNA, 15 bp, Homo sapiens
taactgtcctgtcct

SEQ ID NO: 1337208 - DNA, 17 bp, Homo sapiens
taactgtcctgtcctgc

SEQ ID NO: 1337209 - DNA, 13 bp, Homo sapiens
taacttaataatc

SEQ ID NO: 1337210 - DNA, 14 bp, Homo sapiens
taacttaataatca

SEQ ID NO: 1337211 - DNA, 17 bp, Homo sapiens
taacttaataatcaaga

SEQ ID NO: 1337212 - DNA, 21 bp, Homo sapiens
taacttaataatcaagagcct

SEQ ID NO: 1337213 - DNA, 14 bp, Homo sapiens
taactttacagaaa

SEQ ID NO: 1337214 - DNA, 16 bp, Homo sapiens
taactttataaatcca

SEQ ID NO: 1337215 - DNA, 15 bp, Homo sapiens
taagaaggcaatatt

SEQ ID NO: 1337216 - DNA, 17 bp, Homo sapiens
taagaaggcaatattaa

SEQ ID NO: 1337217 - DNA, 20 bp, Homo sapiens
taagaaggcaatattaacct

SEQ ID NO: 1337218 - DNA, 23 bp, Homo sapiens
taagaataccacatcaaataaga

SEQ ID NO: 1337219 - DNA, 13 bp, Homo sapiens
taagaattctgat

SEQ ID NO: 1337220 - DNA, 23 bp, Homo sapiens
taagactatatatataaatgtat

SEQ ID NO: 1337221 - DNA, 15 bp, Homo sapiens
taagagaagttgtaa

SEQ ID NO: 1337222 - DNA, 13 bp, Homo sapiens
taagatcactgtt

SEQ ID NO: 1337223 - DNA, 17 bp, Homo sapiens
taagatcactgtttaga

SEQ ID NO: 1337224 - DNA, 22 bp, Homo sapiens
taagattgatatctataaaata

SEQ ID NO: 1337225 - DNA, 21 bp, Homo sapiens
taagccaaaattaaggtgttt

SEQ ID NO: 1337226 - DNA, 16 bp, Homo sapiens
taagcgtatggcttta

SEQ ID NO: 1337227 - DNA, 21 bp, Homo sapiens
taagctagttgaatacttgaa

SEQ ID NO: 1337228 - DNA, 10 bp, Homo sapiens
taagctgcaa

SEQ ID NO: 1337229 - DNA, 23 bp, Homo sapiens
taagctgcaaatctgatggcctt

SEQ ID NO: 1337230 - DNA, 18 bp, Homo sapiens
taaggaaaactacctgta

SEQ ID NO: 1337231 - DNA, 21 bp, Homo sapiens
taaggacaaagtgccaaagaa

SEQ ID NO: 1337232 - DNA, 23 bp, Homo sapiens
taaggacaaagtgccaaagaaag

SEQ ID NO: 1337233 - DNA, 18 bp, Homo sapiens
taaggactgactgaggca

SEQ ID NO: 1337234 - DNA, 16 bp, Homo sapiens
taaggcctgtgggggg

SEQ ID NO: 1337235 - DNA, 11 bp, Homo sapiens
taagggaaaaa

SEQ ID NO: 1337236 - DNA, 12 bp, Homo sapiens
taaggtgtttga

SEQ ID NO: 1337237 - DNA, 18 bp, Homo sapiens
taaggtgtttgaaaatag

SEQ ID NO: 1337238 - DNA, 14 bp, Homo sapiens
taagtcatgtatgt

SEQ ID NO: 1337239 - DNA, 15 bp, Homo sapiens
taagttattgcagtt

SEQ ID NO: 1337240 - DNA, 16 bp, Homo sapiens
taagttattgcagttt

SEQ ID NO: 1337241 - DNA, 14 bp, Homo sapiens
taataaatatatac

SEQ ID NO: 1337242 - DNA, 17 bp, Homo sapiens
taataactgtgtactgt

SEQ ID NO: 1337243 - DNA, 23 bp, Homo sapiens
taataagctagttgaatacttga

SEQ ID NO: 1337244 - DNA, 14 bp, Homo sapiens
taataataatgttt

SEQ ID NO: 1337245 - DNA, 20 bp, Homo sapiens
taataatcttgtttctgaaa

SEQ ID NO: 1337246 - DNA, 14 bp, Homo sapiens
taatacaaggtata

SEQ ID NO: 1337247 - DNA, 13 bp, Homo sapiens
taatactgaacca

SEQ ID NO: 1337248 - DNA, 21 bp, Homo sapiens
taatactgaaccacttgtaga

SEQ ID NO: 1337249 - DNA, 22 bp, Homo sapiens
taatagactgtaacttccaaat

SEQ ID NO: 1337250 - DNA, 20 bp, Homo sapiens
taatagcaacttttgtgtaa

SEQ ID NO: 1337251 - DNA, 14 bp, Homo sapiens
taatagggaatata

SEQ ID NO: 1337252 - DNA, 14 bp, Homo sapiens
taatatatatgaat

SEQ ID NO: 1337253 - DNA, 16 bp, Homo sapiens
taatatatatgaataa

SEQ ID NO: 1337254 - DNA, 18 bp, Homo sapiens
taatatatatgaataaag

SEQ ID NO: 1337255 - DNA, 13 bp, Homo sapiens
taatatattttct

SEQ ID NO: 1337256 - DNA, 20 bp, Homo sapiens
taatatgttcttttaaatga

SEQ ID NO: 1337257 - DNA, 20 bp, Homo sapiens
taatattgtttggtaaatgt

SEQ ID NO: 1337258 - DNA, 13 bp, Homo sapiens
taatatttaacat

SEQ ID NO: 1337259 - DNA, 16 bp, Homo sapiens
taatatttattaaatt

SEQ ID NO: 1337260 - DNA, 14 bp, Homo sapiens
taatcaagagcctt

SEQ ID NO: 1337261 - DNA, 18 bp, Homo sapiens
taatcaagagccttaaaa

SEQ ID NO: 1337262 - DNA, 19 bp, Homo sapiens
taatcaagagccttaaaac

SEQ ID NO: 1337263 - DNA, 21 bp, Homo sapiens
taatcaagtaaggatgtatgt

SEQ ID NO: 1337264 - DNA, 13 bp, Homo sapiens
taatcactgtgta

SEQ ID NO: 1337265 - DNA, 15 bp, Homo sapiens
taatcactgtgtata

SEQ ID NO: 1337266 - DNA, 16 bp, Homo sapiens
taatcactgtgtatat

SEQ ID NO: 1337267 - DNA, 17 bp, Homo sapiens
taatcatagttactgtg

SEQ ID NO: 1337268 - DNA, 12 bp, Homo sapiens
taatcattttca

SEQ ID NO: 1337269 - DNA, 14 bp, Homo sapiens
taatcattttcatt

SEQ ID NO: 1337270 - DNA, 17 bp, Homo sapiens
taatcattttcattcct

SEQ ID NO: 1337271 - DNA, 19 bp, Homo sapiens
taatccagttataagaaga

SEQ ID NO: 1337272 - DNA, 18 bp, Homo sapiens
taatcctttgttttctga

SEQ ID NO: 1337273 - DNA, 23 bp, Homo sapiens
taatcctttgttttctgactaat

SEQ ID NO: 1337274 - DNA, 14 bp, Homo sapiens
taatctactgcatt

SEQ ID NO: 1337275 - DNA, 16 bp, Homo sapiens
taatctactgcattta

SEQ ID NO: 1337276 - DNA, 19 bp, Homo sapiens
taatctttacctgtataca

SEQ ID NO: 1337277 - DNA, 13 bp, Homo sapiens
taatgaaatggag

SEQ ID NO: 1337278 - DNA, 14 bp, Homo sapiens
taatgcactttcta

SEQ ID NO: 1337279 - DNA, 22 bp, Homo sapiens
taatggtgatgcagtcttagat

SEQ ID NO: 1337280 - DNA, 22 bp, Homo sapiens
taattacttattgtatttatgt

SEQ ID NO: 1337281 - DNA, 17 bp, Homo sapiens
taattaggcaaggctat

SEQ ID NO: 1337282 - DNA, 20 bp, Homo sapiens
taattatataactgtatttg

SEQ ID NO: 1337283 - DNA, 15 bp, Homo sapiens
taattcttttttatt

SEQ ID NO: 1337284 - DNA, 16 bp, Homo sapiens
taattcttttttatta

SEQ ID NO: 1337285 - DNA, 17 bp, Homo sapiens
taattcttttttattaa

SEQ ID NO: 1337286 - DNA, 22 bp, Homo sapiens
taattgaagtgtataatataaa

SEQ ID NO: 1337287 - DNA, 21 bp, Homo sapiens
taattgcaaaaacatagaaat

SEQ ID NO: 1337288 - DNA, 22 bp, Homo sapiens
taattgctgtgtgtcccaggca

SEQ ID NO: 1337289 - DNA, 15 bp, Homo sapiens
taattgtacaaaatt

SEQ ID NO: 1337290 - DNA, 17 bp, Homo sapiens
taattgtacaaaattaa

SEQ ID NO: 1337291 - DNA, 23 bp, Homo sapiens
taattgtacaaaattaagcaaat

SEQ ID NO: 1337292 - DNA, 12 bp, Homo sapiens
taattgtatttt

SEQ ID NO: 1337293 - DNA, 13 bp, Homo sapiens
taattgtttaaaa

SEQ ID NO: 1337294 - DNA, 13 bp, Homo sapiens
taatttaaatgaa

SEQ ID NO: 1337295 - DNA, 15 bp, Homo sapiens
taatttaagttttga

SEQ ID NO: 1337296 - DNA, 20 bp, Homo sapiens
taatttcatgtaaaacagaa

SEQ ID NO: 1337297 - DNA, 19 bp, Homo sapiens
taatttcctttttgacact

SEQ ID NO: 1337298 - DNA, 21 bp, Homo sapiens
taatttcctttttgacactga

SEQ ID NO: 1337299 - DNA, 22 bp, Homo sapiens
taatttcctttttgacactgaa

SEQ ID NO: 1337300 - DNA, 13 bp, Homo sapiens
taatttctcctcc

SEQ ID NO: 1337301 - DNA, 17 bp, Homo sapiens
taatttgatgaggtatt

SEQ ID NO: 1337302 - DNA, 19 bp, Homo sapiens
taatttttaatgatgacaa

SEQ ID NO: 1337303 - DNA, 16 bp, Homo sapiens
tacaaacatttaagct

SEQ ID NO: 1337304 - DNA, 13 bp, Homo sapiens
tacaaacctacca

SEQ ID NO: 1337305 - DNA, 19 bp, Homo sapiens
tacaaatgcatctttgatg

SEQ ID NO: 1337306 - DNA, 16 bp, Homo sapiens
tacaaatttgttattt

SEQ ID NO: 1337307 - DNA, 19 bp, Homo sapiens
tacaagggcataaagtaaa

SEQ ID NO: 1337308 - DNA, 16 bp, Homo sapiens
tacaaggtataataaa

SEQ ID NO: 1337309 - DNA, 17 bp, Homo sapiens
tacaaggtataataaaa

SEQ ID NO: 1337310 - DNA, 20 bp, Homo sapiens
tacaaggtataataaaatta

SEQ ID NO: 1337311 - DNA, 14 bp, Homo sapiens
tacaagtagttctg

SEQ ID NO: 1337312 - DNA, 15 bp, Homo sapiens
tacaagtagttctgt

SEQ ID NO: 1337313 - DNA, 21 bp, Homo sapiens
tacaagtagttctgtatttga

SEQ ID NO: 1337314 - DNA, 22 bp, Homo sapiens
tacaagtagttctgtatttgaa

SEQ ID NO: 1337315 - DNA, 17 bp, Homo sapiens
tacaagtttatatatat

SEQ ID NO: 1337316 - DNA, 15 bp, Homo sapiens
tacaatattgattgg

SEQ ID NO: 1337317 - DNA, 21 bp, Homo sapiens
tacaatgaacacttataagtg

SEQ ID NO: 1337318 - DNA, 18 bp, Homo sapiens
tacaattttatctgtttc

SEQ ID NO: 1337319 - DNA, 13 bp, Homo sapiens
tacacagaaacac

SEQ ID NO: 1337320 - DNA, 18 bp, Homo sapiens
tacacagaaacactgcct

SEQ ID NO: 1337321 - DNA, 13 bp, Homo sapiens
tacacatttgcta

SEQ ID NO: 1337322 - DNA, 21 bp, Homo sapiens
tacacatttgctactgttgta

SEQ ID NO: 1337323 - DNA, 13 bp, Homo sapiens
tacacctggctga

SEQ ID NO: 1337324 - DNA, 19 bp, Homo sapiens
tacacgaatagacatcaaa

SEQ ID NO: 1337325 - DNA, 21 bp, Homo sapiens
tacacgaccatttgataggga

SEQ ID NO: 1337326 - DNA, 19 bp, Homo sapiens
tacacgttagatttgccgt

SEQ ID NO: 1337327 - DNA, 20 bp, Homo sapiens
tacactggcaatggtagttt

SEQ ID NO: 1337328 - DNA, 22 bp, Homo sapiens
ctgccagccttgagccctggct

SEQ ID NO: 1337329 - DNA, 20 bp, Homo sapiens
ctgccaggcaggggtggggg

SEQ ID NO: 1337330 - DNA, 13 bp, Homo sapiens
ctgccaggcatgg

SEQ ID NO: 1337331 - DNA, 15 bp, Homo sapiens
ctgccaggccagcct

SEQ ID NO: 1337332 - DNA, 16 bp, Homo sapiens
ctgccaggccagcctc

SEQ ID NO: 1337333 - DNA, 19 bp, Homo sapiens
ctgccaggccagcctccga

SEQ ID NO: 1337334 - DNA, 20 bp, Homo sapiens
ctgccaggccagcctccgag

SEQ ID NO: 1337335 - DNA, 17 bp, Homo sapiens
ctgccatctagccagcc

SEQ ID NO: 1337336 - DNA, 15 bp, Homo sapiens
ctgccatttctgaga

SEQ ID NO: 1337337 - DNA, 13 bp, Homo sapiens
ctgcccactgttt

SEQ ID NO: 1337338 - DNA, 22 bp, Homo sapiens
ctgcccactgtttctcttgagc

SEQ ID NO: 1337339 - DNA, 17 bp, Homo sapiens
ctgcccagccccctggt

SEQ ID NO: 1337340 - DNA, 22 bp, Homo sapiens
ctgcccatcgtgaagaagcctg

SEQ ID NO: 1337341 - DNA, 16 bp, Homo sapiens
ctgccccatctcccct

SEQ ID NO: 1337342 - DNA, 17 bp, Homo sapiens
ctgccccatctcccctc

SEQ ID NO: 1337343 - DNA, 19 bp, Homo sapiens
ctgccccggagctggagga

SEQ ID NO: 1337344 - DNA, 16 bp, Homo sapiens
ctgcccctcccccagc

SEQ ID NO: 1337345 - DNA, 20 bp, Homo sapiens
ctgcccggcagggtcctaga

SEQ ID NO: 1337346 - DNA, 14 bp, Homo sapiens
ctgccctggctgct

SEQ ID NO: 1337347 - DNA, 21 bp, Homo sapiens
ctgccggacccggaggccgag

SEQ ID NO: 1337348 - DNA, 22 bp, Homo sapiens
ctgccgtcaccaccacccctac

SEQ ID NO: 1337349 - DNA, 15 bp, Homo sapiens
ctgccgtctctggag

SEQ ID NO: 1337350 - DNA, 15 bp, Homo sapiens
ctgccgtgccgcctg

SEQ ID NO: 1337351 - DNA, 15 bp, Homo sapiens
ctgcctcccacttca

SEQ ID NO: 1337352 - DNA, 18 bp, Homo sapiens
ctgcctcccacttcactg

SEQ ID NO: 1337353 - DNA, 13 bp, Homo sapiens
ctgcctcccatgc

SEQ ID NO: 1337354 - DNA, 13 bp, Homo sapiens
ctgcctgaataaa

SEQ ID NO: 1337355 - DNA, 18 bp, Homo sapiens
ctgcctgcaatatttgaa

SEQ ID NO: 1337356 - DNA, 21 bp, Homo sapiens
ctgcctgccccgcccccagtc

SEQ ID NO: 1337357 - DNA, 22 bp, Homo sapiens
ctgcctgccccgcccccagtcc

SEQ ID NO: 1337358 - DNA, 22 bp, Homo sapiens
ctgcctggcccccaacctcagg

SEQ ID NO: 1337359 - DNA, 12 bp, Homo sapiens
ctgcctggcctt

SEQ ID NO: 1337360 - DNA, 12 bp, Homo sapiens
ctgcctgggctg

SEQ ID NO: 1337361 - DNA, 19 bp, Homo sapiens
ctgcctgtaacttgagagt

SEQ ID NO: 1337362 - DNA, 19 bp, Homo sapiens
ctgccttaaaaccaaagag

SEQ ID NO: 1337363 - DNA, 11 bp, Homo sapiens
ctgccttccct

SEQ ID NO: 1337364 - DNA, 20 bp, Homo sapiens
ctgccttcgcttcttgcctc

SEQ ID NO: 1337365 - DNA, 14 bp, Homo sapiens
ctgcctttgcacca

SEQ ID NO: 1337366 - DNA, 13 bp, Homo sapiens
ctgcgaccctggg

SEQ ID NO: 1337367 - DNA, 21 bp, Homo sapiens
ctgcgaccctgggggcacagg

SEQ ID NO: 1337368 - DNA, 22 bp, Homo sapiens
ctgcgcccttaactgcatccag

SEQ ID NO: 1337369 - DNA, 12 bp, Homo sapiens
ctgcgcctgctg

SEQ ID NO: 1337370 - DNA, 23 bp, Homo sapiens
ctgcgcctgctgcatgccctctc

SEQ ID NO: 1337371 - DNA, 15 bp, Homo sapiens
ctgcggatctcagct

SEQ ID NO: 1337372 - DNA, 13 bp, Homo sapiens
ctgcgtcctcctc

SEQ ID NO: 1337373 - DNA, 14 bp, Homo sapiens
ctgcgtcctcctca

SEQ ID NO: 1337374 - DNA, 18 bp, Homo sapiens
ctgcgtcctcctcacctc

SEQ ID NO: 1337375 - DNA, 15 bp, Homo sapiens
ctgctacaatgtcct

SEQ ID NO: 1337376 - DNA, 20 bp, Homo sapiens
ctgctacctttcaaagcttg

SEQ ID NO: 1337377 - DNA, 16 bp, Homo sapiens
ctgctatccccatctc

SEQ ID NO: 1337378 - DNA, 20 bp, Homo sapiens
ctgctatccccatctccctg

SEQ ID NO: 1337379 - DNA, 21 bp, Homo sapiens
ctgctatttattttcctaaag

SEQ ID NO: 1337380 - DNA, 20 bp, Homo sapiens
ctgctcaccgcccatcaggg

SEQ ID NO: 1337381 - DNA, 23 bp, Homo sapiens
ctgctcaccgcccatcagggttc

SEQ ID NO: 1337382 - DNA, 15 bp, Homo sapiens
ctgctccagctgttc

SEQ ID NO: 1337383 - DNA, 16 bp, Homo sapiens
ctgctccccaggggag

SEQ ID NO: 1337384 - DNA, 15 bp, Homo sapiens
ctgctccctggcatt

SEQ ID NO: 1337385 - DNA, 15 bp, Homo sapiens
ctgctcttcatccca

SEQ ID NO: 1337386 - DNA, 15 bp, Homo sapiens
ctgctgcagagcagt

SEQ ID NO: 1337387 - DNA, 14 bp, Homo sapiens
ctgctggcacccac

SEQ ID NO: 1337388 - DNA, 17 bp, Homo sapiens
ctgctggcacccaccgt

SEQ ID NO: 1337389 - DNA, 16 bp, Homo sapiens
ctgctggtccgtggga

SEQ ID NO: 1337390 - DNA, 17 bp, Homo sapiens
ctgctggtccgtgggac

SEQ ID NO: 1337391 - DNA, 16 bp, Homo sapiens
ctgcttcctcctggaa

SEQ ID NO: 1337392 - DNA, 13 bp, Homo sapiens
ctgcttctctgac

SEQ ID NO: 1337393 - DNA, 16 bp, Homo sapiens
ctgcttctctgacttc

SEQ ID NO: 1337394 - DNA, 13 bp, Homo sapiens
ctgcttgaggcaa

SEQ ID NO: 1337395 - DNA, 20 bp, Homo sapiens
ctgcttgaggcaactcatct

SEQ ID NO: 1337396 - DNA, 21 bp, Homo sapiens
ctgcttgaggcaactcatctt

SEQ ID NO: 1337397 - DNA, 22 bp, Homo sapiens
ctgcttgaggcaactcatctta

SEQ ID NO: 1337398 - DNA, 14 bp, Homo sapiens
ctgctttagacttg

SEQ ID NO: 1337399 - DNA, 20 bp, Homo sapiens
ctgctttagacttgaaaaga

SEQ ID NO: 1337400 - DNA, 23 bp, Homo sapiens
ctgcttttaactttataaatcca

SEQ ID NO: 1337401 - DNA, 17 bp, Homo sapiens
ctgcttttctgccctgg

SEQ ID NO: 1337402 - DNA, 22 bp, Homo sapiens
ctgcttttctgccctggctgct

SEQ ID NO: 1337403 - DNA, 15 bp, Homo sapiens
ctggaaaggggagag

SEQ ID NO: 1337404 - DNA, 19 bp, Homo sapiens
ctggaaaggggagagcctg

SEQ ID NO: 1337405 - DNA, 23 bp, Homo sapiens
ctggaaaggggagagcctgctgg

SEQ ID NO: 1337406 - DNA, 20 bp, Homo sapiens
ctggaaccacattgaagaat

SEQ ID NO: 1337407 - DNA, 17 bp, Homo sapiens
ctggaatctggagacca

SEQ ID NO: 1337408 - DNA, 18 bp, Homo sapiens
ctggaatctggagaccag

SEQ ID NO: 1337409 - DNA, 24 bp, Homo sapiens
ctggaatctggagaccagggagcc

SEQ ID NO: 1337410 - DNA, 15 bp, Homo sapiens
ctggaccctgtggat

SEQ ID NO: 1337411 - DNA, 18 bp, Homo sapiens
ctggacccttataaaatc

SEQ ID NO: 1337412 - DNA, 15 bp, Homo sapiens
ctggacttctacctg

SEQ ID NO: 1337413 - DNA, 18 bp, Homo sapiens
ctggacttctacctgccc

SEQ ID NO: 1337414 - DNA, 19 bp, Homo sapiens
ctggagaccagggagcctt

SEQ ID NO: 1337415 - DNA, 21 bp, Homo sapiens
ctggagacttagggcaccagg

SEQ ID NO: 1337416 - DNA, 19 bp, Homo sapiens
ctggagcactgggctcccg

SEQ ID NO: 1337417 - DNA, 21 bp, Homo sapiens
ctggagcactgggctcccggg

SEQ ID NO: 1337418 - DNA, 14 bp, Homo sapiens
ctggatagacgagt

SEQ ID NO: 1337419 - DNA, 22 bp, Homo sapiens
ctggcaaacatgaaaaatcggc

SEQ ID NO: 1337420 - DNA, 14 bp, Homo sapiens
ctggcaagaatgtg

SEQ ID NO: 1337421 - DNA, 19 bp, Homo sapiens
ctggcaaggactttgtaca

SEQ ID NO: 1337422 - DNA, 19 bp, Homo sapiens
ctggcactcttgttcccac

SEQ ID NO: 1337423 - DNA, 20 bp, Homo sapiens
ctggcactgactgggcatag

SEQ ID NO: 1337424 - DNA, 19 bp, Homo sapiens
ctggcactggaccccagca

SEQ ID NO: 1337425 - DNA, 16 bp, Homo sapiens
ctggcagcccagagac

SEQ ID NO: 1337426 - DNA, 22 bp, Homo sapiens
ctggcagcccagagactttgta

SEQ ID NO: 1337427 - DNA, 19 bp, Homo sapiens
ctggcagtccgtgggacgg

SEQ ID NO: 1337428 - DNA, 20 bp, Homo sapiens
ctggcatcgcaccattctga

SEQ ID NO: 1337429 - DNA, 13 bp, Homo sapiens
ctggccagaatgc

SEQ ID NO: 1337430 - DNA, 14 bp, Homo sapiens
ctggccaggagcag

SEQ ID NO: 1337431 - DNA, 20 bp, Homo sapiens
ctggccagtccaccctgcct

SEQ ID NO: 1337432 - DNA, 18 bp, Homo sapiens
ctggccagtccaggctgc

SEQ ID NO: 1337433 - DNA, 23 bp, Homo sapiens
ctggccagtccaggctgccgtgg

SEQ ID NO: 1337434 - DNA, 22 bp, Homo sapiens
ctggccatttgccaattttcct

SEQ ID NO: 1337435 - DNA, 18 bp, Homo sapiens
ctggccccagccctgctg

SEQ ID NO: 1337436 - DNA, 22 bp, Homo sapiens
ctggcccccaacctcagggctc

SEQ ID NO: 1337437 - DNA, 19 bp, Homo sapiens
ctggcctatccgctgccag

SEQ ID NO: 1337438 - DNA, 16 bp, Homo sapiens
ctggcctcccctgcca

SEQ ID NO: 1337439 - DNA, 11 bp, Homo sapiens
ctggcctctgt

SEQ ID NO: 1337440 - DNA, 20 bp, Homo sapiens
ctggcctctgtgccttcttt

SEQ ID NO: 1337441 - DNA, 23 bp, Homo sapiens
ctggcctggacagtatcccacat

SEQ ID NO: 1337442 - DNA, 15 bp, Homo sapiens
ctggccttgtcctca

SEQ ID NO: 1337443 - DNA, 21 bp, Homo sapiens
ctggccttgtcctcagccagt

SEQ ID NO: 1337444 - DNA, 16 bp, Homo sapiens
ctggcgcaggtgggct

SEQ ID NO: 1337445 - DNA, 22 bp, Homo sapiens
ctggctccctcctccaggcctg

SEQ ID NO: 1337446 - DNA, 20 bp, Homo sapiens
ctggctgaggttcctctgcc

SEQ ID NO: 1337447 - DNA, 22 bp, Homo sapiens
ctggctgaggttcctctgcctg

SEQ ID NO: 1337448 - DNA, 23 bp, Homo sapiens
gagcctgcatttcctcgcagcct

SEQ ID NO: 1337449 - DNA, 13 bp, Homo sapiens
gagcctgcccagc

SEQ ID NO: 1337450 - DNA, 15 bp, Homo sapiens
gagcctgctggcacc

SEQ ID NO: 1337451 - DNA, 10 bp, Homo sapiens
gagcctggca

SEQ ID NO: 1337452 - DNA, 15 bp, Homo sapiens
gagcctggcaagaat

SEQ ID NO: 1337453 - DNA, 21 bp, Homo sapiens
gagcctgggaggtcaaggctg

SEQ ID NO: 1337454 - DNA, 19 bp, Homo sapiens
gagcgcagtgttttgcaag

SEQ ID NO: 1337455 - DNA, 16 bp, Homo sapiens
gagcgcgcccctagcc

SEQ ID NO: 1337456 - DNA, 13 bp, Homo sapiens
gagcggaggttgc

SEQ ID NO: 1337457 - DNA, 21 bp, Homo sapiens
gagctccactctgcttctctg

SEQ ID NO: 1337458 - DNA, 21 bp, Homo sapiens
gagctcttcctatccctctcc

SEQ ID NO: 1337459 - DNA, 14 bp, Homo sapiens
gagctgccttccct

SEQ ID NO: 1337460 - DNA, 19 bp, Homo sapiens
gagctgccttccctagctt

SEQ ID NO: 1337461 - DNA, 16 bp, Homo sapiens
gagctggcctctctag

SEQ ID NO: 1337462 - DNA, 13 bp, Homo sapiens
gagctggctctga

SEQ ID NO: 1337463 - DNA, 20 bp, Homo sapiens
gagctgggcccgacatggct

SEQ ID NO: 1337464 - DNA, 22 bp, Homo sapiens
gagcttaatgctacatgtgagt

SEQ ID NO: 1337465 - DNA, 22 bp, Homo sapiens
gagctttctgctatcaaagagg

SEQ ID NO: 1337466 - DNA, 13 bp, Homo sapiens
gaggaaaattctt

SEQ ID NO: 1337467 - DNA, 19 bp, Homo sapiens
gaggaacaatcggctgcat

SEQ ID NO: 1337468 - DNA, 17 bp, Homo sapiens
gaggaagagaaaaaata

SEQ ID NO: 1337469 - DNA, 15 bp, Homo sapiens
gaggacagcttgagc

SEQ ID NO: 1337470 - DNA, 11 bp, Homo sapiens
gaggacccagg

SEQ ID NO: 1337471 - DNA, 20 bp, Homo sapiens
gaggacccaggaaaggcagg

SEQ ID NO: 1337472 - DNA, 21 bp, Homo sapiens
gaggactgtagggagggcggc

SEQ ID NO: 1337473 - DNA, 13 bp, Homo sapiens
gaggaggaaggca

SEQ ID NO: 1337474 - DNA, 11 bp, Homo sapiens
gaggagggaga

SEQ ID NO: 1337475 - DNA, 13 bp, Homo sapiens
gaggatctcttga

SEQ ID NO: 1337476 - DNA, 22 bp, Homo sapiens
gaggatctcttgagcctgggag

SEQ ID NO: 1337477 - DNA, 22 bp, Homo sapiens
gaggatggtagaagtttggctg

SEQ ID NO: 1337478 - DNA, 20 bp, Homo sapiens
gaggattgcttgagctcagg

SEQ ID NO: 1337479 - DNA, 16 bp, Homo sapiens
gaggcaaagctggctc

SEQ ID NO: 1337480 - DNA, 15 bp, Homo sapiens
gaggcagtttgagga

SEQ ID NO: 1337481 - DNA, 22 bp, Homo sapiens
gaggccaagaatattgcaaaat

SEQ ID NO: 1337482 - DNA, 22 bp, Homo sapiens
gaggccatgtgcatagtttctt

SEQ ID NO: 1337483 - DNA, 15 bp, Homo sapiens
gaggcccccagccca

SEQ ID NO: 1337484 - DNA, 14 bp, Homo sapiens
gaggccgaggccat

SEQ ID NO: 1337485 - DNA, 14 bp, Homo sapiens
gaggccgaggcggg

SEQ ID NO: 1337486 - DNA, 21 bp, Homo sapiens
gaggccgttgctgacttagaa

SEQ ID NO: 1337487 - DNA, 18 bp, Homo sapiens
gaggcctaccccgcagac

SEQ ID NO: 1337488 - DNA, 14 bp, Homo sapiens
gaggcctgggccgc

SEQ ID NO: 1337489 - DNA, 21 bp, Homo sapiens
gaggcctgggccgctgccacg

SEQ ID NO: 1337490 - DNA, 14 bp, Homo sapiens
gaggctgcccctct

SEQ ID NO: 1337491 - DNA, 23 bp, Homo sapiens
gaggctgtggtcacagcggaggt

SEQ ID NO: 1337492 - DNA, 13 bp, Homo sapiens
gaggcttcctgcg

SEQ ID NO: 1337493 - DNA, 21 bp, Homo sapiens
gaggcttcctgcgtcctcctc

SEQ ID NO: 1337494 - DNA, 18 bp, Homo sapiens
gaggcttctccgccagcc

SEQ ID NO: 1337495 - DNA, 22 bp, Homo sapiens
gaggcttctccgccagcctcct

SEQ ID NO: 1337496 - DNA, 19 bp, Homo sapiens
gaggcttgtttacctttct

SEQ ID NO: 1337497 - DNA, 20 bp, Homo sapiens
gagggaagggtttctctatt

SEQ ID NO: 1337498 - DNA, 15 bp, Homo sapiens
gagggacggccaaga

SEQ ID NO: 1337499 - DNA, 16 bp, Homo sapiens
gagggagaacaagacc

SEQ ID NO: 1337500 - DNA, 15 bp, Homo sapiens
gagggagagagagag

SEQ ID NO: 1337501 - DNA, 11 bp, Homo sapiens
gagggaggccc

SEQ ID NO: 1337502 - DNA, 18 bp, Homo sapiens
gagggcagactggggcat

SEQ ID NO: 1337503 - DNA, 13 bp, Homo sapiens
gagggcagctgct

SEQ ID NO: 1337504 - DNA, 13 bp, Homo sapiens
gagggcggcaggg

SEQ ID NO: 1337505 - DNA, 23 bp, Homo sapiens
gagggcggcaggggcctggagat

SEQ ID NO: 1337506 - DNA, 12 bp, Homo sapiens
gagggctgcagt

SEQ ID NO: 1337507 - DNA, 21 bp, Homo sapiens
gagggcttcctctagaagcca

SEQ ID NO: 1337508 - DNA, 13 bp, Homo sapiens
gagggggtggagg

SEQ ID NO: 1337509 - DNA, 14 bp, Homo sapiens
gagggggtggaggg

SEQ ID NO: 1337510 - DNA, 17 bp, Homo sapiens
gaggggtgtggcagtgg

SEQ ID NO: 1337511 - DNA, 13 bp, Homo sapiens
gagggtgggaagg

SEQ ID NO: 1337512 - DNA, 17 bp, Homo sapiens
gaggtcaaggctgcagt

SEQ ID NO: 1337513 - DNA, 17 bp, Homo sapiens
gaggtcactggaaaggg

SEQ ID NO: 1337514 - DNA, 20 bp, Homo sapiens
gaggtcactggaaaggggag

SEQ ID NO: 1337515 - DNA, 15 bp, Homo sapiens
gaggtcgaggcagga

SEQ ID NO: 1337516 - DNA, 13 bp, Homo sapiens
gaggtctaatcta

SEQ ID NO: 1337517 - DNA, 13 bp, Homo sapiens
gaggtgattccag

SEQ ID NO: 1337518 - DNA, 15 bp, Homo sapiens
gaggtggaagaaggg

SEQ ID NO: 1337519 - DNA, 18 bp, Homo sapiens
gaggtggagggagggaag

SEQ ID NO: 1337520 - DNA, 11 bp, Homo sapiens
gaggtgggagg

SEQ ID NO: 1337521 - DNA, 17 bp, Homo sapiens
gaggtgggccagtctgt

SEQ ID NO: 1337522 - DNA, 21 bp, Homo sapiens
gaggtgggccagtctgtggat

SEQ ID NO: 1337523 - DNA, 18 bp, Homo sapiens
gaggttcctctgcctgcc

SEQ ID NO: 1337524 - DNA, 16 bp, Homo sapiens
gaggtttcaaacctcc

SEQ ID NO: 1337525 - DNA, 10 bp, Homo sapiens
gagtaaagct

SEQ ID NO: 1337526 - DNA, 17 bp, Homo sapiens
gagtaaagctcctatct

SEQ ID NO: 1337527 - DNA, 12 bp, Homo sapiens
gagtattctaat

SEQ ID NO: 1337528 - DNA, 20 bp, Homo sapiens
gagtattgtttaaaatgtaa

SEQ ID NO: 1337529 - DNA, 15 bp, Homo sapiens
gagtcaaggcctgct

SEQ ID NO: 1337530 - DNA, 13 bp, Homo sapiens
gagtccactttgt

SEQ ID NO: 1337531 - DNA, 17 bp, Homo sapiens
gagtccattctcccagg

SEQ ID NO: 1337532 - DNA, 22 bp, Homo sapiens
gagtcgtggggtgtgctgggag

SEQ ID NO: 1337533 - DNA, 19 bp, Homo sapiens
gagtctaatagtctttgcc

SEQ ID NO: 1337534 - DNA, 19 bp, Homo sapiens
gagtctgaggccgttgctg

SEQ ID NO: 1337535 - DNA, 16 bp, Homo sapiens
gagtctgttctggtaa

SEQ ID NO: 1337536 - DNA, 20 bp, Homo sapiens
gagtctgttgtgtgtcatgc

SEQ ID NO: 1337537 - DNA, 15 bp, Homo sapiens
gagtgaaaaagagaa

SEQ ID NO: 1337538 - DNA, 19 bp, Homo sapiens
gagtgatagtcttttgctt

SEQ ID NO: 1337539 - DNA, 23 bp, Homo sapiens
gagtgggggatcacagcctctga

SEQ ID NO: 1337540 - DNA, 13 bp, Homo sapiens
gagtgtatgagta

SEQ ID NO: 1337541 - DNA, 13 bp, Homo sapiens
gagttaaggtggg

SEQ ID NO: 1337542 - DNA, 19 bp, Homo sapiens
gagttccagttcctctttg

SEQ ID NO: 1337543 - DNA, 22 bp, Homo sapiens
gagttcccttgaaactttggga

SEQ ID NO: 1337544 - DNA, 15 bp, Homo sapiens
gagttgattcagctc

SEQ ID NO: 1337545 - DNA, 18 bp, Homo sapiens
gagttgtttttgtatatt

SEQ ID NO: 1337546 - DNA, 22 bp, Homo sapiens
gagtttgtcgctcatgtgtgca

SEQ ID NO: 1337547 - DNA, 16 bp, Homo sapiens
gagttttcattaaatc

SEQ ID NO: 1337548 - DNA, 19 bp, Homo sapiens
gataactttacagaaatgg

SEQ ID NO: 1337549 - DNA, 15 bp, Homo sapiens
gataaggcctgtggg

SEQ ID NO: 1337550 - DNA, 18 bp, Homo sapiens
gatacctccaaccctgcc

SEQ ID NO: 1337551 - DNA, 20 bp, Homo sapiens
gatacctccaaccctgccgt

SEQ ID NO: 1337552 - DNA, 19 bp, Homo sapiens
gatactgcgactttctgcc

SEQ ID NO: 1337553 - DNA, 19 bp, Homo sapiens
gatacttcccacaccacaa

SEQ ID NO: 1337554 - DNA, 16 bp, Homo sapiens
gatactttgtattgtc

SEQ ID NO: 1337555 - DNA, 19 bp, Homo sapiens
gatagtgggatttccagaa

SEQ ID NO: 1337556 - DNA, 15 bp, Homo sapiens
gatagttgctatttt

SEQ ID NO: 1337557 - DNA, 22 bp, Homo sapiens
gatagttgctatttttgtaaag

SEQ ID NO: 1337558 - DNA, 14 bp, Homo sapiens
gatataaattttta

SEQ ID NO: 1337559 - DNA, 18 bp, Homo sapiens
gatatacacggatgactt

SEQ ID NO: 1337560 - DNA, 19 bp, Homo sapiens
gatatataggctattttct

SEQ ID NO: 1337561 - DNA, 13 bp, Homo sapiens
gatcacaaatgac

SEQ ID NO: 1337562 - DNA, 23 bp, Homo sapiens
gatcaccgactgaaaatattgtt

SEQ ID NO: 1337563 - DNA, 13 bp, Homo sapiens
gatcactgccaca

SEQ ID NO: 1337564 - DNA, 21 bp, Homo sapiens
gatcactgtttagatttgcca

SEQ ID NO: 1337565 - DNA, 15 bp, Homo sapiens
gatcagcctgggcaa

SEQ ID NO: 1337566 - DNA, 15 bp, Homo sapiens
gatcaggctcccagg

SEQ ID NO: 1337567 - DNA, 19 bp, Homo sapiens
gatcatgtactttttagta

SEQ ID NO: 1337568 - DNA, 18 bp, Homo sapiens
gatccactcgcctcagcc

SEQ ID NO: 1337569 - DNA, 13 bp, Homo sapiens
gatccccgcctgg

SEQ ID NO: 1337570 - DNA, 14 bp, Homo sapiens
gatccccgcctggc

SEQ ID NO: 1337571 - DNA, 15 bp, Homo sapiens
gatccccgcctggcc

SEQ ID NO: 1337572 - DNA, 20 bp, Homo sapiens
gatccccgcctggccaggag

SEQ ID NO: 1337573 - DNA, 21 bp, Homo sapiens
gatccccgcctggccaggagc

SEQ ID NO: 1337574 - DNA, 14 bp, Homo sapiens
gatccgactgcttt

SEQ ID NO: 1337575 - DNA, 20 bp, Homo sapiens
gatccgactgctttggacct

SEQ ID NO: 1337576 - DNA, 17 bp, Homo sapiens
gatcctgcgggtggggc

SEQ ID NO: 1337577 - DNA, 22 bp, Homo sapiens
gatccttagaggtcctctggag

SEQ ID NO: 1337578 - DNA, 19 bp, Homo sapiens
gatcgagaccatcctggct

SEQ ID NO: 1337579 - DNA, 14 bp, Homo sapiens
gatctcggtttgcc

SEQ ID NO: 1337580 - DNA, 17 bp, Homo sapiens
gatctcttgagcctggg

SEQ ID NO: 1337581 - DNA, 18 bp, Homo sapiens
gatctcttgagcctggga

SEQ ID NO: 1337582 - DNA, 13 bp, Homo sapiens
gatctgcccatcg

SEQ ID NO: 1337583 - DNA, 12 bp, Homo sapiens
gatctgctgcag

SEQ ID NO: 1337584 - DNA, 12 bp, Homo sapiens
gatctttcagaa

SEQ ID NO: 1337585 - DNA, 16 bp, Homo sapiens
gatgaaactaaagcaa

SEQ ID NO: 1337586 - DNA, 17 bp, Homo sapiens
gatgaaactaaagcaat

SEQ ID NO: 1337587 - DNA, 19 bp, Homo sapiens
gatgcaggctcccctgagg

SEQ ID NO: 1337588 - DNA, 12 bp, Homo sapiens
gatgccacccta

SEQ ID NO: 1337589 - DNA, 16 bp, Homo sapiens
gatgccaccctagcca

SEQ ID NO: 1337590 - DNA, 17 bp, Homo sapiens
gatgccagggccgacca

SEQ ID NO: 1337591 - DNA, 19 bp, Homo sapiens
gatgctgggagttctaaca

SEQ ID NO: 1337592 - DNA, 16 bp, Homo sapiens
gatgctgtgctatgaa

SEQ ID NO: 1337593 - DNA, 17 bp, Homo sapiens
gatgctgtgtatatggt

SEQ ID NO: 1337594 - DNA, 18 bp, Homo sapiens
gatggaaaaactgaggct

SEQ ID NO: 1337595 - DNA, 13 bp, Homo sapiens
gatggaatttttt

SEQ ID NO: 1337596 - DNA, 20 bp, Homo sapiens
gatggaatttttttgtacga

SEQ ID NO: 1337597 - DNA, 22 bp, Homo sapiens
gatggatttccagccaaagcct

SEQ ID NO: 1337598 - DNA, 12 bp, Homo sapiens
gatggccccagc

SEQ ID NO: 1337599 - DNA, 22 bp, Homo sapiens
gatggccgggcgcggtggctca

SEQ ID NO: 1337600 - DNA, 15 bp, Homo sapiens
gatggcttgtctata

SEQ ID NO: 1337601 - DNA, 20 bp, Homo sapiens
gatggtgtagccctcccact

SEQ ID NO: 1337602 - DNA, 19 bp, Homo sapiens
gatggtgtggcctgtggct

SEQ ID NO: 1337603 - DNA, 18 bp, Homo sapiens
gatggttcttcacctcct

SEQ ID NO: 1337604 - DNA, 16 bp, Homo sapiens
gatggttttaaacttt

SEQ ID NO: 1337605 - DNA, 19 bp, Homo sapiens
gatgtcagcagttgctggt

SEQ ID NO: 1337606 - DNA, 16 bp, Homo sapiens
gatgtctttttattaa

SEQ ID NO: 1337607 - DNA, 22 bp, Homo sapiens
gatgtgaattattgacactgaa

SEQ ID NO: 1337608 - DNA, 23 bp, Homo sapiens
gatgtggccctggctgccggcac

SEQ ID NO: 1337609 - DNA, 13 bp, Homo sapiens
gatgttgccatgt

SEQ ID NO: 1337610 - DNA, 14 bp, Homo sapiens
gatgtttaaaacac

SEQ ID NO: 1337611 - DNA, 13 bp, Homo sapiens
gatgtttccagac

SEQ ID NO: 1337612 - DNA, 22 bp, Homo sapiens
gattaaaaatatcaaattaatt

SEQ ID NO: 1337613 - DNA, 18 bp, Homo sapiens
gattaaagctaaggacct

SEQ ID NO: 1337614 - DNA, 20 bp, Homo sapiens
gattaaatacatatggatgt

SEQ ID NO: 1337615 - DNA, 21 bp, Homo sapiens
gattaaccacttcagctgact

SEQ ID NO: 1337616 - DNA, 20 bp, Homo sapiens
gattaatttgcatctgaaat

SEQ ID NO: 1337617 - DNA, 14 bp, Homo sapiens
gattacacacgtga

SEQ ID NO: 1337618 - DNA, 13 bp, Homo sapiens
gattagtttagaa

SEQ ID NO: 1337619 - DNA, 17 bp, Homo sapiens
gattatttaagactaaa

SEQ ID NO: 1337620 - DNA, 11 bp, Homo sapiens
gattatttgca

SEQ ID NO: 1337621 - DNA, 17 bp, Homo sapiens
gattatttgcatgttat

SEQ ID NO: 1337622 - DNA, 18 bp, Homo sapiens
gattatttgcatgttatg

SEQ ID NO: 1337623 - DNA, 19 bp, Homo sapiens
gattatttgcatgttatgt

SEQ ID NO: 1337624 - DNA, 17 bp, Homo sapiens
gattattttttttttct

SEQ ID NO: 1337625 - DNA, 13 bp, Homo sapiens
gattcagctctgc

SEQ ID NO: 1337626 - DNA, 13 bp, Homo sapiens
gattcagtcacat

SEQ ID NO: 1337627 - DNA, 16 bp, Homo sapiens
gattctggctttaagc

SEQ ID NO: 1337628 - DNA, 20 bp, Homo sapiens
gattctttcagttctttgga

SEQ ID NO: 1337629 - DNA, 14 bp, Homo sapiens
gattgagtgagggc

SEQ ID NO: 1337630 - DNA, 19 bp, Homo sapiens
gattgatatctataaaata

SEQ ID NO: 1337631 - DNA, 22 bp, Homo sapiens
gatttctcattgacttttataa

SEQ ID NO: 1337632 - DNA, 20 bp, Homo sapiens
gatttctttaaaagaatgac

SEQ ID NO: 1337633 - DNA, 11 bp, Homo sapiens
gatttgcaata

SEQ ID NO: 1337634 - DNA, 13 bp, Homo sapiens
gatttgccataga

SEQ ID NO: 1337635 - DNA, 15 bp, Homo sapiens
gatttgctgctcttc

SEQ ID NO: 1337636 - DNA, 21 bp, Homo sapiens
gatttgttgttctttcagaaa

SEQ ID NO: 1337637 - DNA, 15 bp, Homo sapiens
gattttaacttaact

SEQ ID NO: 1337638 - DNA, 19 bp, Homo sapiens
gattttcacattcttggct

SEQ ID NO: 1337639 - DNA, 18 bp, Homo sapiens
gatttttactgtgtttta

SEQ ID NO: 1337640 - DNA, 18 bp, Homo sapiens
gcaaaaaaaaaaaaaagc

SEQ ID NO: 1337641 - DNA, 16 bp, Homo sapiens
gcaaaaggcctcttgt

SEQ ID NO: 1337642 - DNA, 20 bp, Homo sapiens
gcaaaggaaggtggatggcc

SEQ ID NO: 1337643 - DNA, 23 bp, Homo sapiens
gcaaatgttaaaagttttatatg

SEQ ID NO: 1337644 - DNA, 16 bp, Homo sapiens
gcaacacagcctgggc

SEQ ID NO: 1337645 - DNA, 22 bp, Homo sapiens
gcaacagggtatggactatctg

SEQ ID NO: 1337646 - DNA, 17 bp, Homo sapiens
gcaaccaggaacagcaa

SEQ ID NO: 1337647 - DNA, 20 bp, Homo sapiens
gcaaccaggaacagcaaatg

SEQ ID NO: 1337648 - DNA, 18 bp, Homo sapiens
gcaacctacccagcgtgg

SEQ ID NO: 1337649 - DNA, 22 bp, Homo sapiens
gcaacgccgtgggctgcgtcct

SEQ ID NO: 1337650 - DNA, 14 bp, Homo sapiens
gcaacttcttctcc

SEQ ID NO: 1337651 - DNA, 20 bp, Homo sapiens
gcaagagggggtggaggggt

SEQ ID NO: 1337652 - DNA, 22 bp, Homo sapiens
gcaagagggggtggaggggtgt

SEQ ID NO: 1337653 - DNA, 13 bp, Homo sapiens
gcaagatgtgaat

SEQ ID NO: 1337654 - DNA, 21 bp, Homo sapiens
gcaagatgtgaattattgaca

SEQ ID NO: 1337655 - DNA, 14 bp, Homo sapiens
gcaagcagaggacc

SEQ ID NO: 1337656 - DNA, 18 bp, Homo sapiens
gcaagctccgcaggactt

SEQ ID NO: 1337657 - DNA, 22 bp, Homo sapiens
gcaaggggttcccttgagggct

SEQ ID NO: 1337658 - DNA, 18 bp, Homo sapiens
gcaagtttccatcatcta

SEQ ID NO: 1337659 - DNA, 13 bp, Homo sapiens
gcaataaaattta

SEQ ID NO: 1337660 - DNA, 13 bp, Homo sapiens
gcaataaattttg

SEQ ID NO: 1337661 - DNA, 17 bp, Homo sapiens
gcaatggtagtttctgt

SEQ ID NO: 1337662 - DNA, 20 bp, Homo sapiens
gcacaccaatcttactttgt

SEQ ID NO: 1337663 - DNA, 15 bp, Homo sapiens
gcacagctaattcta

SEQ ID NO: 1337664 - DNA, 12 bp, Homo sapiens
gcacagctcagg

SEQ ID NO: 1337665 - DNA, 21 bp, Homo sapiens
gcacagcttgacctgaggctg

SEQ ID NO: 1337666 - DNA, 22 bp, Homo sapiens
gcacagcttgacctgaggctgt

SEQ ID NO: 1337667 - DNA, 16 bp, Homo sapiens
gcacaggaggcaggca

SEQ ID NO: 1337668 - DNA, 21 bp, Homo sapiens
gcacaggaggcaggcatggcc

SEQ ID NO: 1337669 - DNA, 20 bp, Homo sapiens
gcacctcttccttgatgttt

SEQ ID NO: 1337670 - DNA, 15 bp, Homo sapiens
gcaccttgtgcctgg

SEQ ID NO: 1337671 - DNA, 14 bp, Homo sapiens
gcaccttttactgt

SEQ ID NO: 1337672 - DNA, 15 bp, Homo sapiens
gcaccttttactgtg

SEQ ID NO: 1337673 - DNA, 23 bp, Homo sapiens
gcaccttttactgtgatgtttgt

SEQ ID NO: 1337674 - DNA, 13 bp, Homo sapiens
gcacgtcatggga

SEQ ID NO: 1337675 - DNA, 20 bp, Homo sapiens
gcactcctcggtactcccat

SEQ ID NO: 1337676 - DNA, 17 bp, Homo sapiens
gcactctgtatatttga

SEQ ID NO: 1337677 - DNA, 17 bp, Homo sapiens
gcactgactgggcatag

SEQ ID NO: 1337678 - DNA, 14 bp, Homo sapiens
gcactgggctcccg

SEQ ID NO: 1337679 - DNA, 22 bp, Homo sapiens
gcacttactggtaggaccaagc

SEQ ID NO: 1337680 - DNA, 23 bp, Homo sapiens
gcacttattgaccattttttaat

SEQ ID NO: 1337681 - DNA, 14 bp, Homo sapiens
gcacttgcctgggt

SEQ ID NO: 1337682 - DNA, 15 bp, Homo sapiens
gcacttgcctgggtc

SEQ ID NO: 1337683 - DNA, 17 bp, Homo sapiens
gcacttgtgattattta

SEQ ID NO: 1337684 - DNA, 21 bp, Homo sapiens
gcacttgtgattatttattat

SEQ ID NO: 1337685 - DNA, 22 bp, Homo sapiens
gcactttgggaggccgaggcgg

SEQ ID NO: 1337686 - DNA, 19 bp, Homo sapiens
gcagaaaaaggctgtgctg

SEQ ID NO: 1337687 - DNA, 14 bp, Homo sapiens
gcagacaataaacc

SEQ ID NO: 1337688 - DNA, 17 bp, Homo sapiens
gcagacaataaaccctc

SEQ ID NO: 1337689 - DNA, 16 bp, Homo sapiens
gcagagatttctcatt

SEQ ID NO: 1337690 - DNA, 12 bp, Homo sapiens
gcagagctggct

SEQ ID NO: 1337691 - DNA, 23 bp, Homo sapiens
gcagagctggctctgagcgcctc

SEQ ID NO: 1337692 - DNA, 14 bp, Homo sapiens
gcagaggaccaggg

SEQ ID NO: 1337693 - DNA, 15 bp, Homo sapiens
gcagaggccagaggc

SEQ ID NO: 1337694 - DNA, 18 bp, Homo sapiens
gcagatgccaccctagcc

SEQ ID NO: 1337695 - DNA, 16 bp, Homo sapiens
gcagattttacagagc

SEQ ID NO: 1337696 - DNA, 16 bp, Homo sapiens
gcagcaccgaggggcc

SEQ ID NO: 1337697 - DNA, 13 bp, Homo sapiens
gcagcccaccctg

SEQ ID NO: 1337698 - DNA, 17 bp, Homo sapiens
gcagcccaccctgctgc

SEQ ID NO: 1337699 - DNA, 13 bp, Homo sapiens
gcagcccagagac

SEQ ID NO: 1337700 - DNA, 22 bp, Homo sapiens
gcagcccagagactttgtagat

SEQ ID NO: 1337701 - DNA, 20 bp, Homo sapiens
gcagccgccccatctgcccc

SEQ ID NO: 1337702 - DNA, 22 bp, Homo sapiens
gcagcctctcagtgccctccag

SEQ ID NO: 1337703 - DNA, 22 bp, Homo sapiens
gcagctgctatttattttccta

SEQ ID NO: 1337704 - DNA, 15 bp, Homo sapiens
gcagctgtcccttgc

SEQ ID NO: 1337705 - DNA, 22 bp, Homo sapiens
gcagctgtcccttgcttgcctg

SEQ ID NO: 1337706 - DNA, 23 bp, Homo sapiens
gcagcttataatgggctctccgg

SEQ ID NO: 1337707 - DNA, 14 bp, Homo sapiens
gcaggattgaaaat

SEQ ID NO: 1337708 - DNA, 19 bp, Homo sapiens
gcaggcacgggtggtcccc

SEQ ID NO: 1337709 - DNA, 15 bp, Homo sapiens
gcaggccctggcctc

SEQ ID NO: 1337710 - DNA, 16 bp, Homo sapiens
gcaggccctggcctcc

SEQ ID NO: 1337711 - DNA, 19 bp, Homo sapiens
gcaggctcactgccaggcc

SEQ ID NO: 1337712 - DNA, 14 bp, Homo sapiens
gcaggctcccctga

SEQ ID NO: 1337713 - DNA, 22 bp, Homo sapiens
gcaggctggccagtccaggctg

SEQ ID NO: 1337714 - DNA, 11 bp, Homo sapiens
gcaggctgggc

SEQ ID NO: 1337715 - DNA, 13 bp, Homo sapiens
gcaggctgggcca

SEQ ID NO: 1337716 - DNA, 14 bp, Homo sapiens
gcaggctgggccat

SEQ ID NO: 1337717 - DNA, 18 bp, Homo sapiens
gcagggaagccccacatg

SEQ ID NO: 1337718 - DNA, 22 bp, Homo sapiens
gcagggccatggctcagggtgg

SEQ ID NO: 1337719 - DNA, 20 bp, Homo sapiens
gcaggggtgggggtggaggc

SEQ ID NO: 1337720 - DNA, 17 bp, Homo sapiens
gcagtagaactccaggc

SEQ ID NO: 1337721 - DNA, 16 bp, Homo sapiens
gcagtcgtgcctgtgt

SEQ ID NO: 1337722 - DNA, 22 bp, Homo sapiens
gcagtgttttgcaagtgctgga

SEQ ID NO: 1337723 - DNA, 19 bp, Homo sapiens
gcagttctactcaggctgg

SEQ ID NO: 1337724 - DNA, 23 bp, Homo sapiens
gcagttgctggtaaaatgaagaa

SEQ ID NO: 1337725 - DNA, 17 bp, Homo sapiens
gcagtttcttcatctca

SEQ ID NO: 1337726 - DNA, 14 bp, Homo sapiens
gcatactttgtaaa

SEQ ID NO: 1337727 - DNA, 14 bp, Homo sapiens
gcatactttgtatt

SEQ ID NO: 1337728 - DNA, 18 bp, Homo sapiens
gcatactttgtattttga

SEQ ID NO: 1337729 - DNA, 19 bp, Homo sapiens
gcatagataatattgtttg

SEQ ID NO: 1337730 - DNA, 19 bp, Homo sapiens
gcataggacctttccacca

SEQ ID NO: 1337731 - DNA, 12 bp, Homo sapiens
gcatagtttctt

SEQ ID NO: 1337732 - DNA, 13 bp, Homo sapiens
gcatagtttcttt

SEQ ID NO: 1337733 - DNA, 16 bp, Homo sapiens
gcatcacctgcctgtt

SEQ ID NO: 1337734 - DNA, 16 bp, Homo sapiens
gcatcacttaaaacac

SEQ ID NO: 1337735 - DNA, 12 bp, Homo sapiens
gcatcagggtta

SEQ ID NO: 1337736 - DNA, 11 bp, Homo sapiens
gcatccagcct

SEQ ID NO: 1337737 - DNA, 22 bp, Homo sapiens
gcatccctttttcataaattat

SEQ ID NO: 1337738 - DNA, 18 bp, Homo sapiens
gcatcgcaccattctgac

SEQ ID NO: 1337739 - DNA, 16 bp, Homo sapiens
gcatcggcctagggcc

SEQ ID NO: 1337740 - DNA, 15 bp, Homo sapiens
gcatcttgcctccag

SEQ ID NO: 1337741 - DNA, 17 bp, Homo sapiens
gcatcttgcctccaggt

SEQ ID NO: 1337742 - DNA, 11 bp, Homo sapiens
gcatctttgat

SEQ ID NO: 1337743 - DNA, 14 bp, Homo sapiens
gcatgaaataaaat

SEQ ID NO: 1337744 - DNA, 18 bp, Homo sapiens
gcatgaaataaaatatat

SEQ ID NO: 1337745 - DNA, 14 bp, Homo sapiens
gcatgaaatgtgaa

SEQ ID NO: 1337746 - DNA, 18 bp, Homo sapiens
gcatgagactcagtgcag

SEQ ID NO: 1337747 - DNA, 18 bp, Homo sapiens
gcatgcaaatgagctctg

SEQ ID NO: 1337748 - DNA, 21 bp, Homo sapiens
gcatgcaaatgagctctgaaa

SEQ ID NO: 1337749 - DNA, 16 bp, Homo sapiens
gcatggaaatcagcca

SEQ ID NO: 1337750 - DNA, 15 bp, Homo sapiens
gcatggtggccagag

SEQ ID NO: 1337751 - DNA, 21 bp, Homo sapiens
gcatggttttgtgccatctgt

SEQ ID NO: 1337752 - DNA, 14 bp, Homo sapiens
gcatgtcaaacatg

SEQ ID NO: 1337753 - DNA, 20 bp, Homo sapiens
gcatgtcaaacatgagatgt

SEQ ID NO: 1337754 - DNA, 21 bp, Homo sapiens
gcatgtcaaacatgagatgtg

SEQ ID NO: 1337755 - DNA, 21 bp, Homo sapiens
gcatgtcagacagaacttgaa

SEQ ID NO: 1337756 - DNA, 15 bp, Homo sapiens
gcattataaaaagaa

SEQ ID NO: 1337757 - DNA, 19 bp, Homo sapiens
gcattcatttttatagcaa

SEQ ID NO: 1337758 - DNA, 22 bp, Homo sapiens
gcattcatttttatagcaacaa

SEQ ID NO: 1337759 - DNA, 10 bp, Homo sapiens
gcattgagta

SEQ ID NO: 1337760 - DNA, 17 bp, Homo sapiens
gcattgagtattgttta

SEQ ID NO: 1337761 - DNA, 12 bp, Homo sapiens
gcattgtaagcg

SEQ ID NO: 1337762 - DNA, 13 bp, Homo sapiens
gcatttaaaaaaa

SEQ ID NO: 1337763 - DNA, 23 bp, Homo sapiens
gcatttagggagtattctaataa

SEQ ID NO: 1337764 - DNA, 21 bp, Homo sapiens
gcatttttcaatatattgaac

SEQ ID NO: 1337765 - DNA, 14 bp, Homo sapiens
gccaaaattaaggt

SEQ ID NO: 1337766 - DNA, 21 bp, Homo sapiens
gccaaaattaaggtgtttgaa

SEQ ID NO: 1337767 - DNA, 17 bp, Homo sapiens
gccaaaattcatttcta

SEQ ID NO: 1337768 - DNA, 16 bp, Homo sapiens
gccaaagcctcctcca

SEQ ID NO: 1337769 - DNA, 13 bp, Homo sapiens
gccaaaggctggc

SEQ ID NO: 1337770 - DNA, 15 bp, Homo sapiens
gccaagaagcagtgg

SEQ ID NO: 1337771 - DNA, 16 bp, Homo sapiens
gccaagaatattgcaa

SEQ ID NO: 1337772 - DNA, 16 bp, Homo sapiens
gcccgtcctgcctgtg

SEQ ID NO: 1337773 - DNA, 17 bp, Homo sapiens
gcccgtcctgcctgtgg

SEQ ID NO: 1337774 - DNA, 23 bp, Homo sapiens
gcccgtgtagtccccaaccgtgt

SEQ ID NO: 1337775 - DNA, 18 bp, Homo sapiens
gccctaaccccttccaga

SEQ ID NO: 1337776 - DNA, 20 bp, Homo sapiens
gccctactccctgcagatgc

SEQ ID NO: 1337777 - DNA, 22 bp, Homo sapiens
gccctactccctgcagatgcca

SEQ ID NO: 1337778 - DNA, 19 bp, Homo sapiens
gccctctcaggccggcagc

SEQ ID NO: 1337779 - DNA, 12 bp, Homo sapiens
gccctcttctcg

SEQ ID NO: 1337780 - DNA, 18 bp, Homo sapiens
gccctgaagaatggcgcc

SEQ ID NO: 1337781 - DNA, 21 bp, Homo sapiens
gccctgccactcactaggccc

SEQ ID NO: 1337782 - DNA, 21 bp, Homo sapiens
gccctgctggggatccccgcc

SEQ ID NO: 1337783 - DNA, 16 bp, Homo sapiens
gccctggcagggggca

SEQ ID NO: 1337784 - DNA, 12 bp, Homo sapiens
gccctggcctcc

SEQ ID NO: 1337785 - DNA, 21 bp, Homo sapiens
gccctggcctcccctgccacc

SEQ ID NO: 1337786 - DNA, 16 bp, Homo sapiens
gccctggctgccggca

SEQ ID NO: 1337787 - DNA, 15 bp, Homo sapiens
gccctggctgctgcc

SEQ ID NO: 1337788 - DNA, 17 bp, Homo sapiens
gccctggctgctgcccc

SEQ ID NO: 1337789 - DNA, 18 bp, Homo sapiens
gccctgggctggaatcag

SEQ ID NO: 1337790 - DNA, 12 bp, Homo sapiens
gccctgtgtgca

SEQ ID NO: 1337791 - DNA, 13 bp, Homo sapiens
gccctgtgtgcag

SEQ ID NO: 1337792 - DNA, 23 bp, Homo sapiens
gcccttccgcagtgtggccaggc

SEQ ID NO: 1337793 - DNA, 17 bp, Homo sapiens
gcccttcctgctgcgca

SEQ ID NO: 1337794 - DNA, 12 bp, Homo sapiens
gcccttgggcca

SEQ ID NO: 1337795 - DNA, 13 bp, Homo sapiens
gccctttgctgtc

SEQ ID NO: 1337796 - DNA, 14 bp, Homo sapiens
gccctttgctgtcc

SEQ ID NO: 1337797 - DNA, 23 bp, Homo sapiens
gccgagactcgactctgtgcctc

SEQ ID NO: 1337798 - DNA, 18 bp, Homo sapiens
gccgagattgcaccactg

SEQ ID NO: 1337799 - DNA, 22 bp, Homo sapiens
gccgatagagggacggccaaga

SEQ ID NO: 1337800 - DNA, 18 bp, Homo sapiens
gccgcatctcacagctat

SEQ ID NO: 1337801 - DNA, 20 bp, Homo sapiens
gccgccccatctgccccaca

SEQ ID NO: 1337802 - DNA, 16 bp, Homo sapiens
gccgccccctcctgaa

SEQ ID NO: 1337803 - DNA, 13 bp, Homo sapiens
gccgccgcctctt

SEQ ID NO: 1337804 - DNA, 13 bp, Homo sapiens
gccgctaggtaga

SEQ ID NO: 1337805 - DNA, 23 bp, Homo sapiens
gccgctaggtagagtctgagggc

SEQ ID NO: 1337806 - DNA, 22 bp, Homo sapiens
gccggacccggaggccgaggcc

SEQ ID NO: 1337807 - DNA, 15 bp, Homo sapiens
gccggatctgaggga

SEQ ID NO: 1337808 - DNA, 16 bp, Homo sapiens
gccggcagccccagcc

SEQ ID NO: 1337809 - DNA, 18 bp, Homo sapiens
gccggcagccccagcctg

SEQ ID NO: 1337810 - DNA, 14 bp, Homo sapiens
gccggccccaggct

SEQ ID NO: 1337811 - DNA, 16 bp, Homo sapiens
gccggcccgcctctcc

SEQ ID NO: 1337812 - DNA, 15 bp, Homo sapiens
gccggccctgtgtgc

SEQ ID NO: 1337813 - DNA, 18 bp, Homo sapiens
gccgggaccaccctgagc

SEQ ID NO: 1337814 - DNA, 22 bp, Homo sapiens
gccgggcacattgagctgtgca

SEQ ID NO: 1337815 - DNA, 12 bp, Homo sapiens
gccgggcccctg

SEQ ID NO: 1337816 - DNA, 16 bp, Homo sapiens
gccgggcgcggtggct

SEQ ID NO: 1337817 - DNA, 12 bp, Homo sapiens
gccggggaagag

SEQ ID NO: 1337818 - DNA, 17 bp, Homo sapiens
gccggttcctgtccctg

SEQ ID NO: 1337819 - DNA, 23 bp, Homo sapiens
gccgtatctccggctcccagcct

SEQ ID NO: 1337820 - DNA, 13 bp, Homo sapiens
gccgtcaccacca

SEQ ID NO: 1337821 - DNA, 15 bp, Homo sapiens
gccgtcaccaccacc

SEQ ID NO: 1337822 - DNA, 11 bp, Homo sapiens
gccgtctcaac

SEQ ID NO: 1337823 - DNA, 14 bp, Homo sapiens
gccgtctccagggg

SEQ ID NO: 1337824 - DNA, 20 bp, Homo sapiens
gccgtgtaaccatggaccca

SEQ ID NO: 1337825 - DNA, 18 bp, Homo sapiens
gccgttgctgacttagaa

SEQ ID NO: 1337826 - DNA, 19 bp, Homo sapiens
gccgttgctgacttagaat

SEQ ID NO: 1337827 - DNA, 15 bp, Homo sapiens
gcctaaacctcagtt

SEQ ID NO: 1337828 - DNA, 22 bp, Homo sapiens
gcctacagctttgatccctgac

SEQ ID NO: 1337829 - DNA, 21 bp, Homo sapiens
gcctaccccgcagacaccttg

SEQ ID NO: 1337830 - DNA, 12 bp, Homo sapiens
gcctagcacagc

SEQ ID NO: 1337831 - DNA, 22 bp, Homo sapiens
gcctagcgatctctcctggcct

SEQ ID NO: 1337832 - DNA, 13 bp, Homo sapiens
gcctcactggggc

SEQ ID NO: 1337833 - DNA, 14 bp, Homo sapiens
gcctcactggggca

SEQ ID NO: 1337834 - DNA, 21 bp, Homo sapiens
gcctcagactggagggcaagg

SEQ ID NO: 1337835 - DNA, 16 bp, Homo sapiens
gcctcagcgcggccct

SEQ ID NO: 1337836 - DNA, 18 bp, Homo sapiens
gcctcagcgcggccctcc

SEQ ID NO: 1337837 - DNA, 14 bp, Homo sapiens
gcctcatgtggctg

SEQ ID NO: 1337838 - DNA, 16 bp, Homo sapiens
gcctcatgtggctgga

SEQ ID NO: 1337839 - DNA, 17 bp, Homo sapiens
gcctcatgtggctggaa

SEQ ID NO: 1337840 - DNA, 14 bp, Homo sapiens
gcctccacagcgag

SEQ ID NO: 1337841 - DNA, 16 bp, Homo sapiens
gcctccccacctccag

SEQ ID NO: 1337842 - DNA, 18 bp, Homo sapiens
gcctccccacctccaggc

SEQ ID NO: 1337843 - DNA, 20 bp, Homo sapiens
gcctccccatttcccatctg

SEQ ID NO: 1337844 - DNA, 18 bp, Homo sapiens
gcctccctccaccccagg

SEQ ID NO: 1337845 - DNA, 15 bp, Homo sapiens
gcctccgagagggag

SEQ ID NO: 1337846 - DNA, 13 bp, Homo sapiens
gcctcctccagcc

SEQ ID NO: 1337847 - DNA, 20 bp, Homo sapiens
gcctcctctggacggcaggc

SEQ ID NO: 1337848 - DNA, 19 bp, Homo sapiens
gcctccttagaaaaaaaat

SEQ ID NO: 1337849 - DNA, 22 bp, Homo sapiens
gcctctcagtgccctccagccc

SEQ ID NO: 1337850 - DNA, 15 bp, Homo sapiens
gcctctccagcctca

SEQ ID NO: 1337851 - DNA, 22 bp, Homo sapiens
gcctctccatttgctcttcaga

SEQ ID NO: 1337852 - DNA, 23 bp, Homo sapiens
gcctctccccaggtccagctctg

SEQ ID NO: 1337853 - DNA, 12 bp, Homo sapiens
gcctcttctcta

SEQ ID NO: 1337854 - DNA, 14 bp, Homo sapiens
gcctcttgaccagg

SEQ ID NO: 1337855 - DNA, 17 bp, Homo sapiens
gcctcttgaccaggctg

SEQ ID NO: 1337856 - DNA, 13 bp, Homo sapiens
gcctgagaggcag

SEQ ID NO: 1337857 - DNA, 19 bp, Homo sapiens
gcctgagaggcaggcatag

SEQ ID NO: 1337858 - DNA, 22 bp, Homo sapiens
gcctgagccctactccctgcag

SEQ ID NO: 1337859 - DNA, 16 bp, Homo sapiens
gcctgatcctccaaca

SEQ ID NO: 1337860 - DNA, 19 bp, Homo sapiens
gcctgatgacaataaagct

SEQ ID NO: 1337861 - DNA, 20 bp, Homo sapiens
gcctgatgacaataaagctt

SEQ ID NO: 1337862 - DNA, 19 bp, Homo sapiens
gcctgatgagatttttaaa

SEQ ID NO: 1337863 - DNA, 20 bp, Homo sapiens
gcctgatgagatttttaaaa

SEQ ID NO: 1337864 - DNA, 18 bp, Homo sapiens
gcctgcaatctgagccag

SEQ ID NO: 1337865 - DNA, 12 bp, Homo sapiens
gcctgcagggaa

SEQ ID NO: 1337866 - DNA, 22 bp, Homo sapiens
gcctgcagggaagccccacatg

SEQ ID NO: 1337867 - DNA, 21 bp, Homo sapiens
gcctgcagggccatggctcag

SEQ ID NO: 1337868 - DNA, 14 bp, Homo sapiens
gcctgcatttcctc

SEQ ID NO: 1337869 - DNA, 15 bp, Homo sapiens
gcctgcccagacaag

SEQ ID NO: 1337870 - DNA, 16 bp, Homo sapiens
gcctgcccagacaaga

SEQ ID NO: 1337871 - DNA, 23 bp, Homo sapiens
gcctgcgaccctgggggcacagg

SEQ ID NO: 1337872 - DNA, 20 bp, Homo sapiens
gcctgctagctagctcaact

SEQ ID NO: 1337873 - DNA, 16 bp, Homo sapiens
gcctgctccagctgtt

SEQ ID NO: 1337874 - DNA, 18 bp, Homo sapiens
gcctgctccagctgttca

SEQ ID NO: 1337875 - DNA, 22 bp, Homo sapiens
gcctgctgtgattccactacac

SEQ ID NO: 1337876 - DNA, 20 bp, Homo sapiens
gcctggagatcctcctgcag

SEQ ID NO: 1337877 - DNA, 20 bp, Homo sapiens
gcctggcagtccgtgggacg

SEQ ID NO: 1337878 - DNA, 22 bp, Homo sapiens
gcctggcccccaacctcagggc

SEQ ID NO: 1337879 - DNA, 23 bp, Homo sapiens
gcctggccttgtcctcagccagt

SEQ ID NO: 1337880 - DNA, 21 bp, Homo sapiens
gcctgggaggtcaaggctgca

SEQ ID NO: 1337881 - DNA, 22 bp, Homo sapiens
gcctggggtgttagtggcaccg

SEQ ID NO: 1337882 - DNA, 21 bp, Homo sapiens
gcctgggtcacacacggaggc

SEQ ID NO: 1337883 - DNA, 13 bp, Homo sapiens
gcctggtgctgct

SEQ ID NO: 1337884 - DNA, 20 bp, Homo sapiens
gcctggtgcttccaaatatt

SEQ ID NO: 1337885 - DNA, 20 bp, Homo sapiens
gcctgttaggagaagctgca

SEQ ID NO: 1337886 - DNA, 13 bp, Homo sapiens
gccttcagctcca

SEQ ID NO: 1337887 - DNA, 14 bp, Homo sapiens
gccttcagctccag

SEQ ID NO: 1337888 - DNA, 24 bp, Homo sapiens
gccttccctagctttagaccctgg

SEQ ID NO: 1337889 - DNA, 17 bp, Homo sapiens
gccttcgcttcttgcct

SEQ ID NO: 1337890 - DNA, 17 bp, Homo sapiens
ggggcttgaagccaaag

SEQ ID NO: 1337891 - DNA, 15 bp, Homo sapiens
gggggacccagtgca

SEQ ID NO: 1337892 - DNA, 15 bp, Homo sapiens
gggggcacaggaggc

SEQ ID NO: 1337893 - DNA, 18 bp, Homo sapiens
gggggtctcacccatgca

SEQ ID NO: 1337894 - DNA, 13 bp, Homo sapiens
gggggtggaggct

SEQ ID NO: 1337895 - DNA, 16 bp, Homo sapiens
ggggtccctagcagcc

SEQ ID NO: 1337896 - DNA, 17 bp, Homo sapiens
ggggtctcacccatgca

SEQ ID NO: 1337897 - DNA, 18 bp, Homo sapiens
ggggtgggggtggaggct

SEQ ID NO: 1337898 - DNA, 18 bp, Homo sapiens
ggggttcctcaaattttt

SEQ ID NO: 1337899 - DNA, 19 bp, Homo sapiens
gggtaggagggtgggaagg

SEQ ID NO: 1337900 - DNA, 23 bp, Homo sapiens
gggtcggaacccaagcttagaac

SEQ ID NO: 1337901 - DNA, 16 bp, Homo sapiens
gggtctccctggctcc

SEQ ID NO: 1337902 - DNA, 18 bp, Homo sapiens
gggtctccctggctccct

SEQ ID NO: 1337903 - DNA, 22 bp, Homo sapiens
gggtctccctggctccctcctc

SEQ ID NO: 1337904 - DNA, 19 bp, Homo sapiens
gggtgacagagcaagtgag

SEQ ID NO: 1337905 - DNA, 19 bp, Homo sapiens
gggtgagtccattctccca

SEQ ID NO: 1337906 - DNA, 13 bp, Homo sapiens
gggtgcagcccaa

SEQ ID NO: 1337907 - DNA, 20 bp, Homo sapiens
gggtgcttttatagaggcta

SEQ ID NO: 1337908 - DNA, 21 bp, Homo sapiens
gggtgcttttatagaggctag

SEQ ID NO: 1337909 - DNA, 22 bp, Homo sapiens
gggtgcttttatagaggctagc

SEQ ID NO: 1337910 - DNA, 19 bp, Homo sapiens
gggtggcaccagcagcctg

SEQ ID NO: 1337911 - DNA, 17 bp, Homo sapiens
gggtggccgctgagtgg

SEQ ID NO: 1337912 - DNA, 23 bp, Homo sapiens
gggtgtcttgggcagagctggct

SEQ ID NO: 1337913 - DNA, 13 bp, Homo sapiens
gggtgtgctggga

SEQ ID NO: 1337914 - DNA, 16 bp, Homo sapiens
gggttaagaagacttt

SEQ ID NO: 1337915 - DNA, 13 bp, Homo sapiens
gggttcatttgtg

SEQ ID NO: 1337916 - DNA, 17 bp, Homo sapiens
gggttcctcaaattttt

SEQ ID NO: 1337917 - DNA, 18 bp, Homo sapiens
ggtaaaaagtattttttc

SEQ ID NO: 1337918 - DNA, 15 bp, Homo sapiens
ggtaaataaaccact

SEQ ID NO: 1337919 - DNA, 17 bp, Homo sapiens
ggtaactgtcctgtcct

SEQ ID NO: 1337920 - DNA, 20 bp, Homo sapiens
ggtaatacttccagaagtgc

SEQ ID NO: 1337921 - DNA, 17 bp, Homo sapiens
ggtacccggggcccagg

SEQ ID NO: 1337922 - DNA, 19 bp, Homo sapiens
ggtacccggggcccagggc

SEQ ID NO: 1337923 - DNA, 18 bp, Homo sapiens
ggtactaataatcttgtt

SEQ ID NO: 1337924 - DNA, 16 bp, Homo sapiens
ggtacttgtcatttcg

SEQ ID NO: 1337925 - DNA, 16 bp, Homo sapiens
ggtaggttcagccaag

SEQ ID NO: 1337926 - DNA, 17 bp, Homo sapiens
ggtaggttcagccaagg

SEQ ID NO: 1337927 - DNA, 12 bp, Homo sapiens
ggtatcatatat

SEQ ID NO: 1337928 - DNA, 14 bp, Homo sapiens
ggtatttaaagtat

SEQ ID NO: 1337929 - DNA, 21 bp, Homo sapiens
ggtcacagcggaggtgtggag

SEQ ID NO: 1337930 - DNA, 14 bp, Homo sapiens
ggtcaccatgaaac

SEQ ID NO: 1337931 - DNA, 15 bp, Homo sapiens
ggtcaccatgaaact

SEQ ID NO: 1337932 - DNA, 13 bp, Homo sapiens
ggtcactggaaag

SEQ ID NO: 1337933 - DNA, 22 bp, Homo sapiens
ggtcatccagactcagagctct

SEQ ID NO: 1337934 - DNA, 12 bp, Homo sapiens
tggcagtggttt

SEQ ID NO: 1337935 - DNA, 14 bp, Homo sapiens
tggccactccgaga

SEQ ID NO: 1337936 - DNA, 20 bp, Homo sapiens
tggccactccgagaggtggg

SEQ ID NO: 1337937 - DNA, 23 bp, Homo sapiens
tggccactccgagaggtgggcca

SEQ ID NO: 1337938 - DNA, 23 bp, Homo sapiens
tggccagagagcctggtgctgct

SEQ ID NO: 1337939 - DNA, 11 bp, Homo sapiens
tggccaggagc

SEQ ID NO: 1337940 - DNA, 22 bp, Homo sapiens
tggccaggagcaggcacgggtg

SEQ ID NO: 1337941 - DNA, 14 bp, Homo sapiens
tggccagtccaggc

SEQ ID NO: 1337942 - DNA, 17 bp, Homo sapiens
tggccagtccaggctgc

SEQ ID NO: 1337943 - DNA, 20 bp, Homo sapiens
tggccagtctggtctcgaac

SEQ ID NO: 1337944 - DNA, 12 bp, Homo sapiens
tggccccagcac

SEQ ID NO: 1337945 - DNA, 13 bp, Homo sapiens
tggccccagcaca

SEQ ID NO: 1337946 - DNA, 14 bp, Homo sapiens
tggccccagcacag

SEQ ID NO: 1337947 - DNA, 18 bp, Homo sapiens
tggccccagcacagcttg

SEQ ID NO: 1337948 - DNA, 18 bp, Homo sapiens
tggccccagccctgctgg

SEQ ID NO: 1337949 - DNA, 20 bp, Homo sapiens
tggccccagccctgctgggg

SEQ ID NO: 1337950 - DNA, 15 bp, Homo sapiens
tggcccctactttgt

SEQ ID NO: 1337951 - DNA, 23 bp, Homo sapiens
tggcccctactttgtggcaatct

SEQ ID NO: 1337952 - DNA, 17 bp, Homo sapiens
tggccgctgagtggcag

SEQ ID NO: 1337953 - DNA, 19 bp, Homo sapiens
tggccgctgagtggcaggg

SEQ ID NO: 1337954 - DNA, 23 bp, Homo sapiens
tggccgggcgcggtggctcacgc

SEQ ID NO: 1337955 - DNA, 21 bp, Homo sapiens
tggcctatccgctgccagcct

SEQ ID NO: 1337956 - DNA, 15 bp, Homo sapiens
tggcctcatgtggct

SEQ ID NO: 1337957 - DNA, 20 bp, Homo sapiens
tggcctcatgtggctggaag

SEQ ID NO: 1337958 - DNA, 21 bp, Homo sapiens
tggcctcccctgccaccaggc

SEQ ID NO: 1337959 - DNA, 14 bp, Homo sapiens
tggcctctgctttc

SEQ ID NO: 1337960 - DNA, 11 bp, Homo sapiens
tggcctggaca

SEQ ID NO: 1337961 - DNA, 15 bp, Homo sapiens
tggcctggacagtat

SEQ ID NO: 1337962 - DNA, 18 bp, Homo sapiens
tggcctttgtaagtgcag

SEQ ID NO: 1337963 - DNA, 19 bp, Homo sapiens
tggcctttgtaagtgcagg

SEQ ID NO: 1337964 - DNA, 16 bp, Homo sapiens
tggcgcaggtgggctg

SEQ ID NO: 1337965 - DNA, 21 bp, Homo sapiens
tggcgcaggtgggctggactt

SEQ ID NO: 1337966 - DNA, 17 bp, Homo sapiens
tggcgccgtctccaggg

SEQ ID NO: 1337967 - DNA, 13 bp, Homo sapiens
tggcgcttagaga

SEQ ID NO: 1337968 - DNA, 20 bp, Homo sapiens
tggcgcttagagaggacaat

SEQ ID NO: 1337969 - DNA, 21 bp, Homo sapiens
tggcgtgacccgacctggccg

SEQ ID NO: 1337970 - DNA, 17 bp, Homo sapiens
tggcgtgggagccagcc

SEQ ID NO: 1337971 - DNA, 22 bp, Homo sapiens
tggctcagctcggggagcctta

SEQ ID NO: 1337972 - DNA, 24 bp, Homo sapiens
tggctcagctcggggagccttagc

SEQ ID NO: 1337973 - DNA, 14 bp, Homo sapiens
tggctcagggtggt

SEQ ID NO: 1337974 - DNA, 21 bp, Homo sapiens
tggctccctcctccaggcctg

SEQ ID NO: 1337975 - DNA, 18 bp, Homo sapiens
tggctccggcctctgcct

SEQ ID NO: 1337976 - DNA, 18 bp, Homo sapiens
tggctgaaattctcctgg

SEQ ID NO: 1337977 - DNA, 22 bp, Homo sapiens
tggctgaaattctcctggaggt

SEQ ID NO: 1337978 - DNA, 20 bp, Homo sapiens
tggctgctgcccccaccccg

SEQ ID NO: 1337979 - DNA, 19 bp, Homo sapiens
tggctggaagatcctgcgg

SEQ ID NO: 1337980 - DNA, 17 bp, Homo sapiens
tggcttcacggaagagc

SEQ ID NO: 1337981 - DNA, 20 bp, Homo sapiens
tggcttcacggaagagcctt

SEQ ID NO: 1337982 - DNA, 20 bp, Homo sapiens
tggcttttattaatgcactt

SEQ ID NO: 1337983 - DNA, 17 bp, Homo sapiens
tgggaaaccatgtagca

SEQ ID NO: 1337984 - DNA, 23 bp, Homo sapiens
tgggacctgccaggcaggggtgg

SEQ ID NO: 1337985 - DNA, 14 bp, Homo sapiens
tgggacggtgccca

SEQ ID NO: 1337986 - DNA, 17 bp, Homo sapiens
tgggactcagccttcag

SEQ ID NO: 1337987 - DNA, 18 bp, Homo sapiens
tgggactgctaaataaaa

SEQ ID NO: 1337988 - DNA, 16 bp, Homo sapiens
tgggagagccatacat

SEQ ID NO: 1337989 - DNA, 19 bp, Homo sapiens
tgggagctccactctgctt

SEQ ID NO: 1337990 - DNA, 15 bp, Homo sapiens
tgggaggagggagag

SEQ ID NO: 1337991 - DNA, 20 bp, Homo sapiens
tgggaggatctcttgagcct

SEQ ID NO: 1337992 - DNA, 22 bp, Homo sapiens
tgggaggatctcttgagcctgg

SEQ ID NO: 1337993 - DNA, 19 bp, Homo sapiens
tgggaggccaaggtgggag

SEQ ID NO: 1337994 - DNA, 13 bp, Homo sapiens
tgggatgaccagg

SEQ ID NO: 1337995 - DNA, 17 bp, Homo sapiens
tgggattcaggaatgtg

SEQ ID NO: 1337996 - DNA, 22 bp, Homo sapiens
tgggatttccagaaccacactt

SEQ ID NO: 1337997 - DNA, 14 bp, Homo sapiens
tgggcaaacaggca

SEQ ID NO: 1337998 - DNA, 15 bp, Homo sapiens
tgggcaaacaggcag

SEQ ID NO: 1337999 - DNA, 14 bp, Homo sapiens
tgggcagagctggc

SEQ ID NO: 1338000 - DNA, 18 bp, Homo sapiens
tgggcagagctggctctg

SEQ ID NO: 1338001 - DNA, 20 bp, Homo sapiens
tgggccagtctgtggatcag

SEQ ID NO: 1338002 - DNA, 14 bp, Homo sapiens
tgggccatgtccaa

SEQ ID NO: 1338003 - DNA, 17 bp, Homo sapiens
tgggccatgtccaaaga

SEQ ID NO: 1338004 - DNA, 18 bp, Homo sapiens
tgggccatgtccaaagag

SEQ ID NO: 1338005 - DNA, 19 bp, Homo sapiens
tgggccatgtccaaagagg

SEQ ID NO: 1338006 - DNA, 24 bp, Homo sapiens
tgggccatgtccaaagaggctgcc

SEQ ID NO: 1338007 - DNA, 16 bp, Homo sapiens
tttatatcatgcaaaa

SEQ ID NO: 1338008 - DNA, 18 bp, Homo sapiens
tttatatggggaatatat

SEQ ID NO: 1338009 - DNA, 12 bp, Homo sapiens
tttatatgtact

SEQ ID NO: 1338010 - DNA, 20 bp, Homo sapiens
tttatatgtatgtgtttaga

SEQ ID NO: 1338011 - DNA, 21 bp, Homo sapiens
tttatatgtatgtgtttagaa

SEQ ID NO: 1338012 - DNA, 18 bp, Homo sapiens
tttatatttcctttatgt

SEQ ID NO: 1338013 - DNA, 14 bp, Homo sapiens
tttatcattcaagt

SEQ ID NO: 1338014 - DNA, 19 bp, Homo sapiens
tttatccagaaaactgtga

SEQ ID NO: 1338015 - DNA, 17 bp, Homo sapiens
tttatctggccccaggt

SEQ ID NO: 1338016 - DNA, 18 bp, Homo sapiens
tttatgcaaaaggtttat

SEQ ID NO: 1338017 - DNA, 16 bp, Homo sapiens
tttatggttatgtttt

SEQ ID NO: 1338018 - DNA, 21 bp, Homo sapiens
tttatggttatgtttttctgt

SEQ ID NO: 1338019 - DNA, 12 bp, Homo sapiens
tttattaatgca

SEQ ID NO: 1338020 - DNA, 17 bp, Homo sapiens
tttattaccccctcctt

SEQ ID NO: 1338021 - DNA, 21 bp, Homo sapiens
tttattactgtttattacttc

SEQ ID NO: 1338022 - DNA, 16 bp, Homo sapiens
tttattacttccatga

SEQ ID NO: 1338023 - DNA, 16 bp, Homo sapiens
tttattatttatttat

SEQ ID NO: 1338024 - DNA, 23 bp, Homo sapiens
tttattatttattttttttaatt

SEQ ID NO: 1338025 - DNA, 16 bp, Homo sapiens
tttattgactcttgag

SEQ ID NO: 1338026 - DNA, 17 bp, Homo sapiens
tttattgttaatacaag

SEQ ID NO: 1338027 - DNA, 19 bp, Homo sapiens
tttattgttaatacaaggt

SEQ ID NO: 1338028 - DNA, 20 bp, Homo sapiens
tttatttacagatgaatgta

SEQ ID NO: 1338029 - DNA, 19 bp, Homo sapiens
tttatttatatgtactgtt

SEQ ID NO: 1338030 - DNA, 17 bp, Homo sapiens
tttatttatatttattg

SEQ ID NO: 1338031 - DNA, 22 bp, Homo sapiens
tttatttatccagaaaactgtg

SEQ ID NO: 1338032 - DNA, 15 bp, Homo sapiens
tttatttatgtactt

SEQ ID NO: 1338033 - DNA, 11 bp, Homo sapiens
tttatttcact

SEQ ID NO: 1338034 - DNA, 16 bp, Homo sapiens
tttatttgtaaattta

SEQ ID NO: 1338035 - DNA, 13 bp, Homo sapiens
tttattttaaaac

SEQ ID NO: 1338036 - DNA, 19 bp, Homo sapiens
tttattttacagctcatta

SEQ ID NO: 1338037 - DNA, 15 bp, Homo sapiens
tttattttgtgtaaa

SEQ ID NO: 1338038 - DNA, 17 bp, Homo sapiens
tttcaaaatccaaaaag

SEQ ID NO: 1338039 - DNA, 18 bp, Homo sapiens
tttcaaaatccaaaaaga

SEQ ID NO: 1338040 - DNA, 12 bp, Homo sapiens
tttcaaagtttt

SEQ ID NO: 1338041 - DNA, 16 bp, Homo sapiens
tttcaagttgtaaata

SEQ ID NO: 1338042 - DNA, 13 bp, Homo sapiens
tttcaatatattg

SEQ ID NO: 1338043 - DNA, 17 bp, Homo sapiens
tttcaatatattgaact

SEQ ID NO: 1338044 - DNA, 18 bp, Homo sapiens
tttcaatatattgaactt

SEQ ID NO: 1338045 - DNA, 14 bp, Homo sapiens
tttcactctaagtc

SEQ ID NO: 1338046 - DNA, 15 bp, Homo sapiens
tttcactctaagtca

SEQ ID NO: 1338047 - DNA, 19 bp, Homo sapiens
tttgctgcactttttactt

SEQ ID NO: 1338048 - DNA, 19 bp, Homo sapiens
tttggacctaaatggcctc

SEQ ID NO: 1338049 - DNA, 13 bp, Homo sapiens
tttggcatttgca

SEQ ID NO: 1338050 - DNA, 19 bp, Homo sapiens
tttggcccaatctctgcca

SEQ ID NO: 1338051 - DNA, 22 bp, Homo sapiens
tttgggaggccaaggtgggagg

SEQ ID NO: 1338052 - DNA, 20 bp, Homo sapiens
tttggggggttttcttgcct

SEQ ID NO: 1338053 - DNA, 16 bp, Homo sapiens
tttggtaaatgtttct

SEQ ID NO: 1338054 - DNA, 23 bp, Homo sapiens
tttgtaaaaatcttttgaagcat

SEQ ID NO: 1338055 - DNA, 14 bp, Homo sapiens
tttgtaaataggat

SEQ ID NO: 1338056 - DNA, 12 bp, Homo sapiens
tttgtaaattct

SEQ ID NO: 1338057 - DNA, 15 bp, Homo sapiens
tttgtaaattctgat

SEQ ID NO: 1338058 - DNA, 18 bp, Homo sapiens
tttgtacatttgggagtt

SEQ ID NO: 1338059 - DNA, 18 bp, Homo sapiens
tttgtatattggttttat

SEQ ID NO: 1338060 - DNA, 23 bp, Homo sapiens
tttgtatgaaaacatggaacagt

SEQ ID NO: 1338061 - DNA, 22 bp, Homo sapiens
tttgtatgccaagtgagaagat

SEQ ID NO: 1338062 - DNA, 14 bp, Homo sapiens
tttgtattttcatg

SEQ ID NO: 1338063 - DNA, 17 bp, Homo sapiens
tttgtcaatgacagttt

SEQ ID NO: 1338064 - DNA, 22 bp, Homo sapiens
tttgttaggattttcacattct

SEQ ID NO: 1338065 - DNA, 16 bp, Homo sapiens
tttgttgcaagatgtg

SEQ ID NO: 1338066 - DNA, 18 bp, Homo sapiens
tttgttgcaagatgtgaa

SEQ ID NO: 1338067 - DNA, 19 bp, Homo sapiens
tttgttgcaagatgtgaat

SEQ ID NO: 1338068 - DNA, 18 bp, Homo sapiens
tttgttgtacttaaatgg

SEQ ID NO: 1338069 - DNA, 19 bp, Homo sapiens
tttgttgttctttcagaaa

SEQ ID NO: 1338070 - DNA, 11 bp, Homo sapiens
tttgtttgttt

SEQ ID NO: 1338071 - DNA, 13 bp, Homo sapiens
ttttaaaacacat

SEQ ID NO: 1338072 - DNA, 23 bp, Homo sapiens
ttttaaaatagaaattttgtaag

SEQ ID NO: 1338073 - DNA, 23 bp, Homo sapiens
ttttaaagaatatgactttttat

SEQ ID NO: 1338074 - DNA, 21 bp, Homo sapiens
ttttaagctgcaaatctgatg

SEQ ID NO: 1338075 - DNA, 15 bp, Homo sapiens
ttttaaggaaaacta

SEQ ID NO: 1338076 - DNA, 21 bp, Homo sapiens
ttttaaggtctttcagtactt

SEQ ID NO: 1338077 - DNA, 18 bp, Homo sapiens
ttttaatctactgcattt

SEQ ID NO: 1338078 - DNA, 14 bp, Homo sapiens
ttttaattgtattt

SEQ ID NO: 1338079 - DNA, 21 bp, Homo sapiens
ttttacacagaaacactgcct

SEQ ID NO: 1338080 - DNA, 18 bp, Homo sapiens
ttttacatgtttataaat

SEQ ID NO: 1338081 - DNA, 15 bp, Homo sapiens
ttttactggttgcat

SEQ ID NO: 1338082 - DNA, 16 bp, Homo sapiens
tgaaacttttctagaa

SEQ ID NO: 1338083 - DNA, 22 bp, Homo sapiens
tgaaaggcaggcctatttcatc

SEQ ID NO: 1338084 - DNA, 15 bp, Homo sapiens
tgaaaggcttttcaa

SEQ ID NO: 1338085 - DNA, 17 bp, Homo sapiens
tgaaagtgcctttgcag

SEQ ID NO: 1338086 - DNA, 13 bp, Homo sapiens
tgaaagttttgta

SEQ ID NO: 1338087 - DNA, 14 bp, Homo sapiens
tgaaagttttgtaa

SEQ ID NO: 1338088 - DNA, 16 bp, Homo sapiens
tgaaagttttgtaaaa

SEQ ID NO: 1338089 - DNA, 12 bp, Homo sapiens
tgaaataaaata

SEQ ID NO: 1338090 - DNA, 14 bp, Homo sapiens
tgaaataaaatata

SEQ ID NO: 1338091 - DNA, 20 bp, Homo sapiens
tgaaataactggaacaaatt

SEQ ID NO: 1338092 - DNA, 20 bp, Homo sapiens
tgaaataagaattcagacat

SEQ ID NO: 1338093 - DNA, 18 bp, Homo sapiens
tgaaataggaaacaagtg

SEQ ID NO: 1338094 - DNA, 18 bp, Homo sapiens
tgaaatcttcccatgcat

SEQ ID NO: 1338095 - DNA, 21 bp, Homo sapiens
tgaaatgtgaatttttattgt

SEQ ID NO: 1338096 - DNA, 16 bp, Homo sapiens
tgaaattgcatacttt

SEQ ID NO: 1338097 - DNA, 23 bp, Homo sapiens
tgaacaagtgggccattagccag

SEQ ID NO: 1338098 - DNA, 15 bp, Homo sapiens
tgaacaatgaagttg

SEQ ID NO: 1338099 - DNA, 18 bp, Homo sapiens
tgaacaatgaagttgaaa

SEQ ID NO: 1338100 - DNA, 13 bp, Homo sapiens
tgaacacttataa

SEQ ID NO: 1338101 - DNA, 15 bp, Homo sapiens
tgaacatacaaatgc

SEQ ID NO: 1338102 - DNA, 23 bp, Homo sapiens
tgaacatacaaatgcatctttga

SEQ ID NO: 1338103 - DNA, 13 bp, Homo sapiens
tgaaccacttgta

SEQ ID NO: 1338104 - DNA, 21 bp, Homo sapiens
tgaaccacttgtagatttgat

SEQ ID NO: 1338105 - DNA, 23 bp, Homo sapiens
tgaaccacttgtagatttgattt

SEQ ID NO: 1338106 - DNA, 21 bp, Homo sapiens
tgaaccataaattcaactttg

SEQ ID NO: 1338107 - DNA, 22 bp, Homo sapiens
tgaaccatggtgaagtgcttgg

SEQ ID NO: 1338108 - DNA, 14 bp, Homo sapiens
tgaaccgcacagct

SEQ ID NO: 1338109 - DNA, 14 bp, Homo sapiens
tgaactcttctcat

SEQ ID NO: 1338110 - DNA, 18 bp, Homo sapiens
tgaacttaataactgtgt

SEQ ID NO: 1338111 - DNA, 13 bp, Homo sapiens
tgaacttttgtac

SEQ ID NO: 1338112 - DNA, 15 bp, Homo sapiens
tgaacttttgtactg

SEQ ID NO: 1338113 - DNA, 17 bp, Homo sapiens
tgaagaactgcaggccc

SEQ ID NO: 1338114 - DNA, 16 bp, Homo sapiens
tgaagatactttgtat

SEQ ID NO: 1338115 - DNA, 15 bp, Homo sapiens
tgaagatgggagcct

SEQ ID NO: 1338116 - DNA, 13 bp, Homo sapiens
tgaagcagcctct

SEQ ID NO: 1338117 - DNA, 20 bp, Homo sapiens
tgaagcagcctctccccagg

SEQ ID NO: 1338118 - DNA, 21 bp, Homo sapiens
tgaagccaagtggggtgctgg

SEQ ID NO: 1338119 - DNA, 14 bp, Homo sapiens
tgaagccatctaaa

SEQ ID NO: 1338120 - DNA, 18 bp, Homo sapiens
tgaaggactttggcccta

SEQ ID NO: 1338121 - DNA, 13 bp, Homo sapiens
tgaaggtttttga

SEQ ID NO: 1338122 - DNA, 19 bp, Homo sapiens
tgaaggtttttgatagcat

SEQ ID NO: 1338123 - DNA, 15 bp, Homo sapiens
tgaagtaaaagcaag

SEQ ID NO: 1338124 - DNA, 23 bp, Homo sapiens
tgaagtcttaaggacaaagtgcc

SEQ ID NO: 1338125 - DNA, 20 bp, Homo sapiens
tgaagtgtataatataaaaa

SEQ ID NO: 1338126 - DNA, 19 bp, Homo sapiens
tgaataaattctataggaa

SEQ ID NO: 1338127 - DNA, 15 bp, Homo sapiens
tgaatacatttccaa

SEQ ID NO: 1338128 - DNA, 18 bp, Homo sapiens
tgaatactgcttgaataa

SEQ ID NO: 1338129 - DNA, 21 bp, Homo sapiens
tgaatactgcttgaataaaca

SEQ ID NO: 1338130 - DNA, 13 bp, Homo sapiens
tgaatacttgaac

SEQ ID NO: 1338131 - DNA, 18 bp, Homo sapiens
tgaatatctattaatata

SEQ ID NO: 1338132 - DNA, 20 bp, Homo sapiens
tgaatcaataatatattttc

SEQ ID NO: 1338133 - DNA, 12 bp, Homo sapiens
tgaatgctggga

SEQ ID NO: 1338134 - DNA, 15 bp, Homo sapiens
tgaatgtatttattt

SEQ ID NO: 1338135 - DNA, 17 bp, Homo sapiens
tgaatgtatttatttgg

SEQ ID NO: 1338136 - DNA, 21 bp, Homo sapiens
tgaatgttaaagggatatttt

SEQ ID NO: 1338137 - DNA, 14 bp, Homo sapiens
tgaattattgacac

SEQ ID NO: 1338138 - DNA, 21 bp, Homo sapiens
tgaattattgacactgaactt

SEQ ID NO: 1338139 - DNA, 14 bp, Homo sapiens
tgaatttttattgt

SEQ ID NO: 1338140 - DNA, 16 bp, Homo sapiens
tgaatttttttgtaat

SEQ ID NO: 1338141 - DNA, 20 bp, Homo sapiens
tgacaaataaattaggacca

SEQ ID NO: 1338142 - DNA, 19 bp, Homo sapiens
tgacaaccgagaaggttta

SEQ ID NO: 1338143 - DNA, 13 bp, Homo sapiens
tgacaactgtgac

SEQ ID NO: 1338144 - DNA, 14 bp, Homo sapiens
tgacaagctggctt

SEQ ID NO: 1338145 - DNA, 23 bp, Homo sapiens
tgacaagctggcttacactggca

SEQ ID NO: 1338146 - DNA, 15 bp, Homo sapiens
tgacaataaagcttg

SEQ ID NO: 1338147 - DNA, 16 bp, Homo sapiens
tgacaatattccagat

SEQ ID NO: 1338148 - DNA, 14 bp, Homo sapiens
tgacaatgttgtag

SEQ ID NO: 1338149 - DNA, 10 bp, Homo sapiens
tgacactgaa

SEQ ID NO: 1338150 - DNA, 19 bp, Homo sapiens
tgacactgaaagttttgta

SEQ ID NO: 1338151 - DNA, 20 bp, Homo sapiens
tgacactgaaagttttgtaa

SEQ ID NO: 1338152 - DNA, 13 bp, Homo sapiens
tgacaggaacctt

SEQ ID NO: 1338153 - DNA, 12 bp, Homo sapiens
tgacattgtctc

SEQ ID NO: 1338154 - DNA, 13 bp, Homo sapiens
tgacatttcttct

SEQ ID NO: 1338155 - DNA, 22 bp, Homo sapiens
tgacatttcttctagtgatgat

SEQ ID NO: 1338156 - DNA, 17 bp, Homo sapiens
tgaccacttgaggcctg

SEQ ID NO: 1338157 - DNA, 16 bp, Homo sapiens
tgaccaggatcccaag

SEQ ID NO: 1338158 - DNA, 22 bp, Homo sapiens
tgaccaggatcccaagcctcct

SEQ ID NO: 1338159 - DNA, 16 bp, Homo sapiens
tgaccaggctgcctcc

SEQ ID NO: 1338160 - DNA, 12 bp, Homo sapiens
tgaccatgctca

SEQ ID NO: 1338161 - DNA, 12 bp, Homo sapiens
tgaccatttttt

SEQ ID NO: 1338162 - DNA, 13 bp, Homo sapiens
tgacccattgctg

SEQ ID NO: 1338163 - DNA, 23 bp, Homo sapiens
tgaccccggtggcggccccagca

SEQ ID NO: 1338164 - DNA, 19 bp, Homo sapiens
tgaccggacttttctgcaa

SEQ ID NO: 1338165 - DNA, 18 bp, Homo sapiens
tgacgtacaagtagttct

SEQ ID NO: 1338166 - DNA, 23 bp, Homo sapiens
tgacgtacaagtagttctgtatt

SEQ ID NO: 1338167 - DNA, 17 bp, Homo sapiens
tgacgtgaccggacttt

SEQ ID NO: 1338168 - DNA, 24 bp, Homo sapiens
tgacgtgaccggacttttctgcaa

SEQ ID NO: 1338169 - DNA, 21 bp, Homo sapiens
tgactaactcaaatacacatt

SEQ ID NO: 1338170 - DNA, 14 bp, Homo sapiens
tgactcaaagtctg

SEQ ID NO: 1338171 - DNA, 16 bp, Homo sapiens
tgactcgggggtgggg

SEQ ID NO: 1338172 - DNA, 17 bp, Homo sapiens
tgactcgggggtgggga

SEQ ID NO: 1338173 - DNA, 14 bp, Homo sapiens
tgactcggtttctc

SEQ ID NO: 1338174 - DNA, 19 bp, Homo sapiens
tgactctgggtccttcctg

SEQ ID NO: 1338175 - DNA, 22 bp, Homo sapiens
tgactcttgagttgtttttgta

SEQ ID NO: 1338176 - DNA, 23 bp, Homo sapiens
tgactcttgagttgtttttgtat

SEQ ID NO: 1338177 - DNA, 19 bp, Homo sapiens
tgactgaggcagtttgagg

SEQ ID NO: 1338178 - DNA, 15 bp, Homo sapiens
tgactggtgctgcag

SEQ ID NO: 1338179 - DNA, 20 bp, Homo sapiens
tgacttaacatagccaaaat

SEQ ID NO: 1338180 - DNA, 16 bp, Homo sapiens
tgacttaactgcattt

SEQ ID NO: 1338181 - DNA, 21 bp, Homo sapiens
tgacttagaatccctgtgtta

SEQ ID NO: 1338182 - DNA, 16 bp, Homo sapiens
tgacttctgcctggag

SEQ ID NO: 1338183 - DNA, 17 bp, Homo sapiens
tgactttattatttatt

SEQ ID NO: 1338184 - DNA, 13 bp, Homo sapiens
tgactttttataa

SEQ ID NO: 1338185 - DNA, 19 bp, Homo sapiens
tgactttttttgtatgtgt

SEQ ID NO: 1338186 - DNA, 16 bp, Homo sapiens
tgagaaaattgaaata

SEQ ID NO: 1338187 - DNA, 14 bp, Homo sapiens
tgagaaatgaaata

SEQ ID NO: 1338188 - DNA, 18 bp, Homo sapiens
tgagaaatgaaatattgt

SEQ ID NO: 1338189 - DNA, 14 bp, Homo sapiens
tgagaagccttcag

SEQ ID NO: 1338190 - DNA, 19 bp, Homo sapiens
tgagaagccttcagctcca

SEQ ID NO: 1338191 - DNA, 16 bp, Homo sapiens
tgagaaggtttattgt

SEQ ID NO: 1338192 - DNA, 20 bp, Homo sapiens
tgagaaggtttattgttaat

SEQ ID NO: 1338193 - DNA, 21 bp, Homo sapiens
tgagaagtgaatgctgggact

SEQ ID NO: 1338194 - DNA, 22 bp, Homo sapiens
tgagaagtgaatgctgggactc

SEQ ID NO: 1338195 - DNA, 21 bp, Homo sapiens
tgagacacggagcccagccct

SEQ ID NO: 1338196 - DNA, 20 bp, Homo sapiens
tgagaggcaatgattgttaa

SEQ ID NO: 1338197 - DNA, 20 bp, Homo sapiens
tgagatgtgtggactgtggc

SEQ ID NO: 1338198 - DNA, 15 bp, Homo sapiens
tgagattggttttcc

SEQ ID NO: 1338199 - DNA, 22 bp, Homo sapiens
tgagatttttaaaaaatatttt

SEQ ID NO: 1338200 - DNA, 18 bp, Homo sapiens
tgagcaaactaacttgac

SEQ ID NO: 1338201 - DNA, 14 bp, Homo sapiens
tgagcacttttcaa

SEQ ID NO: 1338202 - DNA, 19 bp, Homo sapiens
tgagccctactccctgcag

SEQ ID NO: 1338203 - DNA, 15 bp, Homo sapiens
tgagccgggcccctg

SEQ ID NO: 1338204 - DNA, 15 bp, Homo sapiens
tgagcctgcagggaa

SEQ ID NO: 1338205 - DNA, 11 bp, Homo sapiens
tgagctcagga

SEQ ID NO: 1338206 - DNA, 21 bp, Homo sapiens
tgagctcccacttctgccaga

SEQ ID NO: 1338207 - DNA, 16 bp, Homo sapiens
tgagctgatctgcgga

SEQ ID NO: 1338208 - DNA, 11 bp, Homo sapiens
tgagctgcctt

SEQ ID NO: 1338209 - DNA, 17 bp, Homo sapiens
tgagcttacgtagttct

SEQ ID NO: 1338210 - DNA, 18 bp, Homo sapiens
tgagcttacgtagttcta

SEQ ID NO: 1338211 - DNA, 15 bp, Homo sapiens
tgaggaaatcaaagt

SEQ ID NO: 1338212 - DNA, 19 bp, Homo sapiens
tgaggaactgtagatgatg

SEQ ID NO: 1338213 - DNA, 17 bp, Homo sapiens
tgaggagggtgggggag

SEQ ID NO: 1338214 - DNA, 17 bp, Homo sapiens
tgaggattagtttagaa

SEQ ID NO: 1338215 - DNA, 14 bp, Homo sapiens
tgaggcaggagaat

SEQ ID NO: 1338216 - DNA, 16 bp, Homo sapiens
tgaggccaagaatatt

SEQ ID NO: 1338217 - DNA, 19 bp, Homo sapiens
tgaggccaagaatattgca

SEQ ID NO: 1338218 - DNA, 19 bp, Homo sapiens
tgaggccgttgctgactta

SEQ ID NO: 1338219 - DNA, 11 bp, Homo sapiens
tgaggctgtgg

SEQ ID NO: 1338220 - DNA, 12 bp, Homo sapiens
tgaggtgggagg

SEQ ID NO: 1338221 - DNA, 13 bp, Homo sapiens
tgaggtgggagga

SEQ ID NO: 1338222 - DNA, 21 bp, Homo sapiens
tgaggtgggaggatctcttga

SEQ ID NO: 1338223 - DNA, 20 bp, Homo sapiens
tgaggttcctctgcctgccc

SEQ ID NO: 1338224 - DNA, 22 bp, Homo sapiens
tgaggttttatttcatttttca

SEQ ID NO: 1338225 - DNA, 15 bp, Homo sapiens
tgagtattgtttaaa

SEQ ID NO: 1338226 - DNA, 21 bp, Homo sapiens
tgagtattgtttaaaatgtaa

SEQ ID NO: 1338227 - DNA, 23 bp, Homo sapiens
tgagtattgtttaaaatgtaatt

SEQ ID NO: 1338228 - DNA, 17 bp, Homo sapiens
tgagtccattctcccag

SEQ ID NO: 1338229 - DNA, 23 bp, Homo sapiens
tacactggcaatggtagtttctg

SEQ ID NO: 1338230 - DNA, 15 bp, Homo sapiens
tacactttgttgcaa

SEQ ID NO: 1338231 - DNA, 18 bp, Homo sapiens
tacactttgttgcaagat

SEQ ID NO: 1338232 - DNA, 22 bp, Homo sapiens
tacactttgttgcaagatgtga

SEQ ID NO: 1338233 - DNA, 22 bp, Homo sapiens
tacagccgagactcgactctgt

SEQ ID NO: 1338234 - DNA, 18 bp, Homo sapiens
tacagctttcatgattag

SEQ ID NO: 1338235 - DNA, 12 bp, Homo sapiens
tacaggctggcg

SEQ ID NO: 1338236 - DNA, 21 bp, Homo sapiens
tacaggctggcgcagaacgaa

SEQ ID NO: 1338237 - DNA, 15 bp, Homo sapiens
tacagtatagatttt

SEQ ID NO: 1338238 - DNA, 18 bp, Homo sapiens
tacagtatctcagggcct

SEQ ID NO: 1338239 - DNA, 21 bp, Homo sapiens
tacagtgcagagccttctcag

SEQ ID NO: 1338240 - DNA, 16 bp, Homo sapiens
tacatacgatttaagg

SEQ ID NO: 1338241 - DNA, 17 bp, Homo sapiens
tacatacgatttaaggt

SEQ ID NO: 1338242 - DNA, 16 bp, Homo sapiens
tacatatggatgttac

SEQ ID NO: 1338243 - DNA, 18 bp, Homo sapiens
tacatatggatgttactc

SEQ ID NO: 1338244 - DNA, 20 bp, Homo sapiens
tacatatggatgttactctc

SEQ ID NO: 1338245 - DNA, 17 bp, Homo sapiens
tacatgccacatcaaac

SEQ ID NO: 1338246 - DNA, 14 bp, Homo sapiens
tacatgtaatttga

SEQ ID NO: 1338247 - DNA, 17 bp, Homo sapiens
tacattcaaatttgtct

SEQ ID NO: 1338248 - DNA, 21 bp, Homo sapiens
tacattcaaatttgtctggtt

SEQ ID NO: 1338249 - DNA, 15 bp, Homo sapiens
tacattgtatatatg

SEQ ID NO: 1338250 - DNA, 23 bp, Homo sapiens
tacatttatttatccagaaaact

SEQ ID NO: 1338251 - DNA, 14 bp, Homo sapiens
taccaagtgaaatt

SEQ ID NO: 1338252 - DNA, 17 bp, Homo sapiens
taccacatcaaataaga

SEQ ID NO: 1338253 - DNA, 19 bp, Homo sapiens
taccagaggttgtgcactg

SEQ ID NO: 1338254 - DNA, 21 bp, Homo sapiens
taccagctgcgcttgcttttc

SEQ ID NO: 1338255 - DNA, 12 bp, Homo sapiens
tacccacctaga

SEQ ID NO: 1338256 - DNA, 15 bp, Homo sapiens
tacccacctagaaca

SEQ ID NO: 1338257 - DNA, 22 bp, Homo sapiens
tacccacctagaacactaactc

SEQ ID NO: 1338258 - DNA, 16 bp, Homo sapiens
taccccctccttcaga

SEQ ID NO: 1338259 - DNA, 18 bp, Homo sapiens
taccccctccttcagaca

SEQ ID NO: 1338260 - DNA, 11 bp, Homo sapiens
taccctgggtg

SEQ ID NO: 1338261 - DNA, 21 bp, Homo sapiens
taccctgggtgtccccgctgc

SEQ ID NO: 1338262 - DNA, 14 bp, Homo sapiens
taccgacccagggt

SEQ ID NO: 1338263 - DNA, 13 bp, Homo sapiens
tacctaacatctg

SEQ ID NO: 1338264 - DNA, 14 bp, Homo sapiens
tacctagtgaaact

SEQ ID NO: 1338265 - DNA, 15 bp, Homo sapiens
tacctagtgaaactt

SEQ ID NO: 1338266 - DNA, 18 bp, Homo sapiens
tacctcggtgccttcctc

SEQ ID NO: 1338267 - DNA, 17 bp, Homo sapiens
taccttttcagggctgg

SEQ ID NO: 1338268 - DNA, 20 bp, Homo sapiens
taccttttttttttcttggt

SEQ ID NO: 1338269 - DNA, 18 bp, Homo sapiens
tacgaagttcaagatcaa

SEQ ID NO: 1338270 - DNA, 20 bp, Homo sapiens
tacgatttaaggtatttaaa

SEQ ID NO: 1338271 - DNA, 22 bp, Homo sapiens
tacgccaggggaaaatcagcct

SEQ ID NO: 1338272 - DNA, 18 bp, Homo sapiens
tacgtgctctgtgggtct

SEQ ID NO: 1338273 - DNA, 11 bp, Homo sapiens
tacgtttcttt

SEQ ID NO: 1338274 - DNA, 13 bp, Homo sapiens
tacgtttctttaa

SEQ ID NO: 1338275 - DNA, 16 bp, Homo sapiens
tactaaaaagtataaa

SEQ ID NO: 1338276 - DNA, 20 bp, Homo sapiens
tactacttttgcatgaaaat

SEQ ID NO: 1338277 - DNA, 20 bp, Homo sapiens
tactagtcaccagagacttt

SEQ ID NO: 1338278 - DNA, 21 bp, Homo sapiens
tactagtcaccagagacttta

SEQ ID NO: 1338279 - DNA, 17 bp, Homo sapiens
tactatttaagatgtga

SEQ ID NO: 1338280 - DNA, 19 bp, Homo sapiens
tactcaagcgggtggctct

SEQ ID NO: 1338281 - DNA, 18 bp, Homo sapiens
tactccctgcagatgcca

SEQ ID NO: 1338282 - DNA, 22 bp, Homo sapiens
tactctaccctcttagaaaaac

SEQ ID NO: 1338283 - DNA, 16 bp, Homo sapiens
tactgaatttttttgt

SEQ ID NO: 1338284 - DNA, 16 bp, Homo sapiens
tactgcactccagcct

SEQ ID NO: 1338285 - DNA, 18 bp, Homo sapiens
tactgcatttagggagta

SEQ ID NO: 1338286 - DNA, 20 bp, Homo sapiens
tactgcctgaataaagagcc

SEQ ID NO: 1338287 - DNA, 12 bp, Homo sapiens
tactgccttgaa

SEQ ID NO: 1338288 - DNA, 13 bp, Homo sapiens
tactgccttgaaa

SEQ ID NO: 1338289 - DNA, 12 bp, Homo sapiens
tactgcgacttt

SEQ ID NO: 1338290 - DNA, 21 bp, Homo sapiens
tactgcgactttctgcctgga

SEQ ID NO: 1338291 - DNA, 22 bp, Homo sapiens
tactgcgactttctgcctggag

SEQ ID NO: 1338292 - DNA, 14 bp, Homo sapiens
tactggttgcatgg

SEQ ID NO: 1338293 - DNA, 20 bp, Homo sapiens
tactgtcaaatgatgtgcaa

SEQ ID NO: 1338294 - DNA, 17 bp, Homo sapiens
tactgtctattaatatt

SEQ ID NO: 1338295 - DNA, 16 bp, Homo sapiens
tactgtgtaaactcat

SEQ ID NO: 1338296 - DNA, 13 bp, Homo sapiens
tactgttactggg

SEQ ID NO: 1338297 - DNA, 16 bp, Homo sapiens
tactgttatctatctg

SEQ ID NO: 1338298 - DNA, 17 bp, Homo sapiens
tactgttgtaagaattc

SEQ ID NO: 1338299 - DNA, 19 bp, Homo sapiens
tactgttttatctggcccc

SEQ ID NO: 1338300 - DNA, 23 bp, Homo sapiens
tacttaaatggtaataagcactg

SEQ ID NO: 1338301 - DNA, 15 bp, Homo sapiens
tacttaatccaatgg

SEQ ID NO: 1338302 - DNA, 12 bp, Homo sapiens
tacttgaaccat

SEQ ID NO: 1338303 - DNA, 17 bp, Homo sapiens
tacttgaaccataaaat

SEQ ID NO: 1338304 - DNA, 17 bp, Homo sapiens
tacttgttgcctataag

SEQ ID NO: 1338305 - DNA, 15 bp, Homo sapiens
tactttactgcctga

SEQ ID NO: 1338306 - DNA, 23 bp, Homo sapiens
tactttgtaaataggatttttag

SEQ ID NO: 1338307 - DNA, 22 bp, Homo sapiens
tactttgtaaattctgatttct

SEQ ID NO: 1338308 - DNA, 14 bp, Homo sapiens
tacttttaaaaaca

SEQ ID NO: 1338309 - DNA, 16 bp, Homo sapiens
tacttttcattctctt

SEQ ID NO: 1338310 - DNA, 17 bp, Homo sapiens
tacttttgcatgaaaat

SEQ ID NO: 1338311 - DNA, 19 bp, Homo sapiens
tactttttagtaatttctt

SEQ ID NO: 1338312 - DNA, 13 bp, Homo sapiens
tacttttttaaat

SEQ ID NO: 1338313 - DNA, 20 bp, Homo sapiens
tacttttttaaatattttct

SEQ ID NO: 1338314 - DNA, 21 bp, Homo sapiens
tacttttttaaatattttcta

SEQ ID NO: 1338315 - DNA, 12 bp, Homo sapiens
tagaaaatgtga

SEQ ID NO: 1338316 - DNA, 17 bp, Homo sapiens
tagaaatggaaattttg

SEQ ID NO: 1338317 - DNA, 15 bp, Homo sapiens
tagaaattttgtaag

SEQ ID NO: 1338318 - DNA, 19 bp, Homo sapiens
tagaactccaggccctcct

SEQ ID NO: 1338319 - DNA, 16 bp, Homo sapiens
tagaactttgtatagt

SEQ ID NO: 1338320 - DNA, 16 bp, Homo sapiens
tagaagccaagggaaa

SEQ ID NO: 1338321 - DNA, 20 bp, Homo sapiens
tagaagtgagcaaaaaagag

SEQ ID NO: 1338322 - DNA, 21 bp, Homo sapiens
tagaagtttggctgctgtcat

SEQ ID NO: 1338323 - DNA, 17 bp, Homo sapiens
tagaataagaatttgca

SEQ ID NO: 1338324 - DNA, 14 bp, Homo sapiens
tagaattaaaaaag

SEQ ID NO: 1338325 - DNA, 15 bp, Homo sapiens
tagaattatttttca

SEQ ID NO: 1338326 - DNA, 19 bp, Homo sapiens
tagacagcttttctcaact

SEQ ID NO: 1338327 - DNA, 13 bp, Homo sapiens
tagacatcaaact

SEQ ID NO: 1338328 - DNA, 23 bp, Homo sapiens
tagacatcaaactcaatgcttta

SEQ ID NO: 1338329 - DNA, 16 bp, Homo sapiens
tagaccctgggtgggc

SEQ ID NO: 1338330 - DNA, 17 bp, Homo sapiens
tagaccttgttacttct

SEQ ID NO: 1338331 - DNA, 10 bp, Homo sapiens
tagacttgaa

SEQ ID NO: 1338332 - DNA, 13 bp, Homo sapiens
tagacttgaaaag

SEQ ID NO: 1338333 - DNA, 19 bp, Homo sapiens
tagacttgaaaagagacag

SEQ ID NO: 1338334 - DNA, 23 bp, Homo sapiens
tagacttgaaaagagacaggcag

SEQ ID NO: 1338335 - DNA, 21 bp, Homo sapiens
tagagaggacaatactggggt

SEQ ID NO: 1338336 - DNA, 18 bp, Homo sapiens
tagaggccctttgctgtc

SEQ ID NO: 1338337 - DNA, 21 bp, Homo sapiens
tagagggacggccaagaatgt

SEQ ID NO: 1338338 - DNA, 23 bp, Homo sapiens
tagagggacggccaagaatgtac

SEQ ID NO: 1338339 - DNA, 14 bp, Homo sapiens
tagagtaatgaaat

SEQ ID NO: 1338340 - DNA, 15 bp, Homo sapiens
tagagtaatgaaatg

SEQ ID NO: 1338341 - DNA, 17 bp, Homo sapiens
tagagtacactgcctgc

SEQ ID NO: 1338342 - DNA, 12 bp, Homo sapiens
tagagtgggagc

SEQ ID NO: 1338343 - DNA, 20 bp, Homo sapiens
tagatatcatgcaaatttca

SEQ ID NO: 1338344 - DNA, 23 bp, Homo sapiens
tagatatcgacttgtttttgcac

SEQ ID NO: 1338345 - DNA, 13 bp, Homo sapiens
tagatatttttca

SEQ ID NO: 1338346 - DNA, 20 bp, Homo sapiens
tagatatttttcataaacaa

SEQ ID NO: 1338347 - DNA, 13 bp, Homo sapiens
tagatcatagttt

SEQ ID NO: 1338348 - DNA, 17 bp, Homo sapiens
tagatcatagttttatt

SEQ ID NO: 1338349 - DNA, 14 bp, Homo sapiens
tagatgatgtattt

SEQ ID NO: 1338350 - DNA, 19 bp, Homo sapiens
tgagtccattctcccaggt

SEQ ID NO: 1338351 - DNA, 20 bp, Homo sapiens
tgagtccattctcccaggta

SEQ ID NO: 1338352 - DNA, 14 bp, Homo sapiens
tgagtctgttctgg

SEQ ID NO: 1338353 - DNA, 17 bp, Homo sapiens
tgagtctgttctggtaa

SEQ ID NO: 1338354 - DNA, 12 bp, Homo sapiens
tgagtgggaagc

SEQ ID NO: 1338355 - DNA, 13 bp, Homo sapiens
tgagtgggaagcc

SEQ ID NO: 1338356 - DNA, 14 bp, Homo sapiens
tgagtgtatgagta

SEQ ID NO: 1338357 - DNA, 16 bp, Homo sapiens
tgagttgtttttgtat

SEQ ID NO: 1338358 - DNA, 16 bp, Homo sapiens
tgagtttgagctgcct

SEQ ID NO: 1338359 - DNA, 19 bp, Homo sapiens
tgagtttgagctgccttcc

SEQ ID NO: 1338360 - DNA, 20 bp, Homo sapiens
tgagtttgtcgctcatgtgt

SEQ ID NO: 1338361 - DNA, 19 bp, Homo sapiens
tgagtttttacaagatgta

SEQ ID NO: 1338362 - DNA, 14 bp, Homo sapiens
tgataaaaactcag

SEQ ID NO: 1338363 - DNA, 16 bp, Homo sapiens
tgatacaatgaacact

SEQ ID NO: 1338364 - DNA, 20 bp, Homo sapiens
tgatacattcaaatttgtct

SEQ ID NO: 1338365 - DNA, 15 bp, Homo sapiens
tgatagggaactggg

SEQ ID NO: 1338366 - DNA, 15 bp, Homo sapiens
tgatatctataaaat

SEQ ID NO: 1338367 - DNA, 18 bp, Homo sapiens
tgatatctataaaataga

SEQ ID NO: 1338368 - DNA, 17 bp, Homo sapiens
tgatattacatttattt

SEQ ID NO: 1338369 - DNA, 15 bp, Homo sapiens
tgatcccattttcct

SEQ ID NO: 1338370 - DNA, 21 bp, Homo sapiens
tgatcccgttttccccatgac

SEQ ID NO: 1338371 - DNA, 22 bp, Homo sapiens
tgatgaggtattttttcctttt

SEQ ID NO: 1338372 - DNA, 17 bp, Homo sapiens
tgatgatacaatgaaca

SEQ ID NO: 1338373 - DNA, 14 bp, Homo sapiens
tgatgatcctaggc

SEQ ID NO: 1338374 - DNA, 16 bp, Homo sapiens
tgatgcatgtctttta

SEQ ID NO: 1338375 - DNA, 20 bp, Homo sapiens
tgatggaatttttttgtacg

SEQ ID NO: 1338376 - DNA, 16 bp, Homo sapiens
tgatggacactccagg

SEQ ID NO: 1338377 - DNA, 21 bp, Homo sapiens
tgatggtgtagccctcccact

SEQ ID NO: 1338378 - DNA, 17 bp, Homo sapiens
tgatgtacagattcttt

SEQ ID NO: 1338379 - DNA, 17 bp, Homo sapiens
tgatgtctttttattaa

SEQ ID NO: 1338380 - DNA, 23 bp, Homo sapiens
tgatgtgcaaaaccttttactgg

SEQ ID NO: 1338381 - DNA, 14 bp, Homo sapiens
tgatgtgttgttct

SEQ ID NO: 1338382 - DNA, 16 bp, Homo sapiens
tgattatttattattt

SEQ ID NO: 1338383 - DNA, 21 bp, Homo sapiens
tgattccactacacctggctg

SEQ ID NO: 1338384 - DNA, 18 bp, Homo sapiens
tgattgggaaaacatttg

SEQ ID NO: 1338385 - DNA, 15 bp, Homo sapiens
tgatttattaactta

SEQ ID NO: 1338386 - DNA, 16 bp, Homo sapiens
tgatttattaacttaa

SEQ ID NO: 1338387 - DNA, 21 bp, Homo sapiens
tgatttcaaagttttgttgta

SEQ ID NO: 1338388 - DNA, 21 bp, Homo sapiens
tgatttctttaaaagaatgac

SEQ ID NO: 1338389 - DNA, 23 bp, Homo sapiens
tgatttcttttcaccattcgtac

SEQ ID NO: 1338390 - DNA, 16 bp, Homo sapiens
tgatttgaaaaatata

SEQ ID NO: 1338391 - DNA, 13 bp, Homo sapiens
tgattttcattgc

SEQ ID NO: 1338392 - DNA, 15 bp, Homo sapiens
tgattttcattgctg

SEQ ID NO: 1338393 - DNA, 18 bp, Homo sapiens
tgcaaaaccttttactgg

SEQ ID NO: 1338394 - DNA, 20 bp, Homo sapiens
tgcaaatgagctctgaaatc

SEQ ID NO: 1338395 - DNA, 12 bp, Homo sapiens
tgcaaatttcat

SEQ ID NO: 1338396 - DNA, 20 bp, Homo sapiens
tgcaacggtctcctgactgg

SEQ ID NO: 1338397 - DNA, 21 bp, Homo sapiens
tgcaacggtctcctgactggt

SEQ ID NO: 1338398 - DNA, 13 bp, Homo sapiens
tgcaagatgtgaa

SEQ ID NO: 1338399 - DNA, 16 bp, Homo sapiens
tgcaagcagaggacca

SEQ ID NO: 1338400 - DNA, 14 bp, Homo sapiens
tgcaataaaattta

SEQ ID NO: 1338401 - DNA, 17 bp, Homo sapiens
tgcaataaaatttaaaa

SEQ ID NO: 1338402 - DNA, 12 bp, Homo sapiens
tgcaataacagc

SEQ ID NO: 1338403 - DNA, 14 bp, Homo sapiens
tgcaataacagctg

SEQ ID NO: 1338404 - DNA, 17 bp, Homo sapiens
tgcaataacagctgcaa

SEQ ID NO: 1338405 - DNA, 14 bp, Homo sapiens
tgcacaagctgcac

SEQ ID NO: 1338406 - DNA, 17 bp, Homo sapiens
tgcacaattttgataaa

SEQ ID NO: 1338407 - DNA, 20 bp, Homo sapiens
tgcacacctactagtcacca

SEQ ID NO: 1338408 - DNA, 22 bp, Homo sapiens
tgcacacctactagtcaccaga

SEQ ID NO: 1338409 - DNA, 20 bp, Homo sapiens
tgcacagccactccccggca

SEQ ID NO: 1338410 - DNA, 22 bp, Homo sapiens
tgcacataagcttccattttaa

SEQ ID NO: 1338411 - DNA, 13 bp, Homo sapiens
tgcacatgtttcc

SEQ ID NO: 1338412 - DNA, 14 bp, Homo sapiens
tgcacatgtttcct

SEQ ID NO: 1338413 - DNA, 14 bp, Homo sapiens
tgcaccaccaagcc

SEQ ID NO: 1338414 - DNA, 16 bp, Homo sapiens
tgcaccaccaagccaa

SEQ ID NO: 1338415 - DNA, 14 bp, Homo sapiens
tgcacccagaacag

SEQ ID NO: 1338416 - DNA, 15 bp, Homo sapiens
tgcaccccttctctc

SEQ ID NO: 1338417 - DNA, 15 bp, Homo sapiens
tgcacgtcatgggag

SEQ ID NO: 1338418 - DNA, 13 bp, Homo sapiens
tgcacttaaagaa

SEQ ID NO: 1338419 - DNA, 18 bp, Homo sapiens
tgcacttacttgcttatt

SEQ ID NO: 1338420 - DNA, 21 bp, Homo sapiens
tgcacttgtgattatttatta

SEQ ID NO: 1338421 - DNA, 11 bp, Homo sapiens
tgcagaatgta

SEQ ID NO: 1338422 - DNA, 13 bp, Homo sapiens
tgcagagatttct

SEQ ID NO: 1338423 - DNA, 15 bp, Homo sapiens
tgcagagatttctca

SEQ ID NO: 1338424 - DNA, 20 bp, Homo sapiens
tgcagagccttctcagaagc

SEQ ID NO: 1338425 - DNA, 17 bp, Homo sapiens
tgcagaggccagaggcc

SEQ ID NO: 1338426 - DNA, 19 bp, Homo sapiens
tgcagagggtactttaaga

SEQ ID NO: 1338427 - DNA, 15 bp, Homo sapiens
tgcagaggtaccctg

SEQ ID NO: 1338428 - DNA, 19 bp, Homo sapiens
tgcagaggtaccctgggtg

SEQ ID NO: 1338429 - DNA, 14 bp, Homo sapiens
tgcaggacctcagg

SEQ ID NO: 1338430 - DNA, 19 bp, Homo sapiens
tgcaggccctggcctcccc

SEQ ID NO: 1338431 - DNA, 18 bp, Homo sapiens
tgcaggctcccctgagga

SEQ ID NO: 1338432 - DNA, 15 bp, Homo sapiens
tgcagggccatggct

SEQ ID NO: 1338433 - DNA, 15 bp, Homo sapiens
tgcagtcactggagg

SEQ ID NO: 1338434 - DNA, 12 bp, Homo sapiens
tgcagtttatca

SEQ ID NO: 1338435 - DNA, 17 bp, Homo sapiens
tgcagtttatcattcaa

SEQ ID NO: 1338436 - DNA, 17 bp, Homo sapiens
tgcggatctcagctttg

SEQ ID NO: 1338437 - DNA, 14 bp, Homo sapiens
tgcgtcctcctcac

SEQ ID NO: 1338438 - DNA, 15 bp, Homo sapiens
tgcgtcttggtgtaa

SEQ ID NO: 1338439 - DNA, 16 bp, Homo sapiens
tgcgtcttggtgtaat

SEQ ID NO: 1338440 - DNA, 12 bp, Homo sapiens
tgctaaaaatgt

SEQ ID NO: 1338441 - DNA, 23 bp, Homo sapiens
tgctaacaaagacaaaagtctgt

SEQ ID NO: 1338442 - DNA, 17 bp, Homo sapiens
tgctacctttcaaagct

SEQ ID NO: 1338443 - DNA, 18 bp, Homo sapiens
tgctacctttcaaagctt

SEQ ID NO: 1338444 - DNA, 15 bp, Homo sapiens
tgctactgcactcca

SEQ ID NO: 1338445 - DNA, 21 bp, Homo sapiens
tgctactgttgtaagaattct

SEQ ID NO: 1338446 - DNA, 15 bp, Homo sapiens
tgctagaaattttca

SEQ ID NO: 1338447 - DNA, 15 bp, Homo sapiens
tgctatttttgtaaa

SEQ ID NO: 1338448 - DNA, 16 bp, Homo sapiens
tgctatttttgtaaag

SEQ ID NO: 1338449 - DNA, 22 bp, Homo sapiens
tgctatttttgtaaagtttccg

SEQ ID NO: 1338450 - DNA, 20 bp, Homo sapiens
tgctcagtgtttttgtgaat

SEQ ID NO: 1338451 - DNA, 13 bp, Homo sapiens
tgctcatctgctg

SEQ ID NO: 1338452 - DNA, 16 bp, Homo sapiens
tgctcatctgctggtc

SEQ ID NO: 1338453 - DNA, 17 bp, Homo sapiens
tgctcattatgccactt

SEQ ID NO: 1338454 - DNA, 19 bp, Homo sapiens
tgctccagcaacacagcct

SEQ ID NO: 1338455 - DNA, 19 bp, Homo sapiens
tgctcctggcccactgcat

SEQ ID NO: 1338456 - DNA, 22 bp, Homo sapiens
tgctctcactgtttgtttttat

SEQ ID NO: 1338457 - DNA, 18 bp, Homo sapiens
tgctcttcagatgccact

SEQ ID NO: 1338458 - DNA, 18 bp, Homo sapiens
tgctcttgtcctagcttg

SEQ ID NO: 1338459 - DNA, 18 bp, Homo sapiens
tgctgaatacagaggcaa

SEQ ID NO: 1338460 - DNA, 20 bp, Homo sapiens
tgctgaatgttgggactgct

SEQ ID NO: 1338461 - DNA, 21 bp, Homo sapiens
tgctgactgttttctcttgag

SEQ ID NO: 1338462 - DNA, 24 bp, Homo sapiens
tgctgactgttttctcttgagagg

SEQ ID NO: 1338463 - DNA, 14 bp, Homo sapiens
tgctgacttagaat

SEQ ID NO: 1338464 - DNA, 15 bp, Homo sapiens
tgctgacttagaatc

SEQ ID NO: 1338465 - DNA, 14 bp, Homo sapiens
tgctgaggcctggg

SEQ ID NO: 1338466 - DNA, 16 bp, Homo sapiens
tgctgaggcctgggcc

SEQ ID NO: 1338467 - DNA, 17 bp, Homo sapiens
tgctgaggcctgggccg

SEQ ID NO: 1338468 - DNA, 16 bp, Homo sapiens
tgctgagtctgttctg

SEQ ID NO: 1338469 - DNA, 16 bp, Homo sapiens
tgctgcatgccctctc

SEQ ID NO: 1338470 - DNA, 19 bp, Homo sapiens
tgctgcctctttccctagg

SEQ ID NO: 1338471 - DNA, 12 bp, Homo sapiens
tgctgctcttca

SEQ ID NO: 1338472 - DNA, 12 bp, Homo sapiens
tgctgctgctgc

SEQ ID NO: 1338473 - DNA, 16 bp, Homo sapiens
tgctgctggtgcacag

SEQ ID NO: 1338474 - DNA, 12 bp, Homo sapiens
tgctgcttgagg

SEQ ID NO: 1338475 - DNA, 20 bp, Homo sapiens
tgctgggaggagggagaggg

SEQ ID NO: 1338476 - DNA, 15 bp, Homo sapiens
tggttctcaatgaaa

SEQ ID NO: 1338477 - DNA, 17 bp, Homo sapiens
tggttctggctgtttga

SEQ ID NO: 1338478 - DNA, 13 bp, Homo sapiens
tggttctgtgaac

SEQ ID NO: 1338479 - DNA, 12 bp, Homo sapiens
tggttgaatatg

SEQ ID NO: 1338480 - DNA, 18 bp, Homo sapiens
tggttggctgggaaatcg

SEQ ID NO: 1338481 - DNA, 16 bp, Homo sapiens
tggttttatactgaag

SEQ ID NO: 1338482 - DNA, 23 bp, Homo sapiens
tggttttatactgaaggaaaaac

SEQ ID NO: 1338483 - DNA, 12 bp, Homo sapiens
tggttttatgat

SEQ ID NO: 1338484 - DNA, 15 bp, Homo sapiens
tggttttatgatgac

SEQ ID NO: 1338485 - DNA, 13 bp, Homo sapiens
tggttttctgcca

SEQ ID NO: 1338486 - DNA, 18 bp, Homo sapiens
tggttttctgccaatgac

SEQ ID NO: 1338487 - DNA, 23 bp, Homo sapiens
tgtaaaaatcttttgaagcatag

SEQ ID NO: 1338488 - DNA, 19 bp, Homo sapiens
tgtaaaatattttgaatca

SEQ ID NO: 1338489 - DNA, 20 bp, Homo sapiens
tgtaaaatattttgaatcaa

SEQ ID NO: 1338490 - DNA, 13 bp, Homo sapiens
tgtaaacatttat

SEQ ID NO: 1338491 - DNA, 13 bp, Homo sapiens
tgtaaactttttg

SEQ ID NO: 1338492 - DNA, 15 bp, Homo sapiens
tgtaaataattcttt

SEQ ID NO: 1338493 - DNA, 22 bp, Homo sapiens
tgtaaataattcttttttatta

SEQ ID NO: 1338494 - DNA, 18 bp, Homo sapiens
tgtaaataggatttttag

SEQ ID NO: 1338495 - DNA, 16 bp, Homo sapiens
tgtaaatgtaaactca

SEQ ID NO: 1338496 - DNA, 16 bp, Homo sapiens
tgtaaattatttatgt

SEQ ID NO: 1338497 - DNA, 12 bp, Homo sapiens
tgtaaattctga

SEQ ID NO: 1338498 - DNA, 20 bp, Homo sapiens
tgtaaattttgtatgaaaaa

SEQ ID NO: 1338499 - DNA, 21 bp, Homo sapiens
tgtaacttccaaataaataat

SEQ ID NO: 1338500 - DNA, 22 bp, Homo sapiens
tgtaacttgcttaaatttctta

SEQ ID NO: 1338501 - DNA, 17 bp, Homo sapiens
tgtaagaattctgattg

SEQ ID NO: 1338502 - DNA, 18 bp, Homo sapiens
tgtaagcactctggatga

SEQ ID NO: 1338503 - DNA, 21 bp, Homo sapiens
tgtaagcgtatggctttattt

SEQ ID NO: 1338504 - DNA, 15 bp, Homo sapiens
tgtaataaactttaa

SEQ ID NO: 1338505 - DNA, 14 bp, Homo sapiens
tgtaatcatttgtt

SEQ ID NO: 1338506 - DNA, 19 bp, Homo sapiens
tgtaatcatttgtttacat

SEQ ID NO: 1338507 - DNA, 20 bp, Homo sapiens
tgtaatcccagctactcggg

SEQ ID NO: 1338508 - DNA, 20 bp, Homo sapiens
tgtaatggtatcttaaagtg

SEQ ID NO: 1338509 - DNA, 19 bp, Homo sapiens
tgtaatttgatgaggtatt

SEQ ID NO: 1338510 - DNA, 13 bp, Homo sapiens
tgtacaaaagcaa

SEQ ID NO: 1338511 - DNA, 16 bp, Homo sapiens
tgtacaaaattaagca

SEQ ID NO: 1338512 - DNA, 18 bp, Homo sapiens
tgtacagtagattttcca

SEQ ID NO: 1338513 - DNA, 19 bp, Homo sapiens
tgtacatacgatttaaggt

SEQ ID NO: 1338514 - DNA, 21 bp, Homo sapiens
tgtacatacgatttaaggtat

SEQ ID NO: 1338515 - DNA, 23 bp, Homo sapiens
tgtacatacgatttaaggtattt

SEQ ID NO: 1338516 - DNA, 17 bp, Homo sapiens
tgtacatttctataaat

SEQ ID NO: 1338517 - DNA, 14 bp, Homo sapiens
tgtaccaaaattca

SEQ ID NO: 1338518 - DNA, 23 bp, Homo sapiens
tgtaccaaaattcatctgtctat

SEQ ID NO: 1338519 - DNA, 14 bp, Homo sapiens
tgtaccaagtgaaa

SEQ ID NO: 1338520 - DNA, 14 bp, Homo sapiens
tgtacgtccagcct

SEQ ID NO: 1338521 - DNA, 20 bp, Homo sapiens
tgtactaaacagtaagatat

SEQ ID NO: 1338522 - DNA, 14 bp, Homo sapiens
tgtactgaattttt

SEQ ID NO: 1338523 - DNA, 18 bp, Homo sapiens
tgtactgttactgggccc

SEQ ID NO: 1338524 - DNA, 20 bp, Homo sapiens
tgtactttttagtaatttct

SEQ ID NO: 1338525 - DNA, 20 bp, Homo sapiens
tgtagaaaagaactggaaac

SEQ ID NO: 1338526 - DNA, 21 bp, Homo sapiens
tgtagaaatgatgatgtggaa

SEQ ID NO: 1338527 - DNA, 18 bp, Homo sapiens
tgtagatatgtattcttt

SEQ ID NO: 1338528 - DNA, 16 bp, Homo sapiens
tgtagatttgattttt

SEQ ID NO: 1338529 - DNA, 12 bp, Homo sapiens
tgtagcatactg

SEQ ID NO: 1338530 - DNA, 16 bp, Homo sapiens
tgtagccccctggcct

SEQ ID NO: 1338531 - DNA, 17 bp, Homo sapiens
tgtagccccctggcctc

SEQ ID NO: 1338532 - DNA, 19 bp, Homo sapiens
tgtagccccctggcctctg

SEQ ID NO: 1338533 - DNA, 20 bp, Homo sapiens
tgtagctataatgagcatgt

SEQ ID NO: 1338534 - DNA, 12 bp, Homo sapiens
tgtaggagctgc

SEQ ID NO: 1338535 - DNA, 15 bp, Homo sapiens
tgtaggagctgcctt

SEQ ID NO: 1338536 - DNA, 17 bp, Homo sapiens
tgtaggcttagtttgtg

SEQ ID NO: 1338537 - DNA, 20 bp, Homo sapiens
tgtagggtccaaccagacct

SEQ ID NO: 1338538 - DNA, 21 bp, Homo sapiens
tgtagggtccaaccagacctg

SEQ ID NO: 1338539 - DNA, 21 bp, Homo sapiens
tgtagttgttcgttggttata

SEQ ID NO: 1338540 - DNA, 16 bp, Homo sapiens
tgtagtttacagaaaa

SEQ ID NO: 1338541 - DNA, 13 bp, Homo sapiens
tgtataaaataca

SEQ ID NO: 1338542 - DNA, 16 bp, Homo sapiens
tgtataatataaaaaa

SEQ ID NO: 1338543 - DNA, 16 bp, Homo sapiens
tgtatacagtgcagag

SEQ ID NO: 1338544 - DNA, 19 bp, Homo sapiens
tgtatagcatgaaataaaa

SEQ ID NO: 1338545 - DNA, 22 bp, Homo sapiens
tgtgtatatattttgtgtgaaa

SEQ ID NO: 1338546 - DNA, 14 bp, Homo sapiens
tgtgtatgccaaga

SEQ ID NO: 1338547 - DNA, 15 bp, Homo sapiens
tgtgtcagttttcat

SEQ ID NO: 1338548 - DNA, 13 bp, Homo sapiens
tgtgtcccaggca

SEQ ID NO: 1338549 - DNA, 19 bp, Homo sapiens
tgtgtcccaggcagggaga

SEQ ID NO: 1338550 - DNA, 14 bp, Homo sapiens
tgtgtgacaattct

SEQ ID NO: 1338551 - DNA, 15 bp, Homo sapiens
tgtgtgacaattctg

SEQ ID NO: 1338552 - DNA, 20 bp, Homo sapiens
tgtgtgacaattctgttttt

SEQ ID NO: 1338553 - DNA, 15 bp, Homo sapiens
tgtgtggtagaaaca

SEQ ID NO: 1338554 - DNA, 17 bp, Homo sapiens
tgtgtgtcagttttcat

SEQ ID NO: 1338555 - DNA, 18 bp, Homo sapiens
tgtgtgtcatgccagtga

SEQ ID NO: 1338556 - DNA, 16 bp, Homo sapiens
tgtgtgtgtgtgtgca

SEQ ID NO: 1338557 - DNA, 18 bp, Homo sapiens
tgtgttctcggagtgtgt

SEQ ID NO: 1338558 - DNA, 13 bp, Homo sapiens
tgtgttgccaagc

SEQ ID NO: 1338559 - DNA, 17 bp, Homo sapiens
tgtgtttagaattgaag

SEQ ID NO: 1338560 - DNA, 16 bp, Homo sapiens
tgtgttttttaagata

SEQ ID NO: 1338561 - DNA, 22 bp, Homo sapiens
tgttaatacaaggtataataaa

SEQ ID NO: 1338562 - DNA, 23 bp, Homo sapiens
tgttaatggatttcagaagccta

SEQ ID NO: 1338563 - DNA, 15 bp, Homo sapiens
tgttaatttaagttt

SEQ ID NO: 1338564 - DNA, 20 bp, Homo sapiens
tgttagatatttttcataaa

SEQ ID NO: 1338565 - DNA, 16 bp, Homo sapiens
tgttattatctgggct

SEQ ID NO: 1338566 - DNA, 16 bp, Homo sapiens
tgttattcaacagcaa

SEQ ID NO: 1338567 - DNA, 11 bp, Homo sapiens
tgttcagctgg

SEQ ID NO: 1338568 - DNA, 14 bp, Homo sapiens
tgttcatagcccag

SEQ ID NO: 1338569 - DNA, 15 bp, Homo sapiens
tgttcatagcccagt

SEQ ID NO: 1338570 - DNA, 15 bp, Homo sapiens
tgttcatcatccaga

SEQ ID NO: 1338571 - DNA, 18 bp, Homo sapiens
tgttcatcatccagatgt

SEQ ID NO: 1338572 - DNA, 16 bp, Homo sapiens
tgttcccacaccccaa

SEQ ID NO: 1338573 - DNA, 20 bp, Homo sapiens
tgttcccatgtagccccctg

SEQ ID NO: 1338574 - DNA, 18 bp, Homo sapiens
tgttctcggagtgtgtat

SEQ ID NO: 1338575 - DNA, 15 bp, Homo sapiens
tgttctctcttctcc

SEQ ID NO: 1338576 - DNA, 22 bp, Homo sapiens
tgttctggggggacccagtgca

SEQ ID NO: 1338577 - DNA, 16 bp, Homo sapiens
tgttcttggcaataaa

SEQ ID NO: 1338578 - DNA, 23 bp, Homo sapiens
tgttgatcatgtactttttagta

SEQ ID NO: 1338579 - DNA, 11 bp, Homo sapiens
tgttgattatt

SEQ ID NO: 1338580 - DNA, 16 bp, Homo sapiens
tgttgcaagatgtgaa

SEQ ID NO: 1338581 - DNA, 19 bp, Homo sapiens
tgttgcaagatgtgaatta

SEQ ID NO: 1338582 - DNA, 23 bp, Homo sapiens
tgttgcaagatgtgaattattga

SEQ ID NO: 1338583 - DNA, 20 bp, Homo sapiens
tgttgccaagctccaagccc

SEQ ID NO: 1338584 - DNA, 19 bp, Homo sapiens
tgttgccatgtgcaccttg

SEQ ID NO: 1338585 - DNA, 14 bp, Homo sapiens
tgttgccatgtgtt

SEQ ID NO: 1338586 - DNA, 15 bp, Homo sapiens
tgttgccatgtgttt

SEQ ID NO: 1338587 - DNA, 19 bp, Homo sapiens
tgttgctgtacaaaagcaa

SEQ ID NO: 1338588 - DNA, 21 bp, Homo sapiens
tgttggcaggctggccagtcc

SEQ ID NO: 1338589 - DNA, 19 bp, Homo sapiens
tgttgggaaacttggctcg

SEQ ID NO: 1338590 - DNA, 14 bp, Homo sapiens
tgttgggactgcta

SEQ ID NO: 1338591 - DNA, 23 bp, Homo sapiens
tgttgtaaaacaaaatttgacta

SEQ ID NO: 1338592 - DNA, 15 bp, Homo sapiens
tgttgtaagaattct

SEQ ID NO: 1338593 - DNA, 16 bp, Homo sapiens
tgttgtaagaattctg

SEQ ID NO: 1338594 - DNA, 15 bp, Homo sapiens
tgttgtacttaaatg

SEQ ID NO: 1338595 - DNA, 16 bp, Homo sapiens
tgttgtacttaaatgg

SEQ ID NO: 1338596 - DNA, 15 bp, Homo sapiens
tgttgtctcttgagt

SEQ ID NO: 1338597 - DNA, 15 bp, Homo sapiens
tgttgtttataataa

SEQ ID NO: 1338598 - DNA, 20 bp, Homo sapiens
tgtttaaaaaccgaataaat

SEQ ID NO: 1338599 - DNA, 21 bp, Homo sapiens
tgtttaaaaaccgaataaatg

SEQ ID NO: 1338600 - DNA, 14 bp, Homo sapiens
ttaaagaagtattt

SEQ ID NO: 1338601 - DNA, 20 bp, Homo sapiens
ttaaagaccctcctattcta

SEQ ID NO: 1338602 - DNA, 13 bp, Homo sapiens
ttaaagtattctt

SEQ ID NO: 1338603 - DNA, 20 bp, Homo sapiens
ttaaataaaattgaaagtaa

SEQ ID NO: 1338604 - DNA, 18 bp, Homo sapiens
ttaaatacatatggatgt

SEQ ID NO: 1338605 - DNA, 13 bp, Homo sapiens
ttaaatattttct

SEQ ID NO: 1338606 - DNA, 18 bp, Homo sapiens
ttaaatattttctatttt

SEQ ID NO: 1338607 - DNA, 22 bp, Homo sapiens
ttaaatattttctattttaaga

SEQ ID NO: 1338608 - DNA, 19 bp, Homo sapiens
ttaaatccttttacctttt

SEQ ID NO: 1338609 - DNA, 17 bp, Homo sapiens
ttaaatgttacctctga

SEQ ID NO: 1338610 - DNA, 14 bp, Homo sapiens
ttaaatttcttatg

SEQ ID NO: 1338611 - DNA, 17 bp, Homo sapiens
ttaaatttcttatgtga

SEQ ID NO: 1338612 - DNA, 19 bp, Homo sapiens
ttaaatttcttatgtgaca

SEQ ID NO: 1338613 - DNA, 22 bp, Homo sapiens
ttaaatttcttatgtgacatta

SEQ ID NO: 1338614 - DNA, 20 bp, Homo sapiens
ttaaatttttttgtatgaaa

SEQ ID NO: 1338615 - DNA, 22 bp, Homo sapiens
ttaaatttttttgtatgaaaac

SEQ ID NO: 1338616 - DNA, 13 bp, Homo sapiens
ttaacagaaattg

SEQ ID NO: 1338617 - DNA, 15 bp, Homo sapiens
ttaacattcatagag

SEQ ID NO: 1338618 - DNA, 19 bp, Homo sapiens
ttaagaaatgtataaactt

SEQ ID NO: 1338619 - DNA, 13 bp, Homo sapiens
ttaagatgtgaaa

SEQ ID NO: 1338620 - DNA, 19 bp, Homo sapiens
ttaagctgcagagatttct

SEQ ID NO: 1338621 - DNA, 17 bp, Homo sapiens
ttaagctgttactgtct

SEQ ID NO: 1338622 - DNA, 21 bp, Homo sapiens
ttaaggaagacaatgtgaaaa

SEQ ID NO: 1338623 - DNA, 22 bp, Homo sapiens
ttaaggacaaagtgccaaagaa

SEQ ID NO: 1338624 - DNA, 13 bp, Homo sapiens
ttaagggaaaaat

SEQ ID NO: 1338625 - DNA, 15 bp, Homo sapiens
ttaagggaaagaaaa

SEQ ID NO: 1338626 - DNA, 20 bp, Homo sapiens
ttaaggggaagaatgaaagc

SEQ ID NO: 1338627 - DNA, 24 bp, Homo sapiens
ttaaggggaggaaccagagtgctg

SEQ ID NO: 1338628 - DNA, 16 bp, Homo sapiens
ttaagtgaggaaatca

SEQ ID NO: 1338629 - DNA, 23 bp, Homo sapiens
ttaagtgaggaaatcaaagtgct

SEQ ID NO: 1338630 - DNA, 13 bp, Homo sapiens
ttaatacaaggta

SEQ ID NO: 1338631 - DNA, 19 bp, Homo sapiens
ttaatacaaggtataataa

SEQ ID NO: 1338632 - DNA, 19 bp, Homo sapiens
ttaatatatgtattattta

SEQ ID NO: 1338633 - DNA, 11 bp, Homo sapiens
ttaatcactgt

SEQ ID NO: 1338634 - DNA, 19 bp, Homo sapiens
ttaatcattttcattccta

SEQ ID NO: 1338635 - DNA, 20 bp, Homo sapiens
ttaatccagttataagaaga

SEQ ID NO: 1338636 - DNA, 22 bp, Homo sapiens
ttaatcctttgttttctgacta

SEQ ID NO: 1338637 - DNA, 11 bp, Homo sapiens
ttaatgcactt

SEQ ID NO: 1338638 - DNA, 13 bp, Homo sapiens
ttaatgcactttc

SEQ ID NO: 1338639 - DNA, 16 bp, Homo sapiens
ttaatgctatttgaac

SEQ ID NO: 1338640 - DNA, 15 bp, Homo sapiens
ttaattcactcccac

SEQ ID NO: 1338641 - DNA, 13 bp, Homo sapiens
ttaattgtatttt

SEQ ID NO: 1338642 - DNA, 12 bp, Homo sapiens
ttaattgtttaa

SEQ ID NO: 1338643 - DNA, 13 bp, Homo sapiens
ttaattgtttaaa

SEQ ID NO: 1338644 - DNA, 23 bp, Homo sapiens
ttaatttaagttttgacaagctg

SEQ ID NO: 1338645 - DNA, 12 bp, Homo sapiens
ttaatttccttt

SEQ ID NO: 1338646 - DNA, 19 bp, Homo sapiens
ttaatttcctttttgacac

SEQ ID NO: 1338647 - DNA, 20 bp, Homo sapiens
ttaatttcctttttgacact

SEQ ID NO: 1338648 - DNA, 21 bp, Homo sapiens
ttaatttcctttttgacactg

SEQ ID NO: 1338649 - DNA, 19 bp, Homo sapiens
ttaattttaaagtgcaaaa

SEQ ID NO: 1338650 - DNA, 22 bp, Homo sapiens
ttacaaaaacaaaataaaataa

SEQ ID NO: 1338651 - DNA, 17 bp, Homo sapiens
ttacaagtttatatata

SEQ ID NO: 1338652 - DNA, 13 bp, Homo sapiens
ttacaattttatc

SEQ ID NO: 1338653 - DNA, 20 bp, Homo sapiens
ttacacagaaacactgcctt

SEQ ID NO: 1338654 - DNA, 23 bp, Homo sapiens
ttacactggcaatggtagtttct

SEQ ID NO: 1338655 - DNA, 15 bp, Homo sapiens
ttacagaaatggact

SEQ ID NO: 1338656 - DNA, 21 bp, Homo sapiens
ttacagaggtattaaaactaa

SEQ ID NO: 1338657 - DNA, 20 bp, Homo sapiens
ttacagatgaatgtatttat

SEQ ID NO: 1338658 - DNA, 20 bp, Homo sapiens
ttacatgtaatttgatgagg

SEQ ID NO: 1338659 - DNA, 16 bp, Homo sapiens
ttacatgtttataaat

SEQ ID NO: 1338660 - DNA, 20 bp, Homo sapiens
ttcataaattatttgattat

SEQ ID NO: 1338661 - DNA, 13 bp, Homo sapiens
ttcatagcccagt

SEQ ID NO: 1338662 - DNA, 12 bp, Homo sapiens
ttcatctcattt

SEQ ID NO: 1338663 - DNA, 16 bp, Homo sapiens
ttcatctgtctatatt

SEQ ID NO: 1338664 - DNA, 15 bp, Homo sapiens
ttcatgaaaatacca

SEQ ID NO: 1338665 - DNA, 17 bp, Homo sapiens
ttcatgcacttaaagaa

SEQ ID NO: 1338666 - DNA, 23 bp, Homo sapiens
ttcatgcacttaaagaagtattt

SEQ ID NO: 1338667 - DNA, 19 bp, Homo sapiens
ttcatggctgctgttgctt

SEQ ID NO: 1338668 - DNA, 21 bp, Homo sapiens
ttcatggctgctgttgcttaa

SEQ ID NO: 1338669 - DNA, 20 bp, Homo sapiens
ttcatgtaaagtgtcagaag

SEQ ID NO: 1338670 - DNA, 18 bp, Homo sapiens
ttcattattttaaaaata

SEQ ID NO: 1338671 - DNA, 16 bp, Homo sapiens
ttcattcctaaagaaa

SEQ ID NO: 1338672 - DNA, 16 bp, Homo sapiens
ttcattcttcagatat

SEQ ID NO: 1338673 - DNA, 20 bp, Homo sapiens
ttcatttaagggaaagaaaa

SEQ ID NO: 1338674 - DNA, 19 bp, Homo sapiens
ttccacacagaatgcaacc

SEQ ID NO: 1338675 - DNA, 15 bp, Homo sapiens
ttccaccacagccag

SEQ ID NO: 1338676 - DNA, 16 bp, Homo sapiens
ttccaccacagccagc

SEQ ID NO: 1338677 - DNA, 21 bp, Homo sapiens
ttccaccacagccagcacctg

SEQ ID NO: 1338678 - DNA, 16 bp, Homo sapiens
ttccactacacctggc

SEQ ID NO: 1338679 - DNA, 19 bp, Homo sapiens
ttccactacacctggctga

SEQ ID NO: 1338680 - DNA, 19 bp, Homo sapiens
ttccactcgtgtgtttcta

SEQ ID NO: 1338681 - DNA, 20 bp, Homo sapiens
ttccagatctttcagaaata

SEQ ID NO: 1338682 - DNA, 19 bp, Homo sapiens
ttccagatggtcatccaga

SEQ ID NO: 1338683 - DNA, 20 bp, Homo sapiens
ttccagcatttagctggcca

SEQ ID NO: 1338684 - DNA, 21 bp, Homo sapiens
ttccagcatttagctggccac

SEQ ID NO: 1338685 - DNA, 13 bp, Homo sapiens
ttccaggcagcct

SEQ ID NO: 1338686 - DNA, 13 bp, Homo sapiens
ttccatgaatttt

SEQ ID NO: 1338687 - DNA, 14 bp, Homo sapiens
ttccattccacaca

SEQ ID NO: 1338688 - DNA, 13 bp, Homo sapiens
ttccattttaatt

SEQ ID NO: 1338689 - DNA, 16 bp, Homo sapiens
ttcccaaacgcctccc

SEQ ID NO: 1338690 - DNA, 18 bp, Homo sapiens
ttcccacttcccaccctg

SEQ ID NO: 1338691 - DNA, 19 bp, Homo sapiens
ttccccagctttgctgcct

SEQ ID NO: 1338692 - DNA, 21 bp, Homo sapiens
ttccccatgcttccttgcctg

SEQ ID NO: 1338693 - DNA, 13 bp, Homo sapiens
ttccctcaccccc

SEQ ID NO: 1338694 - DNA, 14 bp, Homo sapiens
ttccctcaccccct

SEQ ID NO: 1338695 - DNA, 22 bp, Homo sapiens
ttcccttaaggggtatcatgta

SEQ ID NO: 1338696 - DNA, 13 bp, Homo sapiens
ttcctaaagaaaa

SEQ ID NO: 1338697 - DNA, 19 bp, Homo sapiens
ttcctcaaaataaagaagt

SEQ ID NO: 1338698 - DNA, 20 bp, Homo sapiens
ttcctcaaaataaagaagta

SEQ ID NO: 1338699 - DNA, 20 bp, Homo sapiens
ttcctcaaattttttgactt

SEQ ID NO: 1338700 - DNA, 11 bp, Homo sapiens
ttcctcctgga

SEQ ID NO: 1338701 - DNA, 14 bp, Homo sapiens
ttcctcctggaaat

SEQ ID NO: 1338702 - DNA, 14 bp, Homo sapiens
ttcctctctaagtg

SEQ ID NO: 1338703 - DNA, 16 bp, Homo sapiens
ttcctctctatatttc

SEQ ID NO: 1338704 - DNA, 15 bp, Homo sapiens
ttcctctctccagat

SEQ ID NO: 1338705 - DNA, 17 bp, Homo sapiens
ttcctgaaactatattt

SEQ ID NO: 1338706 - DNA, 20 bp, Homo sapiens
ttcctgaaactatattttgt

SEQ ID NO: 1338707 - DNA, 15 bp, Homo sapiens
ttcctgacattgtct

SEQ ID NO: 1338708 - DNA, 17 bp, Homo sapiens
ttcctgccaggcatggt

SEQ ID NO: 1338709 - DNA, 14 bp, Homo sapiens
ttcctgtccctgcg

SEQ ID NO: 1338710 - DNA, 15 bp, Homo sapiens
ttcctgtccctgcgc

SEQ ID NO: 1338711 - DNA, 21 bp, Homo sapiens
ttcctgtccctgcgcctttcc

SEQ ID NO: 1338712 - DNA, 18 bp, Homo sapiens
ttgatgtcagcagttgct

SEQ ID NO: 1338713 - DNA, 16 bp, Homo sapiens
ttgattatttgcatgt

SEQ ID NO: 1338714 - DNA, 23 bp, Homo sapiens
ttgattatttgcatgttatgttt

SEQ ID NO: 1338715 - DNA, 23 bp, Homo sapiens
ttgattcggtatccccccatctt

SEQ ID NO: 1338716 - DNA, 22 bp, Homo sapiens
ttgattgggaaaacatttgctg

SEQ ID NO: 1338717 - DNA, 17 bp, Homo sapiens
ttgatttattaacttaa

SEQ ID NO: 1338718 - DNA, 13 bp, Homo sapiens
ttgcaaaatacat

SEQ ID NO: 1338719 - DNA, 17 bp, Homo sapiens
ttgcaaaatacatgaag

SEQ ID NO: 1338720 - DNA, 14 bp, Homo sapiens
ttgcaagatgtgaa

SEQ ID NO: 1338721 - DNA, 21 bp, Homo sapiens
ttgcaagatgtgaattattga

SEQ ID NO: 1338722 - DNA, 14 bp, Homo sapiens
ttgcaagtgctgga

SEQ ID NO: 1338723 - DNA, 14 bp, Homo sapiens
ttgcaataacagct

SEQ ID NO: 1338724 - DNA, 17 bp, Homo sapiens
ttgcaataacagctgca

SEQ ID NO: 1338725 - DNA, 18 bp, Homo sapiens
ttgcaataacagctgcaa

SEQ ID NO: 1338726 - DNA, 16 bp, Homo sapiens
ttgcagaactgtagct

SEQ ID NO: 1338727 - DNA, 15 bp, Homo sapiens
ttgcagcccttgtga

SEQ ID NO: 1338728 - DNA, 19 bp, Homo sapiens
ttgcagtttatcattcaag

SEQ ID NO: 1338729 - DNA, 23 bp, Homo sapiens
ttgcagtttatcattcaagtgta

SEQ ID NO: 1338730 - DNA, 16 bp, Homo sapiens
ttgcatactttgtatt

SEQ ID NO: 1338731 - DNA, 17 bp, Homo sapiens
ttgcatactttgtattt

SEQ ID NO: 1338732 - DNA, 19 bp, Homo sapiens
ttgcatcagaaagctttat

SEQ ID NO: 1338733 - DNA, 19 bp, Homo sapiens
ttgccaaaattcatttcta

SEQ ID NO: 1338734 - DNA, 23 bp, Homo sapiens
ttgccaagggcccaaagaaagag

SEQ ID NO: 1338735 - DNA, 20 bp, Homo sapiens
ttgccacagtagaactgtct

SEQ ID NO: 1338736 - DNA, 17 bp, Homo sapiens
ttgccatagagtacact

SEQ ID NO: 1338737 - DNA, 14 bp, Homo sapiens
ttgcccatcctgac

SEQ ID NO: 1338738 - DNA, 16 bp, Homo sapiens
ttgcccatcctgactg

SEQ ID NO: 1338739 - DNA, 15 bp, Homo sapiens
ttgcctccaggtgca

SEQ ID NO: 1338740 - DNA, 20 bp, Homo sapiens
ttgcctccaggtgcagaggt

SEQ ID NO: 1338741 - DNA, 20 bp, Homo sapiens
ttgcctccccatttcccatc

SEQ ID NO: 1338742 - DNA, 21 bp, Homo sapiens
ttgcctccccatttcccatct

SEQ ID NO: 1338743 - DNA, 13 bp, Homo sapiens
ttgcctctgtgct

SEQ ID NO: 1338744 - DNA, 14 bp, Homo sapiens
ttgcctctgtgctg

SEQ ID NO: 1338745 - DNA, 20 bp, Homo sapiens
ttgcctgatgacaataaagc

SEQ ID NO: 1338746 - DNA, 13 bp, Homo sapiens
ttgcctgcagggc

SEQ ID NO: 1338747 - DNA, 20 bp, Homo sapiens
ttgccttccatttcccctct

SEQ ID NO: 1338748 - DNA, 15 bp, Homo sapiens
ttgccttttaatttt

SEQ ID NO: 1338749 - DNA, 20 bp, Homo sapiens
ttgctaattaactgaaacat

SEQ ID NO: 1338750 - DNA, 22 bp, Homo sapiens
ttgctatcaacaataaaatttt

SEQ ID NO: 1338751 - DNA, 14 bp, Homo sapiens
ttgctctacaatga

SEQ ID NO: 1338752 - DNA, 15 bp, Homo sapiens
ttgctgacttagaat

SEQ ID NO: 1338753 - DNA, 14 bp, Homo sapiens
ttgctgagcctctg

SEQ ID NO: 1338754 - DNA, 20 bp, Homo sapiens
ttgctgccattacagaggta

SEQ ID NO: 1338755 - DNA, 14 bp, Homo sapiens
ttgctgcttgaggc

SEQ ID NO: 1338756 - DNA, 13 bp, Homo sapiens
ttgctggccccag

SEQ ID NO: 1338757 - DNA, 16 bp, Homo sapiens
ttgctggtaaaatgaa

SEQ ID NO: 1338758 - DNA, 19 bp, Homo sapiens
ttgctgttgtccaactatt

SEQ ID NO: 1338759 - DNA, 19 bp, Homo sapiens
ttgcttgcctgcagggcca

SEQ ID NO: 1338760 - DNA, 14 bp, Homo sapiens
ttgcttgtcttctg

SEQ ID NO: 1338761 - DNA, 20 bp, Homo sapiens
ttgcttttggcaaaactcta

SEQ ID NO: 1338762 - DNA, 11 bp, Homo sapiens
ttggaaattcc

SEQ ID NO: 1338763 - DNA, 21 bp, Homo sapiens
ttggacctaaatggcctcatg

SEQ ID NO: 1338764 - DNA, 16 bp, Homo sapiens
ttggatggcttgtcta

SEQ ID NO: 1338765 - DNA, 21 bp, Homo sapiens
ttggattaaatacatatggat

SEQ ID NO: 1338766 - DNA, 20 bp, Homo sapiens
ttggcaataaattttgaaaa

SEQ ID NO: 1338767 - DNA, 22 bp, Homo sapiens
ttggcaataaattttgaaaagt

SEQ ID NO: 1338768 - DNA, 21 bp, Homo sapiens
ttggcaatgactcaaagtctg

SEQ ID NO: 1338769 - DNA, 12 bp, Homo sapiens
ttggcaggctgg

SEQ ID NO: 1338770 - DNA, 13 bp, Homo sapiens
ttggcaggctggc

SEQ ID NO: 1338771 - DNA, 14 bp, Homo sapiens
ttggcaggctggcc

SEQ ID NO: 1338772 - DNA, 14 bp, Homo sapiens
ttggccactccgag

SEQ ID NO: 1338773 - DNA, 23 bp, Homo sapiens
ttggcccccaaagatagacaggt

SEQ ID NO: 1338774 - DNA, 12 bp, Homo sapiens
ttggcctgctgt

SEQ ID NO: 1338775 - DNA, 13 bp, Homo sapiens
ttggctcagacat

SEQ ID NO: 1338776 - DNA, 17 bp, Homo sapiens
ttggctcgaatctctgt

SEQ ID NO: 1338777 - DNA, 21 bp, Homo sapiens
ttggctcgaatctctgtgcct

SEQ ID NO: 1338778 - DNA, 11 bp, Homo sapiens
ttggcttctgt

SEQ ID NO: 1338779 - DNA, 12 bp, Homo sapiens
ttgggaaaacat

SEQ ID NO: 1338780 - DNA, 17 bp, Homo sapiens
ttgggaaaacatttgct

SEQ ID NO: 1338781 - DNA, 16 bp, Homo sapiens
ttgggaaacttggctc

SEQ ID NO: 1338782 - DNA, 23 bp, Homo sapiens
ttgggaatgaggaaaattcttaa

SEQ ID NO: 1338783 - DNA, 16 bp, Homo sapiens
ttgggaggccgaggcg

SEQ ID NO: 1338784 - DNA, 21 bp, Homo sapiens
ttgggcagagctggctctgag

SEQ ID NO: 1338785 - DNA, 20 bp, Homo sapiens
gtctccaggggctgcttcct

SEQ ID NO: 1338786 - DNA, 11 bp, Homo sapiens
gtctccctggc

SEQ ID NO: 1338787 - DNA, 19 bp, Homo sapiens
gtctccggcctctccagcc

SEQ ID NO: 1338788 - DNA, 22 bp, Homo sapiens
gtctcctatatatttctattat

SEQ ID NO: 1338789 - DNA, 20 bp, Homo sapiens
gtctcggatcaggctcccag

SEQ ID NO: 1338790 - DNA, 19 bp, Homo sapiens
gtctctcttctcagagtgg

SEQ ID NO: 1338791 - DNA, 22 bp, Homo sapiens
gtctcttcttggggcccagtgc

SEQ ID NO: 1338792 - DNA, 22 bp, Homo sapiens
gtctctttaaaaggaaagaaaa

SEQ ID NO: 1338793 - DNA, 18 bp, Homo sapiens
gtctgaggccgttgctga

SEQ ID NO: 1338794 - DNA, 22 bp, Homo sapiens
gtctgaggccgttgctgactta

SEQ ID NO: 1338795 - DNA, 21 bp, Homo sapiens
gtctgagggcttgtagttctt

SEQ ID NO: 1338796 - DNA, 13 bp, Homo sapiens
gtctgatttctta

SEQ ID NO: 1338797 - DNA, 23 bp, Homo sapiens
gtctgccggacccggaggccgag

SEQ ID NO: 1338798 - DNA, 13 bp, Homo sapiens
gtctgtggatcag

SEQ ID NO: 1338799 - DNA, 21 bp, Homo sapiens
gtctgttggcaggctggccag

SEQ ID NO: 1338800 - DNA, 22 bp, Homo sapiens
gtctgttgtgtgtcatgccagt

SEQ ID NO: 1338801 - DNA, 13 bp, Homo sapiens
gtcttaaggacaa

SEQ ID NO: 1338802 - DNA, 20 bp, Homo sapiens
gtcttactacagaaatgagg

SEQ ID NO: 1338803 - DNA, 18 bp, Homo sapiens
gtcttagatcatagtttt

SEQ ID NO: 1338804 - DNA, 18 bp, Homo sapiens
gtcttgattcagtcacat

SEQ ID NO: 1338805 - DNA, 16 bp, Homo sapiens
gtcttgggcagagctg

SEQ ID NO: 1338806 - DNA, 15 bp, Homo sapiens
gtcttggtgtaattt

SEQ ID NO: 1338807 - DNA, 15 bp, Homo sapiens
gtctttcagtacttt

SEQ ID NO: 1338808 - DNA, 13 bp, Homo sapiens
gtctttcatggct

SEQ ID NO: 1338809 - DNA, 20 bp, Homo sapiens
gtctttcccatggggaggga

SEQ ID NO: 1338810 - DNA, 16 bp, Homo sapiens
gtctttgagctcccac

SEQ ID NO: 1338811 - DNA, 15 bp, Homo sapiens
gtgaaaacggagctg

SEQ ID NO: 1338812 - DNA, 20 bp, Homo sapiens
gtgaaattgcatactttgta

SEQ ID NO: 1338813 - DNA, 13 bp, Homo sapiens
gtgaagatacttt

SEQ ID NO: 1338814 - DNA, 18 bp, Homo sapiens
gtgaagatactttgtatt

SEQ ID NO: 1338815 - DNA, 18 bp, Homo sapiens
gtgaagttttactgtcta

SEQ ID NO: 1338816 - DNA, 13 bp, Homo sapiens
gtgaatgctggga

SEQ ID NO: 1338817 - DNA, 14 bp, Homo sapiens
gtgaattattgaca

SEQ ID NO: 1338818 - DNA, 17 bp, Homo sapiens
gtgaattattgacactg

SEQ ID NO: 1338819 - DNA, 18 bp, Homo sapiens
gtgaattattgacactga

SEQ ID NO: 1338820 - DNA, 11 bp, Homo sapiens
gtgaattttta

SEQ ID NO: 1338821 - DNA, 13 bp, Homo sapiens
gtgaatttttaag

SEQ ID NO: 1338822 - DNA, 19 bp, Homo sapiens
gtgacaattctgtttttaa

SEQ ID NO: 1338823 - DNA, 16 bp, Homo sapiens
gtgacaattttgtaca

SEQ ID NO: 1338824 - DNA, 16 bp, Homo sapiens
gtgacatggtgcctga

SEQ ID NO: 1338825 - DNA, 19 bp, Homo sapiens
gtgacatggtgcctgagag

SEQ ID NO: 1338826 - DNA, 14 bp, Homo sapiens
gtgaggaaatcaaa

SEQ ID NO: 1338827 - DNA, 18 bp, Homo sapiens
gtgaggaaatcaaagtgc

SEQ ID NO: 1338828 - DNA, 13 bp, Homo sapiens
gtgagggagggga

SEQ ID NO: 1338829 - DNA, 13 bp, Homo sapiens
gtgaggggtccct

SEQ ID NO: 1338830 - DNA, 18 bp, Homo sapiens
gtgagtgacgatgatgta

SEQ ID NO: 1338831 - DNA, 15 bp, Homo sapiens
gtgagtttgagctgc

SEQ ID NO: 1338832 - DNA, 18 bp, Homo sapiens
gtgagtttgagctgcctt

SEQ ID NO: 1338833 - DNA, 21 bp, Homo sapiens
gtgagtttgagctgccttccc

SEQ ID NO: 1338834 - DNA, 12 bp, Homo sapiens
gtgatgagctga

SEQ ID NO: 1338835 - DNA, 21 bp, Homo sapiens
gtgatttctttaaaagaatga

SEQ ID NO: 1338836 - DNA, 23 bp, Homo sapiens
gtgatttgaaaaatataaaatta

SEQ ID NO: 1338837 - DNA, 19 bp, Homo sapiens
gtgcaacctcgctgagggc

SEQ ID NO: 1338838 - DNA, 13 bp, Homo sapiens
gtgcacagccact

SEQ ID NO: 1338839 - DNA, 15 bp, Homo sapiens
gtgcagatggagaga

SEQ ID NO: 1338840 - DNA, 16 bp, Homo sapiens
gtgcatggtggccaga

SEQ ID NO: 1338841 - DNA, 11 bp, Homo sapiens
gtgccaaagaa

SEQ ID NO: 1338842 - DNA, 16 bp, Homo sapiens
aaatagaagagagagg

SEQ ID NO: 1338843 - DNA, 14 bp, Homo sapiens
aaatagatataaat

SEQ ID NO: 1338844 - DNA, 21 bp, Homo sapiens
aaatagattttataagatgac

SEQ ID NO: 1338845 - DNA, 14 bp, Homo sapiens
aaataggaaacaag

SEQ ID NO: 1338846 - DNA, 20 bp, Homo sapiens
aaataggaatcattcagaaa

SEQ ID NO: 1338847 - DNA, 15 bp, Homo sapiens
aaatagtgtctttgt

SEQ ID NO: 1338848 - DNA, 17 bp, Homo sapiens
aaatagtttattttaaa

SEQ ID NO: 1338849 - DNA, 21 bp, Homo sapiens
aaatagtttattttaaaacaa

SEQ ID NO: 1338850 - DNA, 13 bp, Homo sapiens
aaatatcaaatta

SEQ ID NO: 1338851 - DNA, 16 bp, Homo sapiens
aaatatcaaattaatt

SEQ ID NO: 1338852 - DNA, 13 bp, Homo sapiens
aaatatcattgta

SEQ ID NO: 1338853 - DNA, 14 bp, Homo sapiens
aaatatcttggcct

SEQ ID NO: 1338854 - DNA, 15 bp, Homo sapiens
aaatattaagcatgt

SEQ ID NO: 1338855 - DNA, 17 bp, Homo sapiens
aaatattcactggcccc

SEQ ID NO: 1338856 - DNA, 16 bp, Homo sapiens
aaatattgtttctgca

SEQ ID NO: 1338857 - DNA, 11 bp, Homo sapiens
aaatattttct

SEQ ID NO: 1338858 - DNA, 13 bp, Homo sapiens
aaatattttctat

SEQ ID NO: 1338859 - DNA, 15 bp, Homo sapiens
aaatattttctctgt

SEQ ID NO: 1338860 - DNA, 12 bp, Homo sapiens
aaatcagcctgc

SEQ ID NO: 1338861 - DNA, 19 bp, Homo sapiens
aaatcagcctgctccagct

SEQ ID NO: 1338862 - DNA, 21 bp, Homo sapiens
aaatcagcctgctccagctgt

SEQ ID NO: 1338863 - DNA, 19 bp, Homo sapiens
aaatcatagttaaatgtta

SEQ ID NO: 1338864 - DNA, 19 bp, Homo sapiens
aaatcattcttactaaaaa

SEQ ID NO: 1338865 - DNA, 15 bp, Homo sapiens
aaatcccatttaaaa

SEQ ID NO: 1338866 - DNA, 18 bp, Homo sapiens
aaatcccttacctcggtg

SEQ ID NO: 1338867 - DNA, 21 bp, Homo sapiens
aaatctaagcagcttattgtt

SEQ ID NO: 1338868 - DNA, 16 bp, Homo sapiens
aaatctatttattaat

SEQ ID NO: 1338869 - DNA, 12 bp, Homo sapiens
aaatctggaagc

SEQ ID NO: 1338870 - DNA, 13 bp, Homo sapiens
aaatcttcccatg

SEQ ID NO: 1338871 - DNA, 17 bp, Homo sapiens
aaatcttttgaagcata

SEQ ID NO: 1338872 - DNA, 15 bp, Homo sapiens
aaatgaaagaaaatt

SEQ ID NO: 1338873 - DNA, 20 bp, Homo sapiens
aaatgaaagaaaattgagtt

SEQ ID NO: 1338874 - DNA, 15 bp, Homo sapiens
aaatgaaatgcatat

SEQ ID NO: 1338875 - DNA, 13 bp, Homo sapiens
aaatgaagaattt

SEQ ID NO: 1338876 - DNA, 18 bp, Homo sapiens
aaatgaatatctattaat

SEQ ID NO: 1338877 - DNA, 18 bp, Homo sapiens
aaatgactttattattta

SEQ ID NO: 1338878 - DNA, 21 bp, Homo sapiens
aaatgactttattatttattt

SEQ ID NO: 1338879 - DNA, 15 bp, Homo sapiens
aaatgagctctgaaa

SEQ ID NO: 1338880 - DNA, 19 bp, Homo sapiens
aaatgagctctgaaatctt

SEQ ID NO: 1338881 - DNA, 22 bp, Homo sapiens
aaatgatgatgtggaagaactt

SEQ ID NO: 1338882 - DNA, 16 bp, Homo sapiens
aaatgcatctttgatg

SEQ ID NO: 1338883 - DNA, 18 bp, Homo sapiens
aaatgccatagaaatgta

SEQ ID NO: 1338884 - DNA, 19 bp, Homo sapiens
aaatgccatttatttattg

SEQ ID NO: 1338885 - DNA, 20 bp, Homo sapiens
aaatgccatttatttattga

SEQ ID NO: 1338886 - DNA, 21 bp, Homo sapiens
aaatgccatttatttattgat

SEQ ID NO: 1338887 - DNA, 22 bp, Homo sapiens
aaatgccctcttctcgtgcctc

SEQ ID NO: 1338888 - DNA, 21 bp, Homo sapiens
aaatggaaagcagagttttca

SEQ ID NO: 1338889 - DNA, 23 bp, Homo sapiens
aaatggactggagctcatctgca

SEQ ID NO: 1338890 - DNA, 23 bp, Homo sapiens
aaatggaggatctctaaagagca

SEQ ID NO: 1338891 - DNA, 13 bp, Homo sapiens
aaatggatactgg

SEQ ID NO: 1338892 - DNA, 15 bp, Homo sapiens
aaatggcctcatgtg

SEQ ID NO: 1338893 - DNA, 21 bp, Homo sapiens
aaatggcctcatgtggctgga

SEQ ID NO: 1338894 - DNA, 19 bp, Homo sapiens
aaatggctgtaatcatttg

SEQ ID NO: 1338895 - DNA, 11 bp, Homo sapiens
aaatgtaaact

SEQ ID NO: 1338896 - DNA, 17 bp, Homo sapiens
aaatgtaatttaaatga

SEQ ID NO: 1338897 - DNA, 18 bp, Homo sapiens
aaatgtaatttaaatgaa

SEQ ID NO: 1338898 - DNA, 21 bp, Homo sapiens
aaatgtataaatatacagtat

SEQ ID NO: 1338899 - DNA, 23 bp, Homo sapiens
aaatgtcaaaagtagaactttgt

SEQ ID NO: 1338900 - DNA, 19 bp, Homo sapiens
aaatgtctagttgtaacac

SEQ ID NO: 1338901 - DNA, 14 bp, Homo sapiens
aaatgtctgtaaat

SEQ ID NO: 1338902 - DNA, 20 bp, Homo sapiens
aaatgtctgtaaatatgttt

SEQ ID NO: 1338903 - DNA, 20 bp, Homo sapiens
aaatgtgagtggttgaatat

SEQ ID NO: 1338904 - DNA, 14 bp, Homo sapiens
aaatgttacctctg

SEQ ID NO: 1338905 - DNA, 17 bp, Homo sapiens
aaatgttacctctgaat

SEQ ID NO: 1338906 - DNA, 19 bp, Homo sapiens
aaatgtttcttttgtttgg

SEQ ID NO: 1338907 - DNA, 14 bp, Homo sapiens
aaatgttttgtaaa

SEQ ID NO: 1338908 - DNA, 18 bp, Homo sapiens
aaatgttttgtaaacatt

SEQ ID NO: 1338909 - DNA, 14 bp, Homo sapiens
aaattaggaataaa

SEQ ID NO: 1338910 - DNA, 20 bp, Homo sapiens
aaattatcttgatacattca

SEQ ID NO: 1338911 - DNA, 22 bp, Homo sapiens
aaattatcttgatacattcaaa

SEQ ID NO: 1338912 - DNA, 17 bp, Homo sapiens
aaattatttgattattt

SEQ ID NO: 1338913 - DNA, 16 bp, Homo sapiens
aaattcaactttgtaa

SEQ ID NO: 1338914 - DNA, 20 bp, Homo sapiens
aaattcaactttgtaaaaat

SEQ ID NO: 1338915 - DNA, 16 bp, Homo sapiens
aaattccccaccctga

SEQ ID NO: 1338916 - DNA, 22 bp, Homo sapiens
aaattctgatttcttttcacca

SEQ ID NO: 1338917 - DNA, 21 bp, Homo sapiens
aaattcttctaattgctgtgt

SEQ ID NO: 1338918 - DNA, 19 bp, Homo sapiens
aaattgagttgcacttatt

SEQ ID NO: 1338919 - DNA, 19 bp, Homo sapiens
aaattgtatattgtaattt

SEQ ID NO: 1338920 - DNA, 13 bp, Homo sapiens
aaattgtttagtg

SEQ ID NO: 1338921 - DNA, 21 bp, Homo sapiens
aaatttaataccagatacctt

SEQ ID NO: 1338922 - DNA, 12 bp, Homo sapiens
aaatttagtgtt

SEQ ID NO: 1338923 - DNA, 23 bp, Homo sapiens
aaatttatggttttggtattttt

SEQ ID NO: 1338924 - DNA, 18 bp, Homo sapiens
aaatttcactactagatt

SEQ ID NO: 1338925 - DNA, 14 bp, Homo sapiens
aaatttcttatgtg

SEQ ID NO: 1338926 - DNA, 13 bp, Homo sapiens
aaattttgaaaag

SEQ ID NO: 1338927 - DNA, 12 bp, Homo sapiens
aaatttttttgt

SEQ ID NO: 1338928 - DNA, 14 bp, Homo sapiens
aaatttttttgtat

SEQ ID NO: 1338929 - DNA, 12 bp, Homo sapiens
aacaaaaaccaa

SEQ ID NO: 1338930 - DNA, 16 bp, Homo sapiens
aacaaaaagcttcccc

SEQ ID NO: 1338931 - DNA, 14 bp, Homo sapiens
aacaaaatgaagct

SEQ ID NO: 1338932 - DNA, 20 bp, Homo sapiens
aacaaaatttgactaatttt

SEQ ID NO: 1338933 - DNA, 15 bp, Homo sapiens
aacaaattatttttg

SEQ ID NO: 1338934 - DNA, 13 bp, Homo sapiens
aacaacaattggt

SEQ ID NO: 1338935 - DNA, 14 bp, Homo sapiens
aacaacaattggta

SEQ ID NO: 1338936 - DNA, 22 bp, Homo sapiens
aacaagaaataatagaaatgtc

SEQ ID NO: 1338937 - DNA, 17 bp, Homo sapiens
aacaagttgagctatga

SEQ ID NO: 1338938 - DNA, 18 bp, Homo sapiens
aacaataggctgttccca

SEQ ID NO: 1338939 - DNA, 21 bp, Homo sapiens
aacaatattttatggttatgt

SEQ ID NO: 1338940 - DNA, 15 bp, Homo sapiens
aacaatgaagttgaa

SEQ ID NO: 1338941 - DNA, 18 bp, Homo sapiens
aacaatgaagttgaaaat

SEQ ID NO: 1338942 - DNA, 17 bp, Homo sapiens
aacaatggagtattctc

SEQ ID NO: 1338943 - DNA, 16 bp, Homo sapiens
aacaattggtaaaact

SEQ ID NO: 1338944 - DNA, 24 bp, Homo sapiens
aacaattggtaaaactcactgtga

SEQ ID NO: 1338945 - DNA, 17 bp, Homo sapiens
aacacacacatatacac

SEQ ID NO: 1338946 - DNA, 21 bp, Homo sapiens
aacactccccattaacagatg

SEQ ID NO: 1338947 - DNA, 23 bp, Homo sapiens
aacactgcctttttatttatatg

SEQ ID NO: 1338948 - DNA, 14 bp, Homo sapiens
aacagaaatggaaa

SEQ ID NO: 1338949 - DNA, 18 bp, Homo sapiens
aacagaaattgtatattg

SEQ ID NO: 1338950 - DNA, 16 bp, Homo sapiens
aacagcctctttttga

SEQ ID NO: 1338951 - DNA, 18 bp, Homo sapiens
aacagctgtcacaacttg

SEQ ID NO: 1338952 - DNA, 20 bp, Homo sapiens
aacagtgaagttttactgtc

SEQ ID NO: 1338953 - DNA, 23 bp, Homo sapiens
aacagtgtgtaaacaaaatgaag

SEQ ID NO: 1338954 - DNA, 12 bp, Homo sapiens
aacagttttgtg

SEQ ID NO: 1338955 - DNA, 13 bp, Homo sapiens
aacatcattcctt

SEQ ID NO: 1338956 - DNA, 20 bp, Homo sapiens
aacatcattcctttttattt

SEQ ID NO: 1338957 - DNA, 16 bp, Homo sapiens
aacatccaaccttccc

SEQ ID NO: 1338958 - DNA, 13 bp, Homo sapiens
aacatgaatcaaa

SEQ ID NO: 1338959 - DNA, 20 bp, Homo sapiens
aacatgaatcaaaagtgcct

SEQ ID NO: 1338960 - DNA, 18 bp, Homo sapiens
aatcagcctgctccagct

SEQ ID NO: 1338961 - DNA, 20 bp, Homo sapiens
aatcaggaatattttccaaa

SEQ ID NO: 1338962 - DNA, 23 bp, Homo sapiens
aatcataggcaccttttactgtg

SEQ ID NO: 1338963 - DNA, 22 bp, Homo sapiens
aatcatgttgatcatgtacttt

SEQ ID NO: 1338964 - DNA, 15 bp, Homo sapiens
aatcattcagaaatg

SEQ ID NO: 1338965 - DNA, 18 bp, Homo sapiens
aatcattcttactaaaaa

SEQ ID NO: 1338966 - DNA, 14 bp, Homo sapiens
aatcatttgtttac

SEQ ID NO: 1338967 - DNA, 16 bp, Homo sapiens
aatcatttgtttacat

SEQ ID NO: 1338968 - DNA, 17 bp, Homo sapiens
aatccagtgacctctct

SEQ ID NO: 1338969 - DNA, 16 bp, Homo sapiens
aatccagttataagaa

SEQ ID NO: 1338970 - DNA, 17 bp, Homo sapiens
aatcccatttaaaaaaa

SEQ ID NO: 1338971 - DNA, 18 bp, Homo sapiens
aatcccttaacagttgta

SEQ ID NO: 1338972 - DNA, 24 bp, Homo sapiens
aatcctaatttctcctcccttcct

SEQ ID NO: 1338973 - DNA, 16 bp, Homo sapiens
aatcctggcagcccag

SEQ ID NO: 1338974 - DNA, 15 bp, Homo sapiens
aatcggggtataata

SEQ ID NO: 1338975 - DNA, 15 bp, Homo sapiens
aatctactgcattta

SEQ ID NO: 1338976 - DNA, 22 bp, Homo sapiens
aatctagatatcgacttgtttt

SEQ ID NO: 1338977 - DNA, 17 bp, Homo sapiens
aatctatttattaatat

SEQ ID NO: 1338978 - DNA, 14 bp, Homo sapiens
aatctctaggaagt

SEQ ID NO: 1338979 - DNA, 18 bp, Homo sapiens
aatctgagggaaatgttt

SEQ ID NO: 1338980 - DNA, 14 bp, Homo sapiens
aatctgatggcctt

SEQ ID NO: 1338981 - DNA, 15 bp, Homo sapiens
aatctgatggcctta

SEQ ID NO: 1338982 - DNA, 19 bp, Homo sapiens
aatctgatggccttaattt

SEQ ID NO: 1338983 - DNA, 23 bp, Homo sapiens
aatctgatggccttaatttcctt

SEQ ID NO: 1338984 - DNA, 19 bp, Homo sapiens
aatctgttgataaatccat

SEQ ID NO: 1338985 - DNA, 21 bp, Homo sapiens
aatctgttgataaatccatca

SEQ ID NO: 1338986 - DNA, 13 bp, Homo sapiens
aatcttaatgttc

SEQ ID NO: 1338987 - DNA, 15 bp, Homo sapiens
aatcttaatgttcct

SEQ ID NO: 1338988 - DNA, 15 bp, Homo sapiens
aatcttactttgtaa

SEQ ID NO: 1338989 - DNA, 20 bp, Homo sapiens
aatcttactttgtaaattct

SEQ ID NO: 1338990 - DNA, 17 bp, Homo sapiens
aatcttgtttctgaaaa

SEQ ID NO: 1338991 - DNA, 20 bp, Homo sapiens
aatctttacctgtatacagt

SEQ ID NO: 1338992 - DNA, 23 bp, Homo sapiens
aatctttacctgtatacagtgca

SEQ ID NO: 1338993 - DNA, 13 bp, Homo sapiens
aatgaaaacagtg

SEQ ID NO: 1338994 - DNA, 14 bp, Homo sapiens
aatgaaaattgtat

SEQ ID NO: 1338995 - DNA, 16 bp, Homo sapiens
aatgaaagaaaattga

SEQ ID NO: 1338996 - DNA, 14 bp, Homo sapiens
aatgaatatctatt

SEQ ID NO: 1338997 - DNA, 15 bp, Homo sapiens
aatgaatatctatta

SEQ ID NO: 1338998 - DNA, 23 bp, Homo sapiens
aatgactatataatttatttcca

SEQ ID NO: 1338999 - DNA, 11 bp, Homo sapiens
aatgagcctgg

SEQ ID NO: 1339000 - DNA, 12 bp, Homo sapiens
aatgagcctggc

SEQ ID NO: 1339001 - DNA, 13 bp, Homo sapiens
aatgagcctggca

SEQ ID NO: 1339002 - DNA, 22 bp, Homo sapiens
aatgagctcgcatttgtcaatg

SEQ ID NO: 1339003 - DNA, 19 bp, Homo sapiens
aatgaggaaaattcttaaa

SEQ ID NO: 1339004 - DNA, 14 bp, Homo sapiens
aatgagtctgttgt

SEQ ID NO: 1339005 - DNA, 21 bp, Homo sapiens
aatgatgatcctaggcatttg

SEQ ID NO: 1339006 - DNA, 21 bp, Homo sapiens
aatgatgatgtggaagaactt

SEQ ID NO: 1339007 - DNA, 17 bp, Homo sapiens
aatgcaaaaactctttg

SEQ ID NO: 1339008 - DNA, 21 bp, Homo sapiens
aatgcaaactgggatgaaact

SEQ ID NO: 1339009 - DNA, 15 bp, Homo sapiens
aatgcactttctatc

SEQ ID NO: 1339010 - DNA, 22 bp, Homo sapiens
aatgcactttctatcctctgta

SEQ ID NO: 1339011 - DNA, 17 bp, Homo sapiens
aatgcatatttgcaaag

SEQ ID NO: 1339012 - DNA, 15 bp, Homo sapiens
aatgctacatgtgag

SEQ ID NO: 1339013 - DNA, 22 bp, Homo sapiens
aatggaccctttttgttatgat

SEQ ID NO: 1339014 - DNA, 15 bp, Homo sapiens
aatggagaagctgca

SEQ ID NO: 1339015 - DNA, 19 bp, Homo sapiens
aatggaggatctctaaaga

SEQ ID NO: 1339016 - DNA, 15 bp, Homo sapiens
aatggatttcagaag

SEQ ID NO: 1339017 - DNA, 19 bp, Homo sapiens
aatggcgtgaacccgggag

SEQ ID NO: 1339018 - DNA, 14 bp, Homo sapiens
aatggcttgttcat

SEQ ID NO: 1339019 - DNA, 15 bp, Homo sapiens
aatgggctctccggg

SEQ ID NO: 1339020 - DNA, 13 bp, Homo sapiens
aatggtagtttct

SEQ ID NO: 1339021 - DNA, 20 bp, Homo sapiens
aatggtagtttctgtggttg

SEQ ID NO: 1339022 - DNA, 16 bp, Homo sapiens
aatgtaagcatacttt

SEQ ID NO: 1339023 - DNA, 16 bp, Homo sapiens
aatgtaggtcctcaga

SEQ ID NO: 1339024 - DNA, 21 bp, Homo sapiens
aatgtataaactttagagtag

SEQ ID NO: 1339025 - DNA, 13 bp, Homo sapiens
aatgtataaatat

SEQ ID NO: 1339026 - DNA, 14 bp, Homo sapiens
aatgtataaatata

SEQ ID NO: 1339027 - DNA, 16 bp, Homo sapiens
aatgtataaatataca

SEQ ID NO: 1339028 - DNA, 23 bp, Homo sapiens
aatgtcaaaagtagaactttgta

SEQ ID NO: 1339029 - DNA, 19 bp, Homo sapiens
aatgtccagtaagatcact

SEQ ID NO: 1339030 - DNA, 20 bp, Homo sapiens
aatgtccagtaagatcactg

SEQ ID NO: 1339031 - DNA, 22 bp, Homo sapiens
aatgtccagtaagatcactgtt

SEQ ID NO: 1339032 - DNA, 19 bp, Homo sapiens
aatgtctgtaataatagac

SEQ ID NO: 1339033 - DNA, 19 bp, Homo sapiens
aatgtgaccctccaaatgg

SEQ ID NO: 1339034 - DNA, 23 bp, Homo sapiens
aatgtgagtggttgaatatgatt

SEQ ID NO: 1339035 - DNA, 16 bp, Homo sapiens
aatgtgtggcctgcac

SEQ ID NO: 1339036 - DNA, 12 bp, Homo sapiens
aatgtgttctcg

SEQ ID NO: 1339037 - DNA, 22 bp, Homo sapiens
aatgtgttctcggagtgtgtat

SEQ ID NO: 1339038 - DNA, 15 bp, Homo sapiens
aatgttacctctgaa

SEQ ID NO: 1339039 - DNA, 12 bp, Homo sapiens
aatgttagagta

SEQ ID NO: 1339040 - DNA, 21 bp, Homo sapiens
aatgttcctcaaagcttggat

SEQ ID NO: 1339041 - DNA, 13 bp, Homo sapiens
aatgttgggactg

SEQ ID NO: 1339042 - DNA, 21 bp, Homo sapiens
aatgtttcttttgtttggtaa

SEQ ID NO: 1339043 - DNA, 21 bp, Homo sapiens
aatgtttggcatgtaaatgta

SEQ ID NO: 1339044 - DNA, 17 bp, Homo sapiens
aatgttttatactgttt

SEQ ID NO: 1339045 - DNA, 13 bp, Homo sapiens
aatgttttgtaaa

SEQ ID NO: 1339046 - DNA, 19 bp, Homo sapiens
aatgttttgtaaacattta

SEQ ID NO: 1339047 - DNA, 16 bp, Homo sapiens
aattaaaagtcttttt

SEQ ID NO: 1339048 - DNA, 14 bp, Homo sapiens
aattaactgaaaca

SEQ ID NO: 1339049 - DNA, 15 bp, Homo sapiens
aattaagcaaatgtt

SEQ ID NO: 1339050 - DNA, 18 bp, Homo sapiens
aattaagcaaatgttaaa

SEQ ID NO: 1339051 - DNA, 22 bp, Homo sapiens
aattaagccctaaggtcctaag

SEQ ID NO: 1339052 - DNA, 13 bp, Homo sapiens
aattaaggtgttt

SEQ ID NO: 1339053 - DNA, 15 bp, Homo sapiens
aattaaggtgtttga

SEQ ID NO: 1339054 - DNA, 15 bp, Homo sapiens
aattaattgtgtgaa

SEQ ID NO: 1339055 - DNA, 22 bp, Homo sapiens
aattaattgtgtgaacttggaa

SEQ ID NO: 1339056 - DNA, 15 bp, Homo sapiens
aattacaattttatc

SEQ ID NO: 1339057 - DNA, 19 bp, Homo sapiens
aattacaattttatctgtt

SEQ ID NO: 1339058 - DNA, 19 bp, Homo sapiens
aattacagtccaaaatact

SEQ ID NO: 1339059 - DNA, 16 bp, Homo sapiens
aattactgccttgaaa

SEQ ID NO: 1339060 - DNA, 14 bp, Homo sapiens
aattatataactgt

SEQ ID NO: 1339061 - DNA, 17 bp, Homo sapiens
aattatataactgtatt

SEQ ID NO: 1339062 - DNA, 21 bp, Homo sapiens
aattatataactgtatttgaa

SEQ ID NO: 1339063 - DNA, 20 bp, Homo sapiens
aattatcaatatctaatata

SEQ ID NO: 1339064 - DNA, 20 bp, Homo sapiens
aattatcttgatacattcaa

SEQ ID NO: 1339065 - DNA, 23 bp, Homo sapiens
aattatgagattggttttcctgt

SEQ ID NO: 1339066 - DNA, 13 bp, Homo sapiens
aattattgacact

SEQ ID NO: 1339067 - DNA, 20 bp, Homo sapiens
aattatttgattatttaaga

SEQ ID NO: 1339068 - DNA, 16 bp, Homo sapiens
aattcagacatctgag

SEQ ID NO: 1339069 - DNA, 21 bp, Homo sapiens
aattcagacatctgaggtttt

SEQ ID NO: 1339070 - DNA, 12 bp, Homo sapiens
aattcatttcta

SEQ ID NO: 1339071 - DNA, 14 bp, Homo sapiens
aattccccaccctg

SEQ ID NO: 1339072 - DNA, 21 bp, Homo sapiens
aattcctatatcctgtgactg

SEQ ID NO: 1339073 - DNA, 13 bp, Homo sapiens
aattctcctggag

SEQ ID NO: 1339074 - DNA, 15 bp, Homo sapiens
aattctgattgattt

SEQ ID NO: 1339075 - DNA, 19 bp, Homo sapiens
aattctgtttttaatgcta

SEQ ID NO: 1339076 - DNA, 18 bp, Homo sapiens
aattctgtttttctaggc

SEQ ID NO: 1339077 - DNA, 16 bp, Homo sapiens
aattcttaagtatgtt

SEQ ID NO: 1339078 - DNA, 20 bp, Homo sapiens
acgaggtcaggagatcgaga

SEQ ID NO: 1339079 - DNA, 19 bp, Homo sapiens
acgatcacaaatgacttta

SEQ ID NO: 1339080 - DNA, 15 bp, Homo sapiens
acgccactcatttca

SEQ ID NO: 1339081 - DNA, 20 bp, Homo sapiens
acgccactcatttcatctca

SEQ ID NO: 1339082 - DNA, 18 bp, Homo sapiens
acgcccgtcctgcctgtg

SEQ ID NO: 1339083 - DNA, 23 bp, Homo sapiens
acgcgcctcgccggatctgaggg

SEQ ID NO: 1339084 - DNA, 20 bp, Homo sapiens
acgctccgctgccgtgccgc

SEQ ID NO: 1339085 - DNA, 13 bp, Homo sapiens
acgcttctccgga

SEQ ID NO: 1339086 - DNA, 16 bp, Homo sapiens
acggaagagccttgcg

SEQ ID NO: 1339087 - DNA, 20 bp, Homo sapiens
acggagcccagccctcccca

SEQ ID NO: 1339088 - DNA, 20 bp, Homo sapiens
acggaggcctgcgaccctgg

SEQ ID NO: 1339089 - DNA, 22 bp, Homo sapiens
acgggatggttctggctgtttg

SEQ ID NO: 1339090 - DNA, 14 bp, Homo sapiens
acgggtggggaaag

SEQ ID NO: 1339091 - DNA, 20 bp, Homo sapiens
acggtgctgtgagggagggg

SEQ ID NO: 1339092 - DNA, 17 bp, Homo sapiens
acggtgttttgccatgt

SEQ ID NO: 1339093 - DNA, 17 bp, Homo sapiens
acggttttactgcagct

SEQ ID NO: 1339094 - DNA, 17 bp, Homo sapiens
acgtacaagtagttctg

SEQ ID NO: 1339095 - DNA, 20 bp, Homo sapiens
acgtacaagtagttctgtat

SEQ ID NO: 1339096 - DNA, 22 bp, Homo sapiens
acgtacaagtagttctgtattt

SEQ ID NO: 1339097 - DNA, 15 bp, Homo sapiens
acgtcagatgtttaa

SEQ ID NO: 1339098 - DNA, 12 bp, Homo sapiens
acgtcatgtatt

SEQ ID NO: 1339099 - DNA, 16 bp, Homo sapiens
acgtgggcaaacaggc

SEQ ID NO: 1339100 - DNA, 19 bp, Homo sapiens
acgtgggcaaacaggcagt

SEQ ID NO: 1339101 - DNA, 21 bp, Homo sapiens
acgtttctttaaccttgtata

SEQ ID NO: 1339102 - DNA, 18 bp, Homo sapiens
acgttttttcctcagtgc

SEQ ID NO: 1339103 - DNA, 13 bp, Homo sapiens
actaaaaatattg

SEQ ID NO: 1339104 - DNA, 20 bp, Homo sapiens
actaaactacattgttctta

SEQ ID NO: 1339105 - DNA, 11 bp, Homo sapiens
actaaagcaat

SEQ ID NO: 1339106 - DNA, 16 bp, Homo sapiens
actaaagcaatagaaa

SEQ ID NO: 1339107 - DNA, 19 bp, Homo sapiens
actaaataagaaaataaca

SEQ ID NO: 1339108 - DNA, 15 bp, Homo sapiens
actaaatcagagaca

SEQ ID NO: 1339109 - DNA, 18 bp, Homo sapiens
actaaatcagagacaaaa

SEQ ID NO: 1339110 - DNA, 19 bp, Homo sapiens
actaaatcagagacaaaat

SEQ ID NO: 1339111 - DNA, 21 bp, Homo sapiens
actaaatcagagacaaaatat

SEQ ID NO: 1339112 - DNA, 23 bp, Homo sapiens
actaataatcttgtttctgaaaa

SEQ ID NO: 1339113 - DNA, 13 bp, Homo sapiens
actacacctggct

SEQ ID NO: 1339114 - DNA, 14 bp, Homo sapiens
actacacctggctg

SEQ ID NO: 1339115 - DNA, 21 bp, Homo sapiens
actacaccttgccttgctgtt

SEQ ID NO: 1339116 - DNA, 22 bp, Homo sapiens
actacctgtatttaaaaataga

SEQ ID NO: 1339117 - DNA, 22 bp, Homo sapiens
actactttgttaggattttcac

SEQ ID NO: 1339118 - DNA, 20 bp, Homo sapiens
actagattttcacttatgaa

SEQ ID NO: 1339119 - DNA, 14 bp, Homo sapiens
actagcaaaataaa

SEQ ID NO: 1339120 - DNA, 23 bp, Homo sapiens
actagcaatctcttcattattct

SEQ ID NO: 1339121 - DNA, 20 bp, Homo sapiens
actaggcccccacttgcctc

SEQ ID NO: 1339122 - DNA, 16 bp, Homo sapiens
actatatatataaatg

SEQ ID NO: 1339123 - DNA, 20 bp, Homo sapiens
actatatatataaatgtata

SEQ ID NO: 1339124 - DNA, 16 bp, Homo sapiens
actatgggatgagaaa

SEQ ID NO: 1339125 - DNA, 23 bp, Homo sapiens
actattgtgctcagagacactgt

SEQ ID NO: 1339126 - DNA, 16 bp, Homo sapiens
actatttaagatgtga

SEQ ID NO: 1339127 - DNA, 17 bp, Homo sapiens
actatttaagatgtgaa

SEQ ID NO: 1339128 - DNA, 20 bp, Homo sapiens
actatttaagatgtgaaaat

SEQ ID NO: 1339129 - DNA, 13 bp, Homo sapiens
actcaaaagctgg

SEQ ID NO: 1339130 - DNA, 19 bp, Homo sapiens
actcaaatacacatttgct

SEQ ID NO: 1339131 - DNA, 21 bp, Homo sapiens
actcaagcgggtggctctggg

SEQ ID NO: 1339132 - DNA, 17 bp, Homo sapiens
actcaatgctttatttg

SEQ ID NO: 1339133 - DNA, 21 bp, Homo sapiens
actcaatgctttatttgtaaa

SEQ ID NO: 1339134 - DNA, 23 bp, Homo sapiens
actcaatgctttatttgtaaatt

SEQ ID NO: 1339135 - DNA, 22 bp, Homo sapiens
actcacagagtcaaggcctgct

SEQ ID NO: 1339136 - DNA, 17 bp, Homo sapiens
actcacattagagaaca

SEQ ID NO: 1339137 - DNA, 12 bp, Homo sapiens
actcaccttcta

SEQ ID NO: 1339138 - DNA, 18 bp, Homo sapiens
actcactgtgatcaatat

SEQ ID NO: 1339139 - DNA, 21 bp, Homo sapiens
actcagagctctctctacaga

SEQ ID NO: 1339140 - DNA, 23 bp, Homo sapiens
actcagccttcagacagagagga

SEQ ID NO: 1339141 - DNA, 20 bp, Homo sapiens
actcagtgggttaacatcag

SEQ ID NO: 1339142 - DNA, 15 bp, Homo sapiens
actcatctgaaatgt

SEQ ID NO: 1339143 - DNA, 22 bp, Homo sapiens
actcatctggagttctcaaaga

SEQ ID NO: 1339144 - DNA, 12 bp, Homo sapiens
actcatcttata

SEQ ID NO: 1339145 - DNA, 13 bp, Homo sapiens
actcatttcatct

SEQ ID NO: 1339146 - DNA, 14 bp, Homo sapiens
actcatttcatctc

SEQ ID NO: 1339147 - DNA, 22 bp, Homo sapiens
actcatttgttaaaattatcaa

SEQ ID NO: 1339148 - DNA, 20 bp, Homo sapiens
actccaactcccttaaaata

SEQ ID NO: 1339149 - DNA, 14 bp, Homo sapiens
actccacatctgcc

SEQ ID NO: 1339150 - DNA, 17 bp, Homo sapiens
actccacatctgcctta

SEQ ID NO: 1339151 - DNA, 20 bp, Homo sapiens
actccagcaacttcttctcc

SEQ ID NO: 1339152 - DNA, 12 bp, Homo sapiens
actccagccagc

SEQ ID NO: 1339153 - DNA, 13 bp, Homo sapiens
actccagccagcg

SEQ ID NO: 1339154 - DNA, 18 bp, Homo sapiens
actccagccagcgcctcc

SEQ ID NO: 1339155 - DNA, 13 bp, Homo sapiens
actccagcctggg

SEQ ID NO: 1339156 - DNA, 19 bp, Homo sapiens
actccagggacacacagcc

SEQ ID NO: 1339157 - DNA, 21 bp, Homo sapiens
actcccttgctggccccagcc

SEQ ID NO: 1339158 - DNA, 17 bp, Homo sapiens
actccgttggccactcc

SEQ ID NO: 1339159 - DNA, 18 bp, Homo sapiens
actccgttggccactccg

SEQ ID NO: 1339160 - DNA, 21 bp, Homo sapiens
actccgttggccactccgaga

SEQ ID NO: 1339161 - DNA, 18 bp, Homo sapiens
actcctcagggcagcctc

SEQ ID NO: 1339162 - DNA, 18 bp, Homo sapiens
actcctcggtactcccat

SEQ ID NO: 1339163 - DNA, 15 bp, Homo sapiens
actcgactctgtgcc

SEQ ID NO: 1339164 - DNA, 15 bp, Homo sapiens
actcgagtctgaggc

SEQ ID NO: 1339165 - DNA, 15 bp, Homo sapiens
actcggctctgcagt

SEQ ID NO: 1339166 - DNA, 16 bp, Homo sapiens
actcggggtgcttcct

SEQ ID NO: 1339167 - DNA, 12 bp, Homo sapiens
actcggtttctc

SEQ ID NO: 1339168 - DNA, 15 bp, Homo sapiens
actcgtggctgtcaa

SEQ ID NO: 1339169 - DNA, 20 bp, Homo sapiens
actctaagtcatgtatgttt

SEQ ID NO: 1339170 - DNA, 15 bp, Homo sapiens
actctagggaaaaac

SEQ ID NO: 1339171 - DNA, 17 bp, Homo sapiens
actctagggaaaaacca

SEQ ID NO: 1339172 - DNA, 20 bp, Homo sapiens
actctatcggagaacatgaa

SEQ ID NO: 1339173 - DNA, 17 bp, Homo sapiens
actctcatcactacagt

SEQ ID NO: 1339174 - DNA, 23 bp, Homo sapiens
actctgatggttcttcacctcct

SEQ ID NO: 1339175 - DNA, 14 bp, Homo sapiens
actctgcatgtaga

SEQ ID NO: 1339176 - DNA, 15 bp, Homo sapiens
actctgcttctctga

SEQ ID NO: 1339177 - DNA, 22 bp, Homo sapiens
actctgcttctctgacttctgc

SEQ ID NO: 1339178 - DNA, 18 bp, Homo sapiens
actctgggtccttcctga

SEQ ID NO: 1339179 - DNA, 15 bp, Homo sapiens
actcttcagagaaat

SEQ ID NO: 1339180 - DNA, 24 bp, Homo sapiens
actcttctcattacttgttgccta

SEQ ID NO: 1339181 - DNA, 20 bp, Homo sapiens
actcttgagttgtttttgta

SEQ ID NO: 1339182 - DNA, 16 bp, Homo sapiens
actgaaagttttgtaa

SEQ ID NO: 1339183 - DNA, 16 bp, Homo sapiens
actgaaccacttgtag

SEQ ID NO: 1339184 - DNA, 18 bp, Homo sapiens
actgaaccacttgtagat

SEQ ID NO: 1339185 - DNA, 21 bp, Homo sapiens
actgaaccacttgtagatttg

SEQ ID NO: 1339186 - DNA, 18 bp, Homo sapiens
actgaaggaaaaacacaa

SEQ ID NO: 1339187 - DNA, 21 bp, Homo sapiens
actgaagtcttactacagaaa

SEQ ID NO: 1339188 - DNA, 15 bp, Homo sapiens
actgaatttttttgt

SEQ ID NO: 1339189 - DNA, 18 bp, Homo sapiens
actgaatttttttgtaat

SEQ ID NO: 1339190 - DNA, 12 bp, Homo sapiens
actgatggaatt

SEQ ID NO: 1339191 - DNA, 23 bp, Homo sapiens
actgatggaatttttttgtacga

SEQ ID NO: 1339192 - DNA, 13 bp, Homo sapiens
actgcactccagc

SEQ ID NO: 1339193 - DNA, 16 bp, Homo sapiens
actgcactccagcctg

SEQ ID NO: 1339194 - DNA, 18 bp, Homo sapiens
actgcactccagcctggg

SEQ ID NO: 1339195 - DNA, 13 bp, Homo sapiens
agagagagagagg

SEQ ID NO: 1339196 - DNA, 20 bp, Homo sapiens
agagaggaaattctccactg

SEQ ID NO: 1339197 - DNA, 14 bp, Homo sapiens
agagatccaaagac

SEQ ID NO: 1339198 - DNA, 19 bp, Homo sapiens
agagatgggaatgaggtgg

SEQ ID NO: 1339199 - DNA, 13 bp, Homo sapiens
agagccagcttgg

SEQ ID NO: 1339200 - DNA, 18 bp, Homo sapiens
agagccatacataaaaga

SEQ ID NO: 1339201 - DNA, 20 bp, Homo sapiens
agagccatacataaaagaaa

SEQ ID NO: 1339202 - DNA, 19 bp, Homo sapiens
agagccggcccgcctctcc

SEQ ID NO: 1339203 - DNA, 21 bp, Homo sapiens
agagccggcccgcctctcctc

SEQ ID NO: 1339204 - DNA, 13 bp, Homo sapiens
agagcctgctggc

SEQ ID NO: 1339205 - DNA, 24 bp, Homo sapiens
agagcctgctggcacccaccgtgg

SEQ ID NO: 1339206 - DNA, 13 bp, Homo sapiens
agagccttaaaac

SEQ ID NO: 1339207 - DNA, 19 bp, Homo sapiens
agagccttctcagaagcac

SEQ ID NO: 1339208 - DNA, 21 bp, Homo sapiens
agagccttgcggaaggttcta

SEQ ID NO: 1339209 - DNA, 15 bp, Homo sapiens
agagccttttgtgca

SEQ ID NO: 1339210 - DNA, 20 bp, Homo sapiens
agagctagcagcagggaggg

SEQ ID NO: 1339211 - DNA, 17 bp, Homo sapiens
agagctttgtcgtattt

SEQ ID NO: 1339212 - DNA, 14 bp, Homo sapiens
agaggaccagggcc

SEQ ID NO: 1339213 - DNA, 16 bp, Homo sapiens
agaggcccccagccca

SEQ ID NO: 1339214 - DNA, 19 bp, Homo sapiens
agaggctagcttctgcttt

SEQ ID NO: 1339215 - DNA, 14 bp, Homo sapiens
agaggctgcccctc

SEQ ID NO: 1339216 - DNA, 19 bp, Homo sapiens
agaggctgcccctctcacc

SEQ ID NO: 1339217 - DNA, 14 bp, Homo sapiens
agaggctgggttca

SEQ ID NO: 1339218 - DNA, 17 bp, Homo sapiens
agaggcttctccgccag

SEQ ID NO: 1339219 - DNA, 20 bp, Homo sapiens
agaggcttctccgccagcct

SEQ ID NO: 1339220 - DNA, 23 bp, Homo sapiens
agaggcttctccgccagcctcct

SEQ ID NO: 1339221 - DNA, 13 bp, Homo sapiens
agagggagagaga

SEQ ID NO: 1339222 - DNA, 12 bp, Homo sapiens
agagggcttcct

SEQ ID NO: 1339223 - DNA, 19 bp, Homo sapiens
agagggggtggaggggtgt

SEQ ID NO: 1339224 - DNA, 17 bp, Homo sapiens
agaggtattaaaactaa

SEQ ID NO: 1339225 - DNA, 13 bp, Homo sapiens
agaggtgggccag

SEQ ID NO: 1339226 - DNA, 12 bp, Homo sapiens
agagtctgaggg

SEQ ID NO: 1339227 - DNA, 22 bp, Homo sapiens
agagtctgagggcttgtagttc

SEQ ID NO: 1339228 - DNA, 23 bp, Homo sapiens
agagtctgagggcttgtagttct

SEQ ID NO: 1339229 - DNA, 13 bp, Homo sapiens
agagtctggccct

SEQ ID NO: 1339230 - DNA, 16 bp, Homo sapiens
agagtgaaaaagagaa

SEQ ID NO: 1339231 - DNA, 20 bp, Homo sapiens
agagtgatagtcttttgctt

SEQ ID NO: 1339232 - DNA, 19 bp, Homo sapiens
agagtggggatatgattta

SEQ ID NO: 1339233 - DNA, 14 bp, Homo sapiens
agagtgtgcctgaa

SEQ ID NO: 1339234 - DNA, 20 bp, Homo sapiens
agagttcccttgaaactttg

SEQ ID NO: 1339235 - DNA, 20 bp, Homo sapiens
agagttttgtcattcagagt

SEQ ID NO: 1339236 - DNA, 20 bp, Homo sapiens
agataatattgtttggtaaa

SEQ ID NO: 1339237 - DNA, 17 bp, Homo sapiens
agataattactgccttg

SEQ ID NO: 1339238 - DNA, 19 bp, Homo sapiens
agataattactgccttgaa

SEQ ID NO: 1339239 - DNA, 15 bp, Homo sapiens
agataatttcagggt

SEQ ID NO: 1339240 - DNA, 19 bp, Homo sapiens
agatacctccaaccctgcc

SEQ ID NO: 1339241 - DNA, 22 bp, Homo sapiens
agataccttatcttacaatatt

SEQ ID NO: 1339242 - DNA, 11 bp, Homo sapiens
agatactttgt

SEQ ID NO: 1339243 - DNA, 15 bp, Homo sapiens
agatactttgtattg

SEQ ID NO: 1339244 - DNA, 16 bp, Homo sapiens
agatactttgtattgt

SEQ ID NO: 1339245 - DNA, 20 bp, Homo sapiens
agatactttgtattgtccta

SEQ ID NO: 1339246 - DNA, 14 bp, Homo sapiens
agatagacaggtcc

SEQ ID NO: 1339247 - DNA, 15 bp, Homo sapiens
agatataaattttta

SEQ ID NO: 1339248 - DNA, 15 bp, Homo sapiens
agatatctcaatgaa

SEQ ID NO: 1339249 - DNA, 22 bp, Homo sapiens
agatattgaggccaagaatatt

SEQ ID NO: 1339250 - DNA, 14 bp, Homo sapiens
agatcaaaaaggct

SEQ ID NO: 1339251 - DNA, 19 bp, Homo sapiens
agatcaaaaaggcttataa

SEQ ID NO: 1339252 - DNA, 20 bp, Homo sapiens
agatcactgtttagatttgc

SEQ ID NO: 1339253 - DNA, 13 bp, Homo sapiens
agatcagcctggg

SEQ ID NO: 1339254 - DNA, 20 bp, Homo sapiens
agatcatagttttatttata

SEQ ID NO: 1339255 - DNA, 13 bp, Homo sapiens
agatccaaagact

SEQ ID NO: 1339256 - DNA, 14 bp, Homo sapiens
agatccaaagactc

SEQ ID NO: 1339257 - DNA, 20 bp, Homo sapiens
agatcgagaccatcctggct

SEQ ID NO: 1339258 - DNA, 12 bp, Homo sapiens
agatctccagcg

SEQ ID NO: 1339259 - DNA, 12 bp, Homo sapiens
agatctttcaga

SEQ ID NO: 1339260 - DNA, 14 bp, Homo sapiens
agatctttcagaaa

SEQ ID NO: 1339261 - DNA, 20 bp, Homo sapiens
agatctttcagaaatataac

SEQ ID NO: 1339262 - DNA, 17 bp, Homo sapiens
agatgccaccctagcca

SEQ ID NO: 1339263 - DNA, 17 bp, Homo sapiens
agatgccacttctaaga

SEQ ID NO: 1339264 - DNA, 20 bp, Homo sapiens
agatgccacttctaagaaaa

SEQ ID NO: 1339265 - DNA, 15 bp, Homo sapiens
agatgcgtcccaaga

SEQ ID NO: 1339266 - DNA, 23 bp, Homo sapiens
agatgcgtcccaagatgttgatt

SEQ ID NO: 1339267 - DNA, 15 bp, Homo sapiens
agatgcttctcactg

SEQ ID NO: 1339268 - DNA, 15 bp, Homo sapiens
agatggtcatccaga

SEQ ID NO: 1339269 - DNA, 18 bp, Homo sapiens
agatggtttgagcctgag

SEQ ID NO: 1339270 - DNA, 13 bp, Homo sapiens
agatgtaaaaaga

SEQ ID NO: 1339271 - DNA, 17 bp, Homo sapiens
agatgtcctaatggtga

SEQ ID NO: 1339272 - DNA, 13 bp, Homo sapiens
agatgtgaaaatt

SEQ ID NO: 1339273 - DNA, 16 bp, Homo sapiens
agatgtgaattattga

SEQ ID NO: 1339274 - DNA, 15 bp, Homo sapiens
agatgtgctgacaag

SEQ ID NO: 1339275 - DNA, 23 bp, Homo sapiens
agatgttacaagtttatatatat

SEQ ID NO: 1339276 - DNA, 16 bp, Homo sapiens
agatgttgatttttac

SEQ ID NO: 1339277 - DNA, 14 bp, Homo sapiens
agatgtttaaaaca

SEQ ID NO: 1339278 - DNA, 15 bp, Homo sapiens
agatgtttaaaacac

SEQ ID NO: 1339279 - DNA, 23 bp, Homo sapiens
agatgtttccagacttccttgag

SEQ ID NO: 1339280 - DNA, 15 bp, Homo sapiens
agattaagagcaaat

SEQ ID NO: 1339281 - DNA, 18 bp, Homo sapiens
agattcatgatttataaa

SEQ ID NO: 1339282 - DNA, 21 bp, Homo sapiens
agattgactaactcaaataca

SEQ ID NO: 1339283 - DNA, 17 bp, Homo sapiens
agattgatatctataaa

SEQ ID NO: 1339284 - DNA, 19 bp, Homo sapiens
agattgatatctataaaat

SEQ ID NO: 1339285 - DNA, 22 bp, Homo sapiens
agattgatatctataaaataga

SEQ ID NO: 1339286 - DNA, 14 bp, Homo sapiens
agatttctgaggaa

SEQ ID NO: 1339287 - DNA, 19 bp, Homo sapiens
agatttttaaaaaatattt

SEQ ID NO: 1339288 - DNA, 14 bp, Homo sapiens
agatttttgcaata

SEQ ID NO: 1339289 - DNA, 17 bp, Homo sapiens
agattttttaattgttt

SEQ ID NO: 1339290 - DNA, 18 bp, Homo sapiens
agcaaaagatgcttctca

SEQ ID NO: 1339291 - DNA, 13 bp, Homo sapiens
agcaaatgcaaaa

SEQ ID NO: 1339292 - DNA, 15 bp, Homo sapiens
agcaaattttcagca

SEQ ID NO: 1339293 - DNA, 20 bp, Homo sapiens
agcaacgatcacaaatgact

SEQ ID NO: 1339294 - DNA, 13 bp, Homo sapiens
agcaacggcacag

SEQ ID NO: 1339295 - DNA, 18 bp, Homo sapiens
agcaagcagtagcatttg

SEQ ID NO: 1339296 - DNA, 13 bp, Homo sapiens
agcaagtggtcct

SEQ ID NO: 1339297 - DNA, 15 bp, Homo sapiens
agcaagtgtgaatac

SEQ ID NO: 1339298 - DNA, 16 bp, Homo sapiens
agcaagttacagtgat

SEQ ID NO: 1339299 - DNA, 13 bp, Homo sapiens
agcaataaatgaa

SEQ ID NO: 1339300 - DNA, 15 bp, Homo sapiens
agcaataaatgaatg

SEQ ID NO: 1339301 - DNA, 12 bp, Homo sapiens
agcaatagaaac

SEQ ID NO: 1339302 - DNA, 23 bp, Homo sapiens
agcaatctcttcattattctctg

SEQ ID NO: 1339303 - DNA, 22 bp, Homo sapiens
agcacaccaatcttactttgta

SEQ ID NO: 1339304 - DNA, 14 bp, Homo sapiens
agcacagcttgacc

SEQ ID NO: 1339305 - DNA, 20 bp, Homo sapiens
agcacagcttgacctgaggc

SEQ ID NO: 1339306 - DNA, 19 bp, Homo sapiens
agcacagtctgatgacaca

SEQ ID NO: 1339307 - DNA, 14 bp, Homo sapiens
agcacctcagcctg

SEQ ID NO: 1339308 - DNA, 19 bp, Homo sapiens
agcaccttgtgcctggggt

SEQ ID NO: 1339309 - DNA, 15 bp, Homo sapiens
agcactgggctcccg

SEQ ID NO: 1339310 - DNA, 16 bp, Homo sapiens
agcactgggctcccgg

SEQ ID NO: 1339311 - DNA, 15 bp, Homo sapiens
agcactgtaaacttc

SEQ ID NO: 1339312 - DNA, 15 bp, Homo sapiens
agcactgttgagaag

SEQ ID NO: 1339313 - DNA, 17 bp, Homo sapiens
agcactttgggaggccg

SEQ ID NO: 1339314 - DNA, 14 bp, Homo sapiens
agggctggctcctg

SEQ ID NO: 1339315 - DNA, 23 bp, Homo sapiens
agggcttctgccatttctgagat

SEQ ID NO: 1339316 - DNA, 16 bp, Homo sapiens
agggcttgtagttctt

SEQ ID NO: 1339317 - DNA, 17 bp, Homo sapiens
agggcttgtagttcttt

SEQ ID NO: 1339318 - DNA, 22 bp, Homo sapiens
aggggagagcctgctggcaccc

SEQ ID NO: 1339319 - DNA, 21 bp, Homo sapiens
aggggccggccctgtgtgcag

SEQ ID NO: 1339320 - DNA, 16 bp, Homo sapiens
aggggctgcttcctcc

SEQ ID NO: 1339321 - DNA, 23 bp, Homo sapiens
agggggagccggtaactgtcctg

SEQ ID NO: 1339322 - DNA, 20 bp, Homo sapiens
agggggatccgactgctttg

SEQ ID NO: 1339323 - DNA, 18 bp, Homo sapiens
agggggctttctggggcc

SEQ ID NO: 1339324 - DNA, 16 bp, Homo sapiens
aggggtgtggcagtgg

SEQ ID NO: 1339325 - DNA, 14 bp, Homo sapiens
agggtccctctgtg

SEQ ID NO: 1339326 - DNA, 21 bp, Homo sapiens
agggtctttctcaaagaaata

SEQ ID NO: 1339327 - DNA, 14 bp, Homo sapiens
agggtgcagcccaa

SEQ ID NO: 1339328 - DNA, 17 bp, Homo sapiens
agggtgggggagggagg

SEQ ID NO: 1339329 - DNA, 19 bp, Homo sapiens
agggtgtctgcgtcgtcac

SEQ ID NO: 1339330 - DNA, 17 bp, Homo sapiens
agggttcccgcggggct

SEQ ID NO: 1339331 - DNA, 19 bp, Homo sapiens
agggttcccgcggggctgt

SEQ ID NO: 1339332 - DNA, 23 bp, Homo sapiens
aggtaacactagggccttggaaa

SEQ ID NO: 1339333 - DNA, 13 bp, Homo sapiens
aggtaccctgggt

SEQ ID NO: 1339334 - DNA, 12 bp, Homo sapiens
aggtagaaactt

SEQ ID NO: 1339335 - DNA, 19 bp, Homo sapiens
aggtattaaaactaaattt

SEQ ID NO: 1339336 - DNA, 20 bp, Homo sapiens
aggtatttaaagtattttct

SEQ ID NO: 1339337 - DNA, 17 bp, Homo sapiens
aggtcaagttgtcaggt

SEQ ID NO: 1339338 - DNA, 14 bp, Homo sapiens
aggtcactgtttcc

SEQ ID NO: 1339339 - DNA, 17 bp, Homo sapiens
aggtccagctctggagg

SEQ ID NO: 1339340 - DNA, 23 bp, Homo sapiens
aggtccagctctggaggggaggg

SEQ ID NO: 1339341 - DNA, 20 bp, Homo sapiens
aggtcctctggagccctaac

SEQ ID NO: 1339342 - DNA, 19 bp, Homo sapiens
aggtcctgatttctagaac

SEQ ID NO: 1339343 - DNA, 20 bp, Homo sapiens
aggtctatttaaaaaaaaag

SEQ ID NO: 1339344 - DNA, 19 bp, Homo sapiens
aggtcttcttaatatgttc

SEQ ID NO: 1339345 - DNA, 20 bp, Homo sapiens
aggtgagtttgagctgcctt

SEQ ID NO: 1339346 - DNA, 21 bp, Homo sapiens
aggtgagtttgagctgccttc

SEQ ID NO: 1339347 - DNA, 15 bp, Homo sapiens
aggtgatcccgtttt

SEQ ID NO: 1339348 - DNA, 17 bp, Homo sapiens
aggtgattccagtgaag

SEQ ID NO: 1339349 - DNA, 13 bp, Homo sapiens
aggtgctgcttaa

SEQ ID NO: 1339350 - DNA, 22 bp, Homo sapiens
aggtgctggagcactgggctcc

SEQ ID NO: 1339351 - DNA, 17 bp, Homo sapiens
aggtggaagaagggaga

SEQ ID NO: 1339352 - DNA, 18 bp, Homo sapiens
aggtggaagaagggagaa

SEQ ID NO: 1339353 - DNA, 22 bp, Homo sapiens
aggtggaagaagggagaagaaa

SEQ ID NO: 1339354 - DNA, 12 bp, Homo sapiens
aggtgggaggat

SEQ ID NO: 1339355 - DNA, 13 bp, Homo sapiens
aggttcagccaag

SEQ ID NO: 1339356 - DNA, 20 bp, Homo sapiens
aggttcagtattatgtagtt

SEQ ID NO: 1339357 - DNA, 13 bp, Homo sapiens
aggttcctctgcc

SEQ ID NO: 1339358 - DNA, 18 bp, Homo sapiens
aggttcctctgcctgccc

SEQ ID NO: 1339359 - DNA, 15 bp, Homo sapiens
aggttgaagccaagt

SEQ ID NO: 1339360 - DNA, 24 bp, Homo sapiens
aggttgagctcttcttaaagtatt

SEQ ID NO: 1339361 - DNA, 20 bp, Homo sapiens
aggttggcaaaaaggcagga

SEQ ID NO: 1339362 - DNA, 22 bp, Homo sapiens
aggtttacaataggagtggtga

SEQ ID NO: 1339363 - DNA, 20 bp, Homo sapiens
aggttttatttcatttttca

SEQ ID NO: 1339364 - DNA, 15 bp, Homo sapiens
agtaaagttaaaaga

SEQ ID NO: 1339365 - DNA, 12 bp, Homo sapiens
agtaactcattt

SEQ ID NO: 1339366 - DNA, 14 bp, Homo sapiens
agtaagatcactgt

SEQ ID NO: 1339367 - DNA, 20 bp, Homo sapiens
agtaagatcactgtttagat

SEQ ID NO: 1339368 - DNA, 12 bp, Homo sapiens
agtaagattgat

SEQ ID NO: 1339369 - DNA, 20 bp, Homo sapiens
agtaagttatctttgaatat

SEQ ID NO: 1339370 - DNA, 15 bp, Homo sapiens
agtaatgaaatggag

SEQ ID NO: 1339371 - DNA, 12 bp, Homo sapiens
agtaattgtgaa

SEQ ID NO: 1339372 - DNA, 13 bp, Homo sapiens
agtacttttttaa

SEQ ID NO: 1339373 - DNA, 15 bp, Homo sapiens
agtacttttttaaat

SEQ ID NO: 1339374 - DNA, 23 bp, Homo sapiens
agtacttttttaaatattttcta

SEQ ID NO: 1339375 - DNA, 14 bp, Homo sapiens
agtagaactttgta

SEQ ID NO: 1339376 - DNA, 20 bp, Homo sapiens
agtagaccttgttacttctg

SEQ ID NO: 1339377 - DNA, 18 bp, Homo sapiens
agtagataatttcagggt

SEQ ID NO: 1339378 - DNA, 19 bp, Homo sapiens
agtagataatttcagggtg

SEQ ID NO: 1339379 - DNA, 21 bp, Homo sapiens
agtagatgtggcctttgaatt

SEQ ID NO: 1339380 - DNA, 15 bp, Homo sapiens
agtagattttccaaa

SEQ ID NO: 1339381 - DNA, 23 bp, Homo sapiens
agtaggactccttatttggcgtg

SEQ ID NO: 1339382 - DNA, 23 bp, Homo sapiens
agtagtgtcactgcttgttatgc

SEQ ID NO: 1339383 - DNA, 13 bp, Homo sapiens
agtataaaatagt

SEQ ID NO: 1339384 - DNA, 15 bp, Homo sapiens
agtatctcagggcct

SEQ ID NO: 1339385 - DNA, 23 bp, Homo sapiens
agtatggtaatctttacctgtat

SEQ ID NO: 1339386 - DNA, 15 bp, Homo sapiens
agtatgtatattaaa

SEQ ID NO: 1339387 - DNA, 13 bp, Homo sapiens
agtatgtatgtgt

SEQ ID NO: 1339388 - DNA, 13 bp, Homo sapiens
agtatgtattatt

SEQ ID NO: 1339389 - DNA, 17 bp, Homo sapiens
agtattatcaaagggat

SEQ ID NO: 1339390 - DNA, 23 bp, Homo sapiens
agtattctaataagctagttgaa

SEQ ID NO: 1339391 - DNA, 14 bp, Homo sapiens
agtattgtttaaaa

SEQ ID NO: 1339392 - DNA, 22 bp, Homo sapiens
agtattgtttaaaatgtaattt

SEQ ID NO: 1339393 - DNA, 16 bp, Homo sapiens
agtatttataatagca

SEQ ID NO: 1339394 - DNA, 18 bp, Homo sapiens
agtatttatttatgtact

SEQ ID NO: 1339395 - DNA, 20 bp, Homo sapiens
agtatttatttatgtacttt

SEQ ID NO: 1339396 - DNA, 19 bp, Homo sapiens
agtatttttatacaaacct

SEQ ID NO: 1339397 - DNA, 17 bp, Homo sapiens
agtcaaagttgaaaatt

SEQ ID NO: 1339398 - DNA, 20 bp, Homo sapiens
agtcaaagttgaaaattcat

SEQ ID NO: 1339399 - DNA, 19 bp, Homo sapiens
agtcaacagtaccctggtt

SEQ ID NO: 1339400 - DNA, 20 bp, Homo sapiens
agtcaagtgaaaaaggagga

SEQ ID NO: 1339401 - DNA, 14 bp, Homo sapiens
agtcaatggcttgt

SEQ ID NO: 1339402 - DNA, 21 bp, Homo sapiens
agtcactatgggatgagaaaa

SEQ ID NO: 1339403 - DNA, 18 bp, Homo sapiens
agtcagtacccaccacct

SEQ ID NO: 1339404 - DNA, 15 bp, Homo sapiens
agtcatgtatgtttc

SEQ ID NO: 1339405 - DNA, 22 bp, Homo sapiens
agtcatgtatgtttctctttga

SEQ ID NO: 1339406 - DNA, 14 bp, Homo sapiens
agtcattaaactgg

SEQ ID NO: 1339407 - DNA, 13 bp, Homo sapiens
agtcattcagcag

SEQ ID NO: 1339408 - DNA, 17 bp, Homo sapiens
agtccaccctgcctgcc

SEQ ID NO: 1339409 - DNA, 16 bp, Homo sapiens
agtccattctcccagg

SEQ ID NO: 1339410 - DNA, 11 bp, Homo sapiens
agtccccaccc

SEQ ID NO: 1339411 - DNA, 16 bp, Homo sapiens
agtccccacccctgcc

SEQ ID NO: 1339412 - DNA, 20 bp, Homo sapiens
agtccccacccctgccccca

SEQ ID NO: 1339413 - DNA, 13 bp, Homo sapiens
agtcctgtgaatg

SEQ ID NO: 1339414 - DNA, 19 bp, Homo sapiens
agtcctgtgaatgccactg

SEQ ID NO: 1339415 - DNA, 20 bp, Homo sapiens
agtcctgtgaatgccactgc

SEQ ID NO: 1339416 - DNA, 14 bp, Homo sapiens
agtcggtcctcttt

SEQ ID NO: 1339417 - DNA, 14 bp, Homo sapiens
agtcgtgcctgtgt

SEQ ID NO: 1339418 - DNA, 20 bp, Homo sapiens
agtcgtggggtgtgctggga

SEQ ID NO: 1339419 - DNA, 21 bp, Homo sapiens
agtcgtggggtgtgctgggag

SEQ ID NO: 1339420 - DNA, 17 bp, Homo sapiens
agtctacccgacataag

SEQ ID NO: 1339421 - DNA, 13 bp, Homo sapiens
agtctggccctag

SEQ ID NO: 1339422 - DNA, 21 bp, Homo sapiens
agtctgtctttcctgaaccat

SEQ ID NO: 1339423 - DNA, 16 bp, Homo sapiens
agtctgttctggtaat

SEQ ID NO: 1339424 - DNA, 13 bp, Homo sapiens
agtctttaataaa

SEQ ID NO: 1339425 - DNA, 15 bp, Homo sapiens
agtctttcatggctg

SEQ ID NO: 1339426 - DNA, 17 bp, Homo sapiens
agtctttcatggctgct

SEQ ID NO: 1339427 - DNA, 17 bp, Homo sapiens
agtctttgccagtcatt

SEQ ID NO: 1339428 - DNA, 18 bp, Homo sapiens
agtcttttgcttttggca

SEQ ID NO: 1339429 - DNA, 14 bp, Homo sapiens
agtgaaaaagatgt

SEQ ID NO: 1339430 - DNA, 20 bp, Homo sapiens
agtgaaaaaggaggaagaga

SEQ ID NO: 1339431 - DNA, 12 bp, Homo sapiens
agtgaaactttt

SEQ ID NO: 1339432 - DNA, 19 bp, Homo sapiens
atcgagaccatcctggcta

SEQ ID NO: 1339433 - DNA, 22 bp, Homo sapiens
atcgagtgccgcatctcacagc

SEQ ID NO: 1339434 - DNA, 20 bp, Homo sapiens
atcggagaacatgaatcaaa

SEQ ID NO: 1339435 - DNA, 21 bp, Homo sapiens
atcggccatcaagggaagaac

SEQ ID NO: 1339436 - DNA, 22 bp, Homo sapiens
atcggcctagggcccccacagt

SEQ ID NO: 1339437 - DNA, 15 bp, Homo sapiens
atcgtgaagaagcct

SEQ ID NO: 1339438 - DNA, 15 bp, Homo sapiens
atctaaatctattta

SEQ ID NO: 1339439 - DNA, 18 bp, Homo sapiens
atctaaatctatttatta

SEQ ID NO: 1339440 - DNA, 20 bp, Homo sapiens
atctaaatctatttattaat

SEQ ID NO: 1339441 - DNA, 22 bp, Homo sapiens
atctaaatctatttattaatat

SEQ ID NO: 1339442 - DNA, 13 bp, Homo sapiens
atctaattctgat

SEQ ID NO: 1339443 - DNA, 15 bp, Homo sapiens
atctaattctgattc

SEQ ID NO: 1339444 - DNA, 19 bp, Homo sapiens
atctacaatctctttttgt

SEQ ID NO: 1339445 - DNA, 12 bp, Homo sapiens
atctactgcatt

SEQ ID NO: 1339446 - DNA, 18 bp, Homo sapiens
atctactgcatttaggga

SEQ ID NO: 1339447 - DNA, 12 bp, Homo sapiens
atctagccagcc

SEQ ID NO: 1339448 - DNA, 19 bp, Homo sapiens
atctagccagcccctcttc

SEQ ID NO: 1339449 - DNA, 21 bp, Homo sapiens
atctagccagcccctcttccc

SEQ ID NO: 1339450 - DNA, 19 bp, Homo sapiens
atctaggggagccttgatt

SEQ ID NO: 1339451 - DNA, 15 bp, Homo sapiens
atctatctatttgag

SEQ ID NO: 1339452 - DNA, 19 bp, Homo sapiens
atctatctcatctatctca

SEQ ID NO: 1339453 - DNA, 17 bp, Homo sapiens
atctattctgagaaaac

SEQ ID NO: 1339454 - DNA, 18 bp, Homo sapiens
atctattctgagaaaaca

SEQ ID NO: 1339455 - DNA, 13 bp, Homo sapiens
atctatttattaa

SEQ ID NO: 1339456 - DNA, 15 bp, Homo sapiens
atctatttattaata

SEQ ID NO: 1339457 - DNA, 23 bp, Homo sapiens
atctcaatgaaccataaattcaa

SEQ ID NO: 1339458 - DNA, 23 bp, Homo sapiens
atctcagctttgagaagccttca

SEQ ID NO: 1339459 - DNA, 18 bp, Homo sapiens
atctcaggagatttcatg

SEQ ID NO: 1339460 - DNA, 14 bp, Homo sapiens
atctcagggcctgg

SEQ ID NO: 1339461 - DNA, 16 bp, Homo sapiens
atctcatttaagggaa

SEQ ID NO: 1339462 - DNA, 18 bp, Homo sapiens
atctcatttaagggaaaa

SEQ ID NO: 1339463 - DNA, 20 bp, Homo sapiens
atctcatttaagggaaaaat

SEQ ID NO: 1339464 - DNA, 22 bp, Homo sapiens
atctccattgtgcctaagtcca

SEQ ID NO: 1339465 - DNA, 14 bp, Homo sapiens
atctcccctcagct

SEQ ID NO: 1339466 - DNA, 16 bp, Homo sapiens
atctcccctcagctcg

SEQ ID NO: 1339467 - DNA, 14 bp, Homo sapiens
atctccctcccaca

SEQ ID NO: 1339468 - DNA, 18 bp, Homo sapiens
atctccctgcctggcccc

SEQ ID NO: 1339469 - DNA, 14 bp, Homo sapiens
atctccggctccca

SEQ ID NO: 1339470 - DNA, 18 bp, Homo sapiens
atctccggctcccagcct

SEQ ID NO: 1339471 - DNA, 14 bp, Homo sapiens
atctctaggaagtc

SEQ ID NO: 1339472 - DNA, 16 bp, Homo sapiens
atctctgaatgcccca

SEQ ID NO: 1339473 - DNA, 15 bp, Homo sapiens
atctctgtgccttcg

SEQ ID NO: 1339474 - DNA, 10 bp, Homo sapiens
atctcttttc

SEQ ID NO: 1339475 - DNA, 23 bp, Homo sapiens
atctcttttccactccattgtcg

SEQ ID NO: 1339476 - DNA, 16 bp, Homo sapiens
atctgaaatgttacaa

SEQ ID NO: 1339477 - DNA, 15 bp, Homo sapiens
atctgagccagtgct

SEQ ID NO: 1339478 - DNA, 17 bp, Homo sapiens
atctgagggaaatgttt

SEQ ID NO: 1339479 - DNA, 18 bp, Homo sapiens
atctgagggaaatgtttt

SEQ ID NO: 1339480 - DNA, 19 bp, Homo sapiens
atctgatggccttaatttc

SEQ ID NO: 1339481 - DNA, 21 bp, Homo sapiens
atctgatggccttaatttcct

SEQ ID NO: 1339482 - DNA, 11 bp, Homo sapiens
atctgcaaaag

SEQ ID NO: 1339483 - DNA, 22 bp, Homo sapiens
atctgcaaaaggcctcttgtaa

SEQ ID NO: 1339484 - DNA, 10 bp, Homo sapiens
atctgcaccc

SEQ ID NO: 1339485 - DNA, 17 bp, Homo sapiens
atctgcaccccttctct

SEQ ID NO: 1339486 - DNA, 22 bp, Homo sapiens
atctgcaccccttctctcctcc

SEQ ID NO: 1339487 - DNA, 16 bp, Homo sapiens
atctgccaagggccga

SEQ ID NO: 1339488 - DNA, 22 bp, Homo sapiens
atctgcggatctcagctttgag

SEQ ID NO: 1339489 - DNA, 22 bp, Homo sapiens
atctggagaccagggagccttt

SEQ ID NO: 1339490 - DNA, 21 bp, Homo sapiens
atctggccccaggtagaaact

SEQ ID NO: 1339491 - DNA, 22 bp, Homo sapiens
atctgtgggcatggtcaaaggc

SEQ ID NO: 1339492 - DNA, 19 bp, Homo sapiens
atcttaaagtgtgtttcta

SEQ ID NO: 1339493 - DNA, 19 bp, Homo sapiens
atcttaatctgtttattta

SEQ ID NO: 1339494 - DNA, 12 bp, Homo sapiens
atcttaatgttc

SEQ ID NO: 1339495 - DNA, 13 bp, Homo sapiens
atcttactttgta

SEQ ID NO: 1339496 - DNA, 19 bp, Homo sapiens
atcttactttgtaaattct

SEQ ID NO: 1339497 - DNA, 20 bp, Homo sapiens
atcttactttgtaaattctg

SEQ ID NO: 1339498 - DNA, 22 bp, Homo sapiens
atcttactttgtaaattctgat

SEQ ID NO: 1339499 - DNA, 22 bp, Homo sapiens
atcttatatgggaaaccatgta

SEQ ID NO: 1339500 - DNA, 19 bp, Homo sapiens
atcttccaactcaaactct

SEQ ID NO: 1339501 - DNA, 13 bp, Homo sapiens
atcttctaaatgg

SEQ ID NO: 1339502 - DNA, 13 bp, Homo sapiens
atcttgatacatt

SEQ ID NO: 1339503 - DNA, 15 bp, Homo sapiens
atcttgatacattca

SEQ ID NO: 1339504 - DNA, 16 bp, Homo sapiens
atcttgatacattcaa

SEQ ID NO: 1339505 - DNA, 21 bp, Homo sapiens
atcttgcctccaggtgcagag

SEQ ID NO: 1339506 - DNA, 20 bp, Homo sapiens
atcttgggggggtggccgct

SEQ ID NO: 1339507 - DNA, 23 bp, Homo sapiens
atcttgggggggtggccgctgag

SEQ ID NO: 1339508 - DNA, 17 bp, Homo sapiens
atctttacctgtataca

SEQ ID NO: 1339509 - DNA, 14 bp, Homo sapiens
atctttcagaaata

SEQ ID NO: 1339510 - DNA, 22 bp, Homo sapiens
atctttcagaaatataacacat

SEQ ID NO: 1339511 - DNA, 14 bp, Homo sapiens
atctttgatgtgtt

SEQ ID NO: 1339512 - DNA, 17 bp, Homo sapiens
atgaaaacagtgtgtaa

SEQ ID NO: 1339513 - DNA, 20 bp, Homo sapiens
atgaaaacatggaacagtgt

SEQ ID NO: 1339514 - DNA, 19 bp, Homo sapiens
atgaaaagattcttctgtg

SEQ ID NO: 1339515 - DNA, 11 bp, Homo sapiens
atgaaaattgt

SEQ ID NO: 1339516 - DNA, 14 bp, Homo sapiens
atgaaaattgtatt

SEQ ID NO: 1339517 - DNA, 20 bp, Homo sapiens
atgaaactaaagcaatagaa

SEQ ID NO: 1339518 - DNA, 23 bp, Homo sapiens
atgaaactaaagcaatagaaaca

SEQ ID NO: 1339519 - DNA, 19 bp, Homo sapiens
atgaaacttgtttcactga

SEQ ID NO: 1339520 - DNA, 18 bp, Homo sapiens
atgaaatgcatatttgca

SEQ ID NO: 1339521 - DNA, 16 bp, Homo sapiens
atgaagaatagaaaca

SEQ ID NO: 1339522 - DNA, 17 bp, Homo sapiens
atgaagaatagaaacaa

SEQ ID NO: 1339523 - DNA, 23 bp, Homo sapiens
atgaagtcttaaggacaaagtgc

SEQ ID NO: 1339524 - DNA, 16 bp, Homo sapiens
atgaagttgaaaatca

SEQ ID NO: 1339525 - DNA, 14 bp, Homo sapiens
atgaatacatttcc

SEQ ID NO: 1339526 - DNA, 21 bp, Homo sapiens
atgaatacatttccaaaatgg

SEQ ID NO: 1339527 - DNA, 19 bp, Homo sapiens
atgaatatctattaatata

SEQ ID NO: 1339528 - DNA, 23 bp, Homo sapiens
atgaatctttgtttcaggttcag

SEQ ID NO: 1339529 - DNA, 15 bp, Homo sapiens
atgaatgatttgcat

SEQ ID NO: 1339530 - DNA, 17 bp, Homo sapiens
atgaatgatttgcatat

SEQ ID NO: 1339531 - DNA, 15 bp, Homo sapiens
atgaatgtatttatt

SEQ ID NO: 1339532 - DNA, 17 bp, Homo sapiens
atgaatgtatttatttg

SEQ ID NO: 1339533 - DNA, 18 bp, Homo sapiens
atgaattttcaagtaatt

SEQ ID NO: 1339534 - DNA, 13 bp, Homo sapiens
atgaccagtaaag

SEQ ID NO: 1339535 - DNA, 19 bp, Homo sapiens
atgacgtacaagtagttct

SEQ ID NO: 1339536 - DNA, 20 bp, Homo sapiens
atgacgtacaagtagttctg

SEQ ID NO: 1339537 - DNA, 23 bp, Homo sapiens
atgacgtacaagtagttctgtat

SEQ ID NO: 1339538 - DNA, 17 bp, Homo sapiens
atgactatataatttat

SEQ ID NO: 1339539 - DNA, 13 bp, Homo sapiens
atgactgcacatg

SEQ ID NO: 1339540 - DNA, 18 bp, Homo sapiens
atgactttattatttatt

SEQ ID NO: 1339541 - DNA, 16 bp, Homo sapiens
atgagactcagtgcag

SEQ ID NO: 1339542 - DNA, 12 bp, Homo sapiens
atgagatgtgtg

SEQ ID NO: 1339543 - DNA, 22 bp, Homo sapiens
atgagatgtgtggactgtggca

SEQ ID NO: 1339544 - DNA, 20 bp, Homo sapiens
atgagattggttttcctgtg

SEQ ID NO: 1339545 - DNA, 22 bp, Homo sapiens
atgagctcgcatttgtcaatga

SEQ ID NO: 1339546 - DNA, 22 bp, Homo sapiens
atgagctctgaaatcttcccat

SEQ ID NO: 1339547 - DNA, 17 bp, Homo sapiens
atgagctgatctgcgga

SEQ ID NO: 1339548 - DNA, 21 bp, Homo sapiens
atgaggaaaattcttaaaagg

SEQ ID NO: 1339549 - DNA, 16 bp, Homo sapiens
atgaggaactgtagat

SEQ ID NO: 1339550 - DNA, 20 bp, Homo sapiens
atttgaattttaaatctaaa

SEQ ID NO: 1339551 - DNA, 13 bp, Homo sapiens
atttgactaattt

SEQ ID NO: 1339552 - DNA, 16 bp, Homo sapiens
atttgagcatatcagt

SEQ ID NO: 1339553 - DNA, 16 bp, Homo sapiens
atttgattatttaaga

SEQ ID NO: 1339554 - DNA, 14 bp, Homo sapiens
atttgatttattaa

SEQ ID NO: 1339555 - DNA, 17 bp, Homo sapiens
atttgatttattaactt

SEQ ID NO: 1339556 - DNA, 18 bp, Homo sapiens
atttgatttattaactta

SEQ ID NO: 1339557 - DNA, 22 bp, Homo sapiens
atttgatttattaacttaataa

SEQ ID NO: 1339558 - DNA, 13 bp, Homo sapiens
atttgcatactta

SEQ ID NO: 1339559 - DNA, 15 bp, Homo sapiens
atttgcatacttacc

SEQ ID NO: 1339560 - DNA, 21 bp, Homo sapiens
atttgcatctgaaataggaaa

SEQ ID NO: 1339561 - DNA, 18 bp, Homo sapiens
atttgctcttcagatgcc

SEQ ID NO: 1339562 - DNA, 15 bp, Homo sapiens
atttggcgtgacccg

SEQ ID NO: 1339563 - DNA, 19 bp, Homo sapiens
atttgtaaagctatttatg

SEQ ID NO: 1339564 - DNA, 17 bp, Homo sapiens
atttgtcaatgacagtt

SEQ ID NO: 1339565 - DNA, 20 bp, Homo sapiens
atttgtctctgtcacccttg

SEQ ID NO: 1339566 - DNA, 20 bp, Homo sapiens
atttgttgttctttcagaaa

SEQ ID NO: 1339567 - DNA, 18 bp, Homo sapiens
attttaaaaaagccttcc

SEQ ID NO: 1339568 - DNA, 23 bp, Homo sapiens
attttaaaatctgagggaaatgt

SEQ ID NO: 1339569 - DNA, 21 bp, Homo sapiens
attttaaatctaaatctattt

SEQ ID NO: 1339570 - DNA, 16 bp, Homo sapiens
attttaagactgattt

SEQ ID NO: 1339571 - DNA, 17 bp, Homo sapiens
attttacacagaaacac

SEQ ID NO: 1339572 - DNA, 19 bp, Homo sapiens
attttacacagaaacactg

SEQ ID NO: 1339573 - DNA, 22 bp, Homo sapiens
attttacacagaaacactgcct

SEQ ID NO: 1339574 - DNA, 23 bp, Homo sapiens
attttacacagaaacactgcctt

SEQ ID NO: 1339575 - DNA, 23 bp, Homo sapiens
attttacagctcattaaactttt

SEQ ID NO: 1339576 - DNA, 14 bp, Homo sapiens
attttatggttatg

SEQ ID NO: 1339577 - DNA, 22 bp, Homo sapiens
attttatttagacaagagatgg

SEQ ID NO: 1339578 - DNA, 20 bp, Homo sapiens
attttcaactgtcttcctca

SEQ ID NO: 1339579 - DNA, 16 bp, Homo sapiens
attttcaagtaattgt

SEQ ID NO: 1339580 - DNA, 19 bp, Homo sapiens
attttcaagtaattgtgaa

SEQ ID NO: 1339581 - DNA, 20 bp, Homo sapiens
attttcacattcttggctta

SEQ ID NO: 1339582 - DNA, 22 bp, Homo sapiens
attttcacttttggcaatgact

SEQ ID NO: 1339583 - DNA, 14 bp, Homo sapiens
attttccaaatgta

SEQ ID NO: 1339584 - DNA, 14 bp, Homo sapiens
attttcctcttgtg

SEQ ID NO: 1339585 - DNA, 14 bp, Homo sapiens
attttctaaagact

SEQ ID NO: 1339586 - DNA, 14 bp, Homo sapiens
attttctacagtgg

SEQ ID NO: 1339587 - DNA, 16 bp, Homo sapiens
attttctacgtttctt

SEQ ID NO: 1339588 - DNA, 17 bp, Homo sapiens
attttctacgtttcttt

SEQ ID NO: 1339589 - DNA, 18 bp, Homo sapiens
attttgacctactctcat

SEQ ID NO: 1339590 - DNA, 22 bp, Homo sapiens
attttgagaatgctgacacttt

SEQ ID NO: 1339591 - DNA, 13 bp, Homo sapiens
attttgagatgta

SEQ ID NO: 1339592 - DNA, 16 bp, Homo sapiens
attttgcaaagattta

SEQ ID NO: 1339593 - DNA, 20 bp, Homo sapiens
attttggagattataataaa

SEQ ID NO: 1339594 - DNA, 20 bp, Homo sapiens
attttgtacaaatttgttat

SEQ ID NO: 1339595 - DNA, 15 bp, Homo sapiens
attttgtatgttaaa

SEQ ID NO: 1339596 - DNA, 19 bp, Homo sapiens
attttgtcatatcaaataa

SEQ ID NO: 1339597 - DNA, 13 bp, Homo sapiens
attttgtgtaaaa

SEQ ID NO: 1339598 - DNA, 22 bp, Homo sapiens
attttgtttttgtcttaaaaag

SEQ ID NO: 1339599 - DNA, 15 bp, Homo sapiens
atttttaaaaaatat

SEQ ID NO: 1339600 - DNA, 18 bp, Homo sapiens
atttttaaaaaatatttt

SEQ ID NO: 1339601 - DNA, 16 bp, Homo sapiens
atttttagaataagaa

SEQ ID NO: 1339602 - DNA, 22 bp, Homo sapiens
atttttagaataagaatttgca

SEQ ID NO: 1339603 - DNA, 12 bp, Homo sapiens
atttttataatt

SEQ ID NO: 1339604 - DNA, 17 bp, Homo sapiens
atttttatacaaaccta

SEQ ID NO: 1339605 - DNA, 20 bp, Homo sapiens
atttttatacaaacctacca

SEQ ID NO: 1339606 - DNA, 12 bp, Homo sapiens
atttttattgtt

SEQ ID NO: 1339607 - DNA, 14 bp, Homo sapiens
atttttcaatatat

SEQ ID NO: 1339608 - DNA, 12 bp, Homo sapiens
atttttctcttc

SEQ ID NO: 1339609 - DNA, 13 bp, Homo sapiens
atttttgtaaatg

SEQ ID NO: 1339610 - DNA, 12 bp, Homo sapiens
attttttaagct

SEQ ID NO: 1339611 - DNA, 13 bp, Homo sapiens
attttttaattgt

SEQ ID NO: 1339612 - DNA, 12 bp, Homo sapiens
attttttgactt

SEQ ID NO: 1339613 - DNA, 13 bp, Homo sapiens
atttttttgtatg

SEQ ID NO: 1339614 - DNA, 19 bp, Homo sapiens
attttttttaaaatagaaa

SEQ ID NO: 1339615 - DNA, 17 bp, Homo sapiens
attttttttaattgtat

SEQ ID NO: 1339616 - DNA, 18 bp, Homo sapiens
attttttttagtatttat

SEQ ID NO: 1339617 - DNA, 21 bp, Homo sapiens
atttttttttttaatctactg

SEQ ID NO: 1339618 - DNA, 19 bp, Homo sapiens
caaaaaaaatttagccggg

SEQ ID NO: 1339619 - DNA, 11 bp, Homo sapiens
caaaaaactac

SEQ ID NO: 1339620 - DNA, 18 bp, Homo sapiens
caaaaaattagccgggcg

SEQ ID NO: 1339621 - DNA, 12 bp, Homo sapiens
caaaaaccaaat

SEQ ID NO: 1339622 - DNA, 13 bp, Homo sapiens
caaaaaggcttat

SEQ ID NO: 1339623 - DNA, 23 bp, Homo sapiens
caaaaataaactataaaacaaaa

SEQ ID NO: 1339624 - DNA, 21 bp, Homo sapiens
caaaaccttttactggttgca

SEQ ID NO: 1339625 - DNA, 19 bp, Homo sapiens
caaaactctacttaatcca

SEQ ID NO: 1339626 - DNA, 19 bp, Homo sapiens
caaaagctgggcaggttgg

SEQ ID NO: 1339627 - DNA, 22 bp, Homo sapiens
caaaaggcctcttgtaaagact

SEQ ID NO: 1339628 - DNA, 22 bp, Homo sapiens
caaaagtagaactttgtatagt

SEQ ID NO: 1339629 - DNA, 16 bp, Homo sapiens
caaaagtctgtctttc

SEQ ID NO: 1339630 - DNA, 21 bp, Homo sapiens
caaaagtgcctcaagaggaat

SEQ ID NO: 1339631 - DNA, 22 bp, Homo sapiens
caaaatacatgaagcttcatgc

SEQ ID NO: 1339632 - DNA, 16 bp, Homo sapiens
caaaatatgtttaaaa

SEQ ID NO: 1339633 - DNA, 16 bp, Homo sapiens
caaaatcaattaaaat

SEQ ID NO: 1339634 - DNA, 22 bp, Homo sapiens
caaaatccaaaaagaaatgatg

SEQ ID NO: 1339635 - DNA, 16 bp, Homo sapiens
caaaatggaataaaag

SEQ ID NO: 1339636 - DNA, 21 bp, Homo sapiens
caaaatgtgagtggttgaata

SEQ ID NO: 1339637 - DNA, 16 bp, Homo sapiens
caaaattaagcaaatg

SEQ ID NO: 1339638 - DNA, 15 bp, Homo sapiens
caaaattcatttcta

SEQ ID NO: 1339639 - DNA, 18 bp, Homo sapiens
caaaattcatttctaatt

SEQ ID NO: 1339640 - DNA, 13 bp, Homo sapiens
caaaatttgacta

SEQ ID NO: 1339641 - DNA, 18 bp, Homo sapiens
caaacagccaagattttc

SEQ ID NO: 1339642 - DNA, 15 bp, Homo sapiens
caaacatgagatgtg

SEQ ID NO: 1339643 - DNA, 15 bp, Homo sapiens
caaacctaccaaaat

SEQ ID NO: 1339644 - DNA, 20 bp, Homo sapiens
caaacctttattttagaatt

SEQ ID NO: 1339645 - DNA, 23 bp, Homo sapiens
caaactcaatgctttatttgtaa

SEQ ID NO: 1339646 - DNA, 23 bp, Homo sapiens
caaactgaagcagcctctcccca

SEQ ID NO: 1339647 - DNA, 19 bp, Homo sapiens
caaactggggcctccagaa

SEQ ID NO: 1339648 - DNA, 13 bp, Homo sapiens
caaactgttgatt

SEQ ID NO: 1339649 - DNA, 12 bp, Homo sapiens
caaagaaatatt

SEQ ID NO: 1339650 - DNA, 20 bp, Homo sapiens
caaagaaatccggagaagct

SEQ ID NO: 1339651 - DNA, 14 bp, Homo sapiens
caaagacaaaagtc

SEQ ID NO: 1339652 - DNA, 19 bp, Homo sapiens
caaagacaaaagtctgtct

SEQ ID NO: 1339653 - DNA, 16 bp, Homo sapiens
caaagaggctgcccct

SEQ ID NO: 1339654 - DNA, 18 bp, Homo sapiens
caaagagggcttcctcta

SEQ ID NO: 1339655 - DNA, 21 bp, Homo sapiens
caaagaggttttaaaaaaatc

SEQ ID NO: 1339656 - DNA, 16 bp, Homo sapiens
caaagattcatgattt

SEQ ID NO: 1339657 - DNA, 21 bp, Homo sapiens
caaagcactgttgagaaggag

SEQ ID NO: 1339658 - DNA, 18 bp, Homo sapiens
caaagcctcctccagccg

SEQ ID NO: 1339659 - DNA, 16 bp, Homo sapiens
caaagccttctcccta

SEQ ID NO: 1339660 - DNA, 15 bp, Homo sapiens
caaagctgcccactg

SEQ ID NO: 1339661 - DNA, 20 bp, Homo sapiens
caaagctgcccactgtttct

SEQ ID NO: 1339662 - DNA, 17 bp, Homo sapiens
caaagctggctcacctt

SEQ ID NO: 1339663 - DNA, 19 bp, Homo sapiens
caaagcttggagggaagcc

SEQ ID NO: 1339664 - DNA, 12 bp, Homo sapiens
caaagtcattaa

SEQ ID NO: 1339665 - DNA, 14 bp, Homo sapiens
caaagtgccaaaga

SEQ ID NO: 1339666 - DNA, 22 bp, Homo sapiens
caaagtgtattaggaagtgttt

SEQ ID NO: 1339667 - DNA, 17 bp, Homo sapiens
caaagttaaaattgtta

SEQ ID NO: 1339668 - DNA, 18 bp, Homo sapiens
cagcaacacagcctgggc

SEQ ID NO: 1339669 - DNA, 23 bp, Homo sapiens
cagcaacgatcacaaatgacttt

SEQ ID NO: 1339670 - DNA, 20 bp, Homo sapiens
cagcaacttcttctccatcc

SEQ ID NO: 1339671 - DNA, 22 bp, Homo sapiens
cagcaagtggtcctagaggccc

SEQ ID NO: 1339672 - DNA, 13 bp, Homo sapiens
cagcacagcttga

SEQ ID NO: 1339673 - DNA, 22 bp, Homo sapiens
cagcacagcttgacctgaggct

SEQ ID NO: 1339674 - DNA, 15 bp, Homo sapiens
cagcaccgaggggcc

SEQ ID NO: 1339675 - DNA, 16 bp, Homo sapiens
cagcacctcagcctgc

SEQ ID NO: 1339676 - DNA, 17 bp, Homo sapiens
cagcacctcagcctgca

SEQ ID NO: 1339677 - DNA, 12 bp, Homo sapiens
cagcacctggca

SEQ ID NO: 1339678 - DNA, 16 bp, Homo sapiens
cagcaccttgtgcctg

SEQ ID NO: 1339679 - DNA, 19 bp, Homo sapiens
cagcaccttgtgcctgggg

SEQ ID NO: 1339680 - DNA, 16 bp, Homo sapiens
cagcactttgggaggc

SEQ ID NO: 1339681 - DNA, 15 bp, Homo sapiens
cagcagcagcaggtg

SEQ ID NO: 1339682 - DNA, 15 bp, Homo sapiens
cagcagcctggaccc

SEQ ID NO: 1339683 - DNA, 23 bp, Homo sapiens
cagcagcttataatgggctctcc

SEQ ID NO: 1339684 - DNA, 21 bp, Homo sapiens
cagcaggtgattggaccaggc

SEQ ID NO: 1339685 - DNA, 22 bp, Homo sapiens
cagcagttgctggtaaaatgaa

SEQ ID NO: 1339686 - DNA, 14 bp, Homo sapiens
cagcatcacctgcc

SEQ ID NO: 1339687 - DNA, 15 bp, Homo sapiens
cagcatcacctgcct

SEQ ID NO: 1339688 - DNA, 16 bp, Homo sapiens
cagcatcacctgcctg

SEQ ID NO: 1339689 - DNA, 22 bp, Homo sapiens
cagcatttagctggccacatgg

SEQ ID NO: 1339690 - DNA, 15 bp, Homo sapiens
cagccaaagcctcct

SEQ ID NO: 1339691 - DNA, 18 bp, Homo sapiens
cagccaaagcctcctcca

SEQ ID NO: 1339692 - DNA, 15 bp, Homo sapiens
cagccaaaggctggc

SEQ ID NO: 1339693 - DNA, 20 bp, Homo sapiens
cagccaagattttcctcttg

SEQ ID NO: 1339694 - DNA, 23 bp, Homo sapiens
cagccaaggttttataaggctga

SEQ ID NO: 1339695 - DNA, 16 bp, Homo sapiens
cagccagcgcctccct

SEQ ID NO: 1339696 - DNA, 17 bp, Homo sapiens
cagccagcgcctccctc

SEQ ID NO: 1339697 - DNA, 18 bp, Homo sapiens
cagccagcgcctccctcc

SEQ ID NO: 1339698 - DNA, 23 bp, Homo sapiens
cagccagcgcctccctccacccc

SEQ ID NO: 1339699 - DNA, 15 bp, Homo sapiens
cagccagttcaaaaa

SEQ ID NO: 1339700 - DNA, 23 bp, Homo sapiens
cagccatccagggggcaagagga

SEQ ID NO: 1339701 - DNA, 15 bp, Homo sapiens
cagcccacccctcaa

SEQ ID NO: 1339702 - DNA, 18 bp, Homo sapiens
cagcccaccctgctgctg

SEQ ID NO: 1339703 - DNA, 16 bp, Homo sapiens
cagccccagcctgcta

SEQ ID NO: 1339704 - DNA, 18 bp, Homo sapiens
cagccccgactccagcca

SEQ ID NO: 1339705 - DNA, 18 bp, Homo sapiens
cagcccctctggtcgctc

SEQ ID NO: 1339706 - DNA, 21 bp, Homo sapiens
cagcccctctggtcgctcctg

SEQ ID NO: 1339707 - DNA, 20 bp, Homo sapiens
cagccctccccatggagcca

SEQ ID NO: 1339708 - DNA, 20 bp, Homo sapiens
cagccctgctggggatcccc

SEQ ID NO: 1339709 - DNA, 21 bp, Homo sapiens
cagccctggcagggggcatgc

SEQ ID NO: 1339710 - DNA, 23 bp, Homo sapiens
cagccgccatgctcctggcccac

SEQ ID NO: 1339711 - DNA, 17 bp, Homo sapiens
cagcctagcacagcagc

SEQ ID NO: 1339712 - DNA, 14 bp, Homo sapiens
cagcctcagactgg

SEQ ID NO: 1339713 - DNA, 17 bp, Homo sapiens
cagcctcctctggacgg

SEQ ID NO: 1339714 - DNA, 21 bp, Homo sapiens
cagcctcctctggacggcagg

SEQ ID NO: 1339715 - DNA, 22 bp, Homo sapiens
cagcctcctctggacggcaggc

SEQ ID NO: 1339716 - DNA, 19 bp, Homo sapiens
cagcctctcagtgccctcc

SEQ ID NO: 1339717 - DNA, 20 bp, Homo sapiens
cagcctctgtcaggccttca

SEQ ID NO: 1339718 - DNA, 14 bp, Homo sapiens
cagcctgcacagtg

SEQ ID NO: 1339719 - DNA, 16 bp, Homo sapiens
cagcctgcgcctgctg

SEQ ID NO: 1339720 - DNA, 23 bp, Homo sapiens
cagcctgctagctagctcaacta

SEQ ID NO: 1339721 - DNA, 12 bp, Homo sapiens
cagcctgctcca

SEQ ID NO: 1339722 - DNA, 15 bp, Homo sapiens
cagccttgagccctg

SEQ ID NO: 1339723 - DNA, 18 bp, Homo sapiens
cagccttgagccctggct

SEQ ID NO: 1339724 - DNA, 19 bp, Homo sapiens
cagccttgagccctggctg

SEQ ID NO: 1339725 - DNA, 17 bp, Homo sapiens
cagcgagggcagctgct

SEQ ID NO: 1339726 - DNA, 15 bp, Homo sapiens
cagcgcctccctcca

SEQ ID NO: 1339727 - DNA, 20 bp, Homo sapiens
cagcgcctccctccacccca

SEQ ID NO: 1339728 - DNA, 21 bp, Homo sapiens
cagcgggggaggcccgcagag

SEQ ID NO: 1339729 - DNA, 13 bp, Homo sapiens
cagcgtccctggc

SEQ ID NO: 1339730 - DNA, 14 bp, Homo sapiens
cagctaattctact

SEQ ID NO: 1339731 - DNA, 13 bp, Homo sapiens
cagctatgcaaaa

SEQ ID NO: 1339732 - DNA, 13 bp, Homo sapiens
cagctcagaacca

SEQ ID NO: 1339733 - DNA, 15 bp, Homo sapiens
cagctcagaaccaca

SEQ ID NO: 1339734 - DNA, 16 bp, Homo sapiens
cagctcattaaacttt

SEQ ID NO: 1339735 - DNA, 22 bp, Homo sapiens
cagctccagggaatccaagcct

SEQ ID NO: 1339736 - DNA, 16 bp, Homo sapiens
cagctcggggagcctt

SEQ ID NO: 1339737 - DNA, 23 bp, Homo sapiens
cagctgaagttgcagatgttaga

SEQ ID NO: 1339738 - DNA, 15 bp, Homo sapiens
cagctgcccttccgc

SEQ ID NO: 1339739 - DNA, 20 bp, Homo sapiens
cagctgctatttattttcct

SEQ ID NO: 1339740 - DNA, 18 bp, Homo sapiens
cagctgctccctggcatt

SEQ ID NO: 1339741 - DNA, 15 bp, Homo sapiens
cagctggcctggaca

SEQ ID NO: 1339742 - DNA, 17 bp, Homo sapiens
cagctggcctggacagt

SEQ ID NO: 1339743 - DNA, 23 bp, Homo sapiens
cagctgggccgggacccagggcc

SEQ ID NO: 1339744 - DNA, 24 bp, Homo sapiens
cagctgtcccttgcttgcctgcag

SEQ ID NO: 1339745 - DNA, 19 bp, Homo sapiens
cagctgttcagctggttga

SEQ ID NO: 1339746 - DNA, 15 bp, Homo sapiens
cagcttgacctgagg

SEQ ID NO: 1339747 - DNA, 22 bp, Homo sapiens
cagcttgacctgaggctgtggt

SEQ ID NO: 1339748 - DNA, 17 bp, Homo sapiens
cagctttcatgattagc

SEQ ID NO: 1339749 - DNA, 16 bp, Homo sapiens
cagctttgagaagcct

SEQ ID NO: 1339750 - DNA, 18 bp, Homo sapiens
cagctttgagaagccttc

SEQ ID NO: 1339751 - DNA, 12 bp, Homo sapiens
cagctttgcaaa

SEQ ID NO: 1339752 - DNA, 16 bp, Homo sapiens
cagcttttctcaactg

SEQ ID NO: 1339753 - DNA, 21 bp, Homo sapiens
cagcttttctcaactgggtcc

SEQ ID NO: 1339754 - DNA, 20 bp, Homo sapiens
caggaaactccacatctgcc

SEQ ID NO: 1339755 - DNA, 21 bp, Homo sapiens
caggaaactccacatctgcct

SEQ ID NO: 1339756 - DNA, 18 bp, Homo sapiens
caggaagccgtcctggcg

SEQ ID NO: 1339757 - DNA, 14 bp, Homo sapiens
caggaaggaagtca

SEQ ID NO: 1339758 - DNA, 17 bp, Homo sapiens
caggaatattttccaaa

SEQ ID NO: 1339759 - DNA, 16 bp, Homo sapiens
caggaccctcgccgga

SEQ ID NO: 1339760 - DNA, 12 bp, Homo sapiens
caggacgccact

SEQ ID NO: 1339761 - DNA, 19 bp, Homo sapiens
caggacgccactcatttca

SEQ ID NO: 1339762 - DNA, 21 bp, Homo sapiens
caggacgccactcatttcatc

SEQ ID NO: 1339763 - DNA, 21 bp, Homo sapiens
caggacttccccggagggctg

SEQ ID NO: 1339764 - DNA, 16 bp, Homo sapiens
caggagaacctaacat

SEQ ID NO: 1339765 - DNA, 22 bp, Homo sapiens
caggagatcgagaccatcctgg

SEQ ID NO: 1339766 - DNA, 16 bp, Homo sapiens
caggagcctcactggg

SEQ ID NO: 1339767 - DNA, 16 bp, Homo sapiens
caggagcctgcccagc

SEQ ID NO: 1339768 - DNA, 12 bp, Homo sapiens
caggaggcaggc

SEQ ID NO: 1339769 - DNA, 19 bp, Homo sapiens
caggaggcagggaggcagc

SEQ ID NO: 1339770 - DNA, 20 bp, Homo sapiens
caggaggcagggaggcagcc

SEQ ID NO: 1339771 - DNA, 23 bp, Homo sapiens
caggaggcagggaggcagccgcc

SEQ ID NO: 1339772 - DNA, 13 bp, Homo sapiens
caggaggcgccct

SEQ ID NO: 1339773 - DNA, 17 bp, Homo sapiens
caggaggcgcccttggc

SEQ ID NO: 1339774 - DNA, 23 bp, Homo sapiens
caggatggccgggcgcggtggct

SEQ ID NO: 1339775 - DNA, 16 bp, Homo sapiens
caggcacgggtggtcc

SEQ ID NO: 1339776 - DNA, 23 bp, Homo sapiens
caggcacgggtggtccccgttcc

SEQ ID NO: 1339777 - DNA, 21 bp, Homo sapiens
caggcagcctctgtcaggcct

SEQ ID NO: 1339778 - DNA, 22 bp, Homo sapiens
caggcagcctctgtcaggcctt

SEQ ID NO: 1339779 - DNA, 12 bp, Homo sapiens
caggcaggggtg

SEQ ID NO: 1339780 - DNA, 13 bp, Homo sapiens
caggcaggggtgg

SEQ ID NO: 1339781 - DNA, 23 bp, Homo sapiens
caggcaggggtgggggtggaggc

SEQ ID NO: 1339782 - DNA, 17 bp, Homo sapiens
caggcagttggccagag

SEQ ID NO: 1339783 - DNA, 14 bp, Homo sapiens
caggcatagaggct

SEQ ID NO: 1339784 - DNA, 12 bp, Homo sapiens
caggccacctcc

SEQ ID NO: 1339785 - DNA, 21 bp, Homo sapiens
ccaagggaaaggggtgctttt

SEQ ID NO: 1339786 - DNA, 17 bp, Homo sapiens
ccaagggaacctgtgtc

SEQ ID NO: 1339787 - DNA, 13 bp, Homo sapiens
ccaagggcccaaa

SEQ ID NO: 1339788 - DNA, 13 bp, Homo sapiens
ccaaggtgggagg

SEQ ID NO: 1339789 - DNA, 20 bp, Homo sapiens
ccaagtcaagtgaaaaagga

SEQ ID NO: 1339790 - DNA, 15 bp, Homo sapiens
ccaagtggggtgctg

SEQ ID NO: 1339791 - DNA, 22 bp, Homo sapiens
ccaagtggggtgctgggaggag

SEQ ID NO: 1339792 - DNA, 14 bp, Homo sapiens
ccaatcttactttg

SEQ ID NO: 1339793 - DNA, 20 bp, Homo sapiens
ccaatcttactttgtaaatt

SEQ ID NO: 1339794 - DNA, 13 bp, Homo sapiens
ccacaacctcttc

SEQ ID NO: 1339795 - DNA, 19 bp, Homo sapiens
ccacagccagcacctggca

SEQ ID NO: 1339796 - DNA, 17 bp, Homo sapiens
ccacagcgagggcagct

SEQ ID NO: 1339797 - DNA, 20 bp, Homo sapiens
ccacagcgagggcagctgct

SEQ ID NO: 1339798 - DNA, 12 bp, Homo sapiens
ccacagcgtccc

SEQ ID NO: 1339799 - DNA, 15 bp, Homo sapiens
ccacagcgtccctgg

SEQ ID NO: 1339800 - DNA, 17 bp, Homo sapiens
ccacaggaccctcgccg

SEQ ID NO: 1339801 - DNA, 20 bp, Homo sapiens
ccacagtagaactgtctgtg

SEQ ID NO: 1339802 - DNA, 16 bp, Homo sapiens
ccacatcaaataagaa

SEQ ID NO: 1339803 - DNA, 12 bp, Homo sapiens
ccaccaaagctg

SEQ ID NO: 1339804 - DNA, 13 bp, Homo sapiens
ccaccaaagctgc

SEQ ID NO: 1339805 - DNA, 18 bp, Homo sapiens
ccaccaaagctgcccact

SEQ ID NO: 1339806 - DNA, 14 bp, Homo sapiens
ccaccacagccagc

SEQ ID NO: 1339807 - DNA, 21 bp, Homo sapiens
ccaccacagccagcacctggc

SEQ ID NO: 1339808 - DNA, 13 bp, Homo sapiens
ccaccacccctac

SEQ ID NO: 1339809 - DNA, 19 bp, Homo sapiens
ccaccagcatcacctgcct

SEQ ID NO: 1339810 - DNA, 13 bp, Homo sapiens
ccaccccaagaga

SEQ ID NO: 1339811 - DNA, 17 bp, Homo sapiens
ccaccccaagagaactc

SEQ ID NO: 1339812 - DNA, 19 bp, Homo sapiens
ccaccccaagagaactcgc

SEQ ID NO: 1339813 - DNA, 12 bp, Homo sapiens
ccacccccagcc

SEQ ID NO: 1339814 - DNA, 13 bp, Homo sapiens
ccaccccccaggc

SEQ ID NO: 1339815 - DNA, 15 bp, Homo sapiens
ccaccccccaggcct

SEQ ID NO: 1339816 - DNA, 13 bp, Homo sapiens
ccaccccctgccc

SEQ ID NO: 1339817 - DNA, 15 bp, Homo sapiens
ccaccccctgccctg

SEQ ID NO: 1339818 - DNA, 16 bp, Homo sapiens
ccaccccctgccctgc

SEQ ID NO: 1339819 - DNA, 17 bp, Homo sapiens
ccaccccctgccctgca

SEQ ID NO: 1339820 - DNA, 21 bp, Homo sapiens
ccaccccggggaccctgtgac

SEQ ID NO: 1339821 - DNA, 19 bp, Homo sapiens
ccacccctcaacacctctg

SEQ ID NO: 1339822 - DNA, 17 bp, Homo sapiens
ccaccctgaaagccctg

SEQ ID NO: 1339823 - DNA, 13 bp, Homo sapiens
ccaccctgagccg

SEQ ID NO: 1339824 - DNA, 13 bp, Homo sapiens
ccaccctgcctgc

SEQ ID NO: 1339825 - DNA, 16 bp, Homo sapiens
ccaccctgctgctggt

SEQ ID NO: 1339826 - DNA, 21 bp, Homo sapiens
ccaccctgctgctggtgcaca

SEQ ID NO: 1339827 - DNA, 12 bp, Homo sapiens
ccaccctgggcc

SEQ ID NO: 1339828 - DNA, 17 bp, Homo sapiens
ccaccgcccctggccgc

SEQ ID NO: 1339829 - DNA, 17 bp, Homo sapiens
ccaccggtccagctggc

SEQ ID NO: 1339830 - DNA, 18 bp, Homo sapiens
ccaccggtccagctggcc

SEQ ID NO: 1339831 - DNA, 19 bp, Homo sapiens
ccacctagaacactaactc

SEQ ID NO: 1339832 - DNA, 21 bp, Homo sapiens
ccacctccaggctttcccact

SEQ ID NO: 1339833 - DNA, 20 bp, Homo sapiens
ccacgcccgtcctgcctgtg

SEQ ID NO: 1339834 - DNA, 18 bp, Homo sapiens
ccacgcctcttgaccagg

SEQ ID NO: 1339835 - DNA, 15 bp, Homo sapiens
ccacgcgtgccgtgg

SEQ ID NO: 1339836 - DNA, 22 bp, Homo sapiens
ccacgggacatcacagggtggg

SEQ ID NO: 1339837 - DNA, 16 bp, Homo sapiens
ccactaaaaatattgt

SEQ ID NO: 1339838 - DNA, 13 bp, Homo sapiens
ccactaatgcaaa

SEQ ID NO: 1339839 - DNA, 14 bp, Homo sapiens
ccactacacctggc

SEQ ID NO: 1339840 - DNA, 15 bp, Homo sapiens
ccactacacctggct

SEQ ID NO: 1339841 - DNA, 18 bp, Homo sapiens
ccactatgacagaggatt

SEQ ID NO: 1339842 - DNA, 22 bp, Homo sapiens
ccactcactaggcccccacttg

SEQ ID NO: 1339843 - DNA, 15 bp, Homo sapiens
ccactcatttcatct

SEQ ID NO: 1339844 - DNA, 20 bp, Homo sapiens
ccactgcactccagcctggg

SEQ ID NO: 1339845 - DNA, 21 bp, Homo sapiens
ccactgcatcgtttcatcttc

SEQ ID NO: 1339846 - DNA, 23 bp, Homo sapiens
ccactgccagcagcagcaggtga

SEQ ID NO: 1339847 - DNA, 14 bp, Homo sapiens
ccactgccttcgct

SEQ ID NO: 1339848 - DNA, 16 bp, Homo sapiens
ccactgccttcgcttc

SEQ ID NO: 1339849 - DNA, 18 bp, Homo sapiens
ccactgccttcgcttctt

SEQ ID NO: 1339850 - DNA, 15 bp, Homo sapiens
ccactgtgaagagaa

SEQ ID NO: 1339851 - DNA, 15 bp, Homo sapiens
ccactgtgctttcag

SEQ ID NO: 1339852 - DNA, 21 bp, Homo sapiens
ccactgtttctcttgagctgg

SEQ ID NO: 1339853 - DNA, 22 bp, Homo sapiens
ccactgtttctcttgagctggc

SEQ ID NO: 1339854 - DNA, 23 bp, Homo sapiens
ccactgtttctcttgagctggcc

SEQ ID NO: 1339855 - DNA, 13 bp, Homo sapiens
ccacttctgccag

SEQ ID NO: 1339856 - DNA, 14 bp, Homo sapiens
ccacttctgccaga

SEQ ID NO: 1339857 - DNA, 14 bp, Homo sapiens
ccacttgaggcctg

SEQ ID NO: 1339858 - DNA, 19 bp, Homo sapiens
ccacttgaggcctgatctg

SEQ ID NO: 1339859 - DNA, 20 bp, Homo sapiens
ccacttgaggcctgatctgc

SEQ ID NO: 1339860 - DNA, 17 bp, Homo sapiens
ccacttgcctcttcctt

SEQ ID NO: 1339861 - DNA, 19 bp, Homo sapiens
ccactttacccacctagaa

SEQ ID NO: 1339862 - DNA, 22 bp, Homo sapiens
ccagaaccacacttgaaacctt

SEQ ID NO: 1339863 - DNA, 21 bp, Homo sapiens
ccagaagagaattaagcccta

SEQ ID NO: 1339864 - DNA, 15 bp, Homo sapiens
ccagaataagttatt

SEQ ID NO: 1339865 - DNA, 12 bp, Homo sapiens
ccagaatactga

SEQ ID NO: 1339866 - DNA, 23 bp, Homo sapiens
ccagaatactgatggaatttttt

SEQ ID NO: 1339867 - DNA, 13 bp, Homo sapiens
ccagacttccttg

SEQ ID NO: 1339868 - DNA, 14 bp, Homo sapiens
ccagagactttagg

SEQ ID NO: 1339869 - DNA, 16 bp, Homo sapiens
ccagagactttgtaga

SEQ ID NO: 1339870 - DNA, 21 bp, Homo sapiens
ccagaggaatcctggcagccc

SEQ ID NO: 1339871 - DNA, 13 bp, Homo sapiens
ccagaggagcctt

SEQ ID NO: 1339872 - DNA, 17 bp, Homo sapiens
ccagaggagccttttta

SEQ ID NO: 1339873 - DNA, 12 bp, Homo sapiens
ccagaggctggg

SEQ ID NO: 1339874 - DNA, 15 bp, Homo sapiens
ccagaggctgggttc

SEQ ID NO: 1339875 - DNA, 17 bp, Homo sapiens
ccagaggttgtgcactg

SEQ ID NO: 1339876 - DNA, 21 bp, Homo sapiens
ccagatctttcagaaatataa

SEQ ID NO: 1339877 - DNA, 17 bp, Homo sapiens
ccagatgtttccagact

SEQ ID NO: 1339878 - DNA, 23 bp, Homo sapiens
ccagatttgtctttttgttgtaa

SEQ ID NO: 1339879 - DNA, 20 bp, Homo sapiens
ccagcaacacagcctgggcc

SEQ ID NO: 1339880 - DNA, 23 bp, Homo sapiens
ccagcaacttcttctccatccct

SEQ ID NO: 1339881 - DNA, 13 bp, Homo sapiens
ccagcacagcttg

SEQ ID NO: 1339882 - DNA, 17 bp, Homo sapiens
ccagcacagcttgacct

SEQ ID NO: 1339883 - DNA, 19 bp, Homo sapiens
ccagcaccttgtgcctggg

SEQ ID NO: 1339884 - DNA, 15 bp, Homo sapiens
ccagcactttgggag

SEQ ID NO: 1339885 - DNA, 16 bp, Homo sapiens
ccagcactttgggagg

SEQ ID NO: 1339886 - DNA, 20 bp, Homo sapiens
ccagcactttgggaggccga

SEQ ID NO: 1339887 - DNA, 20 bp, Homo sapiens
ccagcagcctggaccctgtg

SEQ ID NO: 1339888 - DNA, 16 bp, Homo sapiens
ccagcatcacctgcct

SEQ ID NO: 1339889 - DNA, 15 bp, Homo sapiens
ccagcattccagccc

SEQ ID NO: 1339890 - DNA, 17 bp, Homo sapiens
ccagcattccagcccct

SEQ ID NO: 1339891 - DNA, 18 bp, Homo sapiens
ccagcattccagcccctc

SEQ ID NO: 1339892 - DNA, 20 bp, Homo sapiens
ccagccagaggcatctgagg

SEQ ID NO: 1339893 - DNA, 20 bp, Homo sapiens
ccagccagcgcctccctcca

SEQ ID NO: 1339894 - DNA, 18 bp, Homo sapiens
ccagccatgccagctggc

SEQ ID NO: 1339895 - DNA, 17 bp, Homo sapiens
ccagcccagggctcctg

SEQ ID NO: 1339896 - DNA, 13 bp, Homo sapiens
ccagccccactgc

SEQ ID NO: 1339897 - DNA, 17 bp, Homo sapiens
ccagccccactgccagc

SEQ ID NO: 1339898 - DNA, 18 bp, Homo sapiens
ccagccccactgccagca

SEQ ID NO: 1339899 - DNA, 20 bp, Homo sapiens
ccagccccactgccagcagc

SEQ ID NO: 1339900 - DNA, 21 bp, Homo sapiens
ccagccccactgccagcagca

SEQ ID NO: 1339901 - DNA, 15 bp, Homo sapiens
ccagcccctctggtc

SEQ ID NO: 1339902 - DNA, 23 bp, Homo sapiens
ccagcccctctggtcgctcctgc

SEQ ID NO: 1339903 - DNA, 21 bp, Homo sapiens
ccagccctccccatggagcca

SEQ ID NO: 1339904 - DNA, 19 bp, Homo sapiens
cctcctattctataaaact

SEQ ID NO: 1339905 - DNA, 16 bp, Homo sapiens
cctcctcacctcatgc

SEQ ID NO: 1339906 - DNA, 19 bp, Homo sapiens
cctcctcacctcatgccca

SEQ ID NO: 1339907 - DNA, 12 bp, Homo sapiens
cctcctccagcc

SEQ ID NO: 1339908 - DNA, 19 bp, Homo sapiens
cctcctcccacccggctgc

SEQ ID NO: 1339909 - DNA, 14 bp, Homo sapiens
cctccttcagacac

SEQ ID NO: 1339910 - DNA, 15 bp, Homo sapiens
cctccttcagacacc

SEQ ID NO: 1339911 - DNA, 18 bp, Homo sapiens
cctcgccctctcctttgt

SEQ ID NO: 1339912 - DNA, 19 bp, Homo sapiens
cctcgccggatctgaggga

SEQ ID NO: 1339913 - DNA, 18 bp, Homo sapiens
cctcggcccctcccacac

SEQ ID NO: 1339914 - DNA, 14 bp, Homo sapiens
cctctaatgagact

SEQ ID NO: 1339915 - DNA, 17 bp, Homo sapiens
cctctatttatgtttgc

SEQ ID NO: 1339916 - DNA, 23 bp, Homo sapiens
cctctcaggccggcagccccagc

SEQ ID NO: 1339917 - DNA, 18 bp, Homo sapiens
cctctcagtgccctccag

SEQ ID NO: 1339918 - DNA, 13 bp, Homo sapiens
cctctccagcctc

SEQ ID NO: 1339919 - DNA, 18 bp, Homo sapiens
cctctccagcctcagccc

SEQ ID NO: 1339920 - DNA, 13 bp, Homo sapiens
cctctccatttgc

SEQ ID NO: 1339921 - DNA, 23 bp, Homo sapiens
cctctccccaggtccagctctgg

SEQ ID NO: 1339922 - DNA, 18 bp, Homo sapiens
cctctgaaaagtgtgtat

SEQ ID NO: 1339923 - DNA, 22 bp, Homo sapiens
cctctgaatttacttccttgca

SEQ ID NO: 1339924 - DNA, 19 bp, Homo sapiens
cctctgacgtccacctcct

SEQ ID NO: 1339925 - DNA, 11 bp, Homo sapiens
cctctgcacaa

SEQ ID NO: 1339926 - DNA, 15 bp, Homo sapiens
cctctgcacaagctg

SEQ ID NO: 1339927 - DNA, 16 bp, Homo sapiens
cctctgcacccagaac

SEQ ID NO: 1339928 - DNA, 21 bp, Homo sapiens
cctctgcctgccccgccccca

SEQ ID NO: 1339929 - DNA, 15 bp, Homo sapiens
cctctgctcaccgcc

SEQ ID NO: 1339930 - DNA, 14 bp, Homo sapiens
cctctgctccccag

SEQ ID NO: 1339931 - DNA, 21 bp, Homo sapiens
cctctggacggcaggctcact

SEQ ID NO: 1339932 - DNA, 23 bp, Homo sapiens
cctctggacggcaggctcactgc

SEQ ID NO: 1339933 - DNA, 17 bp, Homo sapiens
cctctggagccctaacc

SEQ ID NO: 1339934 - DNA, 19 bp, Homo sapiens
cctctggtcgctcctgccc

SEQ ID NO: 1339935 - DNA, 14 bp, Homo sapiens
cctctgtcaggcct

SEQ ID NO: 1339936 - DNA, 18 bp, Homo sapiens
cctctgtcaggccttcag

SEQ ID NO: 1339937 - DNA, 18 bp, Homo sapiens
cctctgtgtatttgcttt

SEQ ID NO: 1339938 - DNA, 13 bp, Homo sapiens
cctcttgaccagg

SEQ ID NO: 1339939 - DNA, 13 bp, Homo sapiens
cctcttgcccatc

SEQ ID NO: 1339940 - DNA, 17 bp, Homo sapiens
cctcttgtaaagactgg

SEQ ID NO: 1339941 - DNA, 23 bp, Homo sapiens
cctctttagtttttggttgggaa

SEQ ID NO: 1339942 - DNA, 13 bp, Homo sapiens
cctgaaagccctg

SEQ ID NO: 1339943 - DNA, 18 bp, Homo sapiens
cctgaaagccctgagctt

SEQ ID NO: 1339944 - DNA, 14 bp, Homo sapiens
cctgaaccatgtgg

SEQ ID NO: 1339945 - DNA, 22 bp, Homo sapiens
cctgaaccgcacagctcaggag

SEQ ID NO: 1339946 - DNA, 17 bp, Homo sapiens
cctgaagatgggagcct

SEQ ID NO: 1339947 - DNA, 15 bp, Homo sapiens
cctgaataaagagcc

SEQ ID NO: 1339948 - DNA, 15 bp, Homo sapiens
cctgacagaaggtgc

SEQ ID NO: 1339949 - DNA, 17 bp, Homo sapiens
cctgacagaaggtgcca

SEQ ID NO: 1339950 - DNA, 22 bp, Homo sapiens
cctgaccagctgctccgaggac

SEQ ID NO: 1339951 - DNA, 18 bp, Homo sapiens
cctgagaggcaggcatag

SEQ ID NO: 1339952 - DNA, 18 bp, Homo sapiens
cctgagctaggaagagtc

SEQ ID NO: 1339953 - DNA, 13 bp, Homo sapiens
cctgagtctgggc

SEQ ID NO: 1339954 - DNA, 15 bp, Homo sapiens
cctgatttcttcagg

SEQ ID NO: 1339955 - DNA, 23 bp, Homo sapiens
cctgcactcctcagggcagcctc

SEQ ID NO: 1339956 - DNA, 17 bp, Homo sapiens
cctgcacttacttgctt

SEQ ID NO: 1339957 - DNA, 15 bp, Homo sapiens
cctgcagatgccacc

SEQ ID NO: 1339958 - DNA, 21 bp, Homo sapiens
cctgcagatgccaccctagcc

SEQ ID NO: 1339959 - DNA, 19 bp, Homo sapiens
cctgcagggccatggctca

SEQ ID NO: 1339960 - DNA, 20 bp, Homo sapiens
cctgcagggccatggctcag

SEQ ID NO: 1339961 - DNA, 15 bp, Homo sapiens
cctgccaccaggcca

SEQ ID NO: 1339962 - DNA, 18 bp, Homo sapiens
cctgccactcactaggcc

SEQ ID NO: 1339963 - DNA, 14 bp, Homo sapiens
cctgccaggcaggg

SEQ ID NO: 1339964 - DNA, 20 bp, Homo sapiens
cctgccccaatccctttatt

SEQ ID NO: 1339965 - DNA, 13 bp, Homo sapiens
cctgcccccagcc

SEQ ID NO: 1339966 - DNA, 17 bp, Homo sapiens
cctgcccccagccccgg

SEQ ID NO: 1339967 - DNA, 13 bp, Homo sapiens
cctgccccgcccc

SEQ ID NO: 1339968 - DNA, 14 bp, Homo sapiens
cctgcccgttcttg

SEQ ID NO: 1339969 - DNA, 18 bp, Homo sapiens
cctgccctcaagggtgtg

SEQ ID NO: 1339970 - DNA, 13 bp, Homo sapiens
cctgccctgcacg

SEQ ID NO: 1339971 - DNA, 13 bp, Homo sapiens
cctgcctggcccc

SEQ ID NO: 1339972 - DNA, 15 bp, Homo sapiens
cctgcgcctgctgca

SEQ ID NO: 1339973 - DNA, 18 bp, Homo sapiens
cctgcgcctgctgcatgc

SEQ ID NO: 1339974 - DNA, 21 bp, Homo sapiens
cctgcgggtggggcttggggc

SEQ ID NO: 1339975 - DNA, 13 bp, Homo sapiens
cctgcgtcctcct

SEQ ID NO: 1339976 - DNA, 19 bp, Homo sapiens
cctgcgtcctcctcacctc

SEQ ID NO: 1339977 - DNA, 15 bp, Homo sapiens
cctgctagctagctc

SEQ ID NO: 1339978 - DNA, 13 bp, Homo sapiens
cctgctgcatgcc

SEQ ID NO: 1339979 - DNA, 16 bp, Homo sapiens
cctgctgcatgccctc

SEQ ID NO: 1339980 - DNA, 23 bp, Homo sapiens
cctgctgcatgccctctcaggcc

SEQ ID NO: 1339981 - DNA, 14 bp, Homo sapiens
cctgctgcgcagtt

SEQ ID NO: 1339982 - DNA, 15 bp, Homo sapiens
cctgctgctggtgca

SEQ ID NO: 1339983 - DNA, 9 bp, Homo sapiens
cctgctggc

SEQ ID NO: 1339984 - DNA, 19 bp, Homo sapiens
cctgctggcacccaccgtg

SEQ ID NO: 1339985 - DNA, 23 bp, Homo sapiens
cctgcttaatcttcaaagccttc

SEQ ID NO: 1339986 - DNA, 21 bp, Homo sapiens
cctgcttccaggaaactccac

SEQ ID NO: 1339987 - DNA, 15 bp, Homo sapiens
cctggaattgccagc

SEQ ID NO: 1339988 - DNA, 20 bp, Homo sapiens
cctggaccttttgttttctg

SEQ ID NO: 1339989 - DNA, 19 bp, Homo sapiens
cctggagacttagggcacc

SEQ ID NO: 1339990 - DNA, 15 bp, Homo sapiens
cctggagatcctcct

SEQ ID NO: 1339991 - DNA, 21 bp, Homo sapiens
cctggagatcctcctgcagac

SEQ ID NO: 1339992 - DNA, 22 bp, Homo sapiens
cctggagtgtatgactgcacat

SEQ ID NO: 1339993 - DNA, 20 bp, Homo sapiens
cctggcactggaccccagca

SEQ ID NO: 1339994 - DNA, 15 bp, Homo sapiens
cctggcagcccagag

SEQ ID NO: 1339995 - DNA, 21 bp, Homo sapiens
cctggcatcgcaccattctga

SEQ ID NO: 1339996 - DNA, 16 bp, Homo sapiens
cctggccaggagcagg

SEQ ID NO: 1339997 - DNA, 13 bp, Homo sapiens
cctggcccactgc

SEQ ID NO: 1339998 - DNA, 19 bp, Homo sapiens
cctggcccccaacctcagg

SEQ ID NO: 1339999 - DNA, 22 bp, Homo sapiens
cctggcccccaacctcagggct

SEQ ID NO: 1340000 - DNA, 23 bp, Homo sapiens
cctggcccccaacctcagggctc

SEQ ID NO: 1340001 - DNA, 19 bp, Homo sapiens
cctggccgcggagcctgca

SEQ ID NO: 1340002 - DNA, 23 bp, Homo sapiens
cctggcctatccgctgccagcct

SEQ ID NO: 1340003 - DNA, 15 bp, Homo sapiens
cctggcctcccctgc

SEQ ID NO: 1340004 - DNA, 13 bp, Homo sapiens
cctggcctctgtg

SEQ ID NO: 1340005 - DNA, 23 bp, Homo sapiens
cctggcgcaggtgggctggactt

SEQ ID NO: 1340006 - DNA, 12 bp, Homo sapiens
cctggctccctc

SEQ ID NO: 1340007 - DNA, 20 bp, Homo sapiens
cctggctccctcctccaggc

SEQ ID NO: 1340008 - DNA, 22 bp, Homo sapiens
cctggctccctcctccaggcct

SEQ ID NO: 1340009 - DNA, 23 bp, Homo sapiens
cctggctccctcctccaggcctg

SEQ ID NO: 1340010 - DNA, 15 bp, Homo sapiens
cctggctgccggcac

SEQ ID NO: 1340011 - DNA, 14 bp, Homo sapiens
cctggctgctgccc

SEQ ID NO: 1340012 - DNA, 20 bp, Homo sapiens
cctggctgctgcccccaccc

SEQ ID NO: 1340013 - DNA, 21 bp, Homo sapiens
cctggctgttctgtggttcct

SEQ ID NO: 1340014 - DNA, 22 bp, Homo sapiens
cctgggaggtcaaggctgcagt

SEQ ID NO: 1340015 - DNA, 16 bp, Homo sapiens
cctgggccctgggctg

SEQ ID NO: 1340016 - DNA, 13 bp, Homo sapiens
cctgggccgctgc

SEQ ID NO: 1340017 - DNA, 22 bp, Homo sapiens
cctgggccgtatctccggctcc

SEQ ID NO: 1340018 - DNA, 18 bp, Homo sapiens
cctgggcttggcctgctg

SEQ ID NO: 1340019 - DNA, 19 bp, Homo sapiens
cctgggcttggcctgctgt

SEQ ID NO: 1340020 - DNA, 20 bp, Homo sapiens
cctgggcttggcctgctgtg

SEQ ID NO: 1340021 - DNA, 18 bp, Homo sapiens
cctggggtgttagtggca

SEQ ID NO: 1340022 - DNA, 15 bp, Homo sapiens
ctaaataaaatttgt

SEQ ID NO: 1340023 - DNA, 20 bp, Homo sapiens
ctaaataaaatttgttgcat

SEQ ID NO: 1340024 - DNA, 18 bp, Homo sapiens
ctaaataagaaaataaca

SEQ ID NO: 1340025 - DNA, 15 bp, Homo sapiens
ctaaatcagagacaa

SEQ ID NO: 1340026 - DNA, 19 bp, Homo sapiens
ctaaatctatttattaata

SEQ ID NO: 1340027 - DNA, 17 bp, Homo sapiens
ctaaatggcctcatgtg

SEQ ID NO: 1340028 - DNA, 16 bp, Homo sapiens
ctaacctcgccctctc

SEQ ID NO: 1340029 - DNA, 14 bp, Homo sapiens
ctaactcaaataca

SEQ ID NO: 1340030 - DNA, 21 bp, Homo sapiens
ctaactcaccagccccactgc

SEQ ID NO: 1340031 - DNA, 17 bp, Homo sapiens
ctaagaaaagcctaatc

SEQ ID NO: 1340032 - DNA, 19 bp, Homo sapiens
ctaagagaagttattttct

SEQ ID NO: 1340033 - DNA, 21 bp, Homo sapiens
ctaagagaagttgtaaagtat

SEQ ID NO: 1340034 - DNA, 20 bp, Homo sapiens
ctaaggcatctatctgtgct

SEQ ID NO: 1340035 - DNA, 23 bp, Homo sapiens
ctaaggccatggcatcccttttt

SEQ ID NO: 1340036 - DNA, 12 bp, Homo sapiens
ctaaggtcctaa

SEQ ID NO: 1340037 - DNA, 23 bp, Homo sapiens
ctaagtgggcattgccatgtgga

SEQ ID NO: 1340038 - DNA, 22 bp, Homo sapiens
ctaataagctagttgaatactt

SEQ ID NO: 1340039 - DNA, 19 bp, Homo sapiens
ctaatcaccatgtaagcac

SEQ ID NO: 1340040 - DNA, 19 bp, Homo sapiens
ctaatctagatatcgactt

SEQ ID NO: 1340041 - DNA, 13 bp, Homo sapiens
ctaatgagactga

SEQ ID NO: 1340042 - DNA, 23 bp, Homo sapiens
ctaatgtggaccttagaatacag

SEQ ID NO: 1340043 - DNA, 16 bp, Homo sapiens
ctaattatactacttt

SEQ ID NO: 1340044 - DNA, 19 bp, Homo sapiens
ctaattggtacttttaaaa

SEQ ID NO: 1340045 - DNA, 19 bp, Homo sapiens
ctaatttctcctcccttcc

SEQ ID NO: 1340046 - DNA, 18 bp, Homo sapiens
ctaatttttgtattattt

SEQ ID NO: 1340047 - DNA, 13 bp, Homo sapiens
ctacaatctcttt

SEQ ID NO: 1340048 - DNA, 13 bp, Homo sapiens
ctacacctggctg

SEQ ID NO: 1340049 - DNA, 15 bp, Homo sapiens
ctacaccttgccttg

SEQ ID NO: 1340050 - DNA, 22 bp, Homo sapiens
ctacagagaggaaattctccac

SEQ ID NO: 1340051 - DNA, 21 bp, Homo sapiens
ctacagtggttttatactgaa

SEQ ID NO: 1340052 - DNA, 13 bp, Homo sapiens
ctacagttgaaaa

SEQ ID NO: 1340053 - DNA, 21 bp, Homo sapiens
ctacagttgaaaaacagctga

SEQ ID NO: 1340054 - DNA, 16 bp, Homo sapiens
ctacatatcccttcca

SEQ ID NO: 1340055 - DNA, 21 bp, Homo sapiens
ctacatgaggaactgtagatg

SEQ ID NO: 1340056 - DNA, 14 bp, Homo sapiens
ctacatgctggggt

SEQ ID NO: 1340057 - DNA, 13 bp, Homo sapiens
ctacatgtgagtg

SEQ ID NO: 1340058 - DNA, 12 bp, Homo sapiens
ctaccaaaatgg

SEQ ID NO: 1340059 - DNA, 13 bp, Homo sapiens
ctaccaatattag

SEQ ID NO: 1340060 - DNA, 20 bp, Homo sapiens
ctaccccgcagacaccttgg

SEQ ID NO: 1340061 - DNA, 20 bp, Homo sapiens
ctacccgacataagtcgagg

SEQ ID NO: 1340062 - DNA, 17 bp, Homo sapiens
ctaccctccgtttttct

SEQ ID NO: 1340063 - DNA, 17 bp, Homo sapiens
ctactagcaaaataaaa

SEQ ID NO: 1340064 - DNA, 21 bp, Homo sapiens
ctactcaagcgggtggctctg

SEQ ID NO: 1340065 - DNA, 18 bp, Homo sapiens
ctactccctgcagatgcc

SEQ ID NO: 1340066 - DNA, 16 bp, Homo sapiens
ctactgcatttaggga

SEQ ID NO: 1340067 - DNA, 23 bp, Homo sapiens
ctacttcttttttcaaaagaaag

SEQ ID NO: 1340068 - DNA, 20 bp, Homo sapiens
ctactttgttaggattttca

SEQ ID NO: 1340069 - DNA, 17 bp, Homo sapiens
ctacttttgcatgaaaa

SEQ ID NO: 1340070 - DNA, 19 bp, Homo sapiens
ctagaacactaactcacca

SEQ ID NO: 1340071 - DNA, 20 bp, Homo sapiens
ctagaacactaactcaccag

SEQ ID NO: 1340072 - DNA, 12 bp, Homo sapiens
ctagaagccaag

SEQ ID NO: 1340073 - DNA, 21 bp, Homo sapiens
ctagaagccaagggaaagggg

SEQ ID NO: 1340074 - DNA, 17 bp, Homo sapiens
ctagagtgaacttgggc

SEQ ID NO: 1340075 - DNA, 18 bp, Homo sapiens
ctagagttttatagcctg

SEQ ID NO: 1340076 - DNA, 19 bp, Homo sapiens
ctagattttcacttatgaa

SEQ ID NO: 1340077 - DNA, 15 bp, Homo sapiens
ctagcaaaataaaac

SEQ ID NO: 1340078 - DNA, 17 bp, Homo sapiens
ctagcaaaataaaacat

SEQ ID NO: 1340079 - DNA, 19 bp, Homo sapiens
ctagcaatctcttcattat

SEQ ID NO: 1340080 - DNA, 15 bp, Homo sapiens
ctagcacagcagctt

SEQ ID NO: 1340081 - DNA, 17 bp, Homo sapiens
ctagcactttgggaggc

SEQ ID NO: 1340082 - DNA, 18 bp, Homo sapiens
ctagccagcccctcttcc

SEQ ID NO: 1340083 - DNA, 16 bp, Homo sapiens
ctagccggttcctgtc

SEQ ID NO: 1340084 - DNA, 16 bp, Homo sapiens
ctagctaattatttaa

SEQ ID NO: 1340085 - DNA, 12 bp, Homo sapiens
ctagctagctca

SEQ ID NO: 1340086 - DNA, 16 bp, Homo sapiens
ctagctagctcaacta

SEQ ID NO: 1340087 - DNA, 13 bp, Homo sapiens
ctagcttctgctt

SEQ ID NO: 1340088 - DNA, 21 bp, Homo sapiens
ctaggagaaccaaatctggaa

SEQ ID NO: 1340089 - DNA, 23 bp, Homo sapiens
ctaggagaaccaaatctggaagc

SEQ ID NO: 1340090 - DNA, 15 bp, Homo sapiens
ctaggcccccacttg

SEQ ID NO: 1340091 - DNA, 17 bp, Homo sapiens
ctaggcccccacttgcc

SEQ ID NO: 1340092 - DNA, 16 bp, Homo sapiens
ctagggccttggaaat

SEQ ID NO: 1340093 - DNA, 17 bp, Homo sapiens
ctaggtagagtctgagg

SEQ ID NO: 1340094 - DNA, 22 bp, Homo sapiens
ctagtaagaagacaaactgctt

SEQ ID NO: 1340095 - DNA, 12 bp, Homo sapiens
ctagtgaaactt

SEQ ID NO: 1340096 - DNA, 22 bp, Homo sapiens
ctagtgctccatagtttggcat

SEQ ID NO: 1340097 - DNA, 15 bp, Homo sapiens
ctagttgaatacttg

SEQ ID NO: 1340098 - DNA, 18 bp, Homo sapiens
ctagttgaatacttgaac

SEQ ID NO: 1340099 - DNA, 21 bp, Homo sapiens
ctagttgaatacttgaaccat

SEQ ID NO: 1340100 - DNA, 18 bp, Homo sapiens
ctagtttgggaggagcag

SEQ ID NO: 1340101 - DNA, 17 bp, Homo sapiens
ctataagccaaaattaa

SEQ ID NO: 1340102 - DNA, 19 bp, Homo sapiens
ctatatataaaacggtgct

SEQ ID NO: 1340103 - DNA, 18 bp, Homo sapiens
ctatatatataaatgtat

SEQ ID NO: 1340104 - DNA, 13 bp, Homo sapiens
ctatatatataat

SEQ ID NO: 1340105 - DNA, 13 bp, Homo sapiens
ctatatatttcta

SEQ ID NO: 1340106 - DNA, 18 bp, Homo sapiens
ctatccccatctccctgc

SEQ ID NO: 1340107 - DNA, 23 bp, Homo sapiens
ctatccccatctccctgcctggc

SEQ ID NO: 1340108 - DNA, 11 bp, Homo sapiens
ctatcctgatt

SEQ ID NO: 1340109 - DNA, 22 bp, Homo sapiens
ctatcggagaacatgaatcaaa

SEQ ID NO: 1340110 - DNA, 19 bp, Homo sapiens
ctatctcctgacagaaggt

SEQ ID NO: 1340111 - DNA, 14 bp, Homo sapiens
ctatctgtctggtg

SEQ ID NO: 1340112 - DNA, 16 bp, Homo sapiens
ctatctgtctggtggc

SEQ ID NO: 1340113 - DNA, 17 bp, Homo sapiens
ctatctgtctggtggcc

SEQ ID NO: 1340114 - DNA, 20 bp, Homo sapiens
ctatgcatatcagttgagct

SEQ ID NO: 1340115 - DNA, 23 bp, Homo sapiens
ctatggcagaaaaaatgtctgta

SEQ ID NO: 1340116 - DNA, 15 bp, Homo sapiens
ctatgtataaaatac

SEQ ID NO: 1340117 - DNA, 18 bp, Homo sapiens
ctatgtataaaatacata

SEQ ID NO: 1340118 - DNA, 17 bp, Homo sapiens
ctattaatatatgtatt

SEQ ID NO: 1340119 - DNA, 22 bp, Homo sapiens
ctattacgaagttcaagatcaa

SEQ ID NO: 1340120 - DNA, 15 bp, Homo sapiens
ctattagagaagaga

SEQ ID NO: 1340121 - DNA, 14 bp, Homo sapiens
ctattagtgttata

SEQ ID NO: 1340122 - DNA, 16 bp, Homo sapiens
ctattagtgttatatg

SEQ ID NO: 1340123 - DNA, 16 bp, Homo sapiens
ctattatttttataat

SEQ ID NO: 1340124 - DNA, 18 bp, Homo sapiens
ctattatttttataattg

SEQ ID NO: 1340125 - DNA, 19 bp, Homo sapiens
ctattcagtggcgagaaat

SEQ ID NO: 1340126 - DNA, 15 bp, Homo sapiens
ctattctgagaaaac

SEQ ID NO: 1340127 - DNA, 14 bp, Homo sapiens
ctattgcttcacca

SEQ ID NO: 1340128 - DNA, 21 bp, Homo sapiens
ctatttaaaaaaaaagtcaga

SEQ ID NO: 1340129 - DNA, 11 bp, Homo sapiens
ctatttaagat

SEQ ID NO: 1340130 - DNA, 17 bp, Homo sapiens
ctatttattaatattta

SEQ ID NO: 1340131 - DNA, 23 bp, Homo sapiens
ctattttaagactgattttaata

SEQ ID NO: 1340132 - DNA, 14 bp, Homo sapiens
ctattttaatcttg

SEQ ID NO: 1340133 - DNA, 13 bp, Homo sapiens
ctatttttgtaaa

SEQ ID NO: 1340134 - DNA, 19 bp, Homo sapiens
ctatttttgtaaagtttcc

SEQ ID NO: 1340135 - DNA, 18 bp, Homo sapiens
ctcaaaagctgggcaggt

SEQ ID NO: 1340136 - DNA, 21 bp, Homo sapiens
ctcaaagtttgacaggaacct

SEQ ID NO: 1340137 - DNA, 15 bp, Homo sapiens
ctcaaatacacattt

SEQ ID NO: 1340138 - DNA, 17 bp, Homo sapiens
ctcaaatacacatttgc

SEQ ID NO: 1340139 - DNA, 18 bp, Homo sapiens
ctcaagcgggtggctctg

SEQ ID NO: 1340140 - DNA, 22 bp, Homo sapiens
ctgcatcgtttcatcttccaac

SEQ ID NO: 1340141 - DNA, 20 bp, Homo sapiens
ctgcatgtagaggcttgttt

SEQ ID NO: 1340142 - DNA, 15 bp, Homo sapiens
ctgcattcattttta

SEQ ID NO: 1340143 - DNA, 13 bp, Homo sapiens
ctgcattggcttt

SEQ ID NO: 1340144 - DNA, 13 bp, Homo sapiens
ctgcatttaggga

SEQ ID NO: 1340145 - DNA, 17 bp, Homo sapiens
ctgcatttcctcgcagc

SEQ ID NO: 1340146 - DNA, 18 bp, Homo sapiens
ctgcatttttagaccatt

SEQ ID NO: 1340147 - DNA, 13 bp, Homo sapiens
ctgccaccaggcc

SEQ ID NO: 1340148 - DNA, 18 bp, Homo sapiens
ctgccaccaggccacctc

SEQ ID NO: 1340149 - DNA, 19 bp, Homo sapiens
ctgccactcactaggcccc

SEQ ID NO: 1340150 - DNA, 15 bp, Homo sapiens
ctgccagacttaaaa

SEQ ID NO: 1340151 - DNA, 13 bp, Homo sapiens
ctgccagcagcag

SEQ ID NO: 1340152 - DNA, 13 bp, Homo sapiens
ctgccagccttga

SEQ ID NO: 1340153 - DNA, 15 bp, Homo sapiens
ctgccagccttgagc

SEQ ID NO: 1340154 - DNA, 15 bp, Homo sapiens
ctgccaggcaggggt

SEQ ID NO: 1340155 - DNA, 17 bp, Homo sapiens
ctgccaggcaggggtgg

SEQ ID NO: 1340156 - DNA, 17 bp, Homo sapiens
ctgccaggccagcctcc

SEQ ID NO: 1340157 - DNA, 18 bp, Homo sapiens
ctgccaggccagcctccg

SEQ ID NO: 1340158 - DNA, 18 bp, Homo sapiens
ctgccaggtgagaaactg

SEQ ID NO: 1340159 - DNA, 15 bp, Homo sapiens
ctgccatgccagctt

SEQ ID NO: 1340160 - DNA, 22 bp, Homo sapiens
ctgccattacagaggtattaaa

SEQ ID NO: 1340161 - DNA, 12 bp, Homo sapiens
ctgcccacctgc

SEQ ID NO: 1340162 - DNA, 23 bp, Homo sapiens
ctgcccactgtttctcttgagct

SEQ ID NO: 1340163 - DNA, 17 bp, Homo sapiens
ctgcccagacaagattt

SEQ ID NO: 1340164 - DNA, 19 bp, Homo sapiens
ctgccccatctcccctcag

SEQ ID NO: 1340165 - DNA, 20 bp, Homo sapiens
ctgccccatctcccctcagc

SEQ ID NO: 1340166 - DNA, 17 bp, Homo sapiens
ctgccccgcccccagtc

SEQ ID NO: 1340167 - DNA, 23 bp, Homo sapiens
ctgccccgcccccagtccccacc

SEQ ID NO: 1340168 - DNA, 13 bp, Homo sapiens
ctgcccggcaggg

SEQ ID NO: 1340169 - DNA, 17 bp, Homo sapiens
ctgccctgcacgtcatg

SEQ ID NO: 1340170 - DNA, 17 bp, Homo sapiens
ctgccctggctgctgcc

SEQ ID NO: 1340171 - DNA, 20 bp, Homo sapiens
ctgccctggctgctgccccc

SEQ ID NO: 1340172 - DNA, 21 bp, Homo sapiens
ctgccctggctgctgccccca

SEQ ID NO: 1340173 - DNA, 12 bp, Homo sapiens
ctgcccttgggc

SEQ ID NO: 1340174 - DNA, 19 bp, Homo sapiens
ctgccgccccctcctgaac

SEQ ID NO: 1340175 - DNA, 14 bp, Homo sapiens
ctgccggtttgaaa

SEQ ID NO: 1340176 - DNA, 18 bp, Homo sapiens
ctgccgtcaccaccaccc

SEQ ID NO: 1340177 - DNA, 19 bp, Homo sapiens
ctgccgtcaccaccacccc

SEQ ID NO: 1340178 - DNA, 17 bp, Homo sapiens
ctgccgtctctggagcg

SEQ ID NO: 1340179 - DNA, 17 bp, Homo sapiens
ctgccgtgccgcctgca

SEQ ID NO: 1340180 - DNA, 19 bp, Homo sapiens
ctgccgtgccgcctgcact

SEQ ID NO: 1340181 - DNA, 20 bp, Homo sapiens
ctgccgtggggccgccgcct

SEQ ID NO: 1340182 - DNA, 12 bp, Homo sapiens
ctgcctcccact

SEQ ID NO: 1340183 - DNA, 13 bp, Homo sapiens
ctgcctcttctct

SEQ ID NO: 1340184 - DNA, 14 bp, Homo sapiens
ctgcctcttctcta

SEQ ID NO: 1340185 - DNA, 15 bp, Homo sapiens
ctgcctcttctctac

SEQ ID NO: 1340186 - DNA, 19 bp, Homo sapiens
ctgcctctttccctaggaa

SEQ ID NO: 1340187 - DNA, 18 bp, Homo sapiens
ctgcctgccccgccccca

SEQ ID NO: 1340188 - DNA, 12 bp, Homo sapiens
ctgcctggcccc

SEQ ID NO: 1340189 - DNA, 19 bp, Homo sapiens
ctgcctggcccccaacctc

SEQ ID NO: 1340190 - DNA, 11 bp, Homo sapiens
ctgcctgggct

SEQ ID NO: 1340191 - DNA, 23 bp, Homo sapiens
ctgcctgggctgaccccggtggc

SEQ ID NO: 1340192 - DNA, 12 bp, Homo sapiens
ctgcctgtggcg

SEQ ID NO: 1340193 - DNA, 22 bp, Homo sapiens
ctgcctgtggcgccgtctccag

SEQ ID NO: 1340194 - DNA, 18 bp, Homo sapiens
ctgccttaaaaccaaaga

SEQ ID NO: 1340195 - DNA, 16 bp, Homo sapiens
ctgccttaagtgagga

SEQ ID NO: 1340196 - DNA, 16 bp, Homo sapiens
ctgccttccctagctt

SEQ ID NO: 1340197 - DNA, 17 bp, Homo sapiens
ctgccttccctagcttt

SEQ ID NO: 1340198 - DNA, 23 bp, Homo sapiens
ctgccttcgcttcttgcctctgt

SEQ ID NO: 1340199 - DNA, 15 bp, Homo sapiens
ctgccttggctcaga

SEQ ID NO: 1340200 - DNA, 17 bp, Homo sapiens
ctgccttggctcagaca

SEQ ID NO: 1340201 - DNA, 22 bp, Homo sapiens
ctgccttggctcagacatgttt

SEQ ID NO: 1340202 - DNA, 22 bp, Homo sapiens
ctgcgaagaccctcttgcccat

SEQ ID NO: 1340203 - DNA, 19 bp, Homo sapiens
ctgcgactttctgcctgga

SEQ ID NO: 1340204 - DNA, 13 bp, Homo sapiens
ctgcgcctttcct

SEQ ID NO: 1340205 - DNA, 18 bp, Homo sapiens
ctgcgctctctttgcaac

SEQ ID NO: 1340206 - DNA, 17 bp, Homo sapiens
ctgcggcgtacaggctg

SEQ ID NO: 1340207 - DNA, 17 bp, Homo sapiens
ctgcgtcctcctcacct

SEQ ID NO: 1340208 - DNA, 19 bp, Homo sapiens
ctgcgtcctcctcacctca

SEQ ID NO: 1340209 - DNA, 24 bp, Homo sapiens
ctgcgtcctcctcacctcatgccc

SEQ ID NO: 1340210 - DNA, 18 bp, Homo sapiens
ctgcgtctatcctgtgta

SEQ ID NO: 1340211 - DNA, 18 bp, Homo sapiens
ctgctagctagctcaact

SEQ ID NO: 1340212 - DNA, 18 bp, Homo sapiens
ctgctatatataaaacgg

SEQ ID NO: 1340213 - DNA, 19 bp, Homo sapiens
ctgctatttattttcctaa

SEQ ID NO: 1340214 - DNA, 15 bp, Homo sapiens
ctgctcaccgcccat

SEQ ID NO: 1340215 - DNA, 19 bp, Homo sapiens
ctgctcaccgcccatcagg

SEQ ID NO: 1340216 - DNA, 14 bp, Homo sapiens
ctgctccagctgtt

SEQ ID NO: 1340217 - DNA, 21 bp, Homo sapiens
ctgctgcagagcagtaaggga

SEQ ID NO: 1340218 - DNA, 14 bp, Homo sapiens
ctgctgcatgccct

SEQ ID NO: 1340219 - DNA, 15 bp, Homo sapiens
ctgctgcatgccctc

SEQ ID NO: 1340220 - DNA, 17 bp, Homo sapiens
ctgctgcatgccctctc

SEQ ID NO: 1340221 - DNA, 17 bp, Homo sapiens
ctgctgcctctttccct

SEQ ID NO: 1340222 - DNA, 20 bp, Homo sapiens
ctgctgcctctttccctagg

SEQ ID NO: 1340223 - DNA, 21 bp, Homo sapiens
ctgctgcctctttccctagga

SEQ ID NO: 1340224 - DNA, 13 bp, Homo sapiens
ctgctggggatcc

SEQ ID NO: 1340225 - DNA, 14 bp, Homo sapiens
ctgctggggatccc

SEQ ID NO: 1340226 - DNA, 18 bp, Homo sapiens
ctgctgggggcaactggc

SEQ ID NO: 1340227 - DNA, 14 bp, Homo sapiens
ctgctgtgcaacgg

SEQ ID NO: 1340228 - DNA, 21 bp, Homo sapiens
ctgcttcagtcccttccccat

SEQ ID NO: 1340229 - DNA, 15 bp, Homo sapiens
ctgcttcccttactt

SEQ ID NO: 1340230 - DNA, 13 bp, Homo sapiens
ctgcttcctcctg

SEQ ID NO: 1340231 - DNA, 14 bp, Homo sapiens
ctgcttcctcctgg

SEQ ID NO: 1340232 - DNA, 15 bp, Homo sapiens
ctgcttcctcctgga

SEQ ID NO: 1340233 - DNA, 14 bp, Homo sapiens
ctgcttctctgact

SEQ ID NO: 1340234 - DNA, 20 bp, Homo sapiens
ctgcttctctgacttctgcc

SEQ ID NO: 1340235 - DNA, 21 bp, Homo sapiens
ctgcttctctgacttctgcct

SEQ ID NO: 1340236 - DNA, 16 bp, Homo sapiens
ctgctttagacttgaa

SEQ ID NO: 1340237 - DNA, 14 bp, Homo sapiens
ctgctttctccttt

SEQ ID NO: 1340238 - DNA, 19 bp, Homo sapiens
ctgctttgaataaatgtgt

SEQ ID NO: 1340239 - DNA, 14 bp, Homo sapiens
ctgcttttctgccc

SEQ ID NO: 1340240 - DNA, 19 bp, Homo sapiens
ctgcttttctgccctggct

SEQ ID NO: 1340241 - DNA, 24 bp, Homo sapiens
ctgcttttctgccctggctgctgc

SEQ ID NO: 1340242 - DNA, 20 bp, Homo sapiens
ctggaaaggggagagcctgc

SEQ ID NO: 1340243 - DNA, 16 bp, Homo sapiens
ctggaacaaattattt

SEQ ID NO: 1340244 - DNA, 17 bp, Homo sapiens
ctggaattgccagctga

SEQ ID NO: 1340245 - DNA, 16 bp, Homo sapiens
ctggacagtatcccac

SEQ ID NO: 1340246 - DNA, 20 bp, Homo sapiens
ctggacagtatcccacatcc

SEQ ID NO: 1340247 - DNA, 12 bp, Homo sapiens
ctggaccccagc

SEQ ID NO: 1340248 - DNA, 16 bp, Homo sapiens
ctggacccttataaaa

SEQ ID NO: 1340249 - DNA, 14 bp, Homo sapiens
ctggacggcaggct

SEQ ID NO: 1340250 - DNA, 22 bp, Homo sapiens
ctggacggcaggctcactgcca

SEQ ID NO: 1340251 - DNA, 20 bp, Homo sapiens
ctggacttctacctgccctc

SEQ ID NO: 1340252 - DNA, 23 bp, Homo sapiens
ctggacttctacctgccctcaag

SEQ ID NO: 1340253 - DNA, 16 bp, Homo sapiens
ctggagatcctcctgc

SEQ ID NO: 1340254 - DNA, 20 bp, Homo sapiens
ctggagatcctcctgcagac

SEQ ID NO: 1340255 - DNA, 23 bp, Homo sapiens
ctggagatcctcctgcagaccac

SEQ ID NO: 1340256 - DNA, 16 bp, Homo sapiens
ctggaggttgaagcca

SEQ ID NO: 1340257 - DNA, 15 bp, Homo sapiens
ctggagtctcctgag

SEQ ID NO: 1340258 - DNA, 18 bp, Homo sapiens
cttccaggaaactccaca

SEQ ID NO: 1340259 - DNA, 21 bp, Homo sapiens
cttccaggaaactccacatct

SEQ ID NO: 1340260 - DNA, 16 bp, Homo sapiens
cttccagtataaccag

SEQ ID NO: 1340261 - DNA, 19 bp, Homo sapiens
cttccatgaattttaaaat

SEQ ID NO: 1340262 - DNA, 20 bp, Homo sapiens
cttccatgaattttaaaatc

SEQ ID NO: 1340263 - DNA, 15 bp, Homo sapiens
cttccattccacaca

SEQ ID NO: 1340264 - DNA, 22 bp, Homo sapiens
cttccattccacacagaatgca

SEQ ID NO: 1340265 - DNA, 18 bp, Homo sapiens
cttcccatgcattctggt

SEQ ID NO: 1340266 - DNA, 20 bp, Homo sapiens
cttccccccaaaacccggga

SEQ ID NO: 1340267 - DNA, 21 bp, Homo sapiens
cttccctagctttagaccctg

SEQ ID NO: 1340268 - DNA, 15 bp, Homo sapiens
cttccgcagtgtggc

SEQ ID NO: 1340269 - DNA, 21 bp, Homo sapiens
cttccgcagtgtggccaggct

SEQ ID NO: 1340270 - DNA, 22 bp, Homo sapiens
cttcctcaaaataaagaagtat

SEQ ID NO: 1340271 - DNA, 12 bp, Homo sapiens
cttcctcctgga

SEQ ID NO: 1340272 - DNA, 13 bp, Homo sapiens
cttcctcctggaa

SEQ ID NO: 1340273 - DNA, 19 bp, Homo sapiens
cttcctctagaagccaagg

SEQ ID NO: 1340274 - DNA, 18 bp, Homo sapiens
cttcctcttgtctgattt

SEQ ID NO: 1340275 - DNA, 17 bp, Homo sapiens
cttcctgaaactatatt

SEQ ID NO: 1340276 - DNA, 21 bp, Homo sapiens
cttcctgcgtcctcctcacct

SEQ ID NO: 1340277 - DNA, 22 bp, Homo sapiens
cttccttgaagaactgcaggcc

SEQ ID NO: 1340278 - DNA, 14 bp, Homo sapiens
cttccttttaactg

SEQ ID NO: 1340279 - DNA, 15 bp, Homo sapiens
cttccttttccctgc

SEQ ID NO: 1340280 - DNA, 22 bp, Homo sapiens
cttccttttccctgcttccagg

SEQ ID NO: 1340281 - DNA, 21 bp, Homo sapiens
cttcgcttcttgcctctgtgc

SEQ ID NO: 1340282 - DNA, 22 bp, Homo sapiens
cttcgtctttcccatggggagg

SEQ ID NO: 1340283 - DNA, 13 bp, Homo sapiens
cttctaaaaactt

SEQ ID NO: 1340284 - DNA, 12 bp, Homo sapiens
cttctacctgcc

SEQ ID NO: 1340285 - DNA, 14 bp, Homo sapiens
cttctacctgccct

SEQ ID NO: 1340286 - DNA, 19 bp, Homo sapiens
cttctacctgccctcaagg

SEQ ID NO: 1340287 - DNA, 18 bp, Homo sapiens
cttctatagcatcactta

SEQ ID NO: 1340288 - DNA, 17 bp, Homo sapiens
cttctcagaagcacaga

SEQ ID NO: 1340289 - DNA, 22 bp, Homo sapiens
cttctcagaagcacagaatatt

SEQ ID NO: 1340290 - DNA, 16 bp, Homo sapiens
cttctcagagtggtgg

SEQ ID NO: 1340291 - DNA, 22 bp, Homo sapiens
cttctcagatttctgaggaaat

SEQ ID NO: 1340292 - DNA, 19 bp, Homo sapiens
cttctccctagctcctccc

SEQ ID NO: 1340293 - DNA, 14 bp, Homo sapiens
cttctccgccagcc

SEQ ID NO: 1340294 - DNA, 18 bp, Homo sapiens
cttctccgccagcctcct

SEQ ID NO: 1340295 - DNA, 23 bp, Homo sapiens
cttctccgccagcctcctctgga

SEQ ID NO: 1340296 - DNA, 24 bp, Homo sapiens
cttctccgccagcctcctctggac

SEQ ID NO: 1340297 - DNA, 23 bp, Homo sapiens
cttctcctacatatcccttccag

SEQ ID NO: 1340298 - DNA, 15 bp, Homo sapiens
cttctctcctcccca

SEQ ID NO: 1340299 - DNA, 12 bp, Homo sapiens
cttctctgactt

SEQ ID NO: 1340300 - DNA, 22 bp, Homo sapiens
cttctctgacttctgcctggag

SEQ ID NO: 1340301 - DNA, 15 bp, Homo sapiens
cttctctgtgagaag

SEQ ID NO: 1340302 - DNA, 22 bp, Homo sapiens
cttctcttccttttatcagtag

SEQ ID NO: 1340303 - DNA, 18 bp, Homo sapiens
cttctgcaacaagcatgc

SEQ ID NO: 1340304 - DNA, 20 bp, Homo sapiens
cttctgccatttctgagatc

SEQ ID NO: 1340305 - DNA, 14 bp, Homo sapiens
cttctgcctggaga

SEQ ID NO: 1340306 - DNA, 15 bp, Homo sapiens
cttctgcctggagac

SEQ ID NO: 1340307 - DNA, 18 bp, Homo sapiens
cttctgcttttctgccct

SEQ ID NO: 1340308 - DNA, 22 bp, Homo sapiens
cttctgcttttctgccctggct

SEQ ID NO: 1340309 - DNA, 14 bp, Homo sapiens
cttctggggcaggc

SEQ ID NO: 1340310 - DNA, 20 bp, Homo sapiens
cttctggggcaggctgggcc

SEQ ID NO: 1340311 - DNA, 21 bp, Homo sapiens
cttctggggcaggctgggcca

SEQ ID NO: 1340312 - DNA, 15 bp, Homo sapiens
cttctggtactttct

SEQ ID NO: 1340313 - DNA, 22 bp, Homo sapiens
cttctgtatttttttttctaag

SEQ ID NO: 1340314 - DNA, 15 bp, Homo sapiens
cttctgtgatgagct

SEQ ID NO: 1340315 - DNA, 17 bp, Homo sapiens
cttctgtgatgagctga

SEQ ID NO: 1340316 - DNA, 19 bp, Homo sapiens
cttctgtgatgagctgatc

SEQ ID NO: 1340317 - DNA, 14 bp, Homo sapiens
cttctgtgcccaga

SEQ ID NO: 1340318 - DNA, 19 bp, Homo sapiens
cttctgtgcccagaatact

SEQ ID NO: 1340319 - DNA, 20 bp, Homo sapiens
cttctgtgcccagaatactg

SEQ ID NO: 1340320 - DNA, 14 bp, Homo sapiens
cttcttaaagtatt

SEQ ID NO: 1340321 - DNA, 15 bp, Homo sapiens
cttcttctcaaagca

SEQ ID NO: 1340322 - DNA, 12 bp, Homo sapiens
cttcttctccat

SEQ ID NO: 1340323 - DNA, 18 bp, Homo sapiens
cttcttgcctctgtgctg

SEQ ID NO: 1340324 - DNA, 22 bp, Homo sapiens
cttcttggggcccagtgcatgg

SEQ ID NO: 1340325 - DNA, 20 bp, Homo sapiens
cttcttttttcaaaagaaag

SEQ ID NO: 1340326 - DNA, 14 bp, Homo sapiens
cttgaaccataaaa

SEQ ID NO: 1340327 - DNA, 13 bp, Homo sapiens
cttgaagccaaag

SEQ ID NO: 1340328 - DNA, 14 bp, Homo sapiens
cttgaagccaaaga

SEQ ID NO: 1340329 - DNA, 16 bp, Homo sapiens
cttgaagccaaagaaa

SEQ ID NO: 1340330 - DNA, 23 bp, Homo sapiens
cttgaatccttccattccacaca

SEQ ID NO: 1340331 - DNA, 21 bp, Homo sapiens
cttgaccaggctgcctccctt

SEQ ID NO: 1340332 - DNA, 17 bp, Homo sapiens
cttgaccaggcttggcc

SEQ ID NO: 1340333 - DNA, 14 bp, Homo sapiens
cttgacctgaggct

SEQ ID NO: 1340334 - DNA, 23 bp, Homo sapiens
cttgacctgaggctgtggtcaca

SEQ ID NO: 1340335 - DNA, 14 bp, Homo sapiens
cttgagagggtgga

SEQ ID NO: 1340336 - DNA, 14 bp, Homo sapiens
cttgagccctggct

SEQ ID NO: 1340337 - DNA, 19 bp, Homo sapiens
cttgagccgggcccctggg

SEQ ID NO: 1340338 - DNA, 20 bp, Homo sapiens
cttgagccgggcccctgggc

SEQ ID NO: 1340339 - DNA, 16 bp, Homo sapiens
cttgagctggcctctc

SEQ ID NO: 1340340 - DNA, 23 bp, Homo sapiens
cttgagctggcctctctagcaca

SEQ ID NO: 1340341 - DNA, 17 bp, Homo sapiens
cttgaggcctgatctgc

SEQ ID NO: 1340342 - DNA, 15 bp, Homo sapiens
cttgagggctgcagt

SEQ ID NO: 1340343 - DNA, 18 bp, Homo sapiens
cttgagttgattcagctc

SEQ ID NO: 1340344 - DNA, 21 bp, Homo sapiens
cttgagttgtttttgtatatt

SEQ ID NO: 1340345 - DNA, 16 bp, Homo sapiens
cttgattcagtcacat

SEQ ID NO: 1340346 - DNA, 17 bp, Homo sapiens
cttgattcccttgttat

SEQ ID NO: 1340347 - DNA, 23 bp, Homo sapiens
cttgatttcaaagttttgttgta

SEQ ID NO: 1340348 - DNA, 18 bp, Homo sapiens
cttgcaccaaattatctt

SEQ ID NO: 1340349 - DNA, 14 bp, Homo sapiens
cttgcagaactgta

SEQ ID NO: 1340350 - DNA, 12 bp, Homo sapiens
cttgcatgtggt

SEQ ID NO: 1340351 - DNA, 13 bp, Homo sapiens
cttgccagagccg

SEQ ID NO: 1340352 - DNA, 13 bp, Homo sapiens
cttgcctccaggt

SEQ ID NO: 1340353 - DNA, 18 bp, Homo sapiens
cttgcctccaggtgcaga

SEQ ID NO: 1340354 - DNA, 20 bp, Homo sapiens
cttgcctccccatttcccat

SEQ ID NO: 1340355 - DNA, 15 bp, Homo sapiens
cttgcctctgtgctg

SEQ ID NO: 1340356 - DNA, 19 bp, Homo sapiens
cttgcctctgtgctgtgtg

SEQ ID NO: 1340357 - DNA, 14 bp, Homo sapiens
cttgcctgcagggc

SEQ ID NO: 1340358 - DNA, 16 bp, Homo sapiens
cttgcctgggtcacac

SEQ ID NO: 1340359 - DNA, 23 bp, Homo sapiens
cttgccttaaacactcaccttct

SEQ ID NO: 1340360 - DNA, 14 bp, Homo sapiens
cttgctggccccag

SEQ ID NO: 1340361 - DNA, 13 bp, Homo sapiens
cttgcttaaattt

SEQ ID NO: 1340362 - DNA, 16 bp, Homo sapiens
cttgcttaaatttctt

SEQ ID NO: 1340363 - DNA, 22 bp, Homo sapiens
cttgcttaaatttcttatgtga

SEQ ID NO: 1340364 - DNA, 19 bp, Homo sapiens
cttgcttgcctgcagggcc

SEQ ID NO: 1340365 - DNA, 16 bp, Homo sapiens
cttggaaattcctgta

SEQ ID NO: 1340366 - DNA, 20 bp, Homo sapiens
cttggaaattcctgtactgt

SEQ ID NO: 1340367 - DNA, 15 bp, Homo sapiens
cttggacatcctcct

SEQ ID NO: 1340368 - DNA, 16 bp, Homo sapiens
cttggacatcctcctc

SEQ ID NO: 1340369 - DNA, 13 bp, Homo sapiens
cttggagaaatga

SEQ ID NO: 1340370 - DNA, 15 bp, Homo sapiens
cttggagaaatgaaa

SEQ ID NO: 1340371 - DNA, 21 bp, Homo sapiens
cttggcaataaattttgaaaa

SEQ ID NO: 1340372 - DNA, 23 bp, Homo sapiens
cttggcaataaattttgaaaagt

SEQ ID NO: 1340373 - DNA, 20 bp, Homo sapiens
cttggcacttattgaatata

SEQ ID NO: 1340374 - DNA, 13 bp, Homo sapiens
cttggcctgggcc

SEQ ID NO: 1340375 - DNA, 14 bp, Homo sapiens
cttggccttgggct

SEQ ID NO: 1340376 - DNA, 19 bp, Homo sapiens
gaagtatttttagaataag

SEQ ID NO: 1340377 - DNA, 15 bp, Homo sapiens
gaagtgaatgctggg

SEQ ID NO: 1340378 - DNA, 16 bp, Homo sapiens
gaagtgcccttcctgc

SEQ ID NO: 1340379 - DNA, 16 bp, Homo sapiens
gaagtgtttatgttgt

SEQ ID NO: 1340380 - DNA, 16 bp, Homo sapiens
gaagttagtttgtata

SEQ ID NO: 1340381 - DNA, 17 bp, Homo sapiens
gaagttagtttgtatat

SEQ ID NO: 1340382 - DNA, 20 bp, Homo sapiens
gaagtttgagatcagcctgg

SEQ ID NO: 1340383 - DNA, 16 bp, Homo sapiens
gaataagttattgcag

SEQ ID NO: 1340384 - DNA, 18 bp, Homo sapiens
gaataagttattgcagtt

SEQ ID NO: 1340385 - DNA, 16 bp, Homo sapiens
gaataccacatcaaat

SEQ ID NO: 1340386 - DNA, 14 bp, Homo sapiens
gaatactgcttgaa

SEQ ID NO: 1340387 - DNA, 14 bp, Homo sapiens
gaatacttgaacca

SEQ ID NO: 1340388 - DNA, 19 bp, Homo sapiens
gaatagacatcaaactcaa

SEQ ID NO: 1340389 - DNA, 22 bp, Homo sapiens
gaatatacatgaagaatagaaa

SEQ ID NO: 1340390 - DNA, 19 bp, Homo sapiens
gaatatcctttaaaattta

SEQ ID NO: 1340391 - DNA, 19 bp, Homo sapiens
gaatatgattaaaaatatc

SEQ ID NO: 1340392 - DNA, 16 bp, Homo sapiens
gaatatgcaacattgt

SEQ ID NO: 1340393 - DNA, 13 bp, Homo sapiens
gaatatggacata

SEQ ID NO: 1340394 - DNA, 19 bp, Homo sapiens
gaatatgtagtatctatat

SEQ ID NO: 1340395 - DNA, 23 bp, Homo sapiens
gaatatgtagtatctatatgact

SEQ ID NO: 1340396 - DNA, 14 bp, Homo sapiens
gaatattgcaaaat

SEQ ID NO: 1340397 - DNA, 18 bp, Homo sapiens
gaatattgcaaaatacat

SEQ ID NO: 1340398 - DNA, 14 bp, Homo sapiens
gaatcaaaagtgcc

SEQ ID NO: 1340399 - DNA, 15 bp, Homo sapiens
gaatcaaaagtgcct

SEQ ID NO: 1340400 - DNA, 18 bp, Homo sapiens
gaatcattcagaaatgtt

SEQ ID NO: 1340401 - DNA, 15 bp, Homo sapiens
gaatccaagcctcca

SEQ ID NO: 1340402 - DNA, 16 bp, Homo sapiens
gaatcctggcagccca

SEQ ID NO: 1340403 - DNA, 13 bp, Homo sapiens
gaatctctgtgcc

SEQ ID NO: 1340404 - DNA, 12 bp, Homo sapiens
gaatctggagac

SEQ ID NO: 1340405 - DNA, 16 bp, Homo sapiens
gaatgaggaaaattct

SEQ ID NO: 1340406 - DNA, 23 bp, Homo sapiens
gaatgaggaaaattcttaaaagg

SEQ ID NO: 1340407 - DNA, 21 bp, Homo sapiens
gaatgagtctgttgtgtgtca

SEQ ID NO: 1340408 - DNA, 20 bp, Homo sapiens
gaatgatgatcctaggcatt

SEQ ID NO: 1340409 - DNA, 14 bp, Homo sapiens
gaatgatttgcata

SEQ ID NO: 1340410 - DNA, 14 bp, Homo sapiens
gaatgctgggactc

SEQ ID NO: 1340411 - DNA, 19 bp, Homo sapiens
gaatgctgggactcagcct

SEQ ID NO: 1340412 - DNA, 14 bp, Homo sapiens
gaattaaaaaagca

SEQ ID NO: 1340413 - DNA, 19 bp, Homo sapiens
gaattacgtgctctgtggg

SEQ ID NO: 1340414 - DNA, 15 bp, Homo sapiens
gaattatttttcact

SEQ ID NO: 1340415 - DNA, 14 bp, Homo sapiens
gaattgaagcagga

SEQ ID NO: 1340416 - DNA, 12 bp, Homo sapiens
gaattgtggcta

SEQ ID NO: 1340417 - DNA, 20 bp, Homo sapiens
gaatttaaagaaaaaaatgt

SEQ ID NO: 1340418 - DNA, 10 bp, Homo sapiens
gaatttgcat

SEQ ID NO: 1340419 - DNA, 18 bp, Homo sapiens
gaatttgcatacttacct

SEQ ID NO: 1340420 - DNA, 18 bp, Homo sapiens
gacaaaaaatgttttaaa

SEQ ID NO: 1340421 - DNA, 12 bp, Homo sapiens
gacaaagtgcca

SEQ ID NO: 1340422 - DNA, 14 bp, Homo sapiens
gacaagagatggga

SEQ ID NO: 1340423 - DNA, 22 bp, Homo sapiens
gacaataaaccctcagagcctc

SEQ ID NO: 1340424 - DNA, 19 bp, Homo sapiens
gacaataaagcttgttgac

SEQ ID NO: 1340425 - DNA, 12 bp, Homo sapiens
gacaatgtgaaa

SEQ ID NO: 1340426 - DNA, 20 bp, Homo sapiens
gacaatgtgaaaagaaaaat

SEQ ID NO: 1340427 - DNA, 22 bp, Homo sapiens
gacacaagtggaccttaggcct

SEQ ID NO: 1340428 - DNA, 15 bp, Homo sapiens
gacactccagggaca

SEQ ID NO: 1340429 - DNA, 12 bp, Homo sapiens
gacactgcctgg

SEQ ID NO: 1340430 - DNA, 14 bp, Homo sapiens
gacagaaggtgcca

SEQ ID NO: 1340431 - DNA, 17 bp, Homo sapiens
gacagatacctccaacc

SEQ ID NO: 1340432 - DNA, 21 bp, Homo sapiens
gacagatacctccaaccctgc

SEQ ID NO: 1340433 - DNA, 21 bp, Homo sapiens
gacaggagacctggcactgga

SEQ ID NO: 1340434 - DNA, 15 bp, Homo sapiens
gacatcacagggtgg

SEQ ID NO: 1340435 - DNA, 16 bp, Homo sapiens
gacatcacagggtggg

SEQ ID NO: 1340436 - DNA, 19 bp, Homo sapiens
gacatcacagggtgggcct

SEQ ID NO: 1340437 - DNA, 18 bp, Homo sapiens
gacatctggaatctggag

SEQ ID NO: 1340438 - DNA, 15 bp, Homo sapiens
gacatcttgaatcct

SEQ ID NO: 1340439 - DNA, 20 bp, Homo sapiens
gacatgcaataaaatttaaa

SEQ ID NO: 1340440 - DNA, 14 bp, Homo sapiens
gacatggtgcctga

SEQ ID NO: 1340441 - DNA, 19 bp, Homo sapiens
gacatggtgcctgagaggc

SEQ ID NO: 1340442 - DNA, 20 bp, Homo sapiens
gacatggtgcctgagaggca

SEQ ID NO: 1340443 - DNA, 22 bp, Homo sapiens
gacatggtgcctgagaggcagg

SEQ ID NO: 1340444 - DNA, 14 bp, Homo sapiens
gaccaactgtcact

SEQ ID NO: 1340445 - DNA, 15 bp, Homo sapiens
gaccaagcatcttgg

SEQ ID NO: 1340446 - DNA, 20 bp, Homo sapiens
gaccaagcatcttggggggg

SEQ ID NO: 1340447 - DNA, 14 bp, Homo sapiens
gaccaccctgagcc

SEQ ID NO: 1340448 - DNA, 19 bp, Homo sapiens
gaccacgcccgtcctgcct

SEQ ID NO: 1340449 - DNA, 19 bp, Homo sapiens
gaccagaggagccttttta

SEQ ID NO: 1340450 - DNA, 21 bp, Homo sapiens
gaccagctgctccgaggaccc

SEQ ID NO: 1340451 - DNA, 23 bp, Homo sapiens
gaccagctgctccgaggacccag

SEQ ID NO: 1340452 - DNA, 20 bp, Homo sapiens
gaccaggatcccaagcctcc

SEQ ID NO: 1340453 - DNA, 19 bp, Homo sapiens
gaccaggccattctgccgc

SEQ ID NO: 1340454 - DNA, 22 bp, Homo sapiens
gaccagggagcctttggttctg

SEQ ID NO: 1340455 - DNA, 12 bp, Homo sapiens
gaccatcctggc

SEQ ID NO: 1340456 - DNA, 12 bp, Homo sapiens
gaccatgtggcc

SEQ ID NO: 1340457 - DNA, 16 bp, Homo sapiens
gacccagggttcccgc

SEQ ID NO: 1340458 - DNA, 14 bp, Homo sapiens
gacccagtgcagaa

SEQ ID NO: 1340459 - DNA, 13 bp, Homo sapiens
gacccattgctgt

SEQ ID NO: 1340460 - DNA, 16 bp, Homo sapiens
gacccgacctggccgc

SEQ ID NO: 1340461 - DNA, 18 bp, Homo sapiens
gacccggaggccgaggcc

SEQ ID NO: 1340462 - DNA, 14 bp, Homo sapiens
gaccctctaacctc

SEQ ID NO: 1340463 - DNA, 20 bp, Homo sapiens
gaccctcttgcccatcctga

SEQ ID NO: 1340464 - DNA, 18 bp, Homo sapiens
gaccctgggtgggctctg

SEQ ID NO: 1340465 - DNA, 23 bp, Homo sapiens
gaccctgtctcaaaaaaagaaaa

SEQ ID NO: 1340466 - DNA, 21 bp, Homo sapiens
gaccctgtgacatggtgcctg

SEQ ID NO: 1340467 - DNA, 17 bp, Homo sapiens
gacccttataaaatcct

SEQ ID NO: 1340468 - DNA, 18 bp, Homo sapiens
gaccgcccttttccccta

SEQ ID NO: 1340469 - DNA, 20 bp, Homo sapiens
gaccggcggaccccagccat

SEQ ID NO: 1340470 - DNA, 20 bp, Homo sapiens
gacctccacacccgtgagaa

SEQ ID NO: 1340471 - DNA, 14 bp, Homo sapiens
gacctgaggctgtg

SEQ ID NO: 1340472 - DNA, 15 bp, Homo sapiens
gacctgccaggcagg

SEQ ID NO: 1340473 - DNA, 16 bp, Homo sapiens
gacctgccaggcaggg

SEQ ID NO: 1340474 - DNA, 18 bp, Homo sapiens
gacctgccaggcaggggt

SEQ ID NO: 1340475 - DNA, 20 bp, Homo sapiens
gacctgccaggcaggggtgg

SEQ ID NO: 1340476 - DNA, 20 bp, Homo sapiens
gacctggaagaacaggcctc

SEQ ID NO: 1340477 - DNA, 20 bp, Homo sapiens
gacctggcatctaattctga

SEQ ID NO: 1340478 - DNA, 21 bp, Homo sapiens
gacctgtatatttgtaaagct

SEQ ID NO: 1340479 - DNA, 18 bp, Homo sapiens
gaccttgtaaaagacagt

SEQ ID NO: 1340480 - DNA, 16 bp, Homo sapiens
gaccttgttacttctg

SEQ ID NO: 1340481 - DNA, 18 bp, Homo sapiens
gacctttccaccacagcc

SEQ ID NO: 1340482 - DNA, 17 bp, Homo sapiens
gacgagttgatttcctc

SEQ ID NO: 1340483 - DNA, 17 bp, Homo sapiens
gacgccactcatttcat

SEQ ID NO: 1340484 - DNA, 19 bp, Homo sapiens
gacgccactcatttcatct

SEQ ID NO: 1340485 - DNA, 23 bp, Homo sapiens
gacgccactcatttcatctcatt

SEQ ID NO: 1340486 - DNA, 22 bp, Homo sapiens
gacgccatgtgatggacactcc

SEQ ID NO: 1340487 - DNA, 16 bp, Homo sapiens
gacggcaggctcactg

SEQ ID NO: 1340488 - DNA, 20 bp, Homo sapiens
gacggcaggctcactgccag

SEQ ID NO: 1340489 - DNA, 18 bp, Homo sapiens
gacggtgcccaagccaga

SEQ ID NO: 1340490 - DNA, 15 bp, Homo sapiens
gacggtttccaggga

SEQ ID NO: 1340491 - DNA, 18 bp, Homo sapiens
gacgtacaagtagttctg

SEQ ID NO: 1340492 - DNA, 15 bp, Homo sapiens
gactaattaggcaag

SEQ ID NO: 1340493 - DNA, 18 bp, Homo sapiens
gactatatatataaatgt

SEQ ID NO: 1340494 - DNA, 13 bp, Homo sapiens
gcagagctggctc

SEQ ID NO: 1340495 - DNA, 14 bp, Homo sapiens
gcagagctggctct

SEQ ID NO: 1340496 - DNA, 15 bp, Homo sapiens
gcagagctggctctg

SEQ ID NO: 1340497 - DNA, 16 bp, Homo sapiens
gcagaggaccagggcc

SEQ ID NO: 1340498 - DNA, 17 bp, Homo sapiens
gcagaggaccagggcct

SEQ ID NO: 1340499 - DNA, 14 bp, Homo sapiens
gcagaggtaccctg

SEQ ID NO: 1340500 - DNA, 15 bp, Homo sapiens
gcagaggtaccctgg

SEQ ID NO: 1340501 - DNA, 17 bp, Homo sapiens
gcagaggtaccctgggt

SEQ ID NO: 1340502 - DNA, 18 bp, Homo sapiens
gcagaggtaccctgggtg

SEQ ID NO: 1340503 - DNA, 19 bp, Homo sapiens
gcagaggtaccctgggtgt

SEQ ID NO: 1340504 - DNA, 12 bp, Homo sapiens
gcagagttttca

SEQ ID NO: 1340505 - DNA, 14 bp, Homo sapiens
gcagagttttcatt

SEQ ID NO: 1340506 - DNA, 19 bp, Homo sapiens
gcagagttttcattaaatc

SEQ ID NO: 1340507 - DNA, 16 bp, Homo sapiens
gcagatgccaccctag

SEQ ID NO: 1340508 - DNA, 18 bp, Homo sapiens
gcagatgttagatatttt

SEQ ID NO: 1340509 - DNA, 20 bp, Homo sapiens
gcagcaccgaggggcctttg

SEQ ID NO: 1340510 - DNA, 14 bp, Homo sapiens
gcagccaacctaag

SEQ ID NO: 1340511 - DNA, 18 bp, Homo sapiens
gcagcccacccctcaaca

SEQ ID NO: 1340512 - DNA, 20 bp, Homo sapiens
gcagcccaccctgctgctgg

SEQ ID NO: 1340513 - DNA, 14 bp, Homo sapiens
gcagcccagagact

SEQ ID NO: 1340514 - DNA, 14 bp, Homo sapiens
gcagccccagcctg

SEQ ID NO: 1340515 - DNA, 15 bp, Homo sapiens
gcagccccagcctgc

SEQ ID NO: 1340516 - DNA, 16 bp, Homo sapiens
gcagccccagcctgct

SEQ ID NO: 1340517 - DNA, 20 bp, Homo sapiens
gcagcctctcagtgccctcc

SEQ ID NO: 1340518 - DNA, 20 bp, Homo sapiens
gcagcctctccccaggtcca

SEQ ID NO: 1340519 - DNA, 20 bp, Homo sapiens
gcaggcacgggtggtccccg

SEQ ID NO: 1340520 - DNA, 15 bp, Homo sapiens
gcaggcatggccctg

SEQ ID NO: 1340521 - DNA, 15 bp, Homo sapiens
gcaggctcactgcca

SEQ ID NO: 1340522 - DNA, 17 bp, Homo sapiens
gcaggctcactgccagg

SEQ ID NO: 1340523 - DNA, 18 bp, Homo sapiens
gcaggctcactgccaggc

SEQ ID NO: 1340524 - DNA, 16 bp, Homo sapiens
gcaggctcccctgagg

SEQ ID NO: 1340525 - DNA, 10 bp, Homo sapiens
gcaggctggg

SEQ ID NO: 1340526 - DNA, 12 bp, Homo sapiens
gcaggctgggcc

SEQ ID NO: 1340527 - DNA, 23 bp, Homo sapiens
gcaggctgggccatgtccaaaga

SEQ ID NO: 1340528 - DNA, 22 bp, Homo sapiens
gcagggagctgggcccgacatg

SEQ ID NO: 1340529 - DNA, 16 bp, Homo sapiens
gcagggagggcttctg

SEQ ID NO: 1340530 - DNA, 23 bp, Homo sapiens
gcaggggtgggggtggaggcttc

SEQ ID NO: 1340531 - DNA, 23 bp, Homo sapiens
gcaggtgatctgctgcagagcag

SEQ ID NO: 1340532 - DNA, 15 bp, Homo sapiens
gcagtaagtcttttt

SEQ ID NO: 1340533 - DNA, 18 bp, Homo sapiens
gcagtaagtcttttttga

SEQ ID NO: 1340534 - DNA, 23 bp, Homo sapiens
gcagtcactggaggttgaagcca

SEQ ID NO: 1340535 - DNA, 15 bp, Homo sapiens
gcagtcgtgcctgtg

SEQ ID NO: 1340536 - DNA, 18 bp, Homo sapiens
gcagtcgtgcctgtgtcc

SEQ ID NO: 1340537 - DNA, 19 bp, Homo sapiens
gcagtcgtgcctgtgtcca

SEQ ID NO: 1340538 - DNA, 15 bp, Homo sapiens
gcagtgttttgcaag

SEQ ID NO: 1340539 - DNA, 22 bp, Homo sapiens
gcagttagctgaagaattgaaa

SEQ ID NO: 1340540 - DNA, 18 bp, Homo sapiens
gcagttgctggtaaaatg

SEQ ID NO: 1340541 - DNA, 19 bp, Homo sapiens
gcagtttgaggattagttt

SEQ ID NO: 1340542 - DNA, 17 bp, Homo sapiens
gcataatttaaaaatat

SEQ ID NO: 1340543 - DNA, 23 bp, Homo sapiens
gcatagataatattgtttggtaa

SEQ ID NO: 1340544 - DNA, 17 bp, Homo sapiens
gcatagtttctttattt

SEQ ID NO: 1340545 - DNA, 19 bp, Homo sapiens
gcatataatgaataaatca

SEQ ID NO: 1340546 - DNA, 16 bp, Homo sapiens
gcatatgaaaggagag

SEQ ID NO: 1340547 - DNA, 19 bp, Homo sapiens
gcatatttgcaaagtgtat

SEQ ID NO: 1340548 - DNA, 13 bp, Homo sapiens
gcatcatgcatgt

SEQ ID NO: 1340549 - DNA, 21 bp, Homo sapiens
gcatccctaccgacccagggt

SEQ ID NO: 1340550 - DNA, 15 bp, Homo sapiens
gcatctttgatgtgt

SEQ ID NO: 1340551 - DNA, 21 bp, Homo sapiens
gcatgagactcagtgcagatg

SEQ ID NO: 1340552 - DNA, 16 bp, Homo sapiens
gcatgcaaatgagctc

SEQ ID NO: 1340553 - DNA, 14 bp, Homo sapiens
gcatgcagctttgc

SEQ ID NO: 1340554 - DNA, 19 bp, Homo sapiens
gcatggaaatcagccaagt

SEQ ID NO: 1340555 - DNA, 13 bp, Homo sapiens
gcatggtggccag

SEQ ID NO: 1340556 - DNA, 19 bp, Homo sapiens
gcatggttttgtgccatct

SEQ ID NO: 1340557 - DNA, 18 bp, Homo sapiens
gcatgtagaggcttgttt

SEQ ID NO: 1340558 - DNA, 15 bp, Homo sapiens
gcatgtcttttaaaa

SEQ ID NO: 1340559 - DNA, 17 bp, Homo sapiens
gcatgtcttttaaaatg

SEQ ID NO: 1340560 - DNA, 13 bp, Homo sapiens
gcatgttatgttt

SEQ ID NO: 1340561 - DNA, 18 bp, Homo sapiens
gcatgttatgtttaataa

SEQ ID NO: 1340562 - DNA, 21 bp, Homo sapiens
gcatgttcacccttatagtct

SEQ ID NO: 1340563 - DNA, 15 bp, Homo sapiens
gcatgttttgttgct

SEQ ID NO: 1340564 - DNA, 17 bp, Homo sapiens
gcattcatttttatagc

SEQ ID NO: 1340565 - DNA, 15 bp, Homo sapiens
gcattccagcccctc

SEQ ID NO: 1340566 - DNA, 17 bp, Homo sapiens
gcattgccatgtggaag

SEQ ID NO: 1340567 - DNA, 22 bp, Homo sapiens
gcattgtaagcgtatggcttta

SEQ ID NO: 1340568 - DNA, 16 bp, Homo sapiens
gcatttagctggccac

SEQ ID NO: 1340569 - DNA, 18 bp, Homo sapiens
gcatttagggagtattct

SEQ ID NO: 1340570 - DNA, 14 bp, Homo sapiens
gcatttgctgaata

SEQ ID NO: 1340571 - DNA, 17 bp, Homo sapiens
gcatttgtgctagaaat

SEQ ID NO: 1340572 - DNA, 14 bp, Homo sapiens
gcattttcccagat

SEQ ID NO: 1340573 - DNA, 14 bp, Homo sapiens
gcatttttgtaaat

SEQ ID NO: 1340574 - DNA, 19 bp, Homo sapiens
gccaaagcctcctccagcc

SEQ ID NO: 1340575 - DNA, 15 bp, Homo sapiens
gccaagaatattgca

SEQ ID NO: 1340576 - DNA, 18 bp, Homo sapiens
gccaagaatattgcaaaa

SEQ ID NO: 1340577 - DNA, 23 bp, Homo sapiens
gccaagaatattgcaaaatacat

SEQ ID NO: 1340578 - DNA, 18 bp, Homo sapiens
gccaagggaacctgtgtc

SEQ ID NO: 1340579 - DNA, 20 bp, Homo sapiens
gccaagggcccaaagaaaga

SEQ ID NO: 1340580 - DNA, 21 bp, Homo sapiens
gccaagggccgactaagagaa

SEQ ID NO: 1340581 - DNA, 15 bp, Homo sapiens
gccaaggtgggagga

SEQ ID NO: 1340582 - DNA, 16 bp, Homo sapiens
gccaagtaagaaagtg

SEQ ID NO: 1340583 - DNA, 15 bp, Homo sapiens
gccacagcgccagcc

SEQ ID NO: 1340584 - DNA, 18 bp, Homo sapiens
gccacagcgccagcctca

SEQ ID NO: 1340585 - DNA, 11 bp, Homo sapiens
gccacaggacc

SEQ ID NO: 1340586 - DNA, 15 bp, Homo sapiens
gccacagtagaactg

SEQ ID NO: 1340587 - DNA, 14 bp, Homo sapiens
gccaccaaagctgc

SEQ ID NO: 1340588 - DNA, 17 bp, Homo sapiens
gccaccaaagctgccca

SEQ ID NO: 1340589 - DNA, 15 bp, Homo sapiens
gccaccagctctgcc

SEQ ID NO: 1340590 - DNA, 22 bp, Homo sapiens
gccaccatgcctcactaatttt

SEQ ID NO: 1340591 - DNA, 12 bp, Homo sapiens
gccaccctagcc

SEQ ID NO: 1340592 - DNA, 21 bp, Homo sapiens
gccacgtgggcaaacaggcag

SEQ ID NO: 1340593 - DNA, 22 bp, Homo sapiens
gccacgttggagaagcccgtgt

SEQ ID NO: 1340594 - DNA, 15 bp, Homo sapiens
gccactcatttcatc

SEQ ID NO: 1340595 - DNA, 18 bp, Homo sapiens
gccactgccttcgcttct

SEQ ID NO: 1340596 - DNA, 13 bp, Homo sapiens
gccacttctaaga

SEQ ID NO: 1340597 - DNA, 18 bp, Homo sapiens
gccactttacccacctag

SEQ ID NO: 1340598 - DNA, 20 bp, Homo sapiens
gccactttacccacctagaa

SEQ ID NO: 1340599 - DNA, 21 bp, Homo sapiens
gccagaggaatcctggcagcc

SEQ ID NO: 1340600 - DNA, 24 bp, Homo sapiens
gccagaggaatcctggcagcccag

SEQ ID NO: 1340601 - DNA, 14 bp, Homo sapiens
gccagaggccccca

SEQ ID NO: 1340602 - DNA, 23 bp, Homo sapiens
gccagaggcccccagcccagggc

SEQ ID NO: 1340603 - DNA, 15 bp, Homo sapiens
gccagatgtcctaat

SEQ ID NO: 1340604 - DNA, 16 bp, Homo sapiens
gccagcagcagcaggt

SEQ ID NO: 1340605 - DNA, 18 bp, Homo sapiens
gccagccaactctgggaa

SEQ ID NO: 1340606 - DNA, 15 bp, Homo sapiens
gccagcccctcttcc

SEQ ID NO: 1340607 - DNA, 20 bp, Homo sapiens
gccagcccctcttccccaat

SEQ ID NO: 1340608 - DNA, 20 bp, Homo sapiens
gccagcctccgagagggaga

SEQ ID NO: 1340609 - DNA, 21 bp, Homo sapiens
gccagcctccgagagggagag

SEQ ID NO: 1340610 - DNA, 15 bp, Homo sapiens
gccagcgcctccctc

SEQ ID NO: 1340611 - DNA, 18 bp, Homo sapiens
gccagcgcctccctccac

SEQ ID NO: 1340612 - DNA, 13 bp, Homo sapiens
gcgcggtggctca

SEQ ID NO: 1340613 - DNA, 20 bp, Homo sapiens
gcgcggtggctcacgcctgt

SEQ ID NO: 1340614 - DNA, 17 bp, Homo sapiens
gcgctcagtaaacggga

SEQ ID NO: 1340615 - DNA, 15 bp, Homo sapiens
gcgcttgctggccag

SEQ ID NO: 1340616 - DNA, 19 bp, Homo sapiens
gcggcaggggcctggagat

SEQ ID NO: 1340617 - DNA, 16 bp, Homo sapiens
gcggcctttggcttca

SEQ ID NO: 1340618 - DNA, 16 bp, Homo sapiens
gcggcgtacaggctgg

SEQ ID NO: 1340619 - DNA, 17 bp, Homo sapiens
gcggcgtacaggctggc

SEQ ID NO: 1340620 - DNA, 15 bp, Homo sapiens
gcggctggcagccca

SEQ ID NO: 1340621 - DNA, 19 bp, Homo sapiens
gcgggtggatcacgaggtc

SEQ ID NO: 1340622 - DNA, 22 bp, Homo sapiens
gcgtcagctgctccctggcatt

SEQ ID NO: 1340623 - DNA, 18 bp, Homo sapiens
gcgtccctggcgcaggtg

SEQ ID NO: 1340624 - DNA, 15 bp, Homo sapiens
gcgtctatcctgtgt

SEQ ID NO: 1340625 - DNA, 23 bp, Homo sapiens
gcgtgaacccgggaggcggagct

SEQ ID NO: 1340626 - DNA, 20 bp, Homo sapiens
gcgtggagggaggccccagg

SEQ ID NO: 1340627 - DNA, 20 bp, Homo sapiens
gcgtggcccaaggctggcag

SEQ ID NO: 1340628 - DNA, 13 bp, Homo sapiens
gcgtggtgccatc

SEQ ID NO: 1340629 - DNA, 18 bp, Homo sapiens
gctaaagagcccttgcct

SEQ ID NO: 1340630 - DNA, 20 bp, Homo sapiens
gctaaataaaatttgttgca

SEQ ID NO: 1340631 - DNA, 13 bp, Homo sapiens
gctaactgtaaat

SEQ ID NO: 1340632 - DNA, 13 bp, Homo sapiens
gctacaattttaa

SEQ ID NO: 1340633 - DNA, 14 bp, Homo sapiens
gctactagcaaaat

SEQ ID NO: 1340634 - DNA, 16 bp, Homo sapiens
gctactagcaaaataa

SEQ ID NO: 1340635 - DNA, 21 bp, Homo sapiens
gctactgcactccagcctggg

SEQ ID NO: 1340636 - DNA, 19 bp, Homo sapiens
gctactgttgtaagaattc

SEQ ID NO: 1340637 - DNA, 18 bp, Homo sapiens
gctagcttctgcttttct

SEQ ID NO: 1340638 - DNA, 22 bp, Homo sapiens
gctagcttctgcttttctgccc

SEQ ID NO: 1340639 - DNA, 18 bp, Homo sapiens
gctaggttaaatggttgg

SEQ ID NO: 1340640 - DNA, 22 bp, Homo sapiens
gctagtcaacagtaccctggtt

SEQ ID NO: 1340641 - DNA, 13 bp, Homo sapiens
gctagttgaatac

SEQ ID NO: 1340642 - DNA, 18 bp, Homo sapiens
gctagttgaatacttgaa

SEQ ID NO: 1340643 - DNA, 19 bp, Homo sapiens
gctagttgaatacttgaac

SEQ ID NO: 1340644 - DNA, 17 bp, Homo sapiens
gctatataagacaagaa

SEQ ID NO: 1340645 - DNA, 23 bp, Homo sapiens
gctatccccatctccctgcctgg

SEQ ID NO: 1340646 - DNA, 12 bp, Homo sapiens
gctatcctgatt

SEQ ID NO: 1340647 - DNA, 11 bp, Homo sapiens
gctatgactta

SEQ ID NO: 1340648 - DNA, 15 bp, Homo sapiens
gctatgtataaaata

SEQ ID NO: 1340649 - DNA, 23 bp, Homo sapiens
gctattacgaagttcaagatcaa

SEQ ID NO: 1340650 - DNA, 16 bp, Homo sapiens
gctatttatgggcccc

SEQ ID NO: 1340651 - DNA, 15 bp, Homo sapiens
gctatttattttcct

SEQ ID NO: 1340652 - DNA, 16 bp, Homo sapiens
gctatttttgtaaagt

SEQ ID NO: 1340653 - DNA, 20 bp, Homo sapiens
gctatttttgtaaagtttcc

SEQ ID NO: 1340654 - DNA, 13 bp, Homo sapiens
gctcacacacctg

SEQ ID NO: 1340655 - DNA, 17 bp, Homo sapiens
gctcactcacagagtca

SEQ ID NO: 1340656 - DNA, 13 bp, Homo sapiens
gctcactgccagg

SEQ ID NO: 1340657 - DNA, 19 bp, Homo sapiens
gctcactgccaggccagcc

SEQ ID NO: 1340658 - DNA, 23 bp, Homo sapiens
gctcactgccaggccagcctccg

SEQ ID NO: 1340659 - DNA, 17 bp, Homo sapiens
gctcagaaccacagcaa

SEQ ID NO: 1340660 - DNA, 16 bp, Homo sapiens
gctcagacatgttttc

SEQ ID NO: 1340661 - DNA, 19 bp, Homo sapiens
gctcagctcggggagcctt

SEQ ID NO: 1340662 - DNA, 12 bp, Homo sapiens
gctcagggtggt

SEQ ID NO: 1340663 - DNA, 12 bp, Homo sapiens
gctcagtaaacg

SEQ ID NO: 1340664 - DNA, 14 bp, Homo sapiens
gctcatctgctggt

SEQ ID NO: 1340665 - DNA, 15 bp, Homo sapiens
gctcatctgctggtc

SEQ ID NO: 1340666 - DNA, 17 bp, Homo sapiens
gctcatgtgtgcaacag

SEQ ID NO: 1340667 - DNA, 16 bp, Homo sapiens
gctccaagccccatct

SEQ ID NO: 1340668 - DNA, 18 bp, Homo sapiens
gctccaccagcatcacct

SEQ ID NO: 1340669 - DNA, 20 bp, Homo sapiens
gctccaccagcatcacctgc

SEQ ID NO: 1340670 - DNA, 13 bp, Homo sapiens
gctccactctgct

SEQ ID NO: 1340671 - DNA, 20 bp, Homo sapiens
gctccactctgcttctctga

SEQ ID NO: 1340672 - DNA, 23 bp, Homo sapiens
gctccactctgcttctctgactt

SEQ ID NO: 1340673 - DNA, 11 bp, Homo sapiens
gctccagctgt

SEQ ID NO: 1340674 - DNA, 17 bp, Homo sapiens
gctccagctttctgcca

SEQ ID NO: 1340675 - DNA, 21 bp, Homo sapiens
gctccagctttctgccatcta

SEQ ID NO: 1340676 - DNA, 22 bp, Homo sapiens
gctccatcccaaccaggcacct

SEQ ID NO: 1340677 - DNA, 18 bp, Homo sapiens
gctcccacttctgccaga

SEQ ID NO: 1340678 - DNA, 14 bp, Homo sapiens
gctcccagcctcag

SEQ ID NO: 1340679 - DNA, 15 bp, Homo sapiens
gctcccagcctcagc

SEQ ID NO: 1340680 - DNA, 16 bp, Homo sapiens
gctcccaggggtctcc

SEQ ID NO: 1340681 - DNA, 18 bp, Homo sapiens
gctcccaggggtctccct

SEQ ID NO: 1340682 - DNA, 19 bp, Homo sapiens
gctcccaggggtctccctg

SEQ ID NO: 1340683 - DNA, 21 bp, Homo sapiens
gctccccacagcgtccctggc

SEQ ID NO: 1340684 - DNA, 12 bp, Homo sapiens
gctcccctgagg

SEQ ID NO: 1340685 - DNA, 13 bp, Homo sapiens
gctcccctgagga

SEQ ID NO: 1340686 - DNA, 22 bp, Homo sapiens
gctccctcctccaggcctgcct

SEQ ID NO: 1340687 - DNA, 14 bp, Homo sapiens
gctccgcaggactt

SEQ ID NO: 1340688 - DNA, 16 bp, Homo sapiens
gctccgcaggacttcc

SEQ ID NO: 1340689 - DNA, 15 bp, Homo sapiens
gctcctggcccactg

SEQ ID NO: 1340690 - DNA, 13 bp, Homo sapiens
gctcctgtggccc

SEQ ID NO: 1340691 - DNA, 15 bp, Homo sapiens
gctcctgtggcccca

SEQ ID NO: 1340692 - DNA, 15 bp, Homo sapiens
gctcgaatctctgtg

SEQ ID NO: 1340693 - DNA, 18 bp, Homo sapiens
gctcgactatagaaaact

SEQ ID NO: 1340694 - DNA, 13 bp, Homo sapiens
gctcggctcagct

SEQ ID NO: 1340695 - DNA, 16 bp, Homo sapiens
gctcggctcagctcgg

SEQ ID NO: 1340696 - DNA, 19 bp, Homo sapiens
gctctatcgcccaggctgg

SEQ ID NO: 1340697 - DNA, 17 bp, Homo sapiens
gctctatgctttccaaa

SEQ ID NO: 1340698 - DNA, 14 bp, Homo sapiens
gctctgaccacttg

SEQ ID NO: 1340699 - DNA, 17 bp, Homo sapiens
gctctgagcgcctccat

SEQ ID NO: 1340700 - DNA, 23 bp, Homo sapiens
gctctgcaagaattgaagcagga

SEQ ID NO: 1340701 - DNA, 18 bp, Homo sapiens
gctctgcagtcctactca

SEQ ID NO: 1340702 - DNA, 21 bp, Homo sapiens
gctctgcagtcctactcaagc

SEQ ID NO: 1340703 - DNA, 17 bp, Homo sapiens
gctctgccgtctctgga

SEQ ID NO: 1340704 - DNA, 16 bp, Homo sapiens
gctctggaggggaggg

SEQ ID NO: 1340705 - DNA, 14 bp, Homo sapiens
gctctgtgcagtca

SEQ ID NO: 1340706 - DNA, 21 bp, Homo sapiens
gctctgtgcagtcactggagg

SEQ ID NO: 1340707 - DNA, 18 bp, Homo sapiens
gctcttcatcccattcca

SEQ ID NO: 1340708 - DNA, 22 bp, Homo sapiens
gctgaatacagaggcaactgca

SEQ ID NO: 1340709 - DNA, 22 bp, Homo sapiens
gctgacatcttgaatccttcca

SEQ ID NO: 1340710 - DNA, 12 bp, Homo sapiens
gctgagcctgca

SEQ ID NO: 1340711 - DNA, 15 bp, Homo sapiens
gctgaggcctgggcc

SEQ ID NO: 1340712 - DNA, 16 bp, Homo sapiens
gctgagggcagactgg

SEQ ID NO: 1340713 - DNA, 23 bp, Homo sapiens
gctgagggtgagtgggtgaataa

SEQ ID NO: 1340714 - DNA, 14 bp, Homo sapiens
gctgagggtttgaa

SEQ ID NO: 1340715 - DNA, 14 bp, Homo sapiens
gctgaggtgggagg

SEQ ID NO: 1340716 - DNA, 15 bp, Homo sapiens
gctgaggtgggagga

SEQ ID NO: 1340717 - DNA, 19 bp, Homo sapiens
gctgaggttcctctgcctg

SEQ ID NO: 1340718 - DNA, 19 bp, Homo sapiens
gctgagtggcaggggacag

SEQ ID NO: 1340719 - DNA, 22 bp, Homo sapiens
gctgagtgggggatcacagcct

SEQ ID NO: 1340720 - DNA, 22 bp, Homo sapiens
gctgatctgcggatctcagctt

SEQ ID NO: 1340721 - DNA, 13 bp, Homo sapiens
gctgcaccctcag

SEQ ID NO: 1340722 - DNA, 13 bp, Homo sapiens
gctgcagagcagt

SEQ ID NO: 1340723 - DNA, 15 bp, Homo sapiens
gctgcagaggccaga

SEQ ID NO: 1340724 - DNA, 18 bp, Homo sapiens
gctgcagaggccagaggc

SEQ ID NO: 1340725 - DNA, 20 bp, Homo sapiens
gctgcaggctttgccattgt

SEQ ID NO: 1340726 - DNA, 22 bp, Homo sapiens
gctgcagttctactcaggctgg

SEQ ID NO: 1340727 - DNA, 14 bp, Homo sapiens
gctgcatccagagg

SEQ ID NO: 1340728 - DNA, 15 bp, Homo sapiens
gctgcatgccctctc

SEQ ID NO: 1340729 - DNA, 16 bp, Homo sapiens
gctgcatgccctctca

SEQ ID NO: 1340730 - DNA, 22 bp, Homo sapiens
gctgccagccttgagccctggc

SEQ ID NO: 1340731 - DNA, 19 bp, Homo sapiens
ggcaactgcattggctttg

SEQ ID NO: 1340732 - DNA, 15 bp, Homo sapiens
ggcaataaattttga

SEQ ID NO: 1340733 - DNA, 16 bp, Homo sapiens
ggcaataaattttgaa

SEQ ID NO: 1340734 - DNA, 20 bp, Homo sapiens
ggcacaggaggcaggcatgg

SEQ ID NO: 1340735 - DNA, 17 bp, Homo sapiens
ggcaccaggggtttctc

SEQ ID NO: 1340736 - DNA, 21 bp, Homo sapiens
ggcactgccgccgctaggtag

SEQ ID NO: 1340737 - DNA, 17 bp, Homo sapiens
ggcactggaccccagca

SEQ ID NO: 1340738 - DNA, 21 bp, Homo sapiens
ggcacttcatgtaaagtgtca

SEQ ID NO: 1340739 - DNA, 15 bp, Homo sapiens
ggcagcccagagact

SEQ ID NO: 1340740 - DNA, 15 bp, Homo sapiens
ggcagccccagcctg

SEQ ID NO: 1340741 - DNA, 16 bp, Homo sapiens
ggcagccccagcctgc

SEQ ID NO: 1340742 - DNA, 18 bp, Homo sapiens
ggcaggcatggccctggg

SEQ ID NO: 1340743 - DNA, 15 bp, Homo sapiens
ggcaggctcactgcc

SEQ ID NO: 1340744 - DNA, 10 bp, Homo sapiens
ggcaggctgg

SEQ ID NO: 1340745 - DNA, 11 bp, Homo sapiens
ggcaggctggc

SEQ ID NO: 1340746 - DNA, 13 bp, Homo sapiens
ggcaggctggcca

SEQ ID NO: 1340747 - DNA, 20 bp, Homo sapiens
ggcaggctggccagtccagg

SEQ ID NO: 1340748 - DNA, 22 bp, Homo sapiens
ggcaggctgggccatgtccaaa

SEQ ID NO: 1340749 - DNA, 14 bp, Homo sapiens
ggcaggggcctgga

SEQ ID NO: 1340750 - DNA, 16 bp, Homo sapiens
ggcaggggtgggggtg

SEQ ID NO: 1340751 - DNA, 12 bp, Homo sapiens
ggcagggtccta

SEQ ID NO: 1340752 - DNA, 21 bp, Homo sapiens
ggcaggtgctggagcactggg

SEQ ID NO: 1340753 - DNA, 17 bp, Homo sapiens
ggcaggttggtgggggc

SEQ ID NO: 1340754 - DNA, 15 bp, Homo sapiens
ggcagtccgtgggac

SEQ ID NO: 1340755 - DNA, 16 bp, Homo sapiens
ggcagtccgtgggacg

SEQ ID NO: 1340756 - DNA, 14 bp, Homo sapiens
ggcagttggccaga

SEQ ID NO: 1340757 - DNA, 22 bp, Homo sapiens
ggcatccctttttcataaatta

SEQ ID NO: 1340758 - DNA, 18 bp, Homo sapiens
ggcatcgcaccattctga

SEQ ID NO: 1340759 - DNA, 18 bp, Homo sapiens
ggcatctatctgtgctag

SEQ ID NO: 1340760 - DNA, 13 bp, Homo sapiens
ggcatgaccagat

SEQ ID NO: 1340761 - DNA, 22 bp, Homo sapiens
ggcatggttttgtgccatctgt

SEQ ID NO: 1340762 - DNA, 18 bp, Homo sapiens
ggcatgtaaatgtaaact

SEQ ID NO: 1340763 - DNA, 11 bp, Homo sapiens
ggcattgagta

SEQ ID NO: 1340764 - DNA, 15 bp, Homo sapiens
ggccaccaaagctgc

SEQ ID NO: 1340765 - DNA, 13 bp, Homo sapiens
ggccacctcccca

SEQ ID NO: 1340766 - DNA, 16 bp, Homo sapiens
ggccactgtgaagaga

SEQ ID NO: 1340767 - DNA, 19 bp, Homo sapiens
ggccagcctccgagaggga

SEQ ID NO: 1340768 - DNA, 18 bp, Homo sapiens
ggccaggctgcctggcct

SEQ ID NO: 1340769 - DNA, 13 bp, Homo sapiens
ggccagtctgtgg

SEQ ID NO: 1340770 - DNA, 23 bp, Homo sapiens
ggccagtctgtggatcagagatg

SEQ ID NO: 1340771 - DNA, 19 bp, Homo sapiens
ggccatgctgaggcctggg

SEQ ID NO: 1340772 - DNA, 22 bp, Homo sapiens
ggccatgctgaggcctgggccg

SEQ ID NO: 1340773 - DNA, 15 bp, Homo sapiens
ggccatgtccaaaga

SEQ ID NO: 1340774 - DNA, 23 bp, Homo sapiens
ggccatgtgcatagtttctttat

SEQ ID NO: 1340775 - DNA, 14 bp, Homo sapiens
ggccattctgccgc

SEQ ID NO: 1340776 - DNA, 18 bp, Homo sapiens
ggccatttgcaataacag

SEQ ID NO: 1340777 - DNA, 20 bp, Homo sapiens
ggccatttgcaataacagct

SEQ ID NO: 1340778 - DNA, 22 bp, Homo sapiens
ggccatttgcaataacagctgc

SEQ ID NO: 1340779 - DNA, 18 bp, Homo sapiens
ggcccacccggtgggacc

SEQ ID NO: 1340780 - DNA, 22 bp, Homo sapiens
ggcccacgcctgtaatcccagc

SEQ ID NO: 1340781 - DNA, 21 bp, Homo sapiens
ggcccagtgcatggtggccag

SEQ ID NO: 1340782 - DNA, 17 bp, Homo sapiens
ggccccaccctgggccc

SEQ ID NO: 1340783 - DNA, 21 bp, Homo sapiens
ggccccaccctgggccctggg

SEQ ID NO: 1340784 - DNA, 15 bp, Homo sapiens
ggccccagcacagct

SEQ ID NO: 1340785 - DNA, 13 bp, Homo sapiens
ggccccagccctg

SEQ ID NO: 1340786 - DNA, 15 bp, Homo sapiens
ggccccagccctgct

SEQ ID NO: 1340787 - DNA, 18 bp, Homo sapiens
ggccccagccctgctggg

SEQ ID NO: 1340788 - DNA, 18 bp, Homo sapiens
ggcccccagcccagggct

SEQ ID NO: 1340789 - DNA, 23 bp, Homo sapiens
ggcccctcccacacccaaagctg

SEQ ID NO: 1340790 - DNA, 19 bp, Homo sapiens
ggcccgcctctcctcggtt

SEQ ID NO: 1340791 - DNA, 13 bp, Homo sapiens
ggccctggcctcc

SEQ ID NO: 1340792 - DNA, 13 bp, Homo sapiens
ggccctggctgcc

SEQ ID NO: 1340793 - DNA, 14 bp, Homo sapiens
ggccctgggctgga

SEQ ID NO: 1340794 - DNA, 15 bp, Homo sapiens
ggccctgtgtgcagg

SEQ ID NO: 1340795 - DNA, 13 bp, Homo sapiens
ggccctttgctgt

SEQ ID NO: 1340796 - DNA, 14 bp, Homo sapiens
ggccctttgctgtc

SEQ ID NO: 1340797 - DNA, 19 bp, Homo sapiens
ggccgcgcgtccagctgcc

SEQ ID NO: 1340798 - DNA, 19 bp, Homo sapiens
ggccgctccaccagcatca

SEQ ID NO: 1340799 - DNA, 20 bp, Homo sapiens
ggccggcagccccagcctgc

SEQ ID NO: 1340800 - DNA, 21 bp, Homo sapiens
ggccggcagccccagcctgct

SEQ ID NO: 1340801 - DNA, 19 bp, Homo sapiens
ggccgtatctccggctccc

SEQ ID NO: 1340802 - DNA, 20 bp, Homo sapiens
ggccgtatctccggctccca

SEQ ID NO: 1340803 - DNA, 16 bp, Homo sapiens
ggcctaccccgcagac

SEQ ID NO: 1340804 - DNA, 20 bp, Homo sapiens
ggcctaccccgcagacacct

SEQ ID NO: 1340805 - DNA, 21 bp, Homo sapiens
ggcctagcgatctctcctggc

SEQ ID NO: 1340806 - DNA, 19 bp, Homo sapiens
ggcctcagctcaatgcagt

SEQ ID NO: 1340807 - DNA, 14 bp, Homo sapiens
ggcctcatgtggct

SEQ ID NO: 1340808 - DNA, 20 bp, Homo sapiens
ggcctcatgtggctggaaga

SEQ ID NO: 1340809 - DNA, 20 bp, Homo sapiens
ggcctccagaactcactggg

SEQ ID NO: 1340810 - DNA, 15 bp, Homo sapiens
ggcctcccctgccac

SEQ ID NO: 1340811 - DNA, 20 bp, Homo sapiens
ggcctcggtgtggagaagcg

SEQ ID NO: 1340812 - DNA, 13 bp, Homo sapiens
ggcctctctagca

SEQ ID NO: 1340813 - DNA, 14 bp, Homo sapiens
ggcctgcacagtga

SEQ ID NO: 1340814 - DNA, 15 bp, Homo sapiens
ggcctgcctcccact

SEQ ID NO: 1340815 - DNA, 18 bp, Homo sapiens
ggcctgcgaccctggggg

SEQ ID NO: 1340816 - DNA, 10 bp, Homo sapiens
ggcctgctgt

SEQ ID NO: 1340817 - DNA, 19 bp, Homo sapiens
ggcctgctgtgattccact

SEQ ID NO: 1340818 - DNA, 15 bp, Homo sapiens
ggcctggagatcctc

SEQ ID NO: 1340819 - DNA, 15 bp, Homo sapiens
ggcctgggccgctgc

SEQ ID NO: 1340820 - DNA, 21 bp, Homo sapiens
ggcctgggccgtatctccggc

SEQ ID NO: 1340821 - DNA, 15 bp, Homo sapiens
ggcctgtggctgtcg

SEQ ID NO: 1340822 - DNA, 20 bp, Homo sapiens
ggccttaatttcctttttga

SEQ ID NO: 1340823 - DNA, 17 bp, Homo sapiens
ggccttattgcatccca

SEQ ID NO: 1340824 - DNA, 12 bp, Homo sapiens
ggccttggaaat

SEQ ID NO: 1340825 - DNA, 13 bp, Homo sapiens
ggcctttggcttc

SEQ ID NO: 1340826 - DNA, 17 bp, Homo sapiens
ggcctttgttctggggg

SEQ ID NO: 1340827 - DNA, 16 bp, Homo sapiens
ggccttttctggcacc

SEQ ID NO: 1340828 - DNA, 17 bp, Homo sapiens
ggcgaccaccgcccctg

SEQ ID NO: 1340829 - DNA, 20 bp, Homo sapiens
ggcgcaggtgggctggactt

SEQ ID NO: 1340830 - DNA, 17 bp, Homo sapiens
ggcgccaccagctctgc

SEQ ID NO: 1340831 - DNA, 20 bp, Homo sapiens
ggcgccgtctccaggggctg

SEQ ID NO: 1340832 - DNA, 15 bp, Homo sapiens
ggcgcggtggctcac

SEQ ID NO: 1340833 - DNA, 23 bp, Homo sapiens
ggcgctgccccatctcccctcag

SEQ ID NO: 1340834 - DNA, 20 bp, Homo sapiens
ggcggagcttgcagtgagcc

SEQ ID NO: 1340835 - DNA, 23 bp, Homo sapiens
ggctcacgcctgtaatcccagca

SEQ ID NO: 1340836 - DNA, 15 bp, Homo sapiens
ggctcactgccaggc

SEQ ID NO: 1340837 - DNA, 20 bp, Homo sapiens
ggctcagctcggggagcctt

SEQ ID NO: 1340838 - DNA, 21 bp, Homo sapiens
ggctcccaggagcctgcccag

SEQ ID NO: 1340839 - DNA, 22 bp, Homo sapiens
ggctcccaggagcctgcccagc

SEQ ID NO: 1340840 - DNA, 20 bp, Homo sapiens
ggctcccaggggtctccctg

SEQ ID NO: 1340841 - DNA, 21 bp, Homo sapiens
ggctcccaggggtctccctgg

SEQ ID NO: 1340842 - DNA, 16 bp, Homo sapiens
ggctccctcctccagg

SEQ ID NO: 1340843 - DNA, 11 bp, Homo sapiens
ggctcctgatc

SEQ ID NO: 1340844 - DNA, 23 bp, Homo sapiens
ggctcgtggactgagtgggaagc

SEQ ID NO: 1340845 - DNA, 12 bp, Homo sapiens
ggctctgcagtc

SEQ ID NO: 1340846 - DNA, 14 bp, Homo sapiens
ggctgaaattctcc

SEQ ID NO: 1340847 - DNA, 18 bp, Homo sapiens
ggctgaaattctcctgga

SEQ ID NO: 1340848 - DNA, 16 bp, Homo sapiens
ggctgaggcaggagaa

SEQ ID NO: 1340849 - DNA, 23 bp, Homo sapiens
gtctcttcttggggcccagtgca

SEQ ID NO: 1340850 - DNA, 20 bp, Homo sapiens
gtctggccctagactcgggg

SEQ ID NO: 1340851 - DNA, 22 bp, Homo sapiens
gtctgggcagctgtcccttgct

SEQ ID NO: 1340852 - DNA, 18 bp, Homo sapiens
gtctgtgaacagagagac

SEQ ID NO: 1340853 - DNA, 21 bp, Homo sapiens
gtctgtgtgtgtgtgtgtgcg

SEQ ID NO: 1340854 - DNA, 19 bp, Homo sapiens
gtctgttggcaggctggcc

SEQ ID NO: 1340855 - DNA, 22 bp, Homo sapiens
gtctgttggcaggctggccagt

SEQ ID NO: 1340856 - DNA, 18 bp, Homo sapiens
gtctgttgtgtgtcatgc

SEQ ID NO: 1340857 - DNA, 19 bp, Homo sapiens
gtcttaaggacaaagtgcc

SEQ ID NO: 1340858 - DNA, 20 bp, Homo sapiens
gtcttgggcagagctggctc

SEQ ID NO: 1340859 - DNA, 21 bp, Homo sapiens
gtcttgggcagagctggctct

SEQ ID NO: 1340860 - DNA, 16 bp, Homo sapiens
gtctttcatggctgct

SEQ ID NO: 1340861 - DNA, 23 bp, Homo sapiens
gtctttcatggctgctgttgctt

SEQ ID NO: 1340862 - DNA, 19 bp, Homo sapiens
gtctttcccatggggaggg

SEQ ID NO: 1340863 - DNA, 15 bp, Homo sapiens
gtcttttttttcctg

SEQ ID NO: 1340864 - DNA, 22 bp, Homo sapiens
gtgaaagtgcatttttgtaaat

SEQ ID NO: 1340865 - DNA, 14 bp, Homo sapiens
gtgaaattattttg

SEQ ID NO: 1340866 - DNA, 13 bp, Homo sapiens
gtgaagaagcctg

SEQ ID NO: 1340867 - DNA, 13 bp, Homo sapiens
gtgaagtgcttgg

SEQ ID NO: 1340868 - DNA, 15 bp, Homo sapiens
gtgaatgctgggact

SEQ ID NO: 1340869 - DNA, 20 bp, Homo sapiens
gtgaatgctgggactcagcc

SEQ ID NO: 1340870 - DNA, 21 bp, Homo sapiens
gtgaatgctgggactcagcct

SEQ ID NO: 1340871 - DNA, 19 bp, Homo sapiens
gtgaattattgacactgaa

SEQ ID NO: 1340872 - DNA, 16 bp, Homo sapiens
gtgaatttttattgtt

SEQ ID NO: 1340873 - DNA, 16 bp, Homo sapiens
gtgacccgacctggcc

SEQ ID NO: 1340874 - DNA, 20 bp, Homo sapiens
gtgaccctccaaatggagaa

SEQ ID NO: 1340875 - DNA, 15 bp, Homo sapiens
gtgaccggacttttc

SEQ ID NO: 1340876 - DNA, 16 bp, Homo sapiens
gtgacctctctctctg

SEQ ID NO: 1340877 - DNA, 19 bp, Homo sapiens
gtgagaaacatctcaataa

SEQ ID NO: 1340878 - DNA, 17 bp, Homo sapiens
gtgagaacccagtttcc

SEQ ID NO: 1340879 - DNA, 17 bp, Homo sapiens
gtgagaaggtttattgt

SEQ ID NO: 1340880 - DNA, 20 bp, Homo sapiens
gtgagaagtgaatgctggga

SEQ ID NO: 1340881 - DNA, 22 bp, Homo sapiens
gtgagaccctgtctcaaaaaaa

SEQ ID NO: 1340882 - DNA, 21 bp, Homo sapiens
gtgagggaggggaaaagcatt

SEQ ID NO: 1340883 - DNA, 15 bp, Homo sapiens
gtgagtccattctcc

SEQ ID NO: 1340884 - DNA, 17 bp, Homo sapiens
gtgagtttgagctgcct

SEQ ID NO: 1340885 - DNA, 15 bp, Homo sapiens
gtgatacatttttta

SEQ ID NO: 1340886 - DNA, 22 bp, Homo sapiens
gtgatagtcttttgcttttggc

SEQ ID NO: 1340887 - DNA, 17 bp, Homo sapiens
gtgatcaatatttttat

SEQ ID NO: 1340888 - DNA, 19 bp, Homo sapiens
gtgatctgctgcagagcag

SEQ ID NO: 1340889 - DNA, 23 bp, Homo sapiens
gtgattccactacacctggctga

SEQ ID NO: 1340890 - DNA, 14 bp, Homo sapiens
gtgatttgaaaaat

SEQ ID NO: 1340891 - DNA, 22 bp, Homo sapiens
gtgatttgaaaaatataaaatt

SEQ ID NO: 1340892 - DNA, 14 bp, Homo sapiens
gtgatttttttgtc

SEQ ID NO: 1340893 - DNA, 24 bp, Homo sapiens
gtgcaacagggtatggactatctg

SEQ ID NO: 1340894 - DNA, 16 bp, Homo sapiens
gtgcaacgccgtgggc

SEQ ID NO: 1340895 - DNA, 22 bp, Homo sapiens
gtgcagaatgtaagtgggccca

SEQ ID NO: 1340896 - DNA, 16 bp, Homo sapiens
gtgcagagccttctca

SEQ ID NO: 1340897 - DNA, 23 bp, Homo sapiens
gtgcagagccttctcagaagcac

SEQ ID NO: 1340898 - DNA, 15 bp, Homo sapiens
gtgcatagtttcttt

SEQ ID NO: 1340899 - DNA, 13 bp, Homo sapiens
gtgcatttttgta

SEQ ID NO: 1340900 - DNA, 21 bp, Homo sapiens
gtgccagaggaatcctggcag

SEQ ID NO: 1340901 - DNA, 22 bp, Homo sapiens
gtgccagaggaatcctggcagc

SEQ ID NO: 1340902 - DNA, 19 bp, Homo sapiens
gtgcccaagccagaggctg

SEQ ID NO: 1340903 - DNA, 21 bp, Homo sapiens
gtgccgcctgcactcctcagg

SEQ ID NO: 1340904 - DNA, 14 bp, Homo sapiens
gtgcctgagaggca

SEQ ID NO: 1340905 - DNA, 22 bp, Homo sapiens
gtgcctgtgtccatgcgctcag

SEQ ID NO: 1340906 - DNA, 18 bp, Homo sapiens
gtgcgcatcttgcctcca

SEQ ID NO: 1340907 - DNA, 19 bp, Homo sapiens
gtgctggagcactgggctc

SEQ ID NO: 1340908 - DNA, 22 bp, Homo sapiens
gtgctggagcactgggctcccg

SEQ ID NO: 1340909 - DNA, 15 bp, Homo sapiens
gtgctggcaaccact

SEQ ID NO: 1340910 - DNA, 23 bp, Homo sapiens
gtgctgggaggagggagagggag

SEQ ID NO: 1340911 - DNA, 13 bp, Homo sapiens
gtgctgtgaggga

SEQ ID NO: 1340912 - DNA, 22 bp, Homo sapiens
gtgcttcacagtagagccagct

SEQ ID NO: 1340913 - DNA, 18 bp, Homo sapiens
gtggaaaaatagcctgcc

SEQ ID NO: 1340914 - DNA, 20 bp, Homo sapiens
gtggaagaagggagaagaaa

SEQ ID NO: 1340915 - DNA, 16 bp, Homo sapiens
gtggacacacacagac

SEQ ID NO: 1340916 - DNA, 17 bp, Homo sapiens
gtggactgagtgggaag

SEQ ID NO: 1340917 - DNA, 14 bp, Homo sapiens
gtggaggcttcctg

SEQ ID NO: 1340918 - DNA, 12 bp, Homo sapiens
gtggagggaggc

SEQ ID NO: 1340919 - DNA, 12 bp, Homo sapiens
gtggaggggtgt

SEQ ID NO: 1340920 - DNA, 15 bp, Homo sapiens
gtggatggccccagc

SEQ ID NO: 1340921 - DNA, 22 bp, Homo sapiens
gtggatggccccagcacagctt

SEQ ID NO: 1340922 - DNA, 18 bp, Homo sapiens
gtggcaccagcagcctgg

SEQ ID NO: 1340923 - DNA, 19 bp, Homo sapiens
gtggcaccaggcgctgccc

SEQ ID NO: 1340924 - DNA, 19 bp, Homo sapiens
gtggcacttgcctgggtca

SEQ ID NO: 1340925 - DNA, 19 bp, Homo sapiens
gtggcagcaacggcacagc

SEQ ID NO: 1340926 - DNA, 18 bp, Homo sapiens
gtggcaggggacaggagt

SEQ ID NO: 1340927 - DNA, 21 bp, Homo sapiens
gtggcagtggttttggcaaac

SEQ ID NO: 1340928 - DNA, 22 bp, Homo sapiens
gtggccaagaagcagtggcctt

SEQ ID NO: 1340929 - DNA, 23 bp, Homo sapiens
gtggccaagaagcagtggcctta

SEQ ID NO: 1340930 - DNA, 22 bp, Homo sapiens
gtggccacaatccacgcttctc

SEQ ID NO: 1340931 - DNA, 15 bp, Homo sapiens
gtggccccaccctgg

SEQ ID NO: 1340932 - DNA, 18 bp, Homo sapiens
gtggccccaccctgggcc

SEQ ID NO: 1340933 - DNA, 17 bp, Homo sapiens
gtggccccgtttctggt

SEQ ID NO: 1340934 - DNA, 13 bp, Homo sapiens
gtggcctgtggct

SEQ ID NO: 1340935 - DNA, 14 bp, Homo sapiens
gtggcgggcacctg

SEQ ID NO: 1340936 - DNA, 22 bp, Homo sapiens
gtggctgatggtgtggcctgtg

SEQ ID NO: 1340937 - DNA, 24 bp, Homo sapiens
gtggctggaaccacattgaagaat

SEQ ID NO: 1340938 - DNA, 20 bp, Homo sapiens
gtgggacgggatggttctgg

SEQ ID NO: 1340939 - DNA, 12 bp, Homo sapiens
gtgggagctgag

SEQ ID NO: 1340940 - DNA, 17 bp, Homo sapiens
gtgggcaaacaggcagt

SEQ ID NO: 1340941 - DNA, 14 bp, Homo sapiens
gtgggcctcggccc

SEQ ID NO: 1340942 - DNA, 12 bp, Homo sapiens
gtggggcttggg

SEQ ID NO: 1340943 - DNA, 15 bp, Homo sapiens
gtgggggtggaggct

SEQ ID NO: 1340944 - DNA, 13 bp, Homo sapiens
gtggtagaaacaa

SEQ ID NO: 1340945 - DNA, 17 bp, Homo sapiens
gtggtagagtgtgcctg

SEQ ID NO: 1340946 - DNA, 18 bp, Homo sapiens
gtggtcacagcggaggtg

SEQ ID NO: 1340947 - DNA, 16 bp, Homo sapiens
gtggtcggtgggaccc

SEQ ID NO: 1340948 - DNA, 20 bp, Homo sapiens
gtggtctcttcttggggccc

SEQ ID NO: 1340949 - DNA, 21 bp, Homo sapiens
gtggtctcttcttggggccca

SEQ ID NO: 1340950 - DNA, 13 bp, Homo sapiens
gtggtctgttggc

SEQ ID NO: 1340951 - DNA, 17 bp, Homo sapiens
gtggtctgttggcaggc

SEQ ID NO: 1340952 - DNA, 22 bp, Homo sapiens
gtggtgccatccccagggggca

SEQ ID NO: 1340953 - DNA, 18 bp, Homo sapiens
gtggtggctcacgcctgt

SEQ ID NO: 1340954 - DNA, 18 bp, Homo sapiens
gtggttatggagagggtg

SEQ ID NO: 1340955 - DNA, 13 bp, Homo sapiens
gtggttcctctgc

SEQ ID NO: 1340956 - DNA, 19 bp, Homo sapiens
gtgtaaaatattttgaatc

SEQ ID NO: 1340957 - DNA, 16 bp, Homo sapiens
gtgtacagccagacca

SEQ ID NO: 1340958 - DNA, 14 bp, Homo sapiens
gtgtataatataaa

SEQ ID NO: 1340959 - DNA, 12 bp, Homo sapiens
gtgtatttattt

SEQ ID NO: 1340960 - DNA, 19 bp, Homo sapiens
gtgtcacccaaaccggcag

SEQ ID NO: 1340961 - DNA, 19 bp, Homo sapiens
gtgtccatgcgctcagggc

SEQ ID NO: 1340962 - DNA, 20 bp, Homo sapiens
gtgtccatgcgctcagggcc

SEQ ID NO: 1340963 - DNA, 19 bp, Homo sapiens
gtgtcccaggcagggagac

SEQ ID NO: 1340964 - DNA, 22 bp, Homo sapiens
gtgtctccttaagctgcagaga

SEQ ID NO: 1340965 - DNA, 19 bp, Homo sapiens
gtgtctggaattgtggcta

SEQ ID NO: 1340966 - DNA, 20 bp, Homo sapiens
taacttgcttaaatttctta

SEQ ID NO: 1340967 - DNA, 17 bp, Homo sapiens
taactttataaatccag

SEQ ID NO: 1340968 - DNA, 20 bp, Homo sapiens
taacttttgtaaatacacat

SEQ ID NO: 1340969 - DNA, 18 bp, Homo sapiens
taagaaatgtataaactt

SEQ ID NO: 1340970 - DNA, 17 bp, Homo sapiens
taagaagaagttcatgt

SEQ ID NO: 1340971 - DNA, 22 bp, Homo sapiens
taagaataccacatcaaataag

SEQ ID NO: 1340972 - DNA, 18 bp, Homo sapiens
taagaatagtagatgtgg

SEQ ID NO: 1340973 - DNA, 18 bp, Homo sapiens
taagaattctgattgatt

SEQ ID NO: 1340974 - DNA, 12 bp, Homo sapiens
taagaatttgca

SEQ ID NO: 1340975 - DNA, 13 bp, Homo sapiens
taagaatttgcat

SEQ ID NO: 1340976 - DNA, 19 bp, Homo sapiens
taagacaaatattcctttg

SEQ ID NO: 1340977 - DNA, 17 bp, Homo sapiens
taagacagagtatcctg

SEQ ID NO: 1340978 - DNA, 18 bp, Homo sapiens
taagactatatatataaa

SEQ ID NO: 1340979 - DNA, 19 bp, Homo sapiens
taagactatatatataaat

SEQ ID NO: 1340980 - DNA, 20 bp, Homo sapiens
taagatcactgtttagattt

SEQ ID NO: 1340981 - DNA, 21 bp, Homo sapiens
taagatcactgtttagatttg

SEQ ID NO: 1340982 - DNA, 12 bp, Homo sapiens
taagatgtgaaa

SEQ ID NO: 1340983 - DNA, 13 bp, Homo sapiens
taagatgtgaaaa

SEQ ID NO: 1340984 - DNA, 21 bp, Homo sapiens
taagattgatatctataaaat

SEQ ID NO: 1340985 - DNA, 23 bp, Homo sapiens
taagattgatatctataaaatag

SEQ ID NO: 1340986 - DNA, 18 bp, Homo sapiens
taagcaaatgttaaaagt

SEQ ID NO: 1340987 - DNA, 17 bp, Homo sapiens
taagcagcttattgttt

SEQ ID NO: 1340988 - DNA, 17 bp, Homo sapiens
taagcatactttgtaaa

SEQ ID NO: 1340989 - DNA, 17 bp, Homo sapiens
taagccaaaattaaggt

SEQ ID NO: 1340990 - DNA, 19 bp, Homo sapiens
taagctagttgaatacttg

SEQ ID NO: 1340991 - DNA, 22 bp, Homo sapiens
taagctagttgaatacttgaac

SEQ ID NO: 1340992 - DNA, 22 bp, Homo sapiens
taagctgttactgtcttcagta

SEQ ID NO: 1340993 - DNA, 16 bp, Homo sapiens
taaggaaagcaataaa

SEQ ID NO: 1340994 - DNA, 18 bp, Homo sapiens
taaggaaagcaataaatg

SEQ ID NO: 1340995 - DNA, 21 bp, Homo sapiens
taaggaaagcaataaatgaat

SEQ ID NO: 1340996 - DNA, 13 bp, Homo sapiens
taaggaagacaat

SEQ ID NO: 1340997 - DNA, 16 bp, Homo sapiens
taaggacaaagtgcca

SEQ ID NO: 1340998 - DNA, 20 bp, Homo sapiens
taaggacaaagtgccaaaga

SEQ ID NO: 1340999 - DNA, 16 bp, Homo sapiens
taaggaccttaagaca

SEQ ID NO: 1341000 - DNA, 17 bp, Homo sapiens
taaggatttttctctta

SEQ ID NO: 1341001 - DNA, 21 bp, Homo sapiens
taaggcagattttacagagcg

SEQ ID NO: 1341002 - DNA, 23 bp, Homo sapiens
taagggaacaagttgagctatga

SEQ ID NO: 1341003 - DNA, 16 bp, Homo sapiens
taaggggaagaatgaa

SEQ ID NO: 1341004 - DNA, 14 bp, Homo sapiens
taagtatttataat

SEQ ID NO: 1341005 - DNA, 19 bp, Homo sapiens
taagtgaggaaatcaaagt

SEQ ID NO: 1341006 - DNA, 15 bp, Homo sapiens
taagtgggcccaccc

SEQ ID NO: 1341007 - DNA, 20 bp, Homo sapiens
taagtgtgtggtagaaacaa

SEQ ID NO: 1341008 - DNA, 21 bp, Homo sapiens
taagtgtgtggtagaaacaaa

SEQ ID NO: 1341009 - DNA, 20 bp, Homo sapiens
taagttattgcagtttatca

SEQ ID NO: 1341010 - DNA, 12 bp, Homo sapiens
taagttcttatg

SEQ ID NO: 1341011 - DNA, 21 bp, Homo sapiens
taagttttgacaagctggctt

SEQ ID NO: 1341012 - DNA, 16 bp, Homo sapiens
taataaaaaaagaaag

SEQ ID NO: 1341013 - DNA, 19 bp, Homo sapiens
taataaaaaaagaaagcat

SEQ ID NO: 1341014 - DNA, 17 bp, Homo sapiens
taataaactttaatata

SEQ ID NO: 1341015 - DNA, 14 bp, Homo sapiens
taataaatgccctc

SEQ ID NO: 1341016 - DNA, 12 bp, Homo sapiens
taataagctagt

SEQ ID NO: 1341017 - DNA, 12 bp, Homo sapiens
taataatcaaga

SEQ ID NO: 1341018 - DNA, 19 bp, Homo sapiens
taataatcaagagccttaa

SEQ ID NO: 1341019 - DNA, 18 bp, Homo sapiens
taataatcttgtttctga

SEQ ID NO: 1341020 - DNA, 16 bp, Homo sapiens
taataatggcatcaat

SEQ ID NO: 1341021 - DNA, 22 bp, Homo sapiens
taatacaaggtataataaaatt

SEQ ID NO: 1341022 - DNA, 19 bp, Homo sapiens
taatactgaaccacttgta

SEQ ID NO: 1341023 - DNA, 22 bp, Homo sapiens
taatactgaaccacttgtagat

SEQ ID NO: 1341024 - DNA, 21 bp, Homo sapiens
taatagcaacttttgtgtaat

SEQ ID NO: 1341025 - DNA, 16 bp, Homo sapiens
taatagggaatatatc

SEQ ID NO: 1341026 - DNA, 15 bp, Homo sapiens
taatataaaaaattt

SEQ ID NO: 1341027 - DNA, 20 bp, Homo sapiens
taatattcagggtaaatagg

SEQ ID NO: 1341028 - DNA, 21 bp, Homo sapiens
taatattcagggtaaatagga

SEQ ID NO: 1341029 - DNA, 21 bp, Homo sapiens
taatatttaacattatttata

SEQ ID NO: 1341030 - DNA, 14 bp, Homo sapiens
taatatttaatgga

SEQ ID NO: 1341031 - DNA, 20 bp, Homo sapiens
taatcaagagccttaaaaca

SEQ ID NO: 1341032 - DNA, 14 bp, Homo sapiens
taatcatctaagtc

SEQ ID NO: 1341033 - DNA, 23 bp, Homo sapiens
taatcatctaagtcagtacccac

SEQ ID NO: 1341034 - DNA, 14 bp, Homo sapiens
taatccctgctttt

SEQ ID NO: 1341035 - DNA, 20 bp, Homo sapiens
taatcctttgttttctgact

SEQ ID NO: 1341036 - DNA, 18 bp, Homo sapiens
taatctgtttatttacaa

SEQ ID NO: 1341037 - DNA, 15 bp, Homo sapiens
taatcttataattgt

SEQ ID NO: 1341038 - DNA, 22 bp, Homo sapiens
taatcttataattgttctcaga

SEQ ID NO: 1341039 - DNA, 17 bp, Homo sapiens
taatcttcaaagccttc

SEQ ID NO: 1341040 - DNA, 17 bp, Homo sapiens
taatcttgtttctgaaa

SEQ ID NO: 1341041 - DNA, 21 bp, Homo sapiens
taatgaatttttatgatattc

SEQ ID NO: 1341042 - DNA, 13 bp, Homo sapiens
taatgttttcaaa

SEQ ID NO: 1341043 - DNA, 14 bp, Homo sapiens
taatgttttcaaaa

SEQ ID NO: 1341044 - DNA, 19 bp, Homo sapiens
taattaaccttactaatta

SEQ ID NO: 1341045 - DNA, 14 bp, Homo sapiens
taattatataactg

SEQ ID NO: 1341046 - DNA, 16 bp, Homo sapiens
taattatataactgta

SEQ ID NO: 1341047 - DNA, 17 bp, Homo sapiens
taattatataactgtat

SEQ ID NO: 1341048 - DNA, 21 bp, Homo sapiens
taattcttttttattaatcac

SEQ ID NO: 1341049 - DNA, 23 bp, Homo sapiens
taattggtacttttaaaaacata

SEQ ID NO: 1341050 - DNA, 15 bp, Homo sapiens
taattgtatttttgt

SEQ ID NO: 1341051 - DNA, 19 bp, Homo sapiens
taattgtgtgaacttggaa

SEQ ID NO: 1341052 - DNA, 20 bp, Homo sapiens
taattgtgtgaacttggaag

SEQ ID NO: 1341053 - DNA, 21 bp, Homo sapiens
taattgtgtgaacttggaagc

SEQ ID NO: 1341054 - DNA, 16 bp, Homo sapiens
taattgttctcagaat

SEQ ID NO: 1341055 - DNA, 15 bp, Homo sapiens
taattgtttcagaat

SEQ ID NO: 1341056 - DNA, 14 bp, Homo sapiens
taatttaaaaatat

SEQ ID NO: 1341057 - DNA, 12 bp, Homo sapiens
taatttaaatga

SEQ ID NO: 1341058 - DNA, 16 bp, Homo sapiens
taatttaaatgaaaga

SEQ ID NO: 1341059 - DNA, 14 bp, Homo sapiens
taatttaagttttg

SEQ ID NO: 1341060 - DNA, 20 bp, Homo sapiens
taatttacttgttttggatg

SEQ ID NO: 1341061 - DNA, 17 bp, Homo sapiens
taatttcctttttgaca

SEQ ID NO: 1341062 - DNA, 20 bp, Homo sapiens
taatttcctttttgacactg

SEQ ID NO: 1341063 - DNA, 17 bp, Homo sapiens
taatttctttttttcct

SEQ ID NO: 1341064 - DNA, 14 bp, Homo sapiens
taatttgaagattg

SEQ ID NO: 1341065 - DNA, 21 bp, Homo sapiens
taattttacatgtttataaat

SEQ ID NO: 1341066 - DNA, 22 bp, Homo sapiens
taattttacatgtttataaatc

SEQ ID NO: 1341067 - DNA, 17 bp, Homo sapiens
taatttttgtattattt

SEQ ID NO: 1341068 - DNA, 17 bp, Homo sapiens
taattttttttaaaata

SEQ ID NO: 1341069 - DNA, 20 bp, Homo sapiens
taattttttttaaaatagaa

SEQ ID NO: 1341070 - DNA, 16 bp, Homo sapiens
taattttttttagtat

SEQ ID NO: 1341071 - DNA, 15 bp, Homo sapiens
tacaaaaagcataaa

SEQ ID NO: 1341072 - DNA, 20 bp, Homo sapiens
tacaaaaagcataaaaatta

SEQ ID NO: 1341073 - DNA, 19 bp, Homo sapiens
tacaagggaagatttatgt

SEQ ID NO: 1341074 - DNA, 19 bp, Homo sapiens
tacaaggtataataaaatt

SEQ ID NO: 1341075 - DNA, 19 bp, Homo sapiens
tacaatattgattgggaaa

SEQ ID NO: 1341076 - DNA, 17 bp, Homo sapiens
tacaatctctttttgtt

SEQ ID NO: 1341077 - DNA, 14 bp, Homo sapiens
tacacagaaacact

SEQ ID NO: 1341078 - DNA, 23 bp, Homo sapiens
tacacatagcatgtaatggtatc

SEQ ID NO: 1341079 - DNA, 20 bp, Homo sapiens
tacacatatttgaagggtct

SEQ ID NO: 1341080 - DNA, 22 bp, Homo sapiens
tacacctggctgaggttcctct

SEQ ID NO: 1341081 - DNA, 23 bp, Homo sapiens
tacacctggctgaggttcctctg

SEQ ID NO: 1341082 - DNA, 14 bp, Homo sapiens
tacaccttgccttg

SEQ ID NO: 1341083 - DNA, 14 bp, Homo sapiens
tcaaagtgctatta

SEQ ID NO: 1341084 - DNA, 13 bp, Homo sapiens
tcaaataagaaat

SEQ ID NO: 1341085 - DNA, 17 bp, Homo sapiens
tcaaataagtatttata

SEQ ID NO: 1341086 - DNA, 18 bp, Homo sapiens
tcaaataagtatttataa

SEQ ID NO: 1341087 - DNA, 19 bp, Homo sapiens
tcaaataagtatttataat

SEQ ID NO: 1341088 - DNA, 17 bp, Homo sapiens
tcaaatacacatttgct

SEQ ID NO: 1341089 - DNA, 10 bp, Homo sapiens
tcaaattaat

SEQ ID NO: 1341090 - DNA, 13 bp, Homo sapiens
tcaaattaattgt

SEQ ID NO: 1341091 - DNA, 22 bp, Homo sapiens
tcaaatttgtctggttaaaaaa

SEQ ID NO: 1341092 - DNA, 18 bp, Homo sapiens
tcaacaaatattcactgg

SEQ ID NO: 1341093 - DNA, 17 bp, Homo sapiens
tcaacaataaaattttt

SEQ ID NO: 1341094 - DNA, 19 bp, Homo sapiens
tcaacctcttctggctcaa

SEQ ID NO: 1341095 - DNA, 22 bp, Homo sapiens
tcaactagtggggtttcctggc

SEQ ID NO: 1341096 - DNA, 20 bp, Homo sapiens
tcaacttagtcaataagaaa

SEQ ID NO: 1341097 - DNA, 16 bp, Homo sapiens
tcaactttgtaaaaat

SEQ ID NO: 1341098 - DNA, 11 bp, Homo sapiens
tcaagagcctt

SEQ ID NO: 1341099 - DNA, 19 bp, Homo sapiens
tcaagagccttaaaacatc

SEQ ID NO: 1341100 - DNA, 20 bp, Homo sapiens
tcaagagccttaaaacatca

SEQ ID NO: 1341101 - DNA, 18 bp, Homo sapiens
tcaagaggaatgaaaaaa

SEQ ID NO: 1341102 - DNA, 24 bp, Homo sapiens
tcaagatcaaaaaggcttataaaa

SEQ ID NO: 1341103 - DNA, 17 bp, Homo sapiens
tcaagcagtcgtgcctg

SEQ ID NO: 1341104 - DNA, 18 bp, Homo sapiens
tcaagcagtcgtgcctgt

SEQ ID NO: 1341105 - DNA, 20 bp, Homo sapiens
tcaagcagtcgtgcctgtgt

SEQ ID NO: 1341106 - DNA, 15 bp, Homo sapiens
tcaaggtcactgttt

SEQ ID NO: 1341107 - DNA, 15 bp, Homo sapiens
tcaagtgaaaaagga

SEQ ID NO: 1341108 - DNA, 19 bp, Homo sapiens
tcaataatatattttctgt

SEQ ID NO: 1341109 - DNA, 14 bp, Homo sapiens
tcaatacactagtt

SEQ ID NO: 1341110 - DNA, 21 bp, Homo sapiens
tcaatcaaataagtatttata

SEQ ID NO: 1341111 - DNA, 22 bp, Homo sapiens
tcaatcctaatttctcctccct

SEQ ID NO: 1341112 - DNA, 21 bp, Homo sapiens
tcaatcctgattcctctctaa

SEQ ID NO: 1341113 - DNA, 17 bp, Homo sapiens
tcaatgaaccataaatt

SEQ ID NO: 1341114 - DNA, 20 bp, Homo sapiens
tcaatgctttatttgtaaat

SEQ ID NO: 1341115 - DNA, 18 bp, Homo sapiens
tcaatgtggtgatgaaat

SEQ ID NO: 1341116 - DNA, 15 bp, Homo sapiens
tcacaaatgacttta

SEQ ID NO: 1341117 - DNA, 19 bp, Homo sapiens
tcacaaatgactttattat

SEQ ID NO: 1341118 - DNA, 14 bp, Homo sapiens
tcacacagacacta

SEQ ID NO: 1341119 - DNA, 16 bp, Homo sapiens
tcacactggttctcaa

SEQ ID NO: 1341120 - DNA, 18 bp, Homo sapiens
tcacagagtcaaggcctg

SEQ ID NO: 1341121 - DNA, 19 bp, Homo sapiens
tcacagagtcaaggcctgc

SEQ ID NO: 1341122 - DNA, 13 bp, Homo sapiens
tcacagcggaggt

SEQ ID NO: 1341123 - DNA, 12 bp, Homo sapiens
tcacagggtggg

SEQ ID NO: 1341124 - DNA, 19 bp, Homo sapiens
tcacagggtgggcctcggc

SEQ ID NO: 1341125 - DNA, 16 bp, Homo sapiens
tcacagtagagccagc

SEQ ID NO: 1341126 - DNA, 21 bp, Homo sapiens
tcacattcttggcttaatcat

SEQ ID NO: 1341127 - DNA, 18 bp, Homo sapiens
tcacattgttaagaaaaa

SEQ ID NO: 1341128 - DNA, 18 bp, Homo sapiens
tcaccaccacccctacca

SEQ ID NO: 1341129 - DNA, 14 bp, Homo sapiens
tcaccagagacttt

SEQ ID NO: 1341130 - DNA, 15 bp, Homo sapiens
tcaccatgtaagcac

SEQ ID NO: 1341131 - DNA, 21 bp, Homo sapiens
tcaccatgtaagcactctgga

SEQ ID NO: 1341132 - DNA, 20 bp, Homo sapiens
tcacccatgcaagcagagga

SEQ ID NO: 1341133 - DNA, 21 bp, Homo sapiens
tcacccatgcaagcagaggac

SEQ ID NO: 1341134 - DNA, 19 bp, Homo sapiens
tcaccccctcccaccccca

SEQ ID NO: 1341135 - DNA, 22 bp, Homo sapiens
tcaccccctcccacccccagcc

SEQ ID NO: 1341136 - DNA, 13 bp, Homo sapiens
tcacccttgtcct

SEQ ID NO: 1341137 - DNA, 13 bp, Homo sapiens
tcacctcatgccc

SEQ ID NO: 1341138 - DNA, 20 bp, Homo sapiens
tcacctcatgcccaccccct

SEQ ID NO: 1341139 - DNA, 12 bp, Homo sapiens
tcacctgcctgt

SEQ ID NO: 1341140 - DNA, 19 bp, Homo sapiens
tcacgcctgtaatcctagc

SEQ ID NO: 1341141 - DNA, 21 bp, Homo sapiens
tcacgtggctcgactatagaa

SEQ ID NO: 1341142 - DNA, 20 bp, Homo sapiens
tcacgttggggtgatttaat

SEQ ID NO: 1341143 - DNA, 17 bp, Homo sapiens
tcacgtttggtgcttct

SEQ ID NO: 1341144 - DNA, 16 bp, Homo sapiens
tcactaaagcatgaaa

SEQ ID NO: 1341145 - DNA, 18 bp, Homo sapiens
tcactaaagcatgaaatg

SEQ ID NO: 1341146 - DNA, 21 bp, Homo sapiens
tcactaaagcatgaaatgtga

SEQ ID NO: 1341147 - DNA, 15 bp, Homo sapiens
tcactaatacacagt

SEQ ID NO: 1341148 - DNA, 22 bp, Homo sapiens
tcactaggcccccacttgcctc

SEQ ID NO: 1341149 - DNA, 21 bp, Homo sapiens
tcactctaagtcatgtatgtt

SEQ ID NO: 1341150 - DNA, 17 bp, Homo sapiens
tcactgaaaattggaca

SEQ ID NO: 1341151 - DNA, 22 bp, Homo sapiens
tcactgaaaattggacagattg

SEQ ID NO: 1341152 - DNA, 16 bp, Homo sapiens
tcactgatgggaaaac

SEQ ID NO: 1341153 - DNA, 18 bp, Homo sapiens
tcactgatgggaaaactg

SEQ ID NO: 1341154 - DNA, 19 bp, Homo sapiens
tcactgccacactctccat

SEQ ID NO: 1341155 - DNA, 11 bp, Homo sapiens
tcactgccagg

SEQ ID NO: 1341156 - DNA, 14 bp, Homo sapiens
tcactgccaggcca

SEQ ID NO: 1341157 - DNA, 15 bp, Homo sapiens
tcactgccaggccag

SEQ ID NO: 1341158 - DNA, 14 bp, Homo sapiens
tcactggggcagac

SEQ ID NO: 1341159 - DNA, 12 bp, Homo sapiens
tcactgtgatca

SEQ ID NO: 1341160 - DNA, 21 bp, Homo sapiens
tcactgtgtatatttgattta

SEQ ID NO: 1341161 - DNA, 14 bp, Homo sapiens
tcactgtttcctgg

SEQ ID NO: 1341162 - DNA, 15 bp, Homo sapiens
tcacttcaccctgga

SEQ ID NO: 1341163 - DNA, 20 bp, Homo sapiens
tcacttgatgatacaatgaa

SEQ ID NO: 1341164 - DNA, 21 bp, Homo sapiens
tcactttttatgctatttctg

SEQ ID NO: 1341165 - DNA, 22 bp, Homo sapiens
tcactttttatgctatttctgt

SEQ ID NO: 1341166 - DNA, 18 bp, Homo sapiens
tcagaaacttgtgaagtg

SEQ ID NO: 1341167 - DNA, 12 bp, Homo sapiens
tcagaaagtgta

SEQ ID NO: 1341168 - DNA, 18 bp, Homo sapiens
tcagaaagtgtataataa

SEQ ID NO: 1341169 - DNA, 19 bp, Homo sapiens
tcagaaatataacacattt

SEQ ID NO: 1341170 - DNA, 19 bp, Homo sapiens
tcagacatctgaggtttta

SEQ ID NO: 1341171 - DNA, 22 bp, Homo sapiens
tcagacatctgaggttttattt

SEQ ID NO: 1341172 - DNA, 14 bp, Homo sapiens
tcagacatgttttc

SEQ ID NO: 1341173 - DNA, 20 bp, Homo sapiens
tcagacatgttttccgtgaa

SEQ ID NO: 1341174 - DNA, 21 bp, Homo sapiens
tcagagacaaaatatttccca

SEQ ID NO: 1341175 - DNA, 22 bp, Homo sapiens
tcagagacaaaatatttcccat

SEQ ID NO: 1341176 - DNA, 12 bp, Homo sapiens
tcagagacactg

SEQ ID NO: 1341177 - DNA, 22 bp, Homo sapiens
tcagagatgcaccaccaagcca

SEQ ID NO: 1341178 - DNA, 14 bp, Homo sapiens
tcagagctctctct

SEQ ID NO: 1341179 - DNA, 19 bp, Homo sapiens
tcagatgccacttctaaga

SEQ ID NO: 1341180 - DNA, 20 bp, Homo sapiens
tcagatgccacttctaagaa

SEQ ID NO: 1341181 - DNA, 13 bp, Homo sapiens
tcagatgtttaaa

SEQ ID NO: 1341182 - DNA, 17 bp, Homo sapiens
tcagatgtttaaaacac

SEQ ID NO: 1341183 - DNA, 15 bp, Homo sapiens
tcagatttctgagga

SEQ ID NO: 1341184 - DNA, 16 bp, Homo sapiens
tcagatttctgaggaa

SEQ ID NO: 1341185 - DNA, 18 bp, Homo sapiens
tcagcagcaaattttcag

SEQ ID NO: 1341186 - DNA, 17 bp, Homo sapiens
tcagcagttgctggtaa

SEQ ID NO: 1341187 - DNA, 18 bp, Homo sapiens
tcagcagttgctggtaaa

SEQ ID NO: 1341188 - DNA, 22 bp, Homo sapiens
tcagcagttgctggtaaaatga

SEQ ID NO: 1341189 - DNA, 17 bp, Homo sapiens
tcagccccctgcttcag

SEQ ID NO: 1341190 - DNA, 19 bp, Homo sapiens
tcagcctgctccagctgtt

SEQ ID NO: 1341191 - DNA, 10 bp, Homo sapiens
tcagcctggg

SEQ ID NO: 1341192 - DNA, 19 bp, Homo sapiens
tcagcgactccgttggcca

SEQ ID NO: 1341193 - DNA, 23 bp, Homo sapiens
tcagcgactccgttggccactcc

SEQ ID NO: 1341194 - DNA, 23 bp, Homo sapiens
tcagctccagggaatccaagcct

SEQ ID NO: 1341195 - DNA, 18 bp, Homo sapiens
tcagctcggctcagctcg

SEQ ID NO: 1341196 - DNA, 17 bp, Homo sapiens
tcagctcggggagcctt

SEQ ID NO: 1341197 - DNA, 23 bp, Homo sapiens
tcagctctgcaagaattgaagca

SEQ ID NO: 1341198 - DNA, 15 bp, Homo sapiens
tcagctttgagaagc

SEQ ID NO: 1341199 - DNA, 17 bp, Homo sapiens
tcaggaatattttccaa

SEQ ID NO: 1341200 - DNA, 18 bp, Homo sapiens
tcaggaatattttccaaa

SEQ ID NO: 1341201 - DNA, 17 bp, Homo sapiens
tcctctggacggcaggc

SEQ ID NO: 1341202 - DNA, 12 bp, Homo sapiens
tcctctggagcc

SEQ ID NO: 1341203 - DNA, 13 bp, Homo sapiens
tcctcttgtccta

SEQ ID NO: 1341204 - DNA, 18 bp, Homo sapiens
tcctctttagtttttggt

SEQ ID NO: 1341205 - DNA, 14 bp, Homo sapiens
tcctgaaactatat

SEQ ID NO: 1341206 - DNA, 21 bp, Homo sapiens
tcctgaaactatattttgtca

SEQ ID NO: 1341207 - DNA, 23 bp, Homo sapiens
tcctgaaactatattttgtcata

SEQ ID NO: 1341208 - DNA, 22 bp, Homo sapiens
tcctgaaccgcacagctcagga

SEQ ID NO: 1341209 - DNA, 18 bp, Homo sapiens
tcctgacccattgctgtt

SEQ ID NO: 1341210 - DNA, 13 bp, Homo sapiens
tcctgagctagga

SEQ ID NO: 1341211 - DNA, 21 bp, Homo sapiens
tcctgcacttacttgcttatt

SEQ ID NO: 1341212 - DNA, 14 bp, Homo sapiens
tcctgccaggcatg

SEQ ID NO: 1341213 - DNA, 14 bp, Homo sapiens
tcctgcctgtggcg

SEQ ID NO: 1341214 - DNA, 15 bp, Homo sapiens
tcctgcgtcctcctc

SEQ ID NO: 1341215 - DNA, 14 bp, Homo sapiens
tcctggaacaatat

SEQ ID NO: 1341216 - DNA, 20 bp, Homo sapiens
tcctggaacaatattttatg

SEQ ID NO: 1341217 - DNA, 18 bp, Homo sapiens
tcctggcactggacccca

SEQ ID NO: 1341218 - DNA, 19 bp, Homo sapiens
tcctggcactggaccccag

SEQ ID NO: 1341219 - DNA, 14 bp, Homo sapiens
tcctggcagcccag

SEQ ID NO: 1341220 - DNA, 15 bp, Homo sapiens
tcctggcagcccaga

SEQ ID NO: 1341221 - DNA, 17 bp, Homo sapiens
tcctggcccactgcatc

SEQ ID NO: 1341222 - DNA, 18 bp, Homo sapiens
tcctggcctatccgctgc

SEQ ID NO: 1341223 - DNA, 22 bp, Homo sapiens
tcctgtccctgcgcctttcctt

SEQ ID NO: 1341224 - DNA, 12 bp, Homo sapiens
tcctgtggcccc

SEQ ID NO: 1341225 - DNA, 13 bp, Homo sapiens
tcctgtgtagcat

SEQ ID NO: 1341226 - DNA, 18 bp, Homo sapiens
tcctgttcagtaataaaa

SEQ ID NO: 1341227 - DNA, 21 bp, Homo sapiens
tcctgttgaatgacaaagtat

SEQ ID NO: 1341228 - DNA, 17 bp, Homo sapiens
tccttaaatcttaatgt

SEQ ID NO: 1341229 - DNA, 21 bp, Homo sapiens
tccttaaatcttaatgttcct

SEQ ID NO: 1341230 - DNA, 18 bp, Homo sapiens
tccttaattcactcccac

SEQ ID NO: 1341231 - DNA, 19 bp, Homo sapiens
tccttagaaaaaaaattat

SEQ ID NO: 1341232 - DNA, 20 bp, Homo sapiens
tccttatttggcgtgacccg

SEQ ID NO: 1341233 - DNA, 15 bp, Homo sapiens
tccttccagtataac

SEQ ID NO: 1341234 - DNA, 15 bp, Homo sapiens
tccttccatcaaata

SEQ ID NO: 1341235 - DNA, 12 bp, Homo sapiens
tccttctttaaa

SEQ ID NO: 1341236 - DNA, 21 bp, Homo sapiens
tccttgaagaactgcaggccc

SEQ ID NO: 1341237 - DNA, 16 bp, Homo sapiens
tccttgagtgtatgag

SEQ ID NO: 1341238 - DNA, 14 bp, Homo sapiens
tccttgatttcaaa

SEQ ID NO: 1341239 - DNA, 22 bp, Homo sapiens
tccttgatttcaaagttttgtt

SEQ ID NO: 1341240 - DNA, 18 bp, Homo sapiens
tccttggagaaatgaaaa

SEQ ID NO: 1341241 - DNA, 18 bp, Homo sapiens
tcctttggtcctgtcccc

SEQ ID NO: 1341242 - DNA, 18 bp, Homo sapiens
tcctttgttttctgacta

SEQ ID NO: 1341243 - DNA, 15 bp, Homo sapiens
tcctttttatttata

SEQ ID NO: 1341244 - DNA, 18 bp, Homo sapiens
tcctttttatttatatgt

SEQ ID NO: 1341245 - DNA, 17 bp, Homo sapiens
tcctttttgacactgaa

SEQ ID NO: 1341246 - DNA, 18 bp, Homo sapiens
tcgaagtcattaaactgg

SEQ ID NO: 1341247 - DNA, 20 bp, Homo sapiens
tcgaagtcattaaactggtt

SEQ ID NO: 1341248 - DNA, 12 bp, Homo sapiens
tcgaagtgctga

SEQ ID NO: 1341249 - DNA, 17 bp, Homo sapiens
tcgaatctctgtgcctt

SEQ ID NO: 1341250 - DNA, 18 bp, Homo sapiens
tcgagaccatcctggcta

SEQ ID NO: 1341251 - DNA, 23 bp, Homo sapiens
tcgagtgccgcatctcacagcta

SEQ ID NO: 1341252 - DNA, 14 bp, Homo sapiens
tcgatactgcgact

SEQ ID NO: 1341253 - DNA, 22 bp, Homo sapiens
tcgatactgcgactttctgcct

SEQ ID NO: 1341254 - DNA, 19 bp, Homo sapiens
tcgcccaggctggagtgca

SEQ ID NO: 1341255 - DNA, 16 bp, Homo sapiens
tcgccggatctgaggg

SEQ ID NO: 1341256 - DNA, 15 bp, Homo sapiens
tcgcgctcagtaaac

SEQ ID NO: 1341257 - DNA, 15 bp, Homo sapiens
tcgcttcttgcctct

SEQ ID NO: 1341258 - DNA, 21 bp, Homo sapiens
tcgcttcttgcctctgtgctg

SEQ ID NO: 1341259 - DNA, 15 bp, Homo sapiens
tcggcctagggcccc

SEQ ID NO: 1341260 - DNA, 17 bp, Homo sapiens
tcggcgtggcccaaggc

SEQ ID NO: 1341261 - DNA, 18 bp, Homo sapiens
tcggcgtggcccaaggct

SEQ ID NO: 1341262 - DNA, 16 bp, Homo sapiens
tcgggagacagcatca

SEQ ID NO: 1341263 - DNA, 22 bp, Homo sapiens
tcggtacccggggcccagggca

SEQ ID NO: 1341264 - DNA, 13 bp, Homo sapiens
tcggtactcccat

SEQ ID NO: 1341265 - DNA, 16 bp, Homo sapiens
tcggtaggttcagcca

SEQ ID NO: 1341266 - DNA, 20 bp, Homo sapiens
tcggtatccccccatcttgc

SEQ ID NO: 1341267 - DNA, 15 bp, Homo sapiens
tcgtctttcccatgg

SEQ ID NO: 1341268 - DNA, 21 bp, Homo sapiens
tcgtgaagaagcctgtaacac

SEQ ID NO: 1341269 - DNA, 14 bp, Homo sapiens
tcgtgcctgtgtcc

SEQ ID NO: 1341270 - DNA, 21 bp, Homo sapiens
tcgtgcctgtgtccatgcgct

SEQ ID NO: 1341271 - DNA, 22 bp, Homo sapiens
tcgtgctactgcactccagcct

SEQ ID NO: 1341272 - DNA, 20 bp, Homo sapiens
tcgtggactgagtgggaagc

SEQ ID NO: 1341273 - DNA, 15 bp, Homo sapiens
tcgtggggtgtgctg

SEQ ID NO: 1341274 - DNA, 20 bp, Homo sapiens
tctaaacaatgctgatttgg

SEQ ID NO: 1341275 - DNA, 20 bp, Homo sapiens
tctaaatctatttattaata

SEQ ID NO: 1341276 - DNA, 21 bp, Homo sapiens
tctaaatgtttggcatgtaaa

SEQ ID NO: 1341277 - DNA, 22 bp, Homo sapiens
tctaaatgtttggcatgtaaat

SEQ ID NO: 1341278 - DNA, 22 bp, Homo sapiens
tctaacagtgaagttttactgt

SEQ ID NO: 1341279 - DNA, 18 bp, Homo sapiens
tctaacctcgccctctcc

SEQ ID NO: 1341280 - DNA, 21 bp, Homo sapiens
tctaagactatatatataaat

SEQ ID NO: 1341281 - DNA, 15 bp, Homo sapiens
tctaatatatatgaa

SEQ ID NO: 1341282 - DNA, 19 bp, Homo sapiens
tctacaatctctttttgtt

SEQ ID NO: 1341283 - DNA, 22 bp, Homo sapiens
tctacaatctctttttgtttgc

SEQ ID NO: 1341284 - DNA, 21 bp, Homo sapiens
tctacagtggttttatactga

SEQ ID NO: 1341285 - DNA, 22 bp, Homo sapiens
tctacagtggttttatactgaa

SEQ ID NO: 1341286 - DNA, 12 bp, Homo sapiens
tctacgtttctt

SEQ ID NO: 1341287 - DNA, 17 bp, Homo sapiens
tctactagattgtgatc

SEQ ID NO: 1341288 - DNA, 19 bp, Homo sapiens
tctagaattatttttcact

SEQ ID NO: 1341289 - DNA, 21 bp, Homo sapiens
tctagagcttaatgctacatg

SEQ ID NO: 1341290 - DNA, 21 bp, Homo sapiens
tctagccagcccctcttcccc

SEQ ID NO: 1341291 - DNA, 19 bp, Homo sapiens
tctagggaaaaaccagcgt

SEQ ID NO: 1341292 - DNA, 12 bp, Homo sapiens
tctagtgatgat

SEQ ID NO: 1341293 - DNA, 17 bp, Homo sapiens
tctataaaatagatata

SEQ ID NO: 1341294 - DNA, 19 bp, Homo sapiens
tctatagcatcacttaaaa

SEQ ID NO: 1341295 - DNA, 20 bp, Homo sapiens
tctataggaacatatgaaaa

SEQ ID NO: 1341296 - DNA, 21 bp, Homo sapiens
tctataggaacatatgaaaat

SEQ ID NO: 1341297 - DNA, 14 bp, Homo sapiens
tctatatatataat

SEQ ID NO: 1341298 - DNA, 13 bp, Homo sapiens
tctatgctttcca

SEQ ID NO: 1341299 - DNA, 10 bp, Homo sapiens
tctattaata

SEQ ID NO: 1341300 - DNA, 12 bp, Homo sapiens
tctattaatata

SEQ ID NO: 1341301 - DNA, 15 bp, Homo sapiens
tctattatggaaaac

SEQ ID NO: 1341302 - DNA, 19 bp, Homo sapiens
tctattctgagaaaacaag

SEQ ID NO: 1341303 - DNA, 12 bp, Homo sapiens
tctattttaatc

SEQ ID NO: 1341304 - DNA, 19 bp, Homo sapiens
tctcaatgaaccataaatt

SEQ ID NO: 1341305 - DNA, 21 bp, Homo sapiens
tctcacactggttctcaatga

SEQ ID NO: 1341306 - DNA, 18 bp, Homo sapiens
tctcacagctatgcaaaa

SEQ ID NO: 1341307 - DNA, 23 bp, Homo sapiens
tctcactaaagcatgaaatgtga

SEQ ID NO: 1341308 - DNA, 15 bp, Homo sapiens
tctcactgtttgttt

SEQ ID NO: 1341309 - DNA, 19 bp, Homo sapiens
tctcactgtttgtttttat

SEQ ID NO: 1341310 - DNA, 17 bp, Homo sapiens
tctcagatttctgagga

SEQ ID NO: 1341311 - DNA, 19 bp, Homo sapiens
tctcagctttgagaagcct

SEQ ID NO: 1341312 - DNA, 16 bp, Homo sapiens
tctcaggagatttcat

SEQ ID NO: 1341313 - DNA, 23 bp, Homo sapiens
tctcaggccggcagccccagcct

SEQ ID NO: 1341314 - DNA, 12 bp, Homo sapiens
tctcagggcctg

SEQ ID NO: 1341315 - DNA, 14 bp, Homo sapiens
tctcagggcctggt

SEQ ID NO: 1341316 - DNA, 16 bp, Homo sapiens
tctcatttaagggaaa

SEQ ID NO: 1341317 - DNA, 19 bp, Homo sapiens
tctcatttaagggaaaaat

SEQ ID NO: 1341318 - DNA, 23 bp, Homo sapiens
tctcatttaagggaaaaatatat

SEQ ID NO: 1341319 - DNA, 22 bp, Homo sapiens
tgaaattacgggtacctgaaga

SEQ ID NO: 1341320 - DNA, 17 bp, Homo sapiens
tgaacaagcttcagtaa

SEQ ID NO: 1341321 - DNA, 14 bp, Homo sapiens
tgaaccacttgtag

SEQ ID NO: 1341322 - DNA, 15 bp, Homo sapiens
tgaaccacttgtaga

SEQ ID NO: 1341323 - DNA, 20 bp, Homo sapiens
tgaaccacttgtagatttga

SEQ ID NO: 1341324 - DNA, 16 bp, Homo sapiens
tgaaccataaaatgtc

SEQ ID NO: 1341325 - DNA, 16 bp, Homo sapiens
tgaaccataaattcaa

SEQ ID NO: 1341326 - DNA, 22 bp, Homo sapiens
tgaaccataaattcaactttgt

SEQ ID NO: 1341327 - DNA, 20 bp, Homo sapiens
tgaaccatggtgaagtgctt

SEQ ID NO: 1341328 - DNA, 22 bp, Homo sapiens
tgaacttaataactgtgtactg

SEQ ID NO: 1341329 - DNA, 21 bp, Homo sapiens
tgaacttatttacacatagtt

SEQ ID NO: 1341330 - DNA, 16 bp, Homo sapiens
tgaacttggaagcaca

SEQ ID NO: 1341331 - DNA, 16 bp, Homo sapiens
tgaacttttgtactga

SEQ ID NO: 1341332 - DNA, 18 bp, Homo sapiens
tgaacttttgtactgaat

SEQ ID NO: 1341333 - DNA, 14 bp, Homo sapiens
tgaagaactgcagg

SEQ ID NO: 1341334 - DNA, 18 bp, Homo sapiens
tgaagaactgcaggccct

SEQ ID NO: 1341335 - DNA, 16 bp, Homo sapiens
tgaagaatagaaacaa

SEQ ID NO: 1341336 - DNA, 18 bp, Homo sapiens
tgaagaatagaaacaagc

SEQ ID NO: 1341337 - DNA, 13 bp, Homo sapiens
tgaagaattgaaa

SEQ ID NO: 1341338 - DNA, 11 bp, Homo sapiens
tgaagaattta

SEQ ID NO: 1341339 - DNA, 13 bp, Homo sapiens
tgaagaatttaaa

SEQ ID NO: 1341340 - DNA, 15 bp, Homo sapiens
tgaagaatttaaaga

SEQ ID NO: 1341341 - DNA, 15 bp, Homo sapiens
tgaagatactttgta

SEQ ID NO: 1341342 - DNA, 19 bp, Homo sapiens
tgaagatactttgtattgt

SEQ ID NO: 1341343 - DNA, 16 bp, Homo sapiens
tgaagatccagctgcc

SEQ ID NO: 1341344 - DNA, 17 bp, Homo sapiens
tgaagatccagctgcct

SEQ ID NO: 1341345 - DNA, 15 bp, Homo sapiens
tgaagcaaatcagaa

SEQ ID NO: 1341346 - DNA, 17 bp, Homo sapiens
tgaagcatagataatat

SEQ ID NO: 1341347 - DNA, 18 bp, Homo sapiens
tgaagctgccctaataaa

SEQ ID NO: 1341348 - DNA, 13 bp, Homo sapiens
tgaagcttcatgc

SEQ ID NO: 1341349 - DNA, 23 bp, Homo sapiens
tgaaggaaaaacacaagcaaaaa

SEQ ID NO: 1341350 - DNA, 14 bp, Homo sapiens
tgaaggtttttgat

SEQ ID NO: 1341351 - DNA, 14 bp, Homo sapiens
tgaagtaatgaatt

SEQ ID NO: 1341352 - DNA, 20 bp, Homo sapiens
tgaagtaatgaatttttatg

SEQ ID NO: 1341353 - DNA, 17 bp, Homo sapiens
tgaagtttacaatcaaa

SEQ ID NO: 1341354 - DNA, 16 bp, Homo sapiens
tgaagttttactgtct

SEQ ID NO: 1341355 - DNA, 22 bp, Homo sapiens
tgaagtttttttgctgctgcct

SEQ ID NO: 1341356 - DNA, 13 bp, Homo sapiens
tgaataaagagcc

SEQ ID NO: 1341357 - DNA, 12 bp, Homo sapiens
tgaataaagtgt

SEQ ID NO: 1341358 - DNA, 13 bp, Homo sapiens
tgaataaatgtgt

SEQ ID NO: 1341359 - DNA, 21 bp, Homo sapiens
tgaataaattctataggaaca

SEQ ID NO: 1341360 - DNA, 12 bp, Homo sapiens
tgaataatacag

SEQ ID NO: 1341361 - DNA, 13 bp, Homo sapiens
tgaatactgcttg

SEQ ID NO: 1341362 - DNA, 16 bp, Homo sapiens
tgaatactgcttgaat

SEQ ID NO: 1341363 - DNA, 15 bp, Homo sapiens
tgaatacttgaacca

SEQ ID NO: 1341364 - DNA, 14 bp, Homo sapiens
tgaatatctattaa

SEQ ID NO: 1341365 - DNA, 23 bp, Homo sapiens
tgaatatgtagtatctatatgac

SEQ ID NO: 1341366 - DNA, 13 bp, Homo sapiens
tgaatattttcaa

SEQ ID NO: 1341367 - DNA, 15 bp, Homo sapiens
tgaatcaataatata

SEQ ID NO: 1341368 - DNA, 16 bp, Homo sapiens
tgaatcaataatatat

SEQ ID NO: 1341369 - DNA, 17 bp, Homo sapiens
tgaatcaataatatatt

SEQ ID NO: 1341370 - DNA, 18 bp, Homo sapiens
tgaatccttccattccac

SEQ ID NO: 1341371 - DNA, 21 bp, Homo sapiens
tgaatgccactgccttcgctt

SEQ ID NO: 1341372 - DNA, 11 bp, Homo sapiens
tgaatgctggg

SEQ ID NO: 1341373 - DNA, 18 bp, Homo sapiens
tgaatggggtctcaaagt

SEQ ID NO: 1341374 - DNA, 11 bp, Homo sapiens
tgaatgtattt

SEQ ID NO: 1341375 - DNA, 19 bp, Homo sapiens
tgaatgtatttatttggga

SEQ ID NO: 1341376 - DNA, 13 bp, Homo sapiens
tgaattattgaca

SEQ ID NO: 1341377 - DNA, 18 bp, Homo sapiens
tgaattattgacactgaa

SEQ ID NO: 1341378 - DNA, 17 bp, Homo sapiens
tgaatttacttccttgc

SEQ ID NO: 1341379 - DNA, 13 bp, Homo sapiens
tgaatttttaagc

SEQ ID NO: 1341380 - DNA, 15 bp, Homo sapiens
tgaatttttttgtaa

SEQ ID NO: 1341381 - DNA, 18 bp, Homo sapiens
tgacaaaaaatgttttaa

SEQ ID NO: 1341382 - DNA, 21 bp, Homo sapiens
tgacaacgtttcagcgactcc

SEQ ID NO: 1341383 - DNA, 16 bp, Homo sapiens
tgacaactgtgactgt

SEQ ID NO: 1341384 - DNA, 21 bp, Homo sapiens
tgacaagctggcttacactgg

SEQ ID NO: 1341385 - DNA, 21 bp, Homo sapiens
tgacaaggcacttcatgtaaa

SEQ ID NO: 1341386 - DNA, 17 bp, Homo sapiens
tgacaattctgttttta

SEQ ID NO: 1341387 - DNA, 18 bp, Homo sapiens
tgacaattttgtacaaat

SEQ ID NO: 1341388 - DNA, 22 bp, Homo sapiens
tgacaattttgtacaaatttgt

SEQ ID NO: 1341389 - DNA, 16 bp, Homo sapiens
tgacacaagtggacct

SEQ ID NO: 1341390 - DNA, 17 bp, Homo sapiens
tgacacaagtggacctt

SEQ ID NO: 1341391 - DNA, 12 bp, Homo sapiens
tgacactgaaag

SEQ ID NO: 1341392 - DNA, 18 bp, Homo sapiens
tgacactgaaagttttgt

SEQ ID NO: 1341393 - DNA, 22 bp, Homo sapiens
tgacactgaacttaataactgt

SEQ ID NO: 1341394 - DNA, 20 bp, Homo sapiens
tgacagaaggtgccacttta

SEQ ID NO: 1341395 - DNA, 22 bp, Homo sapiens
tgacagagcaagtgagaccctg

SEQ ID NO: 1341396 - DNA, 22 bp, Homo sapiens
tgacagagggatggaggaagaa

SEQ ID NO: 1341397 - DNA, 15 bp, Homo sapiens
tgacatggtgcctga

SEQ ID NO: 1341398 - DNA, 14 bp, Homo sapiens
tgacattaacaaat

SEQ ID NO: 1341399 - DNA, 19 bp, Homo sapiens
tgacattaacaaataaaaa

SEQ ID NO: 1341400 - DNA, 11 bp, Homo sapiens
tgacattgtct

SEQ ID NO: 1341401 - DNA, 14 bp, Homo sapiens
tgacattgtctcct

SEQ ID NO: 1341402 - DNA, 20 bp, Homo sapiens
tgaccacttgaggcctgatc

SEQ ID NO: 1341403 - DNA, 18 bp, Homo sapiens
tgaccatgctcatctgct

SEQ ID NO: 1341404 - DNA, 22 bp, Homo sapiens
tgaccattttttaatttacttg

SEQ ID NO: 1341405 - DNA, 14 bp, Homo sapiens
tgacccattgctgt

SEQ ID NO: 1341406 - DNA, 11 bp, Homo sapiens
tgaccctccaa

SEQ ID NO: 1341407 - DNA, 16 bp, Homo sapiens
tgaccggacttttctg

SEQ ID NO: 1341408 - DNA, 16 bp, Homo sapiens
tgacctctctctctgg

SEQ ID NO: 1341409 - DNA, 20 bp, Homo sapiens
tgacctctctctctgggact

SEQ ID NO: 1341410 - DNA, 17 bp, Homo sapiens
tgacctgaggctgtggt

SEQ ID NO: 1341411 - DNA, 14 bp, Homo sapiens
tgacgatgatgtac

SEQ ID NO: 1341412 - DNA, 12 bp, Homo sapiens
tgacgtttacat

SEQ ID NO: 1341413 - DNA, 15 bp, Homo sapiens
tgactaactcaaata

SEQ ID NO: 1341414 - DNA, 20 bp, Homo sapiens
tgactaactcaaatacacat

SEQ ID NO: 1341415 - DNA, 22 bp, Homo sapiens
tgactaactcaaatacacattt

SEQ ID NO: 1341416 - DNA, 18 bp, Homo sapiens
tgactatataatttattt

SEQ ID NO: 1341417 - DNA, 15 bp, Homo sapiens
tgactcggtttctcc

SEQ ID NO: 1341418 - DNA, 20 bp, Homo sapiens
tgactctgggtccttcctga

SEQ ID NO: 1341419 - DNA, 21 bp, Homo sapiens
tgactcttgagttgtttttgt

SEQ ID NO: 1341420 - DNA, 13 bp, Homo sapiens
tgactgaggcagt

SEQ ID NO: 1341421 - DNA, 13 bp, Homo sapiens
tgacttagaatcc

SEQ ID NO: 1341422 - DNA, 19 bp, Homo sapiens
tgacttagaatccctgtgt

SEQ ID NO: 1341423 - DNA, 15 bp, Homo sapiens
tgactttattattta

SEQ ID NO: 1341424 - DNA, 16 bp, Homo sapiens
tgactttattatttat

SEQ ID NO: 1341425 - DNA, 20 bp, Homo sapiens
tgacttttaaggctaaaact

SEQ ID NO: 1341426 - DNA, 18 bp, Homo sapiens
tgacttttataaagcatg

SEQ ID NO: 1341427 - DNA, 13 bp, Homo sapiens
tgagaaaacaagc

SEQ ID NO: 1341428 - DNA, 21 bp, Homo sapiens
tgagaaaattgaaataaagct

SEQ ID NO: 1341429 - DNA, 20 bp, Homo sapiens
tgagaaacatctcaataaag

SEQ ID NO: 1341430 - DNA, 23 bp, Homo sapiens
tgagaaactgtttgaaaacttca

SEQ ID NO: 1341431 - DNA, 18 bp, Homo sapiens
tgagaaacttaaatgtta

SEQ ID NO: 1341432 - DNA, 19 bp, Homo sapiens
tgagaaacttaaatgttat

SEQ ID NO: 1341433 - DNA, 14 bp, Homo sapiens
tgagaaatcctgga

SEQ ID NO: 1341434 - DNA, 20 bp, Homo sapiens
tgagaagcagaggaaggaga

SEQ ID NO: 1341435 - DNA, 13 bp, Homo sapiens
tgagaagccttca

SEQ ID NO: 1341436 - DNA, 15 bp, Homo sapiens
tgagaagccttcagc

SEQ ID NO: 1341437 - DNA, 20 bp, Homo sapiens
tgagaagccttcagctccag

SEQ ID NO: 1341438 - DNA, 23 bp, Homo sapiens
tgcccaagccagaggctgggttc

SEQ ID NO: 1341439 - DNA, 13 bp, Homo sapiens
tgcccaccccctg

SEQ ID NO: 1341440 - DNA, 14 bp, Homo sapiens
tgcccaccccctgc

SEQ ID NO: 1341441 - DNA, 12 bp, Homo sapiens
tgcccactgttt

SEQ ID NO: 1341442 - DNA, 19 bp, Homo sapiens
tgcccagaataagttattg

SEQ ID NO: 1341443 - DNA, 21 bp, Homo sapiens
tgcccagaataagttattgca

SEQ ID NO: 1341444 - DNA, 22 bp, Homo sapiens
tgcccagccccctggtctttga

SEQ ID NO: 1341445 - DNA, 22 bp, Homo sapiens
tgcccatcgtgaagaagcctgt

SEQ ID NO: 1341446 - DNA, 16 bp, Homo sapiens
tgccccatctcccctc

SEQ ID NO: 1341447 - DNA, 16 bp, Homo sapiens
tgcccccagccccggg

SEQ ID NO: 1341448 - DNA, 20 bp, Homo sapiens
tgcccccagccccggggtga

SEQ ID NO: 1341449 - DNA, 19 bp, Homo sapiens
tgcccgtgtagtccccaac

SEQ ID NO: 1341450 - DNA, 17 bp, Homo sapiens
tgcccgttcttgaaatg

SEQ ID NO: 1341451 - DNA, 14 bp, Homo sapiens
tgccctggctgctg

SEQ ID NO: 1341452 - DNA, 15 bp, Homo sapiens
tgccctggctgctgc

SEQ ID NO: 1341453 - DNA, 17 bp, Homo sapiens
tgccctggctgctgccc

SEQ ID NO: 1341454 - DNA, 20 bp, Homo sapiens
tgccctggctgctgccccca

SEQ ID NO: 1341455 - DNA, 16 bp, Homo sapiens
tgccgcatctcacagc

SEQ ID NO: 1341456 - DNA, 23 bp, Homo sapiens
tgccggacccggaggccgaggcc

SEQ ID NO: 1341457 - DNA, 15 bp, Homo sapiens
tgccggtgagaccca

SEQ ID NO: 1341458 - DNA, 12 bp, Homo sapiens
tgccgtctctgg

SEQ ID NO: 1341459 - DNA, 14 bp, Homo sapiens
tgccgtctctggag

SEQ ID NO: 1341460 - DNA, 13 bp, Homo sapiens
tgccgtggcacca

SEQ ID NO: 1341461 - DNA, 23 bp, Homo sapiens
tgccgtggggccgccgcctcttt

SEQ ID NO: 1341462 - DNA, 22 bp, Homo sapiens
tgcctcactaatttttgtatta

SEQ ID NO: 1341463 - DNA, 21 bp, Homo sapiens
tgcctccccatttcccatctg

SEQ ID NO: 1341464 - DNA, 22 bp, Homo sapiens
tgcctccccatttcccatctgc

SEQ ID NO: 1341465 - DNA, 12 bp, Homo sapiens
tgcctctttccc

SEQ ID NO: 1341466 - DNA, 17 bp, Homo sapiens
tgcctctttccctagga

SEQ ID NO: 1341467 - DNA, 13 bp, Homo sapiens
tgcctgaataaag

SEQ ID NO: 1341468 - DNA, 19 bp, Homo sapiens
tgcctgacagagggatgga

SEQ ID NO: 1341469 - DNA, 16 bp, Homo sapiens
tgcctgagaggcaggc

SEQ ID NO: 1341470 - DNA, 18 bp, Homo sapiens
tgcctgagaggcaggcat

SEQ ID NO: 1341471 - DNA, 18 bp, Homo sapiens
tgcctgatcctccaacag

SEQ ID NO: 1341472 - DNA, 23 bp, Homo sapiens
tgcctgcagggccatggctcagg

SEQ ID NO: 1341473 - DNA, 17 bp, Homo sapiens
tgcctgccccgccccca

SEQ ID NO: 1341474 - DNA, 19 bp, Homo sapiens
tgcctgccttaagtgagga

SEQ ID NO: 1341475 - DNA, 20 bp, Homo sapiens
tgcctggagacttagggcac

SEQ ID NO: 1341476 - DNA, 12 bp, Homo sapiens
tgcctggccccc

SEQ ID NO: 1341477 - DNA, 23 bp, Homo sapiens
tgcctgtggcgccgtctccaggg

SEQ ID NO: 1341478 - DNA, 13 bp, Homo sapiens
tgccttcgcttct

SEQ ID NO: 1341479 - DNA, 14 bp, Homo sapiens
tgccttcgcttctt

SEQ ID NO: 1341480 - DNA, 16 bp, Homo sapiens
tgccttcgcttcttgc

SEQ ID NO: 1341481 - DNA, 20 bp, Homo sapiens
tgccttcgtctttcccatgg

SEQ ID NO: 1341482 - DNA, 16 bp, Homo sapiens
tgccttcttttgatta

SEQ ID NO: 1341483 - DNA, 17 bp, Homo sapiens
tgccttggctcagacat

SEQ ID NO: 1341484 - DNA, 19 bp, Homo sapiens
tgcctttgcaccacgggac

SEQ ID NO: 1341485 - DNA, 19 bp, Homo sapiens
tgcctttttatttatatgt

SEQ ID NO: 1341486 - DNA, 19 bp, Homo sapiens
tgcgaaaggatgaaagtga

SEQ ID NO: 1341487 - DNA, 14 bp, Homo sapiens
tgcgaccctggggg

SEQ ID NO: 1341488 - DNA, 19 bp, Homo sapiens
tgcgaccctgggggcacag

SEQ ID NO: 1341489 - DNA, 21 bp, Homo sapiens
tgcgaccctgggggcacagga

SEQ ID NO: 1341490 - DNA, 17 bp, Homo sapiens
tgcgactttctgcctgg

SEQ ID NO: 1341491 - DNA, 22 bp, Homo sapiens
tgcgcatcttgcctccaggtgc

SEQ ID NO: 1341492 - DNA, 12 bp, Homo sapiens
tgcgcctgctgc

SEQ ID NO: 1341493 - DNA, 23 bp, Homo sapiens
tgcgctcagggccatgctgaggc

SEQ ID NO: 1341494 - DNA, 17 bp, Homo sapiens
tgcggcctttggcttca

SEQ ID NO: 1341495 - DNA, 23 bp, Homo sapiens
tgcgggtggggcttggggctcac

SEQ ID NO: 1341496 - DNA, 12 bp, Homo sapiens
tgcgtcccaaga

SEQ ID NO: 1341497 - DNA, 16 bp, Homo sapiens
tgcgtctatcctgtgt

SEQ ID NO: 1341498 - DNA, 22 bp, Homo sapiens
tgcgtcttggtgtaatttgaag

SEQ ID NO: 1341499 - DNA, 13 bp, Homo sapiens
tgctaacaaagac

SEQ ID NO: 1341500 - DNA, 22 bp, Homo sapiens
tgctaacaaagacaaaagtctg

SEQ ID NO: 1341501 - DNA, 12 bp, Homo sapiens
tgctacaatgtc

SEQ ID NO: 1341502 - DNA, 21 bp, Homo sapiens
tgctactgcactccagcctgg

SEQ ID NO: 1341503 - DNA, 19 bp, Homo sapiens
tgctatccccatctccctg

SEQ ID NO: 1341504 - DNA, 22 bp, Homo sapiens
tgctatccccatctccctgcct

SEQ ID NO: 1341505 - DNA, 19 bp, Homo sapiens
tgctatttattttcctaaa

SEQ ID NO: 1341506 - DNA, 20 bp, Homo sapiens
tgctatttgaacaagtgggc

SEQ ID NO: 1341507 - DNA, 13 bp, Homo sapiens
tgctcaaagaaat

SEQ ID NO: 1341508 - DNA, 15 bp, Homo sapiens
tgctcaaagaaatct

SEQ ID NO: 1341509 - DNA, 19 bp, Homo sapiens
tgctcaccgcccatcaggg

SEQ ID NO: 1341510 - DNA, 15 bp, Homo sapiens
tgctcatctgctggt

SEQ ID NO: 1341511 - DNA, 15 bp, Homo sapiens
tgctccagcaacaca

SEQ ID NO: 1341512 - DNA, 16 bp, Homo sapiens
tgctccagctgttcag

SEQ ID NO: 1341513 - DNA, 18 bp, Homo sapiens
tgctccatagtttggcat

SEQ ID NO: 1341514 - DNA, 11 bp, Homo sapiens
tgctccccaca

SEQ ID NO: 1341515 - DNA, 13 bp, Homo sapiens
tgctccccacagc

SEQ ID NO: 1341516 - DNA, 23 bp, Homo sapiens
tgctccccacagcgtccctggcg

SEQ ID NO: 1341517 - DNA, 16 bp, Homo sapiens
tgctctatgctttcca

SEQ ID NO: 1341518 - DNA, 18 bp, Homo sapiens
tgctctatgctttccaaa

SEQ ID NO: 1341519 - DNA, 23 bp, Homo sapiens
tgctgaatacagaggcaactgca

SEQ ID NO: 1341520 - DNA, 16 bp, Homo sapiens
tgctgactgttttctc

SEQ ID NO: 1341521 - DNA, 13 bp, Homo sapiens
tgctgacttagaa

SEQ ID NO: 1341522 - DNA, 14 bp, Homo sapiens
tgctgagcctctgc

SEQ ID NO: 1341523 - DNA, 20 bp, Homo sapiens
tgctgagcctctgctcccca

SEQ ID NO: 1341524 - DNA, 15 bp, Homo sapiens
tgctgaggcctgggc

SEQ ID NO: 1341525 - DNA, 17 bp, Homo sapiens
tgctgagggtttgaata

SEQ ID NO: 1341526 - DNA, 21 bp, Homo sapiens
tgctgagtctgttctggtaat

SEQ ID NO: 1341527 - DNA, 21 bp, Homo sapiens
tgctgcaggacttgagaagac

SEQ ID NO: 1341528 - DNA, 14 bp, Homo sapiens
tgctgcccccaccc

SEQ ID NO: 1341529 - DNA, 15 bp, Homo sapiens
tgctgcccccacccc

SEQ ID NO: 1341530 - DNA, 22 bp, Homo sapiens
tgctgccctgaagaatggcgcc

SEQ ID NO: 1341531 - DNA, 16 bp, Homo sapiens
tgctggagcactgggc

SEQ ID NO: 1341532 - DNA, 20 bp, Homo sapiens
tgctggagcactgggctccc

SEQ ID NO: 1341533 - DNA, 18 bp, Homo sapiens
tgctggagtctcctgagg

SEQ ID NO: 1341534 - DNA, 14 bp, Homo sapiens
tgctggccccagcc

SEQ ID NO: 1341535 - DNA, 23 bp, Homo sapiens
tgctgggactcagccttcagaca

SEQ ID NO: 1341536 - DNA, 15 bp, Homo sapiens
tgctgggagctccac

SEQ ID NO: 1341537 - DNA, 18 bp, Homo sapiens
tgctgggagctccactct

SEQ ID NO: 1341538 - DNA, 16 bp, Homo sapiens
tgctgggcggctgtgc

SEQ ID NO: 1341539 - DNA, 20 bp, Homo sapiens
tgctgggggcaactggccat

SEQ ID NO: 1341540 - DNA, 14 bp, Homo sapiens
tgctggtaaaatga

SEQ ID NO: 1341541 - DNA, 19 bp, Homo sapiens
tgctggtaaaatgaagaat

SEQ ID NO: 1341542 - DNA, 13 bp, Homo sapiens
tgctggtccgtgg

SEQ ID NO: 1341543 - DNA, 16 bp, Homo sapiens
tgctggtccgtgggac

SEQ ID NO: 1341544 - DNA, 14 bp, Homo sapiens
tgctgtacaaaagc

SEQ ID NO: 1341545 - DNA, 20 bp, Homo sapiens
tgctgtacacatatttgaag

SEQ ID NO: 1341546 - DNA, 21 bp, Homo sapiens
tgctgtcccatagtccctgcc

SEQ ID NO: 1341547 - DNA, 18 bp, Homo sapiens
tgctgtgagggaggggaa

SEQ ID NO: 1341548 - DNA, 23 bp, Homo sapiens
tgctgtgagggaggggaaaagca

SEQ ID NO: 1341549 - DNA, 18 bp, Homo sapiens
tgctgtgtgtcccaggca

SEQ ID NO: 1341550 - DNA, 21 bp, Homo sapiens
tgcttaaaccacttaaacgaa

SEQ ID NO: 1341551 - DNA, 13 bp, Homo sapiens
tgcttaaatttct

SEQ ID NO: 1341552 - DNA, 15 bp, Homo sapiens
tgcttaaatttctta

SEQ ID NO: 1341553 - DNA, 22 bp, Homo sapiens
tgcttaaatttcttatgtgaca

SEQ ID NO: 1341554 - DNA, 16 bp, Homo sapiens
tgcttaatcttcaaag

SEQ ID NO: 1341555 - DNA, 16 bp, Homo sapiens
tgcttcacagtagagc

SEQ ID NO: 1341556 - DNA, 19 bp, Homo sapiens
tggtgctgctgctgctgtg

SEQ ID NO: 1341557 - DNA, 18 bp, Homo sapiens
tggtgtagccctcccact

SEQ ID NO: 1341558 - DNA, 16 bp, Homo sapiens
tggtgtgaacccggga

SEQ ID NO: 1341559 - DNA, 14 bp, Homo sapiens
tggttacttcttct

SEQ ID NO: 1341560 - DNA, 13 bp, Homo sapiens
tggttatgttttt

SEQ ID NO: 1341561 - DNA, 21 bp, Homo sapiens
tggttccagggtccctctgtg

SEQ ID NO: 1341562 - DNA, 11 bp, Homo sapiens
tggttctcaat

SEQ ID NO: 1341563 - DNA, 12 bp, Homo sapiens
tggttctcaatg

SEQ ID NO: 1341564 - DNA, 13 bp, Homo sapiens
tggttttcctgtg

SEQ ID NO: 1341565 - DNA, 18 bp, Homo sapiens
tggttttgtgccatctgt

SEQ ID NO: 1341566 - DNA, 21 bp, Homo sapiens
tggtttttaaaaaactgctga

SEQ ID NO: 1341567 - DNA, 23 bp, Homo sapiens
tgtaaataattcttttttattaa

SEQ ID NO: 1341568 - DNA, 15 bp, Homo sapiens
tgtaaatgtgtacat

SEQ ID NO: 1341569 - DNA, 13 bp, Homo sapiens
tgtaaattctgat

SEQ ID NO: 1341570 - DNA, 14 bp, Homo sapiens
tgtaaattctgatt

SEQ ID NO: 1341571 - DNA, 18 bp, Homo sapiens
tgtaaattctgatttctt

SEQ ID NO: 1341572 - DNA, 22 bp, Homo sapiens
tgtaaattctgatttcttttca

SEQ ID NO: 1341573 - DNA, 14 bp, Homo sapiens
tgtaaatttagtgt

SEQ ID NO: 1341574 - DNA, 15 bp, Homo sapiens
tgtaaatttagtgtt

SEQ ID NO: 1341575 - DNA, 16 bp, Homo sapiens
tgtaacactcctctgc

SEQ ID NO: 1341576 - DNA, 15 bp, Homo sapiens
tgtaacttccaaata

SEQ ID NO: 1341577 - DNA, 17 bp, Homo sapiens
tgtaacttccaaataaa

SEQ ID NO: 1341578 - DNA, 16 bp, Homo sapiens
tgtaacttgcttaaat

SEQ ID NO: 1341579 - DNA, 20 bp, Homo sapiens
tgtaacttgcttaaatttct

SEQ ID NO: 1341580 - DNA, 17 bp, Homo sapiens
tgtaagcactctggatg

SEQ ID NO: 1341581 - DNA, 20 bp, Homo sapiens
tgtaagcatactttgtaaat

SEQ ID NO: 1341582 - DNA, 13 bp, Homo sapiens
tgtaataaacttt

SEQ ID NO: 1341583 - DNA, 13 bp, Homo sapiens
tgtaataagcaat

SEQ ID NO: 1341584 - DNA, 14 bp, Homo sapiens
tgtaataatagact

SEQ ID NO: 1341585 - DNA, 15 bp, Homo sapiens
tgtaatgaaaatgaa

SEQ ID NO: 1341586 - DNA, 21 bp, Homo sapiens
tgtaatgaaaatgaatatcta

SEQ ID NO: 1341587 - DNA, 15 bp, Homo sapiens
tgtaattaaattctg

SEQ ID NO: 1341588 - DNA, 19 bp, Homo sapiens
tgtacaaaattaagcaaat

SEQ ID NO: 1341589 - DNA, 17 bp, Homo sapiens
tgtacacatatttgaag

SEQ ID NO: 1341590 - DNA, 19 bp, Homo sapiens
tgtacagattctttcagtt

SEQ ID NO: 1341591 - DNA, 14 bp, Homo sapiens
tgtacagtagattt

SEQ ID NO: 1341592 - DNA, 16 bp, Homo sapiens
tgtacatttgggagtt

SEQ ID NO: 1341593 - DNA, 23 bp, Homo sapiens
tgtacgtggccatgtatgaagcc

SEQ ID NO: 1341594 - DNA, 14 bp, Homo sapiens
tgtactaaacagta

SEQ ID NO: 1341595 - DNA, 20 bp, Homo sapiens
tgtactgaatttttttgtaa

SEQ ID NO: 1341596 - DNA, 23 bp, Homo sapiens
tgtactgaatttttttgtaataa

SEQ ID NO: 1341597 - DNA, 23 bp, Homo sapiens
tgtacttttattttacacagaaa

SEQ ID NO: 1341598 - DNA, 14 bp, Homo sapiens
tgtagactgtggct

SEQ ID NO: 1341599 - DNA, 13 bp, Homo sapiens
tgtagatttgatt

SEQ ID NO: 1341600 - DNA, 18 bp, Homo sapiens
tgtagccccctggcctct

SEQ ID NO: 1341601 - DNA, 20 bp, Homo sapiens
tgtagccccctggcctctgt

SEQ ID NO: 1341602 - DNA, 21 bp, Homo sapiens
tgtagccctcccactttgctg

SEQ ID NO: 1341603 - DNA, 18 bp, Homo sapiens
tgtaggagacttgccaga

SEQ ID NO: 1341604 - DNA, 22 bp, Homo sapiens
tgtagggagggcggcaggggcc

SEQ ID NO: 1341605 - DNA, 15 bp, Homo sapiens
tgtaggtaagactgt

SEQ ID NO: 1341606 - DNA, 14 bp, Homo sapiens
tgtaggtcctcaga

SEQ ID NO: 1341607 - DNA, 23 bp, Homo sapiens
tgtagtcccagctacttgggagg

SEQ ID NO: 1341608 - DNA, 12 bp, Homo sapiens
tgtagttcttta

SEQ ID NO: 1341609 - DNA, 15 bp, Homo sapiens
tgtagttctttaaac

SEQ ID NO: 1341610 - DNA, 16 bp, Homo sapiens
tgtataaaatacatag

SEQ ID NO: 1341611 - DNA, 19 bp, Homo sapiens
tgtataaaatacatagtga

SEQ ID NO: 1341612 - DNA, 13 bp, Homo sapiens
tgtataaatatac

SEQ ID NO: 1341613 - DNA, 14 bp, Homo sapiens
tgtataataagaaa

SEQ ID NO: 1341614 - DNA, 13 bp, Homo sapiens
tgtatacagtgca

SEQ ID NO: 1341615 - DNA, 22 bp, Homo sapiens
tgtatacagtgcagagccttct

SEQ ID NO: 1341616 - DNA, 13 bp, Homo sapiens
tgtatagttatgt

SEQ ID NO: 1341617 - DNA, 15 bp, Homo sapiens
tgtatagttatgtaa

SEQ ID NO: 1341618 - DNA, 22 bp, Homo sapiens
tgtatatattttgtgtgaaatt

SEQ ID NO: 1341619 - DNA, 19 bp, Homo sapiens
tgtatatggtatatataca

SEQ ID NO: 1341620 - DNA, 15 bp, Homo sapiens
tgtatattacaatga

SEQ ID NO: 1341621 - DNA, 20 bp, Homo sapiens
tgtatattggttttatgatg

SEQ ID NO: 1341622 - DNA, 16 bp, Homo sapiens
tgtatatttgatttat

SEQ ID NO: 1341623 - DNA, 17 bp, Homo sapiens
tgtatatttgatttatt

SEQ ID NO: 1341624 - DNA, 18 bp, Homo sapiens
tgtatatttgtaaagcta

SEQ ID NO: 1341625 - DNA, 19 bp, Homo sapiens
tgtatcctggaacaatatt

SEQ ID NO: 1341626 - DNA, 19 bp, Homo sapiens
tgtatgaaaacatggaaca

SEQ ID NO: 1341627 - DNA, 16 bp, Homo sapiens
tgtatgactgcacatg

SEQ ID NO: 1341628 - DNA, 17 bp, Homo sapiens
tgtatgagtagccaggg

SEQ ID NO: 1341629 - DNA, 17 bp, Homo sapiens
tgtatggggaatctaag

SEQ ID NO: 1341630 - DNA, 16 bp, Homo sapiens
tgtatgtcagaagtgc

SEQ ID NO: 1341631 - DNA, 15 bp, Homo sapiens
tgtatgtgtgttttt

SEQ ID NO: 1341632 - DNA, 19 bp, Homo sapiens
tgtatgtgtttagaattga

SEQ ID NO: 1341633 - DNA, 22 bp, Homo sapiens
tgtatgttaaagagaatgagtc

SEQ ID NO: 1341634 - DNA, 14 bp, Homo sapiens
tgtattatttataa

SEQ ID NO: 1341635 - DNA, 16 bp, Homo sapiens
tgtattcttttctcag

SEQ ID NO: 1341636 - DNA, 19 bp, Homo sapiens
tgtattcttttctcagtgt

SEQ ID NO: 1341637 - DNA, 16 bp, Homo sapiens
tgtattgtatattaca

SEQ ID NO: 1341638 - DNA, 21 bp, Homo sapiens
tgtattgtatattacaatgat

SEQ ID NO: 1341639 - DNA, 20 bp, Homo sapiens
tgtatttaaaaatagaaaca

SEQ ID NO: 1341640 - DNA, 14 bp, Homo sapiens
tgtatttgcttttt

SEQ ID NO: 1341641 - DNA, 18 bp, Homo sapiens
tgtattttatttagacaa

SEQ ID NO: 1341642 - DNA, 22 bp, Homo sapiens
tgtattttatttagacaagaga

SEQ ID NO: 1341643 - DNA, 14 bp, Homo sapiens
tgtattttcagagc

SEQ ID NO: 1341644 - DNA, 12 bp, Homo sapiens
tgtattttcatg

SEQ ID NO: 1341645 - DNA, 21 bp, Homo sapiens
tgtatttttttttctaagaga

SEQ ID NO: 1341646 - DNA, 22 bp, Homo sapiens
tgtatttttttttctaagagaa

SEQ ID NO: 1341647 - DNA, 12 bp, Homo sapiens
tgtcaaaagtag

SEQ ID NO: 1341648 - DNA, 18 bp, Homo sapiens
tgtcaaactgtagaaatg

SEQ ID NO: 1341649 - DNA, 15 bp, Homo sapiens
tgtcaatttctgtgt

SEQ ID NO: 1341650 - DNA, 20 bp, Homo sapiens
tgtcacatttagctgtgctc

SEQ ID NO: 1341651 - DNA, 23 bp, Homo sapiens
tgtcacccaaaccggcaggtgcg

SEQ ID NO: 1341652 - DNA, 21 bp, Homo sapiens
tgtcactcattgctgagcctc

SEQ ID NO: 1341653 - DNA, 22 bp, Homo sapiens
tgtcactcattgctgagcctct

SEQ ID NO: 1341654 - DNA, 15 bp, Homo sapiens
tgtcagcatagaagt

SEQ ID NO: 1341655 - DNA, 14 bp, Homo sapiens
tgtcaggccttcag

SEQ ID NO: 1341656 - DNA, 23 bp, Homo sapiens
tgtcataacatccagagctttgt

SEQ ID NO: 1341657 - DNA, 21 bp, Homo sapiens
tgtcattgcacataagcttcc

SEQ ID NO: 1341658 - DNA, 15 bp, Homo sapiens
tgtcatttcagaagt

SEQ ID NO: 1341659 - DNA, 23 bp, Homo sapiens
tgtccacgcgtgccgtggcacca

SEQ ID NO: 1341660 - DNA, 15 bp, Homo sapiens
tgtccagcaccttgt

SEQ ID NO: 1341661 - DNA, 17 bp, Homo sapiens
tgtccagtaagatcact

SEQ ID NO: 1341662 - DNA, 18 bp, Homo sapiens
tgtccatgcgctcagggc

SEQ ID NO: 1341663 - DNA, 14 bp, Homo sapiens
tgtcccaggcaggg

SEQ ID NO: 1341664 - DNA, 19 bp, Homo sapiens
tgtcccatagtccctgcca

SEQ ID NO: 1341665 - DNA, 15 bp, Homo sapiens
tgtcctaatggtgat

SEQ ID NO: 1341666 - DNA, 16 bp, Homo sapiens
tgtcctattagtgtta

SEQ ID NO: 1341667 - DNA, 17 bp, Homo sapiens
tgtcctattagtgttat

SEQ ID NO: 1341668 - DNA, 14 bp, Homo sapiens
tgtcctgtcctgct

SEQ ID NO: 1341669 - DNA, 12 bp, Homo sapiens
tgtctaaagtgt

SEQ ID NO: 1341670 - DNA, 19 bp, Homo sapiens
tgtctaaagtgtattttca

SEQ ID NO: 1341671 - DNA, 18 bp, Homo sapiens
tgtctcctatatatttct

SEQ ID NO: 1341672 - DNA, 17 bp, Homo sapiens
tgtctccttaagctgca

SEQ ID NO: 1341673 - DNA, 20 bp, Homo sapiens
tgtctctcttctcagagtgg

SEQ ID NO: 1341674 - DNA, 13 bp, Homo sapiens
ttactggttgcat

SEQ ID NO: 1341675 - DNA, 14 bp, Homo sapiens
ttactggttgcatg

SEQ ID NO: 1341676 - DNA, 15 bp, Homo sapiens
ttactggttgcatgg

SEQ ID NO: 1341677 - DNA, 17 bp, Homo sapiens
ttactgtttattacttc

SEQ ID NO: 1341678 - DNA, 14 bp, Homo sapiens
ttacttccatgaat

SEQ ID NO: 1341679 - DNA, 17 bp, Homo sapiens
ttacttgttgcctataa

SEQ ID NO: 1341680 - DNA, 13 bp, Homo sapiens
ttactttgctgag

SEQ ID NO: 1341681 - DNA, 14 bp, Homo sapiens
ttactttgtaaatt

SEQ ID NO: 1341682 - DNA, 17 bp, Homo sapiens
ttactttgtaaattctg

SEQ ID NO: 1341683 - DNA, 19 bp, Homo sapiens
ttactttgtaaattctgat

SEQ ID NO: 1341684 - DNA, 22 bp, Homo sapiens
ttactttgtaaattctgatttc

SEQ ID NO: 1341685 - DNA, 13 bp, Homo sapiens
ttagaacaggttt

SEQ ID NO: 1341686 - DNA, 19 bp, Homo sapiens
ttagaataagaatttgcat

SEQ ID NO: 1341687 - DNA, 17 bp, Homo sapiens
ttagaatccctgtgtta

SEQ ID NO: 1341688 - DNA, 18 bp, Homo sapiens
ttagaattgaaggttttt

SEQ ID NO: 1341689 - DNA, 21 bp, Homo sapiens
ttagactcatcaatcaaataa

SEQ ID NO: 1341690 - DNA, 13 bp, Homo sapiens
ttagacttgaaaa

SEQ ID NO: 1341691 - DNA, 19 bp, Homo sapiens
ttagacttgaaaagagaca

SEQ ID NO: 1341692 - DNA, 21 bp, Homo sapiens
ttagatttgccatagagtaca

SEQ ID NO: 1341693 - DNA, 18 bp, Homo sapiens
ttagccaagtgtggtaga

SEQ ID NO: 1341694 - DNA, 15 bp, Homo sapiens
ttaggcttaaaaact

SEQ ID NO: 1341695 - DNA, 23 bp, Homo sapiens
ttagggactacccatagacatga

SEQ ID NO: 1341696 - DNA, 17 bp, Homo sapiens
ttagggagtattctaat

SEQ ID NO: 1341697 - DNA, 19 bp, Homo sapiens
ttaggtgtgggggaagcac

SEQ ID NO: 1341698 - DNA, 12 bp, Homo sapiens
ttagtggcaccg

SEQ ID NO: 1341699 - DNA, 13 bp, Homo sapiens
ttagtggcaccgc

SEQ ID NO: 1341700 - DNA, 14 bp, Homo sapiens
ttagtgttatatga

SEQ ID NO: 1341701 - DNA, 16 bp, Homo sapiens
ttagttcctcattagc

SEQ ID NO: 1341702 - DNA, 14 bp, Homo sapiens
ttagttccttgagt

SEQ ID NO: 1341703 - DNA, 16 bp, Homo sapiens
ttagtttgtgtgttgt

SEQ ID NO: 1341704 - DNA, 20 bp, Homo sapiens
ttataaaatggctgtaatca

SEQ ID NO: 1341705 - DNA, 13 bp, Homo sapiens
ttataaacagaaa

SEQ ID NO: 1341706 - DNA, 21 bp, Homo sapiens
ttataagaagaagttcatgtc

SEQ ID NO: 1341707 - DNA, 17 bp, Homo sapiens
ttataagtgaagtgata

SEQ ID NO: 1341708 - DNA, 16 bp, Homo sapiens
ttataatccttaaatc

SEQ ID NO: 1341709 - DNA, 18 bp, Homo sapiens
ttataatcttataattgt

SEQ ID NO: 1341710 - DNA, 20 bp, Homo sapiens
ttataattgtacaaaattaa

SEQ ID NO: 1341711 - DNA, 20 bp, Homo sapiens
ttatacaaacctaccaaaat

SEQ ID NO: 1341712 - DNA, 20 bp, Homo sapiens
ttatagcctggactgctacc

SEQ ID NO: 1341713 - DNA, 12 bp, Homo sapiens
ttatataactgt

SEQ ID NO: 1341714 - DNA, 18 bp, Homo sapiens
ttatataactgtatttga

SEQ ID NO: 1341715 - DNA, 15 bp, Homo sapiens
ttatatgaacataca

SEQ ID NO: 1341716 - DNA, 21 bp, Homo sapiens
ttatatgaacatacaaatgca

SEQ ID NO: 1341717 - DNA, 14 bp, Homo sapiens
ttatatgtactgtt

SEQ ID NO: 1341718 - DNA, 19 bp, Homo sapiens
ttatatttatatttcaggt

SEQ ID NO: 1341719 - DNA, 18 bp, Homo sapiens
ttatatttatgtgtctgt

SEQ ID NO: 1341720 - DNA, 15 bp, Homo sapiens
ttatatttattgact

SEQ ID NO: 1341721 - DNA, 20 bp, Homo sapiens
ttatatttattgactcttga

SEQ ID NO: 1341722 - DNA, 13 bp, Homo sapiens
ttatatttccttt

SEQ ID NO: 1341723 - DNA, 20 bp, Homo sapiens
ttatatttcctttatgtgaa

SEQ ID NO: 1341724 - DNA, 15 bp, Homo sapiens
ttatcaatatctaat

SEQ ID NO: 1341725 - DNA, 16 bp, Homo sapiens
ttatcaatatctaata

SEQ ID NO: 1341726 - DNA, 17 bp, Homo sapiens
ttatcccaagaatgcaa

SEQ ID NO: 1341727 - DNA, 23 bp, Homo sapiens
ttatctgggattatggttttgtg

SEQ ID NO: 1341728 - DNA, 12 bp, Homo sapiens
ttatctgggctt

SEQ ID NO: 1341729 - DNA, 15 bp, Homo sapiens
ttatcttacaatatt

SEQ ID NO: 1341730 - DNA, 20 bp, Homo sapiens
ttatcttacaatattgattg

SEQ ID NO: 1341731 - DNA, 14 bp, Homo sapiens
ttatcttgatacat

SEQ ID NO: 1341732 - DNA, 17 bp, Homo sapiens
ttatcttgatacattca

SEQ ID NO: 1341733 - DNA, 18 bp, Homo sapiens
ttatcttgatacattcaa

SEQ ID NO: 1341734 - DNA, 22 bp, Homo sapiens
ttatgagaaacttaaatgttat

SEQ ID NO: 1341735 - DNA, 16 bp, Homo sapiens
ttatgcatcatttcag

SEQ ID NO: 1341736 - DNA, 16 bp, Homo sapiens
ttatggatgatttaag

SEQ ID NO: 1341737 - DNA, 17 bp, Homo sapiens
ttatggatgatttaagt

SEQ ID NO: 1341738 - DNA, 15 bp, Homo sapiens
ttatgggcccctggc

SEQ ID NO: 1341739 - DNA, 12 bp, Homo sapiens
ttatgtaaataa

SEQ ID NO: 1341740 - DNA, 11 bp, Homo sapiens
ttatgtgaatt

SEQ ID NO: 1341741 - DNA, 19 bp, Homo sapiens
ttattaacttaataatcaa

SEQ ID NO: 1341742 - DNA, 12 bp, Homo sapiens
ttattaatcact

SEQ ID NO: 1341743 - DNA, 18 bp, Homo sapiens
ttattaatcactgtgtat

SEQ ID NO: 1341744 - DNA, 12 bp, Homo sapiens
ttattaatgttt

SEQ ID NO: 1341745 - DNA, 15 bp, Homo sapiens
ttattacatgtaatt

SEQ ID NO: 1341746 - DNA, 22 bp, Homo sapiens
ttattaccccctccttcagaca

SEQ ID NO: 1341747 - DNA, 14 bp, Homo sapiens
ttattacttccatg

SEQ ID NO: 1341748 - DNA, 12 bp, Homo sapiens
ttattagatgtt

SEQ ID NO: 1341749 - DNA, 22 bp, Homo sapiens
ttattagccaggtaatgtgaat

SEQ ID NO: 1341750 - DNA, 14 bp, Homo sapiens
ttattcaacagcaa

SEQ ID NO: 1341751 - DNA, 13 bp, Homo sapiens
ttattgacactga

SEQ ID NO: 1341752 - DNA, 17 bp, Homo sapiens
ttattgacactgaactt

SEQ ID NO: 1341753 - DNA, 22 bp, Homo sapiens
ttattgaccattttttaattta

SEQ ID NO: 1341754 - DNA, 16 bp, Homo sapiens
ttattgactcttgagt

SEQ ID NO: 1341755 - DNA, 14 bp, Homo sapiens
ttattgtatttatg

SEQ ID NO: 1341756 - DNA, 12 bp, Homo sapiens
ttatttaaatta

SEQ ID NO: 1341757 - DNA, 15 bp, Homo sapiens
ttatttacagatgaa

SEQ ID NO: 1341758 - DNA, 21 bp, Homo sapiens
ttatttatatggggaatatat

SEQ ID NO: 1341759 - DNA, 18 bp, Homo sapiens
ttatttatatgtactgtt

SEQ ID NO: 1341760 - DNA, 22 bp, Homo sapiens
ttatttatccagaaaactgtga

SEQ ID NO: 1341761 - DNA, 18 bp, Homo sapiens
ttatttccactaaaaata

SEQ ID NO: 1341762 - DNA, 20 bp, Homo sapiens
ttatttgaacaatgaagttg

SEQ ID NO: 1341763 - DNA, 19 bp, Homo sapiens
ttatttgattatttaagac

SEQ ID NO: 1341764 - DNA, 20 bp, Homo sapiens
ttatttgattatttaagact

SEQ ID NO: 1341765 - DNA, 13 bp, Homo sapiens
ttatttgcatgtt

SEQ ID NO: 1341766 - DNA, 18 bp, Homo sapiens
ttattttctacgtttctt

SEQ ID NO: 1341767 - DNA, 19 bp, Homo sapiens
ttattttctacgtttcttt

SEQ ID NO: 1341768 - DNA, 14 bp, Homo sapiens
ttattttgtgtaaa

SEQ ID NO: 1341769 - DNA, 14 bp, Homo sapiens
ttatttttcactct

SEQ ID NO: 1341770 - DNA, 19 bp, Homo sapiens
ttattttttttaattgtat

SEQ ID NO: 1341771 - DNA, 21 bp, Homo sapiens
ttcaaaaggtattatacatgt

SEQ ID NO: 1341772 - DNA, 15 bp, Homo sapiens
ttcaaactggggcct

SEQ ID NO: 1341773 - DNA, 16 bp, Homo sapiens
ttcaaactggggcctc

SEQ ID NO: 1341774 - DNA, 16 bp, Homo sapiens
ttcaaaggaacattgt

SEQ ID NO: 1341775 - DNA, 22 bp, Homo sapiens
ttcaaatttgtctggttaaaaa

SEQ ID NO: 1341776 - DNA, 15 bp, Homo sapiens
ttcaactgtcttcct

SEQ ID NO: 1341777 - DNA, 22 bp, Homo sapiens
ttcaagcagtcgtgcctgtgtc

SEQ ID NO: 1341778 - DNA, 22 bp, Homo sapiens
ttcaaggtcactgtttcctggg

SEQ ID NO: 1341779 - DNA, 17 bp, Homo sapiens
ttcaatagcacatatgg

SEQ ID NO: 1341780 - DNA, 15 bp, Homo sapiens
ttcaatatattgaac

SEQ ID NO: 1341781 - DNA, 18 bp, Homo sapiens
ttcaatatattgaacttt

SEQ ID NO: 1341782 - DNA, 17 bp, Homo sapiens
ttcacggaagagccttg

SEQ ID NO: 1341783 - DNA, 13 bp, Homo sapiens
ttcactccagcct

SEQ ID NO: 1341784 - DNA, 19 bp, Homo sapiens
ttcacttgtgttttaaaat

SEQ ID NO: 1341785 - DNA, 14 bp, Homo sapiens
ttcagaaaaagaaa

SEQ ID NO: 1341786 - DNA, 22 bp, Homo sapiens
ttcagaaatataacacattttt

SEQ ID NO: 1341787 - DNA, 15 bp, Homo sapiens
ttcagaagttagttt

SEQ ID NO: 1341788 - DNA, 13 bp, Homo sapiens
ttcagatgccact

SEQ ID NO: 1341789 - DNA, 18 bp, Homo sapiens
ttcagatgccacttctaa

SEQ ID NO: 1341790 - DNA, 17 bp, Homo sapiens
ttcagcattaagctgtt

SEQ ID NO: 1341791 - DNA, 22 bp, Homo sapiens
ttcagcattaagctgttcctgt

SEQ ID NO: 1341792 - DNA, 11 bp, Homo sapiens
ttcagccaagg

SEQ ID NO: 1341793 - DNA, 13 bp, Homo sapiens
ttgctgtacaaaa

SEQ ID NO: 1341794 - DNA, 17 bp, Homo sapiens
ttgctgtacaaaagcaa

SEQ ID NO: 1341795 - DNA, 20 bp, Homo sapiens
ttgctgtgcttcaaactact

SEQ ID NO: 1341796 - DNA, 19 bp, Homo sapiens
ttgctgtgtgtcccaggca

SEQ ID NO: 1341797 - DNA, 20 bp, Homo sapiens
ttgctgtgtgtcccaggcag

SEQ ID NO: 1341798 - DNA, 14 bp, Homo sapiens
ttgctgttgtccaa

SEQ ID NO: 1341799 - DNA, 18 bp, Homo sapiens
ttgcttaaaccacttaaa

SEQ ID NO: 1341800 - DNA, 22 bp, Homo sapiens
ttgcttcaccatggccttatga

SEQ ID NO: 1341801 - DNA, 14 bp, Homo sapiens
ttggacatcctcct

SEQ ID NO: 1341802 - DNA, 20 bp, Homo sapiens
ttggacttcaaagcaagctg

SEQ ID NO: 1341803 - DNA, 20 bp, Homo sapiens
ttggagaagcccgtgtgaga

SEQ ID NO: 1341804 - DNA, 16 bp, Homo sapiens
ttggattaaatacata

SEQ ID NO: 1341805 - DNA, 17 bp, Homo sapiens
ttggcaaaaaggcagga

SEQ ID NO: 1341806 - DNA, 18 bp, Homo sapiens
ttggcaataaattttgaa

SEQ ID NO: 1341807 - DNA, 20 bp, Homo sapiens
ttggcatgtaaatgtaaact

SEQ ID NO: 1341808 - DNA, 22 bp, Homo sapiens
ttggccactccgagaggtgggc

SEQ ID NO: 1341809 - DNA, 14 bp, Homo sapiens
ttggctcagacatg

SEQ ID NO: 1341810 - DNA, 20 bp, Homo sapiens
ttggctgaaattctcctgga

SEQ ID NO: 1341811 - DNA, 13 bp, Homo sapiens
ttgggaaaacatg

SEQ ID NO: 1341812 - DNA, 16 bp, Homo sapiens
ttgggaaaacatgtta

SEQ ID NO: 1341813 - DNA, 17 bp, Homo sapiens
ttgggcagagctggctc

SEQ ID NO: 1341814 - DNA, 21 bp, Homo sapiens
ttggggccaccaaagctgccc

SEQ ID NO: 1341815 - DNA, 21 bp, Homo sapiens
ttgggtggggggcattgagta

SEQ ID NO: 1341816 - DNA, 20 bp, Homo sapiens
ttggtgtaatttgaagattg

SEQ ID NO: 1341817 - DNA, 22 bp, Homo sapiens
ttggttgggaatgaggaaaatt

SEQ ID NO: 1341818 - DNA, 16 bp, Homo sapiens
ttggttttatgatgac

SEQ ID NO: 1341819 - DNA, 23 bp, Homo sapiens
ttggttttatggttacttcttct

SEQ ID NO: 1341820 - DNA, 22 bp, Homo sapiens
ttgtaaaaatcttttgaagcat

SEQ ID NO: 1341821 - DNA, 18 bp, Homo sapiens
ttgtaaaacaaaatttga

SEQ ID NO: 1341822 - DNA, 13 bp, Homo sapiens
ttgtaaaagaaat

SEQ ID NO: 1341823 - DNA, 18 bp, Homo sapiens
ttgtaaaagaaatcatgt

SEQ ID NO: 1341824 - DNA, 22 bp, Homo sapiens
ttgtaaaagaaatcatgtccat

SEQ ID NO: 1341825 - DNA, 12 bp, Homo sapiens
ttgtaaacattt

SEQ ID NO: 1341826 - DNA, 13 bp, Homo sapiens
ttgtaaagactgg

SEQ ID NO: 1341827 - DNA, 13 bp, Homo sapiens
ttgtaaattctga

SEQ ID NO: 1341828 - DNA, 14 bp, Homo sapiens
ttgtaaattctgat

SEQ ID NO: 1341829 - DNA, 15 bp, Homo sapiens
ttgtaaatttagtgt

SEQ ID NO: 1341830 - DNA, 13 bp, Homo sapiens
ttgtaagaaggca

SEQ ID NO: 1341831 - DNA, 19 bp, Homo sapiens
ttgtaagaaggcaatatta

SEQ ID NO: 1341832 - DNA, 18 bp, Homo sapiens
ttgtaagcgtatggcttt

SEQ ID NO: 1341833 - DNA, 13 bp, Homo sapiens
ttgtaataagcaa

SEQ ID NO: 1341834 - DNA, 14 bp, Homo sapiens
ttgtaataagcaat

SEQ ID NO: 1341835 - DNA, 20 bp, Homo sapiens
ttgtaataagcaatcaaggt

SEQ ID NO: 1341836 - DNA, 23 bp, Homo sapiens
ttgtacatacgatttaaggtatt

SEQ ID NO: 1341837 - DNA, 14 bp, Homo sapiens
ttgtactgaatttt

SEQ ID NO: 1341838 - DNA, 22 bp, Homo sapiens
ttgtactgaatttttttgtaat

SEQ ID NO: 1341839 - DNA, 12 bp, Homo sapiens
ttgtagatttga

SEQ ID NO: 1341840 - DNA, 15 bp, Homo sapiens
ttgtagatttgattt

SEQ ID NO: 1341841 - DNA, 15 bp, Homo sapiens
ttgtagttctttaaa

SEQ ID NO: 1341842 - DNA, 20 bp, Homo sapiens
ttgtatagcatgaaataaaa

SEQ ID NO: 1341843 - DNA, 22 bp, Homo sapiens
ttgtatagcatgaaataaaata

SEQ ID NO: 1341844 - DNA, 19 bp, Homo sapiens
ttgtatagttatgtaaata

SEQ ID NO: 1341845 - DNA, 16 bp, Homo sapiens
ttgtatattacaatga

SEQ ID NO: 1341846 - DNA, 19 bp, Homo sapiens
ttgtatattggttttatga

SEQ ID NO: 1341847 - DNA, 14 bp, Homo sapiens
ttgtatattgtaat

SEQ ID NO: 1341848 - DNA, 18 bp, Homo sapiens
ttgtattgtatattacaa

SEQ ID NO: 1341849 - DNA, 16 bp, Homo sapiens
ttgtattgtcctatta

SEQ ID NO: 1341850 - DNA, 18 bp, Homo sapiens
ttgtatttaacagaaatt

SEQ ID NO: 1341851 - DNA, 22 bp, Homo sapiens
ttgtatttaacagaaattgtat

SEQ ID NO: 1341852 - DNA, 18 bp, Homo sapiens
ttgtattttcatgaaaat

SEQ ID NO: 1341853 - DNA, 16 bp, Homo sapiens
ttgtatttttgttgtt

SEQ ID NO: 1341854 - DNA, 17 bp, Homo sapiens
ttgtctggttaaaaaat

SEQ ID NO: 1341855 - DNA, 18 bp, Homo sapiens
ttgtctggttaaaaaata

SEQ ID NO: 1341856 - DNA, 22 bp, Homo sapiens
ttgtcttaaaaagtggaaaaat

SEQ ID NO: 1341857 - DNA, 16 bp, Homo sapiens
ttgtgctcagagacac

SEQ ID NO: 1341858 - DNA, 16 bp, Homo sapiens
ttgtgcttcacagtag

SEQ ID NO: 1341859 - DNA, 17 bp, Homo sapiens
ttgtggctatcctgatt

SEQ ID NO: 1341860 - DNA, 12 bp, Homo sapiens
ttgtgtaaaaaa

SEQ ID NO: 1341861 - DNA, 15 bp, Homo sapiens
ttgtgtgaaattgca

SEQ ID NO: 1341862 - DNA, 16 bp, Homo sapiens
ttgtgtgtccccttgc

SEQ ID NO: 1341863 - DNA, 15 bp, Homo sapiens
ttgtgttttttaaga

SEQ ID NO: 1341864 - DNA, 14 bp, Homo sapiens
ttgttaagaaaaat

SEQ ID NO: 1341865 - DNA, 16 bp, Homo sapiens
ttgttctcagaatccc

SEQ ID NO: 1341866 - DNA, 19 bp, Homo sapiens
ttgttgcaagatgtgaatt

SEQ ID NO: 1341867 - DNA, 20 bp, Homo sapiens
ttgttgccatgtgcaccttg

SEQ ID NO: 1341868 - DNA, 15 bp, Homo sapiens
ttgtttaaaatgtaa

SEQ ID NO: 1341869 - DNA, 12 bp, Homo sapiens
ttgtttctgaaa

SEQ ID NO: 1341870 - DNA, 13 bp, Homo sapiens
ttgtttgccagga

SEQ ID NO: 1341871 - DNA, 17 bp, Homo sapiens
ttgttttctgactaatt

SEQ ID NO: 1341872 - DNA, 22 bp, Homo sapiens
ttgttttggctgaaattctcct

SEQ ID NO: 1341873 - DNA, 15 bp, Homo sapiens
ttgtttttgtatatt

SEQ ID NO: 1341874 - DNA, 18 bp, Homo sapiens
tttaaaaaaaaagtcaga

SEQ ID NO: 1341875 - DNA, 19 bp, Homo sapiens
tttaaaaaccgaataaatg

SEQ ID NO: 1341876 - DNA, 19 bp, Homo sapiens
tttaaaaagggaagaaact

SEQ ID NO: 1341877 - DNA, 11 bp, Homo sapiens
tttaaaaatat

SEQ ID NO: 1341878 - DNA, 16 bp, Homo sapiens
tttaaaacacatgttt

SEQ ID NO: 1341879 - DNA, 16 bp, Homo sapiens
tttaaaactggacctg

SEQ ID NO: 1341880 - DNA, 16 bp, Homo sapiens
tttaaaataaaatgaa

SEQ ID NO: 1341881 - DNA, 17 bp, Homo sapiens
tttaaaataaaatgaaa

SEQ ID NO: 1341882 - DNA, 18 bp, Homo sapiens
tttaaaataaaatgaaaa

SEQ ID NO: 1341883 - DNA, 19 bp, Homo sapiens
tttaaaataaaatgaaaat

SEQ ID NO: 1341884 - DNA, 22 bp, Homo sapiens
tttaaaatagaaattttgtaag

SEQ ID NO: 1341885 - DNA, 21 bp, Homo sapiens
tttaaaattttgtatgttaaa

SEQ ID NO: 1341886 - DNA, 22 bp, Homo sapiens
tttaaacactcttcagagaaat

SEQ ID NO: 1341887 - DNA, 20 bp, Homo sapiens
tttaaagaaaaaaatgtcaa

SEQ ID NO: 1341888 - DNA, 17 bp, Homo sapiens
tttaaagaaaagatgaa

SEQ ID NO: 1341889 - DNA, 18 bp, Homo sapiens
tttaaagaatatgacttt

SEQ ID NO: 1341890 - DNA, 23 bp, Homo sapiens
tttaaaggtggattttgtttaaa

SEQ ID NO: 1341891 - DNA, 13 bp, Homo sapiens
tttaaattacaat

SEQ ID NO: 1341892 - DNA, 13 bp, Homo sapiens
tttaacagaaatt

SEQ ID NO: 1341893 - DNA, 16 bp, Homo sapiens
tttaacagaaattgta

SEQ ID NO: 1341894 - DNA, 12 bp, Homo sapiens
tttaacattatt

SEQ ID NO: 1341895 - DNA, 13 bp, Homo sapiens
tttaagatgtgaa

SEQ ID NO: 1341896 - DNA, 21 bp, Homo sapiens
tttaagctgttactgtcttca

SEQ ID NO: 1341897 - DNA, 14 bp, Homo sapiens
tttaagcttcagtt

SEQ ID NO: 1341898 - DNA, 18 bp, Homo sapiens
tttaaggctaaaacttaa

SEQ ID NO: 1341899 - DNA, 19 bp, Homo sapiens
tttaagttcttatgaggag

SEQ ID NO: 1341900 - DNA, 15 bp, Homo sapiens
tttaatattgagaaa

SEQ ID NO: 1341901 - DNA, 22 bp, Homo sapiens
tttaatcatagttactgtgtaa

SEQ ID NO: 1341902 - DNA, 13 bp, Homo sapiens
tttaatctactgc

SEQ ID NO: 1341903 - DNA, 18 bp, Homo sapiens
tttaattttttttagtat

SEQ ID NO: 1341904 - DNA, 15 bp, Homo sapiens
tttacacagaaacac

SEQ ID NO: 1341905 - DNA, 19 bp, Homo sapiens
tttacacagaaacactgcc

SEQ ID NO: 1341906 - DNA, 12 bp, Homo sapiens
tttacagaaaaa

SEQ ID NO: 1341907 - DNA, 17 bp, Homo sapiens
tttacagatgaatgtat

SEQ ID NO: 1341908 - DNA, 20 bp, Homo sapiens
tttacagctttcatgattag

SEQ ID NO: 1341909 - DNA, 19 bp, Homo sapiens
tttactggttgcatggaaa

SEQ ID NO: 1341910 - DNA, 22 bp, Homo sapiens
tttactggttgcatggaaatca

SEQ ID NO: 1341911 - DNA, 18 bp, Homo sapiens
ttttgtattttcatgaaa

SEQ ID NO: 1341912 - DNA, 16 bp, Homo sapiens
ttttgttaactgattt

SEQ ID NO: 1341913 - DNA, 15 bp, Homo sapiens
ttttgtttgccagga

SEQ ID NO: 1341914 - DNA, 15 bp, Homo sapiens
ttttgttttggctga

SEQ ID NO: 1341915 - DNA, 14 bp, Homo sapiens
tttttaaaatagaa

SEQ ID NO: 1341916 - DNA, 13 bp, Homo sapiens
tttttaatgctat

SEQ ID NO: 1341917 - DNA, 14 bp, Homo sapiens
tttttacaagatgt

SEQ ID NO: 1341918 - DNA, 13 bp, Homo sapiens
tttttactgtgtt

SEQ ID NO: 1341919 - DNA, 18 bp, Homo sapiens
tttttagaataagaattt

SEQ ID NO: 1341920 - DNA, 13 bp, Homo sapiens
tttttataattgt

SEQ ID NO: 1341921 - DNA, 18 bp, Homo sapiens
tttttataattgtacaaa

SEQ ID NO: 1341922 - DNA, 23 bp, Homo sapiens
tttttataattgtacaaaattaa

SEQ ID NO: 1341923 - DNA, 13 bp, Homo sapiens
tttttatacaaaa

SEQ ID NO: 1341924 - DNA, 20 bp, Homo sapiens
tttttatacaaacctaccaa

SEQ ID NO: 1341925 - DNA, 22 bp, Homo sapiens
tttttatatttcctttatgtga

SEQ ID NO: 1341926 - DNA, 23 bp, Homo sapiens
tttttattaaaatatttcaggtt

SEQ ID NO: 1341927 - DNA, 21 bp, Homo sapiens
tttttattaatcactgtgtat

SEQ ID NO: 1341928 - DNA, 13 bp, Homo sapiens
tttttatttatat

SEQ ID NO: 1341929 - DNA, 14 bp, Homo sapiens
tttttatttatatg

SEQ ID NO: 1341930 - DNA, 18 bp, Homo sapiens
tttttatttatatgtact

SEQ ID NO: 1341931 - DNA, 13 bp, Homo sapiens
tttttcaaaagaa

SEQ ID NO: 1341932 - DNA, 12 bp, Homo sapiens
tttttcaatata

SEQ ID NO: 1341933 - DNA, 16 bp, Homo sapiens
tttttcaatatattga

SEQ ID NO: 1341934 - DNA, 19 bp, Homo sapiens
tttttcaatatattgaact

SEQ ID NO: 1341935 - DNA, 15 bp, Homo sapiens
tttttctaagagaag

SEQ ID NO: 1341936 - DNA, 12 bp, Homo sapiens
tttttgacactg

SEQ ID NO: 1341937 - DNA, 12 bp, Homo sapiens
tttttgactttt

SEQ ID NO: 1341938 - DNA, 23 bp, Homo sapiens
tttttgactttttttgtatgtgt

SEQ ID NO: 1341939 - DNA, 13 bp, Homo sapiens
tttttgatagcat

SEQ ID NO: 1341940 - DNA, 19 bp, Homo sapiens
tttttgatagcattgtaag

SEQ ID NO: 1341941 - DNA, 14 bp, Homo sapiens
tttttggttgggaa

SEQ ID NO: 1341942 - DNA, 12 bp, Homo sapiens
tttttgtaataa

SEQ ID NO: 1341943 - DNA, 22 bp, Homo sapiens
tttttgtatattggttttatga

SEQ ID NO: 1341944 - DNA, 14 bp, Homo sapiens
tttttgtatgtgtg

SEQ ID NO: 1341945 - DNA, 14 bp, Homo sapiens
tttttgtttggaga

SEQ ID NO: 1341946 - DNA, 13 bp, Homo sapiens
ttttttaaagaaa

SEQ ID NO: 1341947 - DNA, 12 bp, Homo sapiens
ttttttaatcta

SEQ ID NO: 1341948 - DNA, 18 bp, Homo sapiens
ttttttaatctactgcat

SEQ ID NO: 1341949 - DNA, 15 bp, Homo sapiens
ttttttctaagagaa

SEQ ID NO: 1341950 - DNA, 14 bp, Homo sapiens
ttttttgtatgaaa

SEQ ID NO: 1341951 - DNA, 12 bp, Homo sapiens
tttttttctatt

SEQ ID NO: 1341952 - DNA, 14 bp, Homo sapiens
ttttttttaaacta

SEQ ID NO: 1341953 - DNA, 16 bp, Homo sapiens
attgaacttttgtact

SEQ ID NO: 1341954 - DNA, 18 bp, Homo sapiens
attgaacttttgtactga

SEQ ID NO: 1341955 - DNA, 16 bp, Homo sapiens
attgaagaatgttaga

SEQ ID NO: 1341956 - DNA, 22 bp, Homo sapiens
attgaatgatatataaatatat

SEQ ID NO: 1341957 - DNA, 14 bp, Homo sapiens
attgacactgaact

SEQ ID NO: 1341958 - DNA, 18 bp, Homo sapiens
attgacactgaacttaat

SEQ ID NO: 1341959 - DNA, 22 bp, Homo sapiens
attgaccattttttaatttact

SEQ ID NO: 1341960 - DNA, 19 bp, Homo sapiens
attgactaactcaaataca

SEQ ID NO: 1341961 - DNA, 23 bp, Homo sapiens
attgactaactcaaatacacatt

SEQ ID NO: 1341962 - DNA, 15 bp, Homo sapiens
attgactcttgagtt

SEQ ID NO: 1341963 - DNA, 20 bp, Homo sapiens
attgagaccgtgaagatact

SEQ ID NO: 1341964 - DNA, 17 bp, Homo sapiens
attgaggccaagaatat

SEQ ID NO: 1341965 - DNA, 18 bp, Homo sapiens
attgaggccaagaatatt

SEQ ID NO: 1341966 - DNA, 14 bp, Homo sapiens
attgagtattgttt

SEQ ID NO: 1341967 - DNA, 14 bp, Homo sapiens
attgatgcaaataa

SEQ ID NO: 1341968 - DNA, 14 bp, Homo sapiens
attgattgggaaaa

SEQ ID NO: 1341969 - DNA, 18 bp, Homo sapiens
attgattgggaaaacatt

SEQ ID NO: 1341970 - DNA, 22 bp, Homo sapiens
attgattgggaaaacatttgct

SEQ ID NO: 1341971 - DNA, 23 bp, Homo sapiens
attgattgggaaaacatttgctg

SEQ ID NO: 1341972 - DNA, 21 bp, Homo sapiens
attgatttaagctttcctgtt

SEQ ID NO: 1341973 - DNA, 17 bp, Homo sapiens
attgcaaaatacatgaa

SEQ ID NO: 1341974 - DNA, 18 bp, Homo sapiens
attgcaaaatacatgaag

SEQ ID NO: 1341975 - DNA, 18 bp, Homo sapiens
attgcagtttatcattca

SEQ ID NO: 1341976 - DNA, 15 bp, Homo sapiens
attgcatactttgta

SEQ ID NO: 1341977 - DNA, 16 bp, Homo sapiens
attgcatcactgtatc

SEQ ID NO: 1341978 - DNA, 19 bp, Homo sapiens
attgcatcactgtatcatt

SEQ ID NO: 1341979 - DNA, 18 bp, Homo sapiens
attgccccatctagacta

SEQ ID NO: 1341980 - DNA, 14 bp, Homo sapiens
attgctgagcctct

SEQ ID NO: 1341981 - DNA, 22 bp, Homo sapiens
attgctgagcctctgctcccca

SEQ ID NO: 1341982 - DNA, 23 bp, Homo sapiens
attgctgagcctctgctccccag

SEQ ID NO: 1341983 - DNA, 17 bp, Homo sapiens
attgctgtgtgtcccag

SEQ ID NO: 1341984 - DNA, 19 bp, Homo sapiens
attgctgttgtccaactat

SEQ ID NO: 1341985 - DNA, 19 bp, Homo sapiens
attgcttattatgtaggta

SEQ ID NO: 1341986 - DNA, 18 bp, Homo sapiens
attgcttgagctcaggag

SEQ ID NO: 1341987 - DNA, 21 bp, Homo sapiens
attgctttgtattgtatatta

SEQ ID NO: 1341988 - DNA, 15 bp, Homo sapiens
attgggaaaacattt

SEQ ID NO: 1341989 - DNA, 12 bp, Homo sapiens
attggggaggag

SEQ ID NO: 1341990 - DNA, 17 bp, Homo sapiens
attggttttatgatgac

SEQ ID NO: 1341991 - DNA, 15 bp, Homo sapiens
attggttttcctgtg

SEQ ID NO: 1341992 - DNA, 15 bp, Homo sapiens
attgtatttatgtgt

SEQ ID NO: 1341993 - DNA, 21 bp, Homo sapiens
attgtcctattagtgttatat

SEQ ID NO: 1341994 - DNA, 22 bp, Homo sapiens
attgtcgtataggcatgtaaac

SEQ ID NO: 1341995 - DNA, 20 bp, Homo sapiens
attgtctcctatatatttct

SEQ ID NO: 1341996 - DNA, 22 bp, Homo sapiens
attgtctcctatatatttctat

SEQ ID NO: 1341997 - DNA, 14 bp, Homo sapiens
attgttaatacaag

SEQ ID NO: 1341998 - DNA, 23 bp, Homo sapiens
attgttaatacaaggtataataa

SEQ ID NO: 1341999 - DNA, 14 bp, Homo sapiens
attgttctcagaat

SEQ ID NO: 1342000 - DNA, 18 bp, Homo sapiens
attgttcttattctggca

SEQ ID NO: 1342001 - DNA, 19 bp, Homo sapiens
attgttgacaactgtgact

SEQ ID NO: 1342002 - DNA, 20 bp, Homo sapiens
attgttgacaactgtgactg

SEQ ID NO: 1342003 - DNA, 16 bp, Homo sapiens
attgtttaaaatgtaa

SEQ ID NO: 1342004 - DNA, 17 bp, Homo sapiens
attgtttaaaatgtaat

SEQ ID NO: 1342005 - DNA, 13 bp, Homo sapiens
attgtttcagaat

SEQ ID NO: 1342006 - DNA, 14 bp, Homo sapiens
attgttttacaata

SEQ ID NO: 1342007 - DNA, 17 bp, Homo sapiens
attgttttacaatagtt

SEQ ID NO: 1342008 - DNA, 17 bp, Homo sapiens
atttaaaaaataaataa

SEQ ID NO: 1342009 - DNA, 22 bp, Homo sapiens
atttaaaaaataaataaaaact

SEQ ID NO: 1342010 - DNA, 14 bp, Homo sapiens
atttaaaaatagaa

SEQ ID NO: 1342011 - DNA, 15 bp, Homo sapiens
atttaaaaatagaaa

SEQ ID NO: 1342012 - DNA, 16 bp, Homo sapiens
atttaaaaatagaaac

SEQ ID NO: 1342013 - DNA, 15 bp, Homo sapiens
atttaaaaatatatt

SEQ ID NO: 1342014 - DNA, 13 bp, Homo sapiens
atttaaatgccat

SEQ ID NO: 1342015 - DNA, 21 bp, Homo sapiens
atttaaattacaattttatct

SEQ ID NO: 1342016 - DNA, 14 bp, Homo sapiens
atttaacagaaatt

SEQ ID NO: 1342017 - DNA, 17 bp, Homo sapiens
atttaacagaaattgta

SEQ ID NO: 1342018 - DNA, 20 bp, Homo sapiens
atttaacattatttatatgg

SEQ ID NO: 1342019 - DNA, 16 bp, Homo sapiens
atttaagctttcctgt

SEQ ID NO: 1342020 - DNA, 20 bp, Homo sapiens
atttaatccagttataagaa

SEQ ID NO: 1342021 - DNA, 22 bp, Homo sapiens
atttaatggaagtgtatttatt

SEQ ID NO: 1342022 - DNA, 23 bp, Homo sapiens
atttaatggaagtgtatttattt

SEQ ID NO: 1342023 - DNA, 12 bp, Homo sapiens
atttacttgttt

SEQ ID NO: 1342024 - DNA, 15 bp, Homo sapiens
atttacttgttttgg

SEQ ID NO: 1342025 - DNA, 16 bp, Homo sapiens
atttacttgttttgga

SEQ ID NO: 1342026 - DNA, 23 bp, Homo sapiens
atttacttgttttggatggcttg

SEQ ID NO: 1342027 - DNA, 20 bp, Homo sapiens
atttagacaagagatgggaa

SEQ ID NO: 1342028 - DNA, 24 bp, Homo sapiens
atttagggagtattctaataagct

SEQ ID NO: 1342029 - DNA, 16 bp, Homo sapiens
atttagtattatcaaa

SEQ ID NO: 1342030 - DNA, 22 bp, Homo sapiens
atttagtgtttttttatttcta

SEQ ID NO: 1342031 - DNA, 19 bp, Homo sapiens
atttatatggggaatatat

SEQ ID NO: 1342032 - DNA, 11 bp, Homo sapiens
atttatatgta

SEQ ID NO: 1342033 - DNA, 15 bp, Homo sapiens
atttatatgtactgt

SEQ ID NO: 1342034 - DNA, 17 bp, Homo sapiens
atttatatgtactgttt

SEQ ID NO: 1342035 - DNA, 18 bp, Homo sapiens
atttatatgtatgtgttt

SEQ ID NO: 1342036 - DNA, 20 bp, Homo sapiens
atttatatttattgactctt

SEQ ID NO: 1342037 - DNA, 22 bp, Homo sapiens
atttatatttattgactcttga

SEQ ID NO: 1342038 - DNA, 18 bp, Homo sapiens
atttatgggcccctggca

SEQ ID NO: 1342039 - DNA, 16 bp, Homo sapiens
atttatgtgtatatgg

SEQ ID NO: 1342040 - DNA, 22 bp, Homo sapiens
atttatgtttgcacttgtgatt

SEQ ID NO: 1342041 - DNA, 21 bp, Homo sapiens
atttattaaatttttttgtat

SEQ ID NO: 1342042 - DNA, 13 bp, Homo sapiens
atttattaactta

SEQ ID NO: 1342043 - DNA, 23 bp, Homo sapiens
atttattaacttaataatcaaga

SEQ ID NO: 1342044 - DNA, 14 bp, Homo sapiens
atttattaatattt

SEQ ID NO: 1342045 - DNA, 22 bp, Homo sapiens
atttattgactcttgagttgtt

SEQ ID NO: 1342046 - DNA, 23 bp, Homo sapiens
atttattgattccttttttcaaa

SEQ ID NO: 1342047 - DNA, 12 bp, Homo sapiens
atttatttaata

SEQ ID NO: 1342048 - DNA, 15 bp, Homo sapiens
cactaactcaccagc

SEQ ID NO: 1342049 - DNA, 18 bp, Homo sapiens
cactaactcaccagcccc

SEQ ID NO: 1342050 - DNA, 19 bp, Homo sapiens
cactaactcaccagcccca

SEQ ID NO: 1342051 - DNA, 17 bp, Homo sapiens
cactaattggtactttt

SEQ ID NO: 1342052 - DNA, 15 bp, Homo sapiens
cactacacctggctg

SEQ ID NO: 1342053 - DNA, 23 bp, Homo sapiens
cactacacctggctgaggttcct

SEQ ID NO: 1342054 - DNA, 20 bp, Homo sapiens
cactaggcccccacttgcct

SEQ ID NO: 1342055 - DNA, 21 bp, Homo sapiens
cactaggcccccacttgcctc

SEQ ID NO: 1342056 - DNA, 22 bp, Homo sapiens
cactaggcccccacttgcctct

SEQ ID NO: 1342057 - DNA, 17 bp, Homo sapiens
cactagggccttggaaa

SEQ ID NO: 1342058 - DNA, 15 bp, Homo sapiens
cactcaaaagctggg

SEQ ID NO: 1342059 - DNA, 19 bp, Homo sapiens
cactcaaaagctgggcagg

SEQ ID NO: 1342060 - DNA, 15 bp, Homo sapiens
cactcacagagtcaa

SEQ ID NO: 1342061 - DNA, 20 bp, Homo sapiens
cactcacagagtcaaggcct

SEQ ID NO: 1342062 - DNA, 22 bp, Homo sapiens
cactcacagagtcaaggcctgc

SEQ ID NO: 1342063 - DNA, 16 bp, Homo sapiens
cactcactaggccccc

SEQ ID NO: 1342064 - DNA, 16 bp, Homo sapiens
cactcattgctgagcc

SEQ ID NO: 1342065 - DNA, 19 bp, Homo sapiens
cactcattgctgagcctct

SEQ ID NO: 1342066 - DNA, 13 bp, Homo sapiens
cactccagcctgg

SEQ ID NO: 1342067 - DNA, 14 bp, Homo sapiens
cactccagcctggg

SEQ ID NO: 1342068 - DNA, 14 bp, Homo sapiens
cactcccctagggg

SEQ ID NO: 1342069 - DNA, 17 bp, Homo sapiens
cactcccttgctggccc

SEQ ID NO: 1342070 - DNA, 14 bp, Homo sapiens
cactcgggtttctc

SEQ ID NO: 1342071 - DNA, 17 bp, Homo sapiens
cactctaagtcatgtat

SEQ ID NO: 1342072 - DNA, 13 bp, Homo sapiens
cactctccatcac

SEQ ID NO: 1342073 - DNA, 12 bp, Homo sapiens
cactctgcttct

SEQ ID NO: 1342074 - DNA, 13 bp, Homo sapiens
cactctgcttctc

SEQ ID NO: 1342075 - DNA, 17 bp, Homo sapiens
cactctgcttctctgac

SEQ ID NO: 1342076 - DNA, 21 bp, Homo sapiens
cactctgcttctctgacttct

SEQ ID NO: 1342077 - DNA, 18 bp, Homo sapiens
cactctggatgatggatt

SEQ ID NO: 1342078 - DNA, 22 bp, Homo sapiens
cactgaaaattggacagattgc

SEQ ID NO: 1342079 - DNA, 16 bp, Homo sapiens
cactgaaagttttgta

SEQ ID NO: 1342080 - DNA, 20 bp, Homo sapiens
cactgaaagttttgtaaaag

SEQ ID NO: 1342081 - DNA, 15 bp, Homo sapiens
cactgcactccagcc

SEQ ID NO: 1342082 - DNA, 16 bp, Homo sapiens
cactgcactccagcct

SEQ ID NO: 1342083 - DNA, 13 bp, Homo sapiens
cactgccagcagc

SEQ ID NO: 1342084 - DNA, 12 bp, Homo sapiens
cactgccaggcc

SEQ ID NO: 1342085 - DNA, 14 bp, Homo sapiens
cactgccaggccag

SEQ ID NO: 1342086 - DNA, 19 bp, Homo sapiens
cactgccaggccagcctcc

SEQ ID NO: 1342087 - DNA, 12 bp, Homo sapiens
cactgcctgggc

SEQ ID NO: 1342088 - DNA, 22 bp, Homo sapiens
cactgcgaagaccctcttgccc

SEQ ID NO: 1342089 - DNA, 12 bp, Homo sapiens
cactggaaaggg

SEQ ID NO: 1342090 - DNA, 18 bp, Homo sapiens
cactggaaaggggagagc

SEQ ID NO: 1342091 - DNA, 22 bp, Homo sapiens
cactggaaaggggagagcctgc

SEQ ID NO: 1342092 - DNA, 18 bp, Homo sapiens
cactggcaatggtagttt

SEQ ID NO: 1342093 - DNA, 23 bp, Homo sapiens
cactggcgcatcatatgcagtga

SEQ ID NO: 1342094 - DNA, 16 bp, Homo sapiens
cactggggcctacagc

SEQ ID NO: 1342095 - DNA, 12 bp, Homo sapiens
cactggttctca

SEQ ID NO: 1342096 - DNA, 21 bp, Homo sapiens
cactgtgatcaatatttttat

SEQ ID NO: 1342097 - DNA, 15 bp, Homo sapiens
cactgtgcacaccca

SEQ ID NO: 1342098 - DNA, 22 bp, Homo sapiens
cactgtgcgtcttggtgtaatt

SEQ ID NO: 1342099 - DNA, 14 bp, Homo sapiens
cactgtgctttcag

SEQ ID NO: 1342100 - DNA, 16 bp, Homo sapiens
cactgtgtatatttga

SEQ ID NO: 1342101 - DNA, 18 bp, Homo sapiens
cactgtgtatatttgatt

SEQ ID NO: 1342102 - DNA, 16 bp, Homo sapiens
cactgttgataaaaac

SEQ ID NO: 1342103 - DNA, 17 bp, Homo sapiens
cactgttgataaaaact

SEQ ID NO: 1342104 - DNA, 16 bp, Homo sapiens
cactgtttaatcatag

SEQ ID NO: 1342105 - DNA, 14 bp, Homo sapiens
cactgtttcctggg

SEQ ID NO: 1342106 - DNA, 19 bp, Homo sapiens
cactgtttctcttgagctg

SEQ ID NO: 1342107 - DNA, 17 bp, Homo sapiens
cacttaaagaagtattt

SEQ ID NO: 1342108 - DNA, 16 bp, Homo sapiens
cacttattgaatatat

SEQ ID NO: 1342109 - DNA, 17 bp, Homo sapiens
cacttattgaatatatg

SEQ ID NO: 1342110 - DNA, 15 bp, Homo sapiens
cacttccttttaact

SEQ ID NO: 1342111 - DNA, 17 bp, Homo sapiens
cacttctgccagatgtc

SEQ ID NO: 1342112 - DNA, 14 bp, Homo sapiens
cacttgaaaccttt

SEQ ID NO: 1342113 - DNA, 13 bp, Homo sapiens
cacttgagagaaa

SEQ ID NO: 1342114 - DNA, 15 bp, Homo sapiens
cacttgaggcctgat

SEQ ID NO: 1342115 - DNA, 17 bp, Homo sapiens
cacttgaggcctgatct

SEQ ID NO: 1342116 - DNA, 20 bp, Homo sapiens
cacttgaggcctgatctgcc

SEQ ID NO: 1342117 - DNA, 13 bp, Homo sapiens
cacttgagtccag

SEQ ID NO: 1342118 - DNA, 12 bp, Homo sapiens
cacttgcctctt

SEQ ID NO: 1342119 - DNA, 14 bp, Homo sapiens
cactttacccacct

SEQ ID NO: 1342120 - DNA, 17 bp, Homo sapiens
cactttacccacctaga

SEQ ID NO: 1342121 - DNA, 19 bp, Homo sapiens
cactttacccacctagaac

SEQ ID NO: 1342122 - DNA, 20 bp, Homo sapiens
cactttacccacctagaaca

SEQ ID NO: 1342123 - DNA, 22 bp, Homo sapiens
cactttacccacctagaacact

SEQ ID NO: 1342124 - DNA, 23 bp, Homo sapiens
cactttattgccttttaattttt

SEQ ID NO: 1342125 - DNA, 17 bp, Homo sapiens
cactttgagcctgggaa

SEQ ID NO: 1342126 - DNA, 19 bp, Homo sapiens
cactttgagcctgggaaat

SEQ ID NO: 1342127 - DNA, 21 bp, Homo sapiens
cactttgtttcgtggggaggt

SEQ ID NO: 1342128 - DNA, 20 bp, Homo sapiens
cagaaaaaaagagtgaaaaa

SEQ ID NO: 1342129 - DNA, 17 bp, Homo sapiens
cagaaaaaggctgtgct

SEQ ID NO: 1342130 - DNA, 12 bp, Homo sapiens
cagaaacactgc

SEQ ID NO: 1342131 - DNA, 18 bp, Homo sapiens
cagaaagctttattttga

SEQ ID NO: 1342132 - DNA, 20 bp, Homo sapiens
cagaaatataacacattttt

SEQ ID NO: 1342133 - DNA, 18 bp, Homo sapiens
cagaaatgaggaggatgc

SEQ ID NO: 1342134 - DNA, 17 bp, Homo sapiens
cagaaatggaaagcaga

SEQ ID NO: 1342135 - DNA, 23 bp, Homo sapiens
cagaaatggtgagatgtatgttt

SEQ ID NO: 1342136 - DNA, 22 bp, Homo sapiens
cagaaatgttgagtctgtacta

SEQ ID NO: 1342137 - DNA, 12 bp, Homo sapiens
cagaaattgtat

SEQ ID NO: 1342138 - DNA, 19 bp, Homo sapiens
cagaaattgtatattgtaa

SEQ ID NO: 1342139 - DNA, 22 bp, Homo sapiens
cagaaattgtatattgtaattt

SEQ ID NO: 1342140 - DNA, 20 bp, Homo sapiens
cagaaccaccccggccccct

SEQ ID NO: 1342141 - DNA, 21 bp, Homo sapiens
cagaacgaaccttggcctggg

SEQ ID NO: 1342142 - DNA, 18 bp, Homo sapiens
cagaactcactggggcct

SEQ ID NO: 1342143 - DNA, 16 bp, Homo sapiens
cagaacttgaatgtgt

SEQ ID NO: 1342144 - DNA, 23 bp, Homo sapiens
cagaagccaatctacaatctctt

SEQ ID NO: 1342145 - DNA, 21 bp, Homo sapiens
cagaagtgcccttcctgctgc

SEQ ID NO: 1342146 - DNA, 21 bp, Homo sapiens
cagaataagttattgcagttt

SEQ ID NO: 1342147 - DNA, 15 bp, Homo sapiens
cagaatactgatgga

SEQ ID NO: 1342148 - DNA, 13 bp, Homo sapiens
cagaatattttta

SEQ ID NO: 1342149 - DNA, 22 bp, Homo sapiens
cagaatatttttatatttcctt

SEQ ID NO: 1342150 - DNA, 20 bp, Homo sapiens
cagacaaaagcgcttttcct

SEQ ID NO: 1342151 - DNA, 14 bp, Homo sapiens
cagacaccttggac

SEQ ID NO: 1342152 - DNA, 23 bp, Homo sapiens
cagacagaacttgaatgtgtcag

SEQ ID NO: 1342153 - DNA, 20 bp, Homo sapiens
cagaccgcgggcactgccgc

SEQ ID NO: 1342154 - DNA, 16 bp, Homo sapiens
cagacctggaagaaca

SEQ ID NO: 1342155 - DNA, 15 bp, Homo sapiens
cagactatttttaga

SEQ ID NO: 1342156 - DNA, 23 bp, Homo sapiens
cagactcagagctctctctacag

SEQ ID NO: 1342157 - DNA, 21 bp, Homo sapiens
cagactggggcatcctgtgcc

SEQ ID NO: 1342158 - DNA, 12 bp, Homo sapiens
cagagacaaaat

SEQ ID NO: 1342159 - DNA, 23 bp, Homo sapiens
cagagacactgttgataaaaact

SEQ ID NO: 1342160 - DNA, 12 bp, Homo sapiens
cagagacagata

SEQ ID NO: 1342161 - DNA, 17 bp, Homo sapiens
cagagactttagggggt

SEQ ID NO: 1342162 - DNA, 21 bp, Homo sapiens
cagagaggaaattctccactg

SEQ ID NO: 1342163 - DNA, 18 bp, Homo sapiens
cagagaggactgtaggga

SEQ ID NO: 1342164 - DNA, 21 bp, Homo sapiens
cagagatttctcattgacttt

SEQ ID NO: 1342165 - DNA, 13 bp, Homo sapiens
cagagccttctca

SEQ ID NO: 1342166 - DNA, 18 bp, Homo sapiens
cagagctctctctacaga

SEQ ID NO: 1342167 - DNA, 18 bp, Homo sapiens
cagagctggctctgagcg

SEQ ID NO: 1342168 - DNA, 16 bp, Homo sapiens
caaagtttgacaggaa

SEQ ID NO: 1342169 - DNA, 14 bp, Homo sapiens
caaataagaaataa

SEQ ID NO: 1342170 - DNA, 13 bp, Homo sapiens
caaatacacattt

SEQ ID NO: 1342171 - DNA, 22 bp, Homo sapiens
caaatattgttgacaactgtga

SEQ ID NO: 1342172 - DNA, 18 bp, Homo sapiens
caaatcgtagcgtttgtt

SEQ ID NO: 1342173 - DNA, 13 bp, Homo sapiens
caaatgactttat

SEQ ID NO: 1342174 - DNA, 15 bp, Homo sapiens
caaatgactttatta

SEQ ID NO: 1342175 - DNA, 20 bp, Homo sapiens
caaatgactttattatttat

SEQ ID NO: 1342176 - DNA, 20 bp, Homo sapiens
caaatgagctctgaaatctt

SEQ ID NO: 1342177 - DNA, 21 bp, Homo sapiens
caaatgagctctgaaatcttc

SEQ ID NO: 1342178 - DNA, 21 bp, Homo sapiens
caaatgatgtgcaaaaccttt

SEQ ID NO: 1342179 - DNA, 17 bp, Homo sapiens
caaatgcatctttgatg

SEQ ID NO: 1342180 - DNA, 22 bp, Homo sapiens
caaatggaaagtaactcatttg

SEQ ID NO: 1342181 - DNA, 14 bp, Homo sapiens
caaatgtttatttt

SEQ ID NO: 1342182 - DNA, 22 bp, Homo sapiens
caaattatcttgatacattcaa

SEQ ID NO: 1342183 - DNA, 22 bp, Homo sapiens
caaatttgtctggttaaaaaat

SEQ ID NO: 1342184 - DNA, 15 bp, Homo sapiens
caacaacaattggta

SEQ ID NO: 1342185 - DNA, 16 bp, Homo sapiens
caacaacaattggtaa

SEQ ID NO: 1342186 - DNA, 13 bp, Homo sapiens
caacacagcctgg

SEQ ID NO: 1342187 - DNA, 15 bp, Homo sapiens
caacacagcctgggc

SEQ ID NO: 1342188 - DNA, 19 bp, Homo sapiens
caacatgttgggaaacttg

SEQ ID NO: 1342189 - DNA, 22 bp, Homo sapiens
caacattcattgccaagggccc

SEQ ID NO: 1342190 - DNA, 13 bp, Homo sapiens
caaccaagtcaca

SEQ ID NO: 1342191 - DNA, 16 bp, Homo sapiens
caaccaggcacctctt

SEQ ID NO: 1342192 - DNA, 18 bp, Homo sapiens
caaccaggctcctgtgat

SEQ ID NO: 1342193 - DNA, 16 bp, Homo sapiens
caaccatgtcatttca

SEQ ID NO: 1342194 - DNA, 19 bp, Homo sapiens
caaccctatctcctgacag

SEQ ID NO: 1342195 - DNA, 20 bp, Homo sapiens
caaccctatctcctgacaga

SEQ ID NO: 1342196 - DNA, 20 bp, Homo sapiens
caacctccgcatccggggtt

SEQ ID NO: 1342197 - DNA, 15 bp, Homo sapiens
caacctttccctcac

SEQ ID NO: 1342198 - DNA, 21 bp, Homo sapiens
caactagtggggtttcctggc

SEQ ID NO: 1342199 - DNA, 13 bp, Homo sapiens
caactccagcaac

SEQ ID NO: 1342200 - DNA, 20 bp, Homo sapiens
caactccagcaacttcttct

SEQ ID NO: 1342201 - DNA, 19 bp, Homo sapiens
caacttagtcaataagaaa

SEQ ID NO: 1342202 - DNA, 19 bp, Homo sapiens
caactttgtaaaaatcttt

SEQ ID NO: 1342203 - DNA, 21 bp, Homo sapiens
caacttttgtgtaatgaaaat

SEQ ID NO: 1342204 - DNA, 17 bp, Homo sapiens
caagaacacacacatat

SEQ ID NO: 1342205 - DNA, 18 bp, Homo sapiens
caagaatatcctttaaaa

SEQ ID NO: 1342206 - DNA, 13 bp, Homo sapiens
caagaatattgca

SEQ ID NO: 1342207 - DNA, 21 bp, Homo sapiens
caagaatattgcaaaatacat

SEQ ID NO: 1342208 - DNA, 20 bp, Homo sapiens
caagaatgtacgtccagcct

SEQ ID NO: 1342209 - DNA, 14 bp, Homo sapiens
caagagccttaaaa

SEQ ID NO: 1342210 - DNA, 17 bp, Homo sapiens
caagagccttaaaacat

SEQ ID NO: 1342211 - DNA, 15 bp, Homo sapiens
caagaggaatgaaaa

SEQ ID NO: 1342212 - DNA, 21 bp, Homo sapiens
caagagggggtggaggggtgt

SEQ ID NO: 1342213 - DNA, 20 bp, Homo sapiens
caagagtctaatagtctttg

SEQ ID NO: 1342214 - DNA, 17 bp, Homo sapiens
caagatcaaaaaggctt

SEQ ID NO: 1342215 - DNA, 21 bp, Homo sapiens
caagatcaaaaaggcttataa

SEQ ID NO: 1342216 - DNA, 19 bp, Homo sapiens
caagatgtgaattattgac

SEQ ID NO: 1342217 - DNA, 17 bp, Homo sapiens
caagattttctactttt

SEQ ID NO: 1342218 - DNA, 15 bp, Homo sapiens
caagcaagttctgag

SEQ ID NO: 1342219 - DNA, 19 bp, Homo sapiens
caagcagtcgtgcctgtgt

SEQ ID NO: 1342220 - DNA, 17 bp, Homo sapiens
caagcatgcagctttgc

SEQ ID NO: 1342221 - DNA, 23 bp, Homo sapiens
caagccaagggaacctgtgtccg

SEQ ID NO: 1342222 - DNA, 13 bp, Homo sapiens
caagccagaggct

SEQ ID NO: 1342223 - DNA, 16 bp, Homo sapiens
caagccagaggctggg

SEQ ID NO: 1342224 - DNA, 19 bp, Homo sapiens
caagccaggctcactcaca

SEQ ID NO: 1342225 - DNA, 20 bp, Homo sapiens
caagccaggctcactcacag

SEQ ID NO: 1342226 - DNA, 14 bp, Homo sapiens
caagcctccacagc

SEQ ID NO: 1342227 - DNA, 15 bp, Homo sapiens
caagcctccacagcg

SEQ ID NO: 1342228 - DNA, 15 bp, Homo sapiens
caagcgggtggctct

SEQ ID NO: 1342229 - DNA, 15 bp, Homo sapiens
caagctattcaattc

SEQ ID NO: 1342230 - DNA, 13 bp, Homo sapiens
caagctccaagcc

SEQ ID NO: 1342231 - DNA, 14 bp, Homo sapiens
caagctccaagccc

SEQ ID NO: 1342232 - DNA, 15 bp, Homo sapiens
caagctccgcaggac

SEQ ID NO: 1342233 - DNA, 14 bp, Homo sapiens
caagctgcaccctc

SEQ ID NO: 1342234 - DNA, 22 bp, Homo sapiens
caagctgcaccctcaggcaggt

SEQ ID NO: 1342235 - DNA, 16 bp, Homo sapiens
caaggactttgtacat

SEQ ID NO: 1342236 - DNA, 22 bp, Homo sapiens
caaggcctggtgtttcttgata

SEQ ID NO: 1342237 - DNA, 22 bp, Homo sapiens
caaggctgcagtgagccgagat

SEQ ID NO: 1342238 - DNA, 13 bp, Homo sapiens
caaggctggcagg

SEQ ID NO: 1342239 - DNA, 15 bp, Homo sapiens
caagggaacctgtgt

SEQ ID NO: 1342240 - DNA, 14 bp, Homo sapiens
caagggatttgagg

SEQ ID NO: 1342241 - DNA, 17 bp, Homo sapiens
caaggtataataaaatt

SEQ ID NO: 1342242 - DNA, 19 bp, Homo sapiens
caaggtataataaaattat

SEQ ID NO: 1342243 - DNA, 22 bp, Homo sapiens
caaggttataattttttttaaa

SEQ ID NO: 1342244 - DNA, 19 bp, Homo sapiens
caaggttttataaggctga

SEQ ID NO: 1342245 - DNA, 15 bp, Homo sapiens
caagtaaaaaggcta

SEQ ID NO: 1342246 - DNA, 23 bp, Homo sapiens
caagtaattgtgaaaaagttaaa

SEQ ID NO: 1342247 - DNA, 17 bp, Homo sapiens
caagtagttctgtattt

SEQ ID NO: 1342248 - DNA, 20 bp, Homo sapiens
caagtcatagccataaatga

SEQ ID NO: 1342249 - DNA, 22 bp, Homo sapiens
caagtgaaaaaggaggaagaga

SEQ ID NO: 1342250 - DNA, 23 bp, Homo sapiens
caagtgaaaaaggaggaagagaa

SEQ ID NO: 1342251 - DNA, 20 bp, Homo sapiens
caagtgaaattattttggag

SEQ ID NO: 1342252 - DNA, 13 bp, Homo sapiens
caagtgctggagt

SEQ ID NO: 1342253 - DNA, 18 bp, Homo sapiens
caagtggggtgctgggag

SEQ ID NO: 1342254 - DNA, 21 bp, Homo sapiens
caagtggggtgctgggaggag

SEQ ID NO: 1342255 - DNA, 21 bp, Homo sapiens
atttctttaaaagaatgacta

SEQ ID NO: 1342256 - DNA, 20 bp, Homo sapiens
atttgaaaaatataaaatta

SEQ ID NO: 1342257 - DNA, 13 bp, Homo sapiens
atttgaaagtgcc

SEQ ID NO: 1342258 - DNA, 18 bp, Homo sapiens
atttgaattttaaatcta

SEQ ID NO: 1342259 - DNA, 14 bp, Homo sapiens
atttgactaatttt

SEQ ID NO: 1342260 - DNA, 15 bp, Homo sapiens
atttgactaatttta

SEQ ID NO: 1342261 - DNA, 19 bp, Homo sapiens
atttgagaaaataaagcta

SEQ ID NO: 1342262 - DNA, 15 bp, Homo sapiens
atttgatttattaac

SEQ ID NO: 1342263 - DNA, 20 bp, Homo sapiens
atttgcaataacagctgcaa

SEQ ID NO: 1342264 - DNA, 14 bp, Homo sapiens
atttgcatgttatg

SEQ ID NO: 1342265 - DNA, 15 bp, Homo sapiens
atttgcatgttatgt

SEQ ID NO: 1342266 - DNA, 21 bp, Homo sapiens
atttgccatagagtacactgc

SEQ ID NO: 1342267 - DNA, 21 bp, Homo sapiens
atttgcctgtttctgcttgct

SEQ ID NO: 1342268 - DNA, 16 bp, Homo sapiens
atttgctactgttgta

SEQ ID NO: 1342269 - DNA, 17 bp, Homo sapiens
atttgctactgttgtaa

SEQ ID NO: 1342270 - DNA, 14 bp, Homo sapiens
atttgctgctcttc

SEQ ID NO: 1342271 - DNA, 14 bp, Homo sapiens
atttgtcaatgaca

SEQ ID NO: 1342272 - DNA, 22 bp, Homo sapiens
atttgtctttttgttgtaaaac

SEQ ID NO: 1342273 - DNA, 18 bp, Homo sapiens
attttaaaacaataggat

SEQ ID NO: 1342274 - DNA, 19 bp, Homo sapiens
attttaaatctaaatctat

SEQ ID NO: 1342275 - DNA, 18 bp, Homo sapiens
attttaacttaactgaaa

SEQ ID NO: 1342276 - DNA, 22 bp, Homo sapiens
attttacaagggcataaagtaa

SEQ ID NO: 1342277 - DNA, 22 bp, Homo sapiens
attttacagctcattaaacttt

SEQ ID NO: 1342278 - DNA, 22 bp, Homo sapiens
attttatattactgacatttct

SEQ ID NO: 1342279 - DNA, 22 bp, Homo sapiens
attttatctgtttcctgacatt

SEQ ID NO: 1342280 - DNA, 16 bp, Homo sapiens
attttatggttatgtt

SEQ ID NO: 1342281 - DNA, 18 bp, Homo sapiens
attttatggttatgtttt

SEQ ID NO: 1342282 - DNA, 22 bp, Homo sapiens
attttatggttatgtttttctg

SEQ ID NO: 1342283 - DNA, 15 bp, Homo sapiens
attttattactgttt

SEQ ID NO: 1342284 - DNA, 16 bp, Homo sapiens
attttattactgttta

SEQ ID NO: 1342285 - DNA, 17 bp, Homo sapiens
attttatttagacaaga

SEQ ID NO: 1342286 - DNA, 23 bp, Homo sapiens
attttcagagccggcccgcctct

SEQ ID NO: 1342287 - DNA, 12 bp, Homo sapiens
attttcagcatt

SEQ ID NO: 1342288 - DNA, 20 bp, Homo sapiens
attttcagcattaagctgtt

SEQ ID NO: 1342289 - DNA, 14 bp, Homo sapiens
attttccaaagagt

SEQ ID NO: 1342290 - DNA, 19 bp, Homo sapiens
attttccctattagagaag

SEQ ID NO: 1342291 - DNA, 16 bp, Homo sapiens
attttcctgccaggca

SEQ ID NO: 1342292 - DNA, 15 bp, Homo sapiens
attttctaaagactt

SEQ ID NO: 1342293 - DNA, 16 bp, Homo sapiens
attttctctgtacttt

SEQ ID NO: 1342294 - DNA, 18 bp, Homo sapiens
attttcttctctgtgaga

SEQ ID NO: 1342295 - DNA, 12 bp, Homo sapiens
attttgaaaagt

SEQ ID NO: 1342296 - DNA, 12 bp, Homo sapiens
attttgaatcaa

SEQ ID NO: 1342297 - DNA, 15 bp, Homo sapiens
attttgaatcaataa

SEQ ID NO: 1342298 - DNA, 18 bp, Homo sapiens
attttgaatcaataatat

SEQ ID NO: 1342299 - DNA, 17 bp, Homo sapiens
attttgacctactctca

SEQ ID NO: 1342300 - DNA, 21 bp, Homo sapiens
attttgcaaagatttaatctg

SEQ ID NO: 1342301 - DNA, 20 bp, Homo sapiens
attttgctaaatgtgaatga

SEQ ID NO: 1342302 - DNA, 20 bp, Homo sapiens
attttgtgtaaaaaaaccac

SEQ ID NO: 1342303 - DNA, 21 bp, Homo sapiens
attttgtttttgtcttaaaaa

SEQ ID NO: 1342304 - DNA, 20 bp, Homo sapiens
atttttaaaaaatattttct

SEQ ID NO: 1342305 - DNA, 21 bp, Homo sapiens
atttttagaattaaaaaagca

SEQ ID NO: 1342306 - DNA, 21 bp, Homo sapiens
atttttataattgtacaaaat

SEQ ID NO: 1342307 - DNA, 19 bp, Homo sapiens
atttttatatcatgcaaaa

SEQ ID NO: 1342308 - DNA, 16 bp, Homo sapiens
atttttatatttcctt

SEQ ID NO: 1342309 - DNA, 22 bp, Homo sapiens
atttttcaatagcacatatgga

SEQ ID NO: 1342310 - DNA, 17 bp, Homo sapiens
atttttcaatatattga

SEQ ID NO: 1342311 - DNA, 22 bp, Homo sapiens
atttttcaatatattgaacttt

SEQ ID NO: 1342312 - DNA, 23 bp, Homo sapiens
atttttgatacagttttcagaaa

SEQ ID NO: 1342313 - DNA, 13 bp, Homo sapiens
atttttgtaaagt

SEQ ID NO: 1342314 - DNA, 14 bp, Homo sapiens
atttttgtaaagtt

SEQ ID NO: 1342315 - DNA, 15 bp, Homo sapiens
atttttgtaaagttt

SEQ ID NO: 1342316 - DNA, 18 bp, Homo sapiens
atttttgtaaagtttccg

SEQ ID NO: 1342317 - DNA, 11 bp, Homo sapiens
attttttcctt

SEQ ID NO: 1342318 - DNA, 22 bp, Homo sapiens
atttttttgaactcttctcatt

SEQ ID NO: 1342319 - DNA, 22 bp, Homo sapiens
atttttttgcatgcatgcaaat

SEQ ID NO: 1342320 - DNA, 23 bp, Homo sapiens
atttttttgcatgcatgcaaatg

SEQ ID NO: 1342321 - DNA, 13 bp, Homo sapiens
atttttttgtaat

SEQ ID NO: 1342322 - DNA, 17 bp, Homo sapiens
atttttttgtatgaaaa

SEQ ID NO: 1342323 - DNA, 20 bp, Homo sapiens
attttttttaattgtatttt

SEQ ID NO: 1342324 - DNA, 19 bp, Homo sapiens
atttttttttctaagagaa

SEQ ID NO: 1342325 - DNA, 22 bp, Homo sapiens
caaaaaaaaaaaaaagcatcta

SEQ ID NO: 1342326 - DNA, 15 bp, Homo sapiens
caaaaaactacttct

SEQ ID NO: 1342327 - DNA, 12 bp, Homo sapiens
caaaaaatgagc

SEQ ID NO: 1342328 - DNA, 16 bp, Homo sapiens
caaaaaattagccggg

SEQ ID NO: 1342329 - DNA, 10 bp, Homo sapiens
caaaaacaaa

SEQ ID NO: 1342330 - DNA, 13 bp, Homo sapiens
caaaaagaaatga

SEQ ID NO: 1342331 - DNA, 13 bp, Homo sapiens
caaaaagcttccc

SEQ ID NO: 1342332 - DNA, 15 bp, Homo sapiens
caaaaattagccggg

SEQ ID NO: 1342333 - DNA, 23 bp, Homo sapiens
caaaaggcctcttgtaaagactg

SEQ ID NO: 1342334 - DNA, 11 bp, Homo sapiens
caaaaggttta

SEQ ID NO: 1342335 - DNA, 15 bp, Homo sapiens
caaaaggtttattcc

SEQ ID NO: 1342336 - DNA, 20 bp, Homo sapiens
caaaagtagaactttgtata

SEQ ID NO: 1342337 - DNA, 13 bp, Homo sapiens
caaaataaaacat

SEQ ID NO: 1342338 - DNA, 14 bp, Homo sapiens
caaaataaaacata

SEQ ID NO: 1342339 - DNA, 15 bp, Homo sapiens
caaaataaaacatag

SEQ ID NO: 1342340 - DNA, 13 bp, Homo sapiens
caaaatacatgaa

SEQ ID NO: 1342341 - DNA, 17 bp, Homo sapiens
caaaatacatgaagctt

SEQ ID NO: 1342342 - DNA, 17 bp, Homo sapiens
caaaatggaataaaagg

SEQ ID NO: 1342343 - DNA, 12 bp, Homo sapiens
caaaatgtgagt

SEQ ID NO: 1342344 - DNA, 19 bp, Homo sapiens
caaaatgtgagtggttgaa

SEQ ID NO: 1342345 - DNA, 22 bp, Homo sapiens
caaaattaagcaaatgttaaaa

SEQ ID NO: 1342346 - DNA, 18 bp, Homo sapiens
ccaggatcccaagcctcc

SEQ ID NO: 1342347 - DNA, 12 bp, Homo sapiens
ccaggcagggag

SEQ ID NO: 1342348 - DNA, 13 bp, Homo sapiens
ccaggcagggaga

SEQ ID NO: 1342349 - DNA, 13 bp, Homo sapiens
ccaggcatggtgg

SEQ ID NO: 1342350 - DNA, 16 bp, Homo sapiens
ccaggccagcctccga

SEQ ID NO: 1342351 - DNA, 19 bp, Homo sapiens
ccaggccagcctccgagag

SEQ ID NO: 1342352 - DNA, 19 bp, Homo sapiens
ccaggccgcgccctttccc

SEQ ID NO: 1342353 - DNA, 22 bp, Homo sapiens
ccaggctatgtataaaatacat

SEQ ID NO: 1342354 - DNA, 13 bp, Homo sapiens
ccaggctcactca

SEQ ID NO: 1342355 - DNA, 14 bp, Homo sapiens
ccaggcttggcctt

SEQ ID NO: 1342356 - DNA, 14 bp, Homo sapiens
ccagggaccggcgg

SEQ ID NO: 1342357 - DNA, 12 bp, Homo sapiens
ccagggagcctt

SEQ ID NO: 1342358 - DNA, 22 bp, Homo sapiens
ccagggagcctttggttctggc

SEQ ID NO: 1342359 - DNA, 17 bp, Homo sapiens
ccagggcaagctccgca

SEQ ID NO: 1342360 - DNA, 12 bp, Homo sapiens
ccagggctcctg

SEQ ID NO: 1342361 - DNA, 13 bp, Homo sapiens
ccagggctcctgc

SEQ ID NO: 1342362 - DNA, 16 bp, Homo sapiens
ccaggggagttgtgtc

SEQ ID NO: 1342363 - DNA, 22 bp, Homo sapiens
ccaggggctgcttcctcctgga

SEQ ID NO: 1342364 - DNA, 18 bp, Homo sapiens
ccagggggtctcacccat

SEQ ID NO: 1342365 - DNA, 14 bp, Homo sapiens
ccaggggtctccct

SEQ ID NO: 1342366 - DNA, 16 bp, Homo sapiens
ccaggggtctccctgg

SEQ ID NO: 1342367 - DNA, 19 bp, Homo sapiens
ccaggtaccagctgcgctt

SEQ ID NO: 1342368 - DNA, 14 bp, Homo sapiens
ccaggtccagctct

SEQ ID NO: 1342369 - DNA, 17 bp, Homo sapiens
ccaggtccagctctgga

SEQ ID NO: 1342370 - DNA, 18 bp, Homo sapiens
ccaggtccagctctggag

SEQ ID NO: 1342371 - DNA, 14 bp, Homo sapiens
ccaggtgcagaggt

SEQ ID NO: 1342372 - DNA, 17 bp, Homo sapiens
ccagtaagatcactgtt

SEQ ID NO: 1342373 - DNA, 19 bp, Homo sapiens
ccagtcaggtagttgcaat

SEQ ID NO: 1342374 - DNA, 13 bp, Homo sapiens
ccagtccaggctg

SEQ ID NO: 1342375 - DNA, 16 bp, Homo sapiens
ccagtccaggctgccg

SEQ ID NO: 1342376 - DNA, 21 bp, Homo sapiens
ccagtctgtggatcagagatg

SEQ ID NO: 1342377 - DNA, 19 bp, Homo sapiens
ccagtgacctctctctctg

SEQ ID NO: 1342378 - DNA, 23 bp, Homo sapiens
ccagtgagggacgtcagacttgg

SEQ ID NO: 1342379 - DNA, 17 bp, Homo sapiens
ccagtgcaaatgcatgc

SEQ ID NO: 1342380 - DNA, 19 bp, Homo sapiens
ccagtgcatggtggccaga

SEQ ID NO: 1342381 - DNA, 20 bp, Homo sapiens
ccagtgccgagaaggaagcc

SEQ ID NO: 1342382 - DNA, 17 bp, Homo sapiens
ccatacactttgttgca

SEQ ID NO: 1342383 - DNA, 16 bp, Homo sapiens
ccatagacatgaaagg

SEQ ID NO: 1342384 - DNA, 20 bp, Homo sapiens
ccatagagtacactgcctgc

SEQ ID NO: 1342385 - DNA, 13 bp, Homo sapiens
ccatagtccctgc

SEQ ID NO: 1342386 - DNA, 14 bp, Homo sapiens
ccatattggccagt

SEQ ID NO: 1342387 - DNA, 21 bp, Homo sapiens
ccatattgtgcttcacagtag

SEQ ID NO: 1342388 - DNA, 13 bp, Homo sapiens
ccatcaccagaca

SEQ ID NO: 1342389 - DNA, 13 bp, Homo sapiens
ccatcaccctctt

SEQ ID NO: 1342390 - DNA, 16 bp, Homo sapiens
ccatcaccctcttcct

SEQ ID NO: 1342391 - DNA, 18 bp, Homo sapiens
ccatcaccctcttcctgt

SEQ ID NO: 1342392 - DNA, 20 bp, Homo sapiens
ccatcaccctcttcctgtga

SEQ ID NO: 1342393 - DNA, 15 bp, Homo sapiens
ccatccaaggccagg

SEQ ID NO: 1342394 - DNA, 12 bp, Homo sapiens
ccatcctgacca

SEQ ID NO: 1342395 - DNA, 13 bp, Homo sapiens
ccatcctgactga

SEQ ID NO: 1342396 - DNA, 19 bp, Homo sapiens
ccatcctgggacggcggca

SEQ ID NO: 1342397 - DNA, 13 bp, Homo sapiens
ccatctccctgcc

SEQ ID NO: 1342398 - DNA, 14 bp, Homo sapiens
ccatctccctgcct

SEQ ID NO: 1342399 - DNA, 18 bp, Homo sapiens
ccatctccctgcctggcc

SEQ ID NO: 1342400 - DNA, 14 bp, Homo sapiens
ccatctgcacccct

SEQ ID NO: 1342401 - DNA, 22 bp, Homo sapiens
ccatctgcaccccttctctcct

SEQ ID NO: 1342402 - DNA, 17 bp, Homo sapiens
ccatctgccccacagtc

SEQ ID NO: 1342403 - DNA, 21 bp, Homo sapiens
ccatcttgcttccctaatcta

SEQ ID NO: 1342404 - DNA, 15 bp, Homo sapiens
ccatgcaagcagagg

SEQ ID NO: 1342405 - DNA, 17 bp, Homo sapiens
ccatgcaagcagaggac

SEQ ID NO: 1342406 - DNA, 13 bp, Homo sapiens
ccatgcgctcagg

SEQ ID NO: 1342407 - DNA, 15 bp, Homo sapiens
ccatgcgctcagggc

SEQ ID NO: 1342408 - DNA, 16 bp, Homo sapiens
ccatgcgctcagggcc

SEQ ID NO: 1342409 - DNA, 13 bp, Homo sapiens
ccatgctcatctg

SEQ ID NO: 1342410 - DNA, 16 bp, Homo sapiens
ccatgctcatctgctg

SEQ ID NO: 1342411 - DNA, 15 bp, Homo sapiens
ccatgctcctggccc

SEQ ID NO: 1342412 - DNA, 18 bp, Homo sapiens
ccatgctcctggcccact

SEQ ID NO: 1342413 - DNA, 17 bp, Homo sapiens
ccatgctgaggcctggg

SEQ ID NO: 1342414 - DNA, 18 bp, Homo sapiens
ccatgctgaggcctgggc

SEQ ID NO: 1342415 - DNA, 12 bp, Homo sapiens
ccatggggaggg

SEQ ID NO: 1342416 - DNA, 14 bp, Homo sapiens
ccatgtccaaagag

SEQ ID NO: 1342417 - DNA, 19 bp, Homo sapiens
ccatgtccaaagaggctgc

SEQ ID NO: 1342418 - DNA, 18 bp, Homo sapiens
caatgctttatttgtaaa

SEQ ID NO: 1342419 - DNA, 20 bp, Homo sapiens
caatgctttatttgtaaatt

SEQ ID NO: 1342420 - DNA, 23 bp, Homo sapiens
caatgctttatttgtaaatttag

SEQ ID NO: 1342421 - DNA, 20 bp, Homo sapiens
caatggtagtttctgtggtt

SEQ ID NO: 1342422 - DNA, 17 bp, Homo sapiens
caatgtaagcatacttt

SEQ ID NO: 1342423 - DNA, 14 bp, Homo sapiens
caattctgttttta

SEQ ID NO: 1342424 - DNA, 21 bp, Homo sapiens
caattgaattaaattaggaat

SEQ ID NO: 1342425 - DNA, 21 bp, Homo sapiens
caattggtaaaactcactgtg

SEQ ID NO: 1342426 - DNA, 17 bp, Homo sapiens
caattgtcactttttat

SEQ ID NO: 1342427 - DNA, 22 bp, Homo sapiens
cacaaactctatcggagaacat

SEQ ID NO: 1342428 - DNA, 20 bp, Homo sapiens
cacaaatgactttattattt

SEQ ID NO: 1342429 - DNA, 22 bp, Homo sapiens
cacaaatgactttattatttat

SEQ ID NO: 1342430 - DNA, 22 bp, Homo sapiens
cacaagcaaaaaaaaaaaaaag

SEQ ID NO: 1342431 - DNA, 13 bp, Homo sapiens
cacacacctgtag

SEQ ID NO: 1342432 - DNA, 20 bp, Homo sapiens
cacacacggaggcatcctac

SEQ ID NO: 1342433 - DNA, 14 bp, Homo sapiens
cacacccaaagctg

SEQ ID NO: 1342434 - DNA, 15 bp, Homo sapiens
cacacccaaagctga

SEQ ID NO: 1342435 - DNA, 15 bp, Homo sapiens
cacagagtcaaggcc

SEQ ID NO: 1342436 - DNA, 17 bp, Homo sapiens
cacagagtcaaggcctg

SEQ ID NO: 1342437 - DNA, 20 bp, Homo sapiens
cacagcaacgatcacaaatg

SEQ ID NO: 1342438 - DNA, 23 bp, Homo sapiens
cacagcagcttataatgggctct

SEQ ID NO: 1342439 - DNA, 15 bp, Homo sapiens
cacagccagcacctg

SEQ ID NO: 1342440 - DNA, 16 bp, Homo sapiens
cacagccagcacctgg

SEQ ID NO: 1342441 - DNA, 20 bp, Homo sapiens
cacagcggaggtgtggagcc

SEQ ID NO: 1342442 - DNA, 18 bp, Homo sapiens
cacagcgtccctggcgca

SEQ ID NO: 1342443 - DNA, 19 bp, Homo sapiens
cacagcgtccctggcgcag

SEQ ID NO: 1342444 - DNA, 13 bp, Homo sapiens
cacagctcaggag

SEQ ID NO: 1342445 - DNA, 15 bp, Homo sapiens
cacagctcaggaggc

SEQ ID NO: 1342446 - DNA, 19 bp, Homo sapiens
cacagcttgacctgaggct

SEQ ID NO: 1342447 - DNA, 21 bp, Homo sapiens
cacagcttgacctgaggctgt

SEQ ID NO: 1342448 - DNA, 22 bp, Homo sapiens
cacagcttgacctgaggctgtg

SEQ ID NO: 1342449 - DNA, 15 bp, Homo sapiens
cacaggaggcaggca

SEQ ID NO: 1342450 - DNA, 19 bp, Homo sapiens
cacaggaggcaggcatggc

SEQ ID NO: 1342451 - DNA, 16 bp, Homo sapiens
cacagggtgggcctcg

SEQ ID NO: 1342452 - DNA, 13 bp, Homo sapiens
cacagtagaactg

SEQ ID NO: 1342453 - DNA, 20 bp, Homo sapiens
cacagtagaactgtctgtga

SEQ ID NO: 1342454 - DNA, 14 bp, Homo sapiens
cacagtagagccag

SEQ ID NO: 1342455 - DNA, 17 bp, Homo sapiens
cacagtagagccagctt

SEQ ID NO: 1342456 - DNA, 18 bp, Homo sapiens
cacatagcatgtaatggt

SEQ ID NO: 1342457 - DNA, 14 bp, Homo sapiens
cacatatatattac

SEQ ID NO: 1342458 - DNA, 23 bp, Homo sapiens
cacatatttgaagggtctttctc

SEQ ID NO: 1342459 - DNA, 14 bp, Homo sapiens
cacatcaaaccttt

SEQ ID NO: 1342460 - DNA, 12 bp, Homo sapiens
cacatccaactc

SEQ ID NO: 1342461 - DNA, 16 bp, Homo sapiens
cacatccaactccagc

SEQ ID NO: 1342462 - DNA, 19 bp, Homo sapiens
cacatccgcgtgtgcctgt

SEQ ID NO: 1342463 - DNA, 22 bp, Homo sapiens
cacatccgcgtgtgcctgtgtg

SEQ ID NO: 1342464 - DNA, 12 bp, Homo sapiens
cacatctgcctt

SEQ ID NO: 1342465 - DNA, 13 bp, Homo sapiens
cacatgtttttat

SEQ ID NO: 1342466 - DNA, 14 bp, Homo sapiens
caccaaagctgccc

SEQ ID NO: 1342467 - DNA, 22 bp, Homo sapiens
caccaatcttactttgtaaatt

SEQ ID NO: 1342468 - DNA, 19 bp, Homo sapiens
caccacagccagcacctgg

SEQ ID NO: 1342469 - DNA, 13 bp, Homo sapiens
caccaccaagcca

SEQ ID NO: 1342470 - DNA, 18 bp, Homo sapiens
caccaccttcttctccta

SEQ ID NO: 1342471 - DNA, 22 bp, Homo sapiens
caccacgggacatcacagggtg

SEQ ID NO: 1342472 - DNA, 12 bp, Homo sapiens
caccagcagcct

SEQ ID NO: 1342473 - DNA, 18 bp, Homo sapiens
caccagccccactgccag

SEQ ID NO: 1342474 - DNA, 13 bp, Homo sapiens
caccaggaagccg

SEQ ID NO: 1342475 - DNA, 14 bp, Homo sapiens
caccaggccacctc

SEQ ID NO: 1342476 - DNA, 19 bp, Homo sapiens
caccaggccacctccccag

SEQ ID NO: 1342477 - DNA, 15 bp, Homo sapiens
caccaggcgctgccc

SEQ ID NO: 1342478 - DNA, 15 bp, Homo sapiens
caccaggggtttctc

SEQ ID NO: 1342479 - DNA, 20 bp, Homo sapiens
caccattcgtacataatact

SEQ ID NO: 1342480 - DNA, 22 bp, Homo sapiens
caccattcgtacataatactga

SEQ ID NO: 1342481 - DNA, 13 bp, Homo sapiens
caccattctgact

SEQ ID NO: 1342482 - DNA, 12 bp, Homo sapiens
cacccaaagctg

SEQ ID NO: 1342483 - DNA, 18 bp, Homo sapiens
cacccaaagctgagcctg

SEQ ID NO: 1342484 - DNA, 15 bp, Homo sapiens
cacccaaccccaagc

SEQ ID NO: 1342485 - DNA, 23 bp, Homo sapiens
cacccaaccctatctcctgacag

SEQ ID NO: 1342486 - DNA, 24 bp, Homo sapiens
cacccaaccctatctcctgacaga

SEQ ID NO: 1342487 - DNA, 16 bp, Homo sapiens
cacccaccgtggagga

SEQ ID NO: 1342488 - DNA, 20 bp, Homo sapiens
cacccaggctggactgcaat

SEQ ID NO: 1342489 - DNA, 22 bp, Homo sapiens
cacccatgcaagcagaggacca

SEQ ID NO: 1342490 - DNA, 20 bp, Homo sapiens
caccccaggacgccactcat

SEQ ID NO: 1342491 - DNA, 14 bp, Homo sapiens
caccccctcccacc

SEQ ID NO: 1342492 - DNA, 18 bp, Homo sapiens
caccccggccccctgccc

SEQ ID NO: 1342493 - DNA, 17 bp, Homo sapiens
caccccggggaccctgt

SEQ ID NO: 1342494 - DNA, 12 bp, Homo sapiens
cacccctaccac

SEQ ID NO: 1342495 - DNA, 19 bp, Homo sapiens
cacccctgcccccagcccc

SEQ ID NO: 1342496 - DNA, 12 bp, Homo sapiens
caccccttctct

SEQ ID NO: 1342497 - DNA, 18 bp, Homo sapiens
caccccttctctcctccc

SEQ ID NO: 1342498 - DNA, 14 bp, Homo sapiens
caccctcttcctgt

SEQ ID NO: 1342499 - DNA, 15 bp, Homo sapiens
caccctcttcctgtg

SEQ ID NO: 1342500 - DNA, 14 bp, Homo sapiens
caccctgagccggc

SEQ ID NO: 1342501 - DNA, 17 bp, Homo sapiens
catgcaagcagaggacc

SEQ ID NO: 1342502 - DNA, 23 bp, Homo sapiens
catgcaagcagaggaccagggcc

SEQ ID NO: 1342503 - DNA, 14 bp, Homo sapiens
catgcaataaaatt

SEQ ID NO: 1342504 - DNA, 17 bp, Homo sapiens
catgcacttaaagaagt

SEQ ID NO: 1342505 - DNA, 18 bp, Homo sapiens
catgcatataatgaataa

SEQ ID NO: 1342506 - DNA, 20 bp, Homo sapiens
catgcatataatgaataaat

SEQ ID NO: 1342507 - DNA, 22 bp, Homo sapiens
catgccagctggcctttgtaag

SEQ ID NO: 1342508 - DNA, 15 bp, Homo sapiens
catgcccaccccctg

SEQ ID NO: 1342509 - DNA, 23 bp, Homo sapiens
catgcccaccccctgccctgcac

SEQ ID NO: 1342510 - DNA, 11 bp, Homo sapiens
catgccccctg

SEQ ID NO: 1342511 - DNA, 23 bp, Homo sapiens
catgcggtgccatgaagggaccc

SEQ ID NO: 1342512 - DNA, 17 bp, Homo sapiens
catgctaacaaagacaa

SEQ ID NO: 1342513 - DNA, 17 bp, Homo sapiens
catgctcatctgctggt

SEQ ID NO: 1342514 - DNA, 15 bp, Homo sapiens
catgctgaggcctgg

SEQ ID NO: 1342515 - DNA, 17 bp, Homo sapiens
catgctgaggcctgggc

SEQ ID NO: 1342516 - DNA, 14 bp, Homo sapiens
catgcttcttctca

SEQ ID NO: 1342517 - DNA, 21 bp, Homo sapiens
catggaaatcagccaagtttt

SEQ ID NO: 1342518 - DNA, 14 bp, Homo sapiens
catggagccagctc

SEQ ID NO: 1342519 - DNA, 20 bp, Homo sapiens
catggcagcctactctcctt

SEQ ID NO: 1342520 - DNA, 21 bp, Homo sapiens
catggcatggttttgtgccat

SEQ ID NO: 1342521 - DNA, 18 bp, Homo sapiens
catggctgctgttgctta

SEQ ID NO: 1342522 - DNA, 14 bp, Homo sapiens
catggtgaagtgct

SEQ ID NO: 1342523 - DNA, 16 bp, Homo sapiens
catggtgcctgagagg

SEQ ID NO: 1342524 - DNA, 19 bp, Homo sapiens
catggtgcctgagaggcag

SEQ ID NO: 1342525 - DNA, 21 bp, Homo sapiens
catggtgcctgagaggcaggc

SEQ ID NO: 1342526 - DNA, 22 bp, Homo sapiens
catggtgcctgagaggcaggca

SEQ ID NO: 1342527 - DNA, 17 bp, Homo sapiens
catgtaaagtgtcagaa

SEQ ID NO: 1342528 - DNA, 18 bp, Homo sapiens
catgtaaagtgtcagaag

SEQ ID NO: 1342529 - DNA, 19 bp, Homo sapiens
catgtagcagtgagtcata

SEQ ID NO: 1342530 - DNA, 13 bp, Homo sapiens
catgtagccccct

SEQ ID NO: 1342531 - DNA, 20 bp, Homo sapiens
catgtcaaacatgagatgtg

SEQ ID NO: 1342532 - DNA, 18 bp, Homo sapiens
catgtcatttcagaagtt

SEQ ID NO: 1342533 - DNA, 19 bp, Homo sapiens
catgtccaaacgtcctctt

SEQ ID NO: 1342534 - DNA, 13 bp, Homo sapiens
catgtccaaagag

SEQ ID NO: 1342535 - DNA, 16 bp, Homo sapiens
catgtccaaagaggct

SEQ ID NO: 1342536 - DNA, 22 bp, Homo sapiens
catgtccagcaccttgtgcctg

SEQ ID NO: 1342537 - DNA, 23 bp, Homo sapiens
catgtccagcaccttgtgcctgg

SEQ ID NO: 1342538 - DNA, 19 bp, Homo sapiens
catgtccatacactttgtt

SEQ ID NO: 1342539 - DNA, 21 bp, Homo sapiens
catgtcgtggacacacacaga

SEQ ID NO: 1342540 - DNA, 15 bp, Homo sapiens
catgtgatacatttt

SEQ ID NO: 1342541 - DNA, 17 bp, Homo sapiens
catgtgatggacactcc

SEQ ID NO: 1342542 - DNA, 19 bp, Homo sapiens
catgtgatggacactccag

SEQ ID NO: 1342543 - DNA, 21 bp, Homo sapiens
catgtgatggacactccaggg

SEQ ID NO: 1342544 - DNA, 16 bp, Homo sapiens
catgtgcatagtttct

SEQ ID NO: 1342545 - DNA, 12 bp, Homo sapiens
catgtggctgga

SEQ ID NO: 1342546 - DNA, 15 bp, Homo sapiens
catgtggctggaaga

SEQ ID NO: 1342547 - DNA, 20 bp, Homo sapiens
catgttgggaaacttggctc

SEQ ID NO: 1342548 - DNA, 19 bp, Homo sapiens
cattaaacttttttaacca

SEQ ID NO: 1342549 - DNA, 19 bp, Homo sapiens
cattagccagatttgtctt

SEQ ID NO: 1342550 - DNA, 13 bp, Homo sapiens
cattataaaaaga

SEQ ID NO: 1342551 - DNA, 18 bp, Homo sapiens
cattatgccacttccttt

SEQ ID NO: 1342552 - DNA, 14 bp, Homo sapiens
cattatttatatgg

SEQ ID NO: 1342553 - DNA, 12 bp, Homo sapiens
cattcagaaatg

SEQ ID NO: 1342554 - DNA, 23 bp, Homo sapiens
cattcagaaatgttgagtctgta

SEQ ID NO: 1342555 - DNA, 11 bp, Homo sapiens
cattcattttt

SEQ ID NO: 1342556 - DNA, 13 bp, Homo sapiens
cattcatttttat

SEQ ID NO: 1342557 - DNA, 13 bp, Homo sapiens
cattccagcccct

SEQ ID NO: 1342558 - DNA, 15 bp, Homo sapiens
cattccagcccctct

SEQ ID NO: 1342559 - DNA, 18 bp, Homo sapiens
cattccagcccctctggt

SEQ ID NO: 1342560 - DNA, 16 bp, Homo sapiens
ccaccgtggaggagga

SEQ ID NO: 1342561 - DNA, 16 bp, Homo sapiens
ccacctagaacactaa

SEQ ID NO: 1342562 - DNA, 18 bp, Homo sapiens
ccacctagaacactaact

SEQ ID NO: 1342563 - DNA, 17 bp, Homo sapiens
ccacctcccacaaagga

SEQ ID NO: 1342564 - DNA, 22 bp, Homo sapiens
ccacctttggaaagctctgacc

SEQ ID NO: 1342565 - DNA, 23 bp, Homo sapiens
ccacgaatttctgtgccctcctg

SEQ ID NO: 1342566 - DNA, 17 bp, Homo sapiens
ccacgcccgtcctgcct

SEQ ID NO: 1342567 - DNA, 19 bp, Homo sapiens
ccacgcccgtcctgcctgt

SEQ ID NO: 1342568 - DNA, 22 bp, Homo sapiens
ccacgcccgtcctgcctgtggc

SEQ ID NO: 1342569 - DNA, 21 bp, Homo sapiens
ccacgcctcttgaccaggctg

SEQ ID NO: 1342570 - DNA, 14 bp, Homo sapiens
ccacgcttctccgg

SEQ ID NO: 1342571 - DNA, 23 bp, Homo sapiens
ccactaaaaatattgtttctgca

SEQ ID NO: 1342572 - DNA, 13 bp, Homo sapiens
ccactacacctgg

SEQ ID NO: 1342573 - DNA, 15 bp, Homo sapiens
ccactccccggcatg

SEQ ID NO: 1342574 - DNA, 16 bp, Homo sapiens
ccactccgagaggtgg

SEQ ID NO: 1342575 - DNA, 17 bp, Homo sapiens
ccactccgagaggtggg

SEQ ID NO: 1342576 - DNA, 19 bp, Homo sapiens
ccactccgagaggtgggcc

SEQ ID NO: 1342577 - DNA, 13 bp, Homo sapiens
ccactctgcttct

SEQ ID NO: 1342578 - DNA, 17 bp, Homo sapiens
ccactctgcttctctga

SEQ ID NO: 1342579 - DNA, 20 bp, Homo sapiens
ccactctgcttctctgactt

SEQ ID NO: 1342580 - DNA, 19 bp, Homo sapiens
ccactgcactccagcctgg

SEQ ID NO: 1342581 - DNA, 23 bp, Homo sapiens
ccactgcactccagcctgggtga

SEQ ID NO: 1342582 - DNA, 14 bp, Homo sapiens
ccactgccagcagc

SEQ ID NO: 1342583 - DNA, 16 bp, Homo sapiens
ccactgccagcagcag

SEQ ID NO: 1342584 - DNA, 20 bp, Homo sapiens
ccactgccagcagcagcagg

SEQ ID NO: 1342585 - DNA, 15 bp, Homo sapiens
ccactgccttcgctt

SEQ ID NO: 1342586 - DNA, 13 bp, Homo sapiens
ccacttcagctga

SEQ ID NO: 1342587 - DNA, 19 bp, Homo sapiens
ccacttctgccagatgtcc

SEQ ID NO: 1342588 - DNA, 15 bp, Homo sapiens
ccacttgaggcctga

SEQ ID NO: 1342589 - DNA, 12 bp, Homo sapiens
ccacttgcctct

SEQ ID NO: 1342590 - DNA, 13 bp, Homo sapiens
ccacttgcctctt

SEQ ID NO: 1342591 - DNA, 19 bp, Homo sapiens
ccacttgcctcttccttga

SEQ ID NO: 1342592 - DNA, 22 bp, Homo sapiens
ccacttgcctcttccttgaaga

SEQ ID NO: 1342593 - DNA, 17 bp, Homo sapiens
ccacttgtagatttgat

SEQ ID NO: 1342594 - DNA, 18 bp, Homo sapiens
ccactttacccacctaga

SEQ ID NO: 1342595 - DNA, 19 bp, Homo sapiens
ccagaaccaccccggcccc

SEQ ID NO: 1342596 - DNA, 22 bp, Homo sapiens
ccagaagtttgagatcagcctg

SEQ ID NO: 1342597 - DNA, 23 bp, Homo sapiens
ccagaagtttgagatcagcctgg

SEQ ID NO: 1342598 - DNA, 19 bp, Homo sapiens
ccagaataagttattgcag

SEQ ID NO: 1342599 - DNA, 15 bp, Homo sapiens
ccagaatactgatgg

SEQ ID NO: 1342600 - DNA, 22 bp, Homo sapiens
ccagacctggaagaacaggcct

SEQ ID NO: 1342601 - DNA, 17 bp, Homo sapiens
ccagactcagagctctc

SEQ ID NO: 1342602 - DNA, 22 bp, Homo sapiens
ccagactcagagctctctctac

SEQ ID NO: 1342603 - DNA, 23 bp, Homo sapiens
ccagactcagagctctctctaca

SEQ ID NO: 1342604 - DNA, 15 bp, Homo sapiens
ccagacttccttgag

SEQ ID NO: 1342605 - DNA, 21 bp, Homo sapiens
ccagagagcctggtgctgctg

SEQ ID NO: 1342606 - DNA, 17 bp, Homo sapiens
ccagaggaatcctggca

SEQ ID NO: 1342607 - DNA, 20 bp, Homo sapiens
ccagaggaatcctggcagcc

SEQ ID NO: 1342608 - DNA, 22 bp, Homo sapiens
ccagaggaatcctggcagccca

SEQ ID NO: 1342609 - DNA, 19 bp, Homo sapiens
ccagaggcccccagcccag

SEQ ID NO: 1342610 - DNA, 15 bp, Homo sapiens
ccagatcactgccac

SEQ ID NO: 1342611 - DNA, 17 bp, Homo sapiens
ccagatgcgtcccaaga

SEQ ID NO: 1342612 - DNA, 21 bp, Homo sapiens
ccagatgcgtcccaagatgtt

SEQ ID NO: 1342613 - DNA, 17 bp, Homo sapiens
ccagatggtcatccaga

SEQ ID NO: 1342614 - DNA, 23 bp, Homo sapiens
ccagatgtttccagacttccttg

SEQ ID NO: 1342615 - DNA, 15 bp, Homo sapiens
ccagatttgtctttt

SEQ ID NO: 1342616 - DNA, 22 bp, Homo sapiens
ccagcaaaagagctattgccaa

SEQ ID NO: 1342617 - DNA, 15 bp, Homo sapiens
ccagcaacacagcct

SEQ ID NO: 1342618 - DNA, 16 bp, Homo sapiens
ccagcaacacagcctg

SEQ ID NO: 1342619 - DNA, 17 bp, Homo sapiens
ccagcaacacagcctgg

SEQ ID NO: 1342620 - DNA, 19 bp, Homo sapiens
ccagcaacacagcctgggc

SEQ ID NO: 1342621 - DNA, 14 bp, Homo sapiens
ccagcaacttcttc

SEQ ID NO: 1342622 - DNA, 17 bp, Homo sapiens
ccagcacctcagcctgc

SEQ ID NO: 1342623 - DNA, 18 bp, Homo sapiens
ccagcacctcagcctgca

SEQ ID NO: 1342624 - DNA, 15 bp, Homo sapiens
ccagcacctggcatc

SEQ ID NO: 1342625 - DNA, 13 bp, Homo sapiens
ccagcagcctgga

SEQ ID NO: 1342626 - DNA, 22 bp, Homo sapiens
cagtcattcagcagcaaatttt

SEQ ID NO: 1342627 - DNA, 14 bp, Homo sapiens
cagtccccacccct

SEQ ID NO: 1342628 - DNA, 20 bp, Homo sapiens
cagtcctactcaagcgggtg

SEQ ID NO: 1342629 - DNA, 15 bp, Homo sapiens
cagtcgtgcctgtgt

SEQ ID NO: 1342630 - DNA, 20 bp, Homo sapiens
cagtgaagatattttatttc

SEQ ID NO: 1342631 - DNA, 19 bp, Homo sapiens
cagtgcagagccttctcag

SEQ ID NO: 1342632 - DNA, 21 bp, Homo sapiens
cagtgcatggtggccagaggt

SEQ ID NO: 1342633 - DNA, 21 bp, Homo sapiens
cagtggaccgcccttttcccc

SEQ ID NO: 1342634 - DNA, 17 bp, Homo sapiens
cagtggtaagaatagta

SEQ ID NO: 1342635 - DNA, 22 bp, Homo sapiens
cagtggtggcaacattcattgc

SEQ ID NO: 1342636 - DNA, 21 bp, Homo sapiens
cagtggttttatactgaagga

SEQ ID NO: 1342637 - DNA, 19 bp, Homo sapiens
cagtgtctataaaagaaac

SEQ ID NO: 1342638 - DNA, 15 bp, Homo sapiens
cagtgtggccaggct

SEQ ID NO: 1342639 - DNA, 19 bp, Homo sapiens
cagtgtggcctcttctgag

SEQ ID NO: 1342640 - DNA, 12 bp, Homo sapiens
cagtgtgtaaac

SEQ ID NO: 1342641 - DNA, 14 bp, Homo sapiens
cagtgtgtaaacaa

SEQ ID NO: 1342642 - DNA, 22 bp, Homo sapiens
cagttcctcccaggaagcccag

SEQ ID NO: 1342643 - DNA, 12 bp, Homo sapiens
cagttgaaaaac

SEQ ID NO: 1342644 - DNA, 18 bp, Homo sapiens
cagttgctggtaaaatga

SEQ ID NO: 1342645 - DNA, 20 bp, Homo sapiens
cagttgctggtaaaatgaag

SEQ ID NO: 1342646 - DNA, 21 bp, Homo sapiens
cagttgctggtaaaatgaaga

SEQ ID NO: 1342647 - DNA, 22 bp, Homo sapiens
cagttgctggtaaaatgaagaa

SEQ ID NO: 1342648 - DNA, 13 bp, Homo sapiens
cagttgcttgtct

SEQ ID NO: 1342649 - DNA, 17 bp, Homo sapiens
cagttggccagagagcc

SEQ ID NO: 1342650 - DNA, 19 bp, Homo sapiens
cagtttatcattcaagtgt

SEQ ID NO: 1342651 - DNA, 18 bp, Homo sapiens
cagtttgagacaggagac

SEQ ID NO: 1342652 - DNA, 23 bp, Homo sapiens
cagtttgaggattagtttagaac

SEQ ID NO: 1342653 - DNA, 15 bp, Homo sapiens
cagtttgttggaaag

SEQ ID NO: 1342654 - DNA, 21 bp, Homo sapiens
cataaaaattagccaagtgtg

SEQ ID NO: 1342655 - DNA, 18 bp, Homo sapiens
cataaattcaactttgta

SEQ ID NO: 1342656 - DNA, 22 bp, Homo sapiens
cataaattttttgaagtcttta

SEQ ID NO: 1342657 - DNA, 15 bp, Homo sapiens
cataacatccagagc

SEQ ID NO: 1342658 - DNA, 19 bp, Homo sapiens
cataagcttccattttaat

SEQ ID NO: 1342659 - DNA, 15 bp, Homo sapiens
catacataaaagaaa

SEQ ID NO: 1342660 - DNA, 18 bp, Homo sapiens
catacataaaagaaataa

SEQ ID NO: 1342661 - DNA, 15 bp, Homo sapiens
catactcgagtctga

SEQ ID NO: 1342662 - DNA, 16 bp, Homo sapiens
catactcgagtctgag

SEQ ID NO: 1342663 - DNA, 17 bp, Homo sapiens
catactcgagtctgagg

SEQ ID NO: 1342664 - DNA, 18 bp, Homo sapiens
catactcgagtctgaggc

SEQ ID NO: 1342665 - DNA, 19 bp, Homo sapiens
catactcgagtctgaggcc

SEQ ID NO: 1342666 - DNA, 18 bp, Homo sapiens
catacttacctagtgaaa

SEQ ID NO: 1342667 - DNA, 16 bp, Homo sapiens
catactttgtattttg

SEQ ID NO: 1342668 - DNA, 17 bp, Homo sapiens
catactttgtattttga

SEQ ID NO: 1342669 - DNA, 16 bp, Homo sapiens
catagacatgaaaggt

SEQ ID NO: 1342670 - DNA, 19 bp, Homo sapiens
catagaggcttctccgcca

SEQ ID NO: 1342671 - DNA, 23 bp, Homo sapiens
catagaggcttctccgccagcct

SEQ ID NO: 1342672 - DNA, 15 bp, Homo sapiens
catagagtacactgc

SEQ ID NO: 1342673 - DNA, 17 bp, Homo sapiens
catagataatattgttt

SEQ ID NO: 1342674 - DNA, 23 bp, Homo sapiens
catagataatattgtttggtaaa

SEQ ID NO: 1342675 - DNA, 11 bp, Homo sapiens
catagcccagt

SEQ ID NO: 1342676 - DNA, 12 bp, Homo sapiens
catagtccctgc

SEQ ID NO: 1342677 - DNA, 13 bp, Homo sapiens
catagtccctgcc

SEQ ID NO: 1342678 - DNA, 19 bp, Homo sapiens
catagtgaaaattgtttag

SEQ ID NO: 1342679 - DNA, 18 bp, Homo sapiens
catagttactgtgtaaac

SEQ ID NO: 1342680 - DNA, 17 bp, Homo sapiens
catagtttctttatttt

SEQ ID NO: 1342681 - DNA, 14 bp, Homo sapiens
catagtttggcatt

SEQ ID NO: 1342682 - DNA, 16 bp, Homo sapiens
catagtttggcatttg

SEQ ID NO: 1342683 - DNA, 12 bp, Homo sapiens
catatatattac

SEQ ID NO: 1342684 - DNA, 16 bp, Homo sapiens
catatatattacaagg

SEQ ID NO: 1342685 - DNA, 11 bp, Homo sapiens
catatgaaaaa

SEQ ID NO: 1342686 - DNA, 15 bp, Homo sapiens
catatgaaaggagag

SEQ ID NO: 1342687 - DNA, 17 bp, Homo sapiens
catatgggttagatgtt

SEQ ID NO: 1342688 - DNA, 21 bp, Homo sapiens
catattgtgcttcacagtaga

SEQ ID NO: 1342689 - DNA, 23 bp, Homo sapiens
catattgtgcttcacagtagagc

SEQ ID NO: 1342690 - DNA, 18 bp, Homo sapiens
cagctggttgaggtttca

SEQ ID NO: 1342691 - DNA, 18 bp, Homo sapiens
cagcttataatgggctct

SEQ ID NO: 1342692 - DNA, 13 bp, Homo sapiens
cagcttattgttt

SEQ ID NO: 1342693 - DNA, 20 bp, Homo sapiens
cagcttgacctgaggctgtg

SEQ ID NO: 1342694 - DNA, 20 bp, Homo sapiens
cagcttggggccaccaaagc

SEQ ID NO: 1342695 - DNA, 22 bp, Homo sapiens
cagcttggggccaccaaagctg

SEQ ID NO: 1342696 - DNA, 16 bp, Homo sapiens
cagctttcatgattag

SEQ ID NO: 1342697 - DNA, 20 bp, Homo sapiens
cagctttgagaagccttcag

SEQ ID NO: 1342698 - DNA, 23 bp, Homo sapiens
caggaaaattgtttgaacccagg

SEQ ID NO: 1342699 - DNA, 13 bp, Homo sapiens
caggaaaccgagt

SEQ ID NO: 1342700 - DNA, 19 bp, Homo sapiens
caggaaactccacatctgc

SEQ ID NO: 1342701 - DNA, 22 bp, Homo sapiens
caggaaactccacatctgcctt

SEQ ID NO: 1342702 - DNA, 16 bp, Homo sapiens
caggaagcccaggagc

SEQ ID NO: 1342703 - DNA, 19 bp, Homo sapiens
caggaagcccaggagcctc

SEQ ID NO: 1342704 - DNA, 20 bp, Homo sapiens
caggaagcccaggagcctca

SEQ ID NO: 1342705 - DNA, 15 bp, Homo sapiens
caggaagccgtcctg

SEQ ID NO: 1342706 - DNA, 20 bp, Homo sapiens
caggaagggatgcaggctcc

SEQ ID NO: 1342707 - DNA, 22 bp, Homo sapiens
caggaagggcctacagcccatt

SEQ ID NO: 1342708 - DNA, 16 bp, Homo sapiens
caggaatgtgtggcct

SEQ ID NO: 1342709 - DNA, 17 bp, Homo sapiens
caggaatgtgtggcctg

SEQ ID NO: 1342710 - DNA, 19 bp, Homo sapiens
caggaatgtgtggcctgca

SEQ ID NO: 1342711 - DNA, 12 bp, Homo sapiens
caggaccctcgc

SEQ ID NO: 1342712 - DNA, 16 bp, Homo sapiens
caggacctcaggtgag

SEQ ID NO: 1342713 - DNA, 23 bp, Homo sapiens
caggacctcaggtgagaagcaga

SEQ ID NO: 1342714 - DNA, 16 bp, Homo sapiens
caggacgccactcatt

SEQ ID NO: 1342715 - DNA, 22 bp, Homo sapiens
caggacttccccggagggctgc

SEQ ID NO: 1342716 - DNA, 15 bp, Homo sapiens
caggagcaggcacgg

SEQ ID NO: 1342717 - DNA, 17 bp, Homo sapiens
caggagcaggcacgggt

SEQ ID NO: 1342718 - DNA, 21 bp, Homo sapiens
caggagtttgagaccaacctg

SEQ ID NO: 1342719 - DNA, 22 bp, Homo sapiens
caggagtttgagaccaacctgg

SEQ ID NO: 1342720 - DNA, 23 bp, Homo sapiens
caggagtttgagaccaacctggg

SEQ ID NO: 1342721 - DNA, 14 bp, Homo sapiens
caggcacctcttcc

SEQ ID NO: 1342722 - DNA, 17 bp, Homo sapiens
caggcacgggtggtccc

SEQ ID NO: 1342723 - DNA, 18 bp, Homo sapiens
caggcacgggtggtcccc

SEQ ID NO: 1342724 - DNA, 19 bp, Homo sapiens
caggcacgggtggtccccg

SEQ ID NO: 1342725 - DNA, 16 bp, Homo sapiens
caggcagcctctgtca

SEQ ID NO: 1342726 - DNA, 12 bp, Homo sapiens
caggcagggaga

SEQ ID NO: 1342727 - DNA, 17 bp, Homo sapiens
caggcaggggtgggggt

SEQ ID NO: 1342728 - DNA, 18 bp, Homo sapiens
caggcatagaggcttctc

SEQ ID NO: 1342729 - DNA, 21 bp, Homo sapiens
caggcatagaggcttctccgc

SEQ ID NO: 1342730 - DNA, 23 bp, Homo sapiens
caggcatagaggcttctccgcca

SEQ ID NO: 1342731 - DNA, 18 bp, Homo sapiens
caggcatggccctgggcg

SEQ ID NO: 1342732 - DNA, 11 bp, Homo sapiens
caggccacctc

SEQ ID NO: 1342733 - DNA, 16 bp, Homo sapiens
caggccacctccccag

SEQ ID NO: 1342734 - DNA, 19 bp, Homo sapiens
caggccagcctccgagagg

SEQ ID NO: 1342735 - DNA, 21 bp, Homo sapiens
caggccagcctccgagaggga

SEQ ID NO: 1342736 - DNA, 14 bp, Homo sapiens
caggccctggcctc

SEQ ID NO: 1342737 - DNA, 17 bp, Homo sapiens
caggccctggcctcccc

SEQ ID NO: 1342738 - DNA, 13 bp, Homo sapiens
caggccggcagcc

SEQ ID NO: 1342739 - DNA, 21 bp, Homo sapiens
caggccggcagccccagcctg

SEQ ID NO: 1342740 - DNA, 22 bp, Homo sapiens
caggccggcagccccagcctgc

SEQ ID NO: 1342741 - DNA, 12 bp, Homo sapiens
caggcctgcctc

SEQ ID NO: 1342742 - DNA, 14 bp, Homo sapiens
caggcctgcctccc

SEQ ID NO: 1342743 - DNA, 17 bp, Homo sapiens
caggcctgcctcccact

SEQ ID NO: 1342744 - DNA, 23 bp, Homo sapiens
caggcgctgcccacctgccggcc

SEQ ID NO: 1342745 - DNA, 16 bp, Homo sapiens
caggctcactgccagg

SEQ ID NO: 1342746 - DNA, 15 bp, Homo sapiens
caggctcccaggagc

SEQ ID NO: 1342747 - DNA, 14 bp, Homo sapiens
caggctcccctgag

SEQ ID NO: 1342748 - DNA, 15 bp, Homo sapiens
caggctcccctgagg

SEQ ID NO: 1342749 - DNA, 16 bp, Homo sapiens
caggctcccctgagga

SEQ ID NO: 1342750 - DNA, 14 bp, Homo sapiens
caggctgaaaacaa

SEQ ID NO: 1342751 - DNA, 15 bp, Homo sapiens
caggctgaaaacaat

SEQ ID NO: 1342752 - DNA, 14 bp, Homo sapiens
caggctggacgtgg

SEQ ID NO: 1342753 - DNA, 18 bp, Homo sapiens
caggctggccagtccagg

SEQ ID NO: 1342754 - DNA, 13 bp, Homo sapiens
caggctgggccat

SEQ ID NO: 1342755 - DNA, 17 bp, Homo sapiens
caggctgggccatgtcc

SEQ ID NO: 1342756 - DNA, 23 bp, Homo sapiens
cagggaccggcggaccccagcca

SEQ ID NO: 1342757 - DNA, 22 bp, Homo sapiens
cagggagcctttggttctggcc

SEQ ID NO: 1342758 - DNA, 22 bp, Homo sapiens
cagggagctgggcccgacatgg

SEQ ID NO: 1342759 - DNA, 16 bp, Homo sapiens
cagggaggggccggcc

SEQ ID NO: 1342760 - DNA, 19 bp, Homo sapiens
cagggataaggcctgtggg

SEQ ID NO: 1342761 - DNA, 16 bp, Homo sapiens
cagggccatgctgagg

SEQ ID NO: 1342762 - DNA, 16 bp, Homo sapiens
cagggccatggctcag

SEQ ID NO: 1342763 - DNA, 17 bp, Homo sapiens
cagggccatggctcagg

SEQ ID NO: 1342764 - DNA, 18 bp, Homo sapiens
cagggccatggctcaggg

SEQ ID NO: 1342765 - DNA, 21 bp, Homo sapiens
cagggctcccaggggtctccc

SEQ ID NO: 1342766 - DNA, 23 bp, Homo sapiens
cagggctgctgggggcaactggc

SEQ ID NO: 1342767 - DNA, 13 bp, Homo sapiens
cagggctggctcc

SEQ ID NO: 1342768 - DNA, 12 bp, Homo sapiens
caggggcctgga

SEQ ID NO: 1342769 - DNA, 22 bp, Homo sapiens
caggggctgcttcctcctggaa

SEQ ID NO: 1342770 - DNA, 15 bp, Homo sapiens
cagggggcaagagga

SEQ ID NO: 1342771 - DNA, 13 bp, Homo sapiens
caggggtctccct

SEQ ID NO: 1342772 - DNA, 16 bp, Homo sapiens
caggggtctccctggc

SEQ ID NO: 1342773 - DNA, 18 bp, Homo sapiens
caggggtctccctggctc

SEQ ID NO: 1342774 - DNA, 22 bp, Homo sapiens
caggggtctccctggctccctc

SEQ ID NO: 1342775 - DNA, 12 bp, Homo sapiens
caggggtggggg

SEQ ID NO: 1342776 - DNA, 22 bp, Homo sapiens
caggggtgggggtggaggcttc

SEQ ID NO: 1342777 - DNA, 13 bp, Homo sapiens
caggggtttctcg

SEQ ID NO: 1342778 - DNA, 13 bp, Homo sapiens
cagggtccctctg

SEQ ID NO: 1342779 - DNA, 21 bp, Homo sapiens
cagggtctctaccatcccctg

SEQ ID NO: 1342780 - DNA, 22 bp, Homo sapiens
cagggtggtctcttcttggggc

SEQ ID NO: 1342781 - DNA, 21 bp, Homo sapiens
cagggttcccgcggggctgtc

SEQ ID NO: 1342782 - DNA, 14 bp, Homo sapiens
caggtaccagctgc

SEQ ID NO: 1342783 - DNA, 13 bp, Homo sapiens
caggtccagctct

SEQ ID NO: 1342784 - DNA, 23 bp, Homo sapiens
caggtccagctctggaggggagg

SEQ ID NO: 1342785 - DNA, 13 bp, Homo sapiens
caggtgagaagca

SEQ ID NO: 1342786 - DNA, 20 bp, Homo sapiens
caggtgagaagcagaggaag

SEQ ID NO: 1342787 - DNA, 21 bp, Homo sapiens
caggtgattggaccaggccat

SEQ ID NO: 1342788 - DNA, 12 bp, Homo sapiens
caggtgcagagg

SEQ ID NO: 1342789 - DNA, 16 bp, Homo sapiens
caggtgcagaggtacc

SEQ ID NO: 1342790 - DNA, 23 bp, Homo sapiens
caggtgctggagcactgggctcc

SEQ ID NO: 1342791 - DNA, 12 bp, Homo sapiens
caggtgggctgg

SEQ ID NO: 1342792 - DNA, 22 bp, Homo sapiens
caggtgggctggacttctacct

SEQ ID NO: 1342793 - DNA, 20 bp, Homo sapiens
caggtggttatggagagggt

SEQ ID NO: 1342794 - DNA, 22 bp, Homo sapiens
caggttctccgttagctcctgt

SEQ ID NO: 1342795 - DNA, 23 bp, Homo sapiens
caggttctccgttagctcctgtg

SEQ ID NO: 1342796 - DNA, 24 bp, Homo sapiens
caggttctccgttagctcctgtgg

SEQ ID NO: 1342797 - DNA, 14 bp, Homo sapiens
caggttggtggggg

SEQ ID NO: 1342798 - DNA, 16 bp, Homo sapiens
caggtttaagctgtta

SEQ ID NO: 1342799 - DNA, 23 bp, Homo sapiens
cagtaaacgggaacatgccccct

SEQ ID NO: 1342800 - DNA, 21 bp, Homo sapiens
cagtaacccccttaaatttaa

SEQ ID NO: 1342801 - DNA, 20 bp, Homo sapiens
cagtaagatcactgtttaga

SEQ ID NO: 1342802 - DNA, 16 bp, Homo sapiens
cagtaccctggttgtg

SEQ ID NO: 1342803 - DNA, 17 bp, Homo sapiens
cagtaccctggttgtgt

SEQ ID NO: 1342804 - DNA, 15 bp, Homo sapiens
cagtacttttttaaa

SEQ ID NO: 1342805 - DNA, 14 bp, Homo sapiens
cagtagaactccag

SEQ ID NO: 1342806 - DNA, 12 bp, Homo sapiens
cagtagagccag

SEQ ID NO: 1342807 - DNA, 14 bp, Homo sapiens
cagtagagccagct

SEQ ID NO: 1342808 - DNA, 16 bp, Homo sapiens
cagtatcccacatcca

SEQ ID NO: 1342809 - DNA, 15 bp, Homo sapiens
cagtatgtgggatat

SEQ ID NO: 1342810 - DNA, 12 bp, Homo sapiens
gagcataattta

SEQ ID NO: 1342811 - DNA, 22 bp, Homo sapiens
gagcatagtccaaaaagctcct

SEQ ID NO: 1342812 - DNA, 20 bp, Homo sapiens
gagcatcggcctagggcccc

SEQ ID NO: 1342813 - DNA, 22 bp, Homo sapiens
gagcatggtacttggcctttgg

SEQ ID NO: 1342814 - DNA, 14 bp, Homo sapiens
gagccatacataaa

SEQ ID NO: 1342815 - DNA, 17 bp, Homo sapiens
gagccatgcgccccctc

SEQ ID NO: 1342816 - DNA, 18 bp, Homo sapiens
gagcccagccctccccat

SEQ ID NO: 1342817 - DNA, 19 bp, Homo sapiens
gagccctaaccccttccag

SEQ ID NO: 1342818 - DNA, 18 bp, Homo sapiens
gagccctactccctgcag

SEQ ID NO: 1342819 - DNA, 17 bp, Homo sapiens
gagcccttgcctcccca

SEQ ID NO: 1342820 - DNA, 20 bp, Homo sapiens
gagccgagatcgcgccactg

SEQ ID NO: 1342821 - DNA, 23 bp, Homo sapiens
gagccggccccaggctcgtggac

SEQ ID NO: 1342822 - DNA, 19 bp, Homo sapiens
gagccggtaactgtcctgt

SEQ ID NO: 1342823 - DNA, 21 bp, Homo sapiens
gagccggtaactgtcctgtcc

SEQ ID NO: 1342824 - DNA, 22 bp, Homo sapiens
gagccggtaactgtcctgtcct

SEQ ID NO: 1342825 - DNA, 17 bp, Homo sapiens
gagcctctgctccccag

SEQ ID NO: 1342826 - DNA, 16 bp, Homo sapiens
gagcctgcagggaagc

SEQ ID NO: 1342827 - DNA, 12 bp, Homo sapiens
gagcctgctggc

SEQ ID NO: 1342828 - DNA, 13 bp, Homo sapiens
gagcctgctggca

SEQ ID NO: 1342829 - DNA, 17 bp, Homo sapiens
gagcctggtgctgctgc

SEQ ID NO: 1342830 - DNA, 13 bp, Homo sapiens
gagccttctcaga

SEQ ID NO: 1342831 - DNA, 19 bp, Homo sapiens
gagcgcctccatccaaggc

SEQ ID NO: 1342832 - DNA, 17 bp, Homo sapiens
gagcgcgcccctagccg

SEQ ID NO: 1342833 - DNA, 17 bp, Homo sapiens
gagctagcagcagggag

SEQ ID NO: 1342834 - DNA, 17 bp, Homo sapiens
gagctaggaagagtcta

SEQ ID NO: 1342835 - DNA, 13 bp, Homo sapiens
gagctatgactta

SEQ ID NO: 1342836 - DNA, 12 bp, Homo sapiens
gagctccactct

SEQ ID NO: 1342837 - DNA, 22 bp, Homo sapiens
gagctccactctgcttctctga

SEQ ID NO: 1342838 - DNA, 19 bp, Homo sapiens
gagctcccacttctgccag

SEQ ID NO: 1342839 - DNA, 20 bp, Homo sapiens
gagctcccacttctgccaga

SEQ ID NO: 1342840 - DNA, 14 bp, Homo sapiens
gagctctctctaca

SEQ ID NO: 1342841 - DNA, 16 bp, Homo sapiens
gagctctgaaatcttc

SEQ ID NO: 1342842 - DNA, 21 bp, Homo sapiens
gagctgagatcgtgctactgc

SEQ ID NO: 1342843 - DNA, 13 bp, Homo sapiens
gagctgccttccc

SEQ ID NO: 1342844 - DNA, 15 bp, Homo sapiens
gagctgccttggctc

SEQ ID NO: 1342845 - DNA, 12 bp, Homo sapiens
gagctggctctg

SEQ ID NO: 1342846 - DNA, 12 bp, Homo sapiens
gaggaaaattct

SEQ ID NO: 1342847 - DNA, 13 bp, Homo sapiens
gaggaccagggcc

SEQ ID NO: 1342848 - DNA, 12 bp, Homo sapiens
gaggacccagga

SEQ ID NO: 1342849 - DNA, 15 bp, Homo sapiens
gaccacttgaggcct

SEQ ID NO: 1342850 - DNA, 13 bp, Homo sapiens
gaccagctgctcc

SEQ ID NO: 1342851 - DNA, 15 bp, Homo sapiens
gaccagctgctccga

SEQ ID NO: 1342852 - DNA, 22 bp, Homo sapiens
gaccaggatcccaagcctcctg

SEQ ID NO: 1342853 - DNA, 15 bp, Homo sapiens
gaccaggctgcctcc

SEQ ID NO: 1342854 - DNA, 14 bp, Homo sapiens
gaccagggcctttt

SEQ ID NO: 1342855 - DNA, 21 bp, Homo sapiens
gaccatgctcatctgctggtc

SEQ ID NO: 1342856 - DNA, 14 bp, Homo sapiens
gaccatgtggccac

SEQ ID NO: 1342857 - DNA, 18 bp, Homo sapiens
gacccaatgtaggagctg

SEQ ID NO: 1342858 - DNA, 19 bp, Homo sapiens
gacccaatgtaggagctgc

SEQ ID NO: 1342859 - DNA, 22 bp, Homo sapiens
gaccccggtggcggccccagca

SEQ ID NO: 1342860 - DNA, 15 bp, Homo sapiens
gacccgacctggccg

SEQ ID NO: 1342861 - DNA, 16 bp, Homo sapiens
gaccctattgctgctt

SEQ ID NO: 1342862 - DNA, 11 bp, Homo sapiens
gaccctccaaa

SEQ ID NO: 1342863 - DNA, 17 bp, Homo sapiens
gaccctcttgcccatcc

SEQ ID NO: 1342864 - DNA, 19 bp, Homo sapiens
gaccctcttgcccatcctg

SEQ ID NO: 1342865 - DNA, 18 bp, Homo sapiens
gaccctgggggcacagga

SEQ ID NO: 1342866 - DNA, 21 bp, Homo sapiens
gaccctgggtgggctctgtgc

SEQ ID NO: 1342867 - DNA, 15 bp, Homo sapiens
gacccttataaaatc

SEQ ID NO: 1342868 - DNA, 19 bp, Homo sapiens
gaccgtgaagatactttgt

SEQ ID NO: 1342869 - DNA, 16 bp, Homo sapiens
gacctaaatggcctca

SEQ ID NO: 1342870 - DNA, 19 bp, Homo sapiens
gacctcaggtgagaagcag

SEQ ID NO: 1342871 - DNA, 21 bp, Homo sapiens
gacctcaggtgagaagcagag

SEQ ID NO: 1342872 - DNA, 13 bp, Homo sapiens
gacctgaggctgt

SEQ ID NO: 1342873 - DNA, 15 bp, Homo sapiens
gacctgaggctgtgg

SEQ ID NO: 1342874 - DNA, 17 bp, Homo sapiens
gacctgccaggcagggg

SEQ ID NO: 1342875 - DNA, 19 bp, Homo sapiens
gacctgccaggcaggggtg

SEQ ID NO: 1342876 - DNA, 21 bp, Homo sapiens
gacctgccaggcaggggtggg

SEQ ID NO: 1342877 - DNA, 14 bp, Homo sapiens
gacctggaagaaca

SEQ ID NO: 1342878 - DNA, 22 bp, Homo sapiens
gacctggcactggatgcagaaa

SEQ ID NO: 1342879 - DNA, 19 bp, Homo sapiens
gacctggggctgctgtgaa

SEQ ID NO: 1342880 - DNA, 16 bp, Homo sapiens
gaccttaggccttcct

SEQ ID NO: 1342881 - DNA, 21 bp, Homo sapiens
gacgccactcatttcatctca

SEQ ID NO: 1342882 - DNA, 11 bp, Homo sapiens
gacgcccaccc

SEQ ID NO: 1342883 - DNA, 18 bp, Homo sapiens
cttcacagtagagccagc

SEQ ID NO: 1342884 - DNA, 16 bp, Homo sapiens
cttcaccatcaatcct

SEQ ID NO: 1342885 - DNA, 15 bp, Homo sapiens
cttcaccctggagcc

SEQ ID NO: 1342886 - DNA, 13 bp, Homo sapiens
cttcagctccagg

SEQ ID NO: 1342887 - DNA, 15 bp, Homo sapiens
cttcagctccaggga

SEQ ID NO: 1342888 - DNA, 14 bp, Homo sapiens
cttcagtaagccgt

SEQ ID NO: 1342889 - DNA, 15 bp, Homo sapiens
cttcagtaagccgtg

SEQ ID NO: 1342890 - DNA, 16 bp, Homo sapiens
cttcatcccattccag

SEQ ID NO: 1342891 - DNA, 17 bp, Homo sapiens
cttcatcccattccagg

SEQ ID NO: 1342892 - DNA, 17 bp, Homo sapiens
cttcatgtaaagtgtca

SEQ ID NO: 1342893 - DNA, 15 bp, Homo sapiens
cttcattattctctg

SEQ ID NO: 1342894 - DNA, 14 bp, Homo sapiens
cttccaaataaata

SEQ ID NO: 1342895 - DNA, 21 bp, Homo sapiens
cttccagatggtcatccagac

SEQ ID NO: 1342896 - DNA, 13 bp, Homo sapiens
cttccagcattta

SEQ ID NO: 1342897 - DNA, 17 bp, Homo sapiens
cttccaggaaactccac

SEQ ID NO: 1342898 - DNA, 19 bp, Homo sapiens
cttccaggaaactccacat

SEQ ID NO: 1342899 - DNA, 23 bp, Homo sapiens
cttccaggaaactccacatctgc

SEQ ID NO: 1342900 - DNA, 17 bp, Homo sapiens
cttccattccacacaga

SEQ ID NO: 1342901 - DNA, 16 bp, Homo sapiens
cttccattttaatttt

SEQ ID NO: 1342902 - DNA, 19 bp, Homo sapiens
cttcccaccctgcccctca

SEQ ID NO: 1342903 - DNA, 23 bp, Homo sapiens
cttcccccaccggtccagctggc

SEQ ID NO: 1342904 - DNA, 12 bp, Homo sapiens
cttcccctcact

SEQ ID NO: 1342905 - DNA, 23 bp, Homo sapiens
cttccctagctttagaccctggg

SEQ ID NO: 1342906 - DNA, 14 bp, Homo sapiens
cttccgcagtgtgg

SEQ ID NO: 1342907 - DNA, 16 bp, Homo sapiens
cttcctctctccagat

SEQ ID NO: 1342908 - DNA, 16 bp, Homo sapiens
cttcctcttgtctgat

SEQ ID NO: 1342909 - DNA, 18 bp, Homo sapiens
cttcctgaaactatattt

SEQ ID NO: 1342910 - DNA, 19 bp, Homo sapiens
cttcctgaaactatatttt

SEQ ID NO: 1342911 - DNA, 16 bp, Homo sapiens
cttcctgcgtcctcct

SEQ ID NO: 1342912 - DNA, 18 bp, Homo sapiens
cttcctgcgtcctcctca

SEQ ID NO: 1342913 - DNA, 20 bp, Homo sapiens
cttcctgcgtcctcctcacc

SEQ ID NO: 1342914 - DNA, 16 bp, Homo sapiens
cttcctgtgatccacc

SEQ ID NO: 1342915 - DNA, 21 bp, Homo sapiens
cttccttaattcactcccaca

SEQ ID NO: 1342916 - DNA, 18 bp, Homo sapiens
cttccttgagacacggag

SEQ ID NO: 1342917 - DNA, 20 bp, Homo sapiens
cttccttgagacacggagcc

SEQ ID NO: 1342918 - DNA, 23 bp, Homo sapiens
cttccttgagacacggagcccag

SEQ ID NO: 1342919 - DNA, 19 bp, Homo sapiens
cttcctttcccaagccttc

SEQ ID NO: 1342920 - DNA, 17 bp, Homo sapiens
cttccttttccctgctt

SEQ ID NO: 1342921 - DNA, 16 bp, Homo sapiens
cttcgcttcttgcctc

SEQ ID NO: 1342922 - DNA, 18 bp, Homo sapiens
cttcgcttcttgcctctg

SEQ ID NO: 1342923 - DNA, 20 bp, Homo sapiens
cttcgcttcttgcctctgtg

SEQ ID NO: 1342924 - DNA, 19 bp, Homo sapiens
cttcgggaggtcgaggcag

SEQ ID NO: 1342925 - DNA, 21 bp, Homo sapiens
cttcgggaggtcgaggcagga

SEQ ID NO: 1342926 - DNA, 14 bp, Homo sapiens
cttcgtctttccca

SEQ ID NO: 1342927 - DNA, 12 bp, Homo sapiens
cttctaaaaact

SEQ ID NO: 1342928 - DNA, 13 bp, Homo sapiens
cttctagagtttt

SEQ ID NO: 1342929 - DNA, 18 bp, Homo sapiens
cttctagtgatgatggtt

SEQ ID NO: 1342930 - DNA, 16 bp, Homo sapiens
cttctatagcatcact

SEQ ID NO: 1342931 - DNA, 14 bp, Homo sapiens
cttctcagaagcac

SEQ ID NO: 1342932 - DNA, 14 bp, Homo sapiens
cttctcattacttg

SEQ ID NO: 1342933 - DNA, 22 bp, Homo sapiens
cttctcattacttgttgcctat

SEQ ID NO: 1342934 - DNA, 12 bp, Homo sapiens
cttctccgccag

SEQ ID NO: 1342935 - DNA, 21 bp, Homo sapiens
cttctccgccagcctcctctg

SEQ ID NO: 1342936 - DNA, 14 bp, Homo sapiens
cttctctgacttct

SEQ ID NO: 1342937 - DNA, 16 bp, Homo sapiens
cttctctgacttctgc

SEQ ID NO: 1342938 - DNA, 17 bp, Homo sapiens
cttctctgacttctgcc

SEQ ID NO: 1342939 - DNA, 21 bp, Homo sapiens
cttctctgacttctgcctgga

SEQ ID NO: 1342940 - DNA, 14 bp, Homo sapiens
cttctctgtgagaa

SEQ ID NO: 1342941 - DNA, 16 bp, Homo sapiens
cttctgcttttctgcc

SEQ ID NO: 1342942 - DNA, 20 bp, Homo sapiens
cttctgcttttctgccctgg

SEQ ID NO: 1342943 - DNA, 12 bp, Homo sapiens
cttctggctcaa

SEQ ID NO: 1342944 - DNA, 20 bp, Homo sapiens
cttctgtatttttttttcta

SEQ ID NO: 1342945 - DNA, 11 bp, Homo sapiens
cttctgtgttt

SEQ ID NO: 1342946 - DNA, 14 bp, Homo sapiens
cttctgtgtttata

SEQ ID NO: 1342947 - DNA, 16 bp, Homo sapiens
cttcttacgcaatgct

SEQ ID NO: 1342948 - DNA, 17 bp, Homo sapiens
cttcttgcctctgtgct

SEQ ID NO: 1342949 - DNA, 18 bp, Homo sapiens
cttcttggggcccagtgc

SEQ ID NO: 1342950 - DNA, 19 bp, Homo sapiens
cttcttggggcccagtgca

SEQ ID NO: 1342951 - DNA, 18 bp, Homo sapiens
cttgaaaagagacaggca

SEQ ID NO: 1342952 - DNA, 23 bp, Homo sapiens
cttgaaactttgggaaaacatgt

SEQ ID NO: 1342953 - DNA, 12 bp, Homo sapiens
cttgaagaactg

SEQ ID NO: 1342954 - DNA, 18 bp, Homo sapiens
cttgaagaactgcaggcc

SEQ ID NO: 1342955 - DNA, 19 bp, Homo sapiens
cttgaagccaaagaaaaat

SEQ ID NO: 1342956 - DNA, 23 bp, Homo sapiens
cttgaataaacaccactggatta

SEQ ID NO: 1342957 - DNA, 13 bp, Homo sapiens
cttgaccaggctg

SEQ ID NO: 1342958 - DNA, 20 bp, Homo sapiens
cttgacctgaggctgtggtc

SEQ ID NO: 1342959 - DNA, 17 bp, Homo sapiens
cttgagacacggagccc

SEQ ID NO: 1342960 - DNA, 17 bp, Homo sapiens
cttgagccgggcccctg

SEQ ID NO: 1342961 - DNA, 12 bp, Homo sapiens
cttgagctggcc

SEQ ID NO: 1342962 - DNA, 15 bp, Homo sapiens
cttgaggcctgatct

SEQ ID NO: 1342963 - DNA, 21 bp, Homo sapiens
cttgaggcctgatctgcccat

SEQ ID NO: 1342964 - DNA, 20 bp, Homo sapiens
cttgagttgattcagctctg

SEQ ID NO: 1342965 - DNA, 19 bp, Homo sapiens
cttgagttgtttttgtata

SEQ ID NO: 1342966 - DNA, 20 bp, Homo sapiens
cttgagttgtttttgtatat

SEQ ID NO: 1342967 - DNA, 18 bp, Homo sapiens
cttgatacattcaaattt

SEQ ID NO: 1342968 - DNA, 19 bp, Homo sapiens
cttgatttcaaagttttgt

SEQ ID NO: 1342969 - DNA, 15 bp, Homo sapiens
cttgcaccaaattat

SEQ ID NO: 1342970 - DNA, 21 bp, Homo sapiens
cttgcctccaggtgcagaggt

SEQ ID NO: 1342971 - DNA, 12 bp, Homo sapiens
cttgcctcccca

SEQ ID NO: 1342972 - DNA, 13 bp, Homo sapiens
cttgcctcttcct

SEQ ID NO: 1342973 - DNA, 16 bp, Homo sapiens
cttgcctgcagggcca

SEQ ID NO: 1342974 - DNA, 17 bp, Homo sapiens
cttgcctgcagggccat

SEQ ID NO: 1342975 - DNA, 13 bp, Homo sapiens
cttgctggcccca

SEQ ID NO: 1342976 - DNA, 13 bp, Homo sapiens
cttgcttccctaa

SEQ ID NO: 1342977 - DNA, 17 bp, Homo sapiens
cttgctttaccttttca

SEQ ID NO: 1342978 - DNA, 17 bp, Homo sapiens
cttggacatcctcctcc

SEQ ID NO: 1342979 - DNA, 19 bp, Homo sapiens
cttggacatcctcctccca

SEQ ID NO: 1342980 - DNA, 20 bp, Homo sapiens
cttggacatcctcctcccac

SEQ ID NO: 1342981 - DNA, 22 bp, Homo sapiens
cttggacatcctcctcccaccc

SEQ ID NO: 1342982 - DNA, 23 bp, Homo sapiens
cttggagaatgtgagaagccagc

SEQ ID NO: 1342983 - DNA, 21 bp, Homo sapiens
gaactgcaggccctggcctcc

SEQ ID NO: 1342984 - DNA, 20 bp, Homo sapiens
gaactggtcaccatgaaact

SEQ ID NO: 1342985 - DNA, 18 bp, Homo sapiens
gaactgtagatgatgtat

SEQ ID NO: 1342986 - DNA, 20 bp, Homo sapiens
gaactgtagctgccatggct

SEQ ID NO: 1342987 - DNA, 17 bp, Homo sapiens
gaactgtctgtgaacag

SEQ ID NO: 1342988 - DNA, 16 bp, Homo sapiens
gaacttttgtactgaa

SEQ ID NO: 1342989 - DNA, 13 bp, Homo sapiens
gaagaacaggcct

SEQ ID NO: 1342990 - DNA, 22 bp, Homo sapiens
gaagaacgttttttcctcagtg

SEQ ID NO: 1342991 - DNA, 16 bp, Homo sapiens
gaagaactgaaaggct

SEQ ID NO: 1342992 - DNA, 15 bp, Homo sapiens
gaagaactgcaggcc

SEQ ID NO: 1342993 - DNA, 16 bp, Homo sapiens
gaagaagggagaagaa

SEQ ID NO: 1342994 - DNA, 17 bp, Homo sapiens
gaagaagggagaagaaa

SEQ ID NO: 1342995 - DNA, 16 bp, Homo sapiens
gaagaatgaaagctgt

SEQ ID NO: 1342996 - DNA, 20 bp, Homo sapiens
gaagacctcacctagaaatt

SEQ ID NO: 1342997 - DNA, 15 bp, Homo sapiens
gaagagatccaaaga

SEQ ID NO: 1342998 - DNA, 13 bp, Homo sapiens
gaagatactttgt

SEQ ID NO: 1342999 - DNA, 21 bp, Homo sapiens
gaagatccagctgcctattga

SEQ ID NO: 1343000 - DNA, 22 bp, Homo sapiens
gaagcagttgtaccaagtgaaa

SEQ ID NO: 1343001 - DNA, 13 bp, Homo sapiens
gaagccaaagaaa

SEQ ID NO: 1343002 - DNA, 14 bp, Homo sapiens
gaagccaagggaaa

SEQ ID NO: 1343003 - DNA, 19 bp, Homo sapiens
gaagccaagggaaaggggt

SEQ ID NO: 1343004 - DNA, 21 bp, Homo sapiens
gaagccaagggaaaggggtgc

SEQ ID NO: 1343005 - DNA, 22 bp, Homo sapiens
gaagccaagtggggtgctggga

SEQ ID NO: 1343006 - DNA, 23 bp, Homo sapiens
gaagccaagtggggtgctgggag

SEQ ID NO: 1343007 - DNA, 16 bp, Homo sapiens
gaagcccatcctgacc

SEQ ID NO: 1343008 - DNA, 18 bp, Homo sapiens
gaagccccacatgtccag

SEQ ID NO: 1343009 - DNA, 21 bp, Homo sapiens
gaagccggggaagagatccaa

SEQ ID NO: 1343010 - DNA, 19 bp, Homo sapiens
gaagcctccttagaaaaaa

SEQ ID NO: 1343011 - DNA, 17 bp, Homo sapiens
gaagccttcagctccag

SEQ ID NO: 1343012 - DNA, 18 bp, Homo sapiens
ctgtgatgagctgatctg

SEQ ID NO: 1343013 - DNA, 13 bp, Homo sapiens
ctgtgatgtttgt

SEQ ID NO: 1343014 - DNA, 22 bp, Homo sapiens
ctgtgattccactacacctggc

SEQ ID NO: 1343015 - DNA, 21 bp, Homo sapiens
ctgtgcaacgccgtgggctgc

SEQ ID NO: 1343016 - DNA, 15 bp, Homo sapiens
ctgtgcacacccacc

SEQ ID NO: 1343017 - DNA, 19 bp, Homo sapiens
ctgtgcccagaatactgat

SEQ ID NO: 1343018 - DNA, 16 bp, Homo sapiens
ctgtgccctcctgacc

SEQ ID NO: 1343019 - DNA, 17 bp, Homo sapiens
ctgtgccctcctgaccc

SEQ ID NO: 1343020 - DNA, 18 bp, Homo sapiens
ctgtgcctccctccccag

SEQ ID NO: 1343021 - DNA, 23 bp, Homo sapiens
ctgtgcctccctccccagtgcaa

SEQ ID NO: 1343022 - DNA, 16 bp, Homo sapiens
ctgtgctatgaatttt

SEQ ID NO: 1343023 - DNA, 13 bp, Homo sapiens
ctgtgctcagaag

SEQ ID NO: 1343024 - DNA, 17 bp, Homo sapiens
ctgtgctcagaagggct

SEQ ID NO: 1343025 - DNA, 11 bp, Homo sapiens
ctgtgctgtgt

SEQ ID NO: 1343026 - DNA, 18 bp, Homo sapiens
ctgtgctgtgtgtgacgt

SEQ ID NO: 1343027 - DNA, 22 bp, Homo sapiens
ctgtggactgaccttgtaaaag

SEQ ID NO: 1343028 - DNA, 15 bp, Homo sapiens
ctgtggatcagagat

SEQ ID NO: 1343029 - DNA, 17 bp, Homo sapiens
ctgtggatgataaaaca

SEQ ID NO: 1343030 - DNA, 19 bp, Homo sapiens
ctgtggcacttgcctgggt

SEQ ID NO: 1343031 - DNA, 20 bp, Homo sapiens
ctgtggcacttgcctgggtc

SEQ ID NO: 1343032 - DNA, 15 bp, Homo sapiens
ctgtggcataaattg

SEQ ID NO: 1343033 - DNA, 17 bp, Homo sapiens
ctgtggcataaattgca

SEQ ID NO: 1343034 - DNA, 21 bp, Homo sapiens
ctgtggcgccgtctccagggg

SEQ ID NO: 1343035 - DNA, 15 bp, Homo sapiens
ctgtggctccaggcc

SEQ ID NO: 1343036 - DNA, 23 bp, Homo sapiens
ctgtgggctacatgctggggtca

SEQ ID NO: 1343037 - DNA, 16 bp, Homo sapiens
ctgtggtcacagcgga

SEQ ID NO: 1343038 - DNA, 15 bp, Homo sapiens
ctgtggttcctctgc

SEQ ID NO: 1343039 - DNA, 11 bp, Homo sapiens
ctgtgtactgt

SEQ ID NO: 1343040 - DNA, 12 bp, Homo sapiens
ctgtgtatattt

SEQ ID NO: 1343041 - DNA, 22 bp, Homo sapiens
ctgtgtatatttgatttattaa

SEQ ID NO: 1343042 - DNA, 16 bp, Homo sapiens
ctgtgtatttgctttt

SEQ ID NO: 1343043 - DNA, 17 bp, Homo sapiens
ctgtgtcagcatagaag

SEQ ID NO: 1343044 - DNA, 19 bp, Homo sapiens
ctgtgtcagcatagaagta

SEQ ID NO: 1343045 - DNA, 13 bp, Homo sapiens
ctgtgtccatgcg

SEQ ID NO: 1343046 - DNA, 18 bp, Homo sapiens
ctgtgtccatgcgctcag

SEQ ID NO: 1343047 - DNA, 21 bp, Homo sapiens
ctgtgtccatgcgctcagggc

SEQ ID NO: 1343048 - DNA, 17 bp, Homo sapiens
ctgtgtgtcagttttca

SEQ ID NO: 1343049 - DNA, 18 bp, Homo sapiens
ctgtgtgtcagttttcat

SEQ ID NO: 1343050 - DNA, 16 bp, Homo sapiens
ctgtgtgtcccaggca

SEQ ID NO: 1343051 - DNA, 18 bp, Homo sapiens
ctgtgtgtcccaggcagg

SEQ ID NO: 1343052 - DNA, 16 bp, Homo sapiens
ctgtgttaatttaagt

SEQ ID NO: 1343053 - DNA, 14 bp, Homo sapiens
ctgtgttgccaagc

SEQ ID NO: 1343054 - DNA, 17 bp, Homo sapiens
ctgtgttgccaagctcc

SEQ ID NO: 1343055 - DNA, 13 bp, Homo sapiens
ctgtgttgccaca

SEQ ID NO: 1343056 - DNA, 21 bp, Homo sapiens
ctgtgttgtaccaaaattcat

SEQ ID NO: 1343057 - DNA, 18 bp, Homo sapiens
ctgtgttttataaaatag

SEQ ID NO: 1343058 - DNA, 14 bp, Homo sapiens
ctgttactgggccc

SEQ ID NO: 1343059 - DNA, 13 bp, Homo sapiens
ctgttactgtctt

SEQ ID NO: 1343060 - DNA, 18 bp, Homo sapiens
ctgttaggagaagctgca

SEQ ID NO: 1343061 - DNA, 19 bp, Homo sapiens
ctgttcagctggttgaggt

SEQ ID NO: 1343062 - DNA, 23 bp, Homo sapiens
ctgttcggaaggggttcctcaaa

SEQ ID NO: 1343063 - DNA, 13 bp, Homo sapiens
ctgttctggtaat

SEQ ID NO: 1343064 - DNA, 19 bp, Homo sapiens
ctgttctgtggttcctctg

SEQ ID NO: 1343065 - DNA, 14 bp, Homo sapiens
ctgttgataaaaac

SEQ ID NO: 1343066 - DNA, 15 bp, Homo sapiens
ctgttgataaaaact

SEQ ID NO: 1343067 - DNA, 18 bp, Homo sapiens
ctgttgccatggtgatgg

SEQ ID NO: 1343068 - DNA, 17 bp, Homo sapiens
ctgttgtaagaattctg

SEQ ID NO: 1343069 - DNA, 19 bp, Homo sapiens
ctgttgtaagaattctgat

SEQ ID NO: 1343070 - DNA, 21 bp, Homo sapiens
ctgttgtaagaattctgattg

SEQ ID NO: 1343071 - DNA, 19 bp, Homo sapiens
ctgtttattacttccatga

SEQ ID NO: 1343072 - DNA, 21 bp, Homo sapiens
ctgtttattacttccatgaat

SEQ ID NO: 1343073 - DNA, 16 bp, Homo sapiens
ctgtttctcttgagct

SEQ ID NO: 1343074 - DNA, 17 bp, Homo sapiens
ctgtttctcttgagctg

SEQ ID NO: 1343075 - DNA, 21 bp, Homo sapiens
ctgtttctcttgagctggcct

SEQ ID NO: 1343076 - DNA, 23 bp, Homo sapiens
ctgtttctggacccttataaaat

SEQ ID NO: 1343077 - DNA, 13 bp, Homo sapiens
ctgttttctcttg

SEQ ID NO: 1343078 - DNA, 17 bp, Homo sapiens
ctgttttctcttgagag

SEQ ID NO: 1343079 - DNA, 19 bp, Homo sapiens
cttaaacgaagagttccct

SEQ ID NO: 1343080 - DNA, 11 bp, Homo sapiens
cttaaatctta

SEQ ID NO: 1343081 - DNA, 12 bp, Homo sapiens
cttaaatcttaa

SEQ ID NO: 1343082 - DNA, 13 bp, Homo sapiens
cttaaatttctta

SEQ ID NO: 1343083 - DNA, 18 bp, Homo sapiens
cttaaatttcttatgtga

SEQ ID NO: 1343084 - DNA, 19 bp, Homo sapiens
cttaaatttcttatgtgac

SEQ ID NO: 1343085 - DNA, 17 bp, Homo sapiens
cttaacagttgtattta

SEQ ID NO: 1343086 - DNA, 19 bp, Homo sapiens
cttaacatagccaaaatgt

SEQ ID NO: 1343087 - DNA, 12 bp, Homo sapiens
cttaagcttccg

SEQ ID NO: 1343088 - DNA, 23 bp, Homo sapiens
cttaaggacaaagtgccaaagaa

SEQ ID NO: 1343089 - DNA, 18 bp, Homo sapiens
cttaagtgaggaaatcaa

SEQ ID NO: 1343090 - DNA, 19 bp, Homo sapiens
cttaataactgtgtactgt

SEQ ID NO: 1343091 - DNA, 13 bp, Homo sapiens
cttaataatcaag

SEQ ID NO: 1343092 - DNA, 14 bp, Homo sapiens
cttaataatcaaga

SEQ ID NO: 1343093 - DNA, 15 bp, Homo sapiens
cttaataatcaagag

SEQ ID NO: 1343094 - DNA, 21 bp, Homo sapiens
cttaatctgtttatttacaag

SEQ ID NO: 1343095 - DNA, 21 bp, Homo sapiens
cttaatgaatgagtctgttgt

SEQ ID NO: 1343096 - DNA, 18 bp, Homo sapiens
cttaatggagttcttgtg

SEQ ID NO: 1343097 - DNA, 17 bp, Homo sapiens
cttaatttcctttttga

SEQ ID NO: 1343098 - DNA, 20 bp, Homo sapiens
cttaatttcctttttgacac

SEQ ID NO: 1343099 - DNA, 22 bp, Homo sapiens
cttaatttcctttttgacactg

SEQ ID NO: 1343100 - DNA, 15 bp, Homo sapiens
cttacaatattgatt

SEQ ID NO: 1343101 - DNA, 14 bp, Homo sapiens
cttacctagtgaaa

SEQ ID NO: 1343102 - DNA, 22 bp, Homo sapiens
cttacctagtgaaacttttcta

SEQ ID NO: 1343103 - DNA, 12 bp, Homo sapiens
cttactaggaag

SEQ ID NO: 1343104 - DNA, 11 bp, Homo sapiens
cttactttgta

SEQ ID NO: 1343105 - DNA, 12 bp, Homo sapiens
cttactttgtaa

SEQ ID NO: 1343106 - DNA, 14 bp, Homo sapiens
cttactttgtaaat

SEQ ID NO: 1343107 - DNA, 19 bp, Homo sapiens
cttactttgtaaattctga

SEQ ID NO: 1343108 - DNA, 16 bp, Homo sapiens
cttagaatacagtttt

SEQ ID NO: 1343109 - DNA, 18 bp, Homo sapiens
cttagaatccctgtgtta

SEQ ID NO: 1343110 - DNA, 19 bp, Homo sapiens
cttagaatccctgtgttaa

SEQ ID NO: 1343111 - DNA, 16 bp, Homo sapiens
cttagatcatagtttt

SEQ ID NO: 1343112 - DNA, 17 bp, Homo sapiens
cttagatcatagtttta

SEQ ID NO: 1343113 - DNA, 19 bp, Homo sapiens
cttagatcatagttttatt

SEQ ID NO: 1343114 - DNA, 21 bp, Homo sapiens
cttagatcatagttttattta

SEQ ID NO: 1343115 - DNA, 14 bp, Homo sapiens
cttagattcttaat

SEQ ID NO: 1343116 - DNA, 12 bp, Homo sapiens
cttaggccttcc

SEQ ID NO: 1343117 - DNA, 18 bp, Homo sapiens
ctgtcttcagtaagccgt

SEQ ID NO: 1343118 - DNA, 15 bp, Homo sapiens
ctgtgaatgccactg

SEQ ID NO: 1343119 - DNA, 16 bp, Homo sapiens
ctgtgaatgccactgc

SEQ ID NO: 1343120 - DNA, 20 bp, Homo sapiens
ctgtgaatgccactgccttc

SEQ ID NO: 1343121 - DNA, 18 bp, Homo sapiens
ctgtgacatggtgcctga

SEQ ID NO: 1343122 - DNA, 20 bp, Homo sapiens
ctgtgacatggtgcctgaga

SEQ ID NO: 1343123 - DNA, 24 bp, Homo sapiens
ctgtgacatggtgcctgagaggca

SEQ ID NO: 1343124 - DNA, 19 bp, Homo sapiens
ctgtgagaaggtttattgt

SEQ ID NO: 1343125 - DNA, 22 bp, Homo sapiens
ctgtgagaaggtttattgttaa

SEQ ID NO: 1343126 - DNA, 22 bp, Homo sapiens
ctgtgagggaggggaaaagcat

SEQ ID NO: 1343127 - DNA, 18 bp, Homo sapiens
ctcccgagaccgggccct

SEQ ID NO: 1343128 - DNA, 12 bp, Homo sapiens
ctccctccaccc

SEQ ID NO: 1343129 - DNA, 16 bp, Homo sapiens
ctccctcctccaggcc

SEQ ID NO: 1343130 - DNA, 14 bp, Homo sapiens
ctccctctatttat

SEQ ID NO: 1343131 - DNA, 18 bp, Homo sapiens
ctccctgcctggccccca

SEQ ID NO: 1343132 - DNA, 14 bp, Homo sapiens
ctccctggctccct

SEQ ID NO: 1343133 - DNA, 15 bp, Homo sapiens
ctccctggctccctc

SEQ ID NO: 1343134 - DNA, 16 bp, Homo sapiens
ctccctggctccctcc

SEQ ID NO: 1343135 - DNA, 22 bp, Homo sapiens
ctccctgtagggtccaaccaga

SEQ ID NO: 1343136 - DNA, 17 bp, Homo sapiens
ctcccttgctggcccca

SEQ ID NO: 1343137 - DNA, 16 bp, Homo sapiens
ctccgagagggagaga

SEQ ID NO: 1343138 - DNA, 14 bp, Homo sapiens
ctccgccagcctcc

SEQ ID NO: 1343139 - DNA, 15 bp, Homo sapiens
ctccgccagcctcct

SEQ ID NO: 1343140 - DNA, 14 bp, Homo sapiens
ctccggcctctcca

SEQ ID NO: 1343141 - DNA, 15 bp, Homo sapiens
ctccggctcccagcc

SEQ ID NO: 1343142 - DNA, 22 bp, Homo sapiens
ctccgttagctcctgtggcccc

SEQ ID NO: 1343143 - DNA, 20 bp, Homo sapiens
ctccgttggccactccgaga

SEQ ID NO: 1343144 - DNA, 14 bp, Homo sapiens
ctcctatatatttc

SEQ ID NO: 1343145 - DNA, 17 bp, Homo sapiens
ctcctatatatttctat

SEQ ID NO: 1343146 - DNA, 15 bp, Homo sapiens
ctcctattctataaa

SEQ ID NO: 1343147 - DNA, 16 bp, Homo sapiens
ctcctattctataaaa

SEQ ID NO: 1343148 - DNA, 20 bp, Homo sapiens
ctcctattctataaaactct

SEQ ID NO: 1343149 - DNA, 12 bp, Homo sapiens
ctcctcacctca

SEQ ID NO: 1343150 - DNA, 19 bp, Homo sapiens
ctcctcacctcatgcccac

SEQ ID NO: 1343151 - DNA, 15 bp, Homo sapiens
ctcctccagccgcca

SEQ ID NO: 1343152 - DNA, 13 bp, Homo sapiens
ctcctccaggcct

SEQ ID NO: 1343153 - DNA, 23 bp, Homo sapiens
ctcctccaggcctgcctcccact

SEQ ID NO: 1343154 - DNA, 17 bp, Homo sapiens
ctcctccagtgtgggct

SEQ ID NO: 1343155 - DNA, 15 bp, Homo sapiens
ctcctccccttcctc

SEQ ID NO: 1343156 - DNA, 21 bp, Homo sapiens
ctcctcccttccttttccctg

SEQ ID NO: 1343157 - DNA, 22 bp, Homo sapiens
ctcctcccttccttttccctgc

SEQ ID NO: 1343158 - DNA, 18 bp, Homo sapiens
ctcctctcccatccttga

SEQ ID NO: 1343159 - DNA, 18 bp, Homo sapiens
ctcctgaaccgcacagct

SEQ ID NO: 1343160 - DNA, 19 bp, Homo sapiens
ctcctgacccattgctgtt

SEQ ID NO: 1343161 - DNA, 20 bp, Homo sapiens
ctcctgagctaggaagagtc

SEQ ID NO: 1343162 - DNA, 15 bp, Homo sapiens
ctcctgcacttactt

SEQ ID NO: 1343163 - DNA, 19 bp, Homo sapiens
ctcctgcacttacttgctt

SEQ ID NO: 1343164 - DNA, 22 bp, Homo sapiens
ctcctgcacttacttgcttatt

SEQ ID NO: 1343165 - DNA, 17 bp, Homo sapiens
ctcctgcccacggagtc

SEQ ID NO: 1343166 - DNA, 18 bp, Homo sapiens
ctcctggcctatccgctg

SEQ ID NO: 1343167 - DNA, 20 bp, Homo sapiens
ctcctgtggccccaccctgg

SEQ ID NO: 1343168 - DNA, 22 bp, Homo sapiens
ctcctgtggccccaccctgggc

SEQ ID NO: 1343169 - DNA, 14 bp, Homo sapiens
ctcgaatctctgtg

SEQ ID NO: 1343170 - DNA, 18 bp, Homo sapiens
ctcgaatctctgtgcctt

SEQ ID NO: 1343171 - DNA, 18 bp, Homo sapiens
ctcgcagcctctcagtgc

SEQ ID NO: 1343172 - DNA, 18 bp, Homo sapiens
ctcgcataggacctttcc

SEQ ID NO: 1343173 - DNA, 22 bp, Homo sapiens
ctcgcataggacctttccacca

SEQ ID NO: 1343174 - DNA, 20 bp, Homo sapiens
ctcgccggaccctctaacct

SEQ ID NO: 1343175 - DNA, 12 bp, Homo sapiens
ctcgctgagggc

SEQ ID NO: 1343176 - DNA, 13 bp, Homo sapiens
ctcggctctgcag

SEQ ID NO: 1343177 - DNA, 21 bp, Homo sapiens
ctcggttcaaggtcactgttt

SEQ ID NO: 1343178 - DNA, 15 bp, Homo sapiens
ctcggtttgccaaaa

SEQ ID NO: 1343179 - DNA, 17 bp, Homo sapiens
ctcgtgcatccctgaga

SEQ ID NO: 1343180 - DNA, 14 bp, Homo sapiens
ctctaaagagcatc

SEQ ID NO: 1343181 - DNA, 17 bp, Homo sapiens
ctctaacctcgccctct

SEQ ID NO: 1343182 - DNA, 20 bp, Homo sapiens
ctctaagtcatgtatgtttc

SEQ ID NO: 1343183 - DNA, 17 bp, Homo sapiens
ctctacttaatccaatg

SEQ ID NO: 1343184 - DNA, 15 bp, Homo sapiens
ctctagaagccaagg

SEQ ID NO: 1343185 - DNA, 18 bp, Homo sapiens
ctctagaagccaagggaa

SEQ ID NO: 1343186 - DNA, 15 bp, Homo sapiens
ctctagttctttgtt

SEQ ID NO: 1343187 - DNA, 18 bp, Homo sapiens
ctctagttctttgttcat

SEQ ID NO: 1343188 - DNA, 17 bp, Homo sapiens
ctctatttatgtttgca

SEQ ID NO: 1343189 - DNA, 20 bp, Homo sapiens
ctctcacactggttctcaat

SEQ ID NO: 1343190 - DNA, 20 bp, Homo sapiens
ctctcagtgccctccagccc

SEQ ID NO: 1343191 - DNA, 16 bp, Homo sapiens
ctctccagcctcagcc

SEQ ID NO: 1343192 - DNA, 15 bp, Homo sapiens
ctctccccaggtcca

SEQ ID NO: 1343193 - DNA, 20 bp, Homo sapiens
ctctccccaggtccagctct

SEQ ID NO: 1343194 - DNA, 17 bp, Homo sapiens
ctctcctactcggctct

SEQ ID NO: 1343195 - DNA, 19 bp, Homo sapiens
ctctcctactcggctctgc

SEQ ID NO: 1343196 - DNA, 21 bp, Homo sapiens
ctctcctggcctatccgctgc

SEQ ID NO: 1343197 - DNA, 23 bp, Homo sapiens
ctctcctggcctatccgctgcca

SEQ ID NO: 1343198 - DNA, 22 bp, Homo sapiens
ctctctaagtgggcattgccat

SEQ ID NO: 1343199 - DNA, 18 bp, Homo sapiens
ctctctacagagaggaaa

SEQ ID NO: 1343200 - DNA, 13 bp, Homo sapiens
ctctctagcacaa

SEQ ID NO: 1343201 - DNA, 12 bp, Homo sapiens
ctctctccagat

SEQ ID NO: 1343202 - DNA, 17 bp, Homo sapiens
ctctctccagatgtttc

SEQ ID NO: 1343203 - DNA, 15 bp, Homo sapiens
ctctgaaatcttccc

SEQ ID NO: 1343204 - DNA, 21 bp, Homo sapiens
ctctgaatttacttccttgca

SEQ ID NO: 1343205 - DNA, 20 bp, Homo sapiens
ctctgaccacttgaggcctg

SEQ ID NO: 1343206 - DNA, 16 bp, Homo sapiens
ctctgacttctgcctg

SEQ ID NO: 1343207 - DNA, 19 bp, Homo sapiens
ctctgacttctgcctggag

SEQ ID NO: 1343208 - DNA, 13 bp, Homo sapiens
ctctgcacaagct

SEQ ID NO: 1343209 - DNA, 14 bp, Homo sapiens
ctctgcacaagctg

SEQ ID NO: 1343210 - DNA, 18 bp, Homo sapiens
ctctgcacaagctgcacc

SEQ ID NO: 1343211 - DNA, 18 bp, Homo sapiens
ctctgccgtctctggagc

SEQ ID NO: 1343212 - DNA, 20 bp, Homo sapiens
ctctgcctgccccgccccca

SEQ ID NO: 1343213 - DNA, 12 bp, Homo sapiens
ctctgcttctct

SEQ ID NO: 1343214 - DNA, 14 bp, Homo sapiens
ctctgcttctctga

SEQ ID NO: 1343215 - DNA, 17 bp, Homo sapiens
ctctgcttctctgactt

SEQ ID NO: 1343216 - DNA, 21 bp, Homo sapiens
ctctgcttctctgacttctgc

SEQ ID NO: 1343217 - DNA, 15 bp, Homo sapiens
ctctggacggcaggc

SEQ ID NO: 1343218 - DNA, 13 bp, Homo sapiens
ctctggagcccta

SEQ ID NO: 1343219 - DNA, 10 bp, Homo sapiens
ctctggcttt

SEQ ID NO: 1343220 - DNA, 21 bp, Homo sapiens
ctctgggtccttcctgaaact

SEQ ID NO: 1343221 - DNA, 11 bp, Homo sapiens
ctctgtacttt

SEQ ID NO: 1343222 - DNA, 11 bp, Homo sapiens
ctctgtgagaa

SEQ ID NO: 1343223 - DNA, 20 bp, Homo sapiens
ctctgtgcagtcactggagg

SEQ ID NO: 1343224 - DNA, 15 bp, Homo sapiens
ctctgtgcctccctc

SEQ ID NO: 1343225 - DNA, 18 bp, Homo sapiens
ctctgtgtatttgctttt

SEQ ID NO: 1343226 - DNA, 22 bp, Homo sapiens
ctcttaagcttccgccgtctca

SEQ ID NO: 1343227 - DNA, 13 bp, Homo sapiens
ctcttagaaaaac

SEQ ID NO: 1343228 - DNA, 23 bp, Homo sapiens
ctcttccttgaagaactgcaggc

SEQ ID NO: 1343229 - DNA, 23 bp, Homo sapiens
ctcttctggggcaggctgggcca

SEQ ID NO: 1343230 - DNA, 20 bp, Homo sapiens
ctcttcttggggcccagtgc

SEQ ID NO: 1343231 - DNA, 21 bp, Homo sapiens
ctcttcttggggcccagtgca

SEQ ID NO: 1343232 - DNA, 22 bp, Homo sapiens
ctcttcttggggcccagtgcat

SEQ ID NO: 1343233 - DNA, 13 bp, Homo sapiens
ctcttgagcctgg

SEQ ID NO: 1343234 - DNA, 14 bp, Homo sapiens
ctcttgagcctggg

SEQ ID NO: 1343235 - DNA, 15 bp, Homo sapiens
ctcttgagcctggga

SEQ ID NO: 1343236 - DNA, 13 bp, Homo sapiens
ctcttgagctggc

SEQ ID NO: 1343237 - DNA, 14 bp, Homo sapiens
ctcttgagctggcc

SEQ ID NO: 1343238 - DNA, 18 bp, Homo sapiens
ctcttgagttgtttttgt

SEQ ID NO: 1343239 - DNA, 20 bp, Homo sapiens
ctcttgagttgtttttgtat

SEQ ID NO: 1343240 - DNA, 15 bp, Homo sapiens
ctcttgtaaagactg

SEQ ID NO: 1343241 - DNA, 22 bp, Homo sapiens
ctctttcaagcagtcgtgcctg

SEQ ID NO: 1343242 - DNA, 14 bp, Homo sapiens
ctctttgattattt

SEQ ID NO: 1343243 - DNA, 20 bp, Homo sapiens
ctcaagcgggtggctctggg

SEQ ID NO: 1343244 - DNA, 20 bp, Homo sapiens
ctcaatgctttatttgtaaa

SEQ ID NO: 1343245 - DNA, 23 bp, Homo sapiens
ctcacacggacactcaaaagctg

SEQ ID NO: 1343246 - DNA, 17 bp, Homo sapiens
ctcacagagtcaaggcc

SEQ ID NO: 1343247 - DNA, 16 bp, Homo sapiens
ctcacagctatgcaaa

SEQ ID NO: 1343248 - DNA, 15 bp, Homo sapiens
ctcacagtgctttta

SEQ ID NO: 1343249 - DNA, 13 bp, Homo sapiens
ctcaccagcccca

SEQ ID NO: 1343250 - DNA, 17 bp, Homo sapiens
ctcaccagccccactgc

SEQ ID NO: 1343251 - DNA, 21 bp, Homo sapiens
ctcacccatgcaagcagagga

SEQ ID NO: 1343252 - DNA, 18 bp, Homo sapiens
ctcaccccctcccacccc

SEQ ID NO: 1343253 - DNA, 13 bp, Homo sapiens
ctcaccgcccatc

SEQ ID NO: 1343254 - DNA, 16 bp, Homo sapiens
ctcaccgcccatcagg

SEQ ID NO: 1343255 - DNA, 17 bp, Homo sapiens
ctcaccgcccatcaggg

SEQ ID NO: 1343256 - DNA, 15 bp, Homo sapiens
ctcacctagcctgat

SEQ ID NO: 1343257 - DNA, 15 bp, Homo sapiens
ctcacctcatgccca

SEQ ID NO: 1343258 - DNA, 14 bp, Homo sapiens
ctcactaaagcatg

SEQ ID NO: 1343259 - DNA, 20 bp, Homo sapiens
ctcactaaagcatgaaatgt

SEQ ID NO: 1343260 - DNA, 13 bp, Homo sapiens
ctcactaattttt

SEQ ID NO: 1343261 - DNA, 15 bp, Homo sapiens
ctcactaatttttgt

SEQ ID NO: 1343262 - DNA, 23 bp, Homo sapiens
ctcactaatttttgtattatttt

SEQ ID NO: 1343263 - DNA, 18 bp, Homo sapiens
ctcactaggcccccactt

SEQ ID NO: 1343264 - DNA, 22 bp, Homo sapiens
ctcactaggcccccacttgcct

SEQ ID NO: 1343265 - DNA, 15 bp, Homo sapiens
ctcactgccaggcca

SEQ ID NO: 1343266 - DNA, 19 bp, Homo sapiens
ctcactgccaggccagcct

SEQ ID NO: 1343267 - DNA, 12 bp, Homo sapiens
ctcactgtgatc

SEQ ID NO: 1343268 - DNA, 19 bp, Homo sapiens
ctcactgtttgtttttatt

SEQ ID NO: 1343269 - DNA, 21 bp, Homo sapiens
ctcagagaaaaatgctcccca

SEQ ID NO: 1343270 - DNA, 23 bp, Homo sapiens
ctcagagaaaaatgctccccaca

SEQ ID NO: 1343271 - DNA, 17 bp, Homo sapiens
ctcagatttctgaggaa

SEQ ID NO: 1343272 - DNA, 20 bp, Homo sapiens
ctcagcatcaaaatatttca

SEQ ID NO: 1343273 - DNA, 18 bp, Homo sapiens
ctcagccccctgcttcag

SEQ ID NO: 1343274 - DNA, 16 bp, Homo sapiens
ctcagccttcagacag

SEQ ID NO: 1343275 - DNA, 14 bp, Homo sapiens
ctcagctcaatgca

SEQ ID NO: 1343276 - DNA, 15 bp, Homo sapiens
ctcagctcggctcag

SEQ ID NO: 1343277 - DNA, 18 bp, Homo sapiens
ctcagctcggggagcctt

SEQ ID NO: 1343278 - DNA, 19 bp, Homo sapiens
ctcagctcggggagcctta

SEQ ID NO: 1343279 - DNA, 15 bp, Homo sapiens
ctcaggcaggtggga

SEQ ID NO: 1343280 - DNA, 19 bp, Homo sapiens
ctcaggccggcagccccag

SEQ ID NO: 1343281 - DNA, 19 bp, Homo sapiens
ctcaggtgagaagcagagg

SEQ ID NO: 1343282 - DNA, 17 bp, Homo sapiens
ctcagtgcatttgtgct

SEQ ID NO: 1343283 - DNA, 16 bp, Homo sapiens
ctcagtgccctccagc

SEQ ID NO: 1343284 - DNA, 22 bp, Homo sapiens
ctcagtgttggtatattttata

SEQ ID NO: 1343285 - DNA, 23 bp, Homo sapiens
ctcagttattacatgtaatttga

SEQ ID NO: 1343286 - DNA, 21 bp, Homo sapiens
ctcatcaatcaaataagtatt

SEQ ID NO: 1343287 - DNA, 14 bp, Homo sapiens
ctcatctatctcaa

SEQ ID NO: 1343288 - DNA, 13 bp, Homo sapiens
ctcatctgctggt

SEQ ID NO: 1343289 - DNA, 15 bp, Homo sapiens
ctcatctgctggtcc

SEQ ID NO: 1343290 - DNA, 17 bp, Homo sapiens
ctcatgcccaccccctg

SEQ ID NO: 1343291 - DNA, 19 bp, Homo sapiens
ctcatgcccaccccctgcc

SEQ ID NO: 1343292 - DNA, 20 bp, Homo sapiens
ctcatgcccaccccctgccc

SEQ ID NO: 1343293 - DNA, 22 bp, Homo sapiens
ctcatgcccaccccctgccctg

SEQ ID NO: 1343294 - DNA, 12 bp, Homo sapiens
ctcatgtggctg

SEQ ID NO: 1343295 - DNA, 15 bp, Homo sapiens
ctcatgtggctggaa

SEQ ID NO: 1343296 - DNA, 14 bp, Homo sapiens
ctcattgactttta

SEQ ID NO: 1343297 - DNA, 22 bp, Homo sapiens
ctcattgacttttataaagcat

SEQ ID NO: 1343298 - DNA, 15 bp, Homo sapiens
ctcattgctgagcct

SEQ ID NO: 1343299 - DNA, 17 bp, Homo sapiens
ctcatttaagggaaaaa

SEQ ID NO: 1343300 - DNA, 13 bp, Homo sapiens
ctcatttcatctc

SEQ ID NO: 1343301 - DNA, 22 bp, Homo sapiens
ctccaaatggagaagctgcagg

SEQ ID NO: 1343302 - DNA, 12 bp, Homo sapiens
ctccaaccctgc

SEQ ID NO: 1343303 - DNA, 13 bp, Homo sapiens
ctccaaccctgcc

SEQ ID NO: 1343304 - DNA, 22 bp, Homo sapiens
ctccaaccctgccgtcaccacc

SEQ ID NO: 1343305 - DNA, 17 bp, Homo sapiens
ctccacaacctcttccc

SEQ ID NO: 1343306 - DNA, 22 bp, Homo sapiens
ctccacaacctcttccccccaa

SEQ ID NO: 1343307 - DNA, 14 bp, Homo sapiens
ctccacagcgaggg

SEQ ID NO: 1343308 - DNA, 19 bp, Homo sapiens
ctccacagcgagggcagct

SEQ ID NO: 1343309 - DNA, 21 bp, Homo sapiens
ctccacagcgagggcagctgc

SEQ ID NO: 1343310 - DNA, 22 bp, Homo sapiens
ctccacagcgagggcagctgct

SEQ ID NO: 1343311 - DNA, 22 bp, Homo sapiens
ctccaccagcatcacctgcctg

SEQ ID NO: 1343312 - DNA, 13 bp, Homo sapiens
ctccaccccagga

SEQ ID NO: 1343313 - DNA, 12 bp, Homo sapiens
ctccactctgct

SEQ ID NO: 1343314 - DNA, 14 bp, Homo sapiens
ctccactctgcttc

SEQ ID NO: 1343315 - DNA, 16 bp, Homo sapiens
ctccactctgcttctc

SEQ ID NO: 1343316 - DNA, 21 bp, Homo sapiens
ctccactctgcttctctgact

SEQ ID NO: 1343317 - DNA, 17 bp, Homo sapiens
ctccagcaacacagcct

SEQ ID NO: 1343318 - DNA, 18 bp, Homo sapiens
ctccagcaacacagcctg

SEQ ID NO: 1343319 - DNA, 20 bp, Homo sapiens
ctccagcaacacagcctggg

SEQ ID NO: 1343320 - DNA, 21 bp, Homo sapiens
ctccagcaacttcttctccat

SEQ ID NO: 1343321 - DNA, 12 bp, Homo sapiens
ctccagccagcg

SEQ ID NO: 1343322 - DNA, 20 bp, Homo sapiens
ctccagccagcgcctccctc

SEQ ID NO: 1343323 - DNA, 21 bp, Homo sapiens
ctccagccagcgcctccctcc

SEQ ID NO: 1343324 - DNA, 22 bp, Homo sapiens
ctccagccagcgcctccctcca

SEQ ID NO: 1343325 - DNA, 18 bp, Homo sapiens
ctccagcctcagccccct

SEQ ID NO: 1343326 - DNA, 13 bp, Homo sapiens
ctccagcctgggg

SEQ ID NO: 1343327 - DNA, 19 bp, Homo sapiens
ctccagcgtcagctgctcc

SEQ ID NO: 1343328 - DNA, 23 bp, Homo sapiens
ctccagcgtcagctgctccctgg

SEQ ID NO: 1343329 - DNA, 20 bp, Homo sapiens
ctccaggcctgcctcccact

SEQ ID NO: 1343330 - DNA, 22 bp, Homo sapiens
ctccaggcctgcctcccacttc

SEQ ID NO: 1343331 - DNA, 15 bp, Homo sapiens
ctccaggctttccca

SEQ ID NO: 1343332 - DNA, 14 bp, Homo sapiens
ctccagggacacac

SEQ ID NO: 1343333 - DNA, 15 bp, Homo sapiens
ctccaggggctgctt

SEQ ID NO: 1343334 - DNA, 21 bp, Homo sapiens
ctccaggggctgcttcctcct

SEQ ID NO: 1343335 - DNA, 22 bp, Homo sapiens
ctccaggggctgcttcctcctg

SEQ ID NO: 1343336 - DNA, 22 bp, Homo sapiens
ctccataaacatgaaaacactt

SEQ ID NO: 1343337 - DNA, 18 bp, Homo sapiens
ctccatagtttggcattt

SEQ ID NO: 1343338 - DNA, 20 bp, Homo sapiens
ctccatagtttggcatttgc

SEQ ID NO: 1343339 - DNA, 12 bp, Homo sapiens
ctccatccaagg

SEQ ID NO: 1343340 - DNA, 15 bp, Homo sapiens
ctccatccctctaat

SEQ ID NO: 1343341 - DNA, 18 bp, Homo sapiens
ctccatttgctcttcaga

SEQ ID NO: 1343342 - DNA, 14 bp, Homo sapiens
ctcccacccccagc

SEQ ID NO: 1343343 - DNA, 15 bp, Homo sapiens
ctcccacccccagcc

SEQ ID NO: 1343344 - DNA, 19 bp, Homo sapiens
ctcccacccggctgcagag

SEQ ID NO: 1343345 - DNA, 12 bp, Homo sapiens
ctcccactttgc

SEQ ID NO: 1343346 - DNA, 21 bp, Homo sapiens
ctcccaggagcctgcccagcc

SEQ ID NO: 1343347 - DNA, 18 bp, Homo sapiens
ctcccaggggtctccctg

SEQ ID NO: 1343348 - DNA, 19 bp, Homo sapiens
ctcccaggggtctccctgg

SEQ ID NO: 1343349 - DNA, 16 bp, Homo sapiens
ctcccaggtaccagct

SEQ ID NO: 1343350 - DNA, 19 bp, Homo sapiens
ctcccaggtaccagctgcg

SEQ ID NO: 1343351 - DNA, 20 bp, Homo sapiens
ctccccacagcgtccctggc

SEQ ID NO: 1343352 - DNA, 21 bp, Homo sapiens
ctccccagcattccagcccct

SEQ ID NO: 1343353 - DNA, 18 bp, Homo sapiens
cgcttcttgcctctgtgc

SEQ ID NO: 1343354 - DNA, 16 bp, Homo sapiens
cgcttttccttggcat

SEQ ID NO: 1343355 - DNA, 19 bp, Homo sapiens
cggaacccaagcttagaac

SEQ ID NO: 1343356 - DNA, 17 bp, Homo sapiens
cggaaggggttcctcaa

SEQ ID NO: 1343357 - DNA, 15 bp, Homo sapiens
cggaccccagccatc

SEQ ID NO: 1343358 - DNA, 20 bp, Homo sapiens
cggacccggaggccgaggcc

SEQ ID NO: 1343359 - DNA, 16 bp, Homo sapiens
cggaccctctaacctc

SEQ ID NO: 1343360 - DNA, 15 bp, Homo sapiens
cggacttttctgcaa

SEQ ID NO: 1343361 - DNA, 18 bp, Homo sapiens
cggagaacatgaatcaaa

SEQ ID NO: 1343362 - DNA, 17 bp, Homo sapiens
cggagaagagcgcagtg

SEQ ID NO: 1343363 - DNA, 22 bp, Homo sapiens
cggaggcatcctacccttttct

SEQ ID NO: 1343364 - DNA, 15 bp, Homo sapiens
cggaggccgaggcca

SEQ ID NO: 1343365 - DNA, 20 bp, Homo sapiens
cggaggcctgcgaccctggg

SEQ ID NO: 1343366 - DNA, 22 bp, Homo sapiens
cggaggcctgcgaccctggggg

SEQ ID NO: 1343367 - DNA, 15 bp, Homo sapiens
cggatagttgctatt

SEQ ID NO: 1343368 - DNA, 17 bp, Homo sapiens
cggatcaggctcccagg

SEQ ID NO: 1343369 - DNA, 14 bp, Homo sapiens
cggcaggctcactg

SEQ ID NO: 1343370 - DNA, 18 bp, Homo sapiens
cggcaggctcactgccag

SEQ ID NO: 1343371 - DNA, 20 bp, Homo sapiens
cggcaggctcactgccaggc

SEQ ID NO: 1343372 - DNA, 15 bp, Homo sapiens
cggcaggggcctgga

SEQ ID NO: 1343373 - DNA, 23 bp, Homo sapiens
cggcatgagactcagtgcagatg

SEQ ID NO: 1343374 - DNA, 14 bp, Homo sapiens
cggccaagaatgta

SEQ ID NO: 1343375 - DNA, 15 bp, Homo sapiens
cggccctgtgtgcag

SEQ ID NO: 1343376 - DNA, 20 bp, Homo sapiens
cggccgcccctcctcgtgaa

SEQ ID NO: 1343377 - DNA, 17 bp, Homo sapiens
cggcctctgcctttgca

SEQ ID NO: 1343378 - DNA, 15 bp, Homo sapiens
cggcctttggcttca

SEQ ID NO: 1343379 - DNA, 22 bp, Homo sapiens
cggcgtggcccaaggctggcag

SEQ ID NO: 1343380 - DNA, 22 bp, Homo sapiens
cggctgaccatgctcatctgct

SEQ ID NO: 1343381 - DNA, 15 bp, Homo sapiens
cggcttcctttccca

SEQ ID NO: 1343382 - DNA, 19 bp, Homo sapiens
cggcttcctttcccaagcc

SEQ ID NO: 1343383 - DNA, 17 bp, Homo sapiens
cgggaacatgccccctg

SEQ ID NO: 1343384 - DNA, 17 bp, Homo sapiens
cgggaacctccccagcc

SEQ ID NO: 1343385 - DNA, 22 bp, Homo sapiens
cgggacccagggccctcggtgg

SEQ ID NO: 1343386 - DNA, 22 bp, Homo sapiens
cgggaggcggagcttgcagtga

SEQ ID NO: 1343387 - DNA, 16 bp, Homo sapiens
cgggaggtcgaggcag

SEQ ID NO: 1343388 - DNA, 15 bp, Homo sapiens
cgggccctgggttcc

SEQ ID NO: 1343389 - DNA, 11 bp, Homo sapiens
cgggctcagca

SEQ ID NO: 1343390 - DNA, 19 bp, Homo sapiens
cgggctcagcaaaagatgc

SEQ ID NO: 1343391 - DNA, 12 bp, Homo sapiens
cggggaagagat

SEQ ID NO: 1343392 - DNA, 14 bp, Homo sapiens
cggggcccagggca

SEQ ID NO: 1343393 - DNA, 20 bp, Homo sapiens
cggggcccagggcaagctcc

SEQ ID NO: 1343394 - DNA, 21 bp, Homo sapiens
cggggcccagggcaagctccg

SEQ ID NO: 1343395 - DNA, 21 bp, Homo sapiens
cggggtatcctgggggaccca

SEQ ID NO: 1343396 - DNA, 14 bp, Homo sapiens
cgggtggtccccgt

SEQ ID NO: 1343397 - DNA, 14 bp, Homo sapiens
cggtaactgtcctg

SEQ ID NO: 1343398 - DNA, 13 bp, Homo sapiens
cggtccagctggc

SEQ ID NO: 1343399 - DNA, 15 bp, Homo sapiens
cggtccagctggcct

SEQ ID NO: 1343400 - DNA, 16 bp, Homo sapiens
cggtccagctggcctg

SEQ ID NO: 1343401 - DNA, 15 bp, Homo sapiens
cggtctcctgactgg

SEQ ID NO: 1343402 - DNA, 22 bp, Homo sapiens
cggtctcggatcaggctcccag

SEQ ID NO: 1343403 - DNA, 18 bp, Homo sapiens
cggtgctgtgagggaggg

SEQ ID NO: 1343404 - DNA, 20 bp, Homo sapiens
cggtggctcacgcctgtaat

SEQ ID NO: 1343405 - DNA, 18 bp, Homo sapiens
cggtgtggagaagcggct

SEQ ID NO: 1343406 - DNA, 20 bp, Homo sapiens
cggttcaaggtcactgtttc

SEQ ID NO: 1343407 - DNA, 17 bp, Homo sapiens
cgtacaggctggcgcag

SEQ ID NO: 1343408 - DNA, 16 bp, Homo sapiens
cgtacataatactgaa

SEQ ID NO: 1343409 - DNA, 13 bp, Homo sapiens
cgtacatgtttat

SEQ ID NO: 1343410 - DNA, 21 bp, Homo sapiens
cgtaggatgaaaagattcttc

SEQ ID NO: 1343411 - DNA, 21 bp, Homo sapiens
cgtatctccggctcccagcct

SEQ ID NO: 1343412 - DNA, 21 bp, Homo sapiens
cgtcaccaccacccctaccac

SEQ ID NO: 1343413 - DNA, 16 bp, Homo sapiens
cgtccagctgcccttc

SEQ ID NO: 1343414 - DNA, 17 bp, Homo sapiens
cgtccagctgcccttcc

SEQ ID NO: 1343415 - DNA, 13 bp, Homo sapiens
cgtccatctccct

SEQ ID NO: 1343416 - DNA, 17 bp, Homo sapiens
cgtccccccccaacctt

SEQ ID NO: 1343417 - DNA, 14 bp, Homo sapiens
cgtcctgcctgtgg

SEQ ID NO: 1343418 - DNA, 15 bp, Homo sapiens
cgtcctgcctgtggc

SEQ ID NO: 1343419 - DNA, 14 bp, Homo sapiens
cgtctccaggggct

SEQ ID NO: 1343420 - DNA, 19 bp, Homo sapiens
cgtctccaggggctgcttc

SEQ ID NO: 1343421 - DNA, 18 bp, Homo sapiens
cgtctgccggacccggag

SEQ ID NO: 1343422 - DNA, 16 bp, Homo sapiens
cgtcttggtgtaattt

SEQ ID NO: 1343423 - DNA, 16 bp, Homo sapiens
cgtgaaaacggagctg

SEQ ID NO: 1343424 - DNA, 17 bp, Homo sapiens
cgtgaaaacggagctga

SEQ ID NO: 1343425 - DNA, 22 bp, Homo sapiens
cgtgaaagtgcatttttgtaaa

SEQ ID NO: 1343426 - DNA, 14 bp, Homo sapiens
cgtgaagaagcctg

SEQ ID NO: 1343427 - DNA, 16 bp, Homo sapiens
cgtgaagatactttgt

SEQ ID NO: 1343428 - DNA, 19 bp, Homo sapiens
cgtgaagatactttgtatt

SEQ ID NO: 1343429 - DNA, 21 bp, Homo sapiens
cgtgaagatactttgtattgt

SEQ ID NO: 1343430 - DNA, 15 bp, Homo sapiens
cgtgacccgacctgg

SEQ ID NO: 1343431 - DNA, 17 bp, Homo sapiens
cgtgcatccctgagaca

SEQ ID NO: 1343432 - DNA, 15 bp, Homo sapiens
cgtgccgcctgcact

SEQ ID NO: 1343433 - DNA, 15 bp, Homo sapiens
cgtgccgtggcacca

SEQ ID NO: 1343434 - DNA, 15 bp, Homo sapiens
cgtgctactgcactc

SEQ ID NO: 1343435 - DNA, 15 bp, Homo sapiens
cgtgctgggcggctg

SEQ ID NO: 1343436 - DNA, 19 bp, Homo sapiens
cgtggactgagtgggaagc

SEQ ID NO: 1343437 - DNA, 15 bp, Homo sapiens
cgtggagggaggccc

SEQ ID NO: 1343438 - DNA, 16 bp, Homo sapiens
cgtggagggaggcccc

SEQ ID NO: 1343439 - DNA, 20 bp, Homo sapiens
cgtggagggaggccccaggg

SEQ ID NO: 1343440 - DNA, 13 bp, Homo sapiens
cgtggcccaaggc

SEQ ID NO: 1343441 - DNA, 14 bp, Homo sapiens
cgtggcccaaggct

SEQ ID NO: 1343442 - DNA, 19 bp, Homo sapiens
cgtggcccaaggctggcag

SEQ ID NO: 1343443 - DNA, 16 bp, Homo sapiens
cgtggggcagggagct

SEQ ID NO: 1343444 - DNA, 21 bp, Homo sapiens
cgtgtgagaagtgaatgctgg

SEQ ID NO: 1343445 - DNA, 22 bp, Homo sapiens
cgtgtgagaagtgaatgctggg

SEQ ID NO: 1343446 - DNA, 15 bp, Homo sapiens
cgtgtgcctgtgtgc

SEQ ID NO: 1343447 - DNA, 11 bp, Homo sapiens
cgttatattaa

SEQ ID NO: 1343448 - DNA, 18 bp, Homo sapiens
cgttgctgacttagaatc

SEQ ID NO: 1343449 - DNA, 18 bp, Homo sapiens
cgttgtgttttttaagat

SEQ ID NO: 1343450 - DNA, 22 bp, Homo sapiens
cgtttcagcgactccgttggcc

SEQ ID NO: 1343451 - DNA, 21 bp, Homo sapiens
cgtttctttaaccttgtataa

SEQ ID NO: 1343452 - DNA, 13 bp, Homo sapiens
cgttttaaggact

SEQ ID NO: 1343453 - DNA, 16 bp, Homo sapiens
cgttttaaggactgac

SEQ ID NO: 1343454 - DNA, 16 bp, Homo sapiens
cgttttccccatgaca

SEQ ID NO: 1343455 - DNA, 21 bp, Homo sapiens
cgtttttgtattttcatgaaa

SEQ ID NO: 1343456 - DNA, 14 bp, Homo sapiens
ctaaaaatattgtt

SEQ ID NO: 1343457 - DNA, 13 bp, Homo sapiens
ctaaaatttgaag

SEQ ID NO: 1343458 - DNA, 12 bp, Homo sapiens
ctaaacctcagt

SEQ ID NO: 1343459 - DNA, 21 bp, Homo sapiens
ctaaagaaaaatatcttggcc

SEQ ID NO: 1343460 - DNA, 19 bp, Homo sapiens
ctaaagagcccttgcctcc

SEQ ID NO: 1343461 - DNA, 17 bp, Homo sapiens
ctaaagcaatagaaaca

SEQ ID NO: 1343462 - DNA, 19 bp, Homo sapiens
ctaaagcatgaaatgtgaa

SEQ ID NO: 1343463 - DNA, 16 bp, Homo sapiens
ctaaatctatttatta

SEQ ID NO: 1343464 - DNA, 21 bp, Homo sapiens
ctaaatctatttattaatatt

SEQ ID NO: 1343465 - DNA, 22 bp, Homo sapiens
ctaaattatagtgtagaaaaga

SEQ ID NO: 1343466 - DNA, 19 bp, Homo sapiens
ctaacataccgtttataat

SEQ ID NO: 1343467 - DNA, 20 bp, Homo sapiens
ctaacgaaatatcaaagtca

SEQ ID NO: 1343468 - DNA, 14 bp, Homo sapiens
ctaactcaccagcc

SEQ ID NO: 1343469 - DNA, 17 bp, Homo sapiens
ctaactgtaaatcatgt

SEQ ID NO: 1343470 - DNA, 18 bp, Homo sapiens
ctaactgtaaatcatgtt

SEQ ID NO: 1343471 - DNA, 17 bp, Homo sapiens
ctaagaattcaaactgg

SEQ ID NO: 1343472 - DNA, 22 bp, Homo sapiens
ctaagactatatatataaatgt

SEQ ID NO: 1343473 - DNA, 22 bp, Homo sapiens
ctaaggcatctatctgtgctag

SEQ ID NO: 1343474 - DNA, 16 bp, Homo sapiens
cctgccgtcaccacca

SEQ ID NO: 1343475 - DNA, 22 bp, Homo sapiens
cctgccgtcaccaccaccccta

SEQ ID NO: 1343476 - DNA, 20 bp, Homo sapiens
cctgcctcccacttcactgc

SEQ ID NO: 1343477 - DNA, 15 bp, Homo sapiens
cctgcctggccccca

SEQ ID NO: 1343478 - DNA, 17 bp, Homo sapiens
cctgcgaccctgggggc

SEQ ID NO: 1343479 - DNA, 24 bp, Homo sapiens
cctgcgggtggggcttggggctca

SEQ ID NO: 1343480 - DNA, 15 bp, Homo sapiens
cctgcgtcctcctca

SEQ ID NO: 1343481 - DNA, 18 bp, Homo sapiens
cctgcgtcctcctcacct

SEQ ID NO: 1343482 - DNA, 23 bp, Homo sapiens
cctgctagctagctcaactagtg

SEQ ID NO: 1343483 - DNA, 18 bp, Homo sapiens
cctgctgctggtgcacag

SEQ ID NO: 1343484 - DNA, 19 bp, Homo sapiens
cctgctgctggtgcacagc

SEQ ID NO: 1343485 - DNA, 23 bp, Homo sapiens
cctgctggggatccccgcctggc

SEQ ID NO: 1343486 - DNA, 23 bp, Homo sapiens
cctgctgtgattccactacacct

SEQ ID NO: 1343487 - DNA, 22 bp, Homo sapiens
cctgcttaatcttcaaagcctt

SEQ ID NO: 1343488 - DNA, 22 bp, Homo sapiens
cctgcttccaggaaactccaca

SEQ ID NO: 1343489 - DNA, 19 bp, Homo sapiens
cctggaacaatattttatg

SEQ ID NO: 1343490 - DNA, 20 bp, Homo sapiens
cctggaacaatattttatgg

SEQ ID NO: 1343491 - DNA, 16 bp, Homo sapiens
cctggaagaacaggcc

SEQ ID NO: 1343492 - DNA, 18 bp, Homo sapiens
cctggaagaacaggcctc

SEQ ID NO: 1343493 - DNA, 20 bp, Homo sapiens
cctggaagaacaggcctctc

SEQ ID NO: 1343494 - DNA, 17 bp, Homo sapiens
cctggaattgccagctg

SEQ ID NO: 1343495 - DNA, 19 bp, Homo sapiens
cctggacagtatcccacat

SEQ ID NO: 1343496 - DNA, 23 bp, Homo sapiens
cctggacagtatcccacatccaa

SEQ ID NO: 1343497 - DNA, 15 bp, Homo sapiens
cctggactgctacct

SEQ ID NO: 1343498 - DNA, 13 bp, Homo sapiens
cctggagatcctc

SEQ ID NO: 1343499 - DNA, 18 bp, Homo sapiens
cctggagatcctcctgca

SEQ ID NO: 1343500 - DNA, 22 bp, Homo sapiens
cctggatctaccagcataaata

SEQ ID NO: 1343501 - DNA, 12 bp, Homo sapiens
cctggcactgga

SEQ ID NO: 1343502 - DNA, 16 bp, Homo sapiens
cctggcactggacccc

SEQ ID NO: 1343503 - DNA, 18 bp, Homo sapiens
cctggcagcccagagact

SEQ ID NO: 1343504 - DNA, 11 bp, Homo sapiens
cctggccagga

SEQ ID NO: 1343505 - DNA, 14 bp, Homo sapiens
cctggccaggagca

SEQ ID NO: 1343506 - DNA, 14 bp, Homo sapiens
cctggcccactgca

SEQ ID NO: 1343507 - DNA, 16 bp, Homo sapiens
cctggcccactgcatc

SEQ ID NO: 1343508 - DNA, 21 bp, Homo sapiens
cctggcctatccgctgccagc

SEQ ID NO: 1343509 - DNA, 17 bp, Homo sapiens
cctggcctcccctgcca

SEQ ID NO: 1343510 - DNA, 18 bp, Homo sapiens
cctggcctcccctgccac

SEQ ID NO: 1343511 - DNA, 14 bp, Homo sapiens
cctggcctctgtgc

SEQ ID NO: 1343512 - DNA, 21 bp, Homo sapiens
cctggccttgtcctcagccag

SEQ ID NO: 1343513 - DNA, 19 bp, Homo sapiens
cctggcgcaggtgggctgg

SEQ ID NO: 1343514 - DNA, 19 bp, Homo sapiens
cctggctgaggttcctctg

SEQ ID NO: 1343515 - DNA, 20 bp, Homo sapiens
cctggctgaggttcctctgc

SEQ ID NO: 1343516 - DNA, 24 bp, Homo sapiens
cctggctgaggttcctctgcctgc

SEQ ID NO: 1343517 - DNA, 13 bp, Homo sapiens
cctggctgctgcc

SEQ ID NO: 1343518 - DNA, 16 bp, Homo sapiens
cctggctgctgccccc

SEQ ID NO: 1343519 - DNA, 18 bp, Homo sapiens
cctgggacggcggcagta

SEQ ID NO: 1343520 - DNA, 14 bp, Homo sapiens
cctgggccccagct

SEQ ID NO: 1343521 - DNA, 14 bp, Homo sapiens
cctgggccctgggc

SEQ ID NO: 1343522 - DNA, 15 bp, Homo sapiens
cctgggccctgggct

SEQ ID NO: 1343523 - DNA, 18 bp, Homo sapiens
cctgggccctgggctgga

SEQ ID NO: 1343524 - DNA, 16 bp, Homo sapiens
cctgggccgctgccac

SEQ ID NO: 1343525 - DNA, 20 bp, Homo sapiens
cctgggctggaatcaggaat

SEQ ID NO: 1343526 - DNA, 17 bp, Homo sapiens
cctgggcttggcctgct

SEQ ID NO: 1343527 - DNA, 18 bp, Homo sapiens
cctgggggcacaggaggc

SEQ ID NO: 1343528 - DNA, 17 bp, Homo sapiens
cctgggggcctgggttg

SEQ ID NO: 1343529 - DNA, 20 bp, Homo sapiens
cctggggtgttagtggcacc

SEQ ID NO: 1343530 - DNA, 14 bp, Homo sapiens
cctgggtgtccccg

SEQ ID NO: 1343531 - DNA, 20 bp, Homo sapiens
cctgggtgtccccgctgctg

SEQ ID NO: 1343532 - DNA, 23 bp, Homo sapiens
cctggttattgatgtggccctgg

SEQ ID NO: 1343533 - DNA, 18 bp, Homo sapiens
cctgtaacactcctctgc

SEQ ID NO: 1343534 - DNA, 18 bp, Homo sapiens
cctgtaacttgagagtag

SEQ ID NO: 1343535 - DNA, 21 bp, Homo sapiens
cctgtacagtagattttccaa

SEQ ID NO: 1343536 - DNA, 21 bp, Homo sapiens
cctgtagagtgggagctgagt

SEQ ID NO: 1343537 - DNA, 15 bp, Homo sapiens
cctgtagcacttact

SEQ ID NO: 1343538 - DNA, 22 bp, Homo sapiens
cctgtagggtccaaccagacct

SEQ ID NO: 1343539 - DNA, 13 bp, Homo sapiens
cctgtagtcccag

SEQ ID NO: 1343540 - DNA, 19 bp, Homo sapiens
cctgtatatttgtaaagct

SEQ ID NO: 1343541 - DNA, 23 bp, Homo sapiens
cctgtccctgcgcctttcctttt

SEQ ID NO: 1343542 - DNA, 21 bp, Homo sapiens
cctgtgaatgccactgccttc

SEQ ID NO: 1343543 - DNA, 17 bp, Homo sapiens
cctgtgacatggtgcct

SEQ ID NO: 1343544 - DNA, 21 bp, Homo sapiens
cctgtgacatggtgcctgaga

SEQ ID NO: 1343545 - DNA, 22 bp, Homo sapiens
cctgtgacatggtgcctgagag

SEQ ID NO: 1343546 - DNA, 18 bp, Homo sapiens
cctgtggcataaattgca

SEQ ID NO: 1343547 - DNA, 16 bp, Homo sapiens
cctgtggccccaccct

SEQ ID NO: 1343548 - DNA, 17 bp, Homo sapiens
cctgtggccccaccctg

SEQ ID NO: 1343549 - DNA, 18 bp, Homo sapiens
cctgtggccccaccctgg

SEQ ID NO: 1343550 - DNA, 13 bp, Homo sapiens
cctgtgtccatgc

SEQ ID NO: 1343551 - DNA, 14 bp, Homo sapiens
cctgtgttaattta

SEQ ID NO: 1343552 - DNA, 19 bp, Homo sapiens
cctgttaggagaagctgca

SEQ ID NO: 1343553 - DNA, 20 bp, Homo sapiens
ccttaaaacatcattccttt

SEQ ID NO: 1343554 - DNA, 15 bp, Homo sapiens
ccttaaaaccaaaga

SEQ ID NO: 1343555 - DNA, 16 bp, Homo sapiens
ccttaaaaccaaagag

SEQ ID NO: 1343556 - DNA, 17 bp, Homo sapiens
ccttaaaaccaaagagg

SEQ ID NO: 1343557 - DNA, 16 bp, Homo sapiens
ccttaacagttgtatt

SEQ ID NO: 1343558 - DNA, 17 bp, Homo sapiens
ccttaacagttgtattt

SEQ ID NO: 1343559 - DNA, 16 bp, Homo sapiens
ccttaactgcatccag

SEQ ID NO: 1343560 - DNA, 17 bp, Homo sapiens
ccttaattcactcccac

SEQ ID NO: 1343561 - DNA, 20 bp, Homo sapiens
ccttaatttcctttttgaca

SEQ ID NO: 1343562 - DNA, 14 bp, Homo sapiens
ccttactaattata

SEQ ID NO: 1343563 - DNA, 17 bp, Homo sapiens
ccttagaggtcctctgg

SEQ ID NO: 1343564 - DNA, 20 bp, Homo sapiens
cctagcagcccaccctgctg

SEQ ID NO: 1343565 - DNA, 17 bp, Homo sapiens
cctagccggttcctgtc

SEQ ID NO: 1343566 - DNA, 21 bp, Homo sapiens
cctagccggttcctgtccctg

SEQ ID NO: 1343567 - DNA, 17 bp, Homo sapiens
cctagcgatctctcctg

SEQ ID NO: 1343568 - DNA, 20 bp, Homo sapiens
cctagcttgggaggcttccc

SEQ ID NO: 1343569 - DNA, 21 bp, Homo sapiens
cctagctttagaccctgggtg

SEQ ID NO: 1343570 - DNA, 16 bp, Homo sapiens
cctaggaaactcacac

SEQ ID NO: 1343571 - DNA, 20 bp, Homo sapiens
cctagggcccccacagttgc

SEQ ID NO: 1343572 - DNA, 14 bp, Homo sapiens
cctagtaagaagac

SEQ ID NO: 1343573 - DNA, 13 bp, Homo sapiens
cctatatatttct

SEQ ID NO: 1343574 - DNA, 14 bp, Homo sapiens
cctatccctctcct

SEQ ID NO: 1343575 - DNA, 15 bp, Homo sapiens
cctatctcctgacag

SEQ ID NO: 1343576 - DNA, 16 bp, Homo sapiens
cctatctcctgacaga

SEQ ID NO: 1343577 - DNA, 16 bp, Homo sapiens
cctattagtgttatat

SEQ ID NO: 1343578 - DNA, 20 bp, Homo sapiens
cctcaaagcttggattaaat

SEQ ID NO: 1343579 - DNA, 17 bp, Homo sapiens
cctcaaattttttgact

SEQ ID NO: 1343580 - DNA, 12 bp, Homo sapiens
cctcaacctctt

SEQ ID NO: 1343581 - DNA, 20 bp, Homo sapiens
cctcaacctcttctggctca

SEQ ID NO: 1343582 - DNA, 16 bp, Homo sapiens
cctcaccccctcccac

SEQ ID NO: 1343583 - DNA, 17 bp, Homo sapiens
cctcaccccctcccacc

SEQ ID NO: 1343584 - DNA, 20 bp, Homo sapiens
cctcaccccctcccaccccc

SEQ ID NO: 1343585 - DNA, 15 bp, Homo sapiens
cctcacctcatgccc

SEQ ID NO: 1343586 - DNA, 22 bp, Homo sapiens
cctcacctcatgcccaccccct

SEQ ID NO: 1343587 - DNA, 15 bp, Homo sapiens
cctcagctcggctca

SEQ ID NO: 1343588 - DNA, 16 bp, Homo sapiens
cctcaggtgagaagca

SEQ ID NO: 1343589 - DNA, 17 bp, Homo sapiens
cctcaggtgagaagcag

SEQ ID NO: 1343590 - DNA, 22 bp, Homo sapiens
cctcaggtgagaagcagaggaa

SEQ ID NO: 1343591 - DNA, 24 bp, Homo sapiens
cctcatgcccaccccctgccctgc

SEQ ID NO: 1343592 - DNA, 15 bp, Homo sapiens
cctcatgtggctgga

SEQ ID NO: 1343593 - DNA, 17 bp, Homo sapiens
cctcatgtggctggaag

SEQ ID NO: 1343594 - DNA, 23 bp, Homo sapiens
cctcatgtggctggaagatcctg

SEQ ID NO: 1343595 - DNA, 20 bp, Homo sapiens
cctccaaatggagaagctgc

SEQ ID NO: 1343596 - DNA, 23 bp, Homo sapiens
cctccaaatggagaagctgcagg

SEQ ID NO: 1343597 - DNA, 12 bp, Homo sapiens
cctccaaccctg

SEQ ID NO: 1343598 - DNA, 13 bp, Homo sapiens
cctccaaccctgc

SEQ ID NO: 1343599 - DNA, 13 bp, Homo sapiens
cctccacagcgag

SEQ ID NO: 1343600 - DNA, 23 bp, Homo sapiens
cctccacagcgagggcagctgct

SEQ ID NO: 1343601 - DNA, 13 bp, Homo sapiens
cctccaggcctgc

SEQ ID NO: 1343602 - DNA, 15 bp, Homo sapiens
cctccaggcctgcct

SEQ ID NO: 1343603 - DNA, 19 bp, Homo sapiens
cctccaggcctgcctccca

SEQ ID NO: 1343604 - DNA, 20 bp, Homo sapiens
cctccaggcctgcctcccac

SEQ ID NO: 1343605 - DNA, 21 bp, Homo sapiens
cctccaggcctgcctcccact

SEQ ID NO: 1343606 - DNA, 17 bp, Homo sapiens
cctccaggtgcagaggt

SEQ ID NO: 1343607 - DNA, 17 bp, Homo sapiens
cctccatttgagaaaat

SEQ ID NO: 1343608 - DNA, 19 bp, Homo sapiens
cctcccacacccaaagctg

SEQ ID NO: 1343609 - DNA, 16 bp, Homo sapiens
cctcccacttcactgc

SEQ ID NO: 1343610 - DNA, 18 bp, Homo sapiens
cctcccaggaagcccagg

SEQ ID NO: 1343611 - DNA, 20 bp, Homo sapiens
cctcccaggaagcccaggag

SEQ ID NO: 1343612 - DNA, 21 bp, Homo sapiens
cctcccaggaagcccaggagc

SEQ ID NO: 1343613 - DNA, 13 bp, Homo sapiens
cctccccagcctg

SEQ ID NO: 1343614 - DNA, 21 bp, Homo sapiens
cctccccagcctgcgcctgct

SEQ ID NO: 1343615 - DNA, 22 bp, Homo sapiens
cctccccagcctgcgcctgctg

SEQ ID NO: 1343616 - DNA, 19 bp, Homo sapiens
cctccccagtgcaaatgca

SEQ ID NO: 1343617 - DNA, 15 bp, Homo sapiens
cctccccatttccca

SEQ ID NO: 1343618 - DNA, 13 bp, Homo sapiens
cctccctccaccc

SEQ ID NO: 1343619 - DNA, 19 bp, Homo sapiens
cctccctccaccccaggac

SEQ ID NO: 1343620 - DNA, 13 bp, Homo sapiens
cctcccttccttt

SEQ ID NO: 1343621 - DNA, 17 bp, Homo sapiens
cctcccttccttttccc

SEQ ID NO: 1343622 - DNA, 21 bp, Homo sapiens
cctcccttccttttccctgct

SEQ ID NO: 1343623 - DNA, 14 bp, Homo sapiens
cctccgagagggag

SEQ ID NO: 1343624 - DNA, 12 bp, Homo sapiens
cctccgccctgc

SEQ ID NO: 1343625 - DNA, 15 bp, Homo sapiens
cctccgccctgccac

SEQ ID NO: 1343626 - DNA, 14 bp, Homo sapiens
cctcctcacctcat

SEQ ID NO: 1343627 - DNA, 21 bp, Homo sapiens
cctcctccagccgccatgctc

SEQ ID NO: 1343628 - DNA, 21 bp, Homo sapiens
cctcctctggacggcaggctc

SEQ ID NO: 1343629 - DNA, 22 bp, Homo sapiens
cctcctctggacggcaggctca

SEQ ID NO: 1343630 - DNA, 21 bp, Homo sapiens
cctcctgacccattgctgttg

SEQ ID NO: 1343631 - DNA, 19 bp, Homo sapiens
cctcctgcagaccacgccc

SEQ ID NO: 1343632 - DNA, 21 bp, Homo sapiens
cctcgcaactgtccacgcgtg

SEQ ID NO: 1343633 - DNA, 22 bp, Homo sapiens
cctcgcagcctctcagtgccct

SEQ ID NO: 1343634 - DNA, 18 bp, Homo sapiens
cctcgccggatctgaggg

SEQ ID NO: 1343635 - DNA, 18 bp, Homo sapiens
cctcgtgaaagtgcattt

SEQ ID NO: 1343636 - DNA, 15 bp, Homo sapiens
cctctagaagccaag

SEQ ID NO: 1343637 - DNA, 21 bp, Homo sapiens
cctctatttatgtttgcactt

SEQ ID NO: 1343638 - DNA, 14 bp, Homo sapiens
cctctcacctcagc

SEQ ID NO: 1343639 - DNA, 12 bp, Homo sapiens
cctctctctctg

SEQ ID NO: 1343640 - DNA, 23 bp, Homo sapiens
cctctgaaaaccaatgttctctc

SEQ ID NO: 1343641 - DNA, 18 bp, Homo sapiens
cctctgcccctcccccag

SEQ ID NO: 1343642 - DNA, 20 bp, Homo sapiens
cctctgcccctcccccagcc

SEQ ID NO: 1343643 - DNA, 12 bp, Homo sapiens
cctctgcctgcc

SEQ ID NO: 1343644 - DNA, 16 bp, Homo sapiens
cctctgcctgccccgc

SEQ ID NO: 1343645 - DNA, 20 bp, Homo sapiens
cctctgctcaccgcccatca

SEQ ID NO: 1343646 - DNA, 21 bp, Homo sapiens
cctctgctcaccgcccatcag

SEQ ID NO: 1343647 - DNA, 13 bp, Homo sapiens
cctctgctcccca

SEQ ID NO: 1343648 - DNA, 22 bp, Homo sapiens
cctctgctttctcctttaattg

SEQ ID NO: 1343649 - DNA, 21 bp, Homo sapiens
cctctggtcgctcctgcccac

SEQ ID NO: 1343650 - DNA, 19 bp, Homo sapiens
cccggtggcggccccagca

SEQ ID NO: 1343651 - DNA, 15 bp, Homo sapiens
cccgtcctgcctgtg

SEQ ID NO: 1343652 - DNA, 17 bp, Homo sapiens
cccgtcctgcctgtggc

SEQ ID NO: 1343653 - DNA, 14 bp, Homo sapiens
cccgtttctggtgg

SEQ ID NO: 1343654 - DNA, 20 bp, Homo sapiens
ccctacagttgaaaaacagc

SEQ ID NO: 1343655 - DNA, 18 bp, Homo sapiens
ccctactccctgcagatg

SEQ ID NO: 1343656 - DNA, 19 bp, Homo sapiens
ccctagcagcccaccctgc

SEQ ID NO: 1343657 - DNA, 17 bp, Homo sapiens
ccctagccggttcctgt

SEQ ID NO: 1343658 - DNA, 17 bp, Homo sapiens
ccctagctttagaccct

SEQ ID NO: 1343659 - DNA, 18 bp, Homo sapiens
ccctagctttagaccctg

SEQ ID NO: 1343660 - DNA, 21 bp, Homo sapiens
ccctagctttagaccctgggt

SEQ ID NO: 1343661 - DNA, 22 bp, Homo sapiens
ccctatctcctgacagaaggtg

SEQ ID NO: 1343662 - DNA, 16 bp, Homo sapiens
ccctcaacctcttctg

SEQ ID NO: 1343663 - DNA, 20 bp, Homo sapiens
ccctccaaatggagaagctg

SEQ ID NO: 1343664 - DNA, 23 bp, Homo sapiens
ccctccaaatggagaagctgcag

SEQ ID NO: 1343665 - DNA, 14 bp, Homo sapiens
ccctccaccccagg

SEQ ID NO: 1343666 - DNA, 10 bp, Homo sapiens
ccctcccact

SEQ ID NO: 1343667 - DNA, 14 bp, Homo sapiens
ccctccccatggag

SEQ ID NO: 1343668 - DNA, 23 bp, Homo sapiens
ccctcccccagccatgccagctg

SEQ ID NO: 1343669 - DNA, 13 bp, Homo sapiens
ccctccgccctgc

SEQ ID NO: 1343670 - DNA, 23 bp, Homo sapiens
ccctcctgaaccgcacagctcag

SEQ ID NO: 1343671 - DNA, 20 bp, Homo sapiens
ccctctcccaaaaaactact

SEQ ID NO: 1343672 - DNA, 14 bp, Homo sapiens
ccctctgcccctcc

SEQ ID NO: 1343673 - DNA, 18 bp, Homo sapiens
ccctctggtcgctcctgc

SEQ ID NO: 1343674 - DNA, 13 bp, Homo sapiens
ccctcttgcccat

SEQ ID NO: 1343675 - DNA, 15 bp, Homo sapiens
ccctcttgcccatcc

SEQ ID NO: 1343676 - DNA, 16 bp, Homo sapiens
ccctcttgcccatcct

SEQ ID NO: 1343677 - DNA, 22 bp, Homo sapiens
ccctcttgcccatcctgactga

SEQ ID NO: 1343678 - DNA, 18 bp, Homo sapiens
ccctgaaagccctgagct

SEQ ID NO: 1343679 - DNA, 15 bp, Homo sapiens
ccctgagtctgggca

SEQ ID NO: 1343680 - DNA, 15 bp, Homo sapiens
ccctgcagatgccac

SEQ ID NO: 1343681 - DNA, 18 bp, Homo sapiens
ccctgcccccagccccgg

SEQ ID NO: 1343682 - DNA, 19 bp, Homo sapiens
ccctgccgtcaccaccacc

SEQ ID NO: 1343683 - DNA, 22 bp, Homo sapiens
ccctgcgctctctttgcaactg

SEQ ID NO: 1343684 - DNA, 15 bp, Homo sapiens
ccctgctgctggtgc

SEQ ID NO: 1343685 - DNA, 15 bp, Homo sapiens
ccctgcttccaggaa

SEQ ID NO: 1343686 - DNA, 12 bp, Homo sapiens
ccctggagccca

SEQ ID NO: 1343687 - DNA, 21 bp, Homo sapiens
ccctggatagacgagttgatt

SEQ ID NO: 1343688 - DNA, 14 bp, Homo sapiens
ccctggcctcccct

SEQ ID NO: 1343689 - DNA, 21 bp, Homo sapiens
ccctggcctctgtgccttctt

SEQ ID NO: 1343690 - DNA, 12 bp, Homo sapiens
ccctggctccct

SEQ ID NO: 1343691 - DNA, 13 bp, Homo sapiens
ccctggctccctc

SEQ ID NO: 1343692 - DNA, 15 bp, Homo sapiens
ccctggctccctcct

SEQ ID NO: 1343693 - DNA, 13 bp, Homo sapiens
ccctggctgctgc

SEQ ID NO: 1343694 - DNA, 14 bp, Homo sapiens
ccctggctgctgcc

SEQ ID NO: 1343695 - DNA, 18 bp, Homo sapiens
ccctggctgctgccccca

SEQ ID NO: 1343696 - DNA, 17 bp, Homo sapiens
ccctgggcttggcctgc

SEQ ID NO: 1343697 - DNA, 21 bp, Homo sapiens
ccctgggcttggcctgctgtg

SEQ ID NO: 1343698 - DNA, 22 bp, Homo sapiens
ccctgggcttggcctgctgtga

SEQ ID NO: 1343699 - DNA, 22 bp, Homo sapiens
ccctgtgacatggtgcctgaga

SEQ ID NO: 1343700 - DNA, 13 bp, Homo sapiens
ccctgtgtgcagg

SEQ ID NO: 1343701 - DNA, 20 bp, Homo sapiens
cccttccagatcactgccac

SEQ ID NO: 1343702 - DNA, 13 bp, Homo sapiens
cccttcccccacc

SEQ ID NO: 1343703 - DNA, 20 bp, Homo sapiens
cccttcctcttgtctgattt

SEQ ID NO: 1343704 - DNA, 17 bp, Homo sapiens
cccttgagggctgcagt

SEQ ID NO: 1343705 - DNA, 16 bp, Homo sapiens
cccttgctggccccag

SEQ ID NO: 1343706 - DNA, 21 bp, Homo sapiens
cccttgctggccccagccctg

SEQ ID NO: 1343707 - DNA, 18 bp, Homo sapiens
cccttgcttgcctgcagg

SEQ ID NO: 1343708 - DNA, 13 bp, Homo sapiens
ccgactccagcca

SEQ ID NO: 1343709 - DNA, 14 bp, Homo sapiens
ccgactccagccag

SEQ ID NO: 1343710 - DNA, 13 bp, Homo sapiens
ccgagagggagag

SEQ ID NO: 1343711 - DNA, 11 bp, Homo sapiens
ccgccagcctc

SEQ ID NO: 1343712 - DNA, 12 bp, Homo sapiens
ccgccagcctcc

SEQ ID NO: 1343713 - DNA, 23 bp, Homo sapiens
ccgccagcctcctctggacggca

SEQ ID NO: 1343714 - DNA, 19 bp, Homo sapiens
ccgcccatgcactggggac

SEQ ID NO: 1343715 - DNA, 19 bp, Homo sapiens
ccgcccccagtccccaccc

SEQ ID NO: 1343716 - DNA, 14 bp, Homo sapiens
ccgccccctcctga

SEQ ID NO: 1343717 - DNA, 15 bp, Homo sapiens
ccgcggagcctgcat

SEQ ID NO: 1343718 - DNA, 21 bp, Homo sapiens
ccggaccctctaacctcgccc

SEQ ID NO: 1343719 - DNA, 22 bp, Homo sapiens
ccggcatgagactcagtgcaga

SEQ ID NO: 1343720 - DNA, 17 bp, Homo sapiens
ccggccctgtgtgcagg

SEQ ID NO: 1343721 - DNA, 15 bp, Homo sapiens
ccggccgctccacca

SEQ ID NO: 1343722 - DNA, 12 bp, Homo sapiens
ccggcctctcca

SEQ ID NO: 1343723 - DNA, 18 bp, Homo sapiens
ccggcctctccagcctca

SEQ ID NO: 1343724 - DNA, 14 bp, Homo sapiens
ccggctcccagcct

SEQ ID NO: 1343725 - DNA, 15 bp, Homo sapiens
ccggcttcctttccc

SEQ ID NO: 1343726 - DNA, 17 bp, Homo sapiens
ccgggaacctccccagc

SEQ ID NO: 1343727 - DNA, 18 bp, Homo sapiens
ccgggaacctccccagcc

SEQ ID NO: 1343728 - DNA, 22 bp, Homo sapiens
ccgggaacctccccagcctgcg

SEQ ID NO: 1343729 - DNA, 21 bp, Homo sapiens
ccgggcccctgggcttggcct

SEQ ID NO: 1343730 - DNA, 14 bp, Homo sapiens
ccgggcgcggtggc

SEQ ID NO: 1343731 - DNA, 21 bp, Homo sapiens
ccgggcgcggtggcgggcacc

SEQ ID NO: 1343732 - DNA, 16 bp, Homo sapiens
ccggtaactgtcctgt

SEQ ID NO: 1343733 - DNA, 15 bp, Homo sapiens
ttttaagttcttatg

SEQ ID NO: 1343734 - DNA, 14 bp, Homo sapiens
ttttaattgtttaa

SEQ ID NO: 1343735 - DNA, 17 bp, Homo sapiens
ttttacacagaaacact

SEQ ID NO: 1343736 - DNA, 18 bp, Homo sapiens
ttttactggttgcatgga

SEQ ID NO: 1343737 - DNA, 16 bp, Homo sapiens
ttttagaataagaatt

SEQ ID NO: 1343738 - DNA, 15 bp, Homo sapiens
ttgatttattaactt

SEQ ID NO: 1343739 - DNA, 20 bp, Homo sapiens
ttgatttattaacttaataa

SEQ ID NO: 1343740 - DNA, 21 bp, Homo sapiens
ttgatttattaacttaataat

SEQ ID NO: 1343741 - DNA, 20 bp, Homo sapiens
ttgatttcaaagttttgttg

SEQ ID NO: 1343742 - DNA, 14 bp, Homo sapiens
ttgcaaaatacatg

SEQ ID NO: 1343743 - DNA, 13 bp, Homo sapiens
ttgcaaagtgtat

SEQ ID NO: 1343744 - DNA, 13 bp, Homo sapiens
ttgcaaccaggaa

SEQ ID NO: 1343745 - DNA, 22 bp, Homo sapiens
ttgcaagatgtgaattattgac

SEQ ID NO: 1343746 - DNA, 23 bp, Homo sapiens
ttgcaagatgtgaattattgaca

SEQ ID NO: 1343747 - DNA, 19 bp, Homo sapiens
ttgcaagcatgcttgtgaa

SEQ ID NO: 1343748 - DNA, 16 bp, Homo sapiens
ttgcaagtgctggagt

SEQ ID NO: 1343749 - DNA, 15 bp, Homo sapiens
ttgcaataccaagta

SEQ ID NO: 1343750 - DNA, 21 bp, Homo sapiens
ttgcaccactgcactccagcc

SEQ ID NO: 1343751 - DNA, 21 bp, Homo sapiens
ttgcagcccttgtgatgtgat

SEQ ID NO: 1343752 - DNA, 20 bp, Homo sapiens
ttgcagtttatcattcaagt

SEQ ID NO: 1343753 - DNA, 23 bp, Homo sapiens
ttgcatcccaaaccacgcctctt

SEQ ID NO: 1343754 - DNA, 14 bp, Homo sapiens
ttgcatctgaaata

SEQ ID NO: 1343755 - DNA, 15 bp, Homo sapiens
ttgcatgcatgcaaa

SEQ ID NO: 1343756 - DNA, 21 bp, Homo sapiens
ttgcatgttatgtttaataag

SEQ ID NO: 1343757 - DNA, 13 bp, Homo sapiens
ttgccaaaattca

SEQ ID NO: 1343758 - DNA, 14 bp, Homo sapiens
ttgccaattttcct

SEQ ID NO: 1343759 - DNA, 14 bp, Homo sapiens
ttgccatgtgtttt

SEQ ID NO: 1343760 - DNA, 13 bp, Homo sapiens
ttgcccatcctga

SEQ ID NO: 1343761 - DNA, 20 bp, Homo sapiens
ttgcctataagccaaaatta

SEQ ID NO: 1343762 - DNA, 19 bp, Homo sapiens
ttgcctctgtgctgtgtgt

SEQ ID NO: 1343763 - DNA, 21 bp, Homo sapiens
ttgcctgtttctgatttgctg

SEQ ID NO: 1343764 - DNA, 19 bp, Homo sapiens
ttgccttttaatttttaat

SEQ ID NO: 1343765 - DNA, 17 bp, Homo sapiens
ttgctcaaaaaatgagc

SEQ ID NO: 1343766 - DNA, 18 bp, Homo sapiens
ttgctctatgctttccaa

SEQ ID NO: 1343767 - DNA, 17 bp, Homo sapiens
ttgctcttcagatgcca

SEQ ID NO: 1343768 - DNA, 12 bp, Homo sapiens
ttgctgacttag

SEQ ID NO: 1343769 - DNA, 14 bp, Homo sapiens
ttgctgacttagaa

SEQ ID NO: 1343770 - DNA, 15 bp, Homo sapiens
ttgctgagcctctgc

SEQ ID NO: 1343771 - DNA, 22 bp, Homo sapiens
ttgctggccagtccaccctgcc

SEQ ID NO: 1343772 - DNA, 14 bp, Homo sapiens
ttgctggccccagc

SEQ ID NO: 1343773 - DNA, 15 bp, Homo sapiens
ttgctggtaaaatga

SEQ ID NO: 1343774 - DNA, 17 bp, Homo sapiens
ttgcttcaccatggcct

SEQ ID NO: 1343775 - DNA, 16 bp, Homo sapiens
ttgcttgcctgcaggg

SEQ ID NO: 1343776 - DNA, 19 bp, Homo sapiens
ttggacctaaatggcctca

SEQ ID NO: 1343777 - DNA, 23 bp, Homo sapiens
ttggacctaaatggcctcatgtg

SEQ ID NO: 1343778 - DNA, 20 bp, Homo sapiens
ttggagccccaggggacaag

SEQ ID NO: 1343779 - DNA, 17 bp, Homo sapiens
ttggattctaaatacat

SEQ ID NO: 1343780 - DNA, 18 bp, Homo sapiens
ttggcacttattgaatat

SEQ ID NO: 1343781 - DNA, 12 bp, Homo sapiens
ttggcatttgca

SEQ ID NO: 1343782 - DNA, 21 bp, Homo sapiens
ttggccactccgagaggtggg

SEQ ID NO: 1343783 - DNA, 22 bp, Homo sapiens
ttggccagccaactctgggaat

SEQ ID NO: 1343784 - DNA, 13 bp, Homo sapiens
ttggcctgctgtg

SEQ ID NO: 1343785 - DNA, 22 bp, Homo sapiens
ttggctcgaatctctgtgcctt

SEQ ID NO: 1343786 - DNA, 21 bp, Homo sapiens
ttggctgaaattctcctggag

SEQ ID NO: 1343787 - DNA, 22 bp, Homo sapiens
ttggctgaaattctcctggagg

SEQ ID NO: 1343788 - DNA, 23 bp, Homo sapiens
ttggcttcacggaagagccttgc

SEQ ID NO: 1343789 - DNA, 22 bp, Homo sapiens
ttggctttgggttgcaggacct

SEQ ID NO: 1343790 - DNA, 15 bp, Homo sapiens
ttgggaaaacatttg

SEQ ID NO: 1343791 - DNA, 16 bp, Homo sapiens
ttgggaaaacatttgc

SEQ ID NO: 1343792 - DNA, 22 bp, Homo sapiens
ttgggactgctaaataaaattt

SEQ ID NO: 1343793 - DNA, 21 bp, Homo sapiens
ttgggagagccatacataaaa

SEQ ID NO: 1343794 - DNA, 12 bp, Homo sapiens
ttgggcagagct

SEQ ID NO: 1343795 - DNA, 13 bp, Homo sapiens
ttgggggggtggc

SEQ ID NO: 1343796 - DNA, 18 bp, Homo sapiens
ttggtaaaactcactgtg

SEQ ID NO: 1343797 - DNA, 19 bp, Homo sapiens
ttggtaaagactggctttt

SEQ ID NO: 1343798 - DNA, 14 bp, Homo sapiens
ttggtaaatgtttc

SEQ ID NO: 1343799 - DNA, 20 bp, Homo sapiens
ttggtaatcccctaaaataa

SEQ ID NO: 1343800 - DNA, 14 bp, Homo sapiens
ttggtcctgtcccc

SEQ ID NO: 1343801 - DNA, 21 bp, Homo sapiens
ttggtgtggcccatggctgtt

SEQ ID NO: 1343802 - DNA, 15 bp, Homo sapiens
ttggttctgtgaaca

SEQ ID NO: 1343803 - DNA, 12 bp, Homo sapiens
ttggttttatga

SEQ ID NO: 1343804 - DNA, 12 bp, Homo sapiens
ttgtaaagactg

SEQ ID NO: 1343805 - DNA, 21 bp, Homo sapiens
ttgtaaagactggttttctgc

SEQ ID NO: 1343806 - DNA, 12 bp, Homo sapiens
ttgtaaagtttc

SEQ ID NO: 1343807 - DNA, 14 bp, Homo sapiens
ttgtaaatacacat

SEQ ID NO: 1343808 - DNA, 15 bp, Homo sapiens
ttgtaagaaggcaat

SEQ ID NO: 1343809 - DNA, 20 bp, Homo sapiens
ttgtaagaaggcaatattaa

SEQ ID NO: 1343810 - DNA, 16 bp, Homo sapiens
ttgtaagcgtatggct

SEQ ID NO: 1343811 - DNA, 17 bp, Homo sapiens
ttgtaagcgtatggctt

SEQ ID NO: 1343812 - DNA, 16 bp, Homo sapiens
ttgtaatttaaaataa

SEQ ID NO: 1343813 - DNA, 20 bp, Homo sapiens
ttgtacaaaattaagcaaat

SEQ ID NO: 1343814 - DNA, 19 bp, Homo sapiens
ttgtacatacgatttaagg

SEQ ID NO: 1343815 - DNA, 18 bp, Homo sapiens
ttgtacgacgtcagatgt

SEQ ID NO: 1343816 - DNA, 15 bp, Homo sapiens
ttgtaggagacttgc

SEQ ID NO: 1343817 - DNA, 14 bp, Homo sapiens
ttgtatagttatgt

SEQ ID NO: 1343818 - DNA, 17 bp, Homo sapiens
ttgtatagttatgtaaa

SEQ ID NO: 1343819 - DNA, 18 bp, Homo sapiens
ttgtatagttatgtaaat

SEQ ID NO: 1343820 - DNA, 20 bp, Homo sapiens
ttgtatagttatgtaaataa

SEQ ID NO: 1343821 - DNA, 22 bp, Homo sapiens
ttgtatattggttttatgatga

SEQ ID NO: 1343822 - DNA, 14 bp, Homo sapiens
ttgtattaaagaca

SEQ ID NO: 1343823 - DNA, 19 bp, Homo sapiens
ttgtattgtatattacaat

SEQ ID NO: 1343824 - DNA, 13 bp, Homo sapiens
ttgtatttaacag

SEQ ID NO: 1343825 - DNA, 17 bp, Homo sapiens
ttgtatttaacagaaat

SEQ ID NO: 1343826 - DNA, 17 bp, Homo sapiens
ttgtattttcatgaaaa

SEQ ID NO: 1343827 - DNA, 18 bp, Homo sapiens
ttgtattttgattatttt

SEQ ID NO: 1343828 - DNA, 19 bp, Homo sapiens
ttgtatttttgttgttggg

SEQ ID NO: 1343829 - DNA, 19 bp, Homo sapiens
ttgtcctattagtgttata

SEQ ID NO: 1343830 - DNA, 20 bp, Homo sapiens
ttgtcctgcctgcaatattt

SEQ ID NO: 1343831 - DNA, 18 bp, Homo sapiens
ttgtcctttttcaggaga

SEQ ID NO: 1343832 - DNA, 16 bp, Homo sapiens
ttgtctgatttcttag

SEQ ID NO: 1343833 - DNA, 23 bp, Homo sapiens
ttgtgaaccatggtgaagtgctt

SEQ ID NO: 1343834 - DNA, 16 bp, Homo sapiens
ttgtgctagaaatttt

SEQ ID NO: 1343835 - DNA, 12 bp, Homo sapiens
ttgtgtgaaatt

SEQ ID NO: 1343836 - DNA, 16 bp, Homo sapiens
ttgtgtgaaattgcat

SEQ ID NO: 1343837 - DNA, 13 bp, Homo sapiens
ttgtgtgaacttg

SEQ ID NO: 1343838 - DNA, 15 bp, Homo sapiens
ttgtgtgttgtctct

SEQ ID NO: 1343839 - DNA, 17 bp, Homo sapiens
ttgtgtgttgtctcttg

SEQ ID NO: 1343840 - DNA, 24 bp, Homo sapiens
ttaagagcaaatcaattctagtca

SEQ ID NO: 1343841 - DNA, 17 bp, Homo sapiens
ttaagatagtgtaactt

SEQ ID NO: 1343842 - DNA, 11 bp, Homo sapiens
ttaagatgtga

SEQ ID NO: 1343843 - DNA, 15 bp, Homo sapiens
ttaagatgtgaaaat

SEQ ID NO: 1343844 - DNA, 17 bp, Homo sapiens
ttaagatgtgaaaatta

SEQ ID NO: 1343845 - DNA, 16 bp, Homo sapiens
ttaagccttcaaaact

SEQ ID NO: 1343846 - DNA, 23 bp, Homo sapiens
ttaagctgcagagatttctcatt

SEQ ID NO: 1343847 - DNA, 21 bp, Homo sapiens
ttaagctgttcctgttcagta

SEQ ID NO: 1343848 - DNA, 15 bp, Homo sapiens
ttaaggactgactga

SEQ ID NO: 1343849 - DNA, 16 bp, Homo sapiens
ttaaggactgactgag

SEQ ID NO: 1343850 - DNA, 17 bp, Homo sapiens
ttaaggggaagaatgaa

SEQ ID NO: 1343851 - DNA, 16 bp, Homo sapiens
ttaaggtgtttgaaaa

SEQ ID NO: 1343852 - DNA, 17 bp, Homo sapiens
ttaaggtgtttgaaaat

SEQ ID NO: 1343853 - DNA, 17 bp, Homo sapiens
ttaagtgaggaaatcaa

SEQ ID NO: 1343854 - DNA, 19 bp, Homo sapiens
ttaagtgaggaaatcaaag

SEQ ID NO: 1343855 - DNA, 22 bp, Homo sapiens
ttaatataaagtagtcctgtga

SEQ ID NO: 1343856 - DNA, 16 bp, Homo sapiens
ttaatatttaacatta

SEQ ID NO: 1343857 - DNA, 17 bp, Homo sapiens
ttaatatttaacattat

SEQ ID NO: 1343858 - DNA, 14 bp, Homo sapiens
ttaatcactgtgta

SEQ ID NO: 1343859 - DNA, 17 bp, Homo sapiens
ttaatcactgtgtatat

SEQ ID NO: 1343860 - DNA, 18 bp, Homo sapiens
ttaatcatagttactgtg

SEQ ID NO: 1343861 - DNA, 19 bp, Homo sapiens
ttaatcatagttactgtgt

SEQ ID NO: 1343862 - DNA, 23 bp, Homo sapiens
ttaatcatagttactgtgtaaac

SEQ ID NO: 1343863 - DNA, 13 bp, Homo sapiens
ttaatcattttca

SEQ ID NO: 1343864 - DNA, 19 bp, Homo sapiens
ttaatccagttataagaag

SEQ ID NO: 1343865 - DNA, 16 bp, Homo sapiens
ttaatctactgcattt

SEQ ID NO: 1343866 - DNA, 14 bp, Homo sapiens
ttaatgcactttct

SEQ ID NO: 1343867 - DNA, 14 bp, Homo sapiens
ttaatgctatttga

SEQ ID NO: 1343868 - DNA, 20 bp, Homo sapiens
ttaatgctatttgaacaagt

SEQ ID NO: 1343869 - DNA, 14 bp, Homo sapiens
ttaatgttttcaaa

SEQ ID NO: 1343870 - DNA, 16 bp, Homo sapiens
ttaatgttttcaaaag

SEQ ID NO: 1343871 - DNA, 14 bp, Homo sapiens
ttaattgtaaagta

SEQ ID NO: 1343872 - DNA, 15 bp, Homo sapiens
ttaattgtaaagtaa

SEQ ID NO: 1343873 - DNA, 21 bp, Homo sapiens
ttaattgtgtgaacttggaag

SEQ ID NO: 1343874 - DNA, 11 bp, Homo sapiens
ttattaatgca

SEQ ID NO: 1343875 - DNA, 13 bp, Homo sapiens
ttattaatgtttt

SEQ ID NO: 1343876 - DNA, 17 bp, Homo sapiens
ttattaatgttttcaaa

SEQ ID NO: 1343877 - DNA, 19 bp, Homo sapiens
ttattaccccctccttcag

SEQ ID NO: 1343878 - DNA, 20 bp, Homo sapiens
ttattaccccctccttcaga

SEQ ID NO: 1343879 - DNA, 17 bp, Homo sapiens
ttattacttccatgaat

SEQ ID NO: 1343880 - DNA, 18 bp, Homo sapiens
ttattacttccatgaatt

SEQ ID NO: 1343881 - DNA, 22 bp, Homo sapiens
ttattataatcttataattgtt

SEQ ID NO: 1343882 - DNA, 18 bp, Homo sapiens
ttattcagtaactgtcag

SEQ ID NO: 1343883 - DNA, 16 bp, Homo sapiens
ttattgaatatatgat

SEQ ID NO: 1343884 - DNA, 12 bp, Homo sapiens
ttattgacactg

SEQ ID NO: 1343885 - DNA, 14 bp, Homo sapiens
ttattgacactgaa

SEQ ID NO: 1343886 - DNA, 13 bp, Homo sapiens
ttattgaccattt

SEQ ID NO: 1343887 - DNA, 16 bp, Homo sapiens
ttattgactctgggtc

SEQ ID NO: 1343888 - DNA, 14 bp, Homo sapiens
ttattgactcttga

SEQ ID NO: 1343889 - DNA, 17 bp, Homo sapiens
ttattgactcttgagtt

SEQ ID NO: 1343890 - DNA, 21 bp, Homo sapiens
ttattgactcttgagttgttt

SEQ ID NO: 1343891 - DNA, 14 bp, Homo sapiens
ttattgttaataca

SEQ ID NO: 1343892 - DNA, 20 bp, Homo sapiens
ttatttacagatgaatgtat

SEQ ID NO: 1343893 - DNA, 14 bp, Homo sapiens
ttatttagacaaga

SEQ ID NO: 1343894 - DNA, 15 bp, Homo sapiens
ttatttagacaagag

SEQ ID NO: 1343895 - DNA, 18 bp, Homo sapiens
ttatttagacaagagatg

SEQ ID NO: 1343896 - DNA, 16 bp, Homo sapiens
ttatttagttccttga

SEQ ID NO: 1343897 - DNA, 17 bp, Homo sapiens
ttatttatatgtactgt

SEQ ID NO: 1343898 - DNA, 15 bp, Homo sapiens
ttatttatatgtatg

SEQ ID NO: 1343899 - DNA, 16 bp, Homo sapiens
ttatttatatgtatgt

SEQ ID NO: 1343900 - DNA, 15 bp, Homo sapiens
ttatttatatttatt

SEQ ID NO: 1343901 - DNA, 16 bp, Homo sapiens
ttatttatatttattg

SEQ ID NO: 1343902 - DNA, 16 bp, Homo sapiens
ttatttatgtactttt

SEQ ID NO: 1343903 - DNA, 19 bp, Homo sapiens
ttatttccactaaaaatat

SEQ ID NO: 1343904 - DNA, 12 bp, Homo sapiens
ttctcaatgaaa

SEQ ID NO: 1343905 - DNA, 14 bp, Homo sapiens
ttctcaatgaaaaa

SEQ ID NO: 1343906 - DNA, 21 bp, Homo sapiens
ttctcactgccatgccagctt

SEQ ID NO: 1343907 - DNA, 13 bp, Homo sapiens
ttctcagaagcac

SEQ ID NO: 1343908 - DNA, 15 bp, Homo sapiens
ttctcattacttgtt

SEQ ID NO: 1343909 - DNA, 21 bp, Homo sapiens
ttctcattacttgttgcctat

SEQ ID NO: 1343910 - DNA, 20 bp, Homo sapiens
ttctccaaactgaagcagcc

SEQ ID NO: 1343911 - DNA, 19 bp, Homo sapiens
ttctcccaggtaccagctg

SEQ ID NO: 1343912 - DNA, 13 bp, Homo sapiens
ttctccgccagcc

SEQ ID NO: 1343913 - DNA, 15 bp, Homo sapiens
ttctccgccagcctc

SEQ ID NO: 1343914 - DNA, 20 bp, Homo sapiens
ttctccgccagcctcctctg

SEQ ID NO: 1343915 - DNA, 16 bp, Homo sapiens
ttctccgttagctcct

SEQ ID NO: 1343916 - DNA, 19 bp, Homo sapiens
ttctccgttagctcctgtg

SEQ ID NO: 1343917 - DNA, 23 bp, Homo sapiens
ttctcgtttttatagtcaatggc

SEQ ID NO: 1343918 - DNA, 17 bp, Homo sapiens
ttctctactctagggaa

SEQ ID NO: 1343919 - DNA, 14 bp, Homo sapiens
ttctctcctcccca

SEQ ID NO: 1343920 - DNA, 11 bp, Homo sapiens
ttctctgactt

SEQ ID NO: 1343921 - DNA, 17 bp, Homo sapiens
ttctctgacttctgcct

SEQ ID NO: 1343922 - DNA, 21 bp, Homo sapiens
ttctctgctatatataaaacg

SEQ ID NO: 1343923 - DNA, 13 bp, Homo sapiens
ttctctgtacttt

SEQ ID NO: 1343924 - DNA, 14 bp, Homo sapiens
ttctctgtactttt

SEQ ID NO: 1343925 - DNA, 16 bp, Homo sapiens
ttctcttgagctggcc

SEQ ID NO: 1343926 - DNA, 19 bp, Homo sapiens
ttctctttgattatttgca

SEQ ID NO: 1343927 - DNA, 13 bp, Homo sapiens
ttctgagaaaaca

SEQ ID NO: 1343928 - DNA, 21 bp, Homo sapiens
ttctgagaaaacaagcaagtt

SEQ ID NO: 1343929 - DNA, 19 bp, Homo sapiens
ttctgcattcatttttata

SEQ ID NO: 1343930 - DNA, 21 bp, Homo sapiens
ttctgcattcatttttatagc

SEQ ID NO: 1343931 - DNA, 21 bp, Homo sapiens
ttctgccaccctgctgagtct

SEQ ID NO: 1343932 - DNA, 22 bp, Homo sapiens
ttctgccagatgtcctaatggt

SEQ ID NO: 1343933 - DNA, 21 bp, Homo sapiens
ttctgccatctagccagcccc

SEQ ID NO: 1343934 - DNA, 13 bp, Homo sapiens
ttctgccctggct

SEQ ID NO: 1343935 - DNA, 17 bp, Homo sapiens
ttctgctttagacttga

SEQ ID NO: 1343936 - DNA, 19 bp, Homo sapiens
ttctgctttagacttgaaa

SEQ ID NO: 1343937 - DNA, 10 bp, Homo sapiens
ttctggctca

SEQ ID NO: 1343938 - DNA, 18 bp, Homo sapiens
ttctggctttaagccttc

SEQ ID NO: 1343939 - DNA, 17 bp, Homo sapiens
ttctggggcaggctggg

SEQ ID NO: 1343940 - DNA, 21 bp, Homo sapiens
ttctggggggacccagtgcag

SEQ ID NO: 1343941 - DNA, 15 bp, Homo sapiens
ttctggttccagggt

SEQ ID NO: 1343942 - DNA, 11 bp, Homo sapiens
ttctgtatttg

SEQ ID NO: 1343943 - DNA, 19 bp, Homo sapiens
ttctgtatttgaaagtgcc

SEQ ID NO: 1343944 - DNA, 21 bp, Homo sapiens
ttctgtccgagctttgaaaat

SEQ ID NO: 1343945 - DNA, 23 bp, Homo sapiens
ttctgtgcccagaatactgatgg

SEQ ID NO: 1343946 - DNA, 24 bp, Homo sapiens
ttctgtgcccagaatactgatgga

SEQ ID NO: 1343947 - DNA, 20 bp, Homo sapiens
ttctgtggttggctgggaaa

SEQ ID NO: 1343948 - DNA, 17 bp, Homo sapiens
ttctgtgtgtcagtttt

SEQ ID NO: 1343949 - DNA, 18 bp, Homo sapiens
ttctgtgtttataaaata

SEQ ID NO: 1343950 - DNA, 20 bp, Homo sapiens
ttctgtttttctaggcctgg

SEQ ID NO: 1343951 - DNA, 21 bp, Homo sapiens
ttcttaaaaggcccatagcag

SEQ ID NO: 1343952 - DNA, 20 bp, Homo sapiens
ttcttactaaaaagtataaa

SEQ ID NO: 1343953 - DNA, 20 bp, Homo sapiens
ttcttatgtgacattaacaa

SEQ ID NO: 1343954 - DNA, 21 bp, Homo sapiens
ttcttatgtgacattaacaaa

SEQ ID NO: 1343955 - DNA, 18 bp, Homo sapiens
ttcttcacacagacacta

SEQ ID NO: 1343956 - DNA, 15 bp, Homo sapiens
ttcttctctgtgaga

SEQ ID NO: 1343957 - DNA, 17 bp, Homo sapiens
ttcttgcctctgtgctg

SEQ ID NO: 1343958 - DNA, 16 bp, Homo sapiens
ttctttaaaagaatga

SEQ ID NO: 1343959 - DNA, 12 bp, Homo sapiens
ttctttcagaaa

SEQ ID NO: 1343960 - DNA, 21 bp, Homo sapiens
ttctttggattctaaatacat

SEQ ID NO: 1343961 - DNA, 14 bp, Homo sapiens
ttcttttaaagacc

SEQ ID NO: 1343962 - DNA, 13 bp, Homo sapiens
ttcttttggtaaa

SEQ ID NO: 1343963 - DNA, 13 bp, Homo sapiens
ttcttttgtttgg

SEQ ID NO: 1343964 - DNA, 21 bp, Homo sapiens
ttcttttttattaatcactgt

SEQ ID NO: 1343965 - DNA, 22 bp, Homo sapiens
ttcttttttttttttttgagac

SEQ ID NO: 1343966 - DNA, 13 bp, Homo sapiens
ttgaaaagagaca

SEQ ID NO: 1343967 - DNA, 17 bp, Homo sapiens
ttgaaaagtaatattta

SEQ ID NO: 1343968 - DNA, 17 bp, Homo sapiens
ttgaaagtgcctttgca

SEQ ID NO: 1343969 - DNA, 14 bp, Homo sapiens
ttgaaataaagcta

SEQ ID NO: 1343970 - DNA, 16 bp, Homo sapiens
ttgaaataagaattca

SEQ ID NO: 1343971 - DNA, 14 bp, Homo sapiens
ttgaaccataaaat

SEQ ID NO: 1343972 - DNA, 19 bp, Homo sapiens
ttgaacttttgtactgaat

SEQ ID NO: 1343973 - DNA, 19 bp, Homo sapiens
ttgaagaactgcaggccct

SEQ ID NO: 1343974 - DNA, 20 bp, Homo sapiens
ttgaagaactgcaggccctg

SEQ ID NO: 1343975 - DNA, 11 bp, Homo sapiens
ttgaagccaaa

SEQ ID NO: 1343976 - DNA, 19 bp, Homo sapiens
ttgaagggtctttctcaaa

SEQ ID NO: 1343977 - DNA, 14 bp, Homo sapiens
ttgaaggtttttga

SEQ ID NO: 1343978 - DNA, 16 bp, Homo sapiens
ttgaaggtttttgata

SEQ ID NO: 1343979 - DNA, 17 bp, Homo sapiens
ttgaagtaatgaatttt

SEQ ID NO: 1343980 - DNA, 18 bp, Homo sapiens
ttgaagtggccagatgag

SEQ ID NO: 1343981 - DNA, 14 bp, Homo sapiens
ttgaatacttgaac

SEQ ID NO: 1343982 - DNA, 23 bp, Homo sapiens
ttgaatatgattaaaaatatcaa

SEQ ID NO: 1343983 - DNA, 14 bp, Homo sapiens
ttgaatgttaaagg

SEQ ID NO: 1343984 - DNA, 22 bp, Homo sapiens
ttgaatgttaaagggatatttt

SEQ ID NO: 1343985 - DNA, 17 bp, Homo sapiens
ttgaattaaattaggaa

SEQ ID NO: 1343986 - DNA, 22 bp, Homo sapiens
ttgaattaaattaggaataaat

SEQ ID NO: 1343987 - DNA, 14 bp, Homo sapiens
ttgaatttttctct

SEQ ID NO: 1343988 - DNA, 14 bp, Homo sapiens
ttgacacaagtgga

SEQ ID NO: 1343989 - DNA, 17 bp, Homo sapiens
ttgacacaagtggacct

SEQ ID NO: 1343990 - DNA, 12 bp, Homo sapiens
ttgacactgaaa

SEQ ID NO: 1343991 - DNA, 21 bp, Homo sapiens
ttgacactgaaagttttgtaa

SEQ ID NO: 1343992 - DNA, 14 bp, Homo sapiens
ttgacactgaactt

SEQ ID NO: 1343993 - DNA, 13 bp, Homo sapiens
ttgactcatctta

SEQ ID NO: 1343994 - DNA, 17 bp, Homo sapiens
ttgactttttttgtatg

SEQ ID NO: 1343995 - DNA, 17 bp, Homo sapiens
ttgagaaaataaagcta

SEQ ID NO: 1343996 - DNA, 22 bp, Homo sapiens
ttgagaagacctcacctagaaa

SEQ ID NO: 1343997 - DNA, 22 bp, Homo sapiens
ttgagcacttttcaaacaatca

SEQ ID NO: 1343998 - DNA, 14 bp, Homo sapiens
ttgagccctggctg

SEQ ID NO: 1343999 - DNA, 11 bp, Homo sapiens
ttgagctatga

SEQ ID NO: 1344000 - DNA, 22 bp, Homo sapiens
tgcctgcagggccatggctcag

SEQ ID NO: 1344001 - DNA, 12 bp, Homo sapiens
tgcctgccccgc

SEQ ID NO: 1344002 - DNA, 11 bp, Homo sapiens
tgcctgcctta

SEQ ID NO: 1344003 - DNA, 13 bp, Homo sapiens
tgcctgctttgaa

SEQ ID NO: 1344004 - DNA, 23 bp, Homo sapiens
tgcctggggtgttagtggcaccg

SEQ ID NO: 1344005 - DNA, 22 bp, Homo sapiens
tgcctgtgtccatgcgctcagg

SEQ ID NO: 1344006 - DNA, 12 bp, Homo sapiens
tgcctgtgtgcg

SEQ ID NO: 1344007 - DNA, 18 bp, Homo sapiens
tgccttaaaaccaaagag

SEQ ID NO: 1344008 - DNA, 19 bp, Homo sapiens
tgccttaaacactcacctt

SEQ ID NO: 1344009 - DNA, 14 bp, Homo sapiens
tgccttccctagct

SEQ ID NO: 1344010 - DNA, 16 bp, Homo sapiens
tgccttccctagcttt

SEQ ID NO: 1344011 - DNA, 17 bp, Homo sapiens
tgccttccctagcttta

SEQ ID NO: 1344012 - DNA, 20 bp, Homo sapiens
tgccttcgcttcttgcctct

SEQ ID NO: 1344013 - DNA, 22 bp, Homo sapiens
tgccttcgcttcttgcctctgt

SEQ ID NO: 1344014 - DNA, 23 bp, Homo sapiens
tgccttcgcttcttgcctctgtg

SEQ ID NO: 1344015 - DNA, 20 bp, Homo sapiens
tgccttgctgtttgtcctga

SEQ ID NO: 1344016 - DNA, 19 bp, Homo sapiens
tgccttttgcaaccaggaa

SEQ ID NO: 1344017 - DNA, 15 bp, Homo sapiens
tgcctttttatttat

SEQ ID NO: 1344018 - DNA, 21 bp, Homo sapiens
tgcctttttatttatatgtac

SEQ ID NO: 1344019 - DNA, 20 bp, Homo sapiens
tgcgaagaccctcttgccca

SEQ ID NO: 1344020 - DNA, 18 bp, Homo sapiens
tgcgactttctgcctgga

SEQ ID NO: 1344021 - DNA, 21 bp, Homo sapiens
tgcgcccttaactgcatccag

SEQ ID NO: 1344022 - DNA, 14 bp, Homo sapiens
tgcgctcagggcca

SEQ ID NO: 1344023 - DNA, 15 bp, Homo sapiens
tgcgctcagggccat

SEQ ID NO: 1344024 - DNA, 19 bp, Homo sapiens
tgcgctcagggccatgctg

SEQ ID NO: 1344025 - DNA, 21 bp, Homo sapiens
tgcgctcagggccatgctgag

SEQ ID NO: 1344026 - DNA, 17 bp, Homo sapiens
tgcgctctctttgcaac

SEQ ID NO: 1344027 - DNA, 18 bp, Homo sapiens
tgcggcgtacaggctggc

SEQ ID NO: 1344028 - DNA, 14 bp, Homo sapiens
tgcgggacagagta

SEQ ID NO: 1344029 - DNA, 22 bp, Homo sapiens
tgcgtcctcctcacctcatgcc

SEQ ID NO: 1344030 - DNA, 17 bp, Homo sapiens
tgctaaataaaatttgt

SEQ ID NO: 1344031 - DNA, 21 bp, Homo sapiens
tgctaaataaaatttgttgca

SEQ ID NO: 1344032 - DNA, 22 bp, Homo sapiens
tgctaaataaaatttgttgcat

SEQ ID NO: 1344033 - DNA, 23 bp, Homo sapiens
tgctaaataaaatttgttgcata

SEQ ID NO: 1344034 - DNA, 15 bp, Homo sapiens
tgctaaatgtgaatg

SEQ ID NO: 1344035 - DNA, 18 bp, Homo sapiens
tgctactgcactccagcc

SEQ ID NO: 1344036 - DNA, 13 bp, Homo sapiens
tgctactgttgta

SEQ ID NO: 1344037 - DNA, 20 bp, Homo sapiens
tgctactgttgtaagaattc

SEQ ID NO: 1344038 - DNA, 17 bp, Homo sapiens
tgctatttgaacaagtg

SEQ ID NO: 1344039 - DNA, 12 bp, Homo sapiens
tgctatttttgt

SEQ ID NO: 1344040 - DNA, 13 bp, Homo sapiens
tgctatttttgta

SEQ ID NO: 1344041 - DNA, 17 bp, Homo sapiens
tgctatttttgtaaagt

SEQ ID NO: 1344042 - DNA, 15 bp, Homo sapiens
tgctcaaaaaatgag

SEQ ID NO: 1344043 - DNA, 14 bp, Homo sapiens
tgctcaaagaaatc

SEQ ID NO: 1344044 - DNA, 14 bp, Homo sapiens
tgctcatctgctgg

SEQ ID NO: 1344045 - DNA, 23 bp, Homo sapiens
tgctccagcaacacagcctgggc

SEQ ID NO: 1344046 - DNA, 19 bp, Homo sapiens
tgctccagctgttcagctg

SEQ ID NO: 1344047 - DNA, 20 bp, Homo sapiens
tgctccagctgttcagctgg

SEQ ID NO: 1344048 - DNA, 21 bp, Homo sapiens
tgctccagctgttcagctggt

SEQ ID NO: 1344049 - DNA, 23 bp, Homo sapiens
tgctccatagtttggcatttgca

SEQ ID NO: 1344050 - DNA, 20 bp, Homo sapiens
tgctccccacagcgtccctg

SEQ ID NO: 1344051 - DNA, 21 bp, Homo sapiens
tgctccccacagcgtccctgg

SEQ ID NO: 1344052 - DNA, 22 bp, Homo sapiens
tgctccctgtagggtccaacca

SEQ ID NO: 1344053 - DNA, 18 bp, Homo sapiens
tgctccgaggacccagga

SEQ ID NO: 1344054 - DNA, 20 bp, Homo sapiens
tgctctacaatgacacacaa

SEQ ID NO: 1344055 - DNA, 21 bp, Homo sapiens
tgctctatgctttccaaacct

SEQ ID NO: 1344056 - DNA, 17 bp, Homo sapiens
tgctcttcagatgccac

SEQ ID NO: 1344057 - DNA, 17 bp, Homo sapiens
tgctcttcatcccattc

SEQ ID NO: 1344058 - DNA, 17 bp, Homo sapiens
gttatgtttttctgtgt

SEQ ID NO: 1344059 - DNA, 14 bp, Homo sapiens
gttattgcagttta

SEQ ID NO: 1344060 - DNA, 14 bp, Homo sapiens
gttattttctacag

SEQ ID NO: 1344061 - DNA, 22 bp, Homo sapiens
gttcaaggtcactgtttcctgg

SEQ ID NO: 1344062 - DNA, 15 bp, Homo sapiens
gttcagccaaggttt

SEQ ID NO: 1344063 - DNA, 14 bp, Homo sapiens
gttcatagcccagt

SEQ ID NO: 1344064 - DNA, 21 bp, Homo sapiens
gttccaccccaagagaactcg

SEQ ID NO: 1344065 - DNA, 20 bp, Homo sapiens
gttcccttgagggctgcagt

SEQ ID NO: 1344066 - DNA, 20 bp, Homo sapiens
gttcctcaaagcttggatta

SEQ ID NO: 1344067 - DNA, 20 bp, Homo sapiens
gttcctcaaattttttgact

SEQ ID NO: 1344068 - DNA, 16 bp, Homo sapiens
gttcctctgcctgccc

SEQ ID NO: 1344069 - DNA, 13 bp, Homo sapiens
gttcctctgctca

SEQ ID NO: 1344070 - DNA, 13 bp, Homo sapiens
gttcctgtccctg

SEQ ID NO: 1344071 - DNA, 15 bp, Homo sapiens
gttcctgtccctgcg

SEQ ID NO: 1344072 - DNA, 16 bp, Homo sapiens
gttcctgtccctgcgc

SEQ ID NO: 1344073 - DNA, 13 bp, Homo sapiens
gttctactcaggc

SEQ ID NO: 1344074 - DNA, 16 bp, Homo sapiens
gttctactcaggctgg

SEQ ID NO: 1344075 - DNA, 23 bp, Homo sapiens
gttctccgttagctcctgtggcc

SEQ ID NO: 1344076 - DNA, 13 bp, Homo sapiens
gttctggccagaa

SEQ ID NO: 1344077 - DNA, 16 bp, Homo sapiens
gttctggccagaatgc

SEQ ID NO: 1344078 - DNA, 14 bp, Homo sapiens
gttctgtatttgaa

SEQ ID NO: 1344079 - DNA, 15 bp, Homo sapiens
gttctgtatttgaaa

SEQ ID NO: 1344080 - DNA, 20 bp, Homo sapiens
gttcttatgaggaggggagg

SEQ ID NO: 1344081 - DNA, 22 bp, Homo sapiens
gttcttggcaataaattttgaa

SEQ ID NO: 1344082 - DNA, 23 bp, Homo sapiens
gttctttaaactgtcgtgtcata

SEQ ID NO: 1344083 - DNA, 12 bp, Homo sapiens
gttctttcagaa

SEQ ID NO: 1344084 - DNA, 15 bp, Homo sapiens
gttcttttaagccca

SEQ ID NO: 1344085 - DNA, 15 bp, Homo sapiens
gttgacaactgtgac

SEQ ID NO: 1344086 - DNA, 15 bp, Homo sapiens
gttgcaagatgtgaa

SEQ ID NO: 1344087 - DNA, 13 bp, Homo sapiens
gttgcatggaaat

SEQ ID NO: 1344088 - DNA, 14 bp, Homo sapiens
gttgcatggaaatc

SEQ ID NO: 1344089 - DNA, 23 bp, Homo sapiens
gttgcattttaaccctattttac

SEQ ID NO: 1344090 - DNA, 19 bp, Homo sapiens
gttgccaagctccaagccc

SEQ ID NO: 1344091 - DNA, 23 bp, Homo sapiens
gttgctctatgctttccaaacct

SEQ ID NO: 1344092 - DNA, 13 bp, Homo sapiens
gttgcttgtcttc

SEQ ID NO: 1344093 - DNA, 14 bp, Homo sapiens
gttgcttgtcttct

SEQ ID NO: 1344094 - DNA, 22 bp, Homo sapiens
gttggaggtgattccagtgaag

SEQ ID NO: 1344095 - DNA, 18 bp, Homo sapiens
gttggcaaaaaggcagga

SEQ ID NO: 1344096 - DNA, 14 bp, Homo sapiens
gttggcaggctggc

SEQ ID NO: 1344097 - DNA, 16 bp, Homo sapiens
gttggcaggctggcca

SEQ ID NO: 1344098 - DNA, 16 bp, Homo sapiens
gttgtaaaccaagtga

SEQ ID NO: 1344099 - DNA, 21 bp, Homo sapiens
gttgtaaagtatgtattattt

SEQ ID NO: 1344100 - DNA, 16 bp, Homo sapiens
gttgtatttaacagaa

SEQ ID NO: 1344101 - DNA, 14 bp, Homo sapiens
gttgtctggcaagg

SEQ ID NO: 1344102 - DNA, 16 bp, Homo sapiens
gttgtgttttttaaga

SEQ ID NO: 1344103 - DNA, 21 bp, Homo sapiens
gttgttcttggcaataaattt

SEQ ID NO: 1344104 - DNA, 15 bp, Homo sapiens
gttgttctttcagaa

SEQ ID NO: 1344105 - DNA, 21 bp, Homo sapiens
gttgtttttgtatattggttt

SEQ ID NO: 1344106 - DNA, 20 bp, Homo sapiens
gtttaaaaaccgaataaatg

SEQ ID NO: 1344107 - DNA, 22 bp, Homo sapiens
gtttaaaataaaatgaaaattg

SEQ ID NO: 1344108 - DNA, 19 bp, Homo sapiens
gtttaaaatgtaatttaaa

SEQ ID NO: 1344109 - DNA, 15 bp, Homo sapiens
gtttatcattcaagt

SEQ ID NO: 1344110 - DNA, 20 bp, Homo sapiens
gtttatcattcaagtgtaaa

SEQ ID NO: 1344111 - DNA, 15 bp, Homo sapiens
gtttattttaaaaca

SEQ ID NO: 1344112 - DNA, 18 bp, Homo sapiens
gtttcagcgactccgttg

SEQ ID NO: 1344113 - DNA, 15 bp, Homo sapiens
gtttcagtttgttgg

SEQ ID NO: 1344114 - DNA, 18 bp, Homo sapiens
gtttcagtttgttggaaa

SEQ ID NO: 1344115 - DNA, 20 bp, Homo sapiens
gtttccagacttccttgaga

SEQ ID NO: 1344116 - DNA, 20 bp, Homo sapiens
gtttcctccatttgagaaaa

SEQ ID NO: 1344117 - DNA, 17 bp, Homo sapiens
gtttcctgacattgtct

SEQ ID NO: 1344118 - DNA, 19 bp, Homo sapiens
gtttcctggcactggaccc

SEQ ID NO: 1344119 - DNA, 17 bp, Homo sapiens
gtttcgaagtcattaaa

SEQ ID NO: 1344120 - DNA, 15 bp, Homo sapiens
gtttcgttatattaa

SEQ ID NO: 1344121 - DNA, 17 bp, Homo sapiens
gtttctattttttgaaa

SEQ ID NO: 1344122 - DNA, 18 bp, Homo sapiens
gtttctccaaactgaagc

SEQ ID NO: 1344123 - DNA, 18 bp, Homo sapiens
gtttctcctgagctagga

SEQ ID NO: 1344124 - DNA, 21 bp, Homo sapiens
gtttctctttgattatttgca

SEQ ID NO: 1344125 - DNA, 18 bp, Homo sapiens
gtttctggtggtctgttg

SEQ ID NO: 1344126 - DNA, 21 bp, Homo sapiens
gtttctggtggtctgttggca

SEQ ID NO: 1344127 - DNA, 21 bp, Homo sapiens
gtttctgtggttggctgggaa

SEQ ID NO: 1344128 - DNA, 21 bp, Homo sapiens
gtttctttaaccttgtataaa

SEQ ID NO: 1344129 - DNA, 19 bp, Homo sapiens
gtttctttattttgtgtaa

SEQ ID NO: 1344130 - DNA, 14 bp, Homo sapiens
gtttcttttaaaga

SEQ ID NO: 1344131 - DNA, 14 bp, Homo sapiens
gtttcttttgtttg

SEQ ID NO: 1344132 - DNA, 18 bp, Homo sapiens
gtttgaaaacttcagaag

SEQ ID NO: 1344133 - DNA, 13 bp, Homo sapiens
gtttgaaaatagt

SEQ ID NO: 1344134 - DNA, 18 bp, Homo sapiens
gtttgagatcagcctggg

SEQ ID NO: 1344135 - DNA, 14 bp, Homo sapiens
gtttgagctgcctt

SEQ ID NO: 1344136 - DNA, 22 bp, Homo sapiens
gtttgaggattagtttagaaca

SEQ ID NO: 1344137 - DNA, 12 bp, Homo sapiens
gtttgtttttgg

SEQ ID NO: 1344138 - DNA, 18 bp, Homo sapiens
gttttaaaactggacctg

SEQ ID NO: 1344139 - DNA, 21 bp, Homo sapiens
gttttaaaactggacctgtat

SEQ ID NO: 1344140 - DNA, 18 bp, Homo sapiens
gttttaaggactgactga

SEQ ID NO: 1344141 - DNA, 13 bp, Homo sapiens
gttttacaatagt

SEQ ID NO: 1344142 - DNA, 16 bp, Homo sapiens
gttttacaatagttct

SEQ ID NO: 1344143 - DNA, 20 bp, Homo sapiens
gttttacaatagttctgtgg

SEQ ID NO: 1344144 - DNA, 16 bp, Homo sapiens
gttttactgcagcttt

SEQ ID NO: 1344145 - DNA, 18 bp, Homo sapiens
gttttactgcagctttgt

SEQ ID NO: 1344146 - DNA, 16 bp, Homo sapiens
gttttataatccttaa

SEQ ID NO: 1344147 - DNA, 18 bp, Homo sapiens
gttttatagcctggactg

SEQ ID NO: 1344148 - DNA, 20 bp, Homo sapiens
gttttatggttacttcttct

SEQ ID NO: 1344149 - DNA, 14 bp, Homo sapiens
gttttatttatatt

SEQ ID NO: 1344150 - DNA, 22 bp, Homo sapiens
gttttcatttactctaaaaact

SEQ ID NO: 1344151 - DNA, 23 bp, Homo sapiens
gttttggctgaaattctcctgga

SEQ ID NO: 1344152 - DNA, 16 bp, Homo sapiens
gttttgtaaacattta

SEQ ID NO: 1344153 - DNA, 17 bp, Homo sapiens
gttttgtaaacatttat

SEQ ID NO: 1344154 - DNA, 19 bp, Homo sapiens
gttttgtacatgtaacatt

SEQ ID NO: 1344155 - DNA, 24 bp, Homo sapiens
gttttgtcaaactgtagaaatgat

SEQ ID NO: 1344156 - DNA, 16 bp, Homo sapiens
gtttttattaaaacat

SEQ ID NO: 1344157 - DNA, 18 bp, Homo sapiens
gtttttctaggcctgggg

SEQ ID NO: 1344158 - DNA, 18 bp, Homo sapiens
gtttttctgctttagact

SEQ ID NO: 1344159 - DNA, 22 bp, Homo sapiens
gtttttctgctttagacttgaa

SEQ ID NO: 1344160 - DNA, 19 bp, Homo sapiens
gttttttaagatagtgtaa

SEQ ID NO: 1344161 - DNA, 19 bp, Homo sapiens
taaaaaaaaagtcagagac

SEQ ID NO: 1344162 - DNA, 20 bp, Homo sapiens
taaaaaaataataataatgt

SEQ ID NO: 1344163 - DNA, 18 bp, Homo sapiens
taaaaaagctcttttaat

SEQ ID NO: 1344164 - DNA, 18 bp, Homo sapiens
taaaaaccgaataaatgt

SEQ ID NO: 1344165 - DNA, 18 bp, Homo sapiens
taaaaaggagtatacaaa

SEQ ID NO: 1344166 - DNA, 20 bp, Homo sapiens
taaaaaggagtatacaaaca

SEQ ID NO: 1344167 - DNA, 18 bp, Homo sapiens
taaaaagtattttttcaa

SEQ ID NO: 1344168 - DNA, 14 bp, Homo sapiens
tgagaaaacaagca

SEQ ID NO: 1344169 - DNA, 15 bp, Homo sapiens
tgagaaaataaagct

SEQ ID NO: 1344170 - DNA, 15 bp, Homo sapiens
tgagaaggtttattg

SEQ ID NO: 1344171 - DNA, 17 bp, Homo sapiens
tgagaaggtttattgtt

SEQ ID NO: 1344172 - DNA, 19 bp, Homo sapiens
tgagaaggtttattgttaa

SEQ ID NO: 1344173 - DNA, 18 bp, Homo sapiens
tgagaagtgaatgctggg

SEQ ID NO: 1344174 - DNA, 22 bp, Homo sapiens
tgagacacggagcccagccctc

SEQ ID NO: 1344175 - DNA, 14 bp, Homo sapiens
tgagaccaacctgg

SEQ ID NO: 1344176 - DNA, 20 bp, Homo sapiens
tgagaccgtgaagatacttt

SEQ ID NO: 1344177 - DNA, 23 bp, Homo sapiens
tgagaccgtgaagatactttgta

SEQ ID NO: 1344178 - DNA, 15 bp, Homo sapiens
tgagactcagtgcag

SEQ ID NO: 1344179 - DNA, 16 bp, Homo sapiens
tgagactcagtgcaga

SEQ ID NO: 1344180 - DNA, 17 bp, Homo sapiens
tgagactcagtgcagat

SEQ ID NO: 1344181 - DNA, 18 bp, Homo sapiens
tgagactcagtgcagatg

SEQ ID NO: 1344182 - DNA, 21 bp, Homo sapiens
tgagactgtgctgttgttctc

SEQ ID NO: 1344183 - DNA, 13 bp, Homo sapiens
tgagagcataatt

SEQ ID NO: 1344184 - DNA, 15 bp, Homo sapiens
tgagatcagcctggg

SEQ ID NO: 1344185 - DNA, 21 bp, Homo sapiens
tgagatggaaaagtgtccttc

SEQ ID NO: 1344186 - DNA, 13 bp, Homo sapiens
tgagatgtaaaaa

SEQ ID NO: 1344187 - DNA, 22 bp, Homo sapiens
tgagattctcaaaggagcgagc

SEQ ID NO: 1344188 - DNA, 13 bp, Homo sapiens
tgagattggtttt

SEQ ID NO: 1344189 - DNA, 21 bp, Homo sapiens
tgagccagtgctttaatggca

SEQ ID NO: 1344190 - DNA, 20 bp, Homo sapiens
tgagccctactccctgcaga

SEQ ID NO: 1344191 - DNA, 13 bp, Homo sapiens
tgagccctggctg

SEQ ID NO: 1344192 - DNA, 16 bp, Homo sapiens
tgagccgggcccctgg

SEQ ID NO: 1344193 - DNA, 20 bp, Homo sapiens
tgagccgggcccctgggctt

SEQ ID NO: 1344194 - DNA, 14 bp, Homo sapiens
tgagcctctgctcc

SEQ ID NO: 1344195 - DNA, 17 bp, Homo sapiens
tgagcctctgctcccca

SEQ ID NO: 1344196 - DNA, 11 bp, Homo sapiens
tgagcctggca

SEQ ID NO: 1344197 - DNA, 16 bp, Homo sapiens
tgagcctgggaaataa

SEQ ID NO: 1344198 - DNA, 19 bp, Homo sapiens
tgagcctgggaggtcaagg

SEQ ID NO: 1344199 - DNA, 18 bp, Homo sapiens
tgagcgcctccatccaag

SEQ ID NO: 1344200 - DNA, 19 bp, Homo sapiens
tgagctatgacttaacata

SEQ ID NO: 1344201 - DNA, 12 bp, Homo sapiens
tgagctgccagt

SEQ ID NO: 1344202 - DNA, 14 bp, Homo sapiens
tgagctgccagtgg

SEQ ID NO: 1344203 - DNA, 15 bp, Homo sapiens
tgagctgccttccct

SEQ ID NO: 1344204 - DNA, 17 bp, Homo sapiens
tgagctgccttccctag

SEQ ID NO: 1344205 - DNA, 19 bp, Homo sapiens
tgagctgccttccctagct

SEQ ID NO: 1344206 - DNA, 10 bp, Homo sapiens
tgagctggcc

SEQ ID NO: 1344207 - DNA, 16 bp, Homo sapiens
tgaggaaatcaaagtg

SEQ ID NO: 1344208 - DNA, 18 bp, Homo sapiens
tgaggatattcagatgta

SEQ ID NO: 1344209 - DNA, 20 bp, Homo sapiens
tgaggattagtttagaacag

SEQ ID NO: 1344210 - DNA, 14 bp, Homo sapiens
tgaggcagtttgag

SEQ ID NO: 1344211 - DNA, 21 bp, Homo sapiens
tgaggccaagaatattgcaaa

SEQ ID NO: 1344212 - DNA, 14 bp, Homo sapiens
tgaggccgttgctg

SEQ ID NO: 1344213 - DNA, 17 bp, Homo sapiens
tgaggccgttgctgact

SEQ ID NO: 1344214 - DNA, 22 bp, Homo sapiens
tgaggccgttgctgacttagaa

SEQ ID NO: 1344215 - DNA, 13 bp, Homo sapiens
tgaggcttagaga

SEQ ID NO: 1344216 - DNA, 22 bp, Homo sapiens
tgagggacgtcagacttggctc

SEQ ID NO: 1344217 - DNA, 18 bp, Homo sapiens
tgagggcagactggggca

SEQ ID NO: 1344218 - DNA, 13 bp, Homo sapiens
tgagggctgcagt

SEQ ID NO: 1344219 - DNA, 22 bp, Homo sapiens
tgaggtgggaggtggaagaagg

SEQ ID NO: 1344220 - DNA, 14 bp, Homo sapiens
tgaggttcctctgc

SEQ ID NO: 1344221 - DNA, 15 bp, Homo sapiens
tgaggttcctctgcc

SEQ ID NO: 1344222 - DNA, 21 bp, Homo sapiens
tgaggttcctctgcctgcccc

SEQ ID NO: 1344223 - DNA, 14 bp, Homo sapiens
tgagtagagttgat

SEQ ID NO: 1344224 - DNA, 21 bp, Homo sapiens
tgagtagatccatttccattg

SEQ ID NO: 1344225 - DNA, 23 bp, Homo sapiens
tgagtcactatgggatgagaaaa

SEQ ID NO: 1344226 - DNA, 19 bp, Homo sapiens
tgagtccagaagtttgaga

SEQ ID NO: 1344227 - DNA, 18 bp, Homo sapiens
tgagtccttgatttcaaa

SEQ ID NO: 1344228 - DNA, 13 bp, Homo sapiens
tgagtggcagggg

SEQ ID NO: 1344229 - DNA, 21 bp, Homo sapiens
tgagtggcaggggacaggagt

SEQ ID NO: 1344230 - DNA, 14 bp, Homo sapiens
tgagtgggaagccc

SEQ ID NO: 1344231 - DNA, 21 bp, Homo sapiens
tgagtgggggatcacagcctc

SEQ ID NO: 1344232 - DNA, 21 bp, Homo sapiens
tgagtgggtgaataatacagt

SEQ ID NO: 1344233 - DNA, 14 bp, Homo sapiens
tgagttgtttttgt

SEQ ID NO: 1344234 - DNA, 15 bp, Homo sapiens
tgagttgtttttgta

SEQ ID NO: 1344235 - DNA, 20 bp, Homo sapiens
tgagttgtttttgtatattg

SEQ ID NO: 1344236 - DNA, 16 bp, Homo sapiens
tctttaaaaggaaaga

SEQ ID NO: 1344237 - DNA, 19 bp, Homo sapiens
tctttacctgtatacagtg

SEQ ID NO: 1344238 - DNA, 23 bp, Homo sapiens
tctttagtttttggttgggaatg

SEQ ID NO: 1344239 - DNA, 20 bp, Homo sapiens
tctttcaagcagtcgtgcct

SEQ ID NO: 1344240 - DNA, 21 bp, Homo sapiens
tctttcaagcagtcgtgcctg

SEQ ID NO: 1344241 - DNA, 11 bp, Homo sapiens
tctttcagaaa

SEQ ID NO: 1344242 - DNA, 23 bp, Homo sapiens
tctttcagaaatataacacattt

SEQ ID NO: 1344243 - DNA, 21 bp, Homo sapiens
tctttcagtacttttttaaat

SEQ ID NO: 1344244 - DNA, 23 bp, Homo sapiens
tctttcagtacttttttaaatat

SEQ ID NO: 1344245 - DNA, 15 bp, Homo sapiens
tctttctcaaagaaa

SEQ ID NO: 1344246 - DNA, 12 bp, Homo sapiens
tctttgagaggg

SEQ ID NO: 1344247 - DNA, 13 bp, Homo sapiens
tctttgatgtgtt

SEQ ID NO: 1344248 - DNA, 17 bp, Homo sapiens
tctttgattatttgcat

SEQ ID NO: 1344249 - DNA, 20 bp, Homo sapiens
tctttgattatttgcatgtt

SEQ ID NO: 1344250 - DNA, 17 bp, Homo sapiens
tctttggacactcacac

SEQ ID NO: 1344251 - DNA, 23 bp, Homo sapiens
tctttgttcatagcccagtagac

SEQ ID NO: 1344252 - DNA, 12 bp, Homo sapiens
tcttttgaagca

SEQ ID NO: 1344253 - DNA, 16 bp, Homo sapiens
tcttttgattatgttt

SEQ ID NO: 1344254 - DNA, 13 bp, Homo sapiens
tcttttgcttttg

SEQ ID NO: 1344255 - DNA, 20 bp, Homo sapiens
tctttttaaaaattgttatt

SEQ ID NO: 1344256 - DNA, 16 bp, Homo sapiens
tctttttgttgtaaaa

SEQ ID NO: 1344257 - DNA, 12 bp, Homo sapiens
tctttttgtttg

SEQ ID NO: 1344258 - DNA, 16 bp, Homo sapiens
tcttttttattaatca

SEQ ID NO: 1344259 - DNA, 24 bp, Homo sapiens
tcttttttattaatcactgtgtat

SEQ ID NO: 1344260 - DNA, 13 bp, Homo sapiens
tgaaaaactgagt

SEQ ID NO: 1344261 - DNA, 16 bp, Homo sapiens
tgaaaaaggaggaaga

SEQ ID NO: 1344262 - DNA, 22 bp, Homo sapiens
tgaaaaatataaaattatgaga

SEQ ID NO: 1344263 - DNA, 18 bp, Homo sapiens
tgaaaaatcggcttacca

SEQ ID NO: 1344264 - DNA, 20 bp, Homo sapiens
tgaaaacggagctgaacaat

SEQ ID NO: 1344265 - DNA, 15 bp, Homo sapiens
tgaaaacttcagaag

SEQ ID NO: 1344266 - DNA, 22 bp, Homo sapiens
tgaaaagaaaaatgagcctggc

SEQ ID NO: 1344267 - DNA, 14 bp, Homo sapiens
tgaaaagattcttc

SEQ ID NO: 1344268 - DNA, 18 bp, Homo sapiens
tgaaaagtaatatttatt

SEQ ID NO: 1344269 - DNA, 14 bp, Homo sapiens
tgaaaagtgtgtat

SEQ ID NO: 1344270 - DNA, 19 bp, Homo sapiens
tgaaaagtgtgtatatatt

SEQ ID NO: 1344271 - DNA, 12 bp, Homo sapiens
tgaaaatacaac

SEQ ID NO: 1344272 - DNA, 18 bp, Homo sapiens
tgaaaatagtttatttta

SEQ ID NO: 1344273 - DNA, 22 bp, Homo sapiens
tgaaaatagtttattttaaaac

SEQ ID NO: 1344274 - DNA, 16 bp, Homo sapiens
tgaaaatattgtttta

SEQ ID NO: 1344275 - DNA, 23 bp, Homo sapiens
tgaaaatattgttttacaatagt

SEQ ID NO: 1344276 - DNA, 17 bp, Homo sapiens
tgaaaccccaaacagtg

SEQ ID NO: 1344277 - DNA, 19 bp, Homo sapiens
tgaaaccccaaacagtgac

SEQ ID NO: 1344278 - DNA, 16 bp, Homo sapiens
gtgagtggttgaatat

SEQ ID NO: 1344279 - DNA, 18 bp, Homo sapiens
gtgatcccgttttcccca

SEQ ID NO: 1344280 - DNA, 16 bp, Homo sapiens
gtgatggtgtagccct

SEQ ID NO: 1344281 - DNA, 14 bp, Homo sapiens
gtgatgtttgtcct

SEQ ID NO: 1344282 - DNA, 19 bp, Homo sapiens
gtgattaaagctaaggacc

SEQ ID NO: 1344283 - DNA, 22 bp, Homo sapiens
gtgattccactacacctggctg

SEQ ID NO: 1344284 - DNA, 17 bp, Homo sapiens
gtgatttgaaaaatata

SEQ ID NO: 1344285 - DNA, 12 bp, Homo sapiens
gtgattttcatt

SEQ ID NO: 1344286 - DNA, 17 bp, Homo sapiens
gtgcaaaaccttttact

SEQ ID NO: 1344287 - DNA, 14 bp, Homo sapiens
gtgcaacagggtat

SEQ ID NO: 1344288 - DNA, 21 bp, Homo sapiens
gtgcacatccgcgtgtgcctg

SEQ ID NO: 1344289 - DNA, 12 bp, Homo sapiens
gtgcagaatgta

SEQ ID NO: 1344290 - DNA, 13 bp, Homo sapiens
gtgcagaatgtaa

SEQ ID NO: 1344291 - DNA, 14 bp, Homo sapiens
gtgcagtcactgga

SEQ ID NO: 1344292 - DNA, 15 bp, Homo sapiens
gtgcatggtggccag

SEQ ID NO: 1344293 - DNA, 23 bp, Homo sapiens
gtgcatttgtgctagaaattttc

SEQ ID NO: 1344294 - DNA, 20 bp, Homo sapiens
gtgccagaggaatcctggca

SEQ ID NO: 1344295 - DNA, 22 bp, Homo sapiens
gtgccgagaaggaagcctccca

SEQ ID NO: 1344296 - DNA, 13 bp, Homo sapiens
gtgccgtggcacc

SEQ ID NO: 1344297 - DNA, 20 bp, Homo sapiens
gtgcctccctccccagtgca

SEQ ID NO: 1344298 - DNA, 16 bp, Homo sapiens
gtgcctgagaggcagg

SEQ ID NO: 1344299 - DNA, 17 bp, Homo sapiens
gtgcctgagaggcaggc

SEQ ID NO: 1344300 - DNA, 11 bp, Homo sapiens
gtgcctggggt

SEQ ID NO: 1344301 - DNA, 24 bp, Homo sapiens
gtgcgcatcttgcctccaggtgca

SEQ ID NO: 1344302 - DNA, 15 bp, Homo sapiens
gtgcgctctgtggat

SEQ ID NO: 1344303 - DNA, 24 bp, Homo sapiens
gtgctattacgaagttcaagatca

SEQ ID NO: 1344304 - DNA, 16 bp, Homo sapiens
gtgctcagaagggcta

SEQ ID NO: 1344305 - DNA, 15 bp, Homo sapiens
gtgctgctgctgctg

SEQ ID NO: 1344306 - DNA, 16 bp, Homo sapiens
gtgctgggagctccac

SEQ ID NO: 1344307 - DNA, 22 bp, Homo sapiens
gtgctgggagctccactctgct

SEQ ID NO: 1344308 - DNA, 17 bp, Homo sapiens
gtgctgggaggagggag

SEQ ID NO: 1344309 - DNA, 18 bp, Homo sapiens
gtgctgggaggagggaga

SEQ ID NO: 1344310 - DNA, 14 bp, Homo sapiens
gtgctgtgagggag

SEQ ID NO: 1344311 - DNA, 11 bp, Homo sapiens
gtgctgtgtgt

SEQ ID NO: 1344312 - DNA, 22 bp, Homo sapiens
gtgcttctgccaccctgctgag

SEQ ID NO: 1344313 - DNA, 19 bp, Homo sapiens
gtgcttttatagaggctag

SEQ ID NO: 1344314 - DNA, 15 bp, Homo sapiens
gtggaagaagggaga

SEQ ID NO: 1344315 - DNA, 18 bp, Homo sapiens
gtggaagaagggagaaga

SEQ ID NO: 1344316 - DNA, 13 bp, Homo sapiens
gtggaagcaacca

SEQ ID NO: 1344317 - DNA, 17 bp, Homo sapiens
gtggaccttaggccttc

SEQ ID NO: 1344318 - DNA, 20 bp, Homo sapiens
gtggactgagtgggaagccc

SEQ ID NO: 1344319 - DNA, 14 bp, Homo sapiens
gtggactgtggcac

SEQ ID NO: 1344320 - DNA, 21 bp, Homo sapiens
gtggactgtggcacttgcctg

SEQ ID NO: 1344321 - DNA, 20 bp, Homo sapiens
gtggagaagcggctggcagc

SEQ ID NO: 1344322 - DNA, 19 bp, Homo sapiens
gtggaggaggaaggcaaga

SEQ ID NO: 1344323 - DNA, 16 bp, Homo sapiens
gtggaggggtgtggca

SEQ ID NO: 1344324 - DNA, 23 bp, Homo sapiens
gtggaggggtgtggcagtggttt

SEQ ID NO: 1344325 - DNA, 21 bp, Homo sapiens
gtggatcagagatgcaccacc

SEQ ID NO: 1344326 - DNA, 18 bp, Homo sapiens
gtggattttgtttaaaaa

SEQ ID NO: 1344327 - DNA, 16 bp, Homo sapiens
gtggcaatctgtgggc

SEQ ID NO: 1344328 - DNA, 14 bp, Homo sapiens
gtggcaccagcagc

SEQ ID NO: 1344329 - DNA, 17 bp, Homo sapiens
gtggcacttgcctgggt

SEQ ID NO: 1344330 - DNA, 17 bp, Homo sapiens
gtggccaagaagcagtg

SEQ ID NO: 1344331 - DNA, 17 bp, Homo sapiens
gtggccacagcgccagc

SEQ ID NO: 1344332 - DNA, 13 bp, Homo sapiens
gtggccagaggtg

SEQ ID NO: 1344333 - DNA, 19 bp, Homo sapiens
gtggccagaggtgtcaccc

SEQ ID NO: 1344334 - DNA, 21 bp, Homo sapiens
gtggccaggctgcctggcctt

SEQ ID NO: 1344335 - DNA, 23 bp, Homo sapiens
gtggccccgtttctggtggtctg

SEQ ID NO: 1344336 - DNA, 21 bp, Homo sapiens
gtggcgccgtctccaggggct

SEQ ID NO: 1344337 - DNA, 15 bp, Homo sapiens
gtggcggccccagca

SEQ ID NO: 1344338 - DNA, 14 bp, Homo sapiens
gtggctcacgcctg

SEQ ID NO: 1344339 - DNA, 12 bp, Homo sapiens
gtggctggaaga

SEQ ID NO: 1344340 - DNA, 17 bp, Homo sapiens
gtggctggaagatcctg

SEQ ID NO: 1344341 - DNA, 22 bp, Homo sapiens
gtggctgtcaatgggacctgtg

SEQ ID NO: 1344342 - DNA, 21 bp, Homo sapiens
gtggctgttgacgcacctgtg

SEQ ID NO: 1344343 - DNA, 23 bp, Homo sapiens
gtgggaggatctcttgagcctgg

SEQ ID NO: 1344344 - DNA, 15 bp, Homo sapiens
gtgggccagtctgtg

SEQ ID NO: 1344345 - DNA, 16 bp, Homo sapiens
gtgggccagtctgtgg

SEQ ID NO: 1344346 - DNA, 17 bp, Homo sapiens
gtgggccagtctgtgga

SEQ ID NO: 1344347 - DNA, 16 bp, Homo sapiens
gtgggctacatgctgg

SEQ ID NO: 1344348 - DNA, 19 bp, Homo sapiens
gtgggctacatgctggggt

SEQ ID NO: 1344349 - DNA, 18 bp, Homo sapiens
gtgggctctgtgcagtca

SEQ ID NO: 1344350 - DNA, 19 bp, Homo sapiens
gtgggctggacttctacct

SEQ ID NO: 1344351 - DNA, 20 bp, Homo sapiens
gtgggggatcacagcctctg

SEQ ID NO: 1344352 - DNA, 16 bp, Homo sapiens
gtggggtgtgctggga

SEQ ID NO: 1344353 - DNA, 14 bp, Homo sapiens
gtggggtttcctgg

SEQ ID NO: 1344354 - DNA, 18 bp, Homo sapiens
gtgggtcctgaggcctgc

SEQ ID NO: 1344355 - DNA, 13 bp, Homo sapiens
gtggtagagaagc

SEQ ID NO: 1344356 - DNA, 15 bp, Homo sapiens
gtggtcacagcggag

SEQ ID NO: 1344357 - DNA, 16 bp, Homo sapiens
gtggtcacagcggagg

SEQ ID NO: 1344358 - DNA, 19 bp, Homo sapiens
gtggtctgttggcaggctg

SEQ ID NO: 1344359 - DNA, 20 bp, Homo sapiens
gtggtctgttggcaggctgg

SEQ ID NO: 1344360 - DNA, 22 bp, Homo sapiens
gtggtctgttggcaggctggcc

SEQ ID NO: 1344361 - DNA, 17 bp, Homo sapiens
gtggtgccatccccagg

SEQ ID NO: 1344362 - DNA, 16 bp, Homo sapiens
gtggttcctctgctca

SEQ ID NO: 1344363 - DNA, 15 bp, Homo sapiens
gtgtaaaaaaaccac

SEQ ID NO: 1344364 - DNA, 15 bp, Homo sapiens
gtgtaatttgaagat

SEQ ID NO: 1344365 - DNA, 13 bp, Homo sapiens
gtgtatatttgat

SEQ ID NO: 1344366 - DNA, 14 bp, Homo sapiens
gtgtatatttgatt

SEQ ID NO: 1344367 - DNA, 18 bp, Homo sapiens
gtgtccatgcgctcaggg

SEQ ID NO: 1344368 - DNA, 14 bp, Homo sapiens
gtgtcccaggcagg

SEQ ID NO: 1344369 - DNA, 19 bp, Homo sapiens
gtgtccccgctgctgtgca

SEQ ID NO: 1344370 - DNA, 18 bp, Homo sapiens
gtgtctggaattgtggct

SEQ ID NO: 1344371 - DNA, 16 bp, Homo sapiens
gtgtcttgggcagagc

SEQ ID NO: 1344372 - DNA, 17 bp, Homo sapiens
gtgtcttgggcagagct

SEQ ID NO: 1344373 - DNA, 11 bp, Homo sapiens
gtgtgctggga

SEQ ID NO: 1344374 - DNA, 12 bp, Homo sapiens
gtgtggcagtgg

SEQ ID NO: 1344375 - DNA, 12 bp, Homo sapiens
gtgtgggaaagc

SEQ ID NO: 1344376 - DNA, 11 bp, Homo sapiens
gtgtgtaaaca

SEQ ID NO: 1344377 - DNA, 16 bp, Homo sapiens
gtgtgttgtctcttga

SEQ ID NO: 1344378 - DNA, 16 bp, Homo sapiens
gtgttaatttaagttt

SEQ ID NO: 1344379 - DNA, 21 bp, Homo sapiens
gtgttagtggcaccgcctccc

SEQ ID NO: 1344380 - DNA, 14 bp, Homo sapiens
gtgttatatgaaca

SEQ ID NO: 1344381 - DNA, 23 bp, Homo sapiens
gtgttatatgaacatacaaatgc

SEQ ID NO: 1344382 - DNA, 14 bp, Homo sapiens
gtgttgccaagctc

SEQ ID NO: 1344383 - DNA, 15 bp, Homo sapiens
gtgttgtctcttgag

SEQ ID NO: 1344384 - DNA, 13 bp, Homo sapiens
gtgtttataaaat

SEQ ID NO: 1344385 - DNA, 14 bp, Homo sapiens
ggtcgctcctgccc

SEQ ID NO: 1344386 - DNA, 23 bp, Homo sapiens
ggtctcacccatgcaagcagagg

SEQ ID NO: 1344387 - DNA, 13 bp, Homo sapiens
ggtctccctggct

SEQ ID NO: 1344388 - DNA, 14 bp, Homo sapiens
ggtctccctggctc

SEQ ID NO: 1344389 - DNA, 22 bp, Homo sapiens
ggtctgtgtgtgtgtgtgtgcg

SEQ ID NO: 1344390 - DNA, 16 bp, Homo sapiens
ggtctgttggcaggct

SEQ ID NO: 1344391 - DNA, 20 bp, Homo sapiens
ggtctgttggcaggctggcc

SEQ ID NO: 1344392 - DNA, 14 bp, Homo sapiens
ggtcttaagaaatg

SEQ ID NO: 1344393 - DNA, 15 bp, Homo sapiens
ggtgaggcaataaaa

SEQ ID NO: 1344394 - DNA, 19 bp, Homo sapiens
ggtgcagaggtaccctggg

SEQ ID NO: 1344395 - DNA, 16 bp, Homo sapiens
ggtgccactttaccca

SEQ ID NO: 1344396 - DNA, 22 bp, Homo sapiens
ggtgccatgaagggaccctttg

SEQ ID NO: 1344397 - DNA, 17 bp, Homo sapiens
ggtgcccaagccagagg

SEQ ID NO: 1344398 - DNA, 18 bp, Homo sapiens
ggtgcccaagccagaggc

SEQ ID NO: 1344399 - DNA, 22 bp, Homo sapiens
ggtgcccaagccagaggctggg

SEQ ID NO: 1344400 - DNA, 15 bp, Homo sapiens
ggtgcctgagaggca

SEQ ID NO: 1344401 - DNA, 17 bp, Homo sapiens
ggtgcctgagaggcagg

SEQ ID NO: 1344402 - DNA, 18 bp, Homo sapiens
ggtgcctgagaggcaggc

SEQ ID NO: 1344403 - DNA, 21 bp, Homo sapiens
ggtgctcggagaagagcgcag

SEQ ID NO: 1344404 - DNA, 21 bp, Homo sapiens
ggtgctgcagcaccgaggggc

SEQ ID NO: 1344405 - DNA, 21 bp, Homo sapiens
ggtgcttttatagaggctagc

SEQ ID NO: 1344406 - DNA, 22 bp, Homo sapiens
ggtggatcacgaggtcaggaga

SEQ ID NO: 1344407 - DNA, 14 bp, Homo sapiens
ggtggatggcccca

SEQ ID NO: 1344408 - DNA, 22 bp, Homo sapiens
ggtggatggccccagcacagct

SEQ ID NO: 1344409 - DNA, 12 bp, Homo sapiens
gtagttgaatgg

SEQ ID NO: 1344410 - DNA, 20 bp, Homo sapiens
gtataaaatacatagtgaaa

SEQ ID NO: 1344411 - DNA, 22 bp, Homo sapiens
gtataaaatacatagtgaaaat

SEQ ID NO: 1344412 - DNA, 12 bp, Homo sapiens
gtataaatatac

SEQ ID NO: 1344413 - DNA, 13 bp, Homo sapiens
gtataatataaaa

SEQ ID NO: 1344414 - DNA, 14 bp, Homo sapiens
gtataatataaaaa

SEQ ID NO: 1344415 - DNA, 13 bp, Homo sapiens
gtatattaaaaaa

SEQ ID NO: 1344416 - DNA, 14 bp, Homo sapiens
gtatattacaatga

SEQ ID NO: 1344417 - DNA, 13 bp, Homo sapiens
gtatattggtttt

SEQ ID NO: 1344418 - DNA, 19 bp, Homo sapiens
gtatattggttttatgatg

SEQ ID NO: 1344419 - DNA, 20 bp, Homo sapiens
gtatatttgatttattaact

SEQ ID NO: 1344420 - DNA, 23 bp, Homo sapiens
gtatatttgatttattaacttaa

SEQ ID NO: 1344421 - DNA, 14 bp, Homo sapiens
gtatccatatttta

SEQ ID NO: 1344422 - DNA, 20 bp, Homo sapiens
gtatccatattttattactg

SEQ ID NO: 1344423 - DNA, 18 bp, Homo sapiens
gtatccccccatcttgct

SEQ ID NO: 1344424 - DNA, 17 bp, Homo sapiens
gtatcctggaacaatat

SEQ ID NO: 1344425 - DNA, 22 bp, Homo sapiens
gtatcctggaacaatattttat

SEQ ID NO: 1344426 - DNA, 23 bp, Homo sapiens
gtatcctggaacaatattttatg

SEQ ID NO: 1344427 - DNA, 18 bp, Homo sapiens
gtatctccggctcccagc

SEQ ID NO: 1344428 - DNA, 22 bp, Homo sapiens
gtatggctttatttttttgaac

SEQ ID NO: 1344429 - DNA, 23 bp, Homo sapiens
gtatgtatattaaaaaagagaca

SEQ ID NO: 1344430 - DNA, 18 bp, Homo sapiens
gtatgtgtttagaattga

SEQ ID NO: 1344431 - DNA, 19 bp, Homo sapiens
gtattctaataagctagtt

SEQ ID NO: 1344432 - DNA, 22 bp, Homo sapiens
gtattctaataagctagttgaa

SEQ ID NO: 1344433 - DNA, 18 bp, Homo sapiens
gtattctagttttgtcaa

SEQ ID NO: 1344434 - DNA, 19 bp, Homo sapiens
gtatttaacagaaattgta

SEQ ID NO: 1344435 - DNA, 12 bp, Homo sapiens
gtatttgctttt

SEQ ID NO: 1344436 - DNA, 22 bp, Homo sapiens
gtatttgcttttttgttttggc

SEQ ID NO: 1344437 - DNA, 16 bp, Homo sapiens
gtattttcatgaaaat

SEQ ID NO: 1344438 - DNA, 16 bp, Homo sapiens
gtattttcttctctgt

SEQ ID NO: 1344439 - DNA, 22 bp, Homo sapiens
gtattttgtttttgtcttaaaa

SEQ ID NO: 1344440 - DNA, 18 bp, Homo sapiens
gtatttttatacaaacct

SEQ ID NO: 1344441 - DNA, 21 bp, Homo sapiens
gtattttttcaagttgtaaat

SEQ ID NO: 1344442 - DNA, 16 bp, Homo sapiens
gtatttttttttctaa

SEQ ID NO: 1344443 - DNA, 17 bp, Homo sapiens
gtcaaaagtagaacttt

SEQ ID NO: 1344444 - DNA, 23 bp, Homo sapiens
gtcaaaagtagaactttgtatag

SEQ ID NO: 1344445 - DNA, 16 bp, Homo sapiens
gtcaaatgatgtgcaa

SEQ ID NO: 1344446 - DNA, 16 bp, Homo sapiens
gtcaagtgaaaaagga

SEQ ID NO: 1344447 - DNA, 17 bp, Homo sapiens
gtcaatgggacctgtgg

SEQ ID NO: 1344448 - DNA, 18 bp, Homo sapiens
gtcacacgcttttgaatt

SEQ ID NO: 1344449 - DNA, 20 bp, Homo sapiens
gtcacacgcttttgaattat

SEQ ID NO: 1344450 - DNA, 14 bp, Homo sapiens
gtcaccaccacccc

SEQ ID NO: 1344451 - DNA, 19 bp, Homo sapiens
gtcacgtttggtgcttctc

SEQ ID NO: 1344452 - DNA, 19 bp, Homo sapiens
gtcactcattgctgagcct

SEQ ID NO: 1344453 - DNA, 18 bp, Homo sapiens
gtcactggaaaggggaga

SEQ ID NO: 1344454 - DNA, 23 bp, Homo sapiens
gtcactggaggttgaagccaagt

SEQ ID NO: 1344455 - DNA, 19 bp, Homo sapiens
gtcactgtttattttttta

SEQ ID NO: 1344456 - DNA, 17 bp, Homo sapiens
gtcactgtttcctgggc

SEQ ID NO: 1344457 - DNA, 17 bp, Homo sapiens
gtcagatgtttaaaaca

SEQ ID NO: 1344458 - DNA, 13 bp, Homo sapiens
gtcagctccagct

SEQ ID NO: 1344459 - DNA, 17 bp, Homo sapiens
gtcagctgctccctggc

SEQ ID NO: 1344460 - DNA, 17 bp, Homo sapiens
gtcaggctgaaaacaat

SEQ ID NO: 1344461 - DNA, 20 bp, Homo sapiens
gtcagtagtttaaaagttct

SEQ ID NO: 1344462 - DNA, 13 bp, Homo sapiens
gtcagttttcata

SEQ ID NO: 1344463 - DNA, 19 bp, Homo sapiens
gtcatactcgagtctgagg

SEQ ID NO: 1344464 - DNA, 14 bp, Homo sapiens
gtcatatcaaataa

SEQ ID NO: 1344465 - DNA, 14 bp, Homo sapiens
gtcatgtatgtttc

SEQ ID NO: 1344466 - DNA, 15 bp, Homo sapiens
gtcattaaactggtt

SEQ ID NO: 1344467 - DNA, 21 bp, Homo sapiens
gtcattatgagaggcaatgat

SEQ ID NO: 1344468 - DNA, 16 bp, Homo sapiens
gtccaccctgcctgcc

SEQ ID NO: 1344469 - DNA, 22 bp, Homo sapiens
gtccagcctgccccggagctgg

SEQ ID NO: 1344470 - DNA, 14 bp, Homo sapiens
gtccagctggcctg

SEQ ID NO: 1344471 - DNA, 17 bp, Homo sapiens
gtccagctggcctggac

SEQ ID NO: 1344472 - DNA, 13 bp, Homo sapiens
gtccaggctgccg

SEQ ID NO: 1344473 - DNA, 14 bp, Homo sapiens
gtccaggctgccgt

SEQ ID NO: 1344474 - DNA, 18 bp, Homo sapiens
gtccagtaagatcactgt

SEQ ID NO: 1344475 - DNA, 21 bp, Homo sapiens
gtccagtaagatcactgttta

SEQ ID NO: 1344476 - DNA, 23 bp, Homo sapiens
gtccagtaagatcactgtttaga

SEQ ID NO: 1344477 - DNA, 19 bp, Homo sapiens
gtccatgctaacaaagaca

SEQ ID NO: 1344478 - DNA, 13 bp, Homo sapiens
gtccattctccca

SEQ ID NO: 1344479 - DNA, 15 bp, Homo sapiens
gtccattctcccagg

SEQ ID NO: 1344480 - DNA, 16 bp, Homo sapiens
gtcccaggcagggaga

SEQ ID NO: 1344481 - DNA, 16 bp, Homo sapiens
gtcccatagtccctgc

SEQ ID NO: 1344482 - DNA, 21 bp, Homo sapiens
gtccccccccaacctttccct

SEQ ID NO: 1344483 - DNA, 15 bp, Homo sapiens
gtccccgctgctgtg

SEQ ID NO: 1344484 - DNA, 16 bp, Homo sapiens
gtccccgctgctgtgc

SEQ ID NO: 1344485 - DNA, 15 bp, Homo sapiens
gtccctagcagccca

SEQ ID NO: 1344486 - DNA, 20 bp, Homo sapiens
gtccctagcagcccaccctg

SEQ ID NO: 1344487 - DNA, 21 bp, Homo sapiens
gtccctagcagcccaccctgc

SEQ ID NO: 1344488 - DNA, 22 bp, Homo sapiens
gtccctctgtgtatttgctttt

SEQ ID NO: 1344489 - DNA, 22 bp, Homo sapiens
gtccctgccacgaatttctgtg

SEQ ID NO: 1344490 - DNA, 22 bp, Homo sapiens
gtcccttgcttgcctgcagggc

SEQ ID NO: 1344491 - DNA, 21 bp, Homo sapiens
gtcctattagtgttatatgaa

SEQ ID NO: 1344492 - DNA, 13 bp, Homo sapiens
gtcctcagccagt

SEQ ID NO: 1344493 - DNA, 15 bp, Homo sapiens
gtcctcctcacctca

SEQ ID NO: 1344494 - DNA, 18 bp, Homo sapiens
gtcctctggagccctaac

SEQ ID NO: 1344495 - DNA, 20 bp, Homo sapiens
gtcctgagatggaaaagtgt

SEQ ID NO: 1344496 - DNA, 14 bp, Homo sapiens
gtcctgtcctgctc

SEQ ID NO: 1344497 - DNA, 19 bp, Homo sapiens
gtcctgtgaatgccactgc

SEQ ID NO: 1344498 - DNA, 22 bp, Homo sapiens
gtcgagaaagaggcaccaggaa

SEQ ID NO: 1344499 - DNA, 17 bp, Homo sapiens
gtcggctgaccatgctc

SEQ ID NO: 1344500 - DNA, 19 bp, Homo sapiens
gtcgtcactaatacacagt

SEQ ID NO: 1344501 - DNA, 12 bp, Homo sapiens
gtcgtgcctgtg

SEQ ID NO: 1344502 - DNA, 14 bp, Homo sapiens
gtcgtgcctgtgtc

SEQ ID NO: 1344503 - DNA, 15 bp, Homo sapiens
gtcgtgcctgtgtcc

SEQ ID NO: 1344504 - DNA, 23 bp, Homo sapiens
gtcgtggacacacacagactatt

SEQ ID NO: 1344505 - DNA, 19 bp, Homo sapiens
gtcgtggggtgtgctggga

SEQ ID NO: 1344506 - DNA, 16 bp, Homo sapiens
gtctaaacaatgctga

SEQ ID NO: 1344507 - DNA, 21 bp, Homo sapiens
gtctaaacaatgctgatttgg

SEQ ID NO: 1344508 - DNA, 19 bp, Homo sapiens
gtctcaaaaaaagaaaaag

SEQ ID NO: 1344509 - DNA, 16 bp, Homo sapiens
gtctccaggggctgct

SEQ ID NO: 1344510 - DNA, 19 bp, Homo sapiens
gtctccaggggctgcttcc

SEQ ID NO: 1344511 - DNA, 23 bp, Homo sapiens
gtctccaggggctgcttcctcct

SEQ ID NO: 1344512 - DNA, 14 bp, Homo sapiens
gtctccctggctcc

SEQ ID NO: 1344513 - DNA, 14 bp, Homo sapiens
gtctccggcctctc

SEQ ID NO: 1344514 - DNA, 16 bp, Homo sapiens
gtctcctccccttccc

SEQ ID NO: 1344515 - DNA, 20 bp, Homo sapiens
gtctcctgactggtgctgca

SEQ ID NO: 1344516 - DNA, 13 bp, Homo sapiens
gtctggtggcccc

SEQ ID NO: 1344517 - DNA, 21 bp, Homo sapiens
gtctgtgaacagagagaccct

SEQ ID NO: 1344518 - DNA, 20 bp, Homo sapiens
gtctgtgtgcgctctgtgga

SEQ ID NO: 1344519 - DNA, 18 bp, Homo sapiens
gtctgttggcaggctggc

SEQ ID NO: 1344520 - DNA, 20 bp, Homo sapiens
gtctgttggcaggctggcca

SEQ ID NO: 1344521 - DNA, 20 bp, Homo sapiens
gtctgttgtgtgtcatgcca

SEQ ID NO: 1344522 - DNA, 14 bp, Homo sapiens
gtcttggccagcca

SEQ ID NO: 1344523 - DNA, 19 bp, Homo sapiens
gtcttgggcagagctggct

SEQ ID NO: 1344524 - DNA, 11 bp, Homo sapiens
gtctttcagta

SEQ ID NO: 1344525 - DNA, 16 bp, Homo sapiens
gtctttcagtactttt

SEQ ID NO: 1344526 - DNA, 13 bp, Homo sapiens
gtcttttaaaatg

SEQ ID NO: 1344527 - DNA, 23 bp, Homo sapiens
gtgaaaagaaaaatgagcctggc

SEQ ID NO: 1344528 - DNA, 21 bp, Homo sapiens
gtgaaacttttctagaattat

SEQ ID NO: 1344529 - DNA, 23 bp, Homo sapiens
gggagagagagagagagaggaca

SEQ ID NO: 1344530 - DNA, 17 bp, Homo sapiens
gggagagggaggtcact

SEQ ID NO: 1344531 - DNA, 19 bp, Homo sapiens
gggagctccactctgcttc

SEQ ID NO: 1344532 - DNA, 13 bp, Homo sapiens
gggagctgggccc

SEQ ID NO: 1344533 - DNA, 14 bp, Homo sapiens
gggaggagggagag

SEQ ID NO: 1344534 - DNA, 21 bp, Homo sapiens
gggaggattgcttgagctcag

SEQ ID NO: 1344535 - DNA, 17 bp, Homo sapiens
gggaggggccggccctg

SEQ ID NO: 1344536 - DNA, 18 bp, Homo sapiens
gggaggtcgaggcaggag

SEQ ID NO: 1344537 - DNA, 19 bp, Homo sapiens
gggaggtcgaggcaggagg

SEQ ID NO: 1344538 - DNA, 15 bp, Homo sapiens
gggatatttttttct

SEQ ID NO: 1344539 - DNA, 15 bp, Homo sapiens
gggcaaacaggcagt

SEQ ID NO: 1344540 - DNA, 13 bp, Homo sapiens
gggcacaggaggc

SEQ ID NO: 1344541 - DNA, 16 bp, Homo sapiens
gggcacagggtctcta

SEQ ID NO: 1344542 - DNA, 18 bp, Homo sapiens
gggcaccaggggtttctc

SEQ ID NO: 1344543 - DNA, 16 bp, Homo sapiens
gggcacgcactgggtt

SEQ ID NO: 1344544 - DNA, 16 bp, Homo sapiens
gggcagagctggctct

SEQ ID NO: 1344545 - DNA, 17 bp, Homo sapiens
gggcagagctggctctg

SEQ ID NO: 1344546 - DNA, 15 bp, Homo sapiens
gggcagcctcccccg

SEQ ID NO: 1344547 - DNA, 12 bp, Homo sapiens
gggcagctgcta

SEQ ID NO: 1344548 - DNA, 13 bp, Homo sapiens
gggcaggctgggc

SEQ ID NO: 1344549 - DNA, 14 bp, Homo sapiens
gggcaggctgggcc

SEQ ID NO: 1344550 - DNA, 11 bp, Homo sapiens
gggcagggagc

SEQ ID NO: 1344551 - DNA, 19 bp, Homo sapiens
gggcagggagctgggcccg

SEQ ID NO: 1344552 - DNA, 20 bp, Homo sapiens
gggcagggagctgggcccga

SEQ ID NO: 1344553 - DNA, 22 bp, Homo sapiens
gggcaggtgctggagcactggg

SEQ ID NO: 1344554 - DNA, 14 bp, Homo sapiens
gggcataaagtaaa

SEQ ID NO: 1344555 - DNA, 22 bp, Homo sapiens
gggccagtctgtggatcagaga

SEQ ID NO: 1344556 - DNA, 14 bp, Homo sapiens
gggccatgctgagg

SEQ ID NO: 1344557 - DNA, 15 bp, Homo sapiens
gggccatgctgaggc

SEQ ID NO: 1344558 - DNA, 21 bp, Homo sapiens
gggccatgctgaggcctgggc

SEQ ID NO: 1344559 - DNA, 22 bp, Homo sapiens
ggccgtatctccggctcccagc

SEQ ID NO: 1344560 - DNA, 16 bp, Homo sapiens
ggccgttgctgactta

SEQ ID NO: 1344561 - DNA, 23 bp, Homo sapiens
ggcctacagctttgatccctgac

SEQ ID NO: 1344562 - DNA, 15 bp, Homo sapiens
ggcctccagaactca

SEQ ID NO: 1344563 - DNA, 14 bp, Homo sapiens
ggcctcggcccctc

SEQ ID NO: 1344564 - DNA, 15 bp, Homo sapiens
ggcctctccagcctc

SEQ ID NO: 1344565 - DNA, 19 bp, Homo sapiens
ggcctctccagcctcagcc

SEQ ID NO: 1344566 - DNA, 16 bp, Homo sapiens
ggcctctgtgccttct

SEQ ID NO: 1344567 - DNA, 18 bp, Homo sapiens
ggcctggagatcctcctg

SEQ ID NO: 1344568 - DNA, 19 bp, Homo sapiens
ggcctggagatcctcctgc

SEQ ID NO: 1344569 - DNA, 23 bp, Homo sapiens
ggcctgggccgtatctccggctc

SEQ ID NO: 1344570 - DNA, 16 bp, Homo sapiens
ggcgccaccagctctg

SEQ ID NO: 1344571 - DNA, 18 bp, Homo sapiens
ggcgccaccagctctgcc

SEQ ID NO: 1344572 - DNA, 18 bp, Homo sapiens
ggcgcccttggcttctgt

SEQ ID NO: 1344573 - DNA, 21 bp, Homo sapiens
ggcgccgtctccaggggctgc

SEQ ID NO: 1344574 - DNA, 15 bp, Homo sapiens
ggcgcggagtgaacc

SEQ ID NO: 1344575 - DNA, 13 bp, Homo sapiens
ggcggccccagca

SEQ ID NO: 1344576 - DNA, 20 bp, Homo sapiens
ggcgggtggatcacgaggtc

SEQ ID NO: 1344577 - DNA, 17 bp, Homo sapiens
ggcgtccaggccgcgcc

SEQ ID NO: 1344578 - DNA, 14 bp, Homo sapiens
ggcgtctgtgtgcg

SEQ ID NO: 1344579 - DNA, 15 bp, Homo sapiens
ggcgtggagggaggc

SEQ ID NO: 1344580 - DNA, 20 bp, Homo sapiens
ggctcactgccaggccagcc

SEQ ID NO: 1344581 - DNA, 19 bp, Homo sapiens
ggctcagcaaaagatgctt

SEQ ID NO: 1344582 - DNA, 15 bp, Homo sapiens
ggctcccagcctcag

SEQ ID NO: 1344583 - DNA, 20 bp, Homo sapiens
ggctcccaggagcctgccca

SEQ ID NO: 1344584 - DNA, 22 bp, Homo sapiens
ggctcccaggggtctccctggc

SEQ ID NO: 1344585 - DNA, 15 bp, Homo sapiens
ggctccctcctccag

SEQ ID NO: 1344586 - DNA, 20 bp, Homo sapiens
ggctccctcctccaggcctg

SEQ ID NO: 1344587 - DNA, 17 bp, Homo sapiens
ggctccggcctctgcct

SEQ ID NO: 1344588 - DNA, 15 bp, Homo sapiens
ggctcgaatctctgt

SEQ ID NO: 1344589 - DNA, 17 bp, Homo sapiens
ggctcgaatctctgtgc

SEQ ID NO: 1344590 - DNA, 19 bp, Homo sapiens
ggctcgaatctctgtgcct

SEQ ID NO: 1344591 - DNA, 14 bp, Homo sapiens
ggctctgcagtcct

SEQ ID NO: 1344592 - DNA, 15 bp, Homo sapiens
ggctgaccatgctca

SEQ ID NO: 1344593 - DNA, 15 bp, Homo sapiens
ggctgaggcaggaga

SEQ ID NO: 1344594 - DNA, 17 bp, Homo sapiens
ggctgaggttcctctgc

SEQ ID NO: 1344595 - DNA, 22 bp, Homo sapiens
ggctgatgtcaatttctgtgtt

SEQ ID NO: 1344596 - DNA, 16 bp, Homo sapiens
ggctgcagaggccaga

SEQ ID NO: 1344597 - DNA, 16 bp, Homo sapiens
ggctgcccttgggcca

SEQ ID NO: 1344598 - DNA, 16 bp, Homo sapiens
ggctgccgtggggccg

SEQ ID NO: 1344599 - DNA, 22 bp, Homo sapiens
ggctgcggcgtacaggctggcg

SEQ ID NO: 1344600 - DNA, 13 bp, Homo sapiens
ggctgctgccccc

SEQ ID NO: 1344601 - DNA, 15 bp, Homo sapiens
ggctgctgctacaat

SEQ ID NO: 1344602 - DNA, 19 bp, Homo sapiens
ggctggaagatcctgcggg

SEQ ID NO: 1344603 - DNA, 22 bp, Homo sapiens
ggctggaagatcctgcgggtgg

SEQ ID NO: 1344604 - DNA, 20 bp, Homo sapiens
ggctggacttctacctgccc

SEQ ID NO: 1344605 - DNA, 16 bp, Homo sapiens
ggctggccagtccagg

SEQ ID NO: 1344606 - DNA, 20 bp, Homo sapiens
ggctggccagtccaggctgc

SEQ ID NO: 1344607 - DNA, 21 bp, Homo sapiens
ggctggccagtccaggctgcc

SEQ ID NO: 1344608 - DNA, 15 bp, Homo sapiens
ggctggctcctgatc

SEQ ID NO: 1344609 - DNA, 21 bp, Homo sapiens
ggctgggccatgtccaaagag

SEQ ID NO: 1344610 - DNA, 16 bp, Homo sapiens
ggctgtcggtgggacc

SEQ ID NO: 1344611 - DNA, 16 bp, Homo sapiens
ggctgtgctgccctga

SEQ ID NO: 1344612 - DNA, 14 bp, Homo sapiens
ggcttataaaacag

SEQ ID NO: 1344613 - DNA, 18 bp, Homo sapiens
ggcttatatctggcctct

SEQ ID NO: 1344614 - DNA, 19 bp, Homo sapiens
ggcttcctgcgtcctcctc

SEQ ID NO: 1344615 - DNA, 18 bp, Homo sapiens
ggcttctccgccagcctc

SEQ ID NO: 1344616 - DNA, 21 bp, Homo sapiens
ggcttctccgccagcctcctc

SEQ ID NO: 1344617 - DNA, 21 bp, Homo sapiens
ggcttctgtgatgagctgatc

SEQ ID NO: 1344618 - DNA, 12 bp, Homo sapiens
ggcttgaagcca

SEQ ID NO: 1344619 - DNA, 15 bp, Homo sapiens
ggcttgaagccaaag

SEQ ID NO: 1344620 - DNA, 20 bp, Homo sapiens
ggcttgaagccaaagaaaaa

SEQ ID NO: 1344621 - DNA, 13 bp, Homo sapiens
ggcttgaagctgt

SEQ ID NO: 1344622 - DNA, 12 bp, Homo sapiens
ggcttggcctgc

SEQ ID NO: 1344623 - DNA, 16 bp, Homo sapiens
ggcttggcctgctgtg

SEQ ID NO: 1344624 - DNA, 22 bp, Homo sapiens
ggcttggggctcacacacctgt

SEQ ID NO: 1344625 - DNA, 13 bp, Homo sapiens
ggcttgtagttct

SEQ ID NO: 1344626 - DNA, 17 bp, Homo sapiens
ggcttgtttacctttct

SEQ ID NO: 1344627 - DNA, 22 bp, Homo sapiens
ggctttatttttttgaactctt

SEQ ID NO: 1344628 - DNA, 22 bp, Homo sapiens
ggctttcccacttcccaccctg

SEQ ID NO: 1344629 - DNA, 23 bp, Homo sapiens
ggctttcccacttcccaccctgc

SEQ ID NO: 1344630 - DNA, 14 bp, Homo sapiens
gggaaacttggctc

SEQ ID NO: 1344631 - DNA, 23 bp, Homo sapiens
gggaaatatatacaaaaagaaaa

SEQ ID NO: 1344632 - DNA, 23 bp, Homo sapiens
gggaaatgttttgtaaacattta

SEQ ID NO: 1344633 - DNA, 15 bp, Homo sapiens
gggaacatgccccct

SEQ ID NO: 1344634 - DNA, 20 bp, Homo sapiens
gggaacctccccagcctgcg

SEQ ID NO: 1344635 - DNA, 18 bp, Homo sapiens
gggaagaagctctctcct

SEQ ID NO: 1344636 - DNA, 19 bp, Homo sapiens
gggaagagatccaaagact

SEQ ID NO: 1344637 - DNA, 18 bp, Homo sapiens
gggaagcccatcctgacc

SEQ ID NO: 1344638 - DNA, 13 bp, Homo sapiens
gggacacacagcc

SEQ ID NO: 1344639 - DNA, 22 bp, Homo sapiens
gggacatcacagggtgggcctc

SEQ ID NO: 1344640 - DNA, 16 bp, Homo sapiens
gggacccagtgcagaa

SEQ ID NO: 1344641 - DNA, 17 bp, Homo sapiens
gggacggtgcccaagcc

SEQ ID NO: 1344642 - DNA, 15 bp, Homo sapiens
gggactgctaaataa

SEQ ID NO: 1344643 - DNA, 22 bp, Homo sapiens
gggagacggtttccagggaggg

SEQ ID NO: 1344644 - DNA, 22 bp, Homo sapiens
gggagagagagagagagaggac

SEQ ID NO: 1344645 - DNA, 16 bp, Homo sapiens
gctaattctactcaca

SEQ ID NO: 1344646 - DNA, 17 bp, Homo sapiens
gctagcttctgcttttc

SEQ ID NO: 1344647 - DNA, 21 bp, Homo sapiens
gctaggaagagtctacccgac

SEQ ID NO: 1344648 - DNA, 15 bp, Homo sapiens
gctagttgaatactt

SEQ ID NO: 1344649 - DNA, 16 bp, Homo sapiens
gctagttgaatacttg

SEQ ID NO: 1344650 - DNA, 18 bp, Homo sapiens
gctataatgagcatgttt

SEQ ID NO: 1344651 - DNA, 16 bp, Homo sapiens
gctatcaggagaaagc

SEQ ID NO: 1344652 - DNA, 18 bp, Homo sapiens
gctatccccatctccctg

SEQ ID NO: 1344653 - DNA, 19 bp, Homo sapiens
gctatccccatctccctgc

SEQ ID NO: 1344654 - DNA, 22 bp, Homo sapiens
gctatccccatctccctgcctg

SEQ ID NO: 1344655 - DNA, 17 bp, Homo sapiens
gctatttatgggcccct

SEQ ID NO: 1344656 - DNA, 20 bp, Homo sapiens
gctatttattttcctaaaga

SEQ ID NO: 1344657 - DNA, 17 bp, Homo sapiens
gctattttctaaagact

SEQ ID NO: 1344658 - DNA, 13 bp, Homo sapiens
gctatttttgtaa

SEQ ID NO: 1344659 - DNA, 15 bp, Homo sapiens
gctcaccgcccatca

SEQ ID NO: 1344660 - DNA, 12 bp, Homo sapiens
gctcactgccag

SEQ ID NO: 1344661 - DNA, 17 bp, Homo sapiens
gctcactgccaggccag

SEQ ID NO: 1344662 - DNA, 20 bp, Homo sapiens
gctcactgccaggccagcct

SEQ ID NO: 1344663 - DNA, 21 bp, Homo sapiens
gctcactgccaggccagcctc

SEQ ID NO: 1344664 - DNA, 21 bp, Homo sapiens
gctcagacatgttttccgtga

SEQ ID NO: 1344665 - DNA, 17 bp, Homo sapiens
gctcagcaaaagatgct

SEQ ID NO: 1344666 - DNA, 22 bp, Homo sapiens
gctcagcaaaagatgcttctca

SEQ ID NO: 1344667 - DNA, 15 bp, Homo sapiens
gctcaggaggcgccc

SEQ ID NO: 1344668 - DNA, 19 bp, Homo sapiens
gctcagggccatgctgagg

SEQ ID NO: 1344669 - DNA, 23 bp, Homo sapiens
gctcagggccatgctgaggcctg

SEQ ID NO: 1344670 - DNA, 18 bp, Homo sapiens
gctcagtaaacgggaaca

SEQ ID NO: 1344671 - DNA, 13 bp, Homo sapiens
gctcatctgctgg

SEQ ID NO: 1344672 - DNA, 23 bp, Homo sapiens
gctcatctgctggtccgtgggac

SEQ ID NO: 1344673 - DNA, 16 bp, Homo sapiens
gctccactctgcttct

SEQ ID NO: 1344674 - DNA, 17 bp, Homo sapiens
gctccactctgcttctc

SEQ ID NO: 1344675 - DNA, 19 bp, Homo sapiens
gctccactctgcttctctg

SEQ ID NO: 1344676 - DNA, 21 bp, Homo sapiens
gctccactctgcttctctgac

SEQ ID NO: 1344677 - DNA, 22 bp, Homo sapiens
gctccagcaacacagcctgggc

SEQ ID NO: 1344678 - DNA, 20 bp, Homo sapiens
gctccagggaatccaagcct

SEQ ID NO: 1344679 - DNA, 22 bp, Homo sapiens
gctccagggaatccaagcctcc

SEQ ID NO: 1344680 - DNA, 23 bp, Homo sapiens
gctccagggaatccaagcctcca

SEQ ID NO: 1344681 - DNA, 12 bp, Homo sapiens
gctcccagcctc

SEQ ID NO: 1344682 - DNA, 13 bp, Homo sapiens
gctcccagcctca

SEQ ID NO: 1344683 - DNA, 21 bp, Homo sapiens
gctcccaggagcctgcccagc

SEQ ID NO: 1344684 - DNA, 20 bp, Homo sapiens
gctcccaggggtctccctgg

SEQ ID NO: 1344685 - DNA, 19 bp, Homo sapiens
gctccctcctccaggcctg

SEQ ID NO: 1344686 - DNA, 15 bp, Homo sapiens
gctcctccccttcct

SEQ ID NO: 1344687 - DNA, 20 bp, Homo sapiens
gctcctggcccactgcatcg

SEQ ID NO: 1344688 - DNA, 20 bp, Homo sapiens
gctcctgtggccccaccctg

SEQ ID NO: 1344689 - DNA, 19 bp, Homo sapiens
gctcgaatctctgtgcctt

SEQ ID NO: 1344690 - DNA, 19 bp, Homo sapiens
gctcggagaagagcgcagt

SEQ ID NO: 1344691 - DNA, 22 bp, Homo sapiens
gctcgtggactgagtgggaagc

SEQ ID NO: 1344692 - DNA, 20 bp, Homo sapiens
gctctaaaaggtaatgtgtg

SEQ ID NO: 1344693 - DNA, 21 bp, Homo sapiens
gctctccggggccatttgcaa

SEQ ID NO: 1344694 - DNA, 15 bp, Homo sapiens
gcttctccgccagcc

SEQ ID NO: 1344695 - DNA, 21 bp, Homo sapiens
gcttctccgccagcctcctct

SEQ ID NO: 1344696 - DNA, 23 bp, Homo sapiens
gcttctccgccagcctcctctgg

SEQ ID NO: 1344697 - DNA, 20 bp, Homo sapiens
gcttctctgacttctgcctg

SEQ ID NO: 1344698 - DNA, 21 bp, Homo sapiens
gcttctctgacttctgcctgg

SEQ ID NO: 1344699 - DNA, 12 bp, Homo sapiens
gcttctgcctgc

SEQ ID NO: 1344700 - DNA, 16 bp, Homo sapiens
gcttctgcttttctgc

SEQ ID NO: 1344701 - DNA, 23 bp, Homo sapiens
gcttctgcttttctgccctggct

SEQ ID NO: 1344702 - DNA, 15 bp, Homo sapiens
gcttctgtgcccaga

SEQ ID NO: 1344703 - DNA, 16 bp, Homo sapiens
gcttcttgcctctgtg

SEQ ID NO: 1344704 - DNA, 17 bp, Homo sapiens
gcttcttgcctctgtgc

SEQ ID NO: 1344705 - DNA, 20 bp, Homo sapiens
gcttgaagccaaagaaaaat

SEQ ID NO: 1344706 - DNA, 11 bp, Homo sapiens
gcttgaagctg

SEQ ID NO: 1344707 - DNA, 17 bp, Homo sapiens
gcttgagccgggcccct

SEQ ID NO: 1344708 - DNA, 14 bp, Homo sapiens
gcttgagctcagga

SEQ ID NO: 1344709 - DNA, 15 bp, Homo sapiens
gcttgcctgcagggc

SEQ ID NO: 1344710 - DNA, 16 bp, Homo sapiens
gcttgcctgcagggcc

SEQ ID NO: 1344711 - DNA, 17 bp, Homo sapiens
gcttgcctgcagggcca

SEQ ID NO: 1344712 - DNA, 13 bp, Homo sapiens
gcttggcctgctg

SEQ ID NO: 1344713 - DNA, 17 bp, Homo sapiens
gcttgtagttctttaaa

SEQ ID NO: 1344714 - DNA, 18 bp, Homo sapiens
gcttgttcatcatccaga

SEQ ID NO: 1344715 - DNA, 22 bp, Homo sapiens
gctttaaaaagggaagaaactg

SEQ ID NO: 1344716 - DNA, 17 bp, Homo sapiens
gctttaccttttcaggg

SEQ ID NO: 1344717 - DNA, 20 bp, Homo sapiens
gctttaccttttcagggctg

SEQ ID NO: 1344718 - DNA, 22 bp, Homo sapiens
gctttaccttttcagggctggc

SEQ ID NO: 1344719 - DNA, 14 bp, Homo sapiens
gctttagacttgaa

SEQ ID NO: 1344720 - DNA, 18 bp, Homo sapiens
gctttagacttgaaaaga

SEQ ID NO: 1344721 - DNA, 24 bp, Homo sapiens
gctttagacttgaaaagagacagg

SEQ ID NO: 1344722 - DNA, 12 bp, Homo sapiens
gctttcatgatt

SEQ ID NO: 1344723 - DNA, 19 bp, Homo sapiens
gctttccaaaccttatctc

SEQ ID NO: 1344724 - DNA, 17 bp, Homo sapiens
gctttctggggcctagc

SEQ ID NO: 1344725 - DNA, 16 bp, Homo sapiens
gctttgaataaatgtg

SEQ ID NO: 1344726 - DNA, 22 bp, Homo sapiens
gctttgagaagccttcagctcc

SEQ ID NO: 1344727 - DNA, 22 bp, Homo sapiens
gctttggacctaaatggcctca

SEQ ID NO: 1344728 - DNA, 20 bp, Homo sapiens
gctttgtagagttttgtcat

SEQ ID NO: 1344729 - DNA, 22 bp, Homo sapiens
gcttttatagaggctagcttct

SEQ ID NO: 1344730 - DNA, 22 bp, Homo sapiens
gcttttattaatgcactttcta

SEQ ID NO: 1344731 - DNA, 14 bp, Homo sapiens
gcttttctgccctg

SEQ ID NO: 1344732 - DNA, 15 bp, Homo sapiens
gcttttctgccctgg

SEQ ID NO: 1344733 - DNA, 18 bp, Homo sapiens
gcttttctgccctggctg

SEQ ID NO: 1344734 - DNA, 19 bp, Homo sapiens
gcttttctgccctggctgc

SEQ ID NO: 1344735 - DNA, 11 bp, Homo sapiens
gcttttggcaa

SEQ ID NO: 1344736 - DNA, 13 bp, Homo sapiens
ggaaaaatagcct

SEQ ID NO: 1344737 - DNA, 18 bp, Homo sapiens
ggaaactcacactcccct

SEQ ID NO: 1344738 - DNA, 21 bp, Homo sapiens
ggaaactccacatctgcctta

SEQ ID NO: 1344739 - DNA, 15 bp, Homo sapiens
ggaaagcaataaatg

SEQ ID NO: 1344740 - DNA, 19 bp, Homo sapiens
ggaaaggggagagcctgct

SEQ ID NO: 1344741 - DNA, 20 bp, Homo sapiens
ggaaatcaaagtgctattac

SEQ ID NO: 1344742 - DNA, 15 bp, Homo sapiens
ggaacaaattatttt

SEQ ID NO: 1344743 - DNA, 14 bp, Homo sapiens
ggaacctccccagc

SEQ ID NO: 1344744 - DNA, 15 bp, Homo sapiens
ggaagaaactgctga

SEQ ID NO: 1344745 - DNA, 15 bp, Homo sapiens
ggaagaacaggcctc

SEQ ID NO: 1344746 - DNA, 14 bp, Homo sapiens
ggaagaagggagaa

SEQ ID NO: 1344747 - DNA, 18 bp, Homo sapiens
ggaagaagggagaagaaa

SEQ ID NO: 1344748 - DNA, 13 bp, Homo sapiens
ggaagaatgaaag

SEQ ID NO: 1344749 - DNA, 15 bp, Homo sapiens
ggaagagaaaaaata

SEQ ID NO: 1344750 - DNA, 13 bp, Homo sapiens
ggaagagccttgc

SEQ ID NO: 1344751 - DNA, 18 bp, Homo sapiens
ggaagaggaaaaggctgg

SEQ ID NO: 1344752 - DNA, 15 bp, Homo sapiens
ggaagatcattttga

SEQ ID NO: 1344753 - DNA, 22 bp, Homo sapiens
ggaagccaaaatgtaggcttag

SEQ ID NO: 1344754 - DNA, 14 bp, Homo sapiens
ggaagcccatcctg

SEQ ID NO: 1344755 - DNA, 18 bp, Homo sapiens
ggaagcccatcctgacca

SEQ ID NO: 1344756 - DNA, 15 bp, Homo sapiens
ggaagccgtcctggc

SEQ ID NO: 1344757 - DNA, 16 bp, Homo sapiens
ggaaggagaagtaaga

SEQ ID NO: 1344758 - DNA, 21 bp, Homo sapiens
ggaaggggttcctcaaatttt

SEQ ID NO: 1344759 - DNA, 22 bp, Homo sapiens
ggaaggggttcctcaaattttt

SEQ ID NO: 1344760 - DNA, 14 bp, Homo sapiens
ggaataaaaggctt

SEQ ID NO: 1344761 - DNA, 15 bp, Homo sapiens
ggaataaaaggcttg

SEQ ID NO: 1344762 - DNA, 17 bp, Homo sapiens
ggaatgaggaaaattct

SEQ ID NO: 1344763 - DNA, 21 bp, Homo sapiens
ggaatgaggtgggaggtggaa

SEQ ID NO: 1344764 - DNA, 15 bp, Homo sapiens
ggaatgtgtggcctg

SEQ ID NO: 1344765 - DNA, 14 bp, Homo sapiens
ggacacacagccta

SEQ ID NO: 1344766 - DNA, 20 bp, Homo sapiens
ggacacgcgcgtcgccgcca

SEQ ID NO: 1344767 - DNA, 17 bp, Homo sapiens
ggacactcaaaagctgg

SEQ ID NO: 1344768 - DNA, 22 bp, Homo sapiens
ggacactcaaaagctgggcagg

SEQ ID NO: 1344769 - DNA, 14 bp, Homo sapiens
ggacactccaggga

SEQ ID NO: 1344770 - DNA, 19 bp, Homo sapiens
tgcagtttgagacaggaga

SEQ ID NO: 1344771 - DNA, 20 bp, Homo sapiens
tgcatactttgtattttgat

SEQ ID NO: 1344772 - DNA, 14 bp, Homo sapiens
tgcatagtttcttt

SEQ ID NO: 1344773 - DNA, 17 bp, Homo sapiens
tgcatataatgaataaa

SEQ ID NO: 1344774 - DNA, 16 bp, Homo sapiens
tgcatattataaagga

SEQ ID NO: 1344775 - DNA, 13 bp, Homo sapiens
tgcatcagaaagc

SEQ ID NO: 1344776 - DNA, 14 bp, Homo sapiens
tgcatccagaggca

SEQ ID NO: 1344777 - DNA, 22 bp, Homo sapiens
tgcatcccaaaccacgcctctt

SEQ ID NO: 1344778 - DNA, 16 bp, Homo sapiens
tgcatctttgatgtgt

SEQ ID NO: 1344779 - DNA, 17 bp, Homo sapiens
tgcatctttgatgtgtt

SEQ ID NO: 1344780 - DNA, 18 bp, Homo sapiens
tgcatctttgatgtgttg

SEQ ID NO: 1344781 - DNA, 22 bp, Homo sapiens
tgcatgcaaatgagctctgaaa

SEQ ID NO: 1344782 - DNA, 13 bp, Homo sapiens
tgcatggtggcca

SEQ ID NO: 1344783 - DNA, 20 bp, Homo sapiens
tgcatgtcaaacatgagatg

SEQ ID NO: 1344784 - DNA, 15 bp, Homo sapiens
tgcatgttatgttta

SEQ ID NO: 1344785 - DNA, 18 bp, Homo sapiens
tgcattcgttgtgttttt

SEQ ID NO: 1344786 - DNA, 14 bp, Homo sapiens
tgcatttttgtaaa

SEQ ID NO: 1344787 - DNA, 17 bp, Homo sapiens
tgccaaaattcatttct

SEQ ID NO: 1344788 - DNA, 18 bp, Homo sapiens
tgccacactctccatcac

SEQ ID NO: 1344789 - DNA, 15 bp, Homo sapiens
tgccactcactaggc

SEQ ID NO: 1344790 - DNA, 22 bp, Homo sapiens
tgccactcactaggcccccact

SEQ ID NO: 1344791 - DNA, 19 bp, Homo sapiens
tgccactgccttcgcttct

SEQ ID NO: 1344792 - DNA, 21 bp, Homo sapiens
tgccactttacccacctagaa

SEQ ID NO: 1344793 - DNA, 20 bp, Homo sapiens
tgccagaggaatcctggcag

SEQ ID NO: 1344794 - DNA, 18 bp, Homo sapiens
tgccagcagcagcaggtg

SEQ ID NO: 1344795 - DNA, 19 bp, Homo sapiens
tgccagccccctaaaagca

SEQ ID NO: 1344796 - DNA, 21 bp, Homo sapiens
tgccagccccctaaaagcact

SEQ ID NO: 1344797 - DNA, 17 bp, Homo sapiens
tgccagccttgagccct

SEQ ID NO: 1344798 - DNA, 19 bp, Homo sapiens
tgccagccttgagccctgg

SEQ ID NO: 1344799 - DNA, 23 bp, Homo sapiens
tgccagccttgagccctggctgt

SEQ ID NO: 1344800 - DNA, 12 bp, Homo sapiens
tgccagctggcc

SEQ ID NO: 1344801 - DNA, 15 bp, Homo sapiens
tgccagctggccttt

SEQ ID NO: 1344802 - DNA, 16 bp, Homo sapiens
tgccagctggcctttg

SEQ ID NO: 1344803 - DNA, 18 bp, Homo sapiens
tgccagcttatctcaggg

SEQ ID NO: 1344804 - DNA, 20 bp, Homo sapiens
tgccaggacatgcaataaaa

SEQ ID NO: 1344805 - DNA, 14 bp, Homo sapiens
tgtatagttatgta

SEQ ID NO: 1344806 - DNA, 16 bp, Homo sapiens
tgtatagttatgtaaa

SEQ ID NO: 1344807 - DNA, 17 bp, Homo sapiens
tgtatagttatgtaaat

SEQ ID NO: 1344808 - DNA, 18 bp, Homo sapiens
tgtatagttatgtaaata

SEQ ID NO: 1344809 - DNA, 14 bp, Homo sapiens
tgtatatattatta

SEQ ID NO: 1344810 - DNA, 20 bp, Homo sapiens
tgtatatattattataatct

SEQ ID NO: 1344811 - DNA, 20 bp, Homo sapiens
tgtatatattttgtgtgaaa

SEQ ID NO: 1344812 - DNA, 20 bp, Homo sapiens
tgtatatggtatatatacat

SEQ ID NO: 1344813 - DNA, 14 bp, Homo sapiens
tgtatattacaatg

SEQ ID NO: 1344814 - DNA, 21 bp, Homo sapiens
tgtatattggttttatgatga

SEQ ID NO: 1344815 - DNA, 14 bp, Homo sapiens
tgtatattgtaatt

SEQ ID NO: 1344816 - DNA, 22 bp, Homo sapiens
tgtatatttgatttattaactt

SEQ ID NO: 1344817 - DNA, 16 bp, Homo sapiens
tgtatatttgtaaagc

SEQ ID NO: 1344818 - DNA, 16 bp, Homo sapiens
tgtatgccaagtgaga

SEQ ID NO: 1344819 - DNA, 14 bp, Homo sapiens
tgtatgtagaagca

SEQ ID NO: 1344820 - DNA, 16 bp, Homo sapiens
tgtatgtgtttagaat

SEQ ID NO: 1344821 - DNA, 13 bp, Homo sapiens
tgtatgtttctct

SEQ ID NO: 1344822 - DNA, 18 bp, Homo sapiens
tgtattatttacatttaa

SEQ ID NO: 1344823 - DNA, 15 bp, Homo sapiens
tgtattatttataat

SEQ ID NO: 1344824 - DNA, 18 bp, Homo sapiens
tgtattgtatattacaat

SEQ ID NO: 1344825 - DNA, 13 bp, Homo sapiens
tgtatttgaaagt

SEQ ID NO: 1344826 - DNA, 20 bp, Homo sapiens
tgtcaaaagtagaactttgt

SEQ ID NO: 1344827 - DNA, 21 bp, Homo sapiens
tgtcaaaagtagaactttgta

SEQ ID NO: 1344828 - DNA, 16 bp, Homo sapiens
tgtcaaactgtagaaa

SEQ ID NO: 1344829 - DNA, 15 bp, Homo sapiens
tgtcactcattgctg

SEQ ID NO: 1344830 - DNA, 12 bp, Homo sapiens
tgtcagaagtgc

SEQ ID NO: 1344831 - DNA, 23 bp, Homo sapiens
tgtcagacagaacttgaatgtgt

SEQ ID NO: 1344832 - DNA, 16 bp, Homo sapiens
tgtcagctgaacctgg

SEQ ID NO: 1344833 - DNA, 18 bp, Homo sapiens
tgtcaggctgaaaacaat

SEQ ID NO: 1344834 - DNA, 17 bp, Homo sapiens
tgtcagtactattcagg

SEQ ID NO: 1344835 - DNA, 20 bp, Homo sapiens
tgtcatactcgagtctgagg

SEQ ID NO: 1344836 - DNA, 19 bp, Homo sapiens
tgtcattcagagtcagcca

SEQ ID NO: 1344837 - DNA, 17 bp, Homo sapiens
tgtcattgcacataagc

SEQ ID NO: 1344838 - DNA, 21 bp, Homo sapiens
tgtccaaagaggctgcccctc

SEQ ID NO: 1344839 - DNA, 19 bp, Homo sapiens
tgtccagtaagatcactgt

SEQ ID NO: 1344840 - DNA, 20 bp, Homo sapiens
tgtccagtaagatcactgtt

SEQ ID NO: 1344841 - DNA, 21 bp, Homo sapiens
tgtccagtaagatcactgttt

SEQ ID NO: 1344842 - DNA, 13 bp, Homo sapiens
tgtccatacactt

SEQ ID NO: 1344843 - DNA, 20 bp, Homo sapiens
tgtccatgcgctcagggcca

SEQ ID NO: 1344844 - DNA, 18 bp, Homo sapiens
tgtcccatagtccctgcc

SEQ ID NO: 1344845 - DNA, 20 bp, Homo sapiens
tgtcccccaggttccgaaga

SEQ ID NO: 1344846 - DNA, 18 bp, Homo sapiens
tgtccctgcgcctttcct

SEQ ID NO: 1344847 - DNA, 14 bp, Homo sapiens
tgtcctcagccagt

SEQ ID NO: 1344848 - DNA, 22 bp, Homo sapiens
tgtcctgcctgcaatatttgaa

SEQ ID NO: 1344849 - DNA, 13 bp, Homo sapiens
tgtcctgtcctgc

SEQ ID NO: 1344850 - DNA, 20 bp, Homo sapiens
tgtcgtggacacacacagac

SEQ ID NO: 1344851 - DNA, 17 bp, Homo sapiens
tgtctaaacaatgctga

SEQ ID NO: 1344852 - DNA, 20 bp, Homo sapiens
tgtctaaacaatgctgattt

SEQ ID NO: 1344853 - DNA, 21 bp, Homo sapiens
tgtctcaaaaaaagaaaaaga

SEQ ID NO: 1344854 - DNA, 20 bp, Homo sapiens
tgtctcactaaagcatgaaa

SEQ ID NO: 1344855 - DNA, 23 bp, Homo sapiens
tgtctcactaaagcatgaaatgt

SEQ ID NO: 1344856 - DNA, 20 bp, Homo sapiens
tggagatcctcctgcagacc

SEQ ID NO: 1344857 - DNA, 19 bp, Homo sapiens
tggagattataataaatat

SEQ ID NO: 1344858 - DNA, 19 bp, Homo sapiens
tggagcactgggctcccgg

SEQ ID NO: 1344859 - DNA, 13 bp, Homo sapiens
tggagccagctcc

SEQ ID NO: 1344860 - DNA, 20 bp, Homo sapiens
tggaggaacaatcggctgca

SEQ ID NO: 1344861 - DNA, 21 bp, Homo sapiens
tggaggaacaatcggctgcat

SEQ ID NO: 1344862 - DNA, 15 bp, Homo sapiens
tggaggaagaactga

SEQ ID NO: 1344863 - DNA, 20 bp, Homo sapiens
tggaggaagaactgaaaggc

SEQ ID NO: 1344864 - DNA, 15 bp, Homo sapiens
tggaggaggaaggca

SEQ ID NO: 1344865 - DNA, 16 bp, Homo sapiens
tggaggaggaaggcaa

SEQ ID NO: 1344866 - DNA, 17 bp, Homo sapiens
tggaggaggaaggcaag

SEQ ID NO: 1344867 - DNA, 21 bp, Homo sapiens
tggaggaggaaggcaagaggg

SEQ ID NO: 1344868 - DNA, 13 bp, Homo sapiens
tggaggcttcctg

SEQ ID NO: 1344869 - DNA, 16 bp, Homo sapiens
tggaggcttcctgcgt

SEQ ID NO: 1344870 - DNA, 20 bp, Homo sapiens
tggaggcttcctgcgtcctc

SEQ ID NO: 1344871 - DNA, 12 bp, Homo sapiens
tggagggaagcc

SEQ ID NO: 1344872 - DNA, 13 bp, Homo sapiens
tggagggaggccc

SEQ ID NO: 1344873 - DNA, 20 bp, Homo sapiens
tggaggtcggtaggttcagc

SEQ ID NO: 1344874 - DNA, 14 bp, Homo sapiens
tggagtctcctgag

SEQ ID NO: 1344875 - DNA, 14 bp, Homo sapiens
tggagtgtatgact

SEQ ID NO: 1344876 - DNA, 15 bp, Homo sapiens
tggagtgtgagccac

SEQ ID NO: 1344877 - DNA, 17 bp, Homo sapiens
tggagttttaactgtaa

SEQ ID NO: 1344878 - DNA, 22 bp, Homo sapiens
tggatgccagggccgaccagag

SEQ ID NO: 1344879 - DNA, 15 bp, Homo sapiens
tggatggccccagca

SEQ ID NO: 1344880 - DNA, 17 bp, Homo sapiens
tggatggccccagcaca

SEQ ID NO: 1344881 - DNA, 21 bp, Homo sapiens
tggatggccccagcacagctt

SEQ ID NO: 1344882 - DNA, 14 bp, Homo sapiens
tggattaaatacat

SEQ ID NO: 1344883 - DNA, 15 bp, Homo sapiens
tggattctaaataca

SEQ ID NO: 1344884 - DNA, 13 bp, Homo sapiens
tggatttcagaag

SEQ ID NO: 1344885 - DNA, 21 bp, Homo sapiens
tggatttggcactagccaaag

SEQ ID NO: 1344886 - DNA, 20 bp, Homo sapiens
tggcaaaactctacttaatc

SEQ ID NO: 1344887 - DNA, 24 bp, Homo sapiens
tggcaaacgctaaagagcccttgc

SEQ ID NO: 1344888 - DNA, 19 bp, Homo sapiens
tggcaaggactttgtacat

SEQ ID NO: 1344889 - DNA, 21 bp, Homo sapiens
tggcaaggactttgtacattt

SEQ ID NO: 1344890 - DNA, 19 bp, Homo sapiens
tggcaatgactcaaagtct

SEQ ID NO: 1344891 - DNA, 16 bp, Homo sapiens
tggcaatttaacatgt

SEQ ID NO: 1344892 - DNA, 20 bp, Homo sapiens
tggcacccaccgtggaggag

SEQ ID NO: 1344893 - DNA, 21 bp, Homo sapiens
tggcacccaccgtggaggagg

SEQ ID NO: 1344894 - DNA, 18 bp, Homo sapiens
tggcactggatgcagaaa

SEQ ID NO: 1344895 - DNA, 14 bp, Homo sapiens
tggcacttgcctgg

SEQ ID NO: 1344896 - DNA, 20 bp, Homo sapiens
tggcagaaaaaatgtctgta

SEQ ID NO: 1344897 - DNA, 12 bp, Homo sapiens
tggcaggctggc

SEQ ID NO: 1344898 - DNA, 18 bp, Homo sapiens
tggcaggctggccagtcc

SEQ ID NO: 1344899 - DNA, 12 bp, Homo sapiens
tgtttaaaataa

SEQ ID NO: 1344900 - DNA, 18 bp, Homo sapiens
tgtttaaaataaaatgaa

SEQ ID NO: 1344901 - DNA, 13 bp, Homo sapiens
tgtttaaaatgta

SEQ ID NO: 1344902 - DNA, 20 bp, Homo sapiens
tgtttaaaatgtaatttaaa

SEQ ID NO: 1344903 - DNA, 22 bp, Homo sapiens
tgtttacatttgatgcatgtct

SEQ ID NO: 1344904 - DNA, 15 bp, Homo sapiens
tgtttacctttctct

SEQ ID NO: 1344905 - DNA, 16 bp, Homo sapiens
tgtttacctttctctc

SEQ ID NO: 1344906 - DNA, 15 bp, Homo sapiens
tgtttagaattgaag

SEQ ID NO: 1344907 - DNA, 16 bp, Homo sapiens
tgtttataataaaaat

SEQ ID NO: 1344908 - DNA, 22 bp, Homo sapiens
tgtttatatctgcaaaaaacct

SEQ ID NO: 1344909 - DNA, 18 bp, Homo sapiens
tgtttatgttgtttataa

SEQ ID NO: 1344910 - DNA, 22 bp, Homo sapiens
tgtttatgttgtttataataaa

SEQ ID NO: 1344911 - DNA, 18 bp, Homo sapiens
tgtttattacttccatga

SEQ ID NO: 1344912 - DNA, 20 bp, Homo sapiens
tgtttccagacttccttgag

SEQ ID NO: 1344913 - DNA, 15 bp, Homo sapiens
tgtttcgtggggagg

SEQ ID NO: 1344914 - DNA, 13 bp, Homo sapiens
tgtttctgaaaag

SEQ ID NO: 1344915 - DNA, 22 bp, Homo sapiens
tgtttctggacccttataaaat

SEQ ID NO: 1344916 - DNA, 21 bp, Homo sapiens
tgtttcttttgtttggtaaat

SEQ ID NO: 1344917 - DNA, 18 bp, Homo sapiens
tgtttgagattctcaaag

SEQ ID NO: 1344918 - DNA, 19 bp, Homo sapiens
tgtttggagacgtttataa

SEQ ID NO: 1344919 - DNA, 15 bp, Homo sapiens
tgtttggcatgtaaa

SEQ ID NO: 1344920 - DNA, 16 bp, Homo sapiens
tgtttggcatgtaaat

SEQ ID NO: 1344921 - DNA, 17 bp, Homo sapiens
tgtttgggatgaccagg

SEQ ID NO: 1344922 - DNA, 15 bp, Homo sapiens
tgtttggtaaatgtt

SEQ ID NO: 1344923 - DNA, 17 bp, Homo sapiens
tgtttgttgtcagctga

SEQ ID NO: 1344924 - DNA, 18 bp, Homo sapiens
tgttttaaaactggacct

SEQ ID NO: 1344925 - DNA, 17 bp, Homo sapiens
tgttttggatggcttgt

SEQ ID NO: 1344926 - DNA, 13 bp, Homo sapiens
tgttttgtaaaca

SEQ ID NO: 1344927 - DNA, 16 bp, Homo sapiens
tgttttgtaaacattt

SEQ ID NO: 1344928 - DNA, 12 bp, Homo sapiens
tgtttttctgct

SEQ ID NO: 1344929 - DNA, 15 bp, Homo sapiens
tgtttttctgcttta

SEQ ID NO: 1344930 - DNA, 16 bp, Homo sapiens
tgtttttgcacatgtt

SEQ ID NO: 1344931 - DNA, 12 bp, Homo sapiens
tgtttttgtata

SEQ ID NO: 1344932 - DNA, 14 bp, Homo sapiens
tgtttttgtatatt

SEQ ID NO: 1344933 - DNA, 16 bp, Homo sapiens
tgttttttaagatagt

SEQ ID NO: 1344934 - DNA, 22 bp, Homo sapiens
tgttttttctttttttttaagt

SEQ ID NO: 1344935 - DNA, 18 bp, Homo sapiens
tgtttttttgttattaaa

SEQ ID NO: 1344936 - DNA, 13 bp, Homo sapiens
ttaaaaaaaatcc

SEQ ID NO: 1344937 - DNA, 13 bp, Homo sapiens
ttaaaaaagagac

SEQ ID NO: 1344938 - DNA, 14 bp, Homo sapiens
ttaaaaaatatttt

SEQ ID NO: 1344939 - DNA, 20 bp, Homo sapiens
ttaaaaaatattttctctgt

SEQ ID NO: 1344940 - DNA, 15 bp, Homo sapiens
ttaaaaaatcttaat

SEQ ID NO: 1344941 - DNA, 16 bp, Homo sapiens
ttaaaaaatcttaatg

SEQ ID NO: 1344942 - DNA, 19 bp, Homo sapiens
ttaaaacacgttttaagga

SEQ ID NO: 1344943 - DNA, 21 bp, Homo sapiens
ttaaaacacgttttaaggact

SEQ ID NO: 1344944 - DNA, 22 bp, Homo sapiens
ttaaaacacgttttaaggactg

SEQ ID NO: 1344945 - DNA, 18 bp, Homo sapiens
ttaaaacatcattccttt

SEQ ID NO: 1344946 - DNA, 23 bp, Homo sapiens
ttaaaacatcattcctttttatt

SEQ ID NO: 1344947 - DNA, 14 bp, Homo sapiens
ttaaaaccaaagag

SEQ ID NO: 1344948 - DNA, 14 bp, Homo sapiens
ttaaaactggacct

SEQ ID NO: 1344949 - DNA, 16 bp, Homo sapiens
ttaaaactggacctgt

SEQ ID NO: 1344950 - DNA, 13 bp, Homo sapiens
ttaaaagaatgac

SEQ ID NO: 1344951 - DNA, 14 bp, Homo sapiens
ttaaaagaatgact

SEQ ID NO: 1344952 - DNA, 15 bp, Homo sapiens
ttaaaagaatgacta

SEQ ID NO: 1344953 - DNA, 20 bp, Homo sapiens
ttaaaataaaatgaaaattg

SEQ ID NO: 1344954 - DNA, 17 bp, Homo sapiens
ttaaaatagaaattttg

SEQ ID NO: 1344955 - DNA, 21 bp, Homo sapiens
ttaaaatctgagggaaatgtt

SEQ ID NO: 1344956 - DNA, 23 bp, Homo sapiens
ttaaaattatcaatatctaatat

SEQ ID NO: 1344957 - DNA, 22 bp, Homo sapiens
ttaaactaggagaaccaaatct

SEQ ID NO: 1344958 - DNA, 15 bp, Homo sapiens
ttaaacttttttaac

SEQ ID NO: 1344959 - DNA, 17 bp, Homo sapiens
ttaaagaaaagatgaaa

SEQ ID NO: 1344960 - DNA, 15 bp, Homo sapiens
ttacccacctagaac

SEQ ID NO: 1344961 - DNA, 18 bp, Homo sapiens
ttacctagctaattattt

SEQ ID NO: 1344962 - DNA, 21 bp, Homo sapiens
ttacctagctaattatttaat

SEQ ID NO: 1344963 - DNA, 19 bp, Homo sapiens
ttacctagtgaaacttttc

SEQ ID NO: 1344964 - DNA, 18 bp, Homo sapiens
ttaccttttcagggctgg

SEQ ID NO: 1344965 - DNA, 19 bp, Homo sapiens
ttaccttttttttttcttg

SEQ ID NO: 1344966 - DNA, 14 bp, Homo sapiens
ttacgggtacctga

SEQ ID NO: 1344967 - DNA, 15 bp, Homo sapiens
ttacgtgctctgtgg

SEQ ID NO: 1344968 - DNA, 15 bp, Homo sapiens
ttactaaaaagtata

SEQ ID NO: 1344969 - DNA, 19 bp, Homo sapiens
ttactgtctattaatattc

SEQ ID NO: 1344970 - DNA, 21 bp, Homo sapiens
ttacttaaaccgccaaggctg

SEQ ID NO: 1344971 - DNA, 11 bp, Homo sapiens
ttactttgtaa

SEQ ID NO: 1344972 - DNA, 20 bp, Homo sapiens
ttactttgtaaattctgatt

SEQ ID NO: 1344973 - DNA, 23 bp, Homo sapiens
ttagaagcactacaccttgcctt

SEQ ID NO: 1344974 - DNA, 18 bp, Homo sapiens
ttagaataagaatttgca

SEQ ID NO: 1344975 - DNA, 23 bp, Homo sapiens
ttagaatccctgtgttaatttaa

SEQ ID NO: 1344976 - DNA, 13 bp, Homo sapiens
ttagaattgaagg

SEQ ID NO: 1344977 - DNA, 14 bp, Homo sapiens
ttagaattgaaggt

SEQ ID NO: 1344978 - DNA, 16 bp, Homo sapiens
ttagatcatagtttta

SEQ ID NO: 1344979 - DNA, 16 bp, Homo sapiens
ttagatgttgccatgt

SEQ ID NO: 1344980 - DNA, 22 bp, Homo sapiens
ttagatgttgccatgtgtttta

SEQ ID NO: 1344981 - DNA, 20 bp, Homo sapiens
ttagattcttaattcatgag

SEQ ID NO: 1344982 - DNA, 14 bp, Homo sapiens
ttagctcctgtggc

SEQ ID NO: 1344983 - DNA, 18 bp, Homo sapiens
ttagctggccacatggcg

SEQ ID NO: 1344984 - DNA, 20 bp, Homo sapiens
ttaggaagtgtttatgttgt

SEQ ID NO: 1344985 - DNA, 20 bp, Homo sapiens
ttaggcaaggctatgtgatt

SEQ ID NO: 1344986 - DNA, 14 bp, Homo sapiens
ttagggagtattct

SEQ ID NO: 1344987 - DNA, 17 bp, Homo sapiens
ttagggcaccaggggtt

SEQ ID NO: 1344988 - DNA, 18 bp, Homo sapiens
ttaggttggcaaaaaggc

SEQ ID NO: 1344989 - DNA, 17 bp, Homo sapiens
ttagtaatttctttttt

SEQ ID NO: 1344990 - DNA, 20 bp, Homo sapiens
ttagtatttatttatgtact

SEQ ID NO: 1344991 - DNA, 11 bp, Homo sapiens
ttagtttagaa

SEQ ID NO: 1344992 - DNA, 20 bp, Homo sapiens
ttagtttagaacaggttttt

SEQ ID NO: 1344993 - DNA, 22 bp, Homo sapiens
ttagtttgtatgccaagtgaga

SEQ ID NO: 1344994 - DNA, 15 bp, Homo sapiens
ttagtttgtgtgttg

SEQ ID NO: 1344995 - DNA, 23 bp, Homo sapiens
ttagtttttggttgggaatgagg

SEQ ID NO: 1344996 - DNA, 13 bp, Homo sapiens
ttataaagcatgt

SEQ ID NO: 1344997 - DNA, 18 bp, Homo sapiens
ttataagaagaagttcat

SEQ ID NO: 1344998 - DNA, 20 bp, Homo sapiens
ttataataaatatatacatt

SEQ ID NO: 1344999 - DNA, 20 bp, Homo sapiens
ttataattttttttaaaata

SEQ ID NO: 1345000 - DNA, 19 bp, Homo sapiens
ttatacaaaataagaacga

SEQ ID NO: 1345001 - DNA, 21 bp, Homo sapiens
ttatacaaacctaccaaaatg

SEQ ID NO: 1345002 - DNA, 18 bp, Homo sapiens
ttatagcaacaacaattg

SEQ ID NO: 1345003 - DNA, 20 bp, Homo sapiens
ttatagcaacaacaattggt

SEQ ID NO: 1345004 - DNA, 20 bp, Homo sapiens
ttatagtctaagactatata

SEQ ID NO: 1345005 - DNA, 22 bp, Homo sapiens
ttatataactgtatttgaaata

SEQ ID NO: 1345006 - DNA, 20 bp, Homo sapiens
ttatatcatgcaaaatatgt

SEQ ID NO: 1345007 - DNA, 16 bp, Homo sapiens
ttatatctggcctctg

SEQ ID NO: 1345008 - DNA, 15 bp, Homo sapiens
ttatatgtatgtgtt

SEQ ID NO: 1345009 - DNA, 16 bp, Homo sapiens
ttatatgtatgtgttt

SEQ ID NO: 1345010 - DNA, 19 bp, Homo sapiens
ttatattactgacatttct

SEQ ID NO: 1345011 - DNA, 12 bp, Homo sapiens
ttatatttcctt

SEQ ID NO: 1345012 - DNA, 17 bp, Homo sapiens
ttatcaatatctaatat

SEQ ID NO: 1345013 - DNA, 18 bp, Homo sapiens
ttatccacatgaaaataa

SEQ ID NO: 1345014 - DNA, 22 bp, Homo sapiens
ttatcgtttttgtattttcatg

SEQ ID NO: 1345015 - DNA, 22 bp, Homo sapiens
ttggggaggagggggccgggcg

SEQ ID NO: 1345016 - DNA, 23 bp, Homo sapiens
ttgggggaggggagactttgatg

SEQ ID NO: 1345017 - DNA, 17 bp, Homo sapiens
ttggtaaatgtttcttt

SEQ ID NO: 1345018 - DNA, 17 bp, Homo sapiens
ttggtgtaatttgaaga

SEQ ID NO: 1345019 - DNA, 14 bp, Homo sapiens
ttggtgtacagact

SEQ ID NO: 1345020 - DNA, 14 bp, Homo sapiens
ttggttctgtgaac

SEQ ID NO: 1345021 - DNA, 13 bp, Homo sapiens
ttggtttccccaa

SEQ ID NO: 1345022 - DNA, 19 bp, Homo sapiens
ttggttttatgatgacgta

SEQ ID NO: 1345023 - DNA, 13 bp, Homo sapiens
ttggttttatggt

SEQ ID NO: 1345024 - DNA, 15 bp, Homo sapiens
ttgtaaaagaaatca

SEQ ID NO: 1345025 - DNA, 13 bp, Homo sapiens
ttgtaaacattta

SEQ ID NO: 1345026 - DNA, 14 bp, Homo sapiens
ttgtaaacatttat

SEQ ID NO: 1345027 - DNA, 17 bp, Homo sapiens
ttgtaaagtatgtatta

SEQ ID NO: 1345028 - DNA, 18 bp, Homo sapiens
ttgtaaataggattttta

SEQ ID NO: 1345029 - DNA, 15 bp, Homo sapiens
ttgtaaattctgatt

SEQ ID NO: 1345030 - DNA, 16 bp, Homo sapiens
ttgtaaatttagtgtt

SEQ ID NO: 1345031 - DNA, 24 bp, Homo sapiens
ttgtaagaaggcaatattaaccta

SEQ ID NO: 1345032 - DNA, 18 bp, Homo sapiens
ttgtacaaaattaagcaa

SEQ ID NO: 1345033 - DNA, 22 bp, Homo sapiens
ttgtacatacgatttaaggtat

SEQ ID NO: 1345034 - DNA, 20 bp, Homo sapiens
ttgtacatgtaacattaaag

SEQ ID NO: 1345035 - DNA, 20 bp, Homo sapiens
ttgtacatttgggagttttt

SEQ ID NO: 1345036 - DNA, 21 bp, Homo sapiens
ttgtacgacgtcagatgttta

SEQ ID NO: 1345037 - DNA, 15 bp, Homo sapiens
ttgtacttaaatggt

SEQ ID NO: 1345038 - DNA, 18 bp, Homo sapiens
ttgtagagtgtagactgt

SEQ ID NO: 1345039 - DNA, 17 bp, Homo sapiens
ttgtagttctttaaact

SEQ ID NO: 1345040 - DNA, 22 bp, Homo sapiens
ttgtatagttatgtaaataatt

SEQ ID NO: 1345041 - DNA, 14 bp, Homo sapiens
ttgtatattacaat

SEQ ID NO: 1345042 - DNA, 15 bp, Homo sapiens
ttgtatattacaatg

SEQ ID NO: 1345043 - DNA, 14 bp, Homo sapiens
ttgtatattggttt

SEQ ID NO: 1345044 - DNA, 16 bp, Homo sapiens
ttgtattaaagacaga

SEQ ID NO: 1345045 - DNA, 17 bp, Homo sapiens
ttgtattatttttgtag

SEQ ID NO: 1345046 - DNA, 16 bp, Homo sapiens
ttgtattttcatgaaa

SEQ ID NO: 1345047 - DNA, 22 bp, Homo sapiens
ttgtcaaactgtagaaatgatg

SEQ ID NO: 1345048 - DNA, 14 bp, Homo sapiens
ttgtcactttttat

SEQ ID NO: 1345049 - DNA, 21 bp, Homo sapiens
ttgtcactttttatgctattt

SEQ ID NO: 1345050 - DNA, 16 bp, Homo sapiens
ttgtcctattagtgtt

SEQ ID NO: 1345051 - DNA, 14 bp, Homo sapiens
ttgtcgctcatgtg

SEQ ID NO: 1345052 - DNA, 20 bp, Homo sapiens
ttgtctggcaaggactttgt

SEQ ID NO: 1345053 - DNA, 14 bp, Homo sapiens
ttgtgatttcttta

SEQ ID NO: 1345054 - DNA, 13 bp, Homo sapiens
ttgtgccagagga

SEQ ID NO: 1345055 - DNA, 12 bp, Homo sapiens
ttgtgccatctg

SEQ ID NO: 1345056 - DNA, 13 bp, Homo sapiens
ttgtgcctggggt

SEQ ID NO: 1345057 - DNA, 18 bp, Homo sapiens
ttgtgctagaaattttca

SEQ ID NO: 1345058 - DNA, 24 bp, Homo sapiens
ttgtgtaatgaaaatgaatatcta

SEQ ID NO: 1345059 - DNA, 19 bp, Homo sapiens
tttcactctaagtcatgta

SEQ ID NO: 1345060 - DNA, 23 bp, Homo sapiens
tttcactctaagtcatgtatgtt

SEQ ID NO: 1345061 - DNA, 16 bp, Homo sapiens
tttcagaaaaagaaat

SEQ ID NO: 1345062 - DNA, 16 bp, Homo sapiens
tttcagaaaatgaaaa

SEQ ID NO: 1345063 - DNA, 21 bp, Homo sapiens
tttcagaaatataacacattt

SEQ ID NO: 1345064 - DNA, 22 bp, Homo sapiens
tttcagaagttagtttgtatat

SEQ ID NO: 1345065 - DNA, 15 bp, Homo sapiens
tttcagggctggctc

SEQ ID NO: 1345066 - DNA, 21 bp, Homo sapiens
tttcaggttcagtattatgta

SEQ ID NO: 1345067 - DNA, 16 bp, Homo sapiens
tttcagtactttttta

SEQ ID NO: 1345068 - DNA, 23 bp, Homo sapiens
tttcatctcatttaagggaaaaa

SEQ ID NO: 1345069 - DNA, 14 bp, Homo sapiens
tttcatgaaaatac

SEQ ID NO: 1345070 - DNA, 16 bp, Homo sapiens
tttcattaaatccttt

SEQ ID NO: 1345071 - DNA, 23 bp, Homo sapiens
tttcatttaagggaaagaaaatg

SEQ ID NO: 1345072 - DNA, 16 bp, Homo sapiens
tttccactccattgtc

SEQ ID NO: 1345073 - DNA, 19 bp, Homo sapiens
tttccagacttccttgaga

SEQ ID NO: 1345074 - DNA, 19 bp, Homo sapiens
tttccaggtttaagctgtt

SEQ ID NO: 1345075 - DNA, 10 bp, Homo sapiens
tttcccaagc

SEQ ID NO: 1345076 - DNA, 19 bp, Homo sapiens
tttcccacttcccaccctg

SEQ ID NO: 1345077 - DNA, 22 bp, Homo sapiens
tttcccatttgtgccagaggaa

SEQ ID NO: 1345078 - DNA, 16 bp, Homo sapiens
tttccctattagagaa

SEQ ID NO: 1345079 - DNA, 13 bp, Homo sapiens
tttcctcttgtga

SEQ ID NO: 1345080 - DNA, 18 bp, Homo sapiens
tttcctttttgacactga

SEQ ID NO: 1345081 - DNA, 20 bp, Homo sapiens
tttcgaagtcattaaactgg

SEQ ID NO: 1345082 - DNA, 13 bp, Homo sapiens
tttcgcctttcct

SEQ ID NO: 1345083 - DNA, 12 bp, Homo sapiens
tttctaaagact

SEQ ID NO: 1345084 - DNA, 16 bp, Homo sapiens
tttctaagagaagtta

SEQ ID NO: 1345085 - DNA, 15 bp, Homo sapiens
tttctaattaacctt

SEQ ID NO: 1345086 - DNA, 20 bp, Homo sapiens
tttctactgtcaaatgatgt

SEQ ID NO: 1345087 - DNA, 15 bp, Homo sapiens
tttctattttaagac

SEQ ID NO: 1345088 - DNA, 21 bp, Homo sapiens
tttctcaactgggtccagaag

SEQ ID NO: 1345089 - DNA, 20 bp, Homo sapiens
tttctcagtgttggtatatt

SEQ ID NO: 1345090 - DNA, 19 bp, Homo sapiens
tttctcctttaattgtaaa

SEQ ID NO: 1345091 - DNA, 12 bp, Homo sapiens
tttctctctcta

SEQ ID NO: 1345092 - DNA, 17 bp, Homo sapiens
tttctcttgagctggcc

SEQ ID NO: 1345093 - DNA, 12 bp, Homo sapiens
tttctgccctgg

SEQ ID NO: 1345094 - DNA, 20 bp, Homo sapiens
tttctgccctggctgctgcc

SEQ ID NO: 1345095 - DNA, 17 bp, Homo sapiens
tttctgctttagacttg

SEQ ID NO: 1345096 - DNA, 15 bp, Homo sapiens
tttctggggaaagac

SEQ ID NO: 1345097 - DNA, 21 bp, Homo sapiens
tttctggggaaagacactgcc

SEQ ID NO: 1345098 - DNA, 20 bp, Homo sapiens
tttctggtggtctgttggca

SEQ ID NO: 1345099 - DNA, 21 bp, Homo sapiens
tttctgtgtgtcagttttcat

SEQ ID NO: 1345100 - DNA, 17 bp, Homo sapiens
tttcttatgtgacatta

SEQ ID NO: 1345101 - DNA, 15 bp, Homo sapiens
tttcttcagggctgc

SEQ ID NO: 1345102 - DNA, 23 bp, Homo sapiens
tttctttaaccttgtataaatta

SEQ ID NO: 1345103 - DNA, 12 bp, Homo sapiens
tttgaaaaatat

SEQ ID NO: 1345104 - DNA, 13 bp, Homo sapiens
tttgaaaagcaga

SEQ ID NO: 1345105 - DNA, 16 bp, Homo sapiens
tttgaaaagcagacat

SEQ ID NO: 1345106 - DNA, 18 bp, Homo sapiens
tttgaaaagcagacattt

SEQ ID NO: 1345107 - DNA, 14 bp, Homo sapiens
tttgaaaatagttt

SEQ ID NO: 1345108 - DNA, 15 bp, Homo sapiens
tttgaaaatagttta

SEQ ID NO: 1345109 - DNA, 17 bp, Homo sapiens
tttgaactcttctcatt

SEQ ID NO: 1345110 - DNA, 23 bp, Homo sapiens
tttgacaagctggcttacactgg

SEQ ID NO: 1345111 - DNA, 12 bp, Homo sapiens
tttgacactgaa

SEQ ID NO: 1345112 - DNA, 22 bp, Homo sapiens
tttgacactgaaagttttgtaa

SEQ ID NO: 1345113 - DNA, 17 bp, Homo sapiens
tttgactaattttacat

SEQ ID NO: 1345114 - DNA, 21 bp, Homo sapiens
tttgactaattttacatgttt

SEQ ID NO: 1345115 - DNA, 22 bp, Homo sapiens
tttgactttttttgtatgtgtg

SEQ ID NO: 1345116 - DNA, 14 bp, Homo sapiens
tttgagctgccttc

SEQ ID NO: 1345117 - DNA, 18 bp, Homo sapiens
tttgaggattagtttaga

SEQ ID NO: 1345118 - DNA, 19 bp, Homo sapiens
tttgaggattagtttagaa

SEQ ID NO: 1345119 - DNA, 23 bp, Homo sapiens
tttgaggattagtttagaacagg

SEQ ID NO: 1345120 - DNA, 19 bp, Homo sapiens
tttgatagggaactgggga

SEQ ID NO: 1345121 - DNA, 17 bp, Homo sapiens
tttgatgcatgtctttt

SEQ ID NO: 1345122 - DNA, 17 bp, Homo sapiens
tttgatgtcagcagttg

SEQ ID NO: 1345123 - DNA, 17 bp, Homo sapiens
tttgattatttaagact

SEQ ID NO: 1345124 - DNA, 15 bp, Homo sapiens
tttgattatttgcat

SEQ ID NO: 1345125 - DNA, 17 bp, Homo sapiens
tttgattgggatgaatg

SEQ ID NO: 1345126 - DNA, 13 bp, Homo sapiens
tttgatttattaa

SEQ ID NO: 1345127 - DNA, 14 bp, Homo sapiens
tttgcaaccaggaa

SEQ ID NO: 1345128 - DNA, 15 bp, Homo sapiens
tttgcaaccaggaac

SEQ ID NO: 1345129 - DNA, 16 bp, Homo sapiens
tttgcaataacagctg

SEQ ID NO: 1345130 - DNA, 19 bp, Homo sapiens
tttgcacatgtttcctcta

SEQ ID NO: 1345131 - DNA, 14 bp, Homo sapiens
tttgcactgtttaa

SEQ ID NO: 1345132 - DNA, 14 bp, Homo sapiens
tttgcagctcagaa

SEQ ID NO: 1345133 - DNA, 22 bp, Homo sapiens
tttgcatacttacctagtgaaa

SEQ ID NO: 1345134 - DNA, 14 bp, Homo sapiens
tttgcatctgaaat

SEQ ID NO: 1345135 - DNA, 22 bp, Homo sapiens
tttgcatctgaaataggaaaca

SEQ ID NO: 1345136 - DNA, 17 bp, Homo sapiens
tttgccaggacatgcaa

SEQ ID NO: 1345137 - DNA, 14 bp, Homo sapiens
tttgccattgtgaa

SEQ ID NO: 1345138 - DNA, 13 bp, Homo sapiens
tttgctcttcaga

SEQ ID NO: 1345139 - DNA, 20 bp, Homo sapiens
tttgctcttcagatgccact

SEQ ID NO: 1345140 - DNA, 15 bp, Homo sapiens
ttttactgtgtttta

SEQ ID NO: 1345141 - DNA, 22 bp, Homo sapiens
ttttagaataagaatttgcata

SEQ ID NO: 1345142 - DNA, 17 bp, Homo sapiens
ttttagatggtttcttg

SEQ ID NO: 1345143 - DNA, 14 bp, Homo sapiens
ttttagtaatttct

SEQ ID NO: 1345144 - DNA, 14 bp, Homo sapiens
ttttatacaaaata

SEQ ID NO: 1345145 - DNA, 14 bp, Homo sapiens
ttttatacaaacct

SEQ ID NO: 1345146 - DNA, 19 bp, Homo sapiens
ttttatattactgacattt

SEQ ID NO: 1345147 - DNA, 20 bp, Homo sapiens
ttttatatttcctttatgtg

SEQ ID NO: 1345148 - DNA, 12 bp, Homo sapiens
ttttatcagtag

SEQ ID NO: 1345149 - DNA, 22 bp, Homo sapiens
ttttatctattctgagaaaaca

SEQ ID NO: 1345150 - DNA, 17 bp, Homo sapiens
ttttatggttacttctt

SEQ ID NO: 1345151 - DNA, 22 bp, Homo sapiens
ttttattaaaatatttcaggtt

SEQ ID NO: 1345152 - DNA, 13 bp, Homo sapiens
ttttattaatgca

SEQ ID NO: 1345153 - DNA, 19 bp, Homo sapiens
ttttattaatgcactttct

SEQ ID NO: 1345154 - DNA, 13 bp, Homo sapiens
ttttattgttgta

SEQ ID NO: 1345155 - DNA, 14 bp, Homo sapiens
ttttcaatatattg

SEQ ID NO: 1345156 - DNA, 15 bp, Homo sapiens
ttttcaatatattga

SEQ ID NO: 1345157 - DNA, 18 bp, Homo sapiens
ttttcaatatattgaact

SEQ ID NO: 1345158 - DNA, 20 bp, Homo sapiens
ttttcaatatattgaacttt

SEQ ID NO: 1345159 - DNA, 23 bp, Homo sapiens
ttttcactctaagtcatgtatgt

SEQ ID NO: 1345160 - DNA, 17 bp, Homo sapiens
ttttcagaaaaagaaat

SEQ ID NO: 1345161 - DNA, 22 bp, Homo sapiens
ttttcagggctggctcctgatc

SEQ ID NO: 1345162 - DNA, 14 bp, Homo sapiens
ttttcataaacaag

SEQ ID NO: 1345163 - DNA, 19 bp, Homo sapiens
ttttcatagtatccatatt

SEQ ID NO: 1345164 - DNA, 21 bp, Homo sapiens
ttttcattcaggtatttgtaa

SEQ ID NO: 1345165 - DNA, 19 bp, Homo sapiens
ttttccaaagagtgatagt

SEQ ID NO: 1345166 - DNA, 22 bp, Homo sapiens
ttttccaaatgtaataaacttt

SEQ ID NO: 1345167 - DNA, 19 bp, Homo sapiens
ttttccaggtttaagctgt

SEQ ID NO: 1345168 - DNA, 22 bp, Homo sapiens
ttttccctattagagaagagat

SEQ ID NO: 1345169 - DNA, 13 bp, Homo sapiens
ttttctacagtgg

SEQ ID NO: 1345170 - DNA, 14 bp, Homo sapiens
ttttctacagtggt

SEQ ID NO: 1345171 - DNA, 14 bp, Homo sapiens
ttttctagaattat

SEQ ID NO: 1345172 - DNA, 20 bp, Homo sapiens
ttttctagaattatttttca

SEQ ID NO: 1345173 - DNA, 19 bp, Homo sapiens
ttttctattatttttataa

SEQ ID NO: 1345174 - DNA, 20 bp, Homo sapiens
ttttctctgcatttaaaaaa

SEQ ID NO: 1345175 - DNA, 13 bp, Homo sapiens
ttttctgactaat

SEQ ID NO: 1345176 - DNA, 19 bp, Homo sapiens
ttttctgctttagacttga

SEQ ID NO: 1345177 - DNA, 11 bp, Homo sapiens
ttttctggcac

SEQ ID NO: 1345178 - DNA, 23 bp, Homo sapiens
ttttctggggaaagacactgcct

SEQ ID NO: 1345179 - DNA, 23 bp, Homo sapiens
ttttctgttgaagtttacaatca

SEQ ID NO: 1345180 - DNA, 16 bp, Homo sapiens
ttttcttcttgggata

SEQ ID NO: 1345181 - DNA, 11 bp, Homo sapiens
ttttgaaaagt

SEQ ID NO: 1345182 - DNA, 17 bp, Homo sapiens
ttttgaactcttctcat

SEQ ID NO: 1345183 - DNA, 17 bp, Homo sapiens
ttttgcaaagatttaat

SEQ ID NO: 1345184 - DNA, 19 bp, Homo sapiens
ttttgcaaagatttaatct

SEQ ID NO: 1345185 - DNA, 20 bp, Homo sapiens
ttttgcacatgtttcctcta

SEQ ID NO: 1345186 - DNA, 23 bp, Homo sapiens
ttttggcaatgactcaaagtctg

SEQ ID NO: 1345187 - DNA, 22 bp, Homo sapiens
ttttggctgaaattctcctgga

SEQ ID NO: 1345188 - DNA, 15 bp, Homo sapiens
ttttggggagccaga

SEQ ID NO: 1345189 - DNA, 19 bp, Homo sapiens
ttttggtaaagactggctt

SEQ ID NO: 1345190 - DNA, 22 bp, Homo sapiens
ttttgtaataagcaatcaaggt

SEQ ID NO: 1345191 - DNA, 17 bp, Homo sapiens
ttttgtgtaatgaaaat

SEQ ID NO: 1345192 - DNA, 15 bp, Homo sapiens
ttttgtgtgaaattg

SEQ ID NO: 1345193 - DNA, 15 bp, Homo sapiens
ttttgttaactgatt

SEQ ID NO: 1345194 - DNA, 15 bp, Homo sapiens
ttttgttattaaaca

SEQ ID NO: 1345195 - DNA, 19 bp, Homo sapiens
ttttgttgtacttaaatgg

SEQ ID NO: 1345196 - DNA, 15 bp, Homo sapiens
ttttgtttggtaaat

SEQ ID NO: 1345197 - DNA, 16 bp, Homo sapiens
ttttgtttggtaaatg

SEQ ID NO: 1345198 - DNA, 16 bp, Homo sapiens
ttttgttttaaaactg

SEQ ID NO: 1345199 - DNA, 22 bp, Homo sapiens
ttttgttttaaaactggacctg

SEQ ID NO: 1345200 - DNA, 18 bp, Homo sapiens
tttttaaaaaatattttc

SEQ ID NO: 1345201 - DNA, 19 bp, Homo sapiens
tttttaaaaaatattttct

SEQ ID NO: 1345202 - DNA, 14 bp, Homo sapiens
tttttaaaacacat

SEQ ID NO: 1345203 - DNA, 23 bp, Homo sapiens
tttttaaaacacatgtttttata

SEQ ID NO: 1345204 - DNA, 23 bp, Homo sapiens
tttttaaaatagaaattttgtaa

SEQ ID NO: 1345205 - DNA, 12 bp, Homo sapiens
tttttaaaattt

SEQ ID NO: 1345206 - DNA, 20 bp, Homo sapiens
tttttaagctgcaaatctga

SEQ ID NO: 1345207 - DNA, 16 bp, Homo sapiens
tttttaatttacttgt

SEQ ID NO: 1345208 - DNA, 18 bp, Homo sapiens
tttttactgtgttttata

SEQ ID NO: 1345209 - DNA, 14 bp, Homo sapiens
tttttattaaaata

SEQ ID NO: 1345210 - DNA, 19 bp, Homo sapiens
tttttattaatcactgtgt

SEQ ID NO: 1345211 - DNA, 12 bp, Homo sapiens
tttttattgttg

SEQ ID NO: 1345212 - DNA, 17 bp, Homo sapiens
tttttatttatatgtat

SEQ ID NO: 1345213 - DNA, 21 bp, Homo sapiens
tttttcaaaatccaaaaagaa

SEQ ID NO: 1345214 - DNA, 17 bp, Homo sapiens
tttttcaagttgtaaat

SEQ ID NO: 1345215 - DNA, 18 bp, Homo sapiens
tttttcataaacaagttc

SEQ ID NO: 1345216 - DNA, 19 bp, Homo sapiens
tttttgaactcttctcatt

SEQ ID NO: 1345217 - DNA, 18 bp, Homo sapiens
tttttgacactgaaagtt

SEQ ID NO: 1345218 - DNA, 19 bp, Homo sapiens
tttttgacactgaaagttt

SEQ ID NO: 1345219 - DNA, 20 bp, Homo sapiens
tttttgactttttttgtatg

SEQ ID NO: 1345220 - DNA, 20 bp, Homo sapiens
tttttgcacatgtttcctct

SEQ ID NO: 1345221 - DNA, 19 bp, Homo sapiens
tttttgcatgcatgcaaat

SEQ ID NO: 1345222 - DNA, 23 bp, Homo sapiens
tttttgctgctgcctctttccct

SEQ ID NO: 1345223 - DNA, 12 bp, Homo sapiens
tttttggacttc

SEQ ID NO: 1345224 - DNA, 18 bp, Homo sapiens
tttttggacttcaaagca

SEQ ID NO: 1345225 - DNA, 21 bp, Homo sapiens
tttttggggggttttcttgcc

SEQ ID NO: 1345226 - DNA, 16 bp, Homo sapiens
tttttgtaaatgtgta

SEQ ID NO: 1345227 - DNA, 20 bp, Homo sapiens
tttttgtaaatgtgtacata

SEQ ID NO: 1345228 - DNA, 12 bp, Homo sapiens
tttttgtatgtg

SEQ ID NO: 1345229 - DNA, 12 bp, Homo sapiens
tttttgtttgcc

SEQ ID NO: 1345230 - DNA, 14 bp, Homo sapiens
ttttttaaaataga

SEQ ID NO: 1345231 - DNA, 23 bp, Homo sapiens
ttttttaagcttcagttgcttgt

SEQ ID NO: 1345232 - DNA, 18 bp, Homo sapiens
ttttttaagttcttatga

SEQ ID NO: 1345233 - DNA, 21 bp, Homo sapiens
ttttttagtatttatttatgt

SEQ ID NO: 1345234 - DNA, 13 bp, Homo sapiens
ttttttgtatgaa

SEQ ID NO: 1345235 - DNA, 13 bp, Homo sapiens
ttttttgtttgtt

SEQ ID NO: 1345236 - DNA, 13 bp, Homo sapiens
tttttttgtaata

SEQ ID NO: 1345237 - DNA, 16 bp, Homo sapiens
tatattttgtgtgaaa

SEQ ID NO: 1345238 - DNA, 19 bp, Homo sapiens
tatattttgtgtgaaattg

SEQ ID NO: 1345239 - DNA, 18 bp, Homo sapiens
tatcaaagtcattaaaga

SEQ ID NO: 1345240 - DNA, 16 bp, Homo sapiens
tatcaaattaattgtg

SEQ ID NO: 1345241 - DNA, 19 bp, Homo sapiens
tatcaacttagtcaataag

SEQ ID NO: 1345242 - DNA, 14 bp, Homo sapiens
tatcaatatctaat

SEQ ID NO: 1345243 - DNA, 17 bp, Homo sapiens
tatcaatatctaatata

SEQ ID NO: 1345244 - DNA, 21 bp, Homo sapiens
tatcaatatctaatatatatg

SEQ ID NO: 1345245 - DNA, 20 bp, Homo sapiens
tatcacattggagtcactgc

SEQ ID NO: 1345246 - DNA, 22 bp, Homo sapiens
tatcattcaagtgtaaaatatt

SEQ ID NO: 1345247 - DNA, 20 bp, Homo sapiens
ctggagcactgggctcccgg

SEQ ID NO: 1345248 - DNA, 14 bp, Homo sapiens
ctggagctcatctg

SEQ ID NO: 1345249 - DNA, 20 bp, Homo sapiens
ctggagctcatctgcaaaag

SEQ ID NO: 1345250 - DNA, 16 bp, Homo sapiens
ctggagtctcctgagg

SEQ ID NO: 1345251 - DNA, 22 bp, Homo sapiens
ctggcaatggtagtttctgtgg

SEQ ID NO: 1345252 - DNA, 13 bp, Homo sapiens
ctggcagcccaga

SEQ ID NO: 1345253 - DNA, 21 bp, Homo sapiens
agggcttcctctagaagccaa

SEQ ID NO: 1345254 - DNA, 22 bp, Homo sapiens
agggcttcctctagaagccaag

SEQ ID NO: 1345255 - DNA, 18 bp, Homo sapiens
aggggaaaatcagcctgc

SEQ ID NO: 1345256 - DNA, 15 bp, Homo sapiens
aggggagagcctgct

SEQ ID NO: 1345257 - DNA, 17 bp, Homo sapiens
aggggagagcctgctgg

SEQ ID NO: 1345258 - DNA, 18 bp, Homo sapiens
aggggagggggatccgac

SEQ ID NO: 1345259 - DNA, 15 bp, Homo sapiens
aggggcacagggtct

SEQ ID NO: 1345260 - DNA, 14 bp, Homo sapiens
aggggccggccctg

SEQ ID NO: 1345261 - DNA, 13 bp, Homo sapiens
aggggcctggaga

SEQ ID NO: 1345262 - DNA, 21 bp, Homo sapiens
aggggcctggagatcctcctg

SEQ ID NO: 1345263 - DNA, 22 bp, Homo sapiens
aggggcctggagatcctcctgc

SEQ ID NO: 1345264 - DNA, 18 bp, Homo sapiens
aggggctgcttcctcctg

SEQ ID NO: 1345265 - DNA, 16 bp, Homo sapiens
agggggcttgaagcca

SEQ ID NO: 1345266 - DNA, 19 bp, Homo sapiens
agggggcttgaagccaaag

SEQ ID NO: 1345267 - DNA, 15 bp, Homo sapiens
agggggtggaggggt

SEQ ID NO: 1345268 - DNA, 15 bp, Homo sapiens
aggggtcggctgacc

SEQ ID NO: 1345269 - DNA, 15 bp, Homo sapiens
aggggtctccctggc

SEQ ID NO: 1345270 - DNA, 16 bp, Homo sapiens
aggggtctccctggct

SEQ ID NO: 1345271 - DNA, 14 bp, Homo sapiens
aggggtgtcttggg

SEQ ID NO: 1345272 - DNA, 18 bp, Homo sapiens
aggggttcccttgagggc

SEQ ID NO: 1345273 - DNA, 20 bp, Homo sapiens
aggggttcccttgagggctg

SEQ ID NO: 1345274 - DNA, 21 bp, Homo sapiens
aggggttcccttgagggctgc

SEQ ID NO: 1345275 - DNA, 20 bp, Homo sapiens
agggtaggagggtgggaagg

SEQ ID NO: 1345276 - DNA, 21 bp, Homo sapiens
agggtatggactatctgtctg

SEQ ID NO: 1345277 - DNA, 18 bp, Homo sapiens
agggtccaaccagacctg

SEQ ID NO: 1345278 - DNA, 17 bp, Homo sapiens
agggtcggaacccaagc

SEQ ID NO: 1345279 - DNA, 16 bp, Homo sapiens
aggtaatgtgaataaa

SEQ ID NO: 1345280 - DNA, 20 bp, Homo sapiens
aggtaccctgggtgtccccg

SEQ ID NO: 1345281 - DNA, 15 bp, Homo sapiens
aggtagagtctgagg

SEQ ID NO: 1345282 - DNA, 20 bp, Homo sapiens
aggtattaaaactaaatttc

SEQ ID NO: 1345283 - DNA, 21 bp, Homo sapiens
aggtcaaggctgcagtgagcc

SEQ ID NO: 1345284 - DNA, 18 bp, Homo sapiens
aggtcactgtttcctggg

SEQ ID NO: 1345285 - DNA, 16 bp, Homo sapiens
aggtccagctctggag

SEQ ID NO: 1345286 - DNA, 22 bp, Homo sapiens
aggtcggtaggttcagccaagg

SEQ ID NO: 1345287 - DNA, 13 bp, Homo sapiens
aggtgagaaactg

SEQ ID NO: 1345288 - DNA, 21 bp, Homo sapiens
aggtgagaagcagaggaagga

SEQ ID NO: 1345289 - DNA, 22 bp, Homo sapiens
aggtgagtttgagctgccttcc

SEQ ID NO: 1345290 - DNA, 23 bp, Homo sapiens
aggtgatcccgttttccccatga

SEQ ID NO: 1345291 - DNA, 22 bp, Homo sapiens
aggtgatctgctgcagagcagt

SEQ ID NO: 1345292 - DNA, 11 bp, Homo sapiens
aggtgcagagg

SEQ ID NO: 1345293 - DNA, 16 bp, Homo sapiens
aggtgctggagcactg

SEQ ID NO: 1345294 - DNA, 20 bp, Homo sapiens
aggtgctggagcactgggct

SEQ ID NO: 1345295 - DNA, 21 bp, Homo sapiens
aggtgctggagcactgggctc

SEQ ID NO: 1345296 - DNA, 16 bp, Homo sapiens
aggtggaagaagggag

SEQ ID NO: 1345297 - DNA, 19 bp, Homo sapiens
aggtggaagaagggagaag

SEQ ID NO: 1345298 - DNA, 16 bp, Homo sapiens
aggtggatggccccag

SEQ ID NO: 1345299 - DNA, 12 bp, Homo sapiens
aggtgggcccgg

SEQ ID NO: 1345300 - DNA, 18 bp, Homo sapiens
aggtgggggcggggagta

SEQ ID NO: 1345301 - DNA, 14 bp, Homo sapiens
aggttataattttt

SEQ ID NO: 1345302 - DNA, 15 bp, Homo sapiens
aggttcagccaaggt

SEQ ID NO: 1345303 - DNA, 19 bp, Homo sapiens
aggttcagccaaggtttta

SEQ ID NO: 1345304 - DNA, 12 bp, Homo sapiens
aggttcctctgc

SEQ ID NO: 1345305 - DNA, 14 bp, Homo sapiens
aggttcctctgcct

SEQ ID NO: 1345306 - DNA, 15 bp, Homo sapiens
aggttcttcagaagt

SEQ ID NO: 1345307 - DNA, 17 bp, Homo sapiens
aggttgagctcttctta

SEQ ID NO: 1345308 - DNA, 16 bp, Homo sapiens
aggttgcagtgagctg

SEQ ID NO: 1345309 - DNA, 12 bp, Homo sapiens
aggtttattgtt

SEQ ID NO: 1345310 - DNA, 17 bp, Homo sapiens
aggttttataaggctga

SEQ ID NO: 1345311 - DNA, 16 bp, Homo sapiens
agtaaacgggaacatg

SEQ ID NO: 1345312 - DNA, 19 bp, Homo sapiens
agtaaacgggaacatgccc

SEQ ID NO: 1345313 - DNA, 21 bp, Homo sapiens
agtaacccccttaaatttaat

SEQ ID NO: 1345314 - DNA, 17 bp, Homo sapiens
agtaactgtcaggctga

SEQ ID NO: 1345315 - DNA, 17 bp, Homo sapiens
agtaacttacttaggtg

SEQ ID NO: 1345316 - DNA, 21 bp, Homo sapiens
agtaagaaagtgaagcaaatc

SEQ ID NO: 1345317 - DNA, 20 bp, Homo sapiens
agtaagccgtgattttcatt

SEQ ID NO: 1345318 - DNA, 21 bp, Homo sapiens
agtaagggaacaagttgagct

SEQ ID NO: 1345319 - DNA, 13 bp, Homo sapiens
agtaatatttatt

SEQ ID NO: 1345320 - DNA, 15 bp, Homo sapiens
agtaatatttattaa

SEQ ID NO: 1345321 - DNA, 22 bp, Homo sapiens
agtaatatttattaaatttttt

SEQ ID NO: 1345322 - DNA, 22 bp, Homo sapiens
agtaatcatctaagtcagtacc

SEQ ID NO: 1345323 - DNA, 21 bp, Homo sapiens
agtaatgaatttttatgatat

SEQ ID NO: 1345324 - DNA, 12 bp, Homo sapiens
agtacactgcct

SEQ ID NO: 1345325 - DNA, 12 bp, Homo sapiens
agtaccctggtt

SEQ ID NO: 1345326 - DNA, 18 bp, Homo sapiens
agtagaaaatgtgaccct

SEQ ID NO: 1345327 - DNA, 15 bp, Homo sapiens
agtagaactttgtat

SEQ ID NO: 1345328 - DNA, 19 bp, Homo sapiens
agtagaactttgtatagtt

SEQ ID NO: 1345329 - DNA, 21 bp, Homo sapiens
agtagaccttgttacttctga

SEQ ID NO: 1345330 - DNA, 23 bp, Homo sapiens
agtagaccttgttacttctgagg

SEQ ID NO: 1345331 - DNA, 12 bp, Homo sapiens
agtagagccagc

SEQ ID NO: 1345332 - DNA, 18 bp, Homo sapiens
agtagatgtggcctttga

SEQ ID NO: 1345333 - DNA, 20 bp, Homo sapiens
agtagatgtggcctttgaat

SEQ ID NO: 1345334 - DNA, 12 bp, Homo sapiens
agtagtcctgtg

SEQ ID NO: 1345335 - DNA, 18 bp, Homo sapiens
agtagttctgtatttgaa

SEQ ID NO: 1345336 - DNA, 21 bp, Homo sapiens
agtagttctgtatttgaaagt

SEQ ID NO: 1345337 - DNA, 17 bp, Homo sapiens
agtatagcctatggcag

SEQ ID NO: 1345338 - DNA, 18 bp, Homo sapiens
agtatcccacatccaact

SEQ ID NO: 1345339 - DNA, 19 bp, Homo sapiens
agtatgaaaatggaaattt

SEQ ID NO: 1345340 - DNA, 18 bp, Homo sapiens
agtatgtatattaaaaaa

SEQ ID NO: 1345341 - DNA, 20 bp, Homo sapiens
agtatgtatattaaaaaaga

SEQ ID NO: 1345342 - DNA, 21 bp, Homo sapiens
agtatgtggttttgtaatttg

SEQ ID NO: 1345343 - DNA, 16 bp, Homo sapiens
agtattctaataagct

SEQ ID NO: 1345344 - DNA, 21 bp, Homo sapiens
agtattctaataagctagttg

SEQ ID NO: 1345345 - DNA, 23 bp, Homo sapiens
agtattctcggatagttgctatt

SEQ ID NO: 1345346 - DNA, 13 bp, Homo sapiens
agtattgtttaaa

SEQ ID NO: 1345347 - DNA, 16 bp, Homo sapiens
agtattgtttaaaatg

SEQ ID NO: 1345348 - DNA, 19 bp, Homo sapiens
agtattgtttaaaatgtaa

SEQ ID NO: 1345349 - DNA, 13 bp, Homo sapiens
agtatttatttat

SEQ ID NO: 1345350 - DNA, 15 bp, Homo sapiens
agtatttatttatgt

SEQ ID NO: 1345351 - DNA, 17 bp, Homo sapiens
agtatttatttatgtac

SEQ ID NO: 1345352 - DNA, 14 bp, Homo sapiens
agtcaaggcctgct

SEQ ID NO: 1345353 - DNA, 19 bp, Homo sapiens
agtcaaggcctgctccctg

SEQ ID NO: 1345354 - DNA, 19 bp, Homo sapiens
tcaccatcaatcctgattc

SEQ ID NO: 1345355 - DNA, 19 bp, Homo sapiens
tcacccaggctggactgca

SEQ ID NO: 1345356 - DNA, 23 bp, Homo sapiens
tcaccccctcccacccccagccc

SEQ ID NO: 1345357 - DNA, 14 bp, Homo sapiens
tcacctgcctgtta

SEQ ID NO: 1345358 - DNA, 22 bp, Homo sapiens
tcacgggagatttcttgttgct

SEQ ID NO: 1345359 - DNA, 15 bp, Homo sapiens
tcactaaagcatgaa

SEQ ID NO: 1345360 - DNA, 14 bp, Homo sapiens
tcactacagtatta

SEQ ID NO: 1345361 - DNA, 21 bp, Homo sapiens
tcactaggcccccacttgcct

SEQ ID NO: 1345362 - DNA, 14 bp, Homo sapiens
tcactcacagagtc

SEQ ID NO: 1345363 - DNA, 23 bp, Homo sapiens
tcactcacagagtcaaggcctgc

SEQ ID NO: 1345364 - DNA, 20 bp, Homo sapiens
tcactcgggtttctctgtgg

SEQ ID NO: 1345365 - DNA, 15 bp, Homo sapiens
tcactggaaagggga

SEQ ID NO: 1345366 - DNA, 17 bp, Homo sapiens
tcactggaaaggggaga

SEQ ID NO: 1345367 - DNA, 21 bp, Homo sapiens
tcactggaaaggggagagcct

SEQ ID NO: 1345368 - DNA, 21 bp, Homo sapiens
tcactgtgatcaatattttta

SEQ ID NO: 1345369 - DNA, 15 bp, Homo sapiens
tcactgtgtatattt

SEQ ID NO: 1345370 - DNA, 15 bp, Homo sapiens
tcactgtttagattt

SEQ ID NO: 1345371 - DNA, 21 bp, Homo sapiens
tcactgtttagatttgccata

SEQ ID NO: 1345372 - DNA, 16 bp, Homo sapiens
tcactgtttgttttta

SEQ ID NO: 1345373 - DNA, 22 bp, Homo sapiens
tcacttatgaatgatttgcata

SEQ ID NO: 1345374 - DNA, 15 bp, Homo sapiens
ggaaaaatagcctgc

SEQ ID NO: 1345375 - DNA, 12 bp, Homo sapiens
ggaaaacatttg

SEQ ID NO: 1345376 - DNA, 22 bp, Homo sapiens
ggaaaactacctgtatttaaaa

SEQ ID NO: 1345377 - DNA, 14 bp, Homo sapiens
ggaaaactgtgttg

SEQ ID NO: 1345378 - DNA, 15 bp, Homo sapiens
ggaaaatcagcctgc

SEQ ID NO: 1345379 - DNA, 19 bp, Homo sapiens
ggaaaatcagcctgctcca

SEQ ID NO: 1345380 - DNA, 23 bp, Homo sapiens
ggaaaatcagcctgctccagctg

SEQ ID NO: 1345381 - DNA, 20 bp, Homo sapiens
ggaaactccacatctgcctt

SEQ ID NO: 1345382 - DNA, 15 bp, Homo sapiens
ggaaagacactgcct

SEQ ID NO: 1345383 - DNA, 13 bp, Homo sapiens
ggaaaggggagag

SEQ ID NO: 1345384 - DNA, 21 bp, Homo sapiens
ggaaaggggagagcctgctgg

SEQ ID NO: 1345385 - DNA, 23 bp, Homo sapiens
ggaaatatatacaaaaagaaaat

SEQ ID NO: 1345386 - DNA, 14 bp, Homo sapiens
ggaacatgccccct

SEQ ID NO: 1345387 - DNA, 15 bp, Homo sapiens
ggaacatgccccctg

SEQ ID NO: 1345388 - DNA, 18 bp, Homo sapiens
ggaacctccccagcctgc

SEQ ID NO: 1345389 - DNA, 19 bp, Homo sapiens
ggaacctccccagcctgcg

SEQ ID NO: 1345390 - DNA, 13 bp, Homo sapiens
ggaagaagggaga

SEQ ID NO: 1345391 - DNA, 11 bp, Homo sapiens
ggaagaatgaa

SEQ ID NO: 1345392 - DNA, 16 bp, Homo sapiens
ggaagaatgaaagctg

SEQ ID NO: 1345393 - DNA, 16 bp, Homo sapiens
ggaagagatccaaaga

SEQ ID NO: 1345394 - DNA, 20 bp, Homo sapiens
ggaagagatccaaagactct

SEQ ID NO: 1345395 - DNA, 14 bp, Homo sapiens
ggaagcccaggagc

SEQ ID NO: 1345396 - DNA, 17 bp, Homo sapiens
ggaataaaaggcttgaa

SEQ ID NO: 1345397 - DNA, 20 bp, Homo sapiens
ggaatccaagcctccacagc

SEQ ID NO: 1345398 - DNA, 21 bp, Homo sapiens
ggaatccaagcctccacagcg

SEQ ID NO: 1345399 - DNA, 20 bp, Homo sapiens
ggaatcccactaatgcaaac

SEQ ID NO: 1345400 - DNA, 21 bp, Homo sapiens
ggaatcctggcagcccagaga

SEQ ID NO: 1345401 - DNA, 23 bp, Homo sapiens
ggaattgtggctatcctgattat

SEQ ID NO: 1345402 - DNA, 23 bp, Homo sapiens
ggacactccagggacacacagcc

SEQ ID NO: 1345403 - DNA, 14 bp, Homo sapiens
ggacagaaagagac

SEQ ID NO: 1345404 - DNA, 21 bp, Homo sapiens
ggacatcacagggtgggcctc

SEQ ID NO: 1345405 - DNA, 19 bp, Homo sapiens
tccccccccaacctttccc

SEQ ID NO: 1345406 - DNA, 18 bp, Homo sapiens
tccccgcttctgcctgca

SEQ ID NO: 1345407 - DNA, 12 bp, Homo sapiens
tcccctcagctc

SEQ ID NO: 1345408 - DNA, 19 bp, Homo sapiens
tcccctgtagagtgggagc

SEQ ID NO: 1345409 - DNA, 21 bp, Homo sapiens
tccccttgtttgtcccttcta

SEQ ID NO: 1345410 - DNA, 15 bp, Homo sapiens
tccctaccgacccag

SEQ ID NO: 1345411 - DNA, 17 bp, Homo sapiens
tccctcctccaggcctg

SEQ ID NO: 1345412 - DNA, 16 bp, Homo sapiens
tccctctaatgagact

SEQ ID NO: 1345413 - DNA, 17 bp, Homo sapiens
tccctctaatgagactg

SEQ ID NO: 1345414 - DNA, 19 bp, Homo sapiens
tccctctatttatgtttgc

SEQ ID NO: 1345415 - DNA, 15 bp, Homo sapiens
tccctgagacaggga

SEQ ID NO: 1345416 - DNA, 15 bp, Homo sapiens
tccctgcctggcccc

SEQ ID NO: 1345417 - DNA, 16 bp, Homo sapiens
tccctgcgcctttcct

SEQ ID NO: 1345418 - DNA, 14 bp, Homo sapiens
tccctgcttccagg

SEQ ID NO: 1345419 - DNA, 19 bp, Homo sapiens
tccctgctttttgtgtttt

SEQ ID NO: 1345420 - DNA, 21 bp, Homo sapiens
tccctggcgcaggtgggctgg

SEQ ID NO: 1345421 - DNA, 19 bp, Homo sapiens
tccctgtagggtccaacca

SEQ ID NO: 1345422 - DNA, 12 bp, Homo sapiens
tccctgtcccag

SEQ ID NO: 1345423 - DNA, 16 bp, Homo sapiens
tcccttaacagttgta

SEQ ID NO: 1345424 - DNA, 20 bp, Homo sapiens
tcccttaacagttgtattta

SEQ ID NO: 1345425 - DNA, 20 bp, Homo sapiens
tcccttaaggggtatcatgt

SEQ ID NO: 1345426 - DNA, 15 bp, Homo sapiens
tcccttactttgctg

SEQ ID NO: 1345427 - DNA, 21 bp, Homo sapiens
tcccttccagatggtcatcca

SEQ ID NO: 1345428 - DNA, 18 bp, Homo sapiens
tcccttgagggctgcagt

SEQ ID NO: 1345429 - DNA, 12 bp, Homo sapiens
tccgactgcttt

SEQ ID NO: 1345430 - DNA, 14 bp, Homo sapiens
tccgagagggagag

SEQ ID NO: 1345431 - DNA, 21 bp, Homo sapiens
tccgcatccctaccgacccag

SEQ ID NO: 1345432 - DNA, 15 bp, Homo sapiens
tccgccagcctcctc

SEQ ID NO: 1345433 - DNA, 16 bp, Homo sapiens
tccgccagcctcctct

SEQ ID NO: 1345434 - DNA, 17 bp, Homo sapiens
tccgccagcctcctctg

SEQ ID NO: 1345435 - DNA, 18 bp, Homo sapiens
tccgccagcctcctctgg

SEQ ID NO: 1345436 - DNA, 15 bp, Homo sapiens
tccgccctgccactc

SEQ ID NO: 1345437 - DNA, 14 bp, Homo sapiens
tccgcgtgtgcctg

SEQ ID NO: 1345438 - DNA, 16 bp, Homo sapiens
tccggcctctccagcc

SEQ ID NO: 1345439 - DNA, 14 bp, Homo sapiens
tccggcctctgcct

SEQ ID NO: 1345440 - DNA, 19 bp, Homo sapiens
tccggcctctgcctttgca

SEQ ID NO: 1345441 - DNA, 16 bp, Homo sapiens
tccggctcccagcctc

SEQ ID NO: 1345442 - DNA, 17 bp, Homo sapiens
tccggtccctgtcccag

SEQ ID NO: 1345443 - DNA, 15 bp, Homo sapiens
tccgttagctcctgt

SEQ ID NO: 1345444 - DNA, 20 bp, Homo sapiens
tcctaatggtgatgcagtct

SEQ ID NO: 1345445 - DNA, 24 bp, Homo sapiens
tcctaatggtgatgcagtcttaga

SEQ ID NO: 1345446 - DNA, 15 bp, Homo sapiens
tcctaatttctcctc

SEQ ID NO: 1345447 - DNA, 20 bp, Homo sapiens
tcctacatatcccttccaga

SEQ ID NO: 1345448 - DNA, 19 bp, Homo sapiens
tcctactcggctctgcagt

SEQ ID NO: 1345449 - DNA, 21 bp, Homo sapiens
tcctagaaattccccaccctg

SEQ ID NO: 1345450 - DNA, 22 bp, Homo sapiens
tcctagaaattccccaccctga

SEQ ID NO: 1345451 - DNA, 20 bp, Homo sapiens
tcctagcactttgggaggcc

SEQ ID NO: 1345452 - DNA, 13 bp, Homo sapiens
tcctagtaagaag

SEQ ID NO: 1345453 - DNA, 14 bp, Homo sapiens
tcctagtaagaaga

SEQ ID NO: 1345454 - DNA, 18 bp, Homo sapiens
tcctatatcctgtgactg

SEQ ID NO: 1345455 - DNA, 14 bp, Homo sapiens
tcctcagaaagtgt

SEQ ID NO: 1345456 - DNA, 12 bp, Homo sapiens
tcctcagggcag

SEQ ID NO: 1345457 - DNA, 17 bp, Homo sapiens
tcctcagggcagcctcc

SEQ ID NO: 1345458 - DNA, 19 bp, Homo sapiens
tcctcagtgcatttgtgct

SEQ ID NO: 1345459 - DNA, 17 bp, Homo sapiens
tcctccaggcctgcctc

SEQ ID NO: 1345460 - DNA, 20 bp, Homo sapiens
tcctcccacccggctgcaga

SEQ ID NO: 1345461 - DNA, 21 bp, Homo sapiens
tcctccccaaatcaatacact

SEQ ID NO: 1345462 - DNA, 16 bp, Homo sapiens
tcctccccttcctctt

SEQ ID NO: 1345463 - DNA, 12 bp, Homo sapiens
tcctcctcacct

SEQ ID NO: 1345464 - DNA, 14 bp, Homo sapiens
tcctcctcccaccc

SEQ ID NO: 1345465 - DNA, 11 bp, Homo sapiens
tcctcctggaa

SEQ ID NO: 1345466 - DNA, 22 bp, Homo sapiens
tcctctagaagccaagggaaag

SEQ ID NO: 1345467 - DNA, 13 bp, Homo sapiens
tcctctctatatt

SEQ ID NO: 1345468 - DNA, 14 bp, Homo sapiens
tcctctctccagat

SEQ ID NO: 1345469 - DNA, 11 bp, Homo sapiens
tcctctgcctg

SEQ ID NO: 1345470 - DNA, 13 bp, Homo sapiens
tcctctgcctgcc

SEQ ID NO: 1345471 - DNA, 20 bp, Homo sapiens
tcctctgctcaccgcccatc

SEQ ID NO: 1345472 - DNA, 15 bp, Homo sapiens
tcctctggacggcag

SEQ ID NO: 1345473 - DNA, 19 bp, Homo sapiens
tcctcttgtcctacaatga

SEQ ID NO: 1345474 - DNA, 18 bp, Homo sapiens
tcctgaaccgcacagctc

SEQ ID NO: 1345475 - DNA, 20 bp, Homo sapiens
tcctgaaccgcacagctcag

SEQ ID NO: 1345476 - DNA, 21 bp, Homo sapiens
tcctgaaccgcacagctcagg

SEQ ID NO: 1345477 - DNA, 23 bp, Homo sapiens
tcctgaaccgcacagctcaggag

SEQ ID NO: 1345478 - DNA, 15 bp, Homo sapiens
tcctgacagaaggtg

SEQ ID NO: 1345479 - DNA, 14 bp, Homo sapiens
tcctgacattgtct

SEQ ID NO: 1345480 - DNA, 11 bp, Homo sapiens
tcctgaccagc

SEQ ID NO: 1345481 - DNA, 15 bp, Homo sapiens
tcctgactctctcct

SEQ ID NO: 1345482 - DNA, 21 bp, Homo sapiens
tcctgatccactttgggggag

SEQ ID NO: 1345483 - DNA, 14 bp, Homo sapiens
tcctgattcctctc

SEQ ID NO: 1345484 - DNA, 17 bp, Homo sapiens
tcctgcagaccacgccc

SEQ ID NO: 1345485 - DNA, 13 bp, Homo sapiens
tcctgccaggcat

SEQ ID NO: 1345486 - DNA, 14 bp, Homo sapiens
tcctgcgtcctcct

SEQ ID NO: 1345487 - DNA, 22 bp, Homo sapiens
tcctggaaattgacgaggggtg

SEQ ID NO: 1345488 - DNA, 13 bp, Homo sapiens
tcctggcactgga

SEQ ID NO: 1345489 - DNA, 13 bp, Homo sapiens
tcctggcagccca

SEQ ID NO: 1345490 - DNA, 22 bp, Homo sapiens
tcctggcctatccgctgccagc

SEQ ID NO: 1345491 - DNA, 23 bp, Homo sapiens
tcctggcctatccgctgccagcc

SEQ ID NO: 1345492 - DNA, 12 bp, Homo sapiens
tcctggcgcctg

SEQ ID NO: 1345493 - DNA, 23 bp, Homo sapiens
tcctgggggcctgggttgggggc

SEQ ID NO: 1345494 - DNA, 24 bp, Homo sapiens
tcctgtcctgctcattatgccact

SEQ ID NO: 1345495 - DNA, 20 bp, Homo sapiens
tcctgtgaatgccactgcct

SEQ ID NO: 1345496 - DNA, 21 bp, Homo sapiens
tcctgtgatccacccaaccct

SEQ ID NO: 1345497 - DNA, 16 bp, Homo sapiens
tcctgtggcataaatt

SEQ ID NO: 1345498 - DNA, 19 bp, Homo sapiens
tcctgtggcataaattgca

SEQ ID NO: 1345499 - DNA, 20 bp, Homo sapiens
tcctgtggcataaattgcat

SEQ ID NO: 1345500 - DNA, 23 bp, Homo sapiens
tcctgtggccccaccctgggccc

SEQ ID NO: 1345501 - DNA, 17 bp, Homo sapiens
tccttaattcactccca

SEQ ID NO: 1345502 - DNA, 19 bp, Homo sapiens
tccttaattcactcccaca

SEQ ID NO: 1345503 - DNA, 12 bp, Homo sapiens
tccttcagacac

SEQ ID NO: 1345504 - DNA, 23 bp, Homo sapiens
tccttcagacaccctcaacctct

SEQ ID NO: 1345505 - DNA, 18 bp, Homo sapiens
tccttgaagaactgcagg

SEQ ID NO: 1345506 - DNA, 17 bp, Homo sapiens
tccttgagacacggagc

SEQ ID NO: 1345507 - DNA, 23 bp, Homo sapiens
tccttgagacacggagcccagcc

SEQ ID NO: 1345508 - DNA, 16 bp, Homo sapiens
tccttgagtgctcttg

SEQ ID NO: 1345509 - DNA, 13 bp, Homo sapiens
tcctttaattgta

SEQ ID NO: 1345510 - DNA, 15 bp, Homo sapiens
tcctttaattgtaaa

SEQ ID NO: 1345511 - DNA, 16 bp, Homo sapiens
tcctttatgtgaattt

SEQ ID NO: 1345512 - DNA, 20 bp, Homo sapiens
tcctttgttttctgactaat

SEQ ID NO: 1345513 - DNA, 12 bp, Homo sapiens
tccttttaactg

SEQ ID NO: 1345514 - DNA, 13 bp, Homo sapiens
tccttttccctgc

SEQ ID NO: 1345515 - DNA, 14 bp, Homo sapiens
tcctttttatttat

SEQ ID NO: 1345516 - DNA, 22 bp, Homo sapiens
tcctttttatttatatgtatgt

SEQ ID NO: 1345517 - DNA, 23 bp, Homo sapiens
tcctttttatttatatgtatgtg

SEQ ID NO: 1345518 - DNA, 16 bp, Homo sapiens
tcctttttgacactga

SEQ ID NO: 1345519 - DNA, 19 bp, Homo sapiens
tcgaaacctgggattcagg

SEQ ID NO: 1345520 - DNA, 13 bp, Homo sapiens
tcgaagtgctgag

SEQ ID NO: 1345521 - DNA, 16 bp, Homo sapiens
tcgaatctctgtgcct

SEQ ID NO: 1345522 - DNA, 20 bp, Homo sapiens
tcgatactgcgactttctgc

SEQ ID NO: 1345523 - DNA, 13 bp, Homo sapiens
tcgcaccggagtg

SEQ ID NO: 1345524 - DNA, 21 bp, Homo sapiens
tctgaggccgttgctgactta

SEQ ID NO: 1345525 - DNA, 22 bp, Homo sapiens
tctgaggccgttgctgacttag

SEQ ID NO: 1345526 - DNA, 18 bp, Homo sapiens
tctgagggaaatgttttg

SEQ ID NO: 1345527 - DNA, 17 bp, Homo sapiens
tctgagggcttgtagtt

SEQ ID NO: 1345528 - DNA, 20 bp, Homo sapiens
tctgatggccttaatttcct

SEQ ID NO: 1345529 - DNA, 22 bp, Homo sapiens
tctgatggccttaatttccttt

SEQ ID NO: 1345530 - DNA, 15 bp, Homo sapiens
tctgattctggcttt

SEQ ID NO: 1345531 - DNA, 17 bp, Homo sapiens
tctgatttgctgctctt

SEQ ID NO: 1345532 - DNA, 24 bp, Homo sapiens
tctgcaaacaccaacatgttggga

SEQ ID NO: 1345533 - DNA, 19 bp, Homo sapiens
tctgcacaagctgcaccct

SEQ ID NO: 1345534 - DNA, 15 bp, Homo sapiens
tctgcaccccttctc

SEQ ID NO: 1345535 - DNA, 15 bp, Homo sapiens
tctgcatttaaaaaa

SEQ ID NO: 1345536 - DNA, 22 bp, Homo sapiens
tctgccagatgtcctaatggtg

SEQ ID NO: 1345537 - DNA, 16 bp, Homo sapiens
tctgccctggctgctg

SEQ ID NO: 1345538 - DNA, 22 bp, Homo sapiens
tctgccggacccggaggccgag

SEQ ID NO: 1345539 - DNA, 16 bp, Homo sapiens
tctgccggtgctcgga

SEQ ID NO: 1345540 - DNA, 16 bp, Homo sapiens
tctgccgtctctggag

SEQ ID NO: 1345541 - DNA, 12 bp, Homo sapiens
tctgcctgcccc

SEQ ID NO: 1345542 - DNA, 14 bp, Homo sapiens
tctgcctgccccgc

SEQ ID NO: 1345543 - DNA, 12 bp, Homo sapiens
tctgcctggagt

SEQ ID NO: 1345544 - DNA, 16 bp, Homo sapiens
tctgccttaaaaccaa

SEQ ID NO: 1345545 - DNA, 17 bp, Homo sapiens
tctgccttaaaaccaaa

SEQ ID NO: 1345546 - DNA, 20 bp, Homo sapiens
tctgccttaaaaccaaagag

SEQ ID NO: 1345547 - DNA, 19 bp, Homo sapiens
tctgcgtctatcctgtgta

SEQ ID NO: 1345548 - DNA, 16 bp, Homo sapiens
tctgctatatataaaa

SEQ ID NO: 1345549 - DNA, 16 bp, Homo sapiens
tctgctccccagggga

SEQ ID NO: 1345550 - DNA, 16 bp, Homo sapiens
tctgctgtccttgcct

SEQ ID NO: 1345551 - DNA, 16 bp, Homo sapiens
tctgcttgcttggccc

SEQ ID NO: 1345552 - DNA, 17 bp, Homo sapiens
tctgctttagacttgaa

SEQ ID NO: 1345553 - DNA, 18 bp, Homo sapiens
tctgctttagacttgaaa

SEQ ID NO: 1345554 - DNA, 17 bp, Homo sapiens
tctgctttctcctttaa

SEQ ID NO: 1345555 - DNA, 17 bp, Homo sapiens
tctgcttttctgccctg

SEQ ID NO: 1345556 - DNA, 20 bp, Homo sapiens
tctgcttttctgccctggct

SEQ ID NO: 1345557 - DNA, 18 bp, Homo sapiens
tctggacccttataaaat

SEQ ID NO: 1345558 - DNA, 15 bp, Homo sapiens
tctggacggcaggct

SEQ ID NO: 1345559 - DNA, 19 bp, Homo sapiens
tctggacggcaggctcact

SEQ ID NO: 1345560 - DNA, 15 bp, Homo sapiens
tctggcctctgcttt

SEQ ID NO: 1345561 - DNA, 17 bp, Homo sapiens
gctgatttggtgaccaa

SEQ ID NO: 1345562 - DNA, 18 bp, Homo sapiens
gctgcaccctcaggcagg

SEQ ID NO: 1345563 - DNA, 21 bp, Homo sapiens
gctgcagttctactcaggctg

SEQ ID NO: 1345564 - DNA, 21 bp, Homo sapiens
gctgcatgccctctcaggccg

SEQ ID NO: 1345565 - DNA, 19 bp, Homo sapiens
gctgccagccttgagccct

SEQ ID NO: 1345566 - DNA, 20 bp, Homo sapiens
gctgccagccttgagccctg

SEQ ID NO: 1345567 - DNA, 21 bp, Homo sapiens
gctgccagccttgagccctgg

SEQ ID NO: 1345568 - DNA, 17 bp, Homo sapiens
gctgccaggtgagaaac

SEQ ID NO: 1345569 - DNA, 23 bp, Homo sapiens
gctgcccactgtttctcttgagc

SEQ ID NO: 1345570 - DNA, 21 bp, Homo sapiens
gctgccccatctcccctcagc

SEQ ID NO: 1345571 - DNA, 20 bp, Homo sapiens
gctgcccccaccccggggac

SEQ ID NO: 1345572 - DNA, 14 bp, Homo sapiens
gctgccctgaagaa

SEQ ID NO: 1345573 - DNA, 22 bp, Homo sapiens
gctgccgtgccgcctgcactcc

SEQ ID NO: 1345574 - DNA, 15 bp, Homo sapiens
gctgcgcttgctttt

SEQ ID NO: 1345575 - DNA, 17 bp, Homo sapiens
gctgcgcttgcttttct

SEQ ID NO: 1345576 - DNA, 18 bp, Homo sapiens
gctgcggcgtacaggctg

SEQ ID NO: 1345577 - DNA, 17 bp, Homo sapiens
gctgctatccccatctc

SEQ ID NO: 1345578 - DNA, 22 bp, Homo sapiens
gctgctatccccatctccctgc

SEQ ID NO: 1345579 - DNA, 20 bp, Homo sapiens
gctgctccgaggacccagga

SEQ ID NO: 1345580 - DNA, 17 bp, Homo sapiens
gctgcttcctcctggaa

SEQ ID NO: 1345581 - DNA, 19 bp, Homo sapiens
gctggacgggttagacagc

SEQ ID NO: 1345582 - DNA, 20 bp, Homo sapiens
gctggacttctacctgccct

SEQ ID NO: 1345583 - DNA, 21 bp, Homo sapiens
gctggacttctacctgccctc

SEQ ID NO: 1345584 - DNA, 23 bp, Homo sapiens
gctggacttctacctgccctcaa

SEQ ID NO: 1345585 - DNA, 23 bp, Homo sapiens
gctggcacccaccgtggaggagg

SEQ ID NO: 1345586 - DNA, 12 bp, Homo sapiens
gctggccccagc

SEQ ID NO: 1345587 - DNA, 16 bp, Homo sapiens
ggacatcctcctccca

SEQ ID NO: 1345588 - DNA, 16 bp, Homo sapiens
ggaccaccctgagccg

SEQ ID NO: 1345589 - DNA, 19 bp, Homo sapiens
ggacccaatgtaggagctg

SEQ ID NO: 1345590 - DNA, 13 bp, Homo sapiens
ggacccagtgcag

SEQ ID NO: 1345591 - DNA, 21 bp, Homo sapiens
ggaccccagcaagtggtccta

SEQ ID NO: 1345592 - DNA, 17 bp, Homo sapiens
ggaccccagccatccag

SEQ ID NO: 1345593 - DNA, 23 bp, Homo sapiens
ggaccctgtgacatggtgcctga

SEQ ID NO: 1345594 - DNA, 16 bp, Homo sapiens
ggacccttataaaatc

SEQ ID NO: 1345595 - DNA, 18 bp, Homo sapiens
ggaccgcccttttcccct

SEQ ID NO: 1345596 - DNA, 22 bp, Homo sapiens
ggacctaaatggcctcatgtgg

SEQ ID NO: 1345597 - DNA, 17 bp, Homo sapiens
ggacctgccaggcaggg

SEQ ID NO: 1345598 - DNA, 12 bp, Homo sapiens
ggacctgtggct

SEQ ID NO: 1345599 - DNA, 16 bp, Homo sapiens
ggacctgtggctgtcg

SEQ ID NO: 1345600 - DNA, 18 bp, Homo sapiens
ggaccttaggccttcctc

SEQ ID NO: 1345601 - DNA, 19 bp, Homo sapiens
ggacggtgcccaagccaga

SEQ ID NO: 1345602 - DNA, 17 bp, Homo sapiens
ggacgtcagacttggct

SEQ ID NO: 1345603 - DNA, 12 bp, Homo sapiens
ggacgtgctggg

SEQ ID NO: 1345604 - DNA, 17 bp, Homo sapiens
ggactcagccttcagac

SEQ ID NO: 1345605 - DNA, 21 bp, Homo sapiens
ggactcagccttcagacagag

SEQ ID NO: 1345606 - DNA, 21 bp, Homo sapiens
ggactgaccttgtaaaagaca

SEQ ID NO: 1345607 - DNA, 11 bp, Homo sapiens
ggactgactga

SEQ ID NO: 1345608 - DNA, 15 bp, Homo sapiens
ggactgactgaggca

SEQ ID NO: 1345609 - DNA, 22 bp, Homo sapiens
ggactgctacctttcaaagctt

SEQ ID NO: 1345610 - DNA, 20 bp, Homo sapiens
ggactgtagggagggcggca

SEQ ID NO: 1345611 - DNA, 19 bp, Homo sapiens
ggactgtggcacttgcctg

SEQ ID NO: 1345612 - DNA, 19 bp, Homo sapiens
ggacttcaaagcaagctgg

SEQ ID NO: 1345613 - DNA, 20 bp, Homo sapiens
ggacttccccggagggctgc

SEQ ID NO: 1345614 - DNA, 24 bp, Homo sapiens
ggagaaagcttggttctgtgaaca

SEQ ID NO: 1345615 - DNA, 23 bp, Homo sapiens
ggagaacatgaatcaaaagtgcc

SEQ ID NO: 1345616 - DNA, 12 bp, Homo sapiens
ggagaagctgca

SEQ ID NO: 1345617 - DNA, 22 bp, Homo sapiens
ggagaatggtgtgaacccggga

SEQ ID NO: 1345618 - DNA, 15 bp, Homo sapiens
ggagacaaaagagca

SEQ ID NO: 1345619 - DNA, 14 bp, Homo sapiens
ggagacagcatcag

SEQ ID NO: 1345620 - DNA, 20 bp, Homo sapiens
ggagaccggggtatcctggg

SEQ ID NO: 1345621 - DNA, 21 bp, Homo sapiens
ggagacggtttccagggaggg

SEQ ID NO: 1345622 - DNA, 22 bp, Homo sapiens
ggagacgtttataaacagaaat

SEQ ID NO: 1345623 - DNA, 13 bp, Homo sapiens
ggagatcctcctg

SEQ ID NO: 1345624 - DNA, 13 bp, Homo sapiens
ggagcactgggct

SEQ ID NO: 1345625 - DNA, 20 bp, Homo sapiens
ggagccggtaactgtcctgt

SEQ ID NO: 1345626 - DNA, 23 bp, Homo sapiens
ggagcctgcatttcctcgcagcc

SEQ ID NO: 1345627 - DNA, 13 bp, Homo sapiens
ggaggagggagag

SEQ ID NO: 1345628 - DNA, 17 bp, Homo sapiens
ggaggatctcttgagcc

SEQ ID NO: 1345629 - DNA, 17 bp, Homo sapiens
ggaggcaaagctggctc

SEQ ID NO: 1345630 - DNA, 20 bp, Homo sapiens
ggaggcaaagctggctcacc

SEQ ID NO: 1345631 - DNA, 21 bp, Homo sapiens
ggaggcaaagctggctcacct

SEQ ID NO: 1345632 - DNA, 21 bp, Homo sapiens
ggaggcctgcgaccctggggg

SEQ ID NO: 1345633 - DNA, 13 bp, Homo sapiens
ggaggcgcccttg

SEQ ID NO: 1345634 - DNA, 23 bp, Homo sapiens
ggaggcgcccttggcttctgtga

SEQ ID NO: 1345635 - DNA, 11 bp, Homo sapiens
ggagggaggcc

SEQ ID NO: 1345636 - DNA, 13 bp, Homo sapiens
ggagggaggcccc

SEQ ID NO: 1345637 - DNA, 22 bp, Homo sapiens
ggagggattctggttccagggt

SEQ ID NO: 1345638 - DNA, 13 bp, Homo sapiens
ggaggggaggggg

SEQ ID NO: 1345639 - DNA, 18 bp, Homo sapiens
ggagggggcttgaagcca

SEQ ID NO: 1345640 - DNA, 20 bp, Homo sapiens
ggaggtcaaggctgcagtga

SEQ ID NO: 1345641 - DNA, 21 bp, Homo sapiens
ggaggtcactggaaaggggag

SEQ ID NO: 1345642 - DNA, 16 bp, Homo sapiens
ggaggtcgaggcagga

SEQ ID NO: 1345643 - DNA, 18 bp, Homo sapiens
ggaggtcggtaggttcag

SEQ ID NO: 1345644 - DNA, 16 bp, Homo sapiens
ggagtattgaatggtg

SEQ ID NO: 1345645 - DNA, 16 bp, Homo sapiens
ggagtccactttgttt

SEQ ID NO: 1345646 - DNA, 22 bp, Homo sapiens
ggagtcgtggggtgtgctggga

SEQ ID NO: 1345647 - DNA, 18 bp, Homo sapiens
ggagtggtgatttgaaaa

SEQ ID NO: 1345648 - DNA, 18 bp, Homo sapiens
ggagtttttatgagaaac

SEQ ID NO: 1345649 - DNA, 20 bp, Homo sapiens
ggataactttacagaaatgg

SEQ ID NO: 1345650 - DNA, 21 bp, Homo sapiens
ggatcatctaattctctgtgg

SEQ ID NO: 1345651 - DNA, 21 bp, Homo sapiens
ggatccgactgctttggacct

SEQ ID NO: 1345652 - DNA, 12 bp, Homo sapiens
ggatctaccagc

SEQ ID NO: 1345653 - DNA, 18 bp, Homo sapiens
ggatctaccagcataaat

SEQ ID NO: 1345654 - DNA, 15 bp, Homo sapiens
ggatctcagctttga

SEQ ID NO: 1345655 - DNA, 17 bp, Homo sapiens
ggattagtttagaacag

SEQ ID NO: 1345656 - DNA, 18 bp, Homo sapiens
ggattctggttccagggt

SEQ ID NO: 1345657 - DNA, 19 bp, Homo sapiens
ggattctggttccagggtc

SEQ ID NO: 1345658 - DNA, 16 bp, Homo sapiens
ggatttttagaattaa

SEQ ID NO: 1345659 - DNA, 13 bp, Homo sapiens
ggcaaacaggcag

SEQ ID NO: 1345660 - DNA, 23 bp, Homo sapiens
ggcaaacaggcagttggccagag

SEQ ID NO: 1345661 - DNA, 12 bp, Homo sapiens
ggcaactggcca

SEQ ID NO: 1345662 - DNA, 19 bp, Homo sapiens
ggcaactggccatttgcca

SEQ ID NO: 1345663 - DNA, 14 bp, Homo sapiens
ggcaagctccgcag

SEQ ID NO: 1345664 - DNA, 17 bp, Homo sapiens
ggcaatggtagtttctg

SEQ ID NO: 1345665 - DNA, 18 bp, Homo sapiens
ggcaatggtagtttctgt

SEQ ID NO: 1345666 - DNA, 16 bp, Homo sapiens
ggcaccagcagcctgg

SEQ ID NO: 1345667 - DNA, 14 bp, Homo sapiens
ggcaccaggaagcc

SEQ ID NO: 1345668 - DNA, 21 bp, Homo sapiens
ggcacccaccgtggaggagga

SEQ ID NO: 1345669 - DNA, 12 bp, Homo sapiens
ggcacctcttcc

SEQ ID NO: 1345670 - DNA, 16 bp, Homo sapiens
ggcaccttttactgtg

SEQ ID NO: 1345671 - DNA, 17 bp, Homo sapiens
ggcacgggtggtccccg

SEQ ID NO: 1345672 - DNA, 12 bp, Homo sapiens
aaaaaagagaca

SEQ ID NO: 1345673 - DNA, 12 bp, Homo sapiens
aaaaaagtcaga

SEQ ID NO: 1345674 - DNA, 13 bp, Homo sapiens
aaaaaagtcagag

SEQ ID NO: 1345675 - DNA, 13 bp, Homo sapiens
aaaaacataacat

SEQ ID NO: 1345676 - DNA, 16 bp, Homo sapiens
aaaaaccgaataaatg

SEQ ID NO: 1345677 - DNA, 13 bp, Homo sapiens
aaaaagcttcccc

SEQ ID NO: 1345678 - DNA, 16 bp, Homo sapiens
aaaaataataataatg

SEQ ID NO: 1345679 - DNA, 18 bp, Homo sapiens
aaaaatactatttaagat

SEQ ID NO: 1345680 - DNA, 11 bp, Homo sapiens
aaaaatatatt

SEQ ID NO: 1345681 - DNA, 22 bp, Homo sapiens
aaaacaaaatttgactaatttt

SEQ ID NO: 1345682 - DNA, 18 bp, Homo sapiens
aaaacagagtaatcttgt

SEQ ID NO: 1345683 - DNA, 19 bp, Homo sapiens
aaaacagagtaatcttgtt

SEQ ID NO: 1345684 - DNA, 22 bp, Homo sapiens
aaaacagagtaatcttgttggt

SEQ ID NO: 1345685 - DNA, 17 bp, Homo sapiens
aaaacagtgtgtaaaca

SEQ ID NO: 1345686 - DNA, 23 bp, Homo sapiens
aaaacatagaaatggaaattttg

SEQ ID NO: 1345687 - DNA, 19 bp, Homo sapiens
aaaacatcattccttttta

SEQ ID NO: 1345688 - DNA, 15 bp, Homo sapiens
aaaaccaaatgttta

SEQ ID NO: 1345689 - DNA, 18 bp, Homo sapiens
aaaaccaccaaaaacaaa

SEQ ID NO: 1345690 - DNA, 15 bp, Homo sapiens
aaaaccttttactgg

SEQ ID NO: 1345691 - DNA, 14 bp, Homo sapiens
aaaactaaatttca

SEQ ID NO: 1345692 - DNA, 17 bp, Homo sapiens
aaaactacttctttttt

SEQ ID NO: 1345693 - DNA, 23 bp, Homo sapiens
aaaactcaggcaaagaaaatgaa

SEQ ID NO: 1345694 - DNA, 12 bp, Homo sapiens
aaaactctactt

SEQ ID NO: 1345695 - DNA, 19 bp, Homo sapiens
aaaactctacttaatccaa

SEQ ID NO: 1345696 - DNA, 21 bp, Homo sapiens
aaaactctacttaatccaatg

SEQ ID NO: 1345697 - DNA, 22 bp, Homo sapiens
aaaactgctgactgttttctct

SEQ ID NO: 1345698 - DNA, 19 bp, Homo sapiens
aaaactggacctgtatatt

SEQ ID NO: 1345699 - DNA, 13 bp, Homo sapiens
aaaacttcagaag

SEQ ID NO: 1345700 - DNA, 10 bp, Homo sapiens
aaaagaaaca

SEQ ID NO: 1345701 - DNA, 23 bp, Homo sapiens
aaaagaatgacgtttacatataa

SEQ ID NO: 1345702 - DNA, 12 bp, Homo sapiens
aaaagattcttc

SEQ ID NO: 1345703 - DNA, 15 bp, Homo sapiens
aaaagcaatggttga

SEQ ID NO: 1345704 - DNA, 21 bp, Homo sapiens
aaaagcatttttcaatatatt

SEQ ID NO: 1345705 - DNA, 14 bp, Homo sapiens
aaaaggagtataca

SEQ ID NO: 1345706 - DNA, 21 bp, Homo sapiens
aaaaggcctcttgtaaagact

SEQ ID NO: 1345707 - DNA, 19 bp, Homo sapiens
aaaaggcttataaaacaga

SEQ ID NO: 1345708 - DNA, 16 bp, Homo sapiens
aaaagggaagaaactg

SEQ ID NO: 1345709 - DNA, 13 bp, Homo sapiens
aaaagtagaactt

SEQ ID NO: 1345710 - DNA, 15 bp, Homo sapiens
aaaagtagaactttg

SEQ ID NO: 1345711 - DNA, 16 bp, Homo sapiens
aaaagtataaaatagt

SEQ ID NO: 1345712 - DNA, 18 bp, Homo sapiens
aaaagtgcctcaagagga

SEQ ID NO: 1345713 - DNA, 13 bp, Homo sapiens
aaaagtgtccttc

SEQ ID NO: 1345714 - DNA, 17 bp, Homo sapiens
aaaagttgcattttaac

SEQ ID NO: 1345715 - DNA, 18 bp, Homo sapiens
aaaataaaacatagcaaa

SEQ ID NO: 1345716 - DNA, 21 bp, Homo sapiens
aaaataaactataaaacaaaa

SEQ ID NO: 1345717 - DNA, 16 bp, Homo sapiens
aaaataataaaaaaag

SEQ ID NO: 1345718 - DNA, 20 bp, Homo sapiens
aaaataattatataactgta

SEQ ID NO: 1345719 - DNA, 15 bp, Homo sapiens
aaaatacatgaagct

SEQ ID NO: 1345720 - DNA, 16 bp, Homo sapiens
aaaatactatttaaga

SEQ ID NO: 1345721 - DNA, 13 bp, Homo sapiens
aaaatagaaacat

SEQ ID NO: 1345722 - DNA, 15 bp, Homo sapiens
aaaatagaaacatat

SEQ ID NO: 1345723 - DNA, 18 bp, Homo sapiens
aaaatagattttataaga

SEQ ID NO: 1345724 - DNA, 21 bp, Homo sapiens
aaaatagattttataagatga

SEQ ID NO: 1345725 - DNA, 12 bp, Homo sapiens
aaaatagcctgc

SEQ ID NO: 1345726 - DNA, 13 bp, Homo sapiens
aaaatagtttatt

SEQ ID NO: 1345727 - DNA, 15 bp, Homo sapiens
aaaatataaacaaag

SEQ ID NO: 1345728 - DNA, 13 bp, Homo sapiens
aaaatatatatct

SEQ ID NO: 1345729 - DNA, 11 bp, Homo sapiens
aaaatattgtt

SEQ ID NO: 1345730 - DNA, 15 bp, Homo sapiens
aaaatattgtttctg

SEQ ID NO: 1345731 - DNA, 19 bp, Homo sapiens
aaaatattgttttacaata

SEQ ID NO: 1345732 - DNA, 13 bp, Homo sapiens
aaaatcagcctgc

SEQ ID NO: 1345733 - DNA, 22 bp, Homo sapiens
aaaatctaagcagcttattgtt

SEQ ID NO: 1345734 - DNA, 16 bp, Homo sapiens
aaaatgaaatgcatat

SEQ ID NO: 1345735 - DNA, 18 bp, Homo sapiens
aaaatgaaatgcatattt

SEQ ID NO: 1345736 - DNA, 18 bp, Homo sapiens
aaaatgctccccacagcg

SEQ ID NO: 1345737 - DNA, 15 bp, Homo sapiens
aaaatggtctctaac

SEQ ID NO: 1345738 - DNA, 21 bp, Homo sapiens
aaaatgtaggcttagtttgtg

SEQ ID NO: 1345739 - DNA, 15 bp, Homo sapiens
aaaatgtcaaaagta

SEQ ID NO: 1345740 - DNA, 22 bp, Homo sapiens
aaaatgtcaaaagtagaacttt

SEQ ID NO: 1345741 - DNA, 12 bp, Homo sapiens
aaaatgtctgta

SEQ ID NO: 1345742 - DNA, 18 bp, Homo sapiens
aaaatgtgagtggttgaa

SEQ ID NO: 1345743 - DNA, 17 bp, Homo sapiens
aaaattaaggtgtttga

SEQ ID NO: 1345744 - DNA, 18 bp, Homo sapiens
aaaattaaggtgtttgaa

SEQ ID NO: 1345745 - DNA, 19 bp, Homo sapiens
aaaattcatagtaagattg

SEQ ID NO: 1345746 - DNA, 20 bp, Homo sapiens
aaaattcatagtaagattga

SEQ ID NO: 1345747 - DNA, 16 bp, Homo sapiens
aaaattggcaaaacta

SEQ ID NO: 1345748 - DNA, 22 bp, Homo sapiens
aaaatttatggttttggtattt

SEQ ID NO: 1345749 - DNA, 19 bp, Homo sapiens
aaaatttgactaattttac

SEQ ID NO: 1345750 - DNA, 14 bp, Homo sapiens
aaaatttgttgcat

SEQ ID NO: 1345751 - DNA, 21 bp, Homo sapiens
aaaattttgtatgttaaagag

SEQ ID NO: 1345752 - DNA, 22 bp, Homo sapiens
aaacacgttttaaggactgact

SEQ ID NO: 1345753 - DNA, 17 bp, Homo sapiens
aaacactgcctttttat

SEQ ID NO: 1345754 - DNA, 18 bp, Homo sapiens
aaacactgcctttttatt

SEQ ID NO: 1345755 - DNA, 14 bp, Homo sapiens
aaacagaaatggaa

SEQ ID NO: 1345756 - DNA, 20 bp, Homo sapiens
aaacatcattcctttttatt

SEQ ID NO: 1345757 - DNA, 20 bp, Homo sapiens
aaacattgaagtaatgaatt

SEQ ID NO: 1345758 - DNA, 23 bp, Homo sapiens
aaaccaagtcaagtgaaaaagga

SEQ ID NO: 1345759 - DNA, 15 bp, Homo sapiens
aaaccactagaaagt

SEQ ID NO: 1345760 - DNA, 13 bp, Homo sapiens
aaaccgaataaat

SEQ ID NO: 1345761 - DNA, 14 bp, Homo sapiens
aaaccgaataaatg

SEQ ID NO: 1345762 - DNA, 22 bp, Homo sapiens
aaaccttttactggttgcatgg

SEQ ID NO: 1345763 - DNA, 23 bp, Homo sapiens
aaacgtcctctttagtttttggt

SEQ ID NO: 1345764 - DNA, 16 bp, Homo sapiens
aaacgtggttacatta

SEQ ID NO: 1345765 - DNA, 16 bp, Homo sapiens
aaactaaagcaataga

SEQ ID NO: 1345766 - DNA, 17 bp, Homo sapiens
aaactaaagcaatagaa

SEQ ID NO: 1345767 - DNA, 16 bp, Homo sapiens
aaactaatattttatg

SEQ ID NO: 1345768 - DNA, 17 bp, Homo sapiens
aaactataaaacaaaaa

SEQ ID NO: 1345769 - DNA, 18 bp, Homo sapiens
aaactatattttgtcata

SEQ ID NO: 1345770 - DNA, 13 bp, Homo sapiens
aaactcaatgctt

SEQ ID NO: 1345771 - DNA, 18 bp, Homo sapiens
aaactcaatgctttattt

SEQ ID NO: 1345772 - DNA, 13 bp, Homo sapiens
aaactcactgtga

SEQ ID NO: 1345773 - DNA, 19 bp, Homo sapiens
aaactcaggcaaagaaaat

SEQ ID NO: 1345774 - DNA, 16 bp, Homo sapiens
aaactccacatctgcc

SEQ ID NO: 1345775 - DNA, 23 bp, Homo sapiens
aaactcttaaaacccaagtgcct

SEQ ID NO: 1345776 - DNA, 18 bp, Homo sapiens
aaactgaagcagcctctc

SEQ ID NO: 1345777 - DNA, 23 bp, Homo sapiens
aaactgggatgaaactaaagcaa

SEQ ID NO: 1345778 - DNA, 18 bp, Homo sapiens
aaactggggcctccagaa

SEQ ID NO: 1345779 - DNA, 21 bp, Homo sapiens
aaactgtcgtgtcatactcga

SEQ ID NO: 1345780 - DNA, 15 bp, Homo sapiens
aaactgtgttgccac

SEQ ID NO: 1345781 - DNA, 17 bp, Homo sapiens
aaactgtgttgccacag

SEQ ID NO: 1345782 - DNA, 12 bp, Homo sapiens
aaacttcagaag

SEQ ID NO: 1345783 - DNA, 18 bp, Homo sapiens
aaacttgtttcactgaaa

SEQ ID NO: 1345784 - DNA, 13 bp, Homo sapiens
aaactttgggaaa

SEQ ID NO: 1345785 - DNA, 13 bp, Homo sapiens
aaacttttctaga

SEQ ID NO: 1345786 - DNA, 16 bp, Homo sapiens
aaagaaaaaaatgtca

SEQ ID NO: 1345787 - DNA, 12 bp, Homo sapiens
aaagaaaattga

SEQ ID NO: 1345788 - DNA, 12 bp, Homo sapiens
aaagaaatacag

SEQ ID NO: 1345789 - DNA, 11 bp, Homo sapiens
aaagaaatatt

SEQ ID NO: 1345790 - DNA, 16 bp, Homo sapiens
aaagaagtatttttag

SEQ ID NO: 1345791 - DNA, 18 bp, Homo sapiens
aaagaatactatttccaa

SEQ ID NO: 1345792 - DNA, 12 bp, Homo sapiens
aaagacactgcc

SEQ ID NO: 1345793 - DNA, 16 bp, Homo sapiens
aaagacactgcctggg

SEQ ID NO: 1345794 - DNA, 22 bp, Homo sapiens
aaagacagtgtatgtagaagca

SEQ ID NO: 1345795 - DNA, 22 bp, Homo sapiens
aaagaccctcctattctataaa

SEQ ID NO: 1345796 - DNA, 15 bp, Homo sapiens
aaagactcttgggag

SEQ ID NO: 1345797 - DNA, 12 bp, Homo sapiens
aaagactggctt

SEQ ID NO: 1345798 - DNA, 13 bp, Homo sapiens
aaagactggcttt

SEQ ID NO: 1345799 - DNA, 21 bp, Homo sapiens
aaagactggcttttattaatg

SEQ ID NO: 1345800 - DNA, 23 bp, Homo sapiens
aaagactggcttttattaatgca

SEQ ID NO: 1345801 - DNA, 15 bp, Homo sapiens
aaagactggttttct

SEQ ID NO: 1345802 - DNA, 14 bp, Homo sapiens
aaagagaatgagtc

SEQ ID NO: 1345803 - DNA, 21 bp, Homo sapiens
aaagagaattgggggcttagg

SEQ ID NO: 1345804 - DNA, 14 bp, Homo sapiens
aaagagacaggcag

SEQ ID NO: 1345805 - DNA, 18 bp, Homo sapiens
aaagaggctgcccctctc

SEQ ID NO: 1345806 - DNA, 23 bp, Homo sapiens
aaagaggctgcccctctcaccaa

SEQ ID NO: 1345807 - DNA, 21 bp, Homo sapiens
aaagagttgggtgtctcctta

SEQ ID NO: 1345808 - DNA, 15 bp, Homo sapiens
aaagatgaaaggcag

SEQ ID NO: 1345809 - DNA, 14 bp, Homo sapiens
aaagatgcttctca

SEQ ID NO: 1345810 - DNA, 17 bp, Homo sapiens
aaagatgcttctcactg

SEQ ID NO: 1345811 - DNA, 15 bp, Homo sapiens
aaagattcatgattt

SEQ ID NO: 1345812 - DNA, 18 bp, Homo sapiens
aaagcaatattttggagt

SEQ ID NO: 1345813 - DNA, 21 bp, Homo sapiens
aaagcatatgggttagatgtt

SEQ ID NO: 1345814 - DNA, 16 bp, Homo sapiens
aaagcatgaaatgtga

SEQ ID NO: 1345815 - DNA, 22 bp, Homo sapiens
aaagcatgttcacccttatagt

SEQ ID NO: 1345816 - DNA, 17 bp, Homo sapiens
aaagctatataagacaa

SEQ ID NO: 1345817 - DNA, 24 bp, Homo sapiens
aaagctgcccactgtttctcttga

SEQ ID NO: 1345818 - DNA, 13 bp, Homo sapiens
aaaggataaagaa

SEQ ID NO: 1345819 - DNA, 21 bp, Homo sapiens
aaaggcaggcctatttcatca

SEQ ID NO: 1345820 - DNA, 15 bp, Homo sapiens
aaaggctgtgctgcc

SEQ ID NO: 1345821 - DNA, 18 bp, Homo sapiens
aaaggctgtgctgccctg

SEQ ID NO: 1345822 - DNA, 16 bp, Homo sapiens
aaaggcttgaagctgt

SEQ ID NO: 1345823 - DNA, 14 bp, Homo sapiens
aaagggaagaaact

SEQ ID NO: 1345824 - DNA, 13 bp, Homo sapiens
aaagggatatttt

SEQ ID NO: 1345825 - DNA, 23 bp, Homo sapiens
aaaggggtcggctgaccatgctc

SEQ ID NO: 1345826 - DNA, 23 bp, Homo sapiens
aaaggtgagtttgagctgccttc

SEQ ID NO: 1345827 - DNA, 18 bp, Homo sapiens
aaaggtggtgaggcaata

SEQ ID NO: 1345828 - DNA, 20 bp, Homo sapiens
aaagtaaaaagggaattatg

SEQ ID NO: 1345829 - DNA, 18 bp, Homo sapiens
aaagtaaatacatgcata

SEQ ID NO: 1345830 - DNA, 15 bp, Homo sapiens
aaagtaatatttatt

SEQ ID NO: 1345831 - DNA, 16 bp, Homo sapiens
aaagtagtcctgtgaa

SEQ ID NO: 1345832 - DNA, 19 bp, Homo sapiens
aaagtatgtattatttaca

SEQ ID NO: 1345833 - DNA, 12 bp, Homo sapiens
aaagtattttct

SEQ ID NO: 1345834 - DNA, 16 bp, Homo sapiens
aaagtcattaaagaca

SEQ ID NO: 1345835 - DNA, 17 bp, Homo sapiens
aaagtcattaaagacag

SEQ ID NO: 1345836 - DNA, 18 bp, Homo sapiens
aaagtctgtctttcctga

SEQ ID NO: 1345837 - DNA, 17 bp, Homo sapiens
aaagtgcctcaagagga

SEQ ID NO: 1345838 - DNA, 22 bp, Homo sapiens
aaagtgcctcaagaggaatgaa

SEQ ID NO: 1345839 - DNA, 15 bp, Homo sapiens
aaagtggaagtatgt

SEQ ID NO: 1345840 - DNA, 21 bp, Homo sapiens
aaagtggcgtgggagccagcc

SEQ ID NO: 1345841 - DNA, 22 bp, Homo sapiens
aaagtggcgtgggagccagcct

SEQ ID NO: 1345842 - DNA, 17 bp, Homo sapiens
aaagtgggcttaatgga

SEQ ID NO: 1345843 - DNA, 23 bp, Homo sapiens
aaagtgtcagaaggagctacaaa

SEQ ID NO: 1345844 - DNA, 16 bp, Homo sapiens
aaagtgtgtatatatt

SEQ ID NO: 1345845 - DNA, 21 bp, Homo sapiens
aaagtgtgtatatattttgtg

SEQ ID NO: 1345846 - DNA, 22 bp, Homo sapiens
aaagttaaacattgaagtaatg

SEQ ID NO: 1345847 - DNA, 15 bp, Homo sapiens
aaagtttgcttagaa

SEQ ID NO: 1345848 - DNA, 17 bp, Homo sapiens
aaagttttatatgcttt

SEQ ID NO: 1345849 - DNA, 16 bp, Homo sapiens
aaagttttgtaaaaga

SEQ ID NO: 1345850 - DNA, 18 bp, Homo sapiens
aaagttttgtaaaagaaa

SEQ ID NO: 1345851 - DNA, 12 bp, Homo sapiens
aaagttttgttg

SEQ ID NO: 1345852 - DNA, 23 bp, Homo sapiens
aaagttttgttgtacttaaatgg

SEQ ID NO: 1345853 - DNA, 14 bp, Homo sapiens
aaagtttttgtttg

SEQ ID NO: 1345854 - DNA, 21 bp, Homo sapiens
aaataaaaaagctcttttaat

SEQ ID NO: 1345855 - DNA, 14 bp, Homo sapiens
aaataaaatgaaaa

SEQ ID NO: 1345856 - DNA, 19 bp, Homo sapiens
aaataaaatgaaaattgta

SEQ ID NO: 1345857 - DNA, 15 bp, Homo sapiens
aaataaaatttgttg

SEQ ID NO: 1345858 - DNA, 19 bp, Homo sapiens
aaataaaatttgttgcata

SEQ ID NO: 1345859 - DNA, 14 bp, Homo sapiens
aaataaaccactgt

SEQ ID NO: 1345860 - DNA, 14 bp, Homo sapiens
aaataaagagagaa

SEQ ID NO: 1345861 - DNA, 17 bp, Homo sapiens
aaataagtatttataat

SEQ ID NO: 1345862 - DNA, 15 bp, Homo sapiens
aaataataataatgt

SEQ ID NO: 1345863 - DNA, 22 bp, Homo sapiens
aaataattcttttttattaatc

SEQ ID NO: 1345864 - DNA, 18 bp, Homo sapiens
aaatacacatagcatgta

SEQ ID NO: 1345865 - DNA, 13 bp, Homo sapiens
aaatacacatttg

SEQ ID NO: 1345866 - DNA, 14 bp, Homo sapiens
aaatacacatttgc

SEQ ID NO: 1345867 - DNA, 22 bp, Homo sapiens
aaatacacatttgctactgttg

SEQ ID NO: 1345868 - DNA, 19 bp, Homo sapiens
aaatacatgccacatcaaa

SEQ ID NO: 1345869 - DNA, 14 bp, Homo sapiens
aaatagagtgtagt

SEQ ID NO: 1345870 - DNA, 18 bp, Homo sapiens
aaatagagtgtagtttac

SEQ ID NO: 1345871 - DNA, 15 bp, Homo sapiens
aaatagatgctgtgt

SEQ ID NO: 1345872 - DNA, 19 bp, Homo sapiens
aaataggaatcattcagaa

SEQ ID NO: 1345873 - DNA, 16 bp, Homo sapiens
aaataggatttttaga

SEQ ID NO: 1345874 - DNA, 18 bp, Homo sapiens
aaatataaaattatgaga

SEQ ID NO: 1345875 - DNA, 23 bp, Homo sapiens
aaatataaacaaagattcatgat

SEQ ID NO: 1345876 - DNA, 16 bp, Homo sapiens
aaatataacacatttt

SEQ ID NO: 1345877 - DNA, 17 bp, Homo sapiens
aaatataacacattttt

SEQ ID NO: 1345878 - DNA, 17 bp, Homo sapiens
aaatatatcttataaag

SEQ ID NO: 1345879 - DNA, 14 bp, Homo sapiens
aaatatcaaagtca

SEQ ID NO: 1345880 - DNA, 22 bp, Homo sapiens
aaatatcaaagtcattaaagac

SEQ ID NO: 1345881 - DNA, 23 bp, Homo sapiens
aaatatcaaattaattgtgtgaa

SEQ ID NO: 1345882 - DNA, 14 bp, Homo sapiens
aaatattaagcatg

SEQ ID NO: 1345883 - DNA, 16 bp, Homo sapiens
aaatattcctttgcat

SEQ ID NO: 1345884 - DNA, 15 bp, Homo sapiens
aaatattgtttctgc

SEQ ID NO: 1345885 - DNA, 22 bp, Homo sapiens
aaatattgttttacaatagttc

SEQ ID NO: 1345886 - DNA, 15 bp, Homo sapiens
aaatcaatacactag

SEQ ID NO: 1345887 - DNA, 17 bp, Homo sapiens
aaatcaatacactagtt

SEQ ID NO: 1345888 - DNA, 22 bp, Homo sapiens
aaatcaatacactagttgtttc

SEQ ID NO: 1345889 - DNA, 22 bp, Homo sapiens
aaatcagagacaaaatatttcc

SEQ ID NO: 1345890 - DNA, 21 bp, Homo sapiens
aaatcattcttactaaaaagt

SEQ ID NO: 1345891 - DNA, 16 bp, Homo sapiens
aaatccggagaagctg

SEQ ID NO: 1345892 - DNA, 17 bp, Homo sapiens
aaatccttttacctttt

SEQ ID NO: 1345893 - DNA, 19 bp, Homo sapiens
aaatctatttattaatatt

SEQ ID NO: 1345894 - DNA, 21 bp, Homo sapiens
aaatctgagggaaatgttttg

SEQ ID NO: 1345895 - DNA, 22 bp, Homo sapiens
aaatctgagggaaatgttttgt

SEQ ID NO: 1345896 - DNA, 22 bp, Homo sapiens
aaatcttaatgaatgagtctgt

SEQ ID NO: 1345897 - DNA, 13 bp, Homo sapiens
aaatcttaatgtt

SEQ ID NO: 1345898 - DNA, 14 bp, Homo sapiens
aaatgaaaattgta

SEQ ID NO: 1345899 - DNA, 14 bp, Homo sapiens
aaatgaaatgcata

SEQ ID NO: 1345900 - DNA, 16 bp, Homo sapiens
aaatgaagaatttaaa

SEQ ID NO: 1345901 - DNA, 14 bp, Homo sapiens
aaatgactttatta

SEQ ID NO: 1345902 - DNA, 15 bp, Homo sapiens
aaatgactttattat

SEQ ID NO: 1345903 - DNA, 16 bp, Homo sapiens
aaatgatgtgcaaaac

SEQ ID NO: 1345904 - DNA, 15 bp, Homo sapiens
aaatgcatctttgat

SEQ ID NO: 1345905 - DNA, 22 bp, Homo sapiens
aaatgccatttatttattgatt

SEQ ID NO: 1345906 - DNA, 18 bp, Homo sapiens
aaatgctcaaagaaatct

SEQ ID NO: 1345907 - DNA, 13 bp, Homo sapiens
aaatggaaactat

SEQ ID NO: 1345908 - DNA, 20 bp, Homo sapiens
aaatggaaagtaactcattt

SEQ ID NO: 1345909 - DNA, 16 bp, Homo sapiens
aaatggagaagctgca

SEQ ID NO: 1345910 - DNA, 17 bp, Homo sapiens
aaatggagaagctgcag

SEQ ID NO: 1345911 - DNA, 22 bp, Homo sapiens
aaatggaggatctctaaagagc

SEQ ID NO: 1345912 - DNA, 22 bp, Homo sapiens
aaatggcctcatgtggctggaa

SEQ ID NO: 1345913 - DNA, 21 bp, Homo sapiens
aaatggctgtaatcatttgtt

SEQ ID NO: 1345914 - DNA, 20 bp, Homo sapiens
aaatggtctctaacatttcc

SEQ ID NO: 1345915 - DNA, 13 bp, Homo sapiens
aaatgtaatttaa

SEQ ID NO: 1345916 - DNA, 21 bp, Homo sapiens
aaatgtaggcatcatgcatgt

SEQ ID NO: 1345917 - DNA, 20 bp, Homo sapiens
aaatgtaggcttagtttgtg

SEQ ID NO: 1345918 - DNA, 21 bp, Homo sapiens
aaatgtccagtaagatcactg

SEQ ID NO: 1345919 - DNA, 24 bp, Homo sapiens
aaatgtctagttgtaacaccatga

SEQ ID NO: 1345920 - DNA, 13 bp, Homo sapiens
aaatgtgtacata

SEQ ID NO: 1345921 - DNA, 19 bp, Homo sapiens
aaatgttacctctgaattt

SEQ ID NO: 1345922 - DNA, 14 bp, Homo sapiens
aaatgtttcttttg

SEQ ID NO: 1345923 - DNA, 19 bp, Homo sapiens
aaatgtttggcatgtaaat

SEQ ID NO: 1345924 - DNA, 20 bp, Homo sapiens
aaatgtttggcatgtaaatg

SEQ ID NO: 1345925 - DNA, 13 bp, Homo sapiens
aaatgttttgtaa

SEQ ID NO: 1345926 - DNA, 20 bp, Homo sapiens
aaatgttttgtaaacattta

SEQ ID NO: 1345927 - DNA, 17 bp, Homo sapiens
aaattaaggtgtttgaa

SEQ ID NO: 1345928 - DNA, 19 bp, Homo sapiens
aaattaaggtgtttgaaaa

SEQ ID NO: 1345929 - DNA, 18 bp, Homo sapiens
aaattaattgtgtgaact

SEQ ID NO: 1345930 - DNA, 13 bp, Homo sapiens
aaattacaatttt

SEQ ID NO: 1345931 - DNA, 18 bp, Homo sapiens
aaattaggaataaataaa

SEQ ID NO: 1345932 - DNA, 17 bp, Homo sapiens
aaattatcttgatacat

SEQ ID NO: 1345933 - DNA, 12 bp, Homo sapiens
aaattcatttct

SEQ ID NO: 1345934 - DNA, 22 bp, Homo sapiens
aaattctataggaacatatgaa

SEQ ID NO: 1345935 - DNA, 13 bp, Homo sapiens
aaattctcctgga

SEQ ID NO: 1345936 - DNA, 14 bp, Homo sapiens
aaattctcctggag

SEQ ID NO: 1345937 - DNA, 14 bp, Homo sapiens
aaattctgatttct

SEQ ID NO: 1345938 - DNA, 20 bp, Homo sapiens
aaattgacacaagtggacct

SEQ ID NO: 1345939 - DNA, 19 bp, Homo sapiens
aaattggggaggagggggc

SEQ ID NO: 1345940 - DNA, 13 bp, Homo sapiens
aaattgtatattg

SEQ ID NO: 1345941 - DNA, 15 bp, Homo sapiens
aaattgtatattgta

SEQ ID NO: 1345942 - DNA, 23 bp, Homo sapiens
aaattgtttagtgatattacatt

SEQ ID NO: 1345943 - DNA, 19 bp, Homo sapiens
aaatttaaaaaataaataa

SEQ ID NO: 1345944 - DNA, 16 bp, Homo sapiens
aaatttagccgggcgc

SEQ ID NO: 1345945 - DNA, 20 bp, Homo sapiens
aaatttcttatgtgacatta

SEQ ID NO: 1345946 - DNA, 16 bp, Homo sapiens
aaatttgactaatttt

SEQ ID NO: 1345947 - DNA, 20 bp, Homo sapiens
aaatttgactaattttacat

SEQ ID NO: 1345948 - DNA, 14 bp, Homo sapiens
aaattttgaaaagt

SEQ ID NO: 1345949 - DNA, 13 bp, Homo sapiens
aaatttttttgta

SEQ ID NO: 1345950 - DNA, 17 bp, Homo sapiens
aaatttttttgtatgaa

SEQ ID NO: 1345951 - DNA, 18 bp, Homo sapiens
aaatttttttgtatgaaa

SEQ ID NO: 1345952 - DNA, 20 bp, Homo sapiens
aacaaaaaccaaatgtttat

SEQ ID NO: 1345953 - DNA, 14 bp, Homo sapiens
aacaaaaagcttcc

SEQ ID NO: 1345954 - DNA, 19 bp, Homo sapiens
aacaacaattggtaaaact

SEQ ID NO: 1345955 - DNA, 14 bp, Homo sapiens
aacaagcttcagta

SEQ ID NO: 1345956 - DNA, 14 bp, Homo sapiens
aacaagttgagcta

SEQ ID NO: 1345957 - DNA, 22 bp, Homo sapiens
aacaatattttatggttatgtt

SEQ ID NO: 1345958 - DNA, 12 bp, Homo sapiens
aacaatgaagtt

SEQ ID NO: 1345959 - DNA, 16 bp, Homo sapiens
aacaatgaagttgaaa

SEQ ID NO: 1345960 - DNA, 16 bp, Homo sapiens
aacaatggagtattct

SEQ ID NO: 1345961 - DNA, 23 bp, Homo sapiens
aacaattggtaaaactcactgtg

SEQ ID NO: 1345962 - DNA, 12 bp, Homo sapiens
aacacaagcaaa

SEQ ID NO: 1345963 - DNA, 16 bp, Homo sapiens
aacacaagcaaaaaaa

SEQ ID NO: 1345964 - DNA, 16 bp, Homo sapiens
aacacagcctgggccc

SEQ ID NO: 1345965 - DNA, 17 bp, Homo sapiens
aacacatgtttttatac

SEQ ID NO: 1345966 - DNA, 13 bp, Homo sapiens
aacacatttctct

SEQ ID NO: 1345967 - DNA, 17 bp, Homo sapiens
aacactaactcaccagc

SEQ ID NO: 1345968 - DNA, 13 bp, Homo sapiens
aacactcctctgc

SEQ ID NO: 1345969 - DNA, 11 bp, Homo sapiens
aacacttccag

SEQ ID NO: 1345970 - DNA, 15 bp, Homo sapiens
aacagcaagtgtgaa

SEQ ID NO: 1345971 - DNA, 18 bp, Homo sapiens
aacagccaagattttcct

SEQ ID NO: 1345972 - DNA, 11 bp, Homo sapiens
aacagctgcaa

SEQ ID NO: 1345973 - DNA, 15 bp, Homo sapiens
aacagtggaatataa

SEQ ID NO: 1345974 - DNA, 15 bp, Homo sapiens
aacagtgtgtaaaca

SEQ ID NO: 1345975 - DNA, 20 bp, Homo sapiens
aacagttgtatttaacagaa

SEQ ID NO: 1345976 - DNA, 23 bp, Homo sapiens
aacagttgtatttaacagaaatt

SEQ ID NO: 1345977 - DNA, 21 bp, Homo sapiens
aacataaattttttgaagtct

SEQ ID NO: 1345978 - DNA, 14 bp, Homo sapiens
aacatacaaatgca

SEQ ID NO: 1345979 - DNA, 17 bp, Homo sapiens
aacatagccaaaatgtg

SEQ ID NO: 1345980 - DNA, 23 bp, Homo sapiens
aacatctcaataaagtgctttaa

SEQ ID NO: 1345981 - DNA, 12 bp, Homo sapiens
aacatctttaag

SEQ ID NO: 1345982 - DNA, 23 bp, Homo sapiens
aacatgagtagataatttcaggg

SEQ ID NO: 1345983 - DNA, 13 bp, Homo sapiens
aacatgccccctg

SEQ ID NO: 1345984 - DNA, 14 bp, Homo sapiens
aacatgccccctgc

SEQ ID NO: 1345985 - DNA, 22 bp, Homo sapiens
aacatgctggtgaatattttca

SEQ ID NO: 1345986 - DNA, 12 bp, Homo sapiens
aacattatttat

SEQ ID NO: 1345987 - DNA, 18 bp, Homo sapiens
aacattgaagtaatgaat

SEQ ID NO: 1345988 - DNA, 22 bp, Homo sapiens
aacatttattttttttaaagaa

SEQ ID NO: 1345989 - DNA, 23 bp, Homo sapiens
aacatttattttttttaaagaaa

SEQ ID NO: 1345990 - DNA, 12 bp, Homo sapiens
aacatttgctgc

SEQ ID NO: 1345991 - DNA, 19 bp, Homo sapiens
aaccaaagagggcttcctc

SEQ ID NO: 1345992 - DNA, 15 bp, Homo sapiens
aaccaaatgtttatt

SEQ ID NO: 1345993 - DNA, 21 bp, Homo sapiens
aaccaccccggccccctgccc

SEQ ID NO: 1345994 - DNA, 15 bp, Homo sapiens
aaccacgcctcttga

SEQ ID NO: 1345995 - DNA, 21 bp, Homo sapiens
aaccacttgtagatttgattt

SEQ ID NO: 1345996 - DNA, 12 bp, Homo sapiens
aaccagacctgg

SEQ ID NO: 1345997 - DNA, 18 bp, Homo sapiens
aaccaggcacctcttcct

SEQ ID NO: 1345998 - DNA, 18 bp, Homo sapiens
aaccataaaatgtccagt

SEQ ID NO: 1345999 - DNA, 14 bp, Homo sapiens
aaccataaattcaa

SEQ ID NO: 1346000 - DNA, 16 bp, Homo sapiens
aacccaagcttagaac

SEQ ID NO: 1346001 - DNA, 23 bp, Homo sapiens
aacccattaaggggaagaatgaa

SEQ ID NO: 1346002 - DNA, 20 bp, Homo sapiens
aaccctgccgtcaccaccac

SEQ ID NO: 1346003 - DNA, 18 bp, Homo sapiens
aacccttttaaagttgat

SEQ ID NO: 1346004 - DNA, 17 bp, Homo sapiens
aaccgagtagaaaatgt

SEQ ID NO: 1346005 - DNA, 12 bp, Homo sapiens
aaccgcacagct

SEQ ID NO: 1346006 - DNA, 15 bp, Homo sapiens
aaccgcacagctcag

SEQ ID NO: 1346007 - DNA, 14 bp, Homo sapiens
aacctccccagcct

SEQ ID NO: 1346008 - DNA, 16 bp, Homo sapiens
aacctccccagcctgc

SEQ ID NO: 1346009 - DNA, 23 bp, Homo sapiens
aacctccccagcctgcgcctgct

SEQ ID NO: 1346010 - DNA, 14 bp, Homo sapiens
aacctcgccctctc

SEQ ID NO: 1346011 - DNA, 17 bp, Homo sapiens
aacctcgccctctcctt

SEQ ID NO: 1346012 - DNA, 20 bp, Homo sapiens
aacctcgccctctcctttgt

SEQ ID NO: 1346013 - DNA, 21 bp, Homo sapiens
aacctgggattcaggaatgtg

SEQ ID NO: 1346014 - DNA, 12 bp, Homo sapiens
aaccttaagtaa

SEQ ID NO: 1346015 - DNA, 22 bp, Homo sapiens
aaccttatctccacaacctctt

SEQ ID NO: 1346016 - DNA, 15 bp, Homo sapiens
aaccttcgtcctttt

SEQ ID NO: 1346017 - DNA, 14 bp, Homo sapiens
aacctttccctcac

SEQ ID NO: 1346018 - DNA, 18 bp, Homo sapiens
aacctttccctcaccccc

SEQ ID NO: 1346019 - DNA, 19 bp, Homo sapiens
aaccttttactggttgcat

SEQ ID NO: 1346020 - DNA, 18 bp, Homo sapiens
aacgaaccttggcctggg

SEQ ID NO: 1346021 - DNA, 17 bp, Homo sapiens
aacgctaaagagccctt

SEQ ID NO: 1346022 - DNA, 16 bp, Homo sapiens
aacgggaacatgcccc

SEQ ID NO: 1346023 - DNA, 19 bp, Homo sapiens
aacgtcctctttagttttt

SEQ ID NO: 1346024 - DNA, 13 bp, Homo sapiens
aactaaatttcac

SEQ ID NO: 1346025 - DNA, 23 bp, Homo sapiens
aactacctgtatttaaaaataga

SEQ ID NO: 1346026 - DNA, 14 bp, Homo sapiens
aactagtgtacatt

SEQ ID NO: 1346027 - DNA, 21 bp, Homo sapiens
aactatttattgactctgggt

SEQ ID NO: 1346028 - DNA, 17 bp, Homo sapiens
aactcaaactcttaaaa

SEQ ID NO: 1346029 - DNA, 20 bp, Homo sapiens
aactcaccagccccactgcc

SEQ ID NO: 1346030 - DNA, 14 bp, Homo sapiens
aactcaggcaaaga

SEQ ID NO: 1346031 - DNA, 15 bp, Homo sapiens
aactcaggcaaagaa

SEQ ID NO: 1346032 - DNA, 17 bp, Homo sapiens
aactcaggcaaagaaaa

SEQ ID NO: 1346033 - DNA, 17 bp, Homo sapiens
aactcatctgaaatgtt

SEQ ID NO: 1346034 - DNA, 18 bp, Homo sapiens
aactcatctgaaatgtta

SEQ ID NO: 1346035 - DNA, 20 bp, Homo sapiens
aactcatctgaaatgttaca

SEQ ID NO: 1346036 - DNA, 14 bp, Homo sapiens
aactccacatctgc

SEQ ID NO: 1346037 - DNA, 16 bp, Homo sapiens
aactccaggccctcct

SEQ ID NO: 1346038 - DNA, 16 bp, Homo sapiens
aactcgcgctcagtaa

SEQ ID NO: 1346039 - DNA, 16 bp, Homo sapiens
aactgaaatgcctgct

SEQ ID NO: 1346040 - DNA, 14 bp, Homo sapiens
aactgcaggccctg

SEQ ID NO: 1346041 - DNA, 19 bp, Homo sapiens
aactgcaggccctggcctc

SEQ ID NO: 1346042 - DNA, 21 bp, Homo sapiens
aactgcaggccctggcctccc

SEQ ID NO: 1346043 - DNA, 23 bp, Homo sapiens
aactgcaggccctggcctcccct

SEQ ID NO: 1346044 - DNA, 15 bp, Homo sapiens
aactgctgactgttt

SEQ ID NO: 1346045 - DNA, 23 bp, Homo sapiens
aactgcttcccttactttgctga

SEQ ID NO: 1346046 - DNA, 16 bp, Homo sapiens
aactggggttgagggc

SEQ ID NO: 1346047 - DNA, 20 bp, Homo sapiens
aactgtagatgatgtatttt

SEQ ID NO: 1346048 - DNA, 13 bp, Homo sapiens
aactgtatttgaa

SEQ ID NO: 1346049 - DNA, 14 bp, Homo sapiens
aactgtcctgtcct

SEQ ID NO: 1346050 - DNA, 18 bp, Homo sapiens
aactgtcctgtcctgctc

SEQ ID NO: 1346051 - DNA, 15 bp, Homo sapiens
aactgtcttcctcaa

SEQ ID NO: 1346052 - DNA, 16 bp, Homo sapiens
aactgtcttcctcaaa

SEQ ID NO: 1346053 - DNA, 13 bp, Homo sapiens
aacttaaataata

SEQ ID NO: 1346054 - DNA, 19 bp, Homo sapiens
aacttaaatgttattatct

SEQ ID NO: 1346055 - DNA, 22 bp, Homo sapiens
aacttctgcaacaagcatgcag

SEQ ID NO: 1346056 - DNA, 16 bp, Homo sapiens
aacttgaatgtgtcag

SEQ ID NO: 1346057 - DNA, 20 bp, Homo sapiens
aacttgcttaaatttcttat

SEQ ID NO: 1346058 - DNA, 13 bp, Homo sapiens
aactttgtatagt

SEQ ID NO: 1346059 - DNA, 18 bp, Homo sapiens
aagaaaaatgagcctggc

SEQ ID NO: 1346060 - DNA, 17 bp, Homo sapiens
aagaaaacatctttaag

SEQ ID NO: 1346061 - DNA, 13 bp, Homo sapiens
aagaaaagacctt

SEQ ID NO: 1346062 - DNA, 16 bp, Homo sapiens
aagaaaatgaaatgca

SEQ ID NO: 1346063 - DNA, 23 bp, Homo sapiens
aagaaatcatgtccatacacttt

SEQ ID NO: 1346064 - DNA, 19 bp, Homo sapiens
aagaaatccggagaagctg

SEQ ID NO: 1346065 - DNA, 13 bp, Homo sapiens
aagaaatgatgtt

SEQ ID NO: 1346066 - DNA, 23 bp, Homo sapiens
aagaaatgatgttggagaaggga

SEQ ID NO: 1346067 - DNA, 22 bp, Homo sapiens
aagaactgcaggccctggcctc

SEQ ID NO: 1346068 - DNA, 14 bp, Homo sapiens
aagaaggatgatgt

SEQ ID NO: 1346069 - DNA, 15 bp, Homo sapiens
aagaatagaaacaag

SEQ ID NO: 1346070 - DNA, 14 bp, Homo sapiens
aagaatattgcaaa

SEQ ID NO: 1346071 - DNA, 23 bp, Homo sapiens
aagaatattgcaaaatacatgaa

SEQ ID NO: 1346072 - DNA, 13 bp, Homo sapiens
aagaatgaaagct

SEQ ID NO: 1346073 - DNA, 19 bp, Homo sapiens
aagaatgaaagctgttcct

SEQ ID NO: 1346074 - DNA, 15 bp, Homo sapiens
aagaatgttagagta

SEQ ID NO: 1346075 - DNA, 16 bp, Homo sapiens
aagaattgaagcagga

SEQ ID NO: 1346076 - DNA, 14 bp, Homo sapiens
aagaatttgcatac

SEQ ID NO: 1346077 - DNA, 22 bp, Homo sapiens
aagacaagaactcccctttttt

SEQ ID NO: 1346078 - DNA, 20 bp, Homo sapiens
aagacaatgtgaaaagaaaa

SEQ ID NO: 1346079 - DNA, 16 bp, Homo sapiens
aagacactgcctgggc

SEQ ID NO: 1346080 - DNA, 22 bp, Homo sapiens
aagaccctcttgcccatcctga

SEQ ID NO: 1346081 - DNA, 11 bp, Homo sapiens
aagactggctt

SEQ ID NO: 1346082 - DNA, 16 bp, Homo sapiens
aagactggttttctgc

SEQ ID NO: 1346083 - DNA, 20 bp, Homo sapiens
aagactggttttctgccaat

SEQ ID NO: 1346084 - DNA, 14 bp, Homo sapiens
aagagaagttattt

SEQ ID NO: 1346085 - DNA, 14 bp, Homo sapiens
aagagatccaaaga

SEQ ID NO: 1346086 - DNA, 19 bp, Homo sapiens
aagagattgtggtttcatt

SEQ ID NO: 1346087 - DNA, 14 bp, Homo sapiens
aagagcaaatcaat

SEQ ID NO: 1346088 - DNA, 18 bp, Homo sapiens
aagagcagtggtaagaat

SEQ ID NO: 1346089 - DNA, 16 bp, Homo sapiens
aagagcccttgcctcc

SEQ ID NO: 1346090 - DNA, 18 bp, Homo sapiens
aagagcccttgcctcccc

SEQ ID NO: 1346091 - DNA, 23 bp, Homo sapiens
aagaggctgcccctctcaccaaa

SEQ ID NO: 1346092 - DNA, 21 bp, Homo sapiens
aagagtctacccgacataagt

SEQ ID NO: 1346093 - DNA, 19 bp, Homo sapiens
aagataatattaaggaaga

SEQ ID NO: 1346094 - DNA, 13 bp, Homo sapiens
aagatagacaggt

SEQ ID NO: 1346095 - DNA, 16 bp, Homo sapiens
aagatagacaggtcct

SEQ ID NO: 1346096 - DNA, 14 bp, Homo sapiens
aagatagtgtaact

SEQ ID NO: 1346097 - DNA, 15 bp, Homo sapiens
aagatagtgtaactt

SEQ ID NO: 1346098 - DNA, 23 bp, Homo sapiens
aagatgctccagcaacacagcct

SEQ ID NO: 1346099 - DNA, 16 bp, Homo sapiens
aagatggtatatttgg

SEQ ID NO: 1346100 - DNA, 18 bp, Homo sapiens
aagatggtatcatatatt

SEQ ID NO: 1346101 - DNA, 11 bp, Homo sapiens
aagatgtgaaa

SEQ ID NO: 1346102 - DNA, 13 bp, Homo sapiens
aagatgtgaaaat

SEQ ID NO: 1346103 - DNA, 14 bp, Homo sapiens
aagatgtgaaaatt

SEQ ID NO: 1346104 - DNA, 16 bp, Homo sapiens
aagatgtgaattattg

SEQ ID NO: 1346105 - DNA, 18 bp, Homo sapiens
aagatgtgaattattgac

SEQ ID NO: 1346106 - DNA, 21 bp, Homo sapiens
aagatgtgaattattgacact

SEQ ID NO: 1346107 - DNA, 21 bp, Homo sapiens
aagatgttgatttttactgtg

SEQ ID NO: 1346108 - DNA, 16 bp, Homo sapiens
aagattgatatctata

SEQ ID NO: 1346109 - DNA, 21 bp, Homo sapiens
aagattgatatctataaaata

SEQ ID NO: 1346110 - DNA, 18 bp, Homo sapiens
aagattgccccatctaga

SEQ ID NO: 1346111 - DNA, 16 bp, Homo sapiens
aagattttcctcttgt

SEQ ID NO: 1346112 - DNA, 20 bp, Homo sapiens
aagattttttaattgtttaa

SEQ ID NO: 1346113 - DNA, 16 bp, Homo sapiens
aagcaataaatgaatg

SEQ ID NO: 1346114 - DNA, 14 bp, Homo sapiens
aagcaatagaaaca

SEQ ID NO: 1346115 - DNA, 22 bp, Homo sapiens
aagcacaccaatcttactttgt

SEQ ID NO: 1346116 - DNA, 23 bp, Homo sapiens
aagcacaccaatcttactttgta

SEQ ID NO: 1346117 - DNA, 15 bp, Homo sapiens
aagcacagaatattt

SEQ ID NO: 1346118 - DNA, 19 bp, Homo sapiens
aagcactacaccttgcctt

SEQ ID NO: 1346119 - DNA, 16 bp, Homo sapiens
aagcagacattttaaa

SEQ ID NO: 1346120 - DNA, 14 bp, Homo sapiens
aagcagaggaagga

SEQ ID NO: 1346121 - DNA, 13 bp, Homo sapiens
aagcagaggacca

SEQ ID NO: 1346122 - DNA, 15 bp, Homo sapiens
aagcagaggaccagg

SEQ ID NO: 1346123 - DNA, 18 bp, Homo sapiens
aagcagaggaccagggcc

SEQ ID NO: 1346124 - DNA, 14 bp, Homo sapiens
aagcagagttttca

SEQ ID NO: 1346125 - DNA, 17 bp, Homo sapiens
aagcagcctctccccag

SEQ ID NO: 1346126 - DNA, 16 bp, Homo sapiens
aagcagcttattgttt

SEQ ID NO: 1346127 - DNA, 17 bp, Homo sapiens
aagcagtcgtgcctgtg

SEQ ID NO: 1346128 - DNA, 14 bp, Homo sapiens
aagcatactttgta

SEQ ID NO: 1346129 - DNA, 18 bp, Homo sapiens
aagcatactttgtaaata

SEQ ID NO: 1346130 - DNA, 19 bp, Homo sapiens
aagcatatgggttagatgt

SEQ ID NO: 1346131 - DNA, 20 bp, Homo sapiens
aagcatcttgggggggtggc

SEQ ID NO: 1346132 - DNA, 17 bp, Homo sapiens
aagcatgaaatgtgaat

SEQ ID NO: 1346133 - DNA, 17 bp, Homo sapiens
aagccaaaattaaggtg

SEQ ID NO: 1346134 - DNA, 20 bp, Homo sapiens
aagccaaaattaaggtgttt

SEQ ID NO: 1346135 - DNA, 11 bp, Homo sapiens
aagccaaagaa

SEQ ID NO: 1346136 - DNA, 12 bp, Homo sapiens
aagccaaagaaa

SEQ ID NO: 1346137 - DNA, 13 bp, Homo sapiens
aagccaagggaaa

SEQ ID NO: 1346138 - DNA, 14 bp, Homo sapiens
aagccaagggaaag

SEQ ID NO: 1346139 - DNA, 20 bp, Homo sapiens
aagccaagggaacctgtgtc

SEQ ID NO: 1346140 - DNA, 19 bp, Homo sapiens
aagccaagtggggtgctgg

SEQ ID NO: 1346141 - DNA, 16 bp, Homo sapiens
aagcccatcctgacca

SEQ ID NO: 1346142 - DNA, 16 bp, Homo sapiens
aagccccacatgtcca

SEQ ID NO: 1346143 - DNA, 13 bp, Homo sapiens
aagcctccacagc

SEQ ID NO: 1346144 - DNA, 19 bp, Homo sapiens
aagcctccttagaaaaaaa

SEQ ID NO: 1346145 - DNA, 15 bp, Homo sapiens
aagcctgctgtcttg

SEQ ID NO: 1346146 - DNA, 15 bp, Homo sapiens
aagccttcagctcca

SEQ ID NO: 1346147 - DNA, 14 bp, Homo sapiens
aagcggctggcagc

SEQ ID NO: 1346148 - DNA, 19 bp, Homo sapiens
aagctacctcaaacttcca

SEQ ID NO: 1346149 - DNA, 17 bp, Homo sapiens
aagctactagcaaaata

SEQ ID NO: 1346150 - DNA, 15 bp, Homo sapiens
aagctagttgaatac

SEQ ID NO: 1346151 - DNA, 17 bp, Homo sapiens
aagctagttgaatactt

SEQ ID NO: 1346152 - DNA, 16 bp, Homo sapiens
aagctccgcaggactt

SEQ ID NO: 1346153 - DNA, 11 bp, Homo sapiens
aagctgagcct

SEQ ID NO: 1346154 - DNA, 13 bp, Homo sapiens
aagctgagcctgc

SEQ ID NO: 1346155 - DNA, 15 bp, Homo sapiens
aagctgagcctgcag

SEQ ID NO: 1346156 - DNA, 19 bp, Homo sapiens
aagctgcaccctcaggcag

SEQ ID NO: 1346157 - DNA, 15 bp, Homo sapiens
aagctgggcaggttg

SEQ ID NO: 1346158 - DNA, 13 bp, Homo sapiens
aagctgttcctgt

SEQ ID NO: 1346159 - DNA, 18 bp, Homo sapiens
aagcttcagttgcttgtc

SEQ ID NO: 1346160 - DNA, 20 bp, Homo sapiens
aagcttcatgcacttaaaga

SEQ ID NO: 1346161 - DNA, 20 bp, Homo sapiens
aagctttattttgagatgta

SEQ ID NO: 1346162 - DNA, 16 bp, Homo sapiens
aaggaaaaacacaagc

SEQ ID NO: 1346163 - DNA, 19 bp, Homo sapiens
aaggaaaaacacaagcaaa

SEQ ID NO: 1346164 - DNA, 20 bp, Homo sapiens
aaggaaacaaccatgtcatt

SEQ ID NO: 1346165 - DNA, 16 bp, Homo sapiens
aaggaaagcaataaat

SEQ ID NO: 1346166 - DNA, 20 bp, Homo sapiens
aaggacaaagtgccaaagaa

SEQ ID NO: 1346167 - DNA, 19 bp, Homo sapiens
aaggaccttaagacagagt

SEQ ID NO: 1346168 - DNA, 15 bp, Homo sapiens
aaggactttgtacat

SEQ ID NO: 1346169 - DNA, 17 bp, Homo sapiens
aaggactttgtacattt

SEQ ID NO: 1346170 - DNA, 19 bp, Homo sapiens
aaggagagagcaaagggtg

SEQ ID NO: 1346171 - DNA, 18 bp, Homo sapiens
aaggaggaagagaaaaaa

SEQ ID NO: 1346172 - DNA, 20 bp, Homo sapiens
aaggaggaagagaaaaaata

SEQ ID NO: 1346173 - DNA, 14 bp, Homo sapiens
aaggatagtaagca

SEQ ID NO: 1346174 - DNA, 19 bp, Homo sapiens
aaggatgatgtctttttat

SEQ ID NO: 1346175 - DNA, 19 bp, Homo sapiens
aaggcaagagggggtggag

SEQ ID NO: 1346176 - DNA, 16 bp, Homo sapiens
aaggcaagccaggctc

SEQ ID NO: 1346177 - DNA, 17 bp, Homo sapiens
aaggcaatattaaccta

SEQ ID NO: 1346178 - DNA, 23 bp, Homo sapiens
aaggcagtagaactccaggccct

SEQ ID NO: 1346179 - DNA, 13 bp, Homo sapiens
aaggcctcttgta

SEQ ID NO: 1346180 - DNA, 20 bp, Homo sapiens
aaggcctggtgtttcttgat

SEQ ID NO: 1346181 - DNA, 12 bp, Homo sapiens
aaggcgctgaga

SEQ ID NO: 1346182 - DNA, 16 bp, Homo sapiens
aaggctgatgtcaatt

SEQ ID NO: 1346183 - DNA, 20 bp, Homo sapiens
aaggctggcgagagtctggc

SEQ ID NO: 1346184 - DNA, 22 bp, Homo sapiens
aaggctggcgagagtctggccc

SEQ ID NO: 1346185 - DNA, 21 bp, Homo sapiens
aaggctgtgctgccctgaaga

SEQ ID NO: 1346186 - DNA, 22 bp, Homo sapiens
aaggcttttcaaccacaaaact

SEQ ID NO: 1346187 - DNA, 11 bp, Homo sapiens
aagggaaaaat

SEQ ID NO: 1346188 - DNA, 15 bp, Homo sapiens
aagggaaagtttttt

SEQ ID NO: 1346189 - DNA, 15 bp, Homo sapiens
aagggagaagaaagg

SEQ ID NO: 1346190 - DNA, 13 bp, Homo sapiens
aagggataaagaa

SEQ ID NO: 1346191 - DNA, 21 bp, Homo sapiens
aagggcataaagtaaatacat

SEQ ID NO: 1346192 - DNA, 13 bp, Homo sapiens
aaggggtaaaagg

SEQ ID NO: 1346193 - DNA, 14 bp, Homo sapiens
aaggggtgctttta

SEQ ID NO: 1346194 - DNA, 17 bp, Homo sapiens
aaggggtgcttttatag

SEQ ID NO: 1346195 - DNA, 13 bp, Homo sapiens
aagggtttctcta

SEQ ID NO: 1346196 - DNA, 18 bp, Homo sapiens
aaggtataataaaattat

SEQ ID NO: 1346197 - DNA, 13 bp, Homo sapiens
aaggtgccacttt

SEQ ID NO: 1346198 - DNA, 14 bp, Homo sapiens
aaggtggattttgt

SEQ ID NO: 1346199 - DNA, 12 bp, Homo sapiens
aaggtgtttgaa

SEQ ID NO: 1346200 - DNA, 21 bp, Homo sapiens
aagtaactcatttgttaaaat

SEQ ID NO: 1346201 - DNA, 20 bp, Homo sapiens
aagtaagaaagtgaagcaaa

SEQ ID NO: 1346202 - DNA, 16 bp, Homo sapiens
aagtaattgtgaaaaa

SEQ ID NO: 1346203 - DNA, 14 bp, Homo sapiens
aagtagtcctgtga

SEQ ID NO: 1346204 - DNA, 14 bp, Homo sapiens
aagtagttctgtat

SEQ ID NO: 1346205 - DNA, 22 bp, Homo sapiens
aagtagttctgtatttgaaagt

SEQ ID NO: 1346206 - DNA, 20 bp, Homo sapiens
aagtatgtatattaaaaaag

SEQ ID NO: 1346207 - DNA, 21 bp, Homo sapiens
aagtatgtatattaaaaaaga

SEQ ID NO: 1346208 - DNA, 18 bp, Homo sapiens
aagtatgtggttttgtaa

SEQ ID NO: 1346209 - DNA, 17 bp, Homo sapiens
aagtatttttagaataa

SEQ ID NO: 1346210 - DNA, 21 bp, Homo sapiens
aagtcaagtgaaaaaggagga

SEQ ID NO: 1346211 - DNA, 20 bp, Homo sapiens
aagtcaatatgtggaagcaa

SEQ ID NO: 1346212 - DNA, 21 bp, Homo sapiens
aagtcacacattacaaagtta

SEQ ID NO: 1346213 - DNA, 22 bp, Homo sapiens
aagtcagctccagctttctgcc

SEQ ID NO: 1346214 - DNA, 20 bp, Homo sapiens
aagtccagtgtttctttttt

SEQ ID NO: 1346215 - DNA, 13 bp, Homo sapiens
aagtctataaaaa

SEQ ID NO: 1346216 - DNA, 21 bp, Homo sapiens
aagtctcactggctgtcagta

SEQ ID NO: 1346217 - DNA, 17 bp, Homo sapiens
aagtctctaggttctga

SEQ ID NO: 1346218 - DNA, 22 bp, Homo sapiens
aagtctgctctcatataagaca

SEQ ID NO: 1346219 - DNA, 16 bp, Homo sapiens
aagtcttactacagaa

SEQ ID NO: 1346220 - DNA, 14 bp, Homo sapiens
aagtctttaataaa

SEQ ID NO: 1346221 - DNA, 16 bp, Homo sapiens
aagtctttaataaata

SEQ ID NO: 1346222 - DNA, 18 bp, Homo sapiens
aagtgaggaaatcaaagt

SEQ ID NO: 1346223 - DNA, 14 bp, Homo sapiens
aagtgccaaagaaa

SEQ ID NO: 1346224 - DNA, 15 bp, Homo sapiens
aagtgccaaagaaag

SEQ ID NO: 1346225 - DNA, 16 bp, Homo sapiens
aagtgccaaagaaagt

SEQ ID NO: 1346226 - DNA, 16 bp, Homo sapiens
aagtgcctttgcagct

SEQ ID NO: 1346227 - DNA, 13 bp, Homo sapiens
aagtgctattacg

SEQ ID NO: 1346228 - DNA, 22 bp, Homo sapiens
aagtgcttggaacatactgttc

SEQ ID NO: 1346229 - DNA, 23 bp, Homo sapiens
aagtgcttggaacatactgttca

SEQ ID NO: 1346230 - DNA, 16 bp, Homo sapiens
aagtggaagtatgtat

SEQ ID NO: 1346231 - DNA, 22 bp, Homo sapiens
aagtggaccttaggccttcctc

SEQ ID NO: 1346232 - DNA, 19 bp, Homo sapiens
aagtggccaagaagcagtg

SEQ ID NO: 1346233 - DNA, 18 bp, Homo sapiens
aagtggggtgctgggagg

SEQ ID NO: 1346234 - DNA, 21 bp, Homo sapiens
aagtgtataatataaaaaatt

SEQ ID NO: 1346235 - DNA, 19 bp, Homo sapiens
aagtgtctcactaaagcat

SEQ ID NO: 1346236 - DNA, 21 bp, Homo sapiens
aagtgtctcactaaagcatga

SEQ ID NO: 1346237 - DNA, 14 bp, Homo sapiens
aagtgtgaatactg

SEQ ID NO: 1346238 - DNA, 20 bp, Homo sapiens
aagtgtgaatactgcttgaa

SEQ ID NO: 1346239 - DNA, 21 bp, Homo sapiens
aagtgtgtatatattttgtgt

SEQ ID NO: 1346240 - DNA, 18 bp, Homo sapiens
aagtgtgtggtagaaaca

SEQ ID NO: 1346241 - DNA, 15 bp, Homo sapiens
aagtgtttatgttgt

SEQ ID NO: 1346242 - DNA, 15 bp, Homo sapiens
aagttagtttgtata

SEQ ID NO: 1346243 - DNA, 22 bp, Homo sapiens
aagttagtttgtatatattatt

SEQ ID NO: 1346244 - DNA, 23 bp, Homo sapiens
aagttattgcagtttatcattca

SEQ ID NO: 1346245 - DNA, 18 bp, Homo sapiens
aagttattttctacagtg

SEQ ID NO: 1346246 - DNA, 19 bp, Homo sapiens
aagttcaatctgtttttca

SEQ ID NO: 1346247 - DNA, 21 bp, Homo sapiens
aagttcatgtccaaacgtcct

SEQ ID NO: 1346248 - DNA, 9 bp, Homo sapiens
aagttctta

SEQ ID NO: 1346249 - DNA, 22 bp, Homo sapiens
aagttcttatgaggaggggagg

SEQ ID NO: 1346250 - DNA, 16 bp, Homo sapiens
aagttgagctatgact

SEQ ID NO: 1346251 - DNA, 20 bp, Homo sapiens
aagttgagctatgacttaac

SEQ ID NO: 1346252 - DNA, 13 bp, Homo sapiens
aagtttatatata

SEQ ID NO: 1346253 - DNA, 16 bp, Homo sapiens
aagtttgcttagaaaa

SEQ ID NO: 1346254 - DNA, 13 bp, Homo sapiens
aagttttgttgta

SEQ ID NO: 1346255 - DNA, 15 bp, Homo sapiens
aagtttttgtttgga

SEQ ID NO: 1346256 - DNA, 12 bp, Homo sapiens
aagtttttttgc

SEQ ID NO: 1346257 - DNA, 13 bp, Homo sapiens
aagtttttttgct

SEQ ID NO: 1346258 - DNA, 11 bp, Homo sapiens
aataaaaatat

SEQ ID NO: 1346259 - DNA, 20 bp, Homo sapiens
aataaaatatatcttataaa

SEQ ID NO: 1346260 - DNA, 13 bp, Homo sapiens
aataaaatgaaaa

SEQ ID NO: 1346261 - DNA, 14 bp, Homo sapiens
aataaaatgaaaat

SEQ ID NO: 1346262 - DNA, 13 bp, Homo sapiens
aataaaatttaaa

SEQ ID NO: 1346263 - DNA, 17 bp, Homo sapiens
aataaaatttgttgcat

SEQ ID NO: 1346264 - DNA, 18 bp, Homo sapiens
aataaaccaaaggaaaat

SEQ ID NO: 1346265 - DNA, 18 bp, Homo sapiens
aataaataaaaactaatt

SEQ ID NO: 1346266 - DNA, 11 bp, Homo sapiens
aataaatatat

SEQ ID NO: 1346267 - DNA, 18 bp, Homo sapiens
aataaatgttttatttct

SEQ ID NO: 1346268 - DNA, 12 bp, Homo sapiens
aataaattttga

SEQ ID NO: 1346269 - DNA, 14 bp, Homo sapiens
aataaattttgaaa

SEQ ID NO: 1346270 - DNA, 16 bp, Homo sapiens
aataaattttgaaaag

SEQ ID NO: 1346271 - DNA, 20 bp, Homo sapiens
aataaattttgaaaagtaat

SEQ ID NO: 1346272 - DNA, 14 bp, Homo sapiens
aataacagctgcaa

SEQ ID NO: 1346273 - DNA, 21 bp, Homo sapiens
aataactggaacaaattattt

SEQ ID NO: 1346274 - DNA, 12 bp, Homo sapiens
aataactgtgta

SEQ ID NO: 1346275 - DNA, 12 bp, Homo sapiens
aataagaatttg

SEQ ID NO: 1346276 - DNA, 15 bp, Homo sapiens
aataagaatttgcat

SEQ ID NO: 1346277 - DNA, 16 bp, Homo sapiens
aataagaatttgcata

SEQ ID NO: 1346278 - DNA, 19 bp, Homo sapiens
aataagctactagcaaaat

SEQ ID NO: 1346279 - DNA, 16 bp, Homo sapiens
aataagctagttgaat

SEQ ID NO: 1346280 - DNA, 20 bp, Homo sapiens
aataagctagttgaatactt

SEQ ID NO: 1346281 - DNA, 14 bp, Homo sapiens
aataagttattgca

SEQ ID NO: 1346282 - DNA, 16 bp, Homo sapiens
aataataaatgccctc

SEQ ID NO: 1346283 - DNA, 13 bp, Homo sapiens
aataatcaagagc

SEQ ID NO: 1346284 - DNA, 19 bp, Homo sapiens
aataatgctacaattttaa

SEQ ID NO: 1346285 - DNA, 21 bp, Homo sapiens
aataatgctacaattttaaga

SEQ ID NO: 1346286 - DNA, 23 bp, Homo sapiens
aataattcttttttattaatcac

SEQ ID NO: 1346287 - DNA, 21 bp, Homo sapiens
aatacaaaaaattagccgggc

SEQ ID NO: 1346288 - DNA, 19 bp, Homo sapiens
aatacaaggtataataaaa

SEQ ID NO: 1346289 - DNA, 16 bp, Homo sapiens
aatacactagttgttt

SEQ ID NO: 1346290 - DNA, 20 bp, Homo sapiens
aatacagtatctcagggcct

SEQ ID NO: 1346291 - DNA, 18 bp, Homo sapiens
aatacatatggatgttac

SEQ ID NO: 1346292 - DNA, 18 bp, Homo sapiens
aataccatttagtaagaa

SEQ ID NO: 1346293 - DNA, 20 bp, Homo sapiens
aatactatttaagatgtgaa

SEQ ID NO: 1346294 - DNA, 18 bp, Homo sapiens
aatactgatggaattttt

SEQ ID NO: 1346295 - DNA, 16 bp, Homo sapiens
aatactgttctttcca

SEQ ID NO: 1346296 - DNA, 12 bp, Homo sapiens
aatacttccaga

SEQ ID NO: 1346297 - DNA, 15 bp, Homo sapiens
aatacttccagaagt

SEQ ID NO: 1346298 - DNA, 22 bp, Homo sapiens
aatacttgaaccataaaatgtc

SEQ ID NO: 1346299 - DNA, 13 bp, Homo sapiens
aatagcaactttt

SEQ ID NO: 1346300 - DNA, 21 bp, Homo sapiens
aataggagtggtgatttgaaa

SEQ ID NO: 1346301 - DNA, 20 bp, Homo sapiens
aataggatgggcttctgtgc

SEQ ID NO: 1346302 - DNA, 17 bp, Homo sapiens
aatagtatgaaaatgga

SEQ ID NO: 1346303 - DNA, 19 bp, Homo sapiens
aatagtttattttaaaaca

SEQ ID NO: 1346304 - DNA, 22 bp, Homo sapiens
aatagtttattttaaaacaata

SEQ ID NO: 1346305 - DNA, 14 bp, Homo sapiens
aatataaacaaaga

SEQ ID NO: 1346306 - DNA, 23 bp, Homo sapiens
aatataaggaaagcaataaatga

SEQ ID NO: 1346307 - DNA, 14 bp, Homo sapiens
aatatatctctatt

SEQ ID NO: 1346308 - DNA, 21 bp, Homo sapiens
aatatatcttataaagtggaa

SEQ ID NO: 1346309 - DNA, 12 bp, Homo sapiens
aatatatgtatt

SEQ ID NO: 1346310 - DNA, 13 bp, Homo sapiens
aatatattgaact

SEQ ID NO: 1346311 - DNA, 18 bp, Homo sapiens
aatatattgaacttttgt

SEQ ID NO: 1346312 - DNA, 19 bp, Homo sapiens
aatatattgaacttttgta

SEQ ID NO: 1346313 - DNA, 21 bp, Homo sapiens
aatatatttctaaatgtttgg

SEQ ID NO: 1346314 - DNA, 15 bp, Homo sapiens
aatatatttttagac

SEQ ID NO: 1346315 - DNA, 20 bp, Homo sapiens
aatatcaaagtcattaaaga

SEQ ID NO: 1346316 - DNA, 14 bp, Homo sapiens
aatatctaatatat

SEQ ID NO: 1346317 - DNA, 21 bp, Homo sapiens
aatatctaatatatatgaata

SEQ ID NO: 1346318 - DNA, 14 bp, Homo sapiens
aatatctattaata

SEQ ID NO: 1346319 - DNA, 15 bp, Homo sapiens
aatatctattaatat

SEQ ID NO: 1346320 - DNA, 20 bp, Homo sapiens
aatatgcctagtaacacata

SEQ ID NO: 1346321 - DNA, 22 bp, Homo sapiens
aatattaacctaatcaccatgt

SEQ ID NO: 1346322 - DNA, 22 bp, Homo sapiens
aatattaggcttaaaaactgaa

SEQ ID NO: 1346323 - DNA, 23 bp, Homo sapiens
aatattaggcttaaaaactgaaa

SEQ ID NO: 1346324 - DNA, 20 bp, Homo sapiens
aatattcctttgcatattat

SEQ ID NO: 1346325 - DNA, 23 bp, Homo sapiens
aatattgattgggaaaacatttg

SEQ ID NO: 1346326 - DNA, 22 bp, Homo sapiens
aatattgttgacaactgtgact

SEQ ID NO: 1346327 - DNA, 17 bp, Homo sapiens
aatattgttttacaata

SEQ ID NO: 1346328 - DNA, 16 bp, Homo sapiens
aatatttattaaattt

SEQ ID NO: 1346329 - DNA, 12 bp, Homo sapiens
aatatttggaat

SEQ ID NO: 1346330 - DNA, 12 bp, Homo sapiens
aatattttcaac

SEQ ID NO: 1346331 - DNA, 18 bp, Homo sapiens
aatattttgaatcaataa

SEQ ID NO: 1346332 - DNA, 20 bp, Homo sapiens
aatattttgaatcaataata

SEQ ID NO: 1346333 - DNA, 22 bp, Homo sapiens
aatatttttatatttcctttat

SEQ ID NO: 1346334 - DNA, 19 bp, Homo sapiens
aatcaaaagtgcctcaaga

SEQ ID NO: 1346335 - DNA, 17 bp, Homo sapiens
aatcaagagccttaaaa

SEQ ID NO: 1346336 - DNA, 21 bp, Homo sapiens
aatcaagagccttaaaacatc

SEQ ID NO: 1346337 - DNA, 18 bp, Homo sapiens
aatcaatacactagttgt

SEQ ID NO: 1346338 - DNA, 19 bp, Homo sapiens
aatcaatacactagttgtt

SEQ ID NO: 1346339 - DNA, 16 bp, Homo sapiens
aatcaccatgtaagca

SEQ ID NO: 1346340 - DNA, 17 bp, Homo sapiens
aatcactgtgtatattt

SEQ ID NO: 1346341 - DNA, 21 bp, Homo sapiens
aatcactgtgtatatttgatt

SEQ ID NO: 1346342 - DNA, 17 bp, Homo sapiens
aatcagccaagttttat

SEQ ID NO: 1346343 - DNA, 11 bp, Homo sapiens
aatcagcctgc

SEQ ID NO: 1346344 - DNA, 19 bp, Homo sapiens
aatcagcctgctccagctg

SEQ ID NO: 1346345 - DNA, 18 bp, Homo sapiens
aatcaggaatattttcca

SEQ ID NO: 1346346 - DNA, 22 bp, Homo sapiens
aatcataggcaccttttactgt

SEQ ID NO: 1346347 - DNA, 22 bp, Homo sapiens
aatcatagtactctttgtagca

SEQ ID NO: 1346348 - DNA, 16 bp, Homo sapiens
aatcatagttactgtg

SEQ ID NO: 1346349 - DNA, 13 bp, Homo sapiens
aatcattcagaaa

SEQ ID NO: 1346350 - DNA, 19 bp, Homo sapiens
aatcattcagaaatgttga

SEQ ID NO: 1346351 - DNA, 13 bp, Homo sapiens
aatcattttcatt

SEQ ID NO: 1346352 - DNA, 17 bp, Homo sapiens
aatcattttcattccta

SEQ ID NO: 1346353 - DNA, 18 bp, Homo sapiens
aatccaagcctccacagc

SEQ ID NO: 1346354 - DNA, 13 bp, Homo sapiens
aatccagttataa

SEQ ID NO: 1346355 - DNA, 20 bp, Homo sapiens
aatcctccaaccaggctcct

SEQ ID NO: 1346356 - DNA, 12 bp, Homo sapiens
aatcctggcagc

SEQ ID NO: 1346357 - DNA, 21 bp, Homo sapiens
aatccttccattccacacaga

SEQ ID NO: 1346358 - DNA, 14 bp, Homo sapiens
aatctaaatctatt

SEQ ID NO: 1346359 - DNA, 15 bp, Homo sapiens
aatctaaatctattt

SEQ ID NO: 1346360 - DNA, 19 bp, Homo sapiens
aatctaaatctatttatta

SEQ ID NO: 1346361 - DNA, 13 bp, Homo sapiens
aatctactgcatt

SEQ ID NO: 1346362 - DNA, 14 bp, Homo sapiens
aatctactgcattt

SEQ ID NO: 1346363 - DNA, 21 bp, Homo sapiens
aatctatggtcgggagacagc

SEQ ID NO: 1346364 - DNA, 21 bp, Homo sapiens
aatctatttattaatatttaa

SEQ ID NO: 1346365 - DNA, 15 bp, Homo sapiens
aatctctaggaagtc

SEQ ID NO: 1346366 - DNA, 19 bp, Homo sapiens
aatctctaggaagtcaata

SEQ ID NO: 1346367 - DNA, 13 bp, Homo sapiens
aatctctgtgcct

SEQ ID NO: 1346368 - DNA, 20 bp, Homo sapiens
aatctgagggaaatgttttg

SEQ ID NO: 1346369 - DNA, 21 bp, Homo sapiens
aatctgagggaaatgttttgt

SEQ ID NO: 1346370 - DNA, 18 bp, Homo sapiens
aatctgatggccttaatt

SEQ ID NO: 1346371 - DNA, 16 bp, Homo sapiens
aatcttcaaagccttc

SEQ ID NO: 1346372 - DNA, 14 bp, Homo sapiens
aatcttccttttat

SEQ ID NO: 1346373 - DNA, 19 bp, Homo sapiens
aatcttgttggttcaccat

SEQ ID NO: 1346374 - DNA, 16 bp, Homo sapiens
aatcttgtttctgaaa

SEQ ID NO: 1346375 - DNA, 15 bp, Homo sapiens
aatctttacctgtat

SEQ ID NO: 1346376 - DNA, 18 bp, Homo sapiens
aatctttacctgtataca

SEQ ID NO: 1346377 - DNA, 22 bp, Homo sapiens
aatctttacctgtatacagtgc

SEQ ID NO: 1346378 - DNA, 18 bp, Homo sapiens
aatgaaaacagtgtgtaa

SEQ ID NO: 1346379 - DNA, 14 bp, Homo sapiens
aatgaaatgcatat

SEQ ID NO: 1346380 - DNA, 13 bp, Homo sapiens
aatgaagaattta

SEQ ID NO: 1346381 - DNA, 14 bp, Homo sapiens
aatgaagaatttaa

SEQ ID NO: 1346382 - DNA, 14 bp, Homo sapiens
aatgaagttgaaaa

SEQ ID NO: 1346383 - DNA, 19 bp, Homo sapiens
aatgaagttgaaaatcata

SEQ ID NO: 1346384 - DNA, 19 bp, Homo sapiens
aatgaatatctattaatat

SEQ ID NO: 1346385 - DNA, 12 bp, Homo sapiens
aatgacaatatt

SEQ ID NO: 1346386 - DNA, 14 bp, Homo sapiens
aatgacgtttacat

SEQ ID NO: 1346387 - DNA, 15 bp, Homo sapiens
aatgactcaaagtct

SEQ ID NO: 1346388 - DNA, 14 bp, Homo sapiens
aatgagctctgaaa

SEQ ID NO: 1346389 - DNA, 19 bp, Homo sapiens
aatgagtctgttgtgtgtc

SEQ ID NO: 1346390 - DNA, 17 bp, Homo sapiens
aatgatgtgcaaaacct

SEQ ID NO: 1346391 - DNA, 13 bp, Homo sapiens
aatgcaaactggg

SEQ ID NO: 1346392 - DNA, 20 bp, Homo sapiens
aatgcatctttgatgtgttg

SEQ ID NO: 1346393 - DNA, 19 bp, Homo sapiens
aatgccatttatttattga

SEQ ID NO: 1346394 - DNA, 20 bp, Homo sapiens
aatgccatttatttattgat

SEQ ID NO: 1346395 - DNA, 18 bp, Homo sapiens
aatgccattttaaggaaa

SEQ ID NO: 1346396 - DNA, 20 bp, Homo sapiens
aatgccattttaaggaaaac

SEQ ID NO: 1346397 - DNA, 22 bp, Homo sapiens
aatgccattttaaggaaaacta

SEQ ID NO: 1346398 - DNA, 20 bp, Homo sapiens
aatgctacaattttaagagg

SEQ ID NO: 1346399 - DNA, 14 bp, Homo sapiens
aatgctcaaagaaa

SEQ ID NO: 1346400 - DNA, 16 bp, Homo sapiens
aatgctccccacagcg

SEQ ID NO: 1346401 - DNA, 14 bp, Homo sapiens
aatgctttatttgt

SEQ ID NO: 1346402 - DNA, 16 bp, Homo sapiens
aatgctttatttgtaa

SEQ ID NO: 1346403 - DNA, 19 bp, Homo sapiens
aatgctttatttgtaaatt

SEQ ID NO: 1346404 - DNA, 17 bp, Homo sapiens
aatggaaattttgctat

SEQ ID NO: 1346405 - DNA, 16 bp, Homo sapiens
aatggagaagctgcag

SEQ ID NO: 1346406 - DNA, 17 bp, Homo sapiens
aatggtagtttctgtgg

SEQ ID NO: 1346407 - DNA, 18 bp, Homo sapiens
aatggtagtttctgtggt

SEQ ID NO: 1346408 - DNA, 17 bp, Homo sapiens
aatggttgatgatactt

SEQ ID NO: 1346409 - DNA, 16 bp, Homo sapiens
aatgtaatttaaatga

SEQ ID NO: 1346410 - DNA, 16 bp, Homo sapiens
aatgtacagttgaaat

SEQ ID NO: 1346411 - DNA, 15 bp, Homo sapiens
aatgtataaatatac

SEQ ID NO: 1346412 - DNA, 14 bp, Homo sapiens
aatgtcaaaagtag

SEQ ID NO: 1346413 - DNA, 14 bp, Homo sapiens
aatgtctgtaaata

SEQ ID NO: 1346414 - DNA, 23 bp, Homo sapiens
aatgtctgtaataatagactgta

SEQ ID NO: 1346415 - DNA, 17 bp, Homo sapiens
aatgtgaaaagaaaaat

SEQ ID NO: 1346416 - DNA, 19 bp, Homo sapiens
aatgtgaaaagaaaaatga

SEQ ID NO: 1346417 - DNA, 15 bp, Homo sapiens
aatgtgaccctccaa

SEQ ID NO: 1346418 - DNA, 21 bp, Homo sapiens
aatgtgagaagccagccagag

SEQ ID NO: 1346419 - DNA, 13 bp, Homo sapiens
aatgttaaaggga

SEQ ID NO: 1346420 - DNA, 20 bp, Homo sapiens
aatgttagagtaatgaaatg

SEQ ID NO: 1346421 - DNA, 16 bp, Homo sapiens
aatgttttcaaaaggt

SEQ ID NO: 1346422 - DNA, 18 bp, Homo sapiens
aatgttttgtaaacattt

SEQ ID NO: 1346423 - DNA, 20 bp, Homo sapiens
aatgttttgtaaacatttat

SEQ ID NO: 1346424 - DNA, 13 bp, Homo sapiens
aattaagcaaatg

SEQ ID NO: 1346425 - DNA, 16 bp, Homo sapiens
aattaaggtgtttgaa

SEQ ID NO: 1346426 - DNA, 14 bp, Homo sapiens
aattacaattttat

SEQ ID NO: 1346427 - DNA, 14 bp, Homo sapiens
aattagccgggcgt

SEQ ID NO: 1346428 - DNA, 23 bp, Homo sapiens
aattaggcaaggctatgtgatta

SEQ ID NO: 1346429 - DNA, 13 bp, Homo sapiens
aattagtaacatt

SEQ ID NO: 1346430 - DNA, 19 bp, Homo sapiens
aattatagtgtagaaaaga

SEQ ID NO: 1346431 - DNA, 19 bp, Homo sapiens
aattatataactgtatttg

SEQ ID NO: 1346432 - DNA, 17 bp, Homo sapiens
aattatcttgatacatt

SEQ ID NO: 1346433 - DNA, 21 bp, Homo sapiens
aattatcttgatacattcaaa

SEQ ID NO: 1346434 - DNA, 20 bp, Homo sapiens
aattatgagtttttcaatta

SEQ ID NO: 1346435 - DNA, 15 bp, Homo sapiens
aattattgacactga

SEQ ID NO: 1346436 - DNA, 16 bp, Homo sapiens
aattatttaattgtcc

SEQ ID NO: 1346437 - DNA, 14 bp, Homo sapiens
aattcaactttgta

SEQ ID NO: 1346438 - DNA, 15 bp, Homo sapiens
aattcaactttgtaa

SEQ ID NO: 1346439 - DNA, 16 bp, Homo sapiens
aattcatctgtctata

SEQ ID NO: 1346440 - DNA, 23 bp, Homo sapiens
aattctaccaaggtcttcttaat

SEQ ID NO: 1346441 - DNA, 13 bp, Homo sapiens
aattctccactgt

SEQ ID NO: 1346442 - DNA, 15 bp, Homo sapiens
aattctccactgtgc

SEQ ID NO: 1346443 - DNA, 15 bp, Homo sapiens
aattctcctggaggt

SEQ ID NO: 1346444 - DNA, 11 bp, Homo sapiens
aattctgattt

SEQ ID NO: 1346445 - DNA, 15 bp, Homo sapiens
aattctgtttaattt

SEQ ID NO: 1346446 - DNA, 22 bp, Homo sapiens
aattctgtttttaatgctattt

SEQ ID NO: 1346447 - DNA, 23 bp, Homo sapiens
aattcttaaaaggcccatagcag

SEQ ID NO: 1346448 - DNA, 22 bp, Homo sapiens
aattcttttttattaatcactg

SEQ ID NO: 1346449 - DNA, 23 bp, Homo sapiens
aattcttttttattaatcactgt

SEQ ID NO: 1346450 - DNA, 19 bp, Homo sapiens
aattgaaggtttttgatag

SEQ ID NO: 1346451 - DNA, 20 bp, Homo sapiens
aattgcaaaaacatagaaat

SEQ ID NO: 1346452 - DNA, 16 bp, Homo sapiens
aattgcatactttgta

SEQ ID NO: 1346453 - DNA, 22 bp, Homo sapiens
aattgcatactttgtattttga

SEQ ID NO: 1346454 - DNA, 12 bp, Homo sapiens
aattgccagctg

SEQ ID NO: 1346455 - DNA, 20 bp, Homo sapiens
aattggtaaaactcactgtg

SEQ ID NO: 1346456 - DNA, 19 bp, Homo sapiens
aattggtacttttaaaaac

SEQ ID NO: 1346457 - DNA, 18 bp, Homo sapiens
aattgtacaaaattaagc

SEQ ID NO: 1346458 - DNA, 19 bp, Homo sapiens
aattgtacaaaattaagca

SEQ ID NO: 1346459 - DNA, 20 bp, Homo sapiens
aattgtacaaaattaagcaa

SEQ ID NO: 1346460 - DNA, 19 bp, Homo sapiens
aattgtctttggtgctttt

SEQ ID NO: 1346461 - DNA, 15 bp, Homo sapiens
aatttaaaaatatat

SEQ ID NO: 1346462 - DNA, 17 bp, Homo sapiens
aatttaaaaatatattt

SEQ ID NO: 1346463 - DNA, 19 bp, Homo sapiens
aatttaaaataattatata

SEQ ID NO: 1346464 - DNA, 20 bp, Homo sapiens
aatttaaagaaaaaaatgtc

SEQ ID NO: 1346465 - DNA, 19 bp, Homo sapiens
aatttaaatgaaagaaaat

SEQ ID NO: 1346466 - DNA, 22 bp, Homo sapiens
aatttaaatgaaagaaaattga

SEQ ID NO: 1346467 - DNA, 15 bp, Homo sapiens
aatttaagttttgac

SEQ ID NO: 1346468 - DNA, 23 bp, Homo sapiens
aatttaagttttgacaagctggc

SEQ ID NO: 1346469 - DNA, 12 bp, Homo sapiens
aatttagtatta

SEQ ID NO: 1346470 - DNA, 22 bp, Homo sapiens
aatttagtgtttttttatttct

SEQ ID NO: 1346471 - DNA, 15 bp, Homo sapiens
aatttcctttttgac

SEQ ID NO: 1346472 - DNA, 17 bp, Homo sapiens
aatttcctttttgacac

SEQ ID NO: 1346473 - DNA, 21 bp, Homo sapiens
aatttcctttttgacactgaa

SEQ ID NO: 1346474 - DNA, 22 bp, Homo sapiens
aatttcctttttgacactgaaa

SEQ ID NO: 1346475 - DNA, 12 bp, Homo sapiens
aatttctcctcc

SEQ ID NO: 1346476 - DNA, 20 bp, Homo sapiens
aatttctcctcccttccttt

SEQ ID NO: 1346477 - DNA, 16 bp, Homo sapiens
aatttgactaatttta

SEQ ID NO: 1346478 - DNA, 17 bp, Homo sapiens
aatttgactaattttac

SEQ ID NO: 1346479 - DNA, 15 bp, Homo sapiens
aattttaaaatctga

SEQ ID NO: 1346480 - DNA, 13 bp, Homo sapiens
aattttaaagtgc

SEQ ID NO: 1346481 - DNA, 12 bp, Homo sapiens
aattttgtaaga

SEQ ID NO: 1346482 - DNA, 11 bp, Homo sapiens
aatttttaagc

SEQ ID NO: 1346483 - DNA, 17 bp, Homo sapiens
aatttttaagctgcaaa

SEQ ID NO: 1346484 - DNA, 15 bp, Homo sapiens
aatttttttgtaata

SEQ ID NO: 1346485 - DNA, 23 bp, Homo sapiens
aattttttttagtatttatttat

SEQ ID NO: 1346486 - DNA, 14 bp, Homo sapiens
acaaaaaatgtttt

SEQ ID NO: 1346487 - DNA, 18 bp, Homo sapiens
acaaaaaccaaatgttta

SEQ ID NO: 1346488 - DNA, 11 bp, Homo sapiens
acaaaagcaat

SEQ ID NO: 1346489 - DNA, 16 bp, Homo sapiens
acaaaatatttcccat

SEQ ID NO: 1346490 - DNA, 13 bp, Homo sapiens
acaaaatgaagct

SEQ ID NO: 1346491 - DNA, 18 bp, Homo sapiens
acaaacctaccaaaatgg

SEQ ID NO: 1346492 - DNA, 22 bp, Homo sapiens
acaaagaaatccggagaagctg

SEQ ID NO: 1346493 - DNA, 18 bp, Homo sapiens
acaaagacaaaagtctgt

SEQ ID NO: 1346494 - DNA, 15 bp, Homo sapiens
acaaagtgccaaaga

SEQ ID NO: 1346495 - DNA, 16 bp, Homo sapiens
acaaagtgccaaagaa

SEQ ID NO: 1346496 - DNA, 18 bp, Homo sapiens
acaaagtgccaaagaaag

SEQ ID NO: 1346497 - DNA, 13 bp, Homo sapiens
acaaataatttag

SEQ ID NO: 1346498 - DNA, 19 bp, Homo sapiens
acaaatattcactggcccc

SEQ ID NO: 1346499 - DNA, 16 bp, Homo sapiens
acaaatgactttatta

SEQ ID NO: 1346500 - DNA, 23 bp, Homo sapiens
acaaatgactttattatttattt

SEQ ID NO: 1346501 - DNA, 16 bp, Homo sapiens
acaaatgcatctttga

SEQ ID NO: 1346502 - DNA, 18 bp, Homo sapiens
acaaatgcatctttgatg

SEQ ID NO: 1346503 - DNA, 22 bp, Homo sapiens
acaaccatgtcatttcagaagt

SEQ ID NO: 1346504 - DNA, 11 bp, Homo sapiens
acaactgtgac

SEQ ID NO: 1346505 - DNA, 19 bp, Homo sapiens
acaagaccaccacttcgaa

SEQ ID NO: 1346506 - DNA, 15 bp, Homo sapiens
acaagattttttaat

SEQ ID NO: 1346507 - DNA, 21 bp, Homo sapiens
acaagattttttaattgttta

SEQ ID NO: 1346508 - DNA, 23 bp, Homo sapiens
acaagctgcaccctcaggcaggt

SEQ ID NO: 1346509 - DNA, 20 bp, Homo sapiens
acaaggcacttcatgtaaag

SEQ ID NO: 1346510 - DNA, 18 bp, Homo sapiens
acaaggtataataaaatt

SEQ ID NO: 1346511 - DNA, 19 bp, Homo sapiens
acaagtagttctgtatttg

SEQ ID NO: 1346512 - DNA, 21 bp, Homo sapiens
acaagtagttctgtatttgaa

SEQ ID NO: 1346513 - DNA, 22 bp, Homo sapiens
acaagttcgagtcaaagttgaa

SEQ ID NO: 1346514 - DNA, 16 bp, Homo sapiens
acaagtttatatatat

SEQ ID NO: 1346515 - DNA, 15 bp, Homo sapiens
acaataaaccctcag

SEQ ID NO: 1346516 - DNA, 20 bp, Homo sapiens
acaataaaccctcagagcct

SEQ ID NO: 1346517 - DNA, 22 bp, Homo sapiens
acaataggatgggcttctgtgc

SEQ ID NO: 1346518 - DNA, 15 bp, Homo sapiens
acaatattttatggt

SEQ ID NO: 1346519 - DNA, 16 bp, Homo sapiens
acaatgaacacttata

SEQ ID NO: 1346520 - DNA, 22 bp, Homo sapiens
acaatgtcctaactgaaagatg

SEQ ID NO: 1346521 - DNA, 22 bp, Homo sapiens
acaatgttgtagtgtcccccac

SEQ ID NO: 1346522 - DNA, 15 bp, Homo sapiens
acaattggtaaaact

SEQ ID NO: 1346523 - DNA, 12 bp, Homo sapiens
acaattttgtac

SEQ ID NO: 1346524 - DNA, 18 bp, Homo sapiens
acacaaacgggctcagca

SEQ ID NO: 1346525 - DNA, 20 bp, Homo sapiens
acacacctgtagcacttact

SEQ ID NO: 1346526 - DNA, 12 bp, Homo sapiens
acacagaaacac

SEQ ID NO: 1346527 - DNA, 14 bp, Homo sapiens
acacagactatttt

SEQ ID NO: 1346528 - DNA, 13 bp, Homo sapiens
acacagcctgggc

SEQ ID NO: 1346529 - DNA, 20 bp, Homo sapiens
acacagcctgggccccagct

SEQ ID NO: 1346530 - DNA, 23 bp, Homo sapiens
acacagttttgacctaacatacc

SEQ ID NO: 1346531 - DNA, 15 bp, Homo sapiens
acacatatacacgaa

SEQ ID NO: 1346532 - DNA, 18 bp, Homo sapiens
acacattacaaagttaaa

SEQ ID NO: 1346533 - DNA, 17 bp, Homo sapiens
acacatttgctactgtt

SEQ ID NO: 1346534 - DNA, 13 bp, Homo sapiens
acacatttttttg

SEQ ID NO: 1346535 - DNA, 18 bp, Homo sapiens
acaccaatcttactttgt

SEQ ID NO: 1346536 - DNA, 22 bp, Homo sapiens
acaccaatcttactttgtaaat

SEQ ID NO: 1346537 - DNA, 21 bp, Homo sapiens
acacctactagtcaccagaga

SEQ ID NO: 1346538 - DNA, 20 bp, Homo sapiens
acacctgtagcacttactgg

SEQ ID NO: 1346539 - DNA, 12 bp, Homo sapiens
acaccttctata

SEQ ID NO: 1346540 - DNA, 20 bp, Homo sapiens
acaccttggacatcctcctc

SEQ ID NO: 1346541 - DNA, 23 bp, Homo sapiens
acaccttggacatcctcctccca

SEQ ID NO: 1346542 - DNA, 15 bp, Homo sapiens
acacggacactcaaa

SEQ ID NO: 1346543 - DNA, 18 bp, Homo sapiens
acacggagcccagccctc

SEQ ID NO: 1346544 - DNA, 15 bp, Homo sapiens
acacgttttaaggac

SEQ ID NO: 1346545 - DNA, 22 bp, Homo sapiens
acacgttttaaggactgactga

SEQ ID NO: 1346546 - DNA, 16 bp, Homo sapiens
acactaacgaaatatc

SEQ ID NO: 1346547 - DNA, 17 bp, Homo sapiens
acactaactcaccagcc

SEQ ID NO: 1346548 - DNA, 21 bp, Homo sapiens
acactcaaaagctgggcaggt

SEQ ID NO: 1346549 - DNA, 20 bp, Homo sapiens
acactccagggacacacagc

SEQ ID NO: 1346550 - DNA, 12 bp, Homo sapiens
acactgaactta

SEQ ID NO: 1346551 - DNA, 14 bp, Homo sapiens
acactgcctgggct

SEQ ID NO: 1346552 - DNA, 19 bp, Homo sapiens
acactgcctttttatttat

SEQ ID NO: 1346553 - DNA, 22 bp, Homo sapiens
acactgcctttttatttatatg

SEQ ID NO: 1346554 - DNA, 17 bp, Homo sapiens
acactggttctcaatga

SEQ ID NO: 1346555 - DNA, 21 bp, Homo sapiens
acactggttctcaatgaaaaa

SEQ ID NO: 1346556 - DNA, 19 bp, Homo sapiens
acactgttgataaaaactc

SEQ ID NO: 1346557 - DNA, 14 bp, Homo sapiens
acacttataagtga

SEQ ID NO: 1346558 - DNA, 19 bp, Homo sapiens
acacttcttacgcaatgct

SEQ ID NO: 1346559 - DNA, 23 bp, Homo sapiens
acacttgatggagtgtgagccac

SEQ ID NO: 1346560 - DNA, 15 bp, Homo sapiens
acagaaaaagacttt

SEQ ID NO: 1346561 - DNA, 15 bp, Homo sapiens
acagaaatggactgg

SEQ ID NO: 1346562 - DNA, 14 bp, Homo sapiens
acagaaattgtata

SEQ ID NO: 1346563 - DNA, 17 bp, Homo sapiens
acagaacttgaatgtgt

SEQ ID NO: 1346564 - DNA, 22 bp, Homo sapiens
acagaatatttttatatttcct

SEQ ID NO: 1346565 - DNA, 23 bp, Homo sapiens
acagactatttttagattttctt

SEQ ID NO: 1346566 - DNA, 16 bp, Homo sapiens
acagagaggactgtag

SEQ ID NO: 1346567 - DNA, 21 bp, Homo sapiens
acagagcaagtgagaccctgt

SEQ ID NO: 1346568 - DNA, 19 bp, Homo sapiens
acagaggtattaaaactaa

SEQ ID NO: 1346569 - DNA, 22 bp, Homo sapiens
acagaggtattaaaactaaatt

SEQ ID NO: 1346570 - DNA, 17 bp, Homo sapiens
acagatgaatgtattta

SEQ ID NO: 1346571 - DNA, 19 bp, Homo sapiens
acagattgcctgtttctga

SEQ ID NO: 1346572 - DNA, 21 bp, Homo sapiens
acagcaacgatcacaaatgac

SEQ ID NO: 1346573 - DNA, 16 bp, Homo sapiens
acagcaagtgtgaata

SEQ ID NO: 1346574 - DNA, 22 bp, Homo sapiens
acagcagcttataatgggctct

SEQ ID NO: 1346575 - DNA, 13 bp, Homo sapiens
acagcatcagggt

SEQ ID NO: 1346576 - DNA, 17 bp, Homo sapiens
acagcgagggcagctgc

SEQ ID NO: 1346577 - DNA, 16 bp, Homo sapiens
acagcggaggtgtgga

SEQ ID NO: 1346578 - DNA, 14 bp, Homo sapiens
acagctcaggaggc

SEQ ID NO: 1346579 - DNA, 19 bp, Homo sapiens
acagctcaggaggcgccct

SEQ ID NO: 1346580 - DNA, 19 bp, Homo sapiens
acagctcattaaacttttt

SEQ ID NO: 1346581 - DNA, 19 bp, Homo sapiens
acagctgcaattccctgga

SEQ ID NO: 1346582 - DNA, 13 bp, Homo sapiens
acaggaggcaggc

SEQ ID NO: 1346583 - DNA, 22 bp, Homo sapiens
acaggcatgaggaatctgggag

SEQ ID NO: 1346584 - DNA, 14 bp, Homo sapiens
acagggtgggcctc

SEQ ID NO: 1346585 - DNA, 15 bp, Homo sapiens
acagggtgggcctcg

SEQ ID NO: 1346586 - DNA, 15 bp, Homo sapiens
acagtaagatatctc

SEQ ID NO: 1346587 - DNA, 19 bp, Homo sapiens
acagtaccctggttgtgtg

SEQ ID NO: 1346588 - DNA, 19 bp, Homo sapiens
acagtagaactgtctgtga

SEQ ID NO: 1346589 - DNA, 16 bp, Homo sapiens
acagtagagccagctt

SEQ ID NO: 1346590 - DNA, 16 bp, Homo sapiens
acagtatagatttttg

SEQ ID NO: 1346591 - DNA, 23 bp, Homo sapiens
acagtatgtgggatattgaatgt

SEQ ID NO: 1346592 - DNA, 19 bp, Homo sapiens
acagtctccggcctctcca

SEQ ID NO: 1346593 - DNA, 19 bp, Homo sapiens
acagtgcagagccttctca

SEQ ID NO: 1346594 - DNA, 22 bp, Homo sapiens
acagtgcagagccttctcagaa

SEQ ID NO: 1346595 - DNA, 21 bp, Homo sapiens
acagtgcttttaagtgaaaat

SEQ ID NO: 1346596 - DNA, 17 bp, Homo sapiens
acagtggtggcaacatt

SEQ ID NO: 1346597 - DNA, 18 bp, Homo sapiens
acagtggttttatactga

SEQ ID NO: 1346598 - DNA, 20 bp, Homo sapiens
acagtggttttatactgaag

SEQ ID NO: 1346599 - DNA, 24 bp, Homo sapiens
acagtgtcccccaggttccgaaga

SEQ ID NO: 1346600 - DNA, 20 bp, Homo sapiens
acagttgaaaaacagctgag

SEQ ID NO: 1346601 - DNA, 16 bp, Homo sapiens
acagttgctctatgct

SEQ ID NO: 1346602 - DNA, 18 bp, Homo sapiens
acagttgtatttaacaga

SEQ ID NO: 1346603 - DNA, 22 bp, Homo sapiens
acagttgtatttaacagaaatt

SEQ ID NO: 1346604 - DNA, 14 bp, Homo sapiens
acataaaagaaata

SEQ ID NO: 1346605 - DNA, 17 bp, Homo sapiens
acataaaagaaataaac

SEQ ID NO: 1346606 - DNA, 15 bp, Homo sapiens
acataagcttccatt

SEQ ID NO: 1346607 - DNA, 16 bp, Homo sapiens
acataatactgaacca

SEQ ID NO: 1346608 - DNA, 17 bp, Homo sapiens
acataatactgaaccac

SEQ ID NO: 1346609 - DNA, 11 bp, Homo sapiens
acatacaaatg

SEQ ID NO: 1346610 - DNA, 24 bp, Homo sapiens
acatactccttccatcaaatagaa

SEQ ID NO: 1346611 - DNA, 16 bp, Homo sapiens
acatagccaaaatgtg

SEQ ID NO: 1346612 - DNA, 19 bp, Homo sapiens
acatagccaaaatgtgagt

SEQ ID NO: 1346613 - DNA, 14 bp, Homo sapiens
acatatagtgtaca

SEQ ID NO: 1346614 - DNA, 16 bp, Homo sapiens
acatatatatatataa

SEQ ID NO: 1346615 - DNA, 15 bp, Homo sapiens
acatatcccttccag

SEQ ID NO: 1346616 - DNA, 23 bp, Homo sapiens
acatatctacacttcgcaccgga

SEQ ID NO: 1346617 - DNA, 15 bp, Homo sapiens
acatatgaaaataca

SEQ ID NO: 1346618 - DNA, 13 bp, Homo sapiens
acatatggatgtt

SEQ ID NO: 1346619 - DNA, 15 bp, Homo sapiens
acatatggatgttac

SEQ ID NO: 1346620 - DNA, 13 bp, Homo sapiens
acatcaaataaga

SEQ ID NO: 1346621 - DNA, 14 bp, Homo sapiens
acatcaaataagaa

SEQ ID NO: 1346622 - DNA, 18 bp, Homo sapiens
acatcaaataagaaataa

SEQ ID NO: 1346623 - DNA, 16 bp, Homo sapiens
acatcattccttttta

SEQ ID NO: 1346624 - DNA, 20 bp, Homo sapiens
acatctcaataaagtgcttt

SEQ ID NO: 1346625 - DNA, 11 bp, Homo sapiens
acatctgcctt

SEQ ID NO: 1346626 - DNA, 14 bp, Homo sapiens
acatcttgaatcct

SEQ ID NO: 1346627 - DNA, 18 bp, Homo sapiens
acatgagatgtgtggact

SEQ ID NO: 1346628 - DNA, 17 bp, Homo sapiens
acatgaggaactgtaga

SEQ ID NO: 1346629 - DNA, 13 bp, Homo sapiens
acatgcaataaaa

SEQ ID NO: 1346630 - DNA, 14 bp, Homo sapiens
acatgcaataaaat

SEQ ID NO: 1346631 - DNA, 15 bp, Homo sapiens
acatgcaataaaatt

SEQ ID NO: 1346632 - DNA, 18 bp, Homo sapiens
acatgcaataaaatttaa

SEQ ID NO: 1346633 - DNA, 19 bp, Homo sapiens
acatgcaataaaatttaaa

SEQ ID NO: 1346634 - DNA, 13 bp, Homo sapiens
acatgcatataat

SEQ ID NO: 1346635 - DNA, 12 bp, Homo sapiens
acatggaacagt

SEQ ID NO: 1346636 - DNA, 18 bp, Homo sapiens
acatggtgcctgagaggc

SEQ ID NO: 1346637 - DNA, 20 bp, Homo sapiens
acatggtgcctgagaggcag

SEQ ID NO: 1346638 - DNA, 13 bp, Homo sapiens
acatgtaatttga

SEQ ID NO: 1346639 - DNA, 23 bp, Homo sapiens
acatgtccagcaccttgtgcctg

SEQ ID NO: 1346640 - DNA, 17 bp, Homo sapiens
acatgtgatacattttt

SEQ ID NO: 1346641 - DNA, 23 bp, Homo sapiens
acatgtgatacattttttaagct

SEQ ID NO: 1346642 - DNA, 21 bp, Homo sapiens
acatgtttaataaataaaaat

SEQ ID NO: 1346643 - DNA, 14 bp, Homo sapiens
acattaacaaataa

SEQ ID NO: 1346644 - DNA, 19 bp, Homo sapiens
acattactctgcctctgta

SEQ ID NO: 1346645 - DNA, 18 bp, Homo sapiens
acattatttatatgggga

SEQ ID NO: 1346646 - DNA, 19 bp, Homo sapiens
acattgaagtaatgaattt

SEQ ID NO: 1346647 - DNA, 12 bp, Homo sapiens
acattgtgtcta

SEQ ID NO: 1346648 - DNA, 12 bp, Homo sapiens
acatttctctga

SEQ ID NO: 1346649 - DNA, 19 bp, Homo sapiens
acatttcttctagtgatga

SEQ ID NO: 1346650 - DNA, 17 bp, Homo sapiens
acatttgatgcatgtct

SEQ ID NO: 1346651 - DNA, 12 bp, Homo sapiens
accaaagctgcc

SEQ ID NO: 1346652 - DNA, 18 bp, Homo sapiens
accaaagctgcccactgt

SEQ ID NO: 1346653 - DNA, 19 bp, Homo sapiens
accaaagctgcccactgtt

SEQ ID NO: 1346654 - DNA, 15 bp, Homo sapiens
accaaatctggaagc

SEQ ID NO: 1346655 - DNA, 23 bp, Homo sapiens
accaactgtcactcattgctgag

SEQ ID NO: 1346656 - DNA, 15 bp, Homo sapiens
accaagaaagctcac

SEQ ID NO: 1346657 - DNA, 15 bp, Homo sapiens
accaatcttactttg

SEQ ID NO: 1346658 - DNA, 16 bp, Homo sapiens
accaatcttactttgt

SEQ ID NO: 1346659 - DNA, 18 bp, Homo sapiens
accaatcttactttgtaa

SEQ ID NO: 1346660 - DNA, 13 bp, Homo sapiens
accacacttgaaa

SEQ ID NO: 1346661 - DNA, 17 bp, Homo sapiens
accacacttgaaacctt

SEQ ID NO: 1346662 - DNA, 17 bp, Homo sapiens
accacagccagcacctg

SEQ ID NO: 1346663 - DNA, 15 bp, Homo sapiens
accacattgaagaat

SEQ ID NO: 1346664 - DNA, 14 bp, Homo sapiens
accaccaaaaacaa

SEQ ID NO: 1346665 - DNA, 15 bp, Homo sapiens
accaccaaaaacaaa

SEQ ID NO: 1346666 - DNA, 16 bp, Homo sapiens
accaccaagccaaggg

SEQ ID NO: 1346667 - DNA, 13 bp, Homo sapiens
accacccctacca

SEQ ID NO: 1346668 - DNA, 21 bp, Homo sapiens
accaccctgagccggccccag

SEQ ID NO: 1346669 - DNA, 19 bp, Homo sapiens
accacgcccgtcctgcctg

SEQ ID NO: 1346670 - DNA, 21 bp, Homo sapiens
accacgcccgtcctgcctgtg

SEQ ID NO: 1346671 - DNA, 21 bp, Homo sapiens
accactgcactccagcctggg

SEQ ID NO: 1346672 - DNA, 13 bp, Homo sapiens
accacttcgaaac

SEQ ID NO: 1346673 - DNA, 16 bp, Homo sapiens
accacttgaggcctga

SEQ ID NO: 1346674 - DNA, 20 bp, Homo sapiens
accacttgaggcctgatctg

SEQ ID NO: 1346675 - DNA, 16 bp, Homo sapiens
accacttgtagatttg

SEQ ID NO: 1346676 - DNA, 11 bp, Homo sapiens
accagacaggt

SEQ ID NO: 1346677 - DNA, 15 bp, Homo sapiens
accagaggagccttt

SEQ ID NO: 1346678 - DNA, 17 bp, Homo sapiens
accagaggagccttttt

SEQ ID NO: 1346679 - DNA, 21 bp, Homo sapiens
accagatgcgtcccaagatgt

SEQ ID NO: 1346680 - DNA, 22 bp, Homo sapiens
accagatgcgtcccaagatgtt

SEQ ID NO: 1346681 - DNA, 22 bp, Homo sapiens
accagctctgccgtctctggag

SEQ ID NO: 1346682 - DNA, 16 bp, Homo sapiens
accagctgcgcttgct

SEQ ID NO: 1346683 - DNA, 18 bp, Homo sapiens
accagctgcgcttgcttt

SEQ ID NO: 1346684 - DNA, 20 bp, Homo sapiens
accagctgcgcttgcttttc

SEQ ID NO: 1346685 - DNA, 22 bp, Homo sapiens
accagctgctccgaggacccag

SEQ ID NO: 1346686 - DNA, 13 bp, Homo sapiens
accaggaacagca

SEQ ID NO: 1346687 - DNA, 12 bp, Homo sapiens
accaggccacct

SEQ ID NO: 1346688 - DNA, 23 bp, Homo sapiens
accagggccttttctggcaccgc

SEQ ID NO: 1346689 - DNA, 16 bp, Homo sapiens
accaggggtttctcgc

SEQ ID NO: 1346690 - DNA, 14 bp, Homo sapiens
accataaattcaac

SEQ ID NO: 1346691 - DNA, 13 bp, Homo sapiens
accatcaatcctg

SEQ ID NO: 1346692 - DNA, 12 bp, Homo sapiens
accatcctggct

SEQ ID NO: 1346693 - DNA, 22 bp, Homo sapiens
accatcctggctaacatggtga

SEQ ID NO: 1346694 - DNA, 19 bp, Homo sapiens
accatgcctcactaatttt

SEQ ID NO: 1346695 - DNA, 16 bp, Homo sapiens
accatggtgaagtgct

SEQ ID NO: 1346696 - DNA, 19 bp, Homo sapiens
accatgtgagctcttccta

SEQ ID NO: 1346697 - DNA, 22 bp, Homo sapiens
accatgtggataactttacaga

SEQ ID NO: 1346698 - DNA, 16 bp, Homo sapiens
acccaaagctgagcct

SEQ ID NO: 1346699 - DNA, 19 bp, Homo sapiens
acccaaccccaagccagcc

SEQ ID NO: 1346700 - DNA, 18 bp, Homo sapiens
acccaaccctatctcctg

SEQ ID NO: 1346701 - DNA, 15 bp, Homo sapiens
acccaccgtggagga

SEQ ID NO: 1346702 - DNA, 17 bp, Homo sapiens
acccaggagtgtggcca

SEQ ID NO: 1346703 - DNA, 17 bp, Homo sapiens
acccagtgcagaatgta

SEQ ID NO: 1346704 - DNA, 13 bp, Homo sapiens
accccaagagaac

SEQ ID NO: 1346705 - DNA, 13 bp, Homo sapiens
acccccagccccg

SEQ ID NO: 1346706 - DNA, 14 bp, Homo sapiens
acccccagccccga

SEQ ID NO: 1346707 - DNA, 14 bp, Homo sapiens
accccccgtgggct

SEQ ID NO: 1346708 - DNA, 20 bp, Homo sapiens
acccccgtggggcagggagc

SEQ ID NO: 1346709 - DNA, 19 bp, Homo sapiens
accccctcccacccccagc

SEQ ID NO: 1346710 - DNA, 17 bp, Homo sapiens
accccctccttcagaca

SEQ ID NO: 1346711 - DNA, 19 bp, Homo sapiens
accccctccttcagacacc

SEQ ID NO: 1346712 - DNA, 16 bp, Homo sapiens
accccgtctctactaa

SEQ ID NO: 1346713 - DNA, 12 bp, Homo sapiens
acccctgccccc

SEQ ID NO: 1346714 - DNA, 17 bp, Homo sapiens
acccctgcccccagccc

SEQ ID NO: 1346715 - DNA, 21 bp, Homo sapiens
accccttccagatcactgcca

SEQ ID NO: 1346716 - DNA, 17 bp, Homo sapiens
acccgacataagtcgag

SEQ ID NO: 1346717 - DNA, 21 bp, Homo sapiens
acccgggaggcggagcttgca

SEQ ID NO: 1346718 - DNA, 14 bp, Homo sapiens
acccggggcccagg

SEQ ID NO: 1346719 - DNA, 16 bp, Homo sapiens
accctagccaatgtct

SEQ ID NO: 1346720 - DNA, 14 bp, Homo sapiens
accctcagagcctc

SEQ ID NO: 1346721 - DNA, 13 bp, Homo sapiens
accctcaggcagg

SEQ ID NO: 1346722 - DNA, 15 bp, Homo sapiens
accctcaggcaggtg

SEQ ID NO: 1346723 - DNA, 19 bp, Homo sapiens
accctcagtgagcatggta

SEQ ID NO: 1346724 - DNA, 15 bp, Homo sapiens
accctctaacctcgc

SEQ ID NO: 1346725 - DNA, 23 bp, Homo sapiens
accctctaacctcgccctctcct

SEQ ID NO: 1346726 - DNA, 15 bp, Homo sapiens
accctcttcctgtga

SEQ ID NO: 1346727 - DNA, 23 bp, Homo sapiens
accctcttgcccatcctgactga

SEQ ID NO: 1346728 - DNA, 12 bp, Homo sapiens
accctgagccgg

SEQ ID NO: 1346729 - DNA, 14 bp, Homo sapiens
accctgatgaaaac

SEQ ID NO: 1346730 - DNA, 17 bp, Homo sapiens
accctgcccctcagaga

SEQ ID NO: 1346731 - DNA, 19 bp, Homo sapiens
accctgccgtcaccaccac

SEQ ID NO: 1346732 - DNA, 15 bp, Homo sapiens
accctgggccctggg

SEQ ID NO: 1346733 - DNA, 20 bp, Homo sapiens
accctgggccctgggctgga

SEQ ID NO: 1346734 - DNA, 22 bp, Homo sapiens
accctgggccctgggctggaat

SEQ ID NO: 1346735 - DNA, 14 bp, Homo sapiens
accctggttgtgtg

SEQ ID NO: 1346736 - DNA, 19 bp, Homo sapiens
accctgtgacatggtgcct

SEQ ID NO: 1346737 - DNA, 22 bp, Homo sapiens
acccttactggcttacctcctc

SEQ ID NO: 1346738 - DNA, 14 bp, Homo sapiens
accctttatttgaa

SEQ ID NO: 1346739 - DNA, 14 bp, Homo sapiens
accgaggggccttt

SEQ ID NO: 1346740 - DNA, 21 bp, Homo sapiens
accgaggggcctttgttctgg

SEQ ID NO: 1346741 - DNA, 17 bp, Homo sapiens
accgccaaggctggggg

SEQ ID NO: 1346742 - DNA, 16 bp, Homo sapiens
accgcccttttcccct

SEQ ID NO: 1346743 - DNA, 21 bp, Homo sapiens
accgcctccccacctccaggc

SEQ ID NO: 1346744 - DNA, 15 bp, Homo sapiens
accggacttttctgc

SEQ ID NO: 1346745 - DNA, 23 bp, Homo sapiens
accggcggaccccagccatccag

SEQ ID NO: 1346746 - DNA, 14 bp, Homo sapiens
accgtgaagatact

SEQ ID NO: 1346747 - DNA, 20 bp, Homo sapiens
accgtgaagatactttgtat

SEQ ID NO: 1346748 - DNA, 21 bp, Homo sapiens
accgtgaagatactttgtatt

SEQ ID NO: 1346749 - DNA, 20 bp, Homo sapiens
acctaatcaccatgtaagca

SEQ ID NO: 1346750 - DNA, 17 bp, Homo sapiens
acctaccctcagtgagc

SEQ ID NO: 1346751 - DNA, 22 bp, Homo sapiens
acctagaaattgacacaagtgg

SEQ ID NO: 1346752 - DNA, 15 bp, Homo sapiens
acctaggtctccagt

SEQ ID NO: 1346753 - DNA, 17 bp, Homo sapiens
acctatttccagaaata

SEQ ID NO: 1346754 - DNA, 19 bp, Homo sapiens
acctatttccagaaataca

SEQ ID NO: 1346755 - DNA, 13 bp, Homo sapiens
acctcaatgtccc

SEQ ID NO: 1346756 - DNA, 12 bp, Homo sapiens
acctcagggctc

SEQ ID NO: 1346757 - DNA, 16 bp, Homo sapiens
acctcagggctcccag

SEQ ID NO: 1346758 - DNA, 18 bp, Homo sapiens
acctcagttcattgtggt

SEQ ID NO: 1346759 - DNA, 20 bp, Homo sapiens
acctcatgcccaccccctgc

SEQ ID NO: 1346760 - DNA, 22 bp, Homo sapiens
acctcatgcccaccccctgccc

SEQ ID NO: 1346761 - DNA, 14 bp, Homo sapiens
acctccaggctttc

SEQ ID NO: 1346762 - DNA, 21 bp, Homo sapiens
acctccccagcattccagccc

SEQ ID NO: 1346763 - DNA, 23 bp, Homo sapiens
acctccccagcattccagcccct

SEQ ID NO: 1346764 - DNA, 13 bp, Homo sapiens
acctcgccctctc

SEQ ID NO: 1346765 - DNA, 14 bp, Homo sapiens
acctcgctgagggc

SEQ ID NO: 1346766 - DNA, 22 bp, Homo sapiens
acctctgaatttacttccttgc

SEQ ID NO: 1346767 - DNA, 14 bp, Homo sapiens
acctcttctggctc

SEQ ID NO: 1346768 - DNA, 16 bp, Homo sapiens
acctcttctggctcaa

SEQ ID NO: 1346769 - DNA, 12 bp, Homo sapiens
acctgaggctgt

SEQ ID NO: 1346770 - DNA, 21 bp, Homo sapiens
acctggcatctaattctgatt

SEQ ID NO: 1346771 - DNA, 23 bp, Homo sapiens
acctggctgaggttcctctgcct

SEQ ID NO: 1346772 - DNA, 20 bp, Homo sapiens
acctgtaacttttgtaaata

SEQ ID NO: 1346773 - DNA, 15 bp, Homo sapiens
accttaggccttcct

SEQ ID NO: 1346774 - DNA, 18 bp, Homo sapiens
accttctagtcttggcca

SEQ ID NO: 1346775 - DNA, 12 bp, Homo sapiens
accttgtataaa

SEQ ID NO: 1346776 - DNA, 19 bp, Homo sapiens
accttgtataaattattca

SEQ ID NO: 1346777 - DNA, 14 bp, Homo sapiens
accttgtgcctggg

SEQ ID NO: 1346778 - DNA, 16 bp, Homo sapiens
accttgtgcctggggt

SEQ ID NO: 1346779 - DNA, 16 bp, Homo sapiens
accttgttacttctga

SEQ ID NO: 1346780 - DNA, 17 bp, Homo sapiens
acctttattttagaatt

SEQ ID NO: 1346781 - DNA, 18 bp, Homo sapiens
acctttccaccacagcca

SEQ ID NO: 1346782 - DNA, 13 bp, Homo sapiens
acctttccctcac

SEQ ID NO: 1346783 - DNA, 18 bp, Homo sapiens
acctttccctcaccccct

SEQ ID NO: 1346784 - DNA, 19 bp, Homo sapiens
acctttccctcaccccctc

SEQ ID NO: 1346785 - DNA, 20 bp, Homo sapiens
acctttgagtagatccattt

SEQ ID NO: 1346786 - DNA, 17 bp, Homo sapiens
acctttggaaagctctg

SEQ ID NO: 1346787 - DNA, 20 bp, Homo sapiens
accttttactggttgcatgg

SEQ ID NO: 1346788 - DNA, 14 bp, Homo sapiens
accttttgttttct

SEQ ID NO: 1346789 - DNA, 21 bp, Homo sapiens
acgaaggtaaaaagtattttt

SEQ ID NO: 1346790 - DNA, 16 bp, Homo sapiens
acgaatagacatcaaa

SEQ ID NO: 1346791 - DNA, 15 bp, Homo sapiens
acgaggaaccgaaaa

SEQ ID NO: 1346792 - DNA, 20 bp, Homo sapiens
acgaggggtgtcttgggcag

SEQ ID NO: 1346793 - DNA, 17 bp, Homo sapiens
acgatcacaaatgactt

SEQ ID NO: 1346794 - DNA, 15 bp, Homo sapiens
acgatgatgtacaga

SEQ ID NO: 1346795 - DNA, 18 bp, Homo sapiens
acgccaggggaaaatcag

SEQ ID NO: 1346796 - DNA, 16 bp, Homo sapiens
acgcccgtcctgcctg

SEQ ID NO: 1346797 - DNA, 16 bp, Homo sapiens
acgcctcttgaccagg

SEQ ID NO: 1346798 - DNA, 24 bp, Homo sapiens
acgcctcttgaccaggctgcctcc

SEQ ID NO: 1346799 - DNA, 16 bp, Homo sapiens
acgcgcgtcgccgcca

SEQ ID NO: 1346800 - DNA, 17 bp, Homo sapiens
acgctaaagagcccttg

SEQ ID NO: 1346801 - DNA, 21 bp, Homo sapiens
acgctaaagagcccttgcctc

SEQ ID NO: 1346802 - DNA, 15 bp, Homo sapiens
acggaagagccttgc

SEQ ID NO: 1346803 - DNA, 17 bp, Homo sapiens
acggacactcaaaagct

SEQ ID NO: 1346804 - DNA, 18 bp, Homo sapiens
acggaggcatcctaccct

SEQ ID NO: 1346805 - DNA, 21 bp, Homo sapiens
acggagtctcactctgtcacc

SEQ ID NO: 1346806 - DNA, 15 bp, Homo sapiens
acggcaggctcactg

SEQ ID NO: 1346807 - DNA, 17 bp, Homo sapiens
acggcaggctcactgcc

SEQ ID NO: 1346808 - DNA, 20 bp, Homo sapiens
acggcaggctcactgccagg

SEQ ID NO: 1346809 - DNA, 23 bp, Homo sapiens
acggccaagaatgtacgtccagc

SEQ ID NO: 1346810 - DNA, 18 bp, Homo sapiens
acgggaacatgccccctg

SEQ ID NO: 1346811 - DNA, 23 bp, Homo sapiens
acgggttagacagccaaaggctg

SEQ ID NO: 1346812 - DNA, 19 bp, Homo sapiens
acggtgctgtgagggaggg

SEQ ID NO: 1346813 - DNA, 15 bp, Homo sapiens
acggtgttttgccat

SEQ ID NO: 1346814 - DNA, 14 bp, Homo sapiens
acggtttccaggga

SEQ ID NO: 1346815 - DNA, 15 bp, Homo sapiens
acggtttccagggag

SEQ ID NO: 1346816 - DNA, 17 bp, Homo sapiens
acggtttccagggaggg

SEQ ID NO: 1346817 - DNA, 18 bp, Homo sapiens
acggtttcgaagtcatta

SEQ ID NO: 1346818 - DNA, 15 bp, Homo sapiens
acggttttactgcag

SEQ ID NO: 1346819 - DNA, 19 bp, Homo sapiens
acgtacaagtagttctgta

SEQ ID NO: 1346820 - DNA, 17 bp, Homo sapiens
acgtcagatgtttaaaa

SEQ ID NO: 1346821 - DNA, 18 bp, Homo sapiens
acgtcagatgtttaaaac

SEQ ID NO: 1346822 - DNA, 18 bp, Homo sapiens
acgtgctctgtgggtctc

SEQ ID NO: 1346823 - DNA, 19 bp, Homo sapiens
acgttggagaagcccgtgt

SEQ ID NO: 1346824 - DNA, 16 bp, Homo sapiens
acgtttataaacagaa

SEQ ID NO: 1346825 - DNA, 21 bp, Homo sapiens
acgtttataaacagaaatgga

SEQ ID NO: 1346826 - DNA, 17 bp, Homo sapiens
acgttttttcctcagtg

SEQ ID NO: 1346827 - DNA, 17 bp, Homo sapiens
actaaaaagtataaaat

SEQ ID NO: 1346828 - DNA, 21 bp, Homo sapiens
actaaaaagtataaaatagta

SEQ ID NO: 1346829 - DNA, 15 bp, Homo sapiens
actaaaaatattgtt

SEQ ID NO: 1346830 - DNA, 13 bp, Homo sapiens
actaaagcaatag

SEQ ID NO: 1346831 - DNA, 14 bp, Homo sapiens
actaaagcaataga

SEQ ID NO: 1346832 - DNA, 22 bp, Homo sapiens
actaaagcatgaaatgtgaatt

SEQ ID NO: 1346833 - DNA, 22 bp, Homo sapiens
actaactcaccagccccactgc

SEQ ID NO: 1346834 - DNA, 16 bp, Homo sapiens
actaagaattcaaact

SEQ ID NO: 1346835 - DNA, 17 bp, Homo sapiens
actaattatactacttt

SEQ ID NO: 1346836 - DNA, 18 bp, Homo sapiens
actaatttttgtattatt

SEQ ID NO: 1346837 - DNA, 14 bp, Homo sapiens
actacagaaatgag

SEQ ID NO: 1346838 - DNA, 17 bp, Homo sapiens
actacagtattactctt

SEQ ID NO: 1346839 - DNA, 15 bp, Homo sapiens
actacccatagacat

SEQ ID NO: 1346840 - DNA, 23 bp, Homo sapiens
actacctgtatttaaaaatagaa

SEQ ID NO: 1346841 - DNA, 17 bp, Homo sapiens
actactcccccaggtgg

SEQ ID NO: 1346842 - DNA, 15 bp, Homo sapiens
actagattgtgatcc

SEQ ID NO: 1346843 - DNA, 18 bp, Homo sapiens
actaggagaaccaaatct

SEQ ID NO: 1346844 - DNA, 23 bp, Homo sapiens
actaggcccccacttgcctcttc

SEQ ID NO: 1346845 - DNA, 15 bp, Homo sapiens
actataaaacaaaaa

SEQ ID NO: 1346846 - DNA, 19 bp, Homo sapiens
actatataatttatttcca

SEQ ID NO: 1346847 - DNA, 22 bp, Homo sapiens
actatatatataaatgtataaa

SEQ ID NO: 1346848 - DNA, 15 bp, Homo sapiens
actatgggatgagaa

SEQ ID NO: 1346849 - DNA, 14 bp, Homo sapiens
actatttaagatgt

SEQ ID NO: 1346850 - DNA, 21 bp, Homo sapiens
actatttaagatgtgaaaatt

SEQ ID NO: 1346851 - DNA, 20 bp, Homo sapiens
actatttattgactctgggt

SEQ ID NO: 1346852 - DNA, 16 bp, Homo sapiens
actcaaactcttaaaa

SEQ ID NO: 1346853 - DNA, 12 bp, Homo sapiens
actcaatgcttt

SEQ ID NO: 1346854 - DNA, 16 bp, Homo sapiens
actcacagtgctttta

SEQ ID NO: 1346855 - DNA, 19 bp, Homo sapiens
actcacgtgggtcctgagg

SEQ ID NO: 1346856 - DNA, 15 bp, Homo sapiens
actcactaggccccc

SEQ ID NO: 1346857 - DNA, 21 bp, Homo sapiens
actcactaggcccccacttgc

SEQ ID NO: 1346858 - DNA, 22 bp, Homo sapiens
actcactaggcccccacttgcc

SEQ ID NO: 1346859 - DNA, 11 bp, Homo sapiens
actcagccttc

SEQ ID NO: 1346860 - DNA, 15 bp, Homo sapiens
actcaggtgggccct

SEQ ID NO: 1346861 - DNA, 11 bp, Homo sapiens
actcagtgcag

SEQ ID NO: 1346862 - DNA, 23 bp, Homo sapiens
actcatctgaaatgttacaaaaa

SEQ ID NO: 1346863 - DNA, 15 bp, Homo sapiens
actcattgctgagcc

SEQ ID NO: 1346864 - DNA, 20 bp, Homo sapiens
actcattgctgagcctctgc

SEQ ID NO: 1346865 - DNA, 15 bp, Homo sapiens
actccagcaacttct

SEQ ID NO: 1346866 - DNA, 14 bp, Homo sapiens
actccagccagcgc

SEQ ID NO: 1346867 - DNA, 17 bp, Homo sapiens
actccagccagcgcctc

SEQ ID NO: 1346868 - DNA, 19 bp, Homo sapiens
actccagccagcgcctccc

SEQ ID NO: 1346869 - DNA, 20 bp, Homo sapiens
actccagccagcgcctccct

SEQ ID NO: 1346870 - DNA, 22 bp, Homo sapiens
actccagccagcgcctccctcc

SEQ ID NO: 1346871 - DNA, 15 bp, Homo sapiens
actccaggccctcct

SEQ ID NO: 1346872 - DNA, 20 bp, Homo sapiens
actccagggacacacagcct

SEQ ID NO: 1346873 - DNA, 16 bp, Homo sapiens
actcccacacccaaga

SEQ ID NO: 1346874 - DNA, 22 bp, Homo sapiens
actccgagaggtgggccagtct

SEQ ID NO: 1346875 - DNA, 15 bp, Homo sapiens
actccgttggccact

SEQ ID NO: 1346876 - DNA, 15 bp, Homo sapiens
actcctctgcgtcta

SEQ ID NO: 1346877 - DNA, 13 bp, Homo sapiens
actcctgcttaat

SEQ ID NO: 1346878 - DNA, 15 bp, Homo sapiens
actccttatttggcg

SEQ ID NO: 1346879 - DNA, 16 bp, Homo sapiens
actcgcgctcagtaaa

SEQ ID NO: 1346880 - DNA, 15 bp, Homo sapiens
actcgctgtatgaaa

SEQ ID NO: 1346881 - DNA, 14 bp, Homo sapiens
actcggtttctcca

SEQ ID NO: 1346882 - DNA, 23 bp, Homo sapiens
actcgtgtgtttctattttttga

SEQ ID NO: 1346883 - DNA, 12 bp, Homo sapiens
actctaaaaact

SEQ ID NO: 1346884 - DNA, 18 bp, Homo sapiens
actctaagtcatgtatgt

SEQ ID NO: 1346885 - DNA, 22 bp, Homo sapiens
actctaagtcatgtatgtttct

SEQ ID NO: 1346886 - DNA, 23 bp, Homo sapiens
actctaagtcatgtatgtttctc

SEQ ID NO: 1346887 - DNA, 19 bp, Homo sapiens
actctacttaatccaatgg

SEQ ID NO: 1346888 - DNA, 21 bp, Homo sapiens
actctcacactggttctcaat

SEQ ID NO: 1346889 - DNA, 18 bp, Homo sapiens
actctcatcactacagta

SEQ ID NO: 1346890 - DNA, 20 bp, Homo sapiens
actctgcatgtagaggcttg

SEQ ID NO: 1346891 - DNA, 14 bp, Homo sapiens
actctgcttctctg

SEQ ID NO: 1346892 - DNA, 15 bp, Homo sapiens
actctgggtccttcc

SEQ ID NO: 1346893 - DNA, 19 bp, Homo sapiens
actctgggtccttcctgaa

SEQ ID NO: 1346894 - DNA, 16 bp, Homo sapiens
actcttcagagaaatc

SEQ ID NO: 1346895 - DNA, 18 bp, Homo sapiens
actcttctcattacttgt

SEQ ID NO: 1346896 - DNA, 15 bp, Homo sapiens
actcttgagttgttt

SEQ ID NO: 1346897 - DNA, 16 bp, Homo sapiens
actcttgagttgtttt

SEQ ID NO: 1346898 - DNA, 22 bp, Homo sapiens
actcttgagttgtttttgtata

SEQ ID NO: 1346899 - DNA, 18 bp, Homo sapiens
actgaaaatattgtttta

SEQ ID NO: 1346900 - DNA, 15 bp, Homo sapiens
actgaaagttttgta

SEQ ID NO: 1346901 - DNA, 17 bp, Homo sapiens
actgaaagttttgtaaa

SEQ ID NO: 1346902 - DNA, 18 bp, Homo sapiens
actgaaagttttgtaaaa

SEQ ID NO: 1346903 - DNA, 13 bp, Homo sapiens
actgaagcagcct

SEQ ID NO: 1346904 - DNA, 14 bp, Homo sapiens
actgaagcagcctc

SEQ ID NO: 1346905 - DNA, 21 bp, Homo sapiens
actgaagcagcctctccccag

SEQ ID NO: 1346906 - DNA, 23 bp, Homo sapiens
actgaaggaaaaacacaagcaaa

SEQ ID NO: 1346907 - DNA, 17 bp, Homo sapiens
actgaatttttttgtaa

SEQ ID NO: 1346908 - DNA, 13 bp, Homo sapiens
actgacatttctt

SEQ ID NO: 1346909 - DNA, 15 bp, Homo sapiens
actgacatttcttct

SEQ ID NO: 1346910 - DNA, 20 bp, Homo sapiens
actgaggcagtttgaggatt

SEQ ID NO: 1346911 - DNA, 19 bp, Homo sapiens
actgagtattaatatctga

SEQ ID NO: 1346912 - DNA, 20 bp, Homo sapiens
actgatctttgtatattaca

SEQ ID NO: 1346913 - DNA, 21 bp, Homo sapiens
actgatggaatttttttgtac

SEQ ID NO: 1346914 - DNA, 17 bp, Homo sapiens
actgcactccagcctgg

SEQ ID NO: 1346915 - DNA, 21 bp, Homo sapiens
actgcactccagcctgggcga

SEQ ID NO: 1346916 - DNA, 19 bp, Homo sapiens
actgcaggccctggcctcc

SEQ ID NO: 1346917 - DNA, 15 bp, Homo sapiens
actgcatccagcctg

SEQ ID NO: 1346918 - DNA, 18 bp, Homo sapiens
actgccacactctccatc

SEQ ID NO: 1346919 - DNA, 19 bp, Homo sapiens
actgccagcagcagcaggt

SEQ ID NO: 1346920 - DNA, 18 bp, Homo sapiens
actgccaggccagcctcc

SEQ ID NO: 1346921 - DNA, 23 bp, Homo sapiens
actgccaggccagcctccgagag

SEQ ID NO: 1346922 - DNA, 19 bp, Homo sapiens
actgcctgaataaagagcc

SEQ ID NO: 1346923 - DNA, 16 bp, Homo sapiens
actgccttcgcttctt

SEQ ID NO: 1346924 - DNA, 22 bp, Homo sapiens
actgccttcgcttcttgcctct

SEQ ID NO: 1346925 - DNA, 23 bp, Homo sapiens
actgccttcgcttcttgcctctg

SEQ ID NO: 1346926 - DNA, 20 bp, Homo sapiens
actgcctttttatttatatg

SEQ ID NO: 1346927 - DNA, 22 bp, Homo sapiens
actgcgaagaccctcttgccca

SEQ ID NO: 1346928 - DNA, 17 bp, Homo sapiens
actgcgactttctgcct

SEQ ID NO: 1346929 - DNA, 23 bp, Homo sapiens
actgcgcccttaactgcatccag

SEQ ID NO: 1346930 - DNA, 20 bp, Homo sapiens
actgctaaataaaatttgtt

SEQ ID NO: 1346931 - DNA, 19 bp, Homo sapiens
actgctacctttcaaagct

SEQ ID NO: 1346932 - DNA, 20 bp, Homo sapiens
actgctacctttcaaagctt

SEQ ID NO: 1346933 - DNA, 22 bp, Homo sapiens
actggaaaggggagagcctgct

SEQ ID NO: 1346934 - DNA, 22 bp, Homo sapiens
actggaacccttttaaagttga

SEQ ID NO: 1346935 - DNA, 13 bp, Homo sapiens
actggaccccagc

SEQ ID NO: 1346936 - DNA, 17 bp, Homo sapiens
actggatgcagaaacag

SEQ ID NO: 1346937 - DNA, 13 bp, Homo sapiens
actggatttgttg

SEQ ID NO: 1346938 - DNA, 16 bp, Homo sapiens
actggcaatggtagtt

SEQ ID NO: 1346939 - DNA, 21 bp, Homo sapiens
actggcaatggtagtttctgt

SEQ ID NO: 1346940 - DNA, 22 bp, Homo sapiens
actggccatttgccaattttcc

SEQ ID NO: 1346941 - DNA, 17 bp, Homo sapiens
actggctgtcagtatga

SEQ ID NO: 1346942 - DNA, 21 bp, Homo sapiens
actggctgtcagtatgacatt

SEQ ID NO: 1346943 - DNA, 18 bp, Homo sapiens
actggcttacctcctcat

SEQ ID NO: 1346944 - DNA, 14 bp, Homo sapiens
actggcttttatta

SEQ ID NO: 1346945 - DNA, 19 bp, Homo sapiens
actggcttttattaatgca

SEQ ID NO: 1346946 - DNA, 21 bp, Homo sapiens
actggcttttattaatgcact

SEQ ID NO: 1346947 - DNA, 23 bp, Homo sapiens
actggcttttattaatgcacttt

SEQ ID NO: 1346948 - DNA, 15 bp, Homo sapiens
actggggcatcctgt

SEQ ID NO: 1346949 - DNA, 21 bp, Homo sapiens
actggggcctacagctttgat

SEQ ID NO: 1346950 - DNA, 13 bp, Homo sapiens
actggggcctcca

SEQ ID NO: 1346951 - DNA, 19 bp, Homo sapiens
actggggctggggaaggaa

SEQ ID NO: 1346952 - DNA, 21 bp, Homo sapiens
actggggctggggaaggaagc

SEQ ID NO: 1346953 - DNA, 12 bp, Homo sapiens
actggttctcaa

SEQ ID NO: 1346954 - DNA, 17 bp, Homo sapiens
actggttctcaatgaaa

SEQ ID NO: 1346955 - DNA, 18 bp, Homo sapiens
actggttgcatggaaatc

SEQ ID NO: 1346956 - DNA, 22 bp, Homo sapiens
actggtttatccacccacaaca

SEQ ID NO: 1346957 - DNA, 13 bp, Homo sapiens
actggttttctgc

SEQ ID NO: 1346958 - DNA, 15 bp, Homo sapiens
actggttttctgcca

SEQ ID NO: 1346959 - DNA, 22 bp, Homo sapiens
actgtaaatatttatttatgtg

SEQ ID NO: 1346960 - DNA, 12 bp, Homo sapiens
actgtaaatcat

SEQ ID NO: 1346961 - DNA, 20 bp, Homo sapiens
actgtaacttccaaataaat

SEQ ID NO: 1346962 - DNA, 13 bp, Homo sapiens
actgtaagggatt

SEQ ID NO: 1346963 - DNA, 17 bp, Homo sapiens
actgtacccaaatggaa

SEQ ID NO: 1346964 - DNA, 15 bp, Homo sapiens
actgtagaaatgatg

SEQ ID NO: 1346965 - DNA, 15 bp, Homo sapiens
actgtagatgatgta

SEQ ID NO: 1346966 - DNA, 23 bp, Homo sapiens
actgtatttgaaataagaattca

SEQ ID NO: 1346967 - DNA, 20 bp, Homo sapiens
actgtcaggctgaaaacaat

SEQ ID NO: 1346968 - DNA, 12 bp, Homo sapiens
actgtcctgtcc

SEQ ID NO: 1346969 - DNA, 13 bp, Homo sapiens
actgtcctgtcct

SEQ ID NO: 1346970 - DNA, 15 bp, Homo sapiens
actgtcctgtcctgc

SEQ ID NO: 1346971 - DNA, 20 bp, Homo sapiens
actgtctctcttctcagagt

SEQ ID NO: 1346972 - DNA, 16 bp, Homo sapiens
actgtgaagagaacca

SEQ ID NO: 1346973 - DNA, 19 bp, Homo sapiens
actgtggcacttgcctggg

SEQ ID NO: 1346974 - DNA, 20 bp, Homo sapiens
actgtggcacttgcctgggt

SEQ ID NO: 1346975 - DNA, 15 bp, Homo sapiens
actgtgtatatttga

SEQ ID NO: 1346976 - DNA, 19 bp, Homo sapiens
actgtgttttataaaatag

SEQ ID NO: 1346977 - DNA, 15 bp, Homo sapiens
actgttgataaaaac

SEQ ID NO: 1346978 - DNA, 15 bp, Homo sapiens
actgttgtaagaatt

SEQ ID NO: 1346979 - DNA, 19 bp, Homo sapiens
actgtttagatttgccata

SEQ ID NO: 1346980 - DNA, 20 bp, Homo sapiens
actgtttattacttccatga

SEQ ID NO: 1346981 - DNA, 17 bp, Homo sapiens
actgtttcctgggcacg

SEQ ID NO: 1346982 - DNA, 17 bp, Homo sapiens
actgtttctcttgagct

SEQ ID NO: 1346983 - DNA, 20 bp, Homo sapiens
actgtttctcttgagctggc

SEQ ID NO: 1346984 - DNA, 22 bp, Homo sapiens
actgtttctcttgagctggcct

SEQ ID NO: 1346985 - DNA, 23 bp, Homo sapiens
actgtttctcttgagctggcctc

SEQ ID NO: 1346986 - DNA, 17 bp, Homo sapiens
actgttttccagttcat

SEQ ID NO: 1346987 - DNA, 18 bp, Homo sapiens
acttaataactgtgtact

SEQ ID NO: 1346988 - DNA, 22 bp, Homo sapiens
acttaataatcaagagccttaa

SEQ ID NO: 1346989 - DNA, 15 bp, Homo sapiens
acttacctagtgaaa

SEQ ID NO: 1346990 - DNA, 19 bp, Homo sapiens
acttagaatccctgtgtta

SEQ ID NO: 1346991 - DNA, 17 bp, Homo sapiens
acttagtcaataagaaa

SEQ ID NO: 1346992 - DNA, 17 bp, Homo sapiens
acttatgaatgatttgc

SEQ ID NO: 1346993 - DNA, 15 bp, Homo sapiens
acttattgaatatat

SEQ ID NO: 1346994 - DNA, 17 bp, Homo sapiens
acttattgaatatatga

SEQ ID NO: 1346995 - DNA, 15 bp, Homo sapiens
acttattgaccattt

SEQ ID NO: 1346996 - DNA, 21 bp, Homo sapiens
acttcattattttaaaaatat

SEQ ID NO: 1346997 - DNA, 13 bp, Homo sapiens
acttccatgaatt

SEQ ID NO: 1346998 - DNA, 19 bp, Homo sapiens
acttcccaccctgcccctc

SEQ ID NO: 1346999 - DNA, 22 bp, Homo sapiens
acttcgcaccggagtgtctgga

SEQ ID NO: 1347000 - DNA, 20 bp, Homo sapiens
acttcgggaggtcgaggcag

SEQ ID NO: 1347001 - DNA, 17 bp, Homo sapiens
acttctaagaaaagcct

SEQ ID NO: 1347002 - DNA, 16 bp, Homo sapiens
acttctgcaacaagca

SEQ ID NO: 1347003 - DNA, 19 bp, Homo sapiens
acttctgcaacaagcatgc

SEQ ID NO: 1347004 - DNA, 15 bp, Homo sapiens
acttgaaaagagaca

SEQ ID NO: 1347005 - DNA, 21 bp, Homo sapiens
acttgaaaagagacaggcagg

SEQ ID NO: 1347006 - DNA, 20 bp, Homo sapiens
acttgaaccataaaatgtcc

SEQ ID NO: 1347007 - DNA, 16 bp, Homo sapiens
acttgatggctgcgaa

SEQ ID NO: 1347008 - DNA, 12 bp, Homo sapiens
acttgcctcttc

SEQ ID NO: 1347009 - DNA, 14 bp, Homo sapiens
acttgcctgggtca

SEQ ID NO: 1347010 - DNA, 19 bp, Homo sapiens
acttgcttaaatttcttat

SEQ ID NO: 1347011 - DNA, 22 bp, Homo sapiens
acttgctttaccttttcagggc

SEQ ID NO: 1347012 - DNA, 18 bp, Homo sapiens
acttggctcgaatctctg

SEQ ID NO: 1347013 - DNA, 20 bp, Homo sapiens
acttggctcgaatctctgtg

SEQ ID NO: 1347014 - DNA, 23 bp, Homo sapiens
acttggctcgaatctctgtgcct

SEQ ID NO: 1347015 - DNA, 23 bp, Homo sapiens
acttggggggctgaggtgggagg

SEQ ID NO: 1347016 - DNA, 17 bp, Homo sapiens
acttggttttatggtta

SEQ ID NO: 1347017 - DNA, 16 bp, Homo sapiens
acttgtgattatttat

SEQ ID NO: 1347018 - DNA, 17 bp, Homo sapiens
acttgtgattatttatt

SEQ ID NO: 1347019 - DNA, 21 bp, Homo sapiens
acttgttgcctataagccaaa

SEQ ID NO: 1347020 - DNA, 18 bp, Homo sapiens
acttgttttggatggctt

SEQ ID NO: 1347021 - DNA, 15 bp, Homo sapiens
actttacagaaatgg

SEQ ID NO: 1347022 - DNA, 21 bp, Homo sapiens
actttattgccttttaatttt

SEQ ID NO: 1347023 - DNA, 20 bp, Homo sapiens
actttcaattgtcacttttt

SEQ ID NO: 1347024 - DNA, 14 bp, Homo sapiens
actttctgcctgga

SEQ ID NO: 1347025 - DNA, 12 bp, Homo sapiens
actttgatgtca

SEQ ID NO: 1347026 - DNA, 12 bp, Homo sapiens
actttgtaaata

SEQ ID NO: 1347027 - DNA, 16 bp, Homo sapiens
actttgtaaattctga

SEQ ID NO: 1347028 - DNA, 14 bp, Homo sapiens
actttgtatagtta

SEQ ID NO: 1347029 - DNA, 18 bp, Homo sapiens
actttgtatagttatgta

SEQ ID NO: 1347030 - DNA, 15 bp, Homo sapiens
actttgtattgtcct

SEQ ID NO: 1347031 - DNA, 16 bp, Homo sapiens
acttttataaagcatg

SEQ ID NO: 1347032 - DNA, 17 bp, Homo sapiens
acttttataaagcatgt

SEQ ID NO: 1347033 - DNA, 18 bp, Homo sapiens
acttttattttacacaga

SEQ ID NO: 1347034 - DNA, 20 bp, Homo sapiens
acttttcattctcttttaat

SEQ ID NO: 1347035 - DNA, 16 bp, Homo sapiens
acttttgtactgaatt

SEQ ID NO: 1347036 - DNA, 17 bp, Homo sapiens
acttttgtactgaattt

SEQ ID NO: 1347037 - DNA, 18 bp, Homo sapiens
acttttgtactgaatttt

SEQ ID NO: 1347038 - DNA, 13 bp, Homo sapiens
actttttttgtat

SEQ ID NO: 1347039 - DNA, 16 bp, Homo sapiens
actttttttgtatgtg

SEQ ID NO: 1347040 - DNA, 19 bp, Homo sapiens
agaaaaaaatgtcaaaagt

SEQ ID NO: 1347041 - DNA, 23 bp, Homo sapiens
agaaaaaatattttcctgccagg

SEQ ID NO: 1347042 - DNA, 13 bp, Homo sapiens
agaaaaagaaaaa

SEQ ID NO: 1347043 - DNA, 19 bp, Homo sapiens
agaaaaataaaaatctctt

SEQ ID NO: 1347044 - DNA, 17 bp, Homo sapiens
agaaaaatgagcctggc

SEQ ID NO: 1347045 - DNA, 16 bp, Homo sapiens
agaaaacaagcaagtt

SEQ ID NO: 1347046 - DNA, 21 bp, Homo sapiens
agaaaacaagcaagttctgag

SEQ ID NO: 1347047 - DNA, 16 bp, Homo sapiens
agaaaactgtgatttc

SEQ ID NO: 1347048 - DNA, 17 bp, Homo sapiens
agaaaagaactggaaac

SEQ ID NO: 1347049 - DNA, 18 bp, Homo sapiens
agaaaatatattctttca

SEQ ID NO: 1347050 - DNA, 11 bp, Homo sapiens
agaaacactgc

SEQ ID NO: 1347051 - DNA, 17 bp, Homo sapiens
agaaacttaaatgttat

SEQ ID NO: 1347052 - DNA, 18 bp, Homo sapiens
agaaacttaaatgttatt

SEQ ID NO: 1347053 - DNA, 23 bp, Homo sapiens
agaaacttaaatgttattatctg

SEQ ID NO: 1347054 - DNA, 23 bp, Homo sapiens
agaaataaaccaaaggaaaatgt

SEQ ID NO: 1347055 - DNA, 18 bp, Homo sapiens
agaaataaagtttgctta

SEQ ID NO: 1347056 - DNA, 20 bp, Homo sapiens
agaaataatgctacaatttt

SEQ ID NO: 1347057 - DNA, 17 bp, Homo sapiens
agaaatataacacattt

SEQ ID NO: 1347058 - DNA, 19 bp, Homo sapiens
agaaatataacacattttt

SEQ ID NO: 1347059 - DNA, 16 bp, Homo sapiens
agaaatggaaagcaga

SEQ ID NO: 1347060 - DNA, 16 bp, Homo sapiens
agaaattttgtaagaa

SEQ ID NO: 1347061 - DNA, 22 bp, Homo sapiens
agaaattttgtaagaaggcaat

SEQ ID NO: 1347062 - DNA, 15 bp, Homo sapiens
agaacagcattgtcc

SEQ ID NO: 1347063 - DNA, 11 bp, Homo sapiens
agaacaggact

SEQ ID NO: 1347064 - DNA, 16 bp, Homo sapiens
agaaccacacttgaaa

SEQ ID NO: 1347065 - DNA, 20 bp, Homo sapiens
agaaccacacttgaaacctt

SEQ ID NO: 1347066 - DNA, 21 bp, Homo sapiens
agaaccacacttgaaaccttt

SEQ ID NO: 1347067 - DNA, 23 bp, Homo sapiens
agaaccaccccggccccctgccc

SEQ ID NO: 1347068 - DNA, 18 bp, Homo sapiens
agaacgaggattttaatt

SEQ ID NO: 1347069 - DNA, 23 bp, Homo sapiens
agaactattgtgctcagagacac

SEQ ID NO: 1347070 - DNA, 19 bp, Homo sapiens
agaactcactggggcctac

SEQ ID NO: 1347071 - DNA, 15 bp, Homo sapiens
agaactccaggccct

SEQ ID NO: 1347072 - DNA, 16 bp, Homo sapiens
agaactccaggccctc

SEQ ID NO: 1347073 - DNA, 14 bp, Homo sapiens
agaactctggcttt

SEQ ID NO: 1347074 - DNA, 20 bp, Homo sapiens
agaactctggcttttggaag

SEQ ID NO: 1347075 - DNA, 16 bp, Homo sapiens
agaactgaaaggcttt

SEQ ID NO: 1347076 - DNA, 16 bp, Homo sapiens
agaactgcaggccctg

SEQ ID NO: 1347077 - DNA, 14 bp, Homo sapiens
agaactgtctgtga

SEQ ID NO: 1347078 - DNA, 12 bp, Homo sapiens
agaactttgtat

SEQ ID NO: 1347079 - DNA, 17 bp, Homo sapiens
agaactttgtatagtta

SEQ ID NO: 1347080 - DNA, 16 bp, Homo sapiens
agaagaagttcatgtc

SEQ ID NO: 1347081 - DNA, 21 bp, Homo sapiens
agaagagattgtggtttcatt

SEQ ID NO: 1347082 - DNA, 23 bp, Homo sapiens
agaagagcgcagtgttttgcaag

SEQ ID NO: 1347083 - DNA, 14 bp, Homo sapiens
agaagatgctccag

SEQ ID NO: 1347084 - DNA, 23 bp, Homo sapiens
agaagatgctccagcaacacagc

SEQ ID NO: 1347085 - DNA, 13 bp, Homo sapiens
agaagcaagtaaa

SEQ ID NO: 1347086 - DNA, 23 bp, Homo sapiens
agaagcagttgtaccaagtgaaa

SEQ ID NO: 1347087 - DNA, 19 bp, Homo sapiens
agaagccaagggaaagggg

SEQ ID NO: 1347088 - DNA, 21 bp, Homo sapiens
agaagccaagggaaaggggtg

SEQ ID NO: 1347089 - DNA, 22 bp, Homo sapiens
agaagccaatctacaatctctt

SEQ ID NO: 1347090 - DNA, 22 bp, Homo sapiens
agaagcgattatgaaagcaaca

SEQ ID NO: 1347091 - DNA, 11 bp, Homo sapiens
agaagctgcag

SEQ ID NO: 1347092 - DNA, 12 bp, Homo sapiens
agaagctgcagg

SEQ ID NO: 1347093 - DNA, 14 bp, Homo sapiens
agaaggcaatatta

SEQ ID NO: 1347094 - DNA, 14 bp, Homo sapiens
agaaggtttattgt

SEQ ID NO: 1347095 - DNA, 17 bp, Homo sapiens
agaagtgcccttcctgc

SEQ ID NO: 1347096 - DNA, 17 bp, Homo sapiens
agaagttcatgtccaaa

SEQ ID NO: 1347097 - DNA, 22 bp, Homo sapiens
agaagtttgagatcagcctggg

SEQ ID NO: 1347098 - DNA, 13 bp, Homo sapiens
agaataagaattt

SEQ ID NO: 1347099 - DNA, 16 bp, Homo sapiens
agaataagaatttgca

SEQ ID NO: 1347100 - DNA, 13 bp, Homo sapiens
agaataagttatt

SEQ ID NO: 1347101 - DNA, 21 bp, Homo sapiens
agaataagttattgcagttta

SEQ ID NO: 1347102 - DNA, 11 bp, Homo sapiens
agaatactgat

SEQ ID NO: 1347103 - DNA, 14 bp, Homo sapiens
agaatactgatgga

SEQ ID NO: 1347104 - DNA, 17 bp, Homo sapiens
agaatactgatggaatt

SEQ ID NO: 1347105 - DNA, 13 bp, Homo sapiens
agaatagaaacaa

SEQ ID NO: 1347106 - DNA, 13 bp, Homo sapiens
agaatattgcaaa

SEQ ID NO: 1347107 - DNA, 22 bp, Homo sapiens
agaatattgcaaaatacatgaa

SEQ ID NO: 1347108 - DNA, 18 bp, Homo sapiens
agaatccctgtgttaatt

SEQ ID NO: 1347109 - DNA, 21 bp, Homo sapiens
agaatgactatataatttatt

SEQ ID NO: 1347110 - DNA, 22 bp, Homo sapiens
agaatgagtccttgatttcaaa

SEQ ID NO: 1347111 - DNA, 14 bp, Homo sapiens
agaattatttttca

SEQ ID NO: 1347112 - DNA, 13 bp, Homo sapiens
agaattcagacat

SEQ ID NO: 1347113 - DNA, 15 bp, Homo sapiens
agaattctgattgat

SEQ ID NO: 1347114 - DNA, 16 bp, Homo sapiens
agaattgaaaagtttt

SEQ ID NO: 1347115 - DNA, 19 bp, Homo sapiens
agaattgaaaagtttttgt

SEQ ID NO: 1347116 - DNA, 18 bp, Homo sapiens
agaattgaaggtttttga

SEQ ID NO: 1347117 - DNA, 20 bp, Homo sapiens
agaattgaaggtttttgata

SEQ ID NO: 1347118 - DNA, 21 bp, Homo sapiens
agaatttaaagaaaaaaatgt

SEQ ID NO: 1347119 - DNA, 16 bp, Homo sapiens
agaatttagtattatc

SEQ ID NO: 1347120 - DNA, 12 bp, Homo sapiens
agaatttgcata

SEQ ID NO: 1347121 - DNA, 13 bp, Homo sapiens
agaatttgcatac

SEQ ID NO: 1347122 - DNA, 22 bp, Homo sapiens
agacaaatattcctttgcatat

SEQ ID NO: 1347123 - DNA, 23 bp, Homo sapiens
agacaagattttttaattgttta

SEQ ID NO: 1347124 - DNA, 18 bp, Homo sapiens
agacaatggacccttttt

SEQ ID NO: 1347125 - DNA, 21 bp, Homo sapiens
agacaccctcaacctcttctg

SEQ ID NO: 1347126 - DNA, 20 bp, Homo sapiens
agacactaacgaaatatcaa

SEQ ID NO: 1347127 - DNA, 11 bp, Homo sapiens
agacactgcct

SEQ ID NO: 1347128 - DNA, 12 bp, Homo sapiens
agacactgcctg

SEQ ID NO: 1347129 - DNA, 14 bp, Homo sapiens
agacactgcctggg

SEQ ID NO: 1347130 - DNA, 15 bp, Homo sapiens
agacactgcctgggc

SEQ ID NO: 1347131 - DNA, 17 bp, Homo sapiens
agacagaacttgaatgt

SEQ ID NO: 1347132 - DNA, 16 bp, Homo sapiens
agacagatacctccaa

SEQ ID NO: 1347133 - DNA, 19 bp, Homo sapiens
agacagcttttctcaactg

SEQ ID NO: 1347134 - DNA, 15 bp, Homo sapiens
agacaggtcctgatt

SEQ ID NO: 1347135 - DNA, 12 bp, Homo sapiens
agacagtcttgc

SEQ ID NO: 1347136 - DNA, 21 bp, Homo sapiens
agacagtgtatgtagaagcat

SEQ ID NO: 1347137 - DNA, 22 bp, Homo sapiens
agacatccaaatttttttttaa

SEQ ID NO: 1347138 - DNA, 16 bp, Homo sapiens
agaccaccacttcgaa

SEQ ID NO: 1347139 - DNA, 24 bp, Homo sapiens
agaccacgcccgtcctgcctgtgg

SEQ ID NO: 1347140 - DNA, 18 bp, Homo sapiens
agaccctcttgcccatcc

SEQ ID NO: 1347141 - DNA, 20 bp, Homo sapiens
agacctggaagaacaggcct

SEQ ID NO: 1347142 - DNA, 21 bp, Homo sapiens
agaccttgttacttctgaggt

SEQ ID NO: 1347143 - DNA, 22 bp, Homo sapiens
agaccttgttacttctgaggta

SEQ ID NO: 1347144 - DNA, 22 bp, Homo sapiens
agaccttttggcccaatctctg

SEQ ID NO: 1347145 - DNA, 16 bp, Homo sapiens
agacggtgttttgcca

SEQ ID NO: 1347146 - DNA, 13 bp, Homo sapiens
agacgtttataaa

SEQ ID NO: 1347147 - DNA, 16 bp, Homo sapiens
agacgtttataaacag

SEQ ID NO: 1347148 - DNA, 16 bp, Homo sapiens
agactaaaagttgcat

SEQ ID NO: 1347149 - DNA, 21 bp, Homo sapiens
agactatatatataaatgtat

SEQ ID NO: 1347150 - DNA, 17 bp, Homo sapiens
agactcagagctctctc

SEQ ID NO: 1347151 - DNA, 16 bp, Homo sapiens
agactcagtgcagatg

SEQ ID NO: 1347152 - DNA, 17 bp, Homo sapiens
agactcgactctgtgcc

SEQ ID NO: 1347153 - DNA, 17 bp, Homo sapiens
agactcggggtgcttcc

SEQ ID NO: 1347154 - DNA, 16 bp, Homo sapiens
agactctttggacact

SEQ ID NO: 1347155 - DNA, 11 bp, Homo sapiens
agactggcttt

SEQ ID NO: 1347156 - DNA, 18 bp, Homo sapiens
agactgggtaggaaagag

SEQ ID NO: 1347157 - DNA, 22 bp, Homo sapiens
agactgggtaggaaagaggaag

SEQ ID NO: 1347158 - DNA, 23 bp, Homo sapiens
agactgtagatatgtattctttt

SEQ ID NO: 1347159 - DNA, 19 bp, Homo sapiens
agactgtgctgttgttctc

SEQ ID NO: 1347160 - DNA, 19 bp, Homo sapiens
agactgtggctagtgacaa

SEQ ID NO: 1347161 - DNA, 18 bp, Homo sapiens
agactgttaaatgaaacc

SEQ ID NO: 1347162 - DNA, 17 bp, Homo sapiens
agacttagggcaccagg

SEQ ID NO: 1347163 - DNA, 18 bp, Homo sapiens
agacttgaaaagagacag

SEQ ID NO: 1347164 - DNA, 16 bp, Homo sapiens
agacttgccagagccg

SEQ ID NO: 1347165 - DNA, 22 bp, Homo sapiens
agagaaaaaatattttcctgcc

SEQ ID NO: 1347166 - DNA, 13 bp, Homo sapiens
agagaacaggact

SEQ ID NO: 1347167 - DNA, 12 bp, Homo sapiens
agagaagttgta

SEQ ID NO: 1347168 - DNA, 20 bp, Homo sapiens
agagacactgttgataaaaa

SEQ ID NO: 1347169 - DNA, 22 bp, Homo sapiens
agagacactgttgataaaaact

SEQ ID NO: 1347170 - DNA, 18 bp, Homo sapiens
agagacagatacctccaa

SEQ ID NO: 1347171 - DNA, 23 bp, Homo sapiens
agagacagatacctccaaccctg

SEQ ID NO: 1347172 - DNA, 12 bp, Homo sapiens
agagacaggcag

SEQ ID NO: 1347173 - DNA, 16 bp, Homo sapiens
agagagaacaggacta

SEQ ID NO: 1347174 - DNA, 18 bp, Homo sapiens
agagagctgccatcgctg

SEQ ID NO: 1347175 - DNA, 13 bp, Homo sapiens
agagatccaaaga

SEQ ID NO: 1347176 - DNA, 20 bp, Homo sapiens
agagcaagagataagtcttt

SEQ ID NO: 1347177 - DNA, 14 bp, Homo sapiens
agagcataatttaa

SEQ ID NO: 1347178 - DNA, 16 bp, Homo sapiens
agagcatcggcctagg

SEQ ID NO: 1347179 - DNA, 11 bp, Homo sapiens
agagccagctt

SEQ ID NO: 1347180 - DNA, 13 bp, Homo sapiens
agagccatacata

SEQ ID NO: 1347181 - DNA, 21 bp, Homo sapiens
agagccatacataaaagaaat

SEQ ID NO: 1347182 - DNA, 19 bp, Homo sapiens
agagcctgctggcacccac

SEQ ID NO: 1347183 - DNA, 18 bp, Homo sapiens
agagcctggtgctgctgc

SEQ ID NO: 1347184 - DNA, 16 bp, Homo sapiens
agagccttctcagaag

SEQ ID NO: 1347185 - DNA, 18 bp, Homo sapiens
agagccttctcagaagca

SEQ ID NO: 1347186 - DNA, 11 bp, Homo sapiens
agagccttgcg

SEQ ID NO: 1347187 - DNA, 15 bp, Homo sapiens
agagcgcgcccctag

SEQ ID NO: 1347188 - DNA, 20 bp, Homo sapiens
agagcgcgcccctagccggt

SEQ ID NO: 1347189 - DNA, 14 bp, Homo sapiens
agagctattgccaa

SEQ ID NO: 1347190 - DNA, 15 bp, Homo sapiens
agaggaatgaaaaaa

SEQ ID NO: 1347191 - DNA, 18 bp, Homo sapiens
agaggaatgaaaaaagct

SEQ ID NO: 1347192 - DNA, 18 bp, Homo sapiens
agaggaattacgtgctct

SEQ ID NO: 1347193 - DNA, 17 bp, Homo sapiens
agaggaccagggccttt

SEQ ID NO: 1347194 - DNA, 22 bp, Homo sapiens
agaggagcctttttaaaacaca

SEQ ID NO: 1347195 - DNA, 23 bp, Homo sapiens
agaggagcctttttaaaacacat

SEQ ID NO: 1347196 - DNA, 11 bp, Homo sapiens
agaggcaccag

SEQ ID NO: 1347197 - DNA, 14 bp, Homo sapiens
agaggcaccaggaa

SEQ ID NO: 1347198 - DNA, 17 bp, Homo sapiens
agaggcaccaggaagcc

SEQ ID NO: 1347199 - DNA, 17 bp, Homo sapiens
agaggcccccagcccag

SEQ ID NO: 1347200 - DNA, 22 bp, Homo sapiens
agaggcccccagcccagggctc

SEQ ID NO: 1347201 - DNA, 12 bp, Homo sapiens
agaggctgcccc

SEQ ID NO: 1347202 - DNA, 20 bp, Homo sapiens
agagggacggccaagaatgt

SEQ ID NO: 1347203 - DNA, 20 bp, Homo sapiens
agagggaggtcactggaaag

SEQ ID NO: 1347204 - DNA, 22 bp, Homo sapiens
agagggcttcctctagaagcca

SEQ ID NO: 1347205 - DNA, 16 bp, Homo sapiens
agagggtatttttgta

SEQ ID NO: 1347206 - DNA, 17 bp, Homo sapiens
agaggtcctctggagcc

SEQ ID NO: 1347207 - DNA, 18 bp, Homo sapiens
agaggtcctctggagccc

SEQ ID NO: 1347208 - DNA, 19 bp, Homo sapiens
agaggttctaaaatcatga

SEQ ID NO: 1347209 - DNA, 18 bp, Homo sapiens
agagtaatcttgttggtt

SEQ ID NO: 1347210 - DNA, 12 bp, Homo sapiens
agagtacactgc

SEQ ID NO: 1347211 - DNA, 19 bp, Homo sapiens
agagtacactgcctgcctt

SEQ ID NO: 1347212 - DNA, 14 bp, Homo sapiens
agagtcagccagga

SEQ ID NO: 1347213 - DNA, 11 bp, Homo sapiens
agagtgggagc

SEQ ID NO: 1347214 - DNA, 13 bp, Homo sapiens
agagtggtggggg

SEQ ID NO: 1347215 - DNA, 18 bp, Homo sapiens
agagtgtagactgtggct

SEQ ID NO: 1347216 - DNA, 19 bp, Homo sapiens
agagttgggtgtctcctta

SEQ ID NO: 1347217 - DNA, 21 bp, Homo sapiens
agagtttcagtttgttggaaa

SEQ ID NO: 1347218 - DNA, 22 bp, Homo sapiens
agataatattaaggaagacaat

SEQ ID NO: 1347219 - DNA, 14 bp, Homo sapiens
agataatattgttt

SEQ ID NO: 1347220 - DNA, 14 bp, Homo sapiens
agatacctccaacc

SEQ ID NO: 1347221 - DNA, 13 bp, Homo sapiens
agatactttgtat

SEQ ID NO: 1347222 - DNA, 19 bp, Homo sapiens
agatagtgtaacttgctta

SEQ ID NO: 1347223 - DNA, 11 bp, Homo sapiens
agatatactgg

SEQ ID NO: 1347224 - DNA, 14 bp, Homo sapiens
agatatgtattctt

SEQ ID NO: 1347225 - DNA, 15 bp, Homo sapiens
agatatgtattcttt

SEQ ID NO: 1347226 - DNA, 14 bp, Homo sapiens
agatcactgccaca

SEQ ID NO: 1347227 - DNA, 16 bp, Homo sapiens
agatcactgtttagat

SEQ ID NO: 1347228 - DNA, 18 bp, Homo sapiens
agatcactgtttagattt

SEQ ID NO: 1347229 - DNA, 17 bp, Homo sapiens
agatcatagttttattt

SEQ ID NO: 1347230 - DNA, 16 bp, Homo sapiens
agatcattttgaaatt

SEQ ID NO: 1347231 - DNA, 11 bp, Homo sapiens
agcctgctggc

SEQ ID NO: 1347232 - DNA, 17 bp, Homo sapiens
agcctgctggcacccac

SEQ ID NO: 1347233 - DNA, 16 bp, Homo sapiens
agcctgggccccagct

SEQ ID NO: 1347234 - DNA, 17 bp, Homo sapiens
agcctggggctgaggct

SEQ ID NO: 1347235 - DNA, 20 bp, Homo sapiens
agcctgtaacactcctctgc

SEQ ID NO: 1347236 - DNA, 21 bp, Homo sapiens
agccttcaaaactatagcttg

SEQ ID NO: 1347237 - DNA, 17 bp, Homo sapiens
agcctttttaaaacaca

SEQ ID NO: 1347238 - DNA, 19 bp, Homo sapiens
agcctttttaaaacacatg

SEQ ID NO: 1347239 - DNA, 21 bp, Homo sapiens
agcgactccgttggccactcc

SEQ ID NO: 1347240 - DNA, 19 bp, Homo sapiens
agcgatctctccactgtgc

SEQ ID NO: 1347241 - DNA, 19 bp, Homo sapiens
agcgcctccctccacccca

SEQ ID NO: 1347242 - DNA, 22 bp, Homo sapiens
agcgcctccctccaccccagga

SEQ ID NO: 1347243 - DNA, 17 bp, Homo sapiens
agcgcggacgtgctggg

SEQ ID NO: 1347244 - DNA, 16 bp, Homo sapiens
agcgcttttccttggc

SEQ ID NO: 1347245 - DNA, 14 bp, Homo sapiens
agcggaggtgtgga

SEQ ID NO: 1347246 - DNA, 21 bp, Homo sapiens
agcggaggttgcagtgagctg

SEQ ID NO: 1347247 - DNA, 22 bp, Homo sapiens
agcggaggttgcagtgagctga

SEQ ID NO: 1347248 - DNA, 23 bp, Homo sapiens
agcggctggcagcccacccctca

SEQ ID NO: 1347249 - DNA, 15 bp, Homo sapiens
agcgtcagctgctcc

SEQ ID NO: 1347250 - DNA, 21 bp, Homo sapiens
agcgtcagctgctccctggca

SEQ ID NO: 1347251 - DNA, 15 bp, Homo sapiens
agcgtccctggcgca

SEQ ID NO: 1347252 - DNA, 21 bp, Homo sapiens
agctaattctactcacagtgc

SEQ ID NO: 1347253 - DNA, 15 bp, Homo sapiens
agctagctcaactag

SEQ ID NO: 1347254 - DNA, 17 bp, Homo sapiens
agctagttgaatacttg

SEQ ID NO: 1347255 - DNA, 23 bp, Homo sapiens
agctagttgaatacttgaaccat

SEQ ID NO: 1347256 - DNA, 17 bp, Homo sapiens
agctatataagacaaga

SEQ ID NO: 1347257 - DNA, 16 bp, Homo sapiens
agctatgacttaacat

SEQ ID NO: 1347258 - DNA, 13 bp, Homo sapiens
agctatgcaaaaa

SEQ ID NO: 1347259 - DNA, 17 bp, Homo sapiens
agctatgcaaaaagcta

SEQ ID NO: 1347260 - DNA, 13 bp, Homo sapiens
agctcaatgcagt

SEQ ID NO: 1347261 - DNA, 22 bp, Homo sapiens
agctccactctgcttctctgac

SEQ ID NO: 1347262 - DNA, 19 bp, Homo sapiens
agctcccacttctgccaga

SEQ ID NO: 1347263 - DNA, 20 bp, Homo sapiens
agctccccgcttctgcctgc

SEQ ID NO: 1347264 - DNA, 13 bp, Homo sapiens
agctcctgtggcc

SEQ ID NO: 1347265 - DNA, 19 bp, Homo sapiens
agctcctgtggccccaccc

SEQ ID NO: 1347266 - DNA, 22 bp, Homo sapiens
agctcctgtggccccaccctgg

SEQ ID NO: 1347267 - DNA, 15 bp, Homo sapiens
agctcggggagcctt

SEQ ID NO: 1347268 - DNA, 18 bp, Homo sapiens
agctctgccgtctctgga

SEQ ID NO: 1347269 - DNA, 20 bp, Homo sapiens
agctctgccgtctctggagc

SEQ ID NO: 1347270 - DNA, 16 bp, Homo sapiens
agctctggaggggagg

SEQ ID NO: 1347271 - DNA, 18 bp, Homo sapiens
agctcttcttaaagtatt

SEQ ID NO: 1347272 - DNA, 11 bp, Homo sapiens
agctcttttaa

SEQ ID NO: 1347273 - DNA, 23 bp, Homo sapiens
agctgaacaataggctgttccca

SEQ ID NO: 1347274 - DNA, 15 bp, Homo sapiens
agctgacttttctgt

SEQ ID NO: 1347275 - DNA, 19 bp, Homo sapiens
agctgagactacaagtgtg

SEQ ID NO: 1347276 - DNA, 14 bp, Homo sapiens
agctgagcctgcag

SEQ ID NO: 1347277 - DNA, 21 bp, Homo sapiens
agctgagcctgcagggaagcc

SEQ ID NO: 1347278 - DNA, 23 bp, Homo sapiens
agctgagcctgcagggaagcccc

SEQ ID NO: 1347279 - DNA, 16 bp, Homo sapiens
agctgcagagatttct

SEQ ID NO: 1347280 - DNA, 15 bp, Homo sapiens
agctgcccttccgca

SEQ ID NO: 1347281 - DNA, 22 bp, Homo sapiens
agctgctatccccatctccctg

SEQ ID NO: 1347282 - DNA, 20 bp, Homo sapiens
agctgctatttattttccta

SEQ ID NO: 1347283 - DNA, 21 bp, Homo sapiens
agctgctatttattttcctaa

SEQ ID NO: 1347284 - DNA, 17 bp, Homo sapiens
agctgctccctggcatt

SEQ ID NO: 1347285 - DNA, 14 bp, Homo sapiens
agctggctcacctt

SEQ ID NO: 1347286 - DNA, 14 bp, Homo sapiens
agctggctctgagc

SEQ ID NO: 1347287 - DNA, 20 bp, Homo sapiens
agctggctctgagcgcctcc

SEQ ID NO: 1347288 - DNA, 21 bp, Homo sapiens
agctgggcccgacatggctcc

SEQ ID NO: 1347289 - DNA, 13 bp, Homo sapiens
agctgttcagctg

SEQ ID NO: 1347290 - DNA, 15 bp, Homo sapiens
agcttacgtagttct

SEQ ID NO: 1347291 - DNA, 21 bp, Homo sapiens
agcttcagtaagttatctttg

SEQ ID NO: 1347292 - DNA, 22 bp, Homo sapiens
agcttcagtaagttatctttga

SEQ ID NO: 1347293 - DNA, 15 bp, Homo sapiens
agcttcagttgcttg

SEQ ID NO: 1347294 - DNA, 23 bp, Homo sapiens
agcttcagttgcttgtcttctgg

SEQ ID NO: 1347295 - DNA, 15 bp, Homo sapiens
agcttccattttaat

SEQ ID NO: 1347296 - DNA, 19 bp, Homo sapiens
agcttctgcttttctgccc

SEQ ID NO: 1347297 - DNA, 21 bp, Homo sapiens
agcttctgcttttctgccctg

SEQ ID NO: 1347298 - DNA, 20 bp, Homo sapiens
agcttggggccaccaaagct

SEQ ID NO: 1347299 - DNA, 21 bp, Homo sapiens
agctttactggggctggggaa

SEQ ID NO: 1347300 - DNA, 13 bp, Homo sapiens
agctttagaccct

SEQ ID NO: 1347301 - DNA, 17 bp, Homo sapiens
agctttagaccctgggt

SEQ ID NO: 1347302 - DNA, 19 bp, Homo sapiens
agctttagaccctgggtgg

SEQ ID NO: 1347303 - DNA, 21 bp, Homo sapiens
agctttattttgagatgtaaa

SEQ ID NO: 1347304 - DNA, 23 bp, Homo sapiens
agctttcctgttgaatgacaaag

SEQ ID NO: 1347305 - DNA, 18 bp, Homo sapiens
agctttgaaaattcagtg

SEQ ID NO: 1347306 - DNA, 23 bp, Homo sapiens
agctttgtttgttgtcagctgaa

SEQ ID NO: 1347307 - DNA, 13 bp, Homo sapiens
aggaaaactacct

SEQ ID NO: 1347308 - DNA, 21 bp, Homo sapiens
aggaaactccacatctgcctt

SEQ ID NO: 1347309 - DNA, 22 bp, Homo sapiens
aggaaactccacatctgcctta

SEQ ID NO: 1347310 - DNA, 12 bp, Homo sapiens
aggaaagaaaac

SEQ ID NO: 1347311 - DNA, 13 bp, Homo sapiens
aggaaagaaaaca

SEQ ID NO: 1347312 - DNA, 16 bp, Homo sapiens
aggaaagcaataaatg

SEQ ID NO: 1347313 - DNA, 18 bp, Homo sapiens
aggaaagcaataaatgaa

SEQ ID NO: 1347314 - DNA, 14 bp, Homo sapiens
aggaaatcaaagtg

SEQ ID NO: 1347315 - DNA, 18 bp, Homo sapiens
aggaactgtagatgatgt

SEQ ID NO: 1347316 - DNA, 15 bp, Homo sapiens
aggaaggtggatggc

SEQ ID NO: 1347317 - DNA, 16 bp, Homo sapiens
aggaaggtggatggcc

SEQ ID NO: 1347318 - DNA, 14 bp, Homo sapiens
aggaagtgtttatg

SEQ ID NO: 1347319 - DNA, 16 bp, Homo sapiens
aggaatattttccaaa

SEQ ID NO: 1347320 - DNA, 13 bp, Homo sapiens
aggaatcctggca

SEQ ID NO: 1347321 - DNA, 14 bp, Homo sapiens
aggaatcctggcag

SEQ ID NO: 1347322 - DNA, 18 bp, Homo sapiens
aggaatcctggcagccca

SEQ ID NO: 1347323 - DNA, 19 bp, Homo sapiens
aggaatcctggcagcccag

SEQ ID NO: 1347324 - DNA, 14 bp, Homo sapiens
aggaatggaagtcc

SEQ ID NO: 1347325 - DNA, 21 bp, Homo sapiens
aggaattaccaagaatatcct

SEQ ID NO: 1347326 - DNA, 16 bp, Homo sapiens
aggaattacgtgctct

SEQ ID NO: 1347327 - DNA, 21 bp, Homo sapiens
aggacaaagtgccaaagaaag

SEQ ID NO: 1347328 - DNA, 22 bp, Homo sapiens
aggacaaagtgccaaagaaagt

SEQ ID NO: 1347329 - DNA, 16 bp, Homo sapiens
aggacatgcaataaaa

SEQ ID NO: 1347330 - DNA, 14 bp, Homo sapiens
aggacctcaggtga

SEQ ID NO: 1347331 - DNA, 17 bp, Homo sapiens
aggaccttaagacagag

SEQ ID NO: 1347332 - DNA, 20 bp, Homo sapiens
aggacgaacatccaaccttc

SEQ ID NO: 1347333 - DNA, 12 bp, Homo sapiens
aggacgccactc

SEQ ID NO: 1347334 - DNA, 17 bp, Homo sapiens
aggactgactgaggcag

SEQ ID NO: 1347335 - DNA, 22 bp, Homo sapiens
aggactgactgaggcagtttga

SEQ ID NO: 1347336 - DNA, 20 bp, Homo sapiens
aggacttccccggagggctg

SEQ ID NO: 1347337 - DNA, 22 bp, Homo sapiens
aggagaaccaaatctggaagcc

SEQ ID NO: 1347338 - DNA, 13 bp, Homo sapiens
aggagaagctgca

SEQ ID NO: 1347339 - DNA, 14 bp, Homo sapiens
aggagaagctgcat

SEQ ID NO: 1347340 - DNA, 20 bp, Homo sapiens
aggagaatggtgtgaacccg

SEQ ID NO: 1347341 - DNA, 21 bp, Homo sapiens
aggagacctggcactggatgc

SEQ ID NO: 1347342 - DNA, 19 bp, Homo sapiens
aggagagcatcggcctagg

SEQ ID NO: 1347343 - DNA, 15 bp, Homo sapiens
aggagagctagcagc

SEQ ID NO: 1347344 - DNA, 20 bp, Homo sapiens
aggagataattactgccttg

SEQ ID NO: 1347345 - DNA, 14 bp, Homo sapiens
aggagcctcactgg

SEQ ID NO: 1347346 - DNA, 22 bp, Homo sapiens
aggagcctcactggggcagaca

SEQ ID NO: 1347347 - DNA, 19 bp, Homo sapiens
aggagcctttttaaaacac

SEQ ID NO: 1347348 - DNA, 14 bp, Homo sapiens
aggagcgagcatgt

SEQ ID NO: 1347349 - DNA, 15 bp, Homo sapiens
aggagcgagcatgtc

SEQ ID NO: 1347350 - DNA, 17 bp, Homo sapiens
aggaggaaggcaagagg

SEQ ID NO: 1347351 - DNA, 18 bp, Homo sapiens
agatcgagaccatcctgg

SEQ ID NO: 1347352 - DNA, 19 bp, Homo sapiens
agatcgtgctactgcactc

SEQ ID NO: 1347353 - DNA, 16 bp, Homo sapiens
agatctttcagaaata

SEQ ID NO: 1347354 - DNA, 18 bp, Homo sapiens
agatgcaccaccaagcca

SEQ ID NO: 1347355 - DNA, 23 bp, Homo sapiens
agatgcaccaccaagccaaggga

SEQ ID NO: 1347356 - DNA, 15 bp, Homo sapiens
agatgccaccctagc

SEQ ID NO: 1347357 - DNA, 16 bp, Homo sapiens
agatgctgtgtatatg

SEQ ID NO: 1347358 - DNA, 19 bp, Homo sapiens
agatggtatatttggtact

SEQ ID NO: 1347359 - DNA, 18 bp, Homo sapiens
agatgtgaattattgaca

SEQ ID NO: 1347360 - DNA, 23 bp, Homo sapiens
agatgtgaattattgacactgaa

SEQ ID NO: 1347361 - DNA, 16 bp, Homo sapiens
agatgtttaaaacacc

SEQ ID NO: 1347362 - DNA, 13 bp, Homo sapiens
agattataataaa

SEQ ID NO: 1347363 - DNA, 15 bp, Homo sapiens
agattggttttcctg

SEQ ID NO: 1347364 - DNA, 20 bp, Homo sapiens
agattgtgatcccttgagat

SEQ ID NO: 1347365 - DNA, 16 bp, Homo sapiens
agatttctcattgact

SEQ ID NO: 1347366 - DNA, 18 bp, Homo sapiens
agatttctcattgacttt

SEQ ID NO: 1347367 - DNA, 19 bp, Homo sapiens
agatttgccatagagtaca

SEQ ID NO: 1347368 - DNA, 21 bp, Homo sapiens
agatttttaaaaaatattttc

SEQ ID NO: 1347369 - DNA, 23 bp, Homo sapiens
agattttttaattgtttaaaaac

SEQ ID NO: 1347370 - DNA, 14 bp, Homo sapiens
agcaaaaaagagtt

SEQ ID NO: 1347371 - DNA, 16 bp, Homo sapiens
agcaaatcagaaactt

SEQ ID NO: 1347372 - DNA, 23 bp, Homo sapiens
agcaacaacaattggtaaaactc

SEQ ID NO: 1347373 - DNA, 13 bp, Homo sapiens
agcaacacagcct

SEQ ID NO: 1347374 - DNA, 19 bp, Homo sapiens
agcaacgatcacaaatgac

SEQ ID NO: 1347375 - DNA, 15 bp, Homo sapiens
agcaacttcttctcc

SEQ ID NO: 1347376 - DNA, 18 bp, Homo sapiens
agcaacttcttctccatc

SEQ ID NO: 1347377 - DNA, 18 bp, Homo sapiens
agcaagtaaaaaggctaa

SEQ ID NO: 1347378 - DNA, 19 bp, Homo sapiens
agcacaatttgcactaaat

SEQ ID NO: 1347379 - DNA, 13 bp, Homo sapiens
agcacagcagctt

SEQ ID NO: 1347380 - DNA, 17 bp, Homo sapiens
agcaccgaggggccttt

SEQ ID NO: 1347381 - DNA, 15 bp, Homo sapiens
agcaccttgtgcctg

SEQ ID NO: 1347382 - DNA, 16 bp, Homo sapiens
agcaccttgtgcctgg

SEQ ID NO: 1347383 - DNA, 16 bp, Homo sapiens
agcactcctgcttaat

SEQ ID NO: 1347384 - DNA, 11 bp, Homo sapiens
agcagacattt

SEQ ID NO: 1347385 - DNA, 13 bp, Homo sapiens
agcagaggaccag

SEQ ID NO: 1347386 - DNA, 17 bp, Homo sapiens
agcagaggaccagggcc

SEQ ID NO: 1347387 - DNA, 19 bp, Homo sapiens
agcagagttttcattaaat

SEQ ID NO: 1347388 - DNA, 12 bp, Homo sapiens
agcagcagcagg

SEQ ID NO: 1347389 - DNA, 12 bp, Homo sapiens
agcagcaggtga

SEQ ID NO: 1347390 - DNA, 15 bp, Homo sapiens
agcagcctctcccca

SEQ ID NO: 1347391 - DNA, 18 bp, Homo sapiens
agcagcctctccccaggt

SEQ ID NO: 1347392 - DNA, 21 bp, Homo sapiens
agcagcctctccccaggtcca

SEQ ID NO: 1347393 - DNA, 16 bp, Homo sapiens
agcagcctggaccctg

SEQ ID NO: 1347394 - DNA, 14 bp, Homo sapiens
agcagcttattgtt

SEQ ID NO: 1347395 - DNA, 20 bp, Homo sapiens
agcagggagggcttctgcca

SEQ ID NO: 1347396 - DNA, 20 bp, Homo sapiens
agcaggtgattggaccaggc

SEQ ID NO: 1347397 - DNA, 14 bp, Homo sapiens
agcagtcgtgcctg

SEQ ID NO: 1347398 - DNA, 21 bp, Homo sapiens
agcagtcgtgcctgtgtccat

SEQ ID NO: 1347399 - DNA, 12 bp, Homo sapiens
agcagtggcctt

SEQ ID NO: 1347400 - DNA, 18 bp, Homo sapiens
agcataatttaaaaatat

SEQ ID NO: 1347401 - DNA, 14 bp, Homo sapiens
agcatactttgtaa

SEQ ID NO: 1347402 - DNA, 16 bp, Homo sapiens
agcatagaaaccacta

SEQ ID NO: 1347403 - DNA, 15 bp, Homo sapiens
agcatagataatatt

SEQ ID NO: 1347404 - DNA, 19 bp, Homo sapiens
agcatagataatattgttt

SEQ ID NO: 1347405 - DNA, 16 bp, Homo sapiens
agcatcacttaaaaca

SEQ ID NO: 1347406 - DNA, 15 bp, Homo sapiens
agcatgaaatgtgaa

SEQ ID NO: 1347407 - DNA, 23 bp, Homo sapiens
agcatgaagtcttaaggacaaag

SEQ ID NO: 1347408 - DNA, 17 bp, Homo sapiens
agcatgcagctttgcaa

SEQ ID NO: 1347409 - DNA, 22 bp, Homo sapiens
agcatgcttgtgaaaatgtgtt

SEQ ID NO: 1347410 - DNA, 23 bp, Homo sapiens
agcatgcttgtgaaaatgtgttc

SEQ ID NO: 1347411 - DNA, 13 bp, Homo sapiens
agcatgtaatggt

SEQ ID NO: 1347412 - DNA, 15 bp, Homo sapiens
agcattttgctaaat

SEQ ID NO: 1347413 - DNA, 16 bp, Homo sapiens
agcatttttcaatata

SEQ ID NO: 1347414 - DNA, 20 bp, Homo sapiens
agcatttttcaatatattga

SEQ ID NO: 1347415 - DNA, 22 bp, Homo sapiens
agccaaaatgtaggcttagttt

SEQ ID NO: 1347416 - DNA, 17 bp, Homo sapiens
agccaaaattaaggtgt

SEQ ID NO: 1347417 - DNA, 16 bp, Homo sapiens
agccaacctaagcaag

SEQ ID NO: 1347418 - DNA, 13 bp, Homo sapiens
agccaactctggg

SEQ ID NO: 1347419 - DNA, 16 bp, Homo sapiens
agccaagggaacctgt

SEQ ID NO: 1347420 - DNA, 20 bp, Homo sapiens
agccaagggaacctgtgtcc

SEQ ID NO: 1347421 - DNA, 16 bp, Homo sapiens
agccaagtggggtgct

SEQ ID NO: 1347422 - DNA, 15 bp, Homo sapiens
agccaagttttataa

SEQ ID NO: 1347423 - DNA, 17 bp, Homo sapiens
agccactccccggcatg

SEQ ID NO: 1347424 - DNA, 17 bp, Homo sapiens
agccagcgcctccctcc

SEQ ID NO: 1347425 - DNA, 18 bp, Homo sapiens
agccagcgcctccctcca

SEQ ID NO: 1347426 - DNA, 23 bp, Homo sapiens
agccagcgcctccctccacccca

SEQ ID NO: 1347427 - DNA, 18 bp, Homo sapiens
agccatacataaaagaaa

SEQ ID NO: 1347428 - DNA, 22 bp, Homo sapiens
agccatacataaaagaaataaa

SEQ ID NO: 1347429 - DNA, 12 bp, Homo sapiens
agcccagagact

SEQ ID NO: 1347430 - DNA, 16 bp, Homo sapiens
agcccaggagcctcac

SEQ ID NO: 1347431 - DNA, 17 bp, Homo sapiens
agcccagggctcctgca

SEQ ID NO: 1347432 - DNA, 23 bp, Homo sapiens
agcccagggctcctgcacttact

SEQ ID NO: 1347433 - DNA, 18 bp, Homo sapiens
agcccagtagaccttgtt

SEQ ID NO: 1347434 - DNA, 14 bp, Homo sapiens
agcccatcctgacc

SEQ ID NO: 1347435 - DNA, 19 bp, Homo sapiens
agcccatcgccacaaactc

SEQ ID NO: 1347436 - DNA, 17 bp, Homo sapiens
agccccacatgtccagc

SEQ ID NO: 1347437 - DNA, 17 bp, Homo sapiens
agccccactgccagcag

SEQ ID NO: 1347438 - DNA, 18 bp, Homo sapiens
agccccactgccagcagc

SEQ ID NO: 1347439 - DNA, 20 bp, Homo sapiens
agccccactgccagcagcag

SEQ ID NO: 1347440 - DNA, 12 bp, Homo sapiens
agccccagcctg

SEQ ID NO: 1347441 - DNA, 17 bp, Homo sapiens
agccccagcctgctagc

SEQ ID NO: 1347442 - DNA, 14 bp, Homo sapiens
agccccctgcttca

SEQ ID NO: 1347443 - DNA, 12 bp, Homo sapiens
agccccctggtc

SEQ ID NO: 1347444 - DNA, 16 bp, Homo sapiens
agccccgactccagcc

SEQ ID NO: 1347445 - DNA, 19 bp, Homo sapiens
agccccgactccagccagc

SEQ ID NO: 1347446 - DNA, 21 bp, Homo sapiens
agccccgactccagccagcgc

SEQ ID NO: 1347447 - DNA, 21 bp, Homo sapiens
agcccctctggtcgctcctgc

SEQ ID NO: 1347448 - DNA, 13 bp, Homo sapiens
agcccctcttccc

SEQ ID NO: 1347449 - DNA, 17 bp, Homo sapiens
agcccctcttccccaat

SEQ ID NO: 1347450 - DNA, 15 bp, Homo sapiens
agccctgagctttct

SEQ ID NO: 1347451 - DNA, 22 bp, Homo sapiens
agccgagactcgactctgtgcc

SEQ ID NO: 1347452 - DNA, 17 bp, Homo sapiens
agccgggcccctgggct

SEQ ID NO: 1347453 - DNA, 21 bp, Homo sapiens
agccggtaactgtcctgtcct

SEQ ID NO: 1347454 - DNA, 13 bp, Homo sapiens
agccggttcctgt

SEQ ID NO: 1347455 - DNA, 21 bp, Homo sapiens
agccggttcctgtccctgcgc

SEQ ID NO: 1347456 - DNA, 23 bp, Homo sapiens
agccgtcctggcgcctggcagtc

SEQ ID NO: 1347457 - DNA, 12 bp, Homo sapiens
agcctaatcaca

SEQ ID NO: 1347458 - DNA, 14 bp, Homo sapiens
agcctactctcctt

SEQ ID NO: 1347459 - DNA, 17 bp, Homo sapiens
agcctagcacagcagct

SEQ ID NO: 1347460 - DNA, 13 bp, Homo sapiens
agcctcagactgg

SEQ ID NO: 1347461 - DNA, 19 bp, Homo sapiens
agcctcagccccctgcttc

SEQ ID NO: 1347462 - DNA, 12 bp, Homo sapiens
agcctccacagc

SEQ ID NO: 1347463 - DNA, 14 bp, Homo sapiens
agcctccacagcga

SEQ ID NO: 1347464 - DNA, 14 bp, Homo sapiens
agcctccgagaggg

SEQ ID NO: 1347465 - DNA, 17 bp, Homo sapiens
agcctccgagagggaga

SEQ ID NO: 1347466 - DNA, 13 bp, Homo sapiens
agcctcctctgga

SEQ ID NO: 1347467 - DNA, 13 bp, Homo sapiens
agcctctgctccc

SEQ ID NO: 1347468 - DNA, 16 bp, Homo sapiens
agcctctgctccccag

SEQ ID NO: 1347469 - DNA, 23 bp, Homo sapiens
agcctgcccagccccctggtctt

SEQ ID NO: 1347470 - DNA, 14 bp, Homo sapiens
agcctgcgcctgct

SEQ ID NO: 1347471 - DNA, 18 bp, Homo sapiens
agcctgcgcctgctgcat

SEQ ID NO: 1347472 - DNA, 14 bp, Homo sapiens
aggaggggagggta

SEQ ID NO: 1347473 - DNA, 17 bp, Homo sapiens
aggagggggccgggcgc

SEQ ID NO: 1347474 - DNA, 15 bp, Homo sapiens
aggagggtgggaagg

SEQ ID NO: 1347475 - DNA, 21 bp, Homo sapiens
aggagggtgggggagggaggt

SEQ ID NO: 1347476 - DNA, 20 bp, Homo sapiens
aggaggtggaggctgcagtg

SEQ ID NO: 1347477 - DNA, 21 bp, Homo sapiens
aggagtttgagaccaacctgg

SEQ ID NO: 1347478 - DNA, 17 bp, Homo sapiens
aggatagctaactgtaa

SEQ ID NO: 1347479 - DNA, 21 bp, Homo sapiens
aggatctcttgagcctgggag

SEQ ID NO: 1347480 - DNA, 12 bp, Homo sapiens
aggatttttaga

SEQ ID NO: 1347481 - DNA, 14 bp, Homo sapiens
aggcaataaaaatc

SEQ ID NO: 1347482 - DNA, 17 bp, Homo sapiens
aggcaataaaaatcata

SEQ ID NO: 1347483 - DNA, 11 bp, Homo sapiens
aggcaccagga

SEQ ID NO: 1347484 - DNA, 15 bp, Homo sapiens
aggcaccaggaagcc

SEQ ID NO: 1347485 - DNA, 17 bp, Homo sapiens
aggcacttcatgtaaag

SEQ ID NO: 1347486 - DNA, 16 bp, Homo sapiens
aggcagatttgaggtt

SEQ ID NO: 1347487 - DNA, 16 bp, Homo sapiens
aggcaggattgaaaat

SEQ ID NO: 1347488 - DNA, 22 bp, Homo sapiens
aggcaggattgaaaatgtccag

SEQ ID NO: 1347489 - DNA, 22 bp, Homo sapiens
aggcaggcatagaggcttctcc

SEQ ID NO: 1347490 - DNA, 19 bp, Homo sapiens
aggcaggcatggccctggg

SEQ ID NO: 1347491 - DNA, 20 bp, Homo sapiens
aggcaggcatggccctgggc

SEQ ID NO: 1347492 - DNA, 19 bp, Homo sapiens
aggcaggcctatttcatca

SEQ ID NO: 1347493 - DNA, 19 bp, Homo sapiens
aggcagggaggcagccgcc

SEQ ID NO: 1347494 - DNA, 19 bp, Homo sapiens
aggcaggggtgggggtgga

SEQ ID NO: 1347495 - DNA, 20 bp, Homo sapiens
aggcaggggtgggggtggag

SEQ ID NO: 1347496 - DNA, 20 bp, Homo sapiens
aggcaggtgatctgctgcag

SEQ ID NO: 1347497 - DNA, 13 bp, Homo sapiens
aggcatctatctg

SEQ ID NO: 1347498 - DNA, 23 bp, Homo sapiens
aggcatgtgtcaccatgcccagc

SEQ ID NO: 1347499 - DNA, 18 bp, Homo sapiens
aggccaagaatattgcaa

SEQ ID NO: 1347500 - DNA, 20 bp, Homo sapiens
aggccaagaatattgcaaaa

SEQ ID NO: 1347501 - DNA, 16 bp, Homo sapiens
aggccaaggtgggagg

SEQ ID NO: 1347502 - DNA, 14 bp, Homo sapiens
aggccacctcccca

SEQ ID NO: 1347503 - DNA, 18 bp, Homo sapiens
aggccagaggcccccagc

SEQ ID NO: 1347504 - DNA, 10 bp, Homo sapiens
aggccagcct

SEQ ID NO: 1347505 - DNA, 17 bp, Homo sapiens
aggccagcctccgagag

SEQ ID NO: 1347506 - DNA, 19 bp, Homo sapiens
aggcccccagcccagggct

SEQ ID NO: 1347507 - DNA, 21 bp, Homo sapiens
aggccctcctctcccatcctt

SEQ ID NO: 1347508 - DNA, 23 bp, Homo sapiens
aggccctcctctcccatccttga

SEQ ID NO: 1347509 - DNA, 21 bp, Homo sapiens
aggccctggcctcccctgcca

SEQ ID NO: 1347510 - DNA, 16 bp, Homo sapiens
aggccctttgctgtcc

SEQ ID NO: 1347511 - DNA, 19 bp, Homo sapiens
aggccgaggccatgtgcat

SEQ ID NO: 1347512 - DNA, 20 bp, Homo sapiens
aggccgaggccatgtgcata

SEQ ID NO: 1347513 - DNA, 16 bp, Homo sapiens
aggccgaggcgggtgg

SEQ ID NO: 1347514 - DNA, 19 bp, Homo sapiens
aggccgcgcgtccagctgc

SEQ ID NO: 1347515 - DNA, 13 bp, Homo sapiens
aggccggcagccc

SEQ ID NO: 1347516 - DNA, 15 bp, Homo sapiens
aggccggcagcccca

SEQ ID NO: 1347517 - DNA, 16 bp, Homo sapiens
aggccggcagccccag

SEQ ID NO: 1347518 - DNA, 19 bp, Homo sapiens
aggcctctccatttgctct

SEQ ID NO: 1347519 - DNA, 19 bp, Homo sapiens
aggcctcttgtaaagactg

SEQ ID NO: 1347520 - DNA, 19 bp, Homo sapiens
aggcctgcgaccctggggg

SEQ ID NO: 1347521 - DNA, 14 bp, Homo sapiens
aggcctgctccctg

SEQ ID NO: 1347522 - DNA, 19 bp, Homo sapiens
aggcctgggccgctgccac

SEQ ID NO: 1347523 - DNA, 21 bp, Homo sapiens
aggcctgggccgctgccacgt

SEQ ID NO: 1347524 - DNA, 15 bp, Homo sapiens
aggcgaccaccgccc

SEQ ID NO: 1347525 - DNA, 22 bp, Homo sapiens
aggcgaccaccgcccctggccg

SEQ ID NO: 1347526 - DNA, 19 bp, Homo sapiens
aggcgtcaacgtgcatttt

SEQ ID NO: 1347527 - DNA, 17 bp, Homo sapiens
aggctagcttctgcttt

SEQ ID NO: 1347528 - DNA, 17 bp, Homo sapiens
aggctatgtgattacaa

SEQ ID NO: 1347529 - DNA, 14 bp, Homo sapiens
aggctattttctaa

SEQ ID NO: 1347530 - DNA, 18 bp, Homo sapiens
aggctattttctaaagac

SEQ ID NO: 1347531 - DNA, 12 bp, Homo sapiens
aggctcactgcc

SEQ ID NO: 1347532 - DNA, 13 bp, Homo sapiens
aggctcactgcca

SEQ ID NO: 1347533 - DNA, 15 bp, Homo sapiens
aggctcactgccagg

SEQ ID NO: 1347534 - DNA, 19 bp, Homo sapiens
aggctcactgccaggccag

SEQ ID NO: 1347535 - DNA, 20 bp, Homo sapiens
aggctcactgccaggccagc

SEQ ID NO: 1347536 - DNA, 15 bp, Homo sapiens
aggctcccctgagga

SEQ ID NO: 1347537 - DNA, 12 bp, Homo sapiens
aggctggcaggt

SEQ ID NO: 1347538 - DNA, 19 bp, Homo sapiens
aggctggccagtccaggct

SEQ ID NO: 1347539 - DNA, 10 bp, Homo sapiens
aggctgggcc

SEQ ID NO: 1347540 - DNA, 20 bp, Homo sapiens
aggctgggccatgtccaaag

SEQ ID NO: 1347541 - DNA, 21 bp, Homo sapiens
aggctggtacaacggaggcct

SEQ ID NO: 1347542 - DNA, 20 bp, Homo sapiens
aggctggtggagaactctgg

SEQ ID NO: 1347543 - DNA, 20 bp, Homo sapiens
aggctgtgctgccctgaaga

SEQ ID NO: 1347544 - DNA, 22 bp, Homo sapiens
aggctgtgctgccctgaagaat

SEQ ID NO: 1347545 - DNA, 15 bp, Homo sapiens
aggcttagtttgtgt

SEQ ID NO: 1347546 - DNA, 14 bp, Homo sapiens
aggcttataaaaca

SEQ ID NO: 1347547 - DNA, 20 bp, Homo sapiens
aggcttcctgcgtcctcctc

SEQ ID NO: 1347548 - DNA, 22 bp, Homo sapiens
aggcttcctgcgtcctcctcac

SEQ ID NO: 1347549 - DNA, 21 bp, Homo sapiens
aggcttctccgccagcctcct

SEQ ID NO: 1347550 - DNA, 21 bp, Homo sapiens
aggcttgtttacctttctctc

SEQ ID NO: 1347551 - DNA, 18 bp, Homo sapiens
aggctttcccacttccca

SEQ ID NO: 1347552 - DNA, 22 bp, Homo sapiens
aggctttcccacttcccaccct

SEQ ID NO: 1347553 - DNA, 13 bp, Homo sapiens
agggaaagaaaat

SEQ ID NO: 1347554 - DNA, 17 bp, Homo sapiens
agggaaatgttttgtaa

SEQ ID NO: 1347555 - DNA, 21 bp, Homo sapiens
agggaacaagttgagctatga

SEQ ID NO: 1347556 - DNA, 13 bp, Homo sapiens
agggaagaaactg

SEQ ID NO: 1347557 - DNA, 14 bp, Homo sapiens
agggaagaactatt

SEQ ID NO: 1347558 - DNA, 15 bp, Homo sapiens
agggaagaactattg

SEQ ID NO: 1347559 - DNA, 15 bp, Homo sapiens
agggaatccaagcct

SEQ ID NO: 1347560 - DNA, 19 bp, Homo sapiens
agggaatccaagcctccac

SEQ ID NO: 1347561 - DNA, 17 bp, Homo sapiens
agggacacacagcctag

SEQ ID NO: 1347562 - DNA, 19 bp, Homo sapiens
agggacacacagcctagca

SEQ ID NO: 1347563 - DNA, 16 bp, Homo sapiens
agggaccctttggggg

SEQ ID NO: 1347564 - DNA, 17 bp, Homo sapiens
agggaccctttgggggt

SEQ ID NO: 1347565 - DNA, 14 bp, Homo sapiens
agggaccggcggac

SEQ ID NO: 1347566 - DNA, 20 bp, Homo sapiens
agggacggccaagaatgtac

SEQ ID NO: 1347567 - DNA, 19 bp, Homo sapiens
agggactacccatagacat

SEQ ID NO: 1347568 - DNA, 13 bp, Homo sapiens
agggagagggagg

SEQ ID NO: 1347569 - DNA, 18 bp, Homo sapiens
agggagcctttggttctg

SEQ ID NO: 1347570 - DNA, 11 bp, Homo sapiens
agggaggcccc

SEQ ID NO: 1347571 - DNA, 15 bp, Homo sapiens
agggaggccccaggg

SEQ ID NO: 1347572 - DNA, 21 bp, Homo sapiens
agggaggtcactggaaagggg

SEQ ID NO: 1347573 - DNA, 16 bp, Homo sapiens
agggatggaggaagaa

SEQ ID NO: 1347574 - DNA, 20 bp, Homo sapiens
agggattctggttccagggt

SEQ ID NO: 1347575 - DNA, 17 bp, Homo sapiens
agggcaagctccgcagg

SEQ ID NO: 1347576 - DNA, 20 bp, Homo sapiens
agggcaagctccgcaggact

SEQ ID NO: 1347577 - DNA, 19 bp, Homo sapiens
agggcaccaggggtttctc

SEQ ID NO: 1347578 - DNA, 21 bp, Homo sapiens
agggcaccaggggtttctcgc

SEQ ID NO: 1347579 - DNA, 15 bp, Homo sapiens
agggcagactggggc

SEQ ID NO: 1347580 - DNA, 20 bp, Homo sapiens
agggcagactggggcatcct

SEQ ID NO: 1347581 - DNA, 14 bp, Homo sapiens
agggcataaagtaa

SEQ ID NO: 1347582 - DNA, 19 bp, Homo sapiens
agggcataaagtaaataca

SEQ ID NO: 1347583 - DNA, 20 bp, Homo sapiens
agggccaaaatatttggaat

SEQ ID NO: 1347584 - DNA, 23 bp, Homo sapiens
agggccactggtccccaacaatg

SEQ ID NO: 1347585 - DNA, 21 bp, Homo sapiens
agggccatggctcagggtggt

SEQ ID NO: 1347586 - DNA, 22 bp, Homo sapiens
agggccgaccagaggagccttt

SEQ ID NO: 1347587 - DNA, 20 bp, Homo sapiens
agggccgactaagagaagtt

SEQ ID NO: 1347588 - DNA, 23 bp, Homo sapiens
agggcggcaggggcctggagatc

SEQ ID NO: 1347589 - DNA, 13 bp, Homo sapiens
agggctcccaggg

SEQ ID NO: 1347590 - DNA, 23 bp, Homo sapiens
agggctgcggcgtacaggctggc

SEQ ID NO: 1347591 - DNA, 19 bp, Homo sapiens
agggctggctcctgatcca

SEQ ID NO: 1347592 - DNA, 13 bp, Homo sapiens
ataaaatttgttg

SEQ ID NO: 1347593 - DNA, 16 bp, Homo sapiens
ataaaatttgttgcat

SEQ ID NO: 1347594 - DNA, 17 bp, Homo sapiens
ataaactttagagtaga

SEQ ID NO: 1347595 - DNA, 14 bp, Homo sapiens
ataaagcagtattt

SEQ ID NO: 1347596 - DNA, 16 bp, Homo sapiens
ataaagtagtcctgtg

SEQ ID NO: 1347597 - DNA, 21 bp, Homo sapiens
ataaatcattcttactaaaaa

SEQ ID NO: 1347598 - DNA, 15 bp, Homo sapiens
ataaatccagtgacc

SEQ ID NO: 1347599 - DNA, 11 bp, Homo sapiens
ataaatgaatg

SEQ ID NO: 1347600 - DNA, 17 bp, Homo sapiens
ataaatgtataaatata

SEQ ID NO: 1347601 - DNA, 20 bp, Homo sapiens
ataaatgtataaatatacag

SEQ ID NO: 1347602 - DNA, 14 bp, Homo sapiens
ataaatgtgttggg

SEQ ID NO: 1347603 - DNA, 13 bp, Homo sapiens
ataacacattttt

SEQ ID NO: 1347604 - DNA, 21 bp, Homo sapiens
ataacagctgcaattccctgg

SEQ ID NO: 1347605 - DNA, 16 bp, Homo sapiens
ataacataaatttttt

SEQ ID NO: 1347606 - DNA, 14 bp, Homo sapiens
ataacatatatgga

SEQ ID NO: 1347607 - DNA, 21 bp, Homo sapiens
ataagaaaatatattctttca

SEQ ID NO: 1347608 - DNA, 16 bp, Homo sapiens
ataagaattcagacat

SEQ ID NO: 1347609 - DNA, 13 bp, Homo sapiens
ataagaatttgca

SEQ ID NO: 1347610 - DNA, 17 bp, Homo sapiens
ataagaatttgcatact

SEQ ID NO: 1347611 - DNA, 13 bp, Homo sapiens
ataagcactgtaa

SEQ ID NO: 1347612 - DNA, 16 bp, Homo sapiens
ataagctactagcaaa

SEQ ID NO: 1347613 - DNA, 18 bp, Homo sapiens
ataagctagttgaatact

SEQ ID NO: 1347614 - DNA, 20 bp, Homo sapiens
ataagctagttgaatacttg

SEQ ID NO: 1347615 - DNA, 13 bp, Homo sapiens
ataaggatttttc

SEQ ID NO: 1347616 - DNA, 20 bp, Homo sapiens
ataagtgtgtggtagaaaca

SEQ ID NO: 1347617 - DNA, 14 bp, Homo sapiens
ataagttattgcag

SEQ ID NO: 1347618 - DNA, 20 bp, Homo sapiens
ataatactgaaccacttgta

SEQ ID NO: 1347619 - DNA, 13 bp, Homo sapiens
ataatagactgta

SEQ ID NO: 1347620 - DNA, 13 bp, Homo sapiens
ataatatattttc

SEQ ID NO: 1347621 - DNA, 14 bp, Homo sapiens
ataatattgtttgg

SEQ ID NO: 1347622 - DNA, 20 bp, Homo sapiens
ataatcaagagccttaaaac

SEQ ID NO: 1347623 - DNA, 22 bp, Homo sapiens
ataatcaagagccttaaaacat

SEQ ID NO: 1347624 - DNA, 20 bp, Homo sapiens
ataatcctgtgaaaatatga

SEQ ID NO: 1347625 - DNA, 16 bp, Homo sapiens
ataatccttaaatctt

SEQ ID NO: 1347626 - DNA, 17 bp, Homo sapiens
ataatcttataattgtt

SEQ ID NO: 1347627 - DNA, 20 bp, Homo sapiens
ataatcttgtttctgaaaag

SEQ ID NO: 1347628 - DNA, 13 bp, Homo sapiens
ataatgaataaat

SEQ ID NO: 1347629 - DNA, 17 bp, Homo sapiens
ataatgaggagtttatg

SEQ ID NO: 1347630 - DNA, 20 bp, Homo sapiens
ataatgccattttaaggaaa

SEQ ID NO: 1347631 - DNA, 17 bp, Homo sapiens
ataatgctacaatttta

SEQ ID NO: 1347632 - DNA, 19 bp, Homo sapiens
ataatgtttaatattgaga

SEQ ID NO: 1347633 - DNA, 22 bp, Homo sapiens
ataatgtttaatattgagaaag

SEQ ID NO: 1347634 - DNA, 19 bp, Homo sapiens
ataattatataactgtatt

SEQ ID NO: 1347635 - DNA, 17 bp, Homo sapiens
ataattcttttttatta

SEQ ID NO: 1347636 - DNA, 13 bp, Homo sapiens
ataattgtacaaa

SEQ ID NO: 1347637 - DNA, 15 bp, Homo sapiens
ataattgtacaaaat

SEQ ID NO: 1347638 - DNA, 13 bp, Homo sapiens
ataatttcagggt

SEQ ID NO: 1347639 - DNA, 18 bp, Homo sapiens
ataattttttttaaaata

SEQ ID NO: 1347640 - DNA, 14 bp, Homo sapiens
atacaaaaagaaaa

SEQ ID NO: 1347641 - DNA, 19 bp, Homo sapiens
atacaaatgcatctttgat

SEQ ID NO: 1347642 - DNA, 20 bp, Homo sapiens
atacaaggtataataaaatt

SEQ ID NO: 1347643 - DNA, 14 bp, Homo sapiens
atacacatttgcta

SEQ ID NO: 1347644 - DNA, 17 bp, Homo sapiens
atacagaggcaactgca

SEQ ID NO: 1347645 - DNA, 13 bp, Homo sapiens
atacagcaaagga

SEQ ID NO: 1347646 - DNA, 22 bp, Homo sapiens
atacagttttcagaaaaagaaa

SEQ ID NO: 1347647 - DNA, 16 bp, Homo sapiens
atacataaaagaaata

SEQ ID NO: 1347648 - DNA, 13 bp, Homo sapiens
atacatatatata

SEQ ID NO: 1347649 - DNA, 20 bp, Homo sapiens
atacatatatatatataaca

SEQ ID NO: 1347650 - DNA, 14 bp, Homo sapiens
atacatatggatgt

SEQ ID NO: 1347651 - DNA, 13 bp, Homo sapiens
atacatgcatata

SEQ ID NO: 1347652 - DNA, 21 bp, Homo sapiens
atacatgcatataatgaataa

SEQ ID NO: 1347653 - DNA, 21 bp, Homo sapiens
atacatgccacatcaaacctt

SEQ ID NO: 1347654 - DNA, 16 bp, Homo sapiens
atacattcaaatttgt

SEQ ID NO: 1347655 - DNA, 20 bp, Homo sapiens
atacattcaaatttgtctgg

SEQ ID NO: 1347656 - DNA, 15 bp, Homo sapiens
ataccacatcaaata

SEQ ID NO: 1347657 - DNA, 18 bp, Homo sapiens
ataccatttagtaagaat

SEQ ID NO: 1347658 - DNA, 15 bp, Homo sapiens
atacctccaaccctg

SEQ ID NO: 1347659 - DNA, 17 bp, Homo sapiens
atacctccaaccctgcc

SEQ ID NO: 1347660 - DNA, 17 bp, Homo sapiens
atacgatttaaggtatt

SEQ ID NO: 1347661 - DNA, 16 bp, Homo sapiens
atactatttaagatgt

SEQ ID NO: 1347662 - DNA, 18 bp, Homo sapiens
atactatttaagatgtga

SEQ ID NO: 1347663 - DNA, 19 bp, Homo sapiens
atactatttaagatgtgaa

SEQ ID NO: 1347664 - DNA, 22 bp, Homo sapiens
atactatttaagatgtgaaaat

SEQ ID NO: 1347665 - DNA, 18 bp, Homo sapiens
atactgaaccacttgtag

SEQ ID NO: 1347666 - DNA, 13 bp, Homo sapiens
atactgaaggaaa

SEQ ID NO: 1347667 - DNA, 15 bp, Homo sapiens
atactggaggaacac

SEQ ID NO: 1347668 - DNA, 12 bp, Homo sapiens
atacttgaacca

SEQ ID NO: 1347669 - DNA, 18 bp, Homo sapiens
atacttgaaccataaaat

SEQ ID NO: 1347670 - DNA, 20 bp, Homo sapiens
atacttgaaccataaaatgt

SEQ ID NO: 1347671 - DNA, 18 bp, Homo sapiens
atactttgtattgtccta

SEQ ID NO: 1347672 - DNA, 17 bp, Homo sapiens
atactttgtattttgat

SEQ ID NO: 1347673 - DNA, 12 bp, Homo sapiens
atagaaatggaa

SEQ ID NO: 1347674 - DNA, 21 bp, Homo sapiens
atagaaatgtaggtcctcaga

SEQ ID NO: 1347675 - DNA, 19 bp, Homo sapiens
atagacgagttgatttcct

SEQ ID NO: 1347676 - DNA, 20 bp, Homo sapiens
atagaggctagcttctgctt

SEQ ID NO: 1347677 - DNA, 18 bp, Homo sapiens
atagaggcttctccgcca

SEQ ID NO: 1347678 - DNA, 17 bp, Homo sapiens
atagagtacactgcctg

SEQ ID NO: 1347679 - DNA, 16 bp, Homo sapiens
atagagtgtagtttac

SEQ ID NO: 1347680 - DNA, 16 bp, Homo sapiens
atagataatattgttt

SEQ ID NO: 1347681 - DNA, 13 bp, Homo sapiens
atagatctccagc

SEQ ID NO: 1347682 - DNA, 16 bp, Homo sapiens
atagcaacaacaattg

SEQ ID NO: 1347683 - DNA, 18 bp, Homo sapiens
atagcaacaacaattggt

SEQ ID NO: 1347684 - DNA, 23 bp, Homo sapiens
atagcatctcaggagatttcatg

SEQ ID NO: 1347685 - DNA, 18 bp, Homo sapiens
atagcctgcctcttctct

SEQ ID NO: 1347686 - DNA, 17 bp, Homo sapiens
atagcttgcagaactgt

SEQ ID NO: 1347687 - DNA, 15 bp, Homo sapiens
ataggaacatatgaa

SEQ ID NO: 1347688 - DNA, 21 bp, Homo sapiens
ataggaacatatgaaaataca

SEQ ID NO: 1347689 - DNA, 20 bp, Homo sapiens
ataggaatcattcagaaatg

SEQ ID NO: 1347690 - DNA, 23 bp, Homo sapiens
ataggacctttccaccacagcca

SEQ ID NO: 1347691 - DNA, 19 bp, Homo sapiens
ataggatgggcttctgtgc

SEQ ID NO: 1347692 - DNA, 15 bp, Homo sapiens
ataggcaccttttac

SEQ ID NO: 1347693 - DNA, 19 bp, Homo sapiens
ataggcaccttttactgtg

SEQ ID NO: 1347694 - DNA, 17 bp, Homo sapiens
ataggctattttctaaa

SEQ ID NO: 1347695 - DNA, 18 bp, Homo sapiens
ataggctattttctaaag

SEQ ID NO: 1347696 - DNA, 21 bp, Homo sapiens
ataggctattttctaaagact

SEQ ID NO: 1347697 - DNA, 13 bp, Homo sapiens
atagtaagcatag

SEQ ID NO: 1347698 - DNA, 14 bp, Homo sapiens
atagtctctttaaa

SEQ ID NO: 1347699 - DNA, 17 bp, Homo sapiens
atagtcttttgcttttg

SEQ ID NO: 1347700 - DNA, 18 bp, Homo sapiens
atagtgtaacttgcttaa

SEQ ID NO: 1347701 - DNA, 16 bp, Homo sapiens
atagttatgtaaataa

SEQ ID NO: 1347702 - DNA, 17 bp, Homo sapiens
atagttatgtaaataat

SEQ ID NO: 1347703 - DNA, 19 bp, Homo sapiens
atagtttctttattttgtg

SEQ ID NO: 1347704 - DNA, 12 bp, Homo sapiens
atagtttggcat

SEQ ID NO: 1347705 - DNA, 23 bp, Homo sapiens
atataaaaaccccaaactgttga

SEQ ID NO: 1347706 - DNA, 12 bp, Homo sapiens
atataaaattat

SEQ ID NO: 1347707 - DNA, 20 bp, Homo sapiens
atataaatttttaagagaaa

SEQ ID NO: 1347708 - DNA, 14 bp, Homo sapiens
atataacacatttt

SEQ ID NO: 1347709 - DNA, 16 bp, Homo sapiens
atataacatatatgga

SEQ ID NO: 1347710 - DNA, 20 bp, Homo sapiens
atataactgtatttgaaata

SEQ ID NO: 1347711 - DNA, 21 bp, Homo sapiens
atatacacgaatagacatcaa

SEQ ID NO: 1347712 - DNA, 22 bp, Homo sapiens
atatacacgaatagacatcaaa

SEQ ID NO: 1347713 - DNA, 22 bp, Homo sapiens
agtccctgccacgaatttctgt

SEQ ID NO: 1347714 - DNA, 21 bp, Homo sapiens
agtcctgtgaatgccactgcc

SEQ ID NO: 1347715 - DNA, 22 bp, Homo sapiens
agtcctgtgaatgccactgcct

SEQ ID NO: 1347716 - DNA, 19 bp, Homo sapiens
agtcgcatctcagtgcagg

SEQ ID NO: 1347717 - DNA, 12 bp, Homo sapiens
agtcgtgcctgt

SEQ ID NO: 1347718 - DNA, 15 bp, Homo sapiens
agtcgtgcctgtgtc

SEQ ID NO: 1347719 - DNA, 18 bp, Homo sapiens
agtcgtggggtgtgctgg

SEQ ID NO: 1347720 - DNA, 19 bp, Homo sapiens
agtcgtggggtgtgctggg

SEQ ID NO: 1347721 - DNA, 18 bp, Homo sapiens
agtctaaggccatggcat

SEQ ID NO: 1347722 - DNA, 16 bp, Homo sapiens
agtctccggcctctcc

SEQ ID NO: 1347723 - DNA, 22 bp, Homo sapiens
agtctccggcctctccagcctc

SEQ ID NO: 1347724 - DNA, 16 bp, Homo sapiens
agtctgagtaaaatct

SEQ ID NO: 1347725 - DNA, 16 bp, Homo sapiens
agtctgtctttcctga

SEQ ID NO: 1347726 - DNA, 14 bp, Homo sapiens
agtctgtggatcag

SEQ ID NO: 1347727 - DNA, 19 bp, Homo sapiens
agtcttagatcatagtttt

SEQ ID NO: 1347728 - DNA, 21 bp, Homo sapiens
agtcttagatcatagttttat

SEQ ID NO: 1347729 - DNA, 22 bp, Homo sapiens
agtctttgccagtcattcagca

SEQ ID NO: 1347730 - DNA, 20 bp, Homo sapiens
agtcttttgcttttggcaaa

SEQ ID NO: 1347731 - DNA, 15 bp, Homo sapiens
agtgaatgctgggac

SEQ ID NO: 1347732 - DNA, 15 bp, Homo sapiens
agtgaggaaatcaaa

SEQ ID NO: 1347733 - DNA, 17 bp, Homo sapiens
agtgaggaaatcaaagt

SEQ ID NO: 1347734 - DNA, 20 bp, Homo sapiens
agtgaggaaatcaaagtgct

SEQ ID NO: 1347735 - DNA, 14 bp, Homo sapiens
agtgatcaaactac

SEQ ID NO: 1347736 - DNA, 22 bp, Homo sapiens
agtgatctacatgaggaactgt

SEQ ID NO: 1347737 - DNA, 20 bp, Homo sapiens
agtgcagaatgtaagtgggc

SEQ ID NO: 1347738 - DNA, 18 bp, Homo sapiens
agtgcagagccttctcag

SEQ ID NO: 1347739 - DNA, 13 bp, Homo sapiens
agtgccaaagaaa

SEQ ID NO: 1347740 - DNA, 20 bp, Homo sapiens
agtgcccttcctgctgcgca

SEQ ID NO: 1347741 - DNA, 19 bp, Homo sapiens
agtgccgcatctcacagct

SEQ ID NO: 1347742 - DNA, 14 bp, Homo sapiens
agtgcctattgata

SEQ ID NO: 1347743 - DNA, 21 bp, Homo sapiens
agtgcctcaagaggaatgaaa

SEQ ID NO: 1347744 - DNA, 19 bp, Homo sapiens
agtgctattacgaagttca

SEQ ID NO: 1347745 - DNA, 18 bp, Homo sapiens
agtggaaaaatagcctgc

SEQ ID NO: 1347746 - DNA, 16 bp, Homo sapiens
agtggactcagtgggt

SEQ ID NO: 1347747 - DNA, 19 bp, Homo sapiens
agtggcgtgggagccagcc

SEQ ID NO: 1347748 - DNA, 23 bp, Homo sapiens
agtggtcttaagaaatgtataaa

SEQ ID NO: 1347749 - DNA, 16 bp, Homo sapiens
agtggtgggggaaggc

SEQ ID NO: 1347750 - DNA, 14 bp, Homo sapiens
agtggttgaatatg

SEQ ID NO: 1347751 - DNA, 15 bp, Homo sapiens
agtggttgaatatga

SEQ ID NO: 1347752 - DNA, 20 bp, Homo sapiens
agtggttttatactgaagga

SEQ ID NO: 1347753 - DNA, 21 bp, Homo sapiens
agtggttttatactgaaggaa

SEQ ID NO: 1347754 - DNA, 14 bp, Homo sapiens
agtgtaaaatattt

SEQ ID NO: 1347755 - DNA, 16 bp, Homo sapiens
agtgtacagccagacc

SEQ ID NO: 1347756 - DNA, 15 bp, Homo sapiens
agtgtataatataaa

SEQ ID NO: 1347757 - DNA, 12 bp, Homo sapiens
agtgtatttatt

SEQ ID NO: 1347758 - DNA, 23 bp, Homo sapiens
agtgtcagaaggagctacaaaac

SEQ ID NO: 1347759 - DNA, 18 bp, Homo sapiens
agtgtcccccacccccac

SEQ ID NO: 1347760 - DNA, 14 bp, Homo sapiens
agtgtcccccaggt

SEQ ID NO: 1347761 - DNA, 17 bp, Homo sapiens
agtgtccttcttgctcc

SEQ ID NO: 1347762 - DNA, 19 bp, Homo sapiens
agtgtctataaaagaaaca

SEQ ID NO: 1347763 - DNA, 21 bp, Homo sapiens
agtgtgcctgaagtcccagat

SEQ ID NO: 1347764 - DNA, 16 bp, Homo sapiens
agtgttatatgaacat

SEQ ID NO: 1347765 - DNA, 15 bp, Homo sapiens
agtgtttttgtgaat

SEQ ID NO: 1347766 - DNA, 20 bp, Homo sapiens
agttaaaattgttatcaaaa

SEQ ID NO: 1347767 - DNA, 19 bp, Homo sapiens
agttaaggtgggcccggcc

SEQ ID NO: 1347768 - DNA, 15 bp, Homo sapiens
agttactgtgtaaac

SEQ ID NO: 1347769 - DNA, 15 bp, Homo sapiens
agttagtttgtatat

SEQ ID NO: 1347770 - DNA, 13 bp, Homo sapiens
agttatgtaaata

SEQ ID NO: 1347771 - DNA, 14 bp, Homo sapiens
agttatgtaaataa

SEQ ID NO: 1347772 - DNA, 17 bp, Homo sapiens
agttatgtaaataattc

SEQ ID NO: 1347773 - DNA, 18 bp, Homo sapiens
agttatgtaaataattct

SEQ ID NO: 1347774 - DNA, 18 bp, Homo sapiens
agttattgcagtttatca

SEQ ID NO: 1347775 - DNA, 12 bp, Homo sapiens
agttcaaaaaca

SEQ ID NO: 1347776 - DNA, 17 bp, Homo sapiens
agttcccttgaaacttt

SEQ ID NO: 1347777 - DNA, 19 bp, Homo sapiens
agttctaacagtgaagttt

SEQ ID NO: 1347778 - DNA, 20 bp, Homo sapiens
agttctgtatttgaaagtgc

SEQ ID NO: 1347779 - DNA, 21 bp, Homo sapiens
agttcttatgaggaggggagg

SEQ ID NO: 1347780 - DNA, 22 bp, Homo sapiens
agttctttggattctaaataca

SEQ ID NO: 1347781 - DNA, 14 bp, Homo sapiens
agttgaatacttga

SEQ ID NO: 1347782 - DNA, 17 bp, Homo sapiens
agttgaatacttgaacc

SEQ ID NO: 1347783 - DNA, 19 bp, Homo sapiens
agttgaatacttgaaccat

SEQ ID NO: 1347784 - DNA, 17 bp, Homo sapiens
agttgagctatgactta

SEQ ID NO: 1347785 - DNA, 18 bp, Homo sapiens
agttgagctatgacttaa

SEQ ID NO: 1347786 - DNA, 23 bp, Homo sapiens
agttgcattttaaccctatttta

SEQ ID NO: 1347787 - DNA, 14 bp, Homo sapiens
agttgctctatgct

SEQ ID NO: 1347788 - DNA, 16 bp, Homo sapiens
agttgctctatgcttt

SEQ ID NO: 1347789 - DNA, 17 bp, Homo sapiens
agttgctctatgctttc

SEQ ID NO: 1347790 - DNA, 21 bp, Homo sapiens
agttgctctatgctttccaaa

SEQ ID NO: 1347791 - DNA, 16 bp, Homo sapiens
agttgggtgtctcctt

SEQ ID NO: 1347792 - DNA, 19 bp, Homo sapiens
agttgtttttgtatattgg

SEQ ID NO: 1347793 - DNA, 13 bp, Homo sapiens
agtttacagaaaa

SEQ ID NO: 1347794 - DNA, 17 bp, Homo sapiens
agtttagaacaggtttt

SEQ ID NO: 1347795 - DNA, 19 bp, Homo sapiens
agtttcagtttgttggaaa

SEQ ID NO: 1347796 - DNA, 13 bp, Homo sapiens
agtttctgtggtt

SEQ ID NO: 1347797 - DNA, 17 bp, Homo sapiens
agtttctgtggttggct

SEQ ID NO: 1347798 - DNA, 23 bp, Homo sapiens
agtttctgtggttggctgggaaa

SEQ ID NO: 1347799 - DNA, 16 bp, Homo sapiens
agtttctttattttgt

SEQ ID NO: 1347800 - DNA, 15 bp, Homo sapiens
agtttgaagaccgcc

SEQ ID NO: 1347801 - DNA, 23 bp, Homo sapiens
agtttgagctgccttccctagct

SEQ ID NO: 1347802 - DNA, 18 bp, Homo sapiens
agtttgaggattagttta

SEQ ID NO: 1347803 - DNA, 14 bp, Homo sapiens
agtttgcttagaaa

SEQ ID NO: 1347804 - DNA, 15 bp, Homo sapiens
agtttggcatttgca

SEQ ID NO: 1347805 - DNA, 13 bp, Homo sapiens
agtttgtgagaaa

SEQ ID NO: 1347806 - DNA, 14 bp, Homo sapiens
agtttgtgagaaac

SEQ ID NO: 1347807 - DNA, 16 bp, Homo sapiens
agttttatatgcttta

SEQ ID NO: 1347808 - DNA, 15 bp, Homo sapiens
agttttatttatatt

SEQ ID NO: 1347809 - DNA, 18 bp, Homo sapiens
agttttatttatatttat

SEQ ID NO: 1347810 - DNA, 22 bp, Homo sapiens
agttttatttatatttattgac

SEQ ID NO: 1347811 - DNA, 15 bp, Homo sapiens
agttttcattaaatc

SEQ ID NO: 1347812 - DNA, 22 bp, Homo sapiens
agttttgtaaaagaaatcatgt

SEQ ID NO: 1347813 - DNA, 14 bp, Homo sapiens
agttttgtcattca

SEQ ID NO: 1347814 - DNA, 18 bp, Homo sapiens
agttttgttgtacttaaa

SEQ ID NO: 1347815 - DNA, 13 bp, Homo sapiens
agtttttcctgga

SEQ ID NO: 1347816 - DNA, 21 bp, Homo sapiens
agtttttggataaagaatact

SEQ ID NO: 1347817 - DNA, 17 bp, Homo sapiens
agtttttggttgggaat

SEQ ID NO: 1347818 - DNA, 12 bp, Homo sapiens
agtttttgtttg

SEQ ID NO: 1347819 - DNA, 16 bp, Homo sapiens
agtttttgtttggaga

SEQ ID NO: 1347820 - DNA, 16 bp, Homo sapiens
ataaaaaaagaaagca

SEQ ID NO: 1347821 - DNA, 21 bp, Homo sapiens
ataaaaactcaggcaaagaaa

SEQ ID NO: 1347822 - DNA, 16 bp, Homo sapiens
ataaaacagagtaatc

SEQ ID NO: 1347823 - DNA, 21 bp, Homo sapiens
ataaaacagagtaatcttgtt

SEQ ID NO: 1347824 - DNA, 11 bp, Homo sapiens
ataaaactctg

SEQ ID NO: 1347825 - DNA, 13 bp, Homo sapiens
ataaaagaaacac

SEQ ID NO: 1347826 - DNA, 17 bp, Homo sapiens
ataaaatatatcttata

SEQ ID NO: 1347827 - DNA, 16 bp, Homo sapiens
ataaaatcctgtgcaa

SEQ ID NO: 1347828 - DNA, 17 bp, Homo sapiens
ataaaatgaaaattgta

SEQ ID NO: 1347829 - DNA, 18 bp, Homo sapiens
ataaaatgaaaattgtat

SEQ ID NO: 1347830 - DNA, 19 bp, Homo sapiens
ataaaatgaaaattgtatt

SEQ ID NO: 1347831 - DNA, 16 bp, Homo sapiens
ataaaatggctgtaat

SEQ ID NO: 1347832 - DNA, 20 bp, Homo sapiens
ataaaatttaaaaaataaat

SEQ ID NO: 1347833 - DNA, 17 bp, Homo sapiens
atatacagtatagattt

SEQ ID NO: 1347834 - DNA, 18 bp, Homo sapiens
atatacattcaaacttaa

SEQ ID NO: 1347835 - DNA, 12 bp, Homo sapiens
atatataaatgt

SEQ ID NO: 1347836 - DNA, 15 bp, Homo sapiens
atatataaatgtata

SEQ ID NO: 1347837 - DNA, 17 bp, Homo sapiens
atatatacaaaaagaaa

SEQ ID NO: 1347838 - DNA, 21 bp, Homo sapiens
atatatatctatatatataat

SEQ ID NO: 1347839 - DNA, 17 bp, Homo sapiens
atatatctctatttgag

SEQ ID NO: 1347840 - DNA, 12 bp, Homo sapiens
atatatgaataa

SEQ ID NO: 1347841 - DNA, 16 bp, Homo sapiens
atatattattataatc

SEQ ID NO: 1347842 - DNA, 13 bp, Homo sapiens
atatattgaactt

SEQ ID NO: 1347843 - DNA, 18 bp, Homo sapiens
atatattgaacttttgta

SEQ ID NO: 1347844 - DNA, 12 bp, Homo sapiens
atatatttctat

SEQ ID NO: 1347845 - DNA, 20 bp, Homo sapiens
atatattttgtgtgaaattg

SEQ ID NO: 1347846 - DNA, 18 bp, Homo sapiens
atatcaaattaattgtgt

SEQ ID NO: 1347847 - DNA, 19 bp, Homo sapiens
atatcaaattaattgtgtg

SEQ ID NO: 1347848 - DNA, 20 bp, Homo sapiens
atatcatgcaaaatatgttt

SEQ ID NO: 1347849 - DNA, 16 bp, Homo sapiens
atatcccttaatgaaa

SEQ ID NO: 1347850 - DNA, 19 bp, Homo sapiens
atatctaatatatatgaat

SEQ ID NO: 1347851 - DNA, 22 bp, Homo sapiens
atatctataaaatagatataaa

SEQ ID NO: 1347852 - DNA, 23 bp, Homo sapiens
atatctataaaatagatataaat

SEQ ID NO: 1347853 - DNA, 19 bp, Homo sapiens
atatctatatatataattt

SEQ ID NO: 1347854 - DNA, 16 bp, Homo sapiens
atatctatctatttga

SEQ ID NO: 1347855 - DNA, 22 bp, Homo sapiens
atatctattaatatatgtatta

SEQ ID NO: 1347856 - DNA, 23 bp, Homo sapiens
atatctcaatgaaccataaattc

SEQ ID NO: 1347857 - DNA, 13 bp, Homo sapiens
atatctgcaaaaa

SEQ ID NO: 1347858 - DNA, 21 bp, Homo sapiens
atatgattaaaaatatcaaat

SEQ ID NO: 1347859 - DNA, 19 bp, Homo sapiens
atatggacatatcatctgt

SEQ ID NO: 1347860 - DNA, 14 bp, Homo sapiens
atatggatgttact

SEQ ID NO: 1347861 - DNA, 15 bp, Homo sapiens
atatggtatatatac

SEQ ID NO: 1347862 - DNA, 18 bp, Homo sapiens
atatggtatatatacata

SEQ ID NO: 1347863 - DNA, 19 bp, Homo sapiens
atatggtatatatacatat

SEQ ID NO: 1347864 - DNA, 14 bp, Homo sapiens
atatgtaagggaaa

SEQ ID NO: 1347865 - DNA, 13 bp, Homo sapiens
atatgtatgtgtt

SEQ ID NO: 1347866 - DNA, 17 bp, Homo sapiens
atatgtatgtgtttaga

SEQ ID NO: 1347867 - DNA, 16 bp, Homo sapiens
atatgtattatttata

SEQ ID NO: 1347868 - DNA, 20 bp, Homo sapiens
atatgtattcttttctcagt

SEQ ID NO: 1347869 - DNA, 21 bp, Homo sapiens
atatgtttaaaataaaatgaa

SEQ ID NO: 1347870 - DNA, 17 bp, Homo sapiens
atatgtttttaaaggtg

SEQ ID NO: 1347871 - DNA, 17 bp, Homo sapiens
atattaaacatccacaa

SEQ ID NO: 1347872 - DNA, 14 bp, Homo sapiens
atattacaaaaaca

SEQ ID NO: 1347873 - DNA, 22 bp, Homo sapiens
atattacaaaaacaaaataaaa

SEQ ID NO: 1347874 - DNA, 12 bp, Homo sapiens
atattacaatga

SEQ ID NO: 1347875 - DNA, 22 bp, Homo sapiens
atattacatttatttatccaga

SEQ ID NO: 1347876 - DNA, 13 bp, Homo sapiens
atattataaagga

SEQ ID NO: 1347877 - DNA, 20 bp, Homo sapiens
atattataaaggataaagaa

SEQ ID NO: 1347878 - DNA, 21 bp, Homo sapiens
atattattataatcttataat

SEQ ID NO: 1347879 - DNA, 23 bp, Homo sapiens
atattattataatcttataattg

SEQ ID NO: 1347880 - DNA, 21 bp, Homo sapiens
atattccagatctttcagaaa

SEQ ID NO: 1347881 - DNA, 23 bp, Homo sapiens
atattcctttgcatattataaag

SEQ ID NO: 1347882 - DNA, 13 bp, Homo sapiens
atattgaatgtta

SEQ ID NO: 1347883 - DNA, 16 bp, Homo sapiens
atattgcaaaatacat

SEQ ID NO: 1347884 - DNA, 19 bp, Homo sapiens
atattgcaaaatacatgaa

SEQ ID NO: 1347885 - DNA, 15 bp, Homo sapiens
atattgttgacaact

SEQ ID NO: 1347886 - DNA, 14 bp, Homo sapiens
atattgtttctgca

SEQ ID NO: 1347887 - DNA, 19 bp, Homo sapiens
atattgtttctgcattcat

SEQ ID NO: 1347888 - DNA, 21 bp, Homo sapiens
atattgtttggtaaatgtttc

SEQ ID NO: 1347889 - DNA, 19 bp, Homo sapiens
atatttaacattatttata

SEQ ID NO: 1347890 - DNA, 16 bp, Homo sapiens
atatttattgactctt

SEQ ID NO: 1347891 - DNA, 18 bp, Homo sapiens
atatttattgactcttga

SEQ ID NO: 1347892 - DNA, 15 bp, Homo sapiens
atatttcctttatgt

SEQ ID NO: 1347893 - DNA, 17 bp, Homo sapiens
atatttcctttatgtga

SEQ ID NO: 1347894 - DNA, 19 bp, Homo sapiens
atatttcctttatgtgaat

SEQ ID NO: 1347895 - DNA, 23 bp, Homo sapiens
atatttgatttattaacttaata

SEQ ID NO: 1347896 - DNA, 15 bp, Homo sapiens
atattttatggttat

SEQ ID NO: 1347897 - DNA, 12 bp, Homo sapiens
atattttctgtt

SEQ ID NO: 1347898 - DNA, 12 bp, Homo sapiens
atattttgaatc

SEQ ID NO: 1347899 - DNA, 21 bp, Homo sapiens
atattttgtcatatcaaataa

SEQ ID NO: 1347900 - DNA, 20 bp, Homo sapiens
atatttttatatttccttta

SEQ ID NO: 1347901 - DNA, 21 bp, Homo sapiens
atatttttatatttcctttat

SEQ ID NO: 1347902 - DNA, 17 bp, Homo sapiens
atcaaaaaggcttataa

SEQ ID NO: 1347903 - DNA, 16 bp, Homo sapiens
atcaaactcaatgctt

SEQ ID NO: 1347904 - DNA, 23 bp, Homo sapiens
atcaaagaggttttaaaaaaatc

SEQ ID NO: 1347905 - DNA, 19 bp, Homo sapiens
atcaaagtcattaaagaca

SEQ ID NO: 1347906 - DNA, 14 bp, Homo sapiens
atcaaataagaaat

SEQ ID NO: 1347907 - DNA, 15 bp, Homo sapiens
atcaaataagaaata

SEQ ID NO: 1347908 - DNA, 20 bp, Homo sapiens
atcaaataagtatttataat

SEQ ID NO: 1347909 - DNA, 17 bp, Homo sapiens
atcaaattaattgtgtg

SEQ ID NO: 1347910 - DNA, 22 bp, Homo sapiens
atcaacaataaaatttttttaa

SEQ ID NO: 1347911 - DNA, 16 bp, Homo sapiens
atcaataatatatttt

SEQ ID NO: 1347912 - DNA, 20 bp, Homo sapiens
atcaataatatattttctgt

SEQ ID NO: 1347913 - DNA, 17 bp, Homo sapiens
atcaatacactagttgt

SEQ ID NO: 1347914 - DNA, 18 bp, Homo sapiens
atcaatatctaatatata

SEQ ID NO: 1347915 - DNA, 23 bp, Homo sapiens
atcaatcctgattcctctctaag

SEQ ID NO: 1347916 - DNA, 16 bp, Homo sapiens
atcacaaatgacttta

SEQ ID NO: 1347917 - DNA, 13 bp, Homo sapiens
atcacagcctctg

SEQ ID NO: 1347918 - DNA, 17 bp, Homo sapiens
atcacagggtgggcctc

SEQ ID NO: 1347919 - DNA, 18 bp, Homo sapiens
atcacagtttttcctgga

SEQ ID NO: 1347920 - DNA, 12 bp, Homo sapiens
atcacctgcctg

SEQ ID NO: 1347921 - DNA, 17 bp, Homo sapiens
atcactgtgtatatttg

SEQ ID NO: 1347922 - DNA, 18 bp, Homo sapiens
atcactgtgtatatttga

SEQ ID NO: 1347923 - DNA, 19 bp, Homo sapiens
atcactgtgtatatttgat

SEQ ID NO: 1347924 - DNA, 16 bp, Homo sapiens
atcactgtttagattt

SEQ ID NO: 1347925 - DNA, 17 bp, Homo sapiens
atcactgtttagatttg

SEQ ID NO: 1347926 - DNA, 13 bp, Homo sapiens
atcacttaaaaca

SEQ ID NO: 1347927 - DNA, 15 bp, Homo sapiens
atcacttaaaacacg

SEQ ID NO: 1347928 - DNA, 20 bp, Homo sapiens
atcactttgagcctgggaaa

SEQ ID NO: 1347929 - DNA, 19 bp, Homo sapiens
atcagaaagctttattttg

SEQ ID NO: 1347930 - DNA, 22 bp, Homo sapiens
atcagagacaaaatatttccca

SEQ ID NO: 1347931 - DNA, 15 bp, Homo sapiens
atcagcatgaaaatg

SEQ ID NO: 1347932 - DNA, 20 bp, Homo sapiens
atcagcctgctccagctgtt

SEQ ID NO: 1347933 - DNA, 21 bp, Homo sapiens
atcagcctgggcaatgtgata

SEQ ID NO: 1347934 - DNA, 19 bp, Homo sapiens
atcagtaacccccttaaat

SEQ ID NO: 1347935 - DNA, 16 bp, Homo sapiens
atcatagttttattta

SEQ ID NO: 1347936 - DNA, 17 bp, Homo sapiens
atcatagttttatttat

SEQ ID NO: 1347937 - DNA, 19 bp, Homo sapiens
atcatctaattctctgtgg

SEQ ID NO: 1347938 - DNA, 16 bp, Homo sapiens
atcatgtccatacact

SEQ ID NO: 1347939 - DNA, 19 bp, Homo sapiens
atcatgttgatcatgtact

SEQ ID NO: 1347940 - DNA, 12 bp, Homo sapiens
atcattcagaaa

SEQ ID NO: 1347941 - DNA, 14 bp, Homo sapiens
atcattcagaaatg

SEQ ID NO: 1347942 - DNA, 15 bp, Homo sapiens
atcattttgaaattg

SEQ ID NO: 1347943 - DNA, 10 bp, Homo sapiens
atccaaagac

SEQ ID NO: 1347944 - DNA, 14 bp, Homo sapiens
atccaagcctccac

SEQ ID NO: 1347945 - DNA, 17 bp, Homo sapiens
atccaagcctccacagc

SEQ ID NO: 1347946 - DNA, 21 bp, Homo sapiens
atccaagcctccacagcgagg

SEQ ID NO: 1347947 - DNA, 17 bp, Homo sapiens
atccacaataaccaaga

SEQ ID NO: 1347948 - DNA, 18 bp, Homo sapiens
atccagaaaactgtgatt

SEQ ID NO: 1347949 - DNA, 16 bp, Homo sapiens
atccagactcagagct

SEQ ID NO: 1347950 - DNA, 23 bp, Homo sapiens
atccagactcagagctctctcta

SEQ ID NO: 1347951 - DNA, 23 bp, Homo sapiens
atccagatgtggctactgacata

SEQ ID NO: 1347952 - DNA, 11 bp, Homo sapiens
atccagtgacc

SEQ ID NO: 1347953 - DNA, 22 bp, Homo sapiens
atccagtgacctctctctctgg

SEQ ID NO: 1347954 - DNA, 22 bp, Homo sapiens
atcccaaccaggcacctcttcc

SEQ ID NO: 1347955 - DNA, 15 bp, Homo sapiens
atcccatttaaaaaa

SEQ ID NO: 1347956 - DNA, 18 bp, Homo sapiens
atccccatctccctgcct

SEQ ID NO: 1347957 - DNA, 15 bp, Homo sapiens
atccccccatcttgc

SEQ ID NO: 1347958 - DNA, 14 bp, Homo sapiens
atccccgcctggcc

SEQ ID NO: 1347959 - DNA, 21 bp, Homo sapiens
atccccgcctggccaggagca

SEQ ID NO: 1347960 - DNA, 16 bp, Homo sapiens
atcccgttttccccat

SEQ ID NO: 1347961 - DNA, 20 bp, Homo sapiens
atccctgtgttaatttaagt

SEQ ID NO: 1347962 - DNA, 15 bp, Homo sapiens
atccgcgtgtgcctg

SEQ ID NO: 1347963 - DNA, 20 bp, Homo sapiens
atccgctgccagccttgagc

SEQ ID NO: 1347964 - DNA, 23 bp, Homo sapiens
atcctaatttctcctcccttcct

SEQ ID NO: 1347965 - DNA, 21 bp, Homo sapiens
atcctaggcatttgctgaata

SEQ ID NO: 1347966 - DNA, 11 bp, Homo sapiens
atcctcctccc

SEQ ID NO: 1347967 - DNA, 20 bp, Homo sapiens
atcctctgtaaactttttgt

SEQ ID NO: 1347968 - DNA, 24 bp, Homo sapiens
atcctgaccagctgctccgaggac

SEQ ID NO: 1347969 - DNA, 20 bp, Homo sapiens
atcctgattcctctctaagt

SEQ ID NO: 1347970 - DNA, 16 bp, Homo sapiens
atcctgcgggtggggc

SEQ ID NO: 1347971 - DNA, 21 bp, Homo sapiens
atcctggaacaatattttatg

SEQ ID NO: 1347972 - DNA, 21 bp, Homo sapiens
atcctgggggacccaatgtag

SEQ ID NO: 1347973 - DNA, 18 bp, Homo sapiens
atcctgggggcctgggtt

SEQ ID NO: 1347974 - DNA, 16 bp, Homo sapiens
atcctgtattcttcaa

SEQ ID NO: 1347975 - DNA, 15 bp, Homo sapiens
atcctgtgcaataga

SEQ ID NO: 1347976 - DNA, 18 bp, Homo sapiens
atccttagaggtcctctg

SEQ ID NO: 1347977 - DNA, 19 bp, Homo sapiens
atccttagaggtcctctgg

SEQ ID NO: 1347978 - DNA, 21 bp, Homo sapiens
atccttagaggtcctctggag

SEQ ID NO: 1347979 - DNA, 16 bp, Homo sapiens
atccttccattccaca

SEQ ID NO: 1347980 - DNA, 22 bp, Homo sapiens
atccttgatgcaagtgcaacct

SEQ ID NO: 1347981 - DNA, 15 bp, Homo sapiens
atcgagaccatcctg

SEQ ID NO: 1347982 - DNA, 17 bp, Homo sapiens
atcgcaccattctgact

SEQ ID NO: 1347983 - DNA, 14 bp, Homo sapiens
atcgccacaaactc

SEQ ID NO: 1347984 - DNA, 14 bp, Homo sapiens
atcgtttttgtatt

SEQ ID NO: 1347985 - DNA, 16 bp, Homo sapiens
atctaaatctatttat

SEQ ID NO: 1347986 - DNA, 17 bp, Homo sapiens
atctaatatatatgaat

SEQ ID NO: 1347987 - DNA, 19 bp, Homo sapiens
atctaatatatatgaataa

SEQ ID NO: 1347988 - DNA, 13 bp, Homo sapiens
atctactgcattt

SEQ ID NO: 1347989 - DNA, 11 bp, Homo sapiens
atctataaaat

SEQ ID NO: 1347990 - DNA, 16 bp, Homo sapiens
atctatctatttgagg

SEQ ID NO: 1347991 - DNA, 13 bp, Homo sapiens
atctatctgtgct

SEQ ID NO: 1347992 - DNA, 17 bp, Homo sapiens
atctatggtcgggagac

SEQ ID NO: 1347993 - DNA, 12 bp, Homo sapiens
atctattaatat

SEQ ID NO: 1347994 - DNA, 15 bp, Homo sapiens
atctattaatatatg

SEQ ID NO: 1347995 - DNA, 19 bp, Homo sapiens
atctcaataaagtgcttta

SEQ ID NO: 1347996 - DNA, 15 bp, Homo sapiens
atctcacagctatgc

SEQ ID NO: 1347997 - DNA, 19 bp, Homo sapiens
atctccacaacctcttccc

SEQ ID NO: 1347998 - DNA, 16 bp, Homo sapiens
atctccataaacatga

SEQ ID NO: 1347999 - DNA, 15 bp, Homo sapiens
atctcccctcagctc

SEQ ID NO: 1348000 - DNA, 13 bp, Homo sapiens
atctccctgcctg

SEQ ID NO: 1348001 - DNA, 15 bp, Homo sapiens
atctccctgcctggc

SEQ ID NO: 1348002 - DNA, 17 bp, Homo sapiens
atctccctgcctggccc

SEQ ID NO: 1348003 - DNA, 19 bp, Homo sapiens
atctccggctcccagcctc

SEQ ID NO: 1348004 - DNA, 15 bp, Homo sapiens
atctcctgacagaag

SEQ ID NO: 1348005 - DNA, 12 bp, Homo sapiens
atctctcctggc

SEQ ID NO: 1348006 - DNA, 14 bp, Homo sapiens
atctctgtgccttc

SEQ ID NO: 1348007 - DNA, 18 bp, Homo sapiens
atctctgtgccttcgtct

SEQ ID NO: 1348008 - DNA, 20 bp, Homo sapiens
atctcttcattattctctgc

SEQ ID NO: 1348009 - DNA, 13 bp, Homo sapiens
atctgaaatgtta

SEQ ID NO: 1348010 - DNA, 18 bp, Homo sapiens
atctgaggatgaccagaa

SEQ ID NO: 1348011 - DNA, 23 bp, Homo sapiens
atctgatggccttaatttccttt

SEQ ID NO: 1348012 - DNA, 18 bp, Homo sapiens
atctgcaccccttctctc

SEQ ID NO: 1348013 - DNA, 17 bp, Homo sapiens
atctgccttaaaaccaa

SEQ ID NO: 1348014 - DNA, 18 bp, Homo sapiens
atctgccttaaaaccaaa

SEQ ID NO: 1348015 - DNA, 21 bp, Homo sapiens
atctgccttaaaaccaaagag

SEQ ID NO: 1348016 - DNA, 15 bp, Homo sapiens
atctgcgtgtgtgca

SEQ ID NO: 1348017 - DNA, 16 bp, Homo sapiens
atctgctgcagagcag

SEQ ID NO: 1348018 - DNA, 17 bp, Homo sapiens
atctgctgcagagcagt

SEQ ID NO: 1348019 - DNA, 21 bp, Homo sapiens
atctggaatctggagaccagg

SEQ ID NO: 1348020 - DNA, 20 bp, Homo sapiens
atctggagaccagggagcct

SEQ ID NO: 1348021 - DNA, 21 bp, Homo sapiens
atctgtagctataatgagcat

SEQ ID NO: 1348022 - DNA, 19 bp, Homo sapiens
atctgtgggcatggtcaaa

SEQ ID NO: 1348023 - DNA, 16 bp, Homo sapiens
atctgtttatttacaa

SEQ ID NO: 1348024 - DNA, 21 bp, Homo sapiens
atcttaatgaatgagtctgtt

SEQ ID NO: 1348025 - DNA, 14 bp, Homo sapiens
atcttaatgttcct

SEQ ID NO: 1348026 - DNA, 21 bp, Homo sapiens
atcttaatgttcctcaaagct

SEQ ID NO: 1348027 - DNA, 21 bp, Homo sapiens
atcttactttgtaaattctga

SEQ ID NO: 1348028 - DNA, 14 bp, Homo sapiens
atcttataattgtt

SEQ ID NO: 1348029 - DNA, 21 bp, Homo sapiens
atcttgatacattcaaatttg

SEQ ID NO: 1348030 - DNA, 14 bp, Homo sapiens
atcttgcttcccta

SEQ ID NO: 1348031 - DNA, 15 bp, Homo sapiens
atcttgcttccctaa

SEQ ID NO: 1348032 - DNA, 21 bp, Homo sapiens
atcttggcctaaacctcagtt

SEQ ID NO: 1348033 - DNA, 16 bp, Homo sapiens
atcttgtttctgaaaa

SEQ ID NO: 1348034 - DNA, 15 bp, Homo sapiens
atctttgatgtgttg

SEQ ID NO: 1348035 - DNA, 21 bp, Homo sapiens
atctttgatgtgttgttcttg

SEQ ID NO: 1348036 - DNA, 16 bp, Homo sapiens
atcttttgaagcatag

SEQ ID NO: 1348037 - DNA, 18 bp, Homo sapiens
atgaaaaattggggagga

SEQ ID NO: 1348038 - DNA, 13 bp, Homo sapiens
atgaaaatacaac

SEQ ID NO: 1348039 - DNA, 17 bp, Homo sapiens
atgaaaatacaacttaa

SEQ ID NO: 1348040 - DNA, 22 bp, Homo sapiens
atgaaaatacaacttaaataat

SEQ ID NO: 1348041 - DNA, 13 bp, Homo sapiens
atgaaactaaagc

SEQ ID NO: 1348042 - DNA, 16 bp, Homo sapiens
atgaaactaaagcaat

SEQ ID NO: 1348043 - DNA, 13 bp, Homo sapiens
atgaaagcaacaa

SEQ ID NO: 1348044 - DNA, 21 bp, Homo sapiens
atgaaagcaacaaagaaatcc

SEQ ID NO: 1348045 - DNA, 12 bp, Homo sapiens
atgaaaggagag

SEQ ID NO: 1348046 - DNA, 18 bp, Homo sapiens
atgaaatgtgaattttta

SEQ ID NO: 1348047 - DNA, 22 bp, Homo sapiens
atgaaatgtgaatttttattgt

SEQ ID NO: 1348048 - DNA, 18 bp, Homo sapiens
atgaagaatagaaacaag

SEQ ID NO: 1348049 - DNA, 21 bp, Homo sapiens
atgaagactgttaaatgaaac

SEQ ID NO: 1348050 - DNA, 18 bp, Homo sapiens
atgaatatctattaatat

SEQ ID NO: 1348051 - DNA, 20 bp, Homo sapiens
atgaatatctattaatatat

SEQ ID NO: 1348052 - DNA, 22 bp, Homo sapiens
atgaattttcaagtaattgtga

SEQ ID NO: 1348053 - DNA, 22 bp, Homo sapiens
atgactatgcgtggctggaacc

SEQ ID NO: 1348054 - DNA, 15 bp, Homo sapiens
atgactttttataaa

SEQ ID NO: 1348055 - DNA, 18 bp, Homo sapiens
atgactttttataaaatg

SEQ ID NO: 1348056 - DNA, 11 bp, Homo sapiens
atgagaaactt

SEQ ID NO: 1348057 - DNA, 20 bp, Homo sapiens
atgagaaacttaaatgttat

SEQ ID NO: 1348058 - DNA, 21 bp, Homo sapiens
atgagaaacttaaatgttatt

SEQ ID NO: 1348059 - DNA, 20 bp, Homo sapiens
atgagagcataatttaaaaa

SEQ ID NO: 1348060 - DNA, 14 bp, Homo sapiens
atgagatgtgtgga

SEQ ID NO: 1348061 - DNA, 16 bp, Homo sapiens
atgagatttttaaaaa

SEQ ID NO: 1348062 - DNA, 17 bp, Homo sapiens
atgagctctgaaatctt

SEQ ID NO: 1348063 - DNA, 19 bp, Homo sapiens
atgagctctgaaatcttcc

SEQ ID NO: 1348064 - DNA, 19 bp, Homo sapiens
atgaggaaaattcttaaaa

SEQ ID NO: 1348065 - DNA, 18 bp, Homo sapiens
atgaggaggatgctaaaa

SEQ ID NO: 1348066 - DNA, 13 bp, Homo sapiens
atgaggaggggag

SEQ ID NO: 1348067 - DNA, 12 bp, Homo sapiens
atgaggagggtg

SEQ ID NO: 1348068 - DNA, 21 bp, Homo sapiens
atgagtccttgatttcaaagt

SEQ ID NO: 1348069 - DNA, 15 bp, Homo sapiens
atgataaaacacaaa

SEQ ID NO: 1348070 - DNA, 13 bp, Homo sapiens
atgatacaatgaa

SEQ ID NO: 1348071 - DNA, 17 bp, Homo sapiens
atgatgacaaaaaatgt

SEQ ID NO: 1348072 - DNA, 14 bp, Homo sapiens
atgatgtacagatt

SEQ ID NO: 1348073 - DNA, 21 bp, Homo sapiens
atgatgtacagattctttcag

SEQ ID NO: 1348074 - DNA, 23 bp, Homo sapiens
atgcaaaaagctagtcaacagta

SEQ ID NO: 1348075 - DNA, 20 bp, Homo sapiens
atgcaaatgagctctgaaat

SEQ ID NO: 1348076 - DNA, 18 bp, Homo sapiens
atgcaaccaagtcacacg

SEQ ID NO: 1348077 - DNA, 15 bp, Homo sapiens
atgcaccaccaagcc

SEQ ID NO: 1348078 - DNA, 21 bp, Homo sapiens
atgcaccaccaagccaaggga

SEQ ID NO: 1348079 - DNA, 22 bp, Homo sapiens
atgcactttctatcctctgtaa

SEQ ID NO: 1348080 - DNA, 15 bp, Homo sapiens
atgcaggctcccctg

SEQ ID NO: 1348081 - DNA, 13 bp, Homo sapiens
atgcagtcttaga

SEQ ID NO: 1348082 - DNA, 21 bp, Homo sapiens
atgcagtcttagatcatagtt

SEQ ID NO: 1348083 - DNA, 15 bp, Homo sapiens
atgcatataatgaat

SEQ ID NO: 1348084 - DNA, 19 bp, Homo sapiens
atgcatataatgaataaat

SEQ ID NO: 1348085 - DNA, 12 bp, Homo sapiens
atgcatatttgc

SEQ ID NO: 1348086 - DNA, 23 bp, Homo sapiens
atgcatcatttcaggagttactg

SEQ ID NO: 1348087 - DNA, 15 bp, Homo sapiens
atgcatctttgatgt

SEQ ID NO: 1348088 - DNA, 14 bp, Homo sapiens
atgccactgccttc

SEQ ID NO: 1348089 - DNA, 12 bp, Homo sapiens
atgccagctggc

SEQ ID NO: 1348090 - DNA, 13 bp, Homo sapiens
atgccagctggcc

SEQ ID NO: 1348091 - DNA, 21 bp, Homo sapiens
atgccattttaaggaaaacta

SEQ ID NO: 1348092 - DNA, 12 bp, Homo sapiens
atgcccaccccc

SEQ ID NO: 1348093 - DNA, 16 bp, Homo sapiens
atgcccaccccctgcc

SEQ ID NO: 1348094 - DNA, 10 bp, Homo sapiens
atgccccctg

SEQ ID NO: 1348095 - DNA, 16 bp, Homo sapiens
atgcctcactaatttt

SEQ ID NO: 1348096 - DNA, 20 bp, Homo sapiens
atgcctcactaatttttgta

SEQ ID NO: 1348097 - DNA, 23 bp, Homo sapiens
atgcctgctttgaataaatgtgt

SEQ ID NO: 1348098 - DNA, 19 bp, Homo sapiens
atgcgtcccaagatgttga

SEQ ID NO: 1348099 - DNA, 15 bp, Homo sapiens
atgctaacaaagaca

SEQ ID NO: 1348100 - DNA, 13 bp, Homo sapiens
atgctcaaagaaa

SEQ ID NO: 1348101 - DNA, 22 bp, Homo sapiens
atgctccagcaacacagcctgg

SEQ ID NO: 1348102 - DNA, 13 bp, Homo sapiens
atgctccccacag

SEQ ID NO: 1348103 - DNA, 14 bp, Homo sapiens
atgctgaggcctgg

SEQ ID NO: 1348104 - DNA, 17 bp, Homo sapiens
atgctgaggcctgggcc

SEQ ID NO: 1348105 - DNA, 18 bp, Homo sapiens
atgctgcaggacttgaga

SEQ ID NO: 1348106 - DNA, 19 bp, Homo sapiens
atgctgcaggacttgagaa

SEQ ID NO: 1348107 - DNA, 10 bp, Homo sapiens
atgctgggac

SEQ ID NO: 1348108 - DNA, 15 bp, Homo sapiens
atgctgggactcagc

SEQ ID NO: 1348109 - DNA, 18 bp, Homo sapiens
atgctgtgctatgaattt

SEQ ID NO: 1348110 - DNA, 23 bp, Homo sapiens
atgcttacgtgatcctctcacct

SEQ ID NO: 1348111 - DNA, 21 bp, Homo sapiens
atgcttccttgcctgatgaca

SEQ ID NO: 1348112 - DNA, 16 bp, Homo sapiens
atgcttctagagtttt

SEQ ID NO: 1348113 - DNA, 20 bp, Homo sapiens
atgcttctcactgccatgcc

SEQ ID NO: 1348114 - DNA, 18 bp, Homo sapiens
atgctttattaatgtttt

SEQ ID NO: 1348115 - DNA, 17 bp, Homo sapiens
atgctttatttgtaaat

SEQ ID NO: 1348116 - DNA, 21 bp, Homo sapiens
atgctttatttgtaaatttag

SEQ ID NO: 1348117 - DNA, 20 bp, Homo sapiens
atgctttccaaaccttatct

SEQ ID NO: 1348118 - DNA, 18 bp, Homo sapiens
atggaaaagtgtccttct

SEQ ID NO: 1348119 - DNA, 17 bp, Homo sapiens
atggaattttgcaaaga

SEQ ID NO: 1348120 - DNA, 15 bp, Homo sapiens
atggaatttttttgt

SEQ ID NO: 1348121 - DNA, 16 bp, Homo sapiens
atggaatttttttgta

SEQ ID NO: 1348122 - DNA, 17 bp, Homo sapiens
atggaatttttttgtac

SEQ ID NO: 1348123 - DNA, 18 bp, Homo sapiens
atggaatttttttgtacg

SEQ ID NO: 1348124 - DNA, 17 bp, Homo sapiens
atggactatctgtctgg

SEQ ID NO: 1348125 - DNA, 23 bp, Homo sapiens
atggagccagctccctctattta

SEQ ID NO: 1348126 - DNA, 14 bp, Homo sapiens
atggatttcagaag

SEQ ID NO: 1348127 - DNA, 21 bp, Homo sapiens
atggcatccctttttcataaa

SEQ ID NO: 1348128 - DNA, 20 bp, Homo sapiens
atggccccagcacagcttga

SEQ ID NO: 1348129 - DNA, 13 bp, Homo sapiens
atggccctgggcg

SEQ ID NO: 1348130 - DNA, 13 bp, Homo sapiens
atggcctcatgtg

SEQ ID NO: 1348131 - DNA, 17 bp, Homo sapiens
atggcctcatgtggctg

SEQ ID NO: 1348132 - DNA, 20 bp, Homo sapiens
atggcctcatgtggctggaa

SEQ ID NO: 1348133 - DNA, 17 bp, Homo sapiens
atggccttaatttcctt

SEQ ID NO: 1348134 - DNA, 19 bp, Homo sapiens
atggccttaatttcctttt

SEQ ID NO: 1348135 - DNA, 15 bp, Homo sapiens
atggctgctgttgct

SEQ ID NO: 1348136 - DNA, 14 bp, Homo sapiens
atggcttgttcatc

SEQ ID NO: 1348137 - DNA, 18 bp, Homo sapiens
atgggaaaactgccaata

SEQ ID NO: 1348138 - DNA, 22 bp, Homo sapiens
atgggagggggcttgaagccaa

SEQ ID NO: 1348139 - DNA, 22 bp, Homo sapiens
atgggtttttccctgtacagta

SEQ ID NO: 1348140 - DNA, 13 bp, Homo sapiens
atggtagtttctg

SEQ ID NO: 1348141 - DNA, 23 bp, Homo sapiens
atggtagtttctgtggttggctg

SEQ ID NO: 1348142 - DNA, 17 bp, Homo sapiens
atggtatatatacatat

SEQ ID NO: 1348143 - DNA, 16 bp, Homo sapiens
atggtgcctgagaggc

SEQ ID NO: 1348144 - DNA, 17 bp, Homo sapiens
atggtgcctgagaggca

SEQ ID NO: 1348145 - DNA, 18 bp, Homo sapiens
atggtgcctgagaggcag

SEQ ID NO: 1348146 - DNA, 19 bp, Homo sapiens
atggttctggctgtttgag

SEQ ID NO: 1348147 - DNA, 22 bp, Homo sapiens
atggtttcctccatttgagaaa

SEQ ID NO: 1348148 - DNA, 15 bp, Homo sapiens
atggttttgtgccat

SEQ ID NO: 1348149 - DNA, 19 bp, Homo sapiens
atggttttgtgccatctgt

SEQ ID NO: 1348150 - DNA, 16 bp, Homo sapiens
atgtaaagtgtcagaa

SEQ ID NO: 1348151 - DNA, 16 bp, Homo sapiens
atgtaaataattcttt

SEQ ID NO: 1348152 - DNA, 22 bp, Homo sapiens
atgtaagcatactttgtaaata

SEQ ID NO: 1348153 - DNA, 16 bp, Homo sapiens
atgtaataaactttaa

SEQ ID NO: 1348154 - DNA, 12 bp, Homo sapiens
atgtaatttaaa

SEQ ID NO: 1348155 - DNA, 17 bp, Homo sapiens
atgtaatttaaatgaaa

SEQ ID NO: 1348156 - DNA, 15 bp, Homo sapiens
atgtacagattcttt

SEQ ID NO: 1348157 - DNA, 20 bp, Homo sapiens
atgtacgtccagcctgcccc

SEQ ID NO: 1348158 - DNA, 20 bp, Homo sapiens
atgtacttttattttacaca

SEQ ID NO: 1348159 - DNA, 22 bp, Homo sapiens
atgtacttttattttacacaga

SEQ ID NO: 1348160 - DNA, 15 bp, Homo sapiens
atgtactttttagta

SEQ ID NO: 1348161 - DNA, 18 bp, Homo sapiens
atgtagccccctggcctc

SEQ ID NO: 1348162 - DNA, 19 bp, Homo sapiens
atgtaggtaagactgtaga

SEQ ID NO: 1348163 - DNA, 21 bp, Homo sapiens
atgtaggtcctcagaaagtgt

SEQ ID NO: 1348164 - DNA, 21 bp, Homo sapiens
atgtataaactttagagtaga

SEQ ID NO: 1348165 - DNA, 12 bp, Homo sapiens
atgtataaatat

SEQ ID NO: 1348166 - DNA, 16 bp, Homo sapiens
atgtatattaaaaaag

SEQ ID NO: 1348167 - DNA, 12 bp, Homo sapiens
atgtatgtgttt

SEQ ID NO: 1348168 - DNA, 16 bp, Homo sapiens
atgtatgtgtttagaa

SEQ ID NO: 1348169 - DNA, 17 bp, Homo sapiens
atgtatgtgtttagaat

SEQ ID NO: 1348170 - DNA, 21 bp, Homo sapiens
atgtatgtgtttagaattgaa

SEQ ID NO: 1348171 - DNA, 19 bp, Homo sapiens
atgtatgtttggctctgct

SEQ ID NO: 1348172 - DNA, 16 bp, Homo sapiens
atgtcagcagttgctg

SEQ ID NO: 1348173 - DNA, 21 bp, Homo sapiens
atgtcagcagttgctggtaaa

SEQ ID NO: 1348174 - DNA, 16 bp, Homo sapiens
atgtcatttcagaagt

SEQ ID NO: 1348175 - DNA, 15 bp, Homo sapiens
atgtccaaagaggct

SEQ ID NO: 1348176 - DNA, 16 bp, Homo sapiens
atgtccagcaccttgt

SEQ ID NO: 1348177 - DNA, 12 bp, Homo sapiens
atgtccaggaaa

SEQ ID NO: 1348178 - DNA, 19 bp, Homo sapiens
atgtccagtaagatcactg

SEQ ID NO: 1348179 - DNA, 13 bp, Homo sapiens
atgtccatacact

SEQ ID NO: 1348180 - DNA, 21 bp, Homo sapiens
atgtccatacactttgttgca

SEQ ID NO: 1348181 - DNA, 15 bp, Homo sapiens
atgtcctaatggtga

SEQ ID NO: 1348182 - DNA, 13 bp, Homo sapiens
atgtctcctcccc

SEQ ID NO: 1348183 - DNA, 13 bp, Homo sapiens
atgtcttttaaaa

SEQ ID NO: 1348184 - DNA, 15 bp, Homo sapiens
atgtctttttattaa

SEQ ID NO: 1348185 - DNA, 18 bp, Homo sapiens
atgtgaattattgacact

SEQ ID NO: 1348186 - DNA, 12 bp, Homo sapiens
atgtgaattttt

SEQ ID NO: 1348187 - DNA, 18 bp, Homo sapiens
atgtgaatttttattgtt

SEQ ID NO: 1348188 - DNA, 14 bp, Homo sapiens
atgtgagagaaagt

SEQ ID NO: 1348189 - DNA, 20 bp, Homo sapiens
atgtgagtgacgatgatgta

SEQ ID NO: 1348190 - DNA, 16 bp, Homo sapiens
atgtgagtggttgaat

SEQ ID NO: 1348191 - DNA, 17 bp, Homo sapiens
atgtgcatagtttcttt

SEQ ID NO: 1348192 - DNA, 18 bp, Homo sapiens
atgtgcatagtttcttta

SEQ ID NO: 1348193 - DNA, 18 bp, Homo sapiens
atgtggaccttagaatac

SEQ ID NO: 1348194 - DNA, 19 bp, Homo sapiens
atgtgtatgcacagtaaaa

SEQ ID NO: 1348195 - DNA, 22 bp, Homo sapiens
atgtgtgcaacagggtatggac

SEQ ID NO: 1348196 - DNA, 14 bp, Homo sapiens
atgtgtggcctgca

SEQ ID NO: 1348197 - DNA, 11 bp, Homo sapiens
atgtgtttaga

SEQ ID NO: 1348198 - DNA, 13 bp, Homo sapiens
atgtgtttagaat

SEQ ID NO: 1348199 - DNA, 17 bp, Homo sapiens
atgtgtttagaattgaa

SEQ ID NO: 1348200 - DNA, 16 bp, Homo sapiens
atgttaaagagaatga

SEQ ID NO: 1348201 - DNA, 18 bp, Homo sapiens
atgttaaagagaatgagt

SEQ ID NO: 1348202 - DNA, 19 bp, Homo sapiens
atgttacaaaaataaacta

SEQ ID NO: 1348203 - DNA, 17 bp, Homo sapiens
atgttacaagtttatat

SEQ ID NO: 1348204 - DNA, 15 bp, Homo sapiens
atgttacctctgaat

SEQ ID NO: 1348205 - DNA, 13 bp, Homo sapiens
atgttatgtttaa

SEQ ID NO: 1348206 - DNA, 16 bp, Homo sapiens
atgttcctcaaagctt

SEQ ID NO: 1348207 - DNA, 21 bp, Homo sapiens
atgttcctcaaagcttggatt

SEQ ID NO: 1348208 - DNA, 20 bp, Homo sapiens
atgttcttttaaatgattga

SEQ ID NO: 1348209 - DNA, 23 bp, Homo sapiens
atgttgatttttactgtgtttta

SEQ ID NO: 1348210 - DNA, 19 bp, Homo sapiens
atgttgggaaacttggctc

SEQ ID NO: 1348211 - DNA, 16 bp, Homo sapiens
atgttgtttataataa

SEQ ID NO: 1348212 - DNA, 20 bp, Homo sapiens
atgttgtttataataaaaat

SEQ ID NO: 1348213 - DNA, 12 bp, Homo sapiens
atgtttaaaaca

SEQ ID NO: 1348214 - DNA, 22 bp, Homo sapiens
atgtttaaaacaccttctatag

SEQ ID NO: 1348215 - DNA, 15 bp, Homo sapiens
atgtttccagacttc

SEQ ID NO: 1348216 - DNA, 20 bp, Homo sapiens
atgtttgaatttttctcttc

SEQ ID NO: 1348217 - DNA, 16 bp, Homo sapiens
atgtttggcatgtaaa

SEQ ID NO: 1348218 - DNA, 19 bp, Homo sapiens
atgtttggctctgctttta

SEQ ID NO: 1348219 - DNA, 12 bp, Homo sapiens
atgtttggggtc

SEQ ID NO: 1348220 - DNA, 18 bp, Homo sapiens
atgtttggtgaactatat

SEQ ID NO: 1348221 - DNA, 23 bp, Homo sapiens
atgtttgtcctgaacacttttgt

SEQ ID NO: 1348222 - DNA, 15 bp, Homo sapiens
atgttttgtaaacat

SEQ ID NO: 1348223 - DNA, 17 bp, Homo sapiens
atgttttgtaaacattt

SEQ ID NO: 1348224 - DNA, 12 bp, Homo sapiens
atgtttttatac

SEQ ID NO: 1348225 - DNA, 22 bp, Homo sapiens
attaaaaaagagacatccaaat

SEQ ID NO: 1348226 - DNA, 19 bp, Homo sapiens
attaaaaaagcatacttct

SEQ ID NO: 1348227 - DNA, 17 bp, Homo sapiens
attaaaaatatcaaatt

SEQ ID NO: 1348228 - DNA, 13 bp, Homo sapiens
attaaacttcata

SEQ ID NO: 1348229 - DNA, 18 bp, Homo sapiens
attaaacttcatatgtaa

SEQ ID NO: 1348230 - DNA, 15 bp, Homo sapiens
attaaacttccttct

SEQ ID NO: 1348231 - DNA, 12 bp, Homo sapiens
attaaacttttt

SEQ ID NO: 1348232 - DNA, 13 bp, Homo sapiens
attaaagacagag

SEQ ID NO: 1348233 - DNA, 18 bp, Homo sapiens
attaaaggaagcactctg

SEQ ID NO: 1348234 - DNA, 15 bp, Homo sapiens
attaaatttttttgt

SEQ ID NO: 1348235 - DNA, 17 bp, Homo sapiens
attaaatttttttgtat

SEQ ID NO: 1348236 - DNA, 20 bp, Homo sapiens
attaaatttttttgtatgaa

SEQ ID NO: 1348237 - DNA, 22 bp, Homo sapiens
attaaatttttttgtatgaaaa

SEQ ID NO: 1348238 - DNA, 23 bp, Homo sapiens
attaaatttttttgtatgaaaac

SEQ ID NO: 1348239 - DNA, 14 bp, Homo sapiens
attaactgaaacat

SEQ ID NO: 1348240 - DNA, 14 bp, Homo sapiens
attaacttaataat

SEQ ID NO: 1348241 - DNA, 16 bp, Homo sapiens
attaacttaataatca

SEQ ID NO: 1348242 - DNA, 22 bp, Homo sapiens
attaagctgttcctgttcagta

SEQ ID NO: 1348243 - DNA, 23 bp, Homo sapiens
attaatattcagggtaaatagga

SEQ ID NO: 1348244 - DNA, 23 bp, Homo sapiens
attaatcactgtgtatatttgat

SEQ ID NO: 1348245 - DNA, 15 bp, Homo sapiens
attacaattttatct

SEQ ID NO: 1348246 - DNA, 18 bp, Homo sapiens
attacaattttatctgtt

SEQ ID NO: 1348247 - DNA, 16 bp, Homo sapiens
attactgacatttctt

SEQ ID NO: 1348248 - DNA, 18 bp, Homo sapiens
attactgtttattacttc

SEQ ID NO: 1348249 - DNA, 17 bp, Homo sapiens
attacttccatgaattt

SEQ ID NO: 1348250 - DNA, 18 bp, Homo sapiens
attacttgttgcctataa

SEQ ID NO: 1348251 - DNA, 15 bp, Homo sapiens
attagagaacatcct

SEQ ID NO: 1348252 - DNA, 15 bp, Homo sapiens
attagccaggtaatg

SEQ ID NO: 1348253 - DNA, 15 bp, Homo sapiens
attaggaagtgttta

SEQ ID NO: 1348254 - DNA, 13 bp, Homo sapiens
attaggaataaat

SEQ ID NO: 1348255 - DNA, 16 bp, Homo sapiens
attaggaataaataaa

SEQ ID NO: 1348256 - DNA, 21 bp, Homo sapiens
attaggcaaggctatgtgatt

SEQ ID NO: 1348257 - DNA, 21 bp, Homo sapiens
attagtatgtatgtgtaccta

SEQ ID NO: 1348258 - DNA, 15 bp, Homo sapiens
attagtgttatatga

SEQ ID NO: 1348259 - DNA, 17 bp, Homo sapiens
attagtgttatatgaac

SEQ ID NO: 1348260 - DNA, 21 bp, Homo sapiens
attagtgttatatgaacatac

SEQ ID NO: 1348261 - DNA, 15 bp, Homo sapiens
attagtttagaacag

SEQ ID NO: 1348262 - DNA, 18 bp, Homo sapiens
attataaaggataaagaa

SEQ ID NO: 1348263 - DNA, 15 bp, Homo sapiens
attataataaatata

SEQ ID NO: 1348264 - DNA, 13 bp, Homo sapiens
attatacaggaaa

SEQ ID NO: 1348265 - DNA, 20 bp, Homo sapiens
attatacatgtgatacattt

SEQ ID NO: 1348266 - DNA, 21 bp, Homo sapiens
attatacatgtgatacatttt

SEQ ID NO: 1348267 - DNA, 14 bp, Homo sapiens
attatagtgtagaa

SEQ ID NO: 1348268 - DNA, 16 bp, Homo sapiens
attatagtgtagaaaa

SEQ ID NO: 1348269 - DNA, 20 bp, Homo sapiens
attatcaaagggataaagaa

SEQ ID NO: 1348270 - DNA, 21 bp, Homo sapiens
attatgaaagcaacaaagaaa

SEQ ID NO: 1348271 - DNA, 22 bp, Homo sapiens
attatgaaagcaacaaagaaat

SEQ ID NO: 1348272 - DNA, 23 bp, Homo sapiens
attatgaaagcaacaaagaaatc

SEQ ID NO: 1348273 - DNA, 23 bp, Homo sapiens
attatgagattggttttcctgtg

SEQ ID NO: 1348274 - DNA, 22 bp, Homo sapiens
attatgccacttccttttaact

SEQ ID NO: 1348275 - DNA, 14 bp, Homo sapiens
attatggaaaactg

SEQ ID NO: 1348276 - DNA, 13 bp, Homo sapiens
attattaattgca

SEQ ID NO: 1348277 - DNA, 13 bp, Homo sapiens
attattgacactg

SEQ ID NO: 1348278 - DNA, 12 bp, Homo sapiens
attatttataat

SEQ ID NO: 1348279 - DNA, 22 bp, Homo sapiens
attatttatatggggaatatat

SEQ ID NO: 1348280 - DNA, 15 bp, Homo sapiens
attatttatttattt

SEQ ID NO: 1348281 - DNA, 16 bp, Homo sapiens
attatttgattattta

SEQ ID NO: 1348282 - DNA, 18 bp, Homo sapiens
attatttgattatttaag

SEQ ID NO: 1348283 - DNA, 12 bp, Homo sapiens
attatttgcatg

SEQ ID NO: 1348284 - DNA, 13 bp, Homo sapiens
attatttgcatgt

SEQ ID NO: 1348285 - DNA, 20 bp, Homo sapiens
attatttgcatgttatgttt

SEQ ID NO: 1348286 - DNA, 18 bp, Homo sapiens
attatttttataattgta

SEQ ID NO: 1348287 - DNA, 19 bp, Homo sapiens
attatttttataattgtac

SEQ ID NO: 1348288 - DNA, 18 bp, Homo sapiens
attatttttttaaaattt

SEQ ID NO: 1348289 - DNA, 13 bp, Homo sapiens
attcagaaatgtt

SEQ ID NO: 1348290 - DNA, 18 bp, Homo sapiens
attcagcagcaaattttc

SEQ ID NO: 1348291 - DNA, 18 bp, Homo sapiens
attcagctctgcaagaat

SEQ ID NO: 1348292 - DNA, 12 bp, Homo sapiens
attcagtcacat

SEQ ID NO: 1348293 - DNA, 19 bp, Homo sapiens
attcagtggcgagaaataa

SEQ ID NO: 1348294 - DNA, 22 bp, Homo sapiens
attccactacacctggctgagg

SEQ ID NO: 1348295 - DNA, 23 bp, Homo sapiens
attccggaaactagtgtacattt

SEQ ID NO: 1348296 - DNA, 17 bp, Homo sapiens
attcctaaagaaaaata

SEQ ID NO: 1348297 - DNA, 16 bp, Homo sapiens
attcctttttatttat

SEQ ID NO: 1348298 - DNA, 20 bp, Homo sapiens
attcctttttatttatatgt

SEQ ID NO: 1348299 - DNA, 22 bp, Homo sapiens
attctcccaggtaccagctgcg

SEQ ID NO: 1348300 - DNA, 11 bp, Homo sapiens
attctcctgga

SEQ ID NO: 1348301 - DNA, 20 bp, Homo sapiens
attctgatttcttttcacca

SEQ ID NO: 1348302 - DNA, 16 bp, Homo sapiens
attctggttccagggt

SEQ ID NO: 1348303 - DNA, 19 bp, Homo sapiens
attctgtttttaatgctat

SEQ ID NO: 1348304 - DNA, 17 bp, Homo sapiens
attcttcagatatactg

SEQ ID NO: 1348305 - DNA, 15 bp, Homo sapiens
attcttctcttcctt

SEQ ID NO: 1348306 - DNA, 13 bp, Homo sapiens
attcttctgtgtt

SEQ ID NO: 1348307 - DNA, 14 bp, Homo sapiens
attcttctgtgttt

SEQ ID NO: 1348308 - DNA, 15 bp, Homo sapiens
attcttctgtgttta

SEQ ID NO: 1348309 - DNA, 19 bp, Homo sapiens
attcttctgtgtttataaa

SEQ ID NO: 1348310 - DNA, 17 bp, Homo sapiens
attctttcagttctttg

SEQ ID NO: 1348311 - DNA, 17 bp, Homo sapiens
attcttttttattaatc

SEQ ID NO: 1348312 - DNA, 22 bp, Homo sapiens
attcttttttattaatcactgt

SEQ ID NO: 1348313 - DNA, 19 bp, Homo sapiens
attgaaaagtttttgtttg

SEQ ID NO: 1348314 - DNA, 20 bp, Homo sapiens
attgaaaagtttttgtttgg

SEQ ID NO: 1348315 - DNA, 14 bp, Homo sapiens
attgaacttttgta

SEQ ID NO: 1348316 - DNA, 18 bp, Homo sapiens
attgaaggtttttgatag

SEQ ID NO: 1348317 - DNA, 22 bp, Homo sapiens
attgaagtgtataatataaaaa

SEQ ID NO: 1348318 - DNA, 19 bp, Homo sapiens
attgacaaccgagaaggtt

SEQ ID NO: 1348319 - DNA, 15 bp, Homo sapiens
attgacactgaactt

SEQ ID NO: 1348320 - DNA, 16 bp, Homo sapiens
attgacactgaactta

SEQ ID NO: 1348321 - DNA, 13 bp, Homo sapiens
attgaccattttt

SEQ ID NO: 1348322 - DNA, 13 bp, Homo sapiens
attgactctgggt

SEQ ID NO: 1348323 - DNA, 14 bp, Homo sapiens
attgactctgggtc

SEQ ID NO: 1348324 - DNA, 22 bp, Homo sapiens
attgactctgggtccttcctga

SEQ ID NO: 1348325 - DNA, 23 bp, Homo sapiens
attgactctgggtccttcctgaa

SEQ ID NO: 1348326 - DNA, 15 bp, Homo sapiens
attgacttttataaa

SEQ ID NO: 1348327 - DNA, 18 bp, Homo sapiens
attgacttttataaagca

SEQ ID NO: 1348328 - DNA, 16 bp, Homo sapiens
attgagaaagaaacta

SEQ ID NO: 1348329 - DNA, 21 bp, Homo sapiens
attgagaccgtgaagatactt

SEQ ID NO: 1348330 - DNA, 23 bp, Homo sapiens
attgagaccgtgaagatactttg

SEQ ID NO: 1348331 - DNA, 15 bp, Homo sapiens
attgagtattgttta

SEQ ID NO: 1348332 - DNA, 21 bp, Homo sapiens
attgatatacacggatgactt

SEQ ID NO: 1348333 - DNA, 21 bp, Homo sapiens
attgatgtggccctggctgcc

SEQ ID NO: 1348334 - DNA, 13 bp, Homo sapiens
attgattcctttt

SEQ ID NO: 1348335 - DNA, 22 bp, Homo sapiens
attgattccttttttcaaaatc

SEQ ID NO: 1348336 - DNA, 20 bp, Homo sapiens
attgattgggaaaacatttg

SEQ ID NO: 1348337 - DNA, 14 bp, Homo sapiens
attgatttgattgg

SEQ ID NO: 1348338 - DNA, 19 bp, Homo sapiens
attgcaaaatacatgaagc

SEQ ID NO: 1348339 - DNA, 12 bp, Homo sapiens
attgcaccactg

SEQ ID NO: 1348340 - DNA, 14 bp, Homo sapiens
attgcagtttatca

SEQ ID NO: 1348341 - DNA, 14 bp, Homo sapiens
attgcatcactgta

SEQ ID NO: 1348342 - DNA, 21 bp, Homo sapiens
attgcctgtttctgatttgct

SEQ ID NO: 1348343 - DNA, 12 bp, Homo sapiens
attgctgcttga

SEQ ID NO: 1348344 - DNA, 15 bp, Homo sapiens
attgctgttgtccaa

SEQ ID NO: 1348345 - DNA, 21 bp, Homo sapiens
attgctgttgtccaactattt

SEQ ID NO: 1348346 - DNA, 14 bp, Homo sapiens
attgcttgagctca

SEQ ID NO: 1348347 - DNA, 14 bp, Homo sapiens
attggggaggaggg

SEQ ID NO: 1348348 - DNA, 18 bp, Homo sapiens
attggttttatgatgacg

SEQ ID NO: 1348349 - DNA, 22 bp, Homo sapiens
attgtaaaaaaggttttctata

SEQ ID NO: 1348350 - DNA, 19 bp, Homo sapiens
attgtaagcgtatggcttt

SEQ ID NO: 1348351 - DNA, 15 bp, Homo sapiens
attgtacaaaattaa

SEQ ID NO: 1348352 - DNA, 21 bp, Homo sapiens
attgtacaaaattaagcaaat

SEQ ID NO: 1348353 - DNA, 20 bp, Homo sapiens
attgtatattacaatgatca

SEQ ID NO: 1348354 - DNA, 13 bp, Homo sapiens
attgtatattgta

SEQ ID NO: 1348355 - DNA, 17 bp, Homo sapiens
attgtatattgtaattt

SEQ ID NO: 1348356 - DNA, 13 bp, Homo sapiens
attgtcacttttt

SEQ ID NO: 1348357 - DNA, 14 bp, Homo sapiens
attgtccagtttgt

SEQ ID NO: 1348358 - DNA, 23 bp, Homo sapiens
attgtcctattagtgttatatga

SEQ ID NO: 1348359 - DNA, 18 bp, Homo sapiens
attgtctcctatatattt

SEQ ID NO: 1348360 - DNA, 18 bp, Homo sapiens
attgtctttggtgctttt

SEQ ID NO: 1348361 - DNA, 17 bp, Homo sapiens
attgtggctatcctgat

SEQ ID NO: 1348362 - DNA, 18 bp, Homo sapiens
attgtggctatcctgatt

SEQ ID NO: 1348363 - DNA, 14 bp, Homo sapiens
attgtgtgaacttg

SEQ ID NO: 1348364 - DNA, 19 bp, Homo sapiens
attgttaatacaaggtata

SEQ ID NO: 1348365 - DNA, 12 bp, Homo sapiens
attgttatcaaa

SEQ ID NO: 1348366 - DNA, 14 bp, Homo sapiens
attgtttaaaaacc

SEQ ID NO: 1348367 - DNA, 22 bp, Homo sapiens
attgtttaaaaaccgaataaat

SEQ ID NO: 1348368 - DNA, 17 bp, Homo sapiens
attgtttggtaaatgtt

SEQ ID NO: 1348369 - DNA, 18 bp, Homo sapiens
attgtttggtaaatgttt

SEQ ID NO: 1348370 - DNA, 13 bp, Homo sapiens
attgttttacaat

SEQ ID NO: 1348371 - DNA, 18 bp, Homo sapiens
attgttttacaatagttc

SEQ ID NO: 1348372 - DNA, 17 bp, Homo sapiens
atttaaaaatagaaaca

SEQ ID NO: 1348373 - DNA, 23 bp, Homo sapiens
atttaaaaggatggcaagttgca

SEQ ID NO: 1348374 - DNA, 18 bp, Homo sapiens
atttaaagaaaaaaatgt

SEQ ID NO: 1348375 - DNA, 20 bp, Homo sapiens
atttaaatcctgaagagcat

SEQ ID NO: 1348376 - DNA, 17 bp, Homo sapiens
atttaaatgaaagaaaa

SEQ ID NO: 1348377 - DNA, 20 bp, Homo sapiens
atttaacagaaattgtatat

SEQ ID NO: 1348378 - DNA, 22 bp, Homo sapiens
atttaacagaaattgtatattg

SEQ ID NO: 1348379 - DNA, 15 bp, Homo sapiens
atttaacattattta

SEQ ID NO: 1348380 - DNA, 16 bp, Homo sapiens
atttaacattatttat

SEQ ID NO: 1348381 - DNA, 17 bp, Homo sapiens
atttaacattatttata

SEQ ID NO: 1348382 - DNA, 14 bp, Homo sapiens
atttaagatgtgaa

SEQ ID NO: 1348383 - DNA, 12 bp, Homo sapiens
atttaagttttg

SEQ ID NO: 1348384 - DNA, 19 bp, Homo sapiens
atttacagatgaatgtatt

SEQ ID NO: 1348385 - DNA, 15 bp, Homo sapiens
atttactacttttgc

SEQ ID NO: 1348386 - DNA, 19 bp, Homo sapiens
atttagaccccatacaagt

SEQ ID NO: 1348387 - DNA, 16 bp, Homo sapiens
atttagccgggcgcgg

SEQ ID NO: 1348388 - DNA, 18 bp, Homo sapiens
atttagggagtattctaa

SEQ ID NO: 1348389 - DNA, 19 bp, Homo sapiens
atttagggagtattctaat

SEQ ID NO: 1348390 - DNA, 15 bp, Homo sapiens
atttagtaagaatac

SEQ ID NO: 1348391 - DNA, 16 bp, Homo sapiens
atttagttgtaaacca

SEQ ID NO: 1348392 - DNA, 20 bp, Homo sapiens
atttatatggggaatatatt

SEQ ID NO: 1348393 - DNA, 13 bp, Homo sapiens
atttatatgtact

SEQ ID NO: 1348394 - DNA, 16 bp, Homo sapiens
atttatatgtatgtgt

SEQ ID NO: 1348395 - DNA, 17 bp, Homo sapiens
atttatatgtatgtgtt

SEQ ID NO: 1348396 - DNA, 15 bp, Homo sapiens
atttatatttattga

SEQ ID NO: 1348397 - DNA, 20 bp, Homo sapiens
atttatctgggattatggtt

SEQ ID NO: 1348398 - DNA, 15 bp, Homo sapiens
atttatgtgtatatg

SEQ ID NO: 1348399 - DNA, 14 bp, Homo sapiens
atttattaacttaa

SEQ ID NO: 1348400 - DNA, 16 bp, Homo sapiens
atttattaacttaata

SEQ ID NO: 1348401 - DNA, 21 bp, Homo sapiens
atttattaacttaataatcaa

SEQ ID NO: 1348402 - DNA, 15 bp, Homo sapiens
atttattaatattta

SEQ ID NO: 1348403 - DNA, 14 bp, Homo sapiens
atttattgactctt

SEQ ID NO: 1348404 - DNA, 16 bp, Homo sapiens
atttattgactcttga

SEQ ID NO: 1348405 - DNA, 19 bp, Homo sapiens
atttattgactcttgagtt

SEQ ID NO: 1348406 - DNA, 20 bp, Homo sapiens
atttattgactcttgagttg

SEQ ID NO: 1348407 - DNA, 14 bp, Homo sapiens
atttattgagtttt

SEQ ID NO: 1348408 - DNA, 15 bp, Homo sapiens
atttatttatccaga

SEQ ID NO: 1348409 - DNA, 15 bp, Homo sapiens
atttatttatgtact

SEQ ID NO: 1348410 - DNA, 18 bp, Homo sapiens
atttatttatgtactttt

SEQ ID NO: 1348411 - DNA, 14 bp, Homo sapiens
atttatttatgtgt

SEQ ID NO: 1348412 - DNA, 21 bp, Homo sapiens
atttatttccactaaaaatat

SEQ ID NO: 1348413 - DNA, 22 bp, Homo sapiens
atttatttccactaaaaatatt

SEQ ID NO: 1348414 - DNA, 16 bp, Homo sapiens
atttattttcctaaag

SEQ ID NO: 1348415 - DNA, 17 bp, Homo sapiens
atttattttcctaaaga

SEQ ID NO: 1348416 - DNA, 17 bp, Homo sapiens
atttattttttttaaag

SEQ ID NO: 1348417 - DNA, 18 bp, Homo sapiens
atttattttttttaaaga

SEQ ID NO: 1348418 - DNA, 19 bp, Homo sapiens
atttattttttttaaagaa

SEQ ID NO: 1348419 - DNA, 21 bp, Homo sapiens
atttattttttttaattgtat

SEQ ID NO: 1348420 - DNA, 18 bp, Homo sapiens
atttcactactagattga

SEQ ID NO: 1348421 - DNA, 19 bp, Homo sapiens
atttcacttgatgatacaa

SEQ ID NO: 1348422 - DNA, 21 bp, Homo sapiens
atttcagaagttagtttgtat

SEQ ID NO: 1348423 - DNA, 12 bp, Homo sapiens
atttcagggtgc

SEQ ID NO: 1348424 - DNA, 15 bp, Homo sapiens
atttcatcacaagaa

SEQ ID NO: 1348425 - DNA, 15 bp, Homo sapiens
atttcatctcattta

SEQ ID NO: 1348426 - DNA, 21 bp, Homo sapiens
atttcatctcatttaagggaa

SEQ ID NO: 1348427 - DNA, 22 bp, Homo sapiens
atttcatctcatttaagggaaa

SEQ ID NO: 1348428 - DNA, 23 bp, Homo sapiens
atttcatctcatttaagggaaaa

SEQ ID NO: 1348429 - DNA, 20 bp, Homo sapiens
atttcatgtaaaacagaaaa

SEQ ID NO: 1348430 - DNA, 21 bp, Homo sapiens
atttccactaaaaatattgtt

SEQ ID NO: 1348431 - DNA, 21 bp, Homo sapiens
atttcccatttgtgccagagg

SEQ ID NO: 1348432 - DNA, 17 bp, Homo sapiens
atttcctcgcagcctct

SEQ ID NO: 1348433 - DNA, 13 bp, Homo sapiens
atttcctttatgt

SEQ ID NO: 1348434 - DNA, 14 bp, Homo sapiens
atttcctttatgtg

SEQ ID NO: 1348435 - DNA, 16 bp, Homo sapiens
atttcctttatgtgaa

SEQ ID NO: 1348436 - DNA, 18 bp, Homo sapiens
atttcctttatgtgaatt

SEQ ID NO: 1348437 - DNA, 20 bp, Homo sapiens
atttcctttatgtgaatttt

SEQ ID NO: 1348438 - DNA, 15 bp, Homo sapiens
atttcctttttgaca

SEQ ID NO: 1348439 - DNA, 15 bp, Homo sapiens
atttctactgtcaaa

SEQ ID NO: 1348440 - DNA, 16 bp, Homo sapiens
atttctactgtcaaat

SEQ ID NO: 1348441 - DNA, 21 bp, Homo sapiens
atttctataaatagatgctgt

SEQ ID NO: 1348442 - DNA, 17 bp, Homo sapiens
atttctcctcccttcct

SEQ ID NO: 1348443 - DNA, 15 bp, Homo sapiens
atttctgtgttgcca

SEQ ID NO: 1348444 - DNA, 14 bp, Homo sapiens
atttcttatgtgac

SEQ ID NO: 1348445 - DNA, 18 bp, Homo sapiens
atttctttaaaagaatga

SEQ ID NO: 1348446 - DNA, 14 bp, Homo sapiens
atttgaaaaatata

SEQ ID NO: 1348447 - DNA, 14 bp, Homo sapiens
atttgaaagtgcct

SEQ ID NO: 1348448 - DNA, 16 bp, Homo sapiens
atttgaaataagaatt

SEQ ID NO: 1348449 - DNA, 18 bp, Homo sapiens
atttgaacaatgaagttg

SEQ ID NO: 1348450 - DNA, 12 bp, Homo sapiens
atttgactaatt

SEQ ID NO: 1348451 - DNA, 19 bp, Homo sapiens
atttgattatttaagacta

SEQ ID NO: 1348452 - DNA, 18 bp, Homo sapiens
atttgcaataacagctgc

SEQ ID NO: 1348453 - DNA, 22 bp, Homo sapiens
atttgcatgttatgtttaataa

SEQ ID NO: 1348454 - DNA, 13 bp, Homo sapiens
atttgccatagag

SEQ ID NO: 1348455 - DNA, 13 bp, Homo sapiens
atttgctgccatt

SEQ ID NO: 1348456 - DNA, 11 bp, Homo sapiens
atttgcttttt

SEQ ID NO: 1348457 - DNA, 17 bp, Homo sapiens
atttgtaaagctattta

SEQ ID NO: 1348458 - DNA, 14 bp, Homo sapiens
atttgtaaatttag

SEQ ID NO: 1348459 - DNA, 17 bp, Homo sapiens
atttgtaaatttagtgt

SEQ ID NO: 1348460 - DNA, 14 bp, Homo sapiens
atttgtctttttgt

SEQ ID NO: 1348461 - DNA, 21 bp, Homo sapiens
atttgtctttttgttgtaaaa

SEQ ID NO: 1348462 - DNA, 23 bp, Homo sapiens
atttgtctttttgttgtaaaaca

SEQ ID NO: 1348463 - DNA, 20 bp, Homo sapiens
atttgtgctagaaattttca

SEQ ID NO: 1348464 - DNA, 21 bp, Homo sapiens
atttgttaaaattatcaatat

SEQ ID NO: 1348465 - DNA, 16 bp, Homo sapiens
attttaaaaaatggtc

SEQ ID NO: 1348466 - DNA, 17 bp, Homo sapiens
attttaaaaaatggtca

SEQ ID NO: 1348467 - DNA, 17 bp, Homo sapiens
attttaacctgcataaa

SEQ ID NO: 1348468 - DNA, 20 bp, Homo sapiens
attttaacttaactgaaatg

SEQ ID NO: 1348469 - DNA, 20 bp, Homo sapiens
attttaatagggaatatatc

SEQ ID NO: 1348470 - DNA, 14 bp, Homo sapiens
attttacacagaaa

SEQ ID NO: 1348471 - DNA, 20 bp, Homo sapiens
attttacacagaaacactgc

SEQ ID NO: 1348472 - DNA, 23 bp, Homo sapiens
attttatggttatgtttttctgt

SEQ ID NO: 1348473 - DNA, 18 bp, Homo sapiens
attttattactgtttatt

SEQ ID NO: 1348474 - DNA, 19 bp, Homo sapiens
attttatttagacaagaga

SEQ ID NO: 1348475 - DNA, 15 bp, Homo sapiens
attttcacattcttg

SEQ ID NO: 1348476 - DNA, 19 bp, Homo sapiens
attttcacattcttggctt

SEQ ID NO: 1348477 - DNA, 14 bp, Homo sapiens
attttcatgaaaat

SEQ ID NO: 1348478 - DNA, 12 bp, Homo sapiens
attttcctctga

SEQ ID NO: 1348479 - DNA, 23 bp, Homo sapiens
attttctattttaagactgattt

SEQ ID NO: 1348480 - DNA, 14 bp, Homo sapiens
attttgaaaagtaa

SEQ ID NO: 1348481 - DNA, 16 bp, Homo sapiens
attttgaaaagtaata

SEQ ID NO: 1348482 - DNA, 13 bp, Homo sapiens
attttgaatcaat

SEQ ID NO: 1348483 - DNA, 17 bp, Homo sapiens
attttgaatcaataata

SEQ ID NO: 1348484 - DNA, 19 bp, Homo sapiens
attttgagatgtaaaaaga

SEQ ID NO: 1348485 - DNA, 18 bp, Homo sapiens
attttgagtaaagctcct

SEQ ID NO: 1348486 - DNA, 13 bp, Homo sapiens
attttgcaaagat

SEQ ID NO: 1348487 - DNA, 18 bp, Homo sapiens
attttggagattataata

SEQ ID NO: 1348488 - DNA, 21 bp, Homo sapiens
attttggagattataataaat

SEQ ID NO: 1348489 - DNA, 16 bp, Homo sapiens
attttgtaagaaggca

SEQ ID NO: 1348490 - DNA, 21 bp, Homo sapiens
attttgtaagaaggcaatatt

SEQ ID NO: 1348491 - DNA, 12 bp, Homo sapiens
attttgtgtaaa

SEQ ID NO: 1348492 - DNA, 14 bp, Homo sapiens
attttgtgtaaaaa

SEQ ID NO: 1348493 - DNA, 17 bp, Homo sapiens
attttgtttaaaaaatc

SEQ ID NO: 1348494 - DNA, 14 bp, Homo sapiens
atttttaaaaaata

SEQ ID NO: 1348495 - DNA, 12 bp, Homo sapiens
atttttaagctg

SEQ ID NO: 1348496 - DNA, 19 bp, Homo sapiens
atttttagaataagaattt

SEQ ID NO: 1348497 - DNA, 21 bp, Homo sapiens
atttttagaataagaatttgc

SEQ ID NO: 1348498 - DNA, 21 bp, Homo sapiens
atttttatagcaacaacaatt

SEQ ID NO: 1348499 - DNA, 20 bp, Homo sapiens
atttttcaatatattgaact

SEQ ID NO: 1348500 - DNA, 22 bp, Homo sapiens
atttttcactctaagtcatgta

SEQ ID NO: 1348501 - DNA, 17 bp, Homo sapiens
atttttgtaaagtttcc

SEQ ID NO: 1348502 - DNA, 19 bp, Homo sapiens
attttttgaaaagcagaca

SEQ ID NO: 1348503 - DNA, 15 bp, Homo sapiens
atttttttaaaattt

SEQ ID NO: 1348504 - DNA, 17 bp, Homo sapiens
atttttttaaaattttg

SEQ ID NO: 1348505 - DNA, 14 bp, Homo sapiens
atttttttgtaata

SEQ ID NO: 1348506 - DNA, 19 bp, Homo sapiens
atttttttgtaataagcaa

SEQ ID NO: 1348507 - DNA, 14 bp, Homo sapiens
atttttttgtatga

SEQ ID NO: 1348508 - DNA, 18 bp, Homo sapiens
attttttttaattgtatt

SEQ ID NO: 1348509 - DNA, 14 bp, Homo sapiens
attttttttagtat

SEQ ID NO: 1348510 - DNA, 14 bp, Homo sapiens
atttttttttctaa

SEQ ID NO: 1348511 - DNA, 15 bp, Homo sapiens
caaaaaccaaatgtt

SEQ ID NO: 1348512 - DNA, 14 bp, Homo sapiens
caaaaagcttcccc

SEQ ID NO: 1348513 - DNA, 20 bp, Homo sapiens
caaaaattagccgggcgtgg

SEQ ID NO: 1348514 - DNA, 15 bp, Homo sapiens
caaaaccttttactg

SEQ ID NO: 1348515 - DNA, 15 bp, Homo sapiens
caaaacggttttact

SEQ ID NO: 1348516 - DNA, 21 bp, Homo sapiens
caaaacggttttactgcagct

SEQ ID NO: 1348517 - DNA, 11 bp, Homo sapiens
caaaactctac

SEQ ID NO: 1348518 - DNA, 22 bp, Homo sapiens
caaaagcgcttttccttggcat

SEQ ID NO: 1348519 - DNA, 16 bp, Homo sapiens
caaaaggcctcttgta

SEQ ID NO: 1348520 - DNA, 14 bp, Homo sapiens
caaaagtagaactt

SEQ ID NO: 1348521 - DNA, 18 bp, Homo sapiens
caaaagtagaactttgta

SEQ ID NO: 1348522 - DNA, 19 bp, Homo sapiens
caaaagtctgtctttcctg

SEQ ID NO: 1348523 - DNA, 12 bp, Homo sapiens
caaaataaaaca

SEQ ID NO: 1348524 - DNA, 17 bp, Homo sapiens
caaaataaaacatagca

SEQ ID NO: 1348525 - DNA, 18 bp, Homo sapiens
caaaataaaacatagcaa

SEQ ID NO: 1348526 - DNA, 19 bp, Homo sapiens
caaaataaaacatagcaaa

SEQ ID NO: 1348527 - DNA, 14 bp, Homo sapiens
caaaatacatgaag

SEQ ID NO: 1348528 - DNA, 16 bp, Homo sapiens
caaaatccaaaaagaa

SEQ ID NO: 1348529 - DNA, 19 bp, Homo sapiens
caaaattcatttctaatta

SEQ ID NO: 1348530 - DNA, 15 bp, Homo sapiens
caaacaggaacaatc

SEQ ID NO: 1348531 - DNA, 23 bp, Homo sapiens
caaacatgagatgtgtggactgt

SEQ ID NO: 1348532 - DNA, 17 bp, Homo sapiens
caaaccacgcctcttga

SEQ ID NO: 1348533 - DNA, 22 bp, Homo sapiens
caaaccacgcctcttgaccagg

SEQ ID NO: 1348534 - DNA, 17 bp, Homo sapiens
caaacctaccaaaatgg

SEQ ID NO: 1348535 - DNA, 14 bp, Homo sapiens
caaacctttgagta

SEQ ID NO: 1348536 - DNA, 15 bp, Homo sapiens
caaacctttgagtag

SEQ ID NO: 1348537 - DNA, 14 bp, Homo sapiens
caaacgcctcccct

SEQ ID NO: 1348538 - DNA, 13 bp, Homo sapiens
caaacgctaaaga

SEQ ID NO: 1348539 - DNA, 21 bp, Homo sapiens
caaacgctaaagagcccttgc

SEQ ID NO: 1348540 - DNA, 22 bp, Homo sapiens
caaacgctaaagagcccttgcc

SEQ ID NO: 1348541 - DNA, 21 bp, Homo sapiens
caaactcaatgctttatttgt

SEQ ID NO: 1348542 - DNA, 18 bp, Homo sapiens
caaactctatcggagaac

SEQ ID NO: 1348543 - DNA, 21 bp, Homo sapiens
caaactgcttcccttactttg

SEQ ID NO: 1348544 - DNA, 15 bp, Homo sapiens
caaactggggcctcc

SEQ ID NO: 1348545 - DNA, 16 bp, Homo sapiens
caaactggggcctcca

SEQ ID NO: 1348546 - DNA, 21 bp, Homo sapiens
caaactggggcctccagaact

SEQ ID NO: 1348547 - DNA, 14 bp, Homo sapiens
caaagaaaatgaaa

SEQ ID NO: 1348548 - DNA, 21 bp, Homo sapiens
caaagaaaatgaaatgcatat

SEQ ID NO: 1348549 - DNA, 14 bp, Homo sapiens
caaagagggcttcc

SEQ ID NO: 1348550 - DNA, 15 bp, Homo sapiens
caaagagggcttcct

SEQ ID NO: 1348551 - DNA, 16 bp, Homo sapiens
caaagagggcttcctc

SEQ ID NO: 1348552 - DNA, 14 bp, Homo sapiens
caaagaggttttaa

SEQ ID NO: 1348553 - DNA, 16 bp, Homo sapiens
caaagatttaatctgc

SEQ ID NO: 1348554 - DNA, 12 bp, Homo sapiens
caaagctgagcc

SEQ ID NO: 1348555 - DNA, 13 bp, Homo sapiens
caaagctgagcct

SEQ ID NO: 1348556 - DNA, 23 bp, Homo sapiens
caaagctgagcctgcagggaagc

SEQ ID NO: 1348557 - DNA, 22 bp, Homo sapiens
caaaggaaaatagtaatgtttt

SEQ ID NO: 1348558 - DNA, 17 bp, Homo sapiens
caaaggaaaatgtctgt

SEQ ID NO: 1348559 - DNA, 19 bp, Homo sapiens
caaaggaacattgtgtcta

SEQ ID NO: 1348560 - DNA, 23 bp, Homo sapiens
caaagtatgtggttttgtaattt

SEQ ID NO: 1348561 - DNA, 16 bp, Homo sapiens
caaagtcattaaagac

SEQ ID NO: 1348562 - DNA, 20 bp, Homo sapiens
caaagtttgacaggaacctt

SEQ ID NO: 1348563 - DNA, 16 bp, Homo sapiens
caaataagtatttata

SEQ ID NO: 1348564 - DNA, 14 bp, Homo sapiens
caaatacacatttg

SEQ ID NO: 1348565 - DNA, 17 bp, Homo sapiens
caaatacacatttgcta

SEQ ID NO: 1348566 - DNA, 18 bp, Homo sapiens
caaatattcactggcccc

SEQ ID NO: 1348567 - DNA, 23 bp, Homo sapiens
caaatattgttgacaactgtgac

SEQ ID NO: 1348568 - DNA, 15 bp, Homo sapiens
caaatcaatacacta

SEQ ID NO: 1348569 - DNA, 16 bp, Homo sapiens
caaatcaattctagtc

SEQ ID NO: 1348570 - DNA, 14 bp, Homo sapiens
caaatgactttatt

SEQ ID NO: 1348571 - DNA, 21 bp, Homo sapiens
caaatgactttattatttatt

SEQ ID NO: 1348572 - DNA, 19 bp, Homo sapiens
caaatgcaaaaactctttg

SEQ ID NO: 1348573 - DNA, 21 bp, Homo sapiens
caaatgcatctttgatgtgtt

SEQ ID NO: 1348574 - DNA, 19 bp, Homo sapiens
caaatgcatgcttcttctc

SEQ ID NO: 1348575 - DNA, 20 bp, Homo sapiens
caaatgcatgcttcttctca

SEQ ID NO: 1348576 - DNA, 16 bp, Homo sapiens
caaatgctcaaagaaa

SEQ ID NO: 1348577 - DNA, 18 bp, Homo sapiens
caaatggagaagctgcag

SEQ ID NO: 1348578 - DNA, 19 bp, Homo sapiens
caaatggagaagctgcagg

SEQ ID NO: 1348579 - DNA, 16 bp, Homo sapiens
caacaaaaagcttccc

SEQ ID NO: 1348580 - DNA, 17 bp, Homo sapiens
caacaaaaagcttcccc

SEQ ID NO: 1348581 - DNA, 13 bp, Homo sapiens
caacaagtaactt

SEQ ID NO: 1348582 - DNA, 15 bp, Homo sapiens
caacaataaaatttt

SEQ ID NO: 1348583 - DNA, 22 bp, Homo sapiens
caacacagcctgggccccagct

SEQ ID NO: 1348584 - DNA, 22 bp, Homo sapiens
caacacctctgcacaagctgca

SEQ ID NO: 1348585 - DNA, 13 bp, Homo sapiens
caaccacaaaact

SEQ ID NO: 1348586 - DNA, 16 bp, Homo sapiens
caaccctatctcctga

SEQ ID NO: 1348587 - DNA, 15 bp, Homo sapiens
caaccctgccgtcac

SEQ ID NO: 1348588 - DNA, 20 bp, Homo sapiens
caaccctgccgtcaccacca

SEQ ID NO: 1348589 - DNA, 14 bp, Homo sapiens
caaccgagaaggtt

SEQ ID NO: 1348590 - DNA, 15 bp, Homo sapiens
caacctcagggctcc

SEQ ID NO: 1348591 - DNA, 19 bp, Homo sapiens
caacctcagggctcccagg

SEQ ID NO: 1348592 - DNA, 16 bp, Homo sapiens
caacctcttctggctc

SEQ ID NO: 1348593 - DNA, 14 bp, Homo sapiens
caacgccgtgggct

SEQ ID NO: 1348594 - DNA, 20 bp, Homo sapiens
caacggaggcctgcgaccct

SEQ ID NO: 1348595 - DNA, 23 bp, Homo sapiens
caacggtctcctgactggtgctg

SEQ ID NO: 1348596 - DNA, 19 bp, Homo sapiens
caactaaaatttgaagtag

SEQ ID NO: 1348597 - DNA, 21 bp, Homo sapiens
caactatttattgactctggg

SEQ ID NO: 1348598 - DNA, 16 bp, Homo sapiens
caactgcattggcttt

SEQ ID NO: 1348599 - DNA, 19 bp, Homo sapiens
caactgggtccagaagaga

SEQ ID NO: 1348600 - DNA, 15 bp, Homo sapiens
caactgtcttcctca

SEQ ID NO: 1348601 - DNA, 22 bp, Homo sapiens
caagaagaaatgctttccaaaa

SEQ ID NO: 1348602 - DNA, 18 bp, Homo sapiens
caagaatattgcaaaata

SEQ ID NO: 1348603 - DNA, 23 bp, Homo sapiens
caagaatattgcaaaatacatga

SEQ ID NO: 1348604 - DNA, 22 bp, Homo sapiens
caagaattgaagcaggactaaa

SEQ ID NO: 1348605 - DNA, 19 bp, Homo sapiens
caagaccaccacttcgaaa

SEQ ID NO: 1348606 - DNA, 23 bp, Homo sapiens
caagagaactcgcgctcagtaaa

SEQ ID NO: 1348607 - DNA, 16 bp, Homo sapiens
caagagataagtcttt

SEQ ID NO: 1348608 - DNA, 16 bp, Homo sapiens
caagagccttaaaaca

SEQ ID NO: 1348609 - DNA, 15 bp, Homo sapiens
caagagggggtggag

SEQ ID NO: 1348610 - DNA, 17 bp, Homo sapiens
caagagggggtggaggg

SEQ ID NO: 1348611 - DNA, 12 bp, Homo sapiens
caagatgtgaat

SEQ ID NO: 1348612 - DNA, 23 bp, Homo sapiens
caagatgtgaattattgacactg

SEQ ID NO: 1348613 - DNA, 11 bp, Homo sapiens
caagcagagga

SEQ ID NO: 1348614 - DNA, 22 bp, Homo sapiens
caagcagaggaccagggccttt

SEQ ID NO: 1348615 - DNA, 18 bp, Homo sapiens
caagcagtcgtgcctgtg

SEQ ID NO: 1348616 - DNA, 20 bp, Homo sapiens
caagcagtcgtgcctgtgtc

SEQ ID NO: 1348617 - DNA, 21 bp, Homo sapiens
caagcagtcgtgcctgtgtcc

SEQ ID NO: 1348618 - DNA, 20 bp, Homo sapiens
caagcatgcttgtgaaaatg

SEQ ID NO: 1348619 - DNA, 21 bp, Homo sapiens
caagccaagggaacctgtgtc

SEQ ID NO: 1348620 - DNA, 16 bp, Homo sapiens
caagcctccacagcga

SEQ ID NO: 1348621 - DNA, 18 bp, Homo sapiens
caagcgggtggctctggg

SEQ ID NO: 1348622 - DNA, 14 bp, Homo sapiens
caagctccgcagga

SEQ ID NO: 1348623 - DNA, 13 bp, Homo sapiens
caagctgcaccct

SEQ ID NO: 1348624 - DNA, 18 bp, Homo sapiens
caagctgcaccctcaggc

SEQ ID NO: 1348625 - DNA, 21 bp, Homo sapiens
caagctgcaccctcaggcagg

SEQ ID NO: 1348626 - DNA, 15 bp, Homo sapiens
caaggactttgtaca

SEQ ID NO: 1348627 - DNA, 24 bp, Homo sapiens
caaggcacttcatgtaaagtgtca

SEQ ID NO: 1348628 - DNA, 21 bp, Homo sapiens
caaggcctggtgtttcttgat

SEQ ID NO: 1348629 - DNA, 15 bp, Homo sapiens
caaggctgcagtgag

SEQ ID NO: 1348630 - DNA, 17 bp, Homo sapiens
caaggctgcagtgagcc

SEQ ID NO: 1348631 - DNA, 18 bp, Homo sapiens
caaggctgggggaagaag

SEQ ID NO: 1348632 - DNA, 16 bp, Homo sapiens
caagggaaaggggtgc

SEQ ID NO: 1348633 - DNA, 16 bp, Homo sapiens
caagggaacctgtgtc

SEQ ID NO: 1348634 - DNA, 16 bp, Homo sapiens
caagggcataaagtaa

SEQ ID NO: 1348635 - DNA, 9 bp, Homo sapiens
caaggtata

SEQ ID NO: 1348636 - DNA, 19 bp, Homo sapiens
caaggtcactgtttcctgg

SEQ ID NO: 1348637 - DNA, 23 bp, Homo sapiens
caaggtgggaggattgcttgagc

SEQ ID NO: 1348638 - DNA, 11 bp, Homo sapiens
caagtaattgt

SEQ ID NO: 1348639 - DNA, 20 bp, Homo sapiens
caagtagttctgtatttgaa

SEQ ID NO: 1348640 - DNA, 23 bp, Homo sapiens
caagtagttctgtatttgaaagt

SEQ ID NO: 1348641 - DNA, 16 bp, Homo sapiens
caagtcagctccagct

SEQ ID NO: 1348642 - DNA, 18 bp, Homo sapiens
caagtcatagccataaat

SEQ ID NO: 1348643 - DNA, 14 bp, Homo sapiens
caagtgctggagtc

SEQ ID NO: 1348644 - DNA, 20 bp, Homo sapiens
caagtgctggagtctcctga

SEQ ID NO: 1348645 - DNA, 12 bp, Homo sapiens
caagtggacctt

SEQ ID NO: 1348646 - DNA, 22 bp, Homo sapiens
caagtggaccttaggccttcct

SEQ ID NO: 1348647 - DNA, 15 bp, Homo sapiens
caagtggggtgctgg

SEQ ID NO: 1348648 - DNA, 17 bp, Homo sapiens
caagtggggtgctggga

SEQ ID NO: 1348649 - DNA, 21 bp, Homo sapiens
caagtgtaaaatattttgaat

SEQ ID NO: 1348650 - DNA, 17 bp, Homo sapiens
caagttcaatctgtttt

SEQ ID NO: 1348651 - DNA, 18 bp, Homo sapiens
caagttggatgcggccat

SEQ ID NO: 1348652 - DNA, 13 bp, Homo sapiens
caataaattttga

SEQ ID NO: 1348653 - DNA, 14 bp, Homo sapiens
caataaattttgaa

SEQ ID NO: 1348654 - DNA, 15 bp, Homo sapiens
caataaattttgaaa

SEQ ID NO: 1348655 - DNA, 16 bp, Homo sapiens
caataaattttgaaaa

SEQ ID NO: 1348656 - DNA, 18 bp, Homo sapiens
caataaattttgaaaagt

SEQ ID NO: 1348657 - DNA, 12 bp, Homo sapiens
caataacagctg

SEQ ID NO: 1348658 - DNA, 23 bp, Homo sapiens
caataagtgtgtggtagaaacaa

SEQ ID NO: 1348659 - DNA, 18 bp, Homo sapiens
caataatatattttctgt

SEQ ID NO: 1348660 - DNA, 12 bp, Homo sapiens
caatagaaacaa

SEQ ID NO: 1348661 - DNA, 16 bp, Homo sapiens
caatagatctccagcg

SEQ ID NO: 1348662 - DNA, 22 bp, Homo sapiens
caataggagtggtgatttgaaa

SEQ ID NO: 1348663 - DNA, 20 bp, Homo sapiens
caatatagaaaaataaaaat

SEQ ID NO: 1348664 - DNA, 19 bp, Homo sapiens
caatattccagatctttca

SEQ ID NO: 1348665 - DNA, 17 bp, Homo sapiens
caatattcgctgtgtca

SEQ ID NO: 1348666 - DNA, 21 bp, Homo sapiens
caatattttatggttatgttt

SEQ ID NO: 1348667 - DNA, 20 bp, Homo sapiens
caatatttttatatcatgca

SEQ ID NO: 1348668 - DNA, 18 bp, Homo sapiens
caatcaaaggaaaatagt

SEQ ID NO: 1348669 - DNA, 19 bp, Homo sapiens
caatcaaggttataatttt

SEQ ID NO: 1348670 - DNA, 19 bp, Homo sapiens
caatcctaatttctcctcc

SEQ ID NO: 1348671 - DNA, 20 bp, Homo sapiens
caatcctaatttctcctccc

SEQ ID NO: 1348672 - DNA, 21 bp, Homo sapiens
caatcctaatttctcctccct

SEQ ID NO: 1348673 - DNA, 15 bp, Homo sapiens
caatcttactttgta

SEQ ID NO: 1348674 - DNA, 22 bp, Homo sapiens
caatcttactttgtaaattctg

SEQ ID NO: 1348675 - DNA, 13 bp, Homo sapiens
caatgaagttgaa

SEQ ID NO: 1348676 - DNA, 15 bp, Homo sapiens
caatgactcaaagtc

SEQ ID NO: 1348677 - DNA, 16 bp, Homo sapiens
caatgctgatttggtg

SEQ ID NO: 1348678 - DNA, 17 bp, Homo sapiens
caatgggacctgtggct

SEQ ID NO: 1348679 - DNA, 19 bp, Homo sapiens
caatgtgaaaagaaaaatg

SEQ ID NO: 1348680 - DNA, 18 bp, Homo sapiens
caatgtgaggggtcccta

SEQ ID NO: 1348681 - DNA, 17 bp, Homo sapiens
caatgtgataaaacccc

SEQ ID NO: 1348682 - DNA, 17 bp, Homo sapiens
caattagtaacattcat

SEQ ID NO: 1348683 - DNA, 19 bp, Homo sapiens
caattcttttaactgttgt

SEQ ID NO: 1348684 - DNA, 15 bp, Homo sapiens
caatttctgtgttgc

SEQ ID NO: 1348685 - DNA, 20 bp, Homo sapiens
caatttctgtgttgccaagc

SEQ ID NO: 1348686 - DNA, 15 bp, Homo sapiens
caattttatctgttt

SEQ ID NO: 1348687 - DNA, 17 bp, Homo sapiens
cacaaacgggctcagca

SEQ ID NO: 1348688 - DNA, 23 bp, Homo sapiens
cacaaactctatcggagaacatg

SEQ ID NO: 1348689 - DNA, 13 bp, Homo sapiens
cacaaaggagagc

SEQ ID NO: 1348690 - DNA, 13 bp, Homo sapiens
cacaaatgacttt

SEQ ID NO: 1348691 - DNA, 18 bp, Homo sapiens
cacaacttgatggctgcg

SEQ ID NO: 1348692 - DNA, 20 bp, Homo sapiens
cacaagaacacacacatata

SEQ ID NO: 1348693 - DNA, 18 bp, Homo sapiens
cacaattttgataaaaat

SEQ ID NO: 1348694 - DNA, 15 bp, Homo sapiens
cacacagcctagcac

SEQ ID NO: 1348695 - DNA, 20 bp, Homo sapiens
cacacatatatattacaagg

SEQ ID NO: 1348696 - DNA, 22 bp, Homo sapiens
cacacctactagtcaccagaga

SEQ ID NO: 1348697 - DNA, 14 bp, Homo sapiens
cacacgcttttgaa

SEQ ID NO: 1348698 - DNA, 19 bp, Homo sapiens
cacactggttctcaatgaa

SEQ ID NO: 1348699 - DNA, 18 bp, Homo sapiens
cacagaaacactgccttt

SEQ ID NO: 1348700 - DNA, 19 bp, Homo sapiens
cacagaaacactgcctttt

SEQ ID NO: 1348701 - DNA, 18 bp, Homo sapiens
cacagaatatttttatat

SEQ ID NO: 1348702 - DNA, 19 bp, Homo sapiens
cacagaatgcaaccaagtc

SEQ ID NO: 1348703 - DNA, 22 bp, Homo sapiens
cacagacactaacgaaatatca

SEQ ID NO: 1348704 - DNA, 13 bp, Homo sapiens
cacagactatttt

SEQ ID NO: 1348705 - DNA, 19 bp, Homo sapiens
cacagagtcaaggcctgct

SEQ ID NO: 1348706 - DNA, 20 bp, Homo sapiens
cacagagtcaaggcctgctc

SEQ ID NO: 1348707 - DNA, 21 bp, Homo sapiens
cacagcaacgatcacaaatga

SEQ ID NO: 1348708 - DNA, 20 bp, Homo sapiens
cacagccagcacctggcatc

SEQ ID NO: 1348709 - DNA, 13 bp, Homo sapiens
cacagcctagcac

SEQ ID NO: 1348710 - DNA, 19 bp, Homo sapiens
cacagcctgggccccagct

SEQ ID NO: 1348711 - DNA, 15 bp, Homo sapiens
cacagcgagggcagc

SEQ ID NO: 1348712 - DNA, 16 bp, Homo sapiens
cacagcgagggcagct

SEQ ID NO: 1348713 - DNA, 18 bp, Homo sapiens
cacagcttgacctgaggc

SEQ ID NO: 1348714 - DNA, 20 bp, Homo sapiens
cacagcttgacctgaggctg

SEQ ID NO: 1348715 - DNA, 15 bp, Homo sapiens
cacagtagagccagc

SEQ ID NO: 1348716 - DNA, 16 bp, Homo sapiens
cacagtagagccagct

SEQ ID NO: 1348717 - DNA, 18 bp, Homo sapiens
cacagttgctctatgctt

SEQ ID NO: 1348718 - DNA, 13 bp, Homo sapiens
cacatatacacga

SEQ ID NO: 1348719 - DNA, 16 bp, Homo sapiens
cacatatttgaagggt

SEQ ID NO: 1348720 - DNA, 18 bp, Homo sapiens
cacatccgcgtgtgcctg

SEQ ID NO: 1348721 - DNA, 16 bp, Homo sapiens
cacatgtccagcacct

SEQ ID NO: 1348722 - DNA, 12 bp, Homo sapiens
cacatgtttcct

SEQ ID NO: 1348723 - DNA, 22 bp, Homo sapiens
cacattcttggcttaatcattt

SEQ ID NO: 1348724 - DNA, 12 bp, Homo sapiens
caccaaaaacaa

SEQ ID NO: 1348725 - DNA, 13 bp, Homo sapiens
caccaaagctgcc

SEQ ID NO: 1348726 - DNA, 18 bp, Homo sapiens
caccaaagctgcccactg

SEQ ID NO: 1348727 - DNA, 22 bp, Homo sapiens
caccaaatcgtagcgtttgtta

SEQ ID NO: 1348728 - DNA, 14 bp, Homo sapiens
caccaagccaaggg

SEQ ID NO: 1348729 - DNA, 18 bp, Homo sapiens
caccaatcttactttgta

SEQ ID NO: 1348730 - DNA, 17 bp, Homo sapiens
caccacagccagcacct

SEQ ID NO: 1348731 - DNA, 14 bp, Homo sapiens
caccaccaccccta

SEQ ID NO: 1348732 - DNA, 20 bp, Homo sapiens
caccagcatcacctgcctgt

SEQ ID NO: 1348733 - DNA, 14 bp, Homo sapiens
caccagccccactg

SEQ ID NO: 1348734 - DNA, 21 bp, Homo sapiens
caccagccccactgccagcag

SEQ ID NO: 1348735 - DNA, 22 bp, Homo sapiens
caccagccccactgccagcagc

SEQ ID NO: 1348736 - DNA, 13 bp, Homo sapiens
caccaggccacct

SEQ ID NO: 1348737 - DNA, 21 bp, Homo sapiens
caccatattggccagtctggt

SEQ ID NO: 1348738 - DNA, 17 bp, Homo sapiens
caccatgtgagctcttc

SEQ ID NO: 1348739 - DNA, 23 bp, Homo sapiens
caccattcgtacataatactgaa

SEQ ID NO: 1348740 - DNA, 20 bp, Homo sapiens
cacccaaaccggcaggtgcg

SEQ ID NO: 1348741 - DNA, 13 bp, Homo sapiens
cacccaccgtgga

SEQ ID NO: 1348742 - DNA, 19 bp, Homo sapiens
cacccatgcaagcagagga

SEQ ID NO: 1348743 - DNA, 17 bp, Homo sapiens
caccccaacacttccag

SEQ ID NO: 1348744 - DNA, 12 bp, Homo sapiens
cacccccagccc

SEQ ID NO: 1348745 - DNA, 19 bp, Homo sapiens
cacccccagccccgactcc

SEQ ID NO: 1348746 - DNA, 19 bp, Homo sapiens
caccccctcccacccccag

SEQ ID NO: 1348747 - DNA, 16 bp, Homo sapiens
caccccctgccctgca

SEQ ID NO: 1348748 - DNA, 19 bp, Homo sapiens
caccccggggaccctgtga

SEQ ID NO: 1348749 - DNA, 11 bp, Homo sapiens
cacccctgccc

SEQ ID NO: 1348750 - DNA, 13 bp, Homo sapiens
cacccctgccccc

SEQ ID NO: 1348751 - DNA, 14 bp, Homo sapiens
cacccctgccccca

SEQ ID NO: 1348752 - DNA, 15 bp, Homo sapiens
cacccggctgcagag

SEQ ID NO: 1348753 - DNA, 21 bp, Homo sapiens
cacccggctgcagaggccaga

SEQ ID NO: 1348754 - DNA, 14 bp, Homo sapiens
caccctcaggcagg

SEQ ID NO: 1348755 - DNA, 12 bp, Homo sapiens
caccctgagccg

SEQ ID NO: 1348756 - DNA, 16 bp, Homo sapiens
caccctgctgagtctg

SEQ ID NO: 1348757 - DNA, 21 bp, Homo sapiens
caccctgggccctgggctgga

SEQ ID NO: 1348758 - DNA, 23 bp, Homo sapiens
caccctgggccctgggctggaat

SEQ ID NO: 1348759 - DNA, 14 bp, Homo sapiens
caccgcccctggcc

SEQ ID NO: 1348760 - DNA, 19 bp, Homo sapiens
caccgcctccccacctcca

SEQ ID NO: 1348761 - DNA, 15 bp, Homo sapiens
caccggtccagctgg

SEQ ID NO: 1348762 - DNA, 17 bp, Homo sapiens
caccggtccagctggcc

SEQ ID NO: 1348763 - DNA, 17 bp, Homo sapiens
caccgtggaggaggaag

SEQ ID NO: 1348764 - DNA, 17 bp, Homo sapiens
cacctcatgcccacccc

SEQ ID NO: 1348765 - DNA, 18 bp, Homo sapiens
cacctgcctgttaggaga

SEQ ID NO: 1348766 - DNA, 23 bp, Homo sapiens
cacctgcctgttaggagaagctg

SEQ ID NO: 1348767 - DNA, 17 bp, Homo sapiens
cacctgtagtcccagct

SEQ ID NO: 1348768 - DNA, 19 bp, Homo sapiens
cacctttggaaagctctga

SEQ ID NO: 1348769 - DNA, 14 bp, Homo sapiens
caccttttactgtg

SEQ ID NO: 1348770 - DNA, 21 bp, Homo sapiens
cacgaaggtaaaaagtatttt

SEQ ID NO: 1348771 - DNA, 17 bp, Homo sapiens
cacgagtaagattaaga

SEQ ID NO: 1348772 - DNA, 17 bp, Homo sapiens
cacgcacttcgggaggt

SEQ ID NO: 1348773 - DNA, 16 bp, Homo sapiens
cacgcccgtcctgcct

SEQ ID NO: 1348774 - DNA, 19 bp, Homo sapiens
cacgcccgtcctgcctgtg

SEQ ID NO: 1348775 - DNA, 20 bp, Homo sapiens
cacgcccgtcctgcctgtgg

SEQ ID NO: 1348776 - DNA, 19 bp, Homo sapiens
cacgcctgtaatcctagca

SEQ ID NO: 1348777 - DNA, 19 bp, Homo sapiens
cacggagcccagccctccc

SEQ ID NO: 1348778 - DNA, 23 bp, Homo sapiens
cacggagtcgtggggtgtgctgg

SEQ ID NO: 1348779 - DNA, 18 bp, Homo sapiens
cacgggacatcacagggt

SEQ ID NO: 1348780 - DNA, 15 bp, Homo sapiens
cacgggagatttctt

SEQ ID NO: 1348781 - DNA, 14 bp, Homo sapiens
cacgggtggtcccc

SEQ ID NO: 1348782 - DNA, 20 bp, Homo sapiens
cacgttggggtgatttaatc

SEQ ID NO: 1348783 - DNA, 21 bp, Homo sapiens
cacgttggggtgatttaatcc

SEQ ID NO: 1348784 - DNA, 21 bp, Homo sapiens
cactaaagcatgaaatgtgaa

SEQ ID NO: 1348785 - DNA, 15 bp, Homo sapiens
cactaaatcagagac

SEQ ID NO: 1348786 - DNA, 16 bp, Homo sapiens
cactaacgaaatatca

SEQ ID NO: 1348787 - DNA, 20 bp, Homo sapiens
cactaatttttgtattattt

SEQ ID NO: 1348788 - DNA, 23 bp, Homo sapiens
cactaatttttgtattatttttg

SEQ ID NO: 1348789 - DNA, 17 bp, Homo sapiens
cactcaaaagctgggca

SEQ ID NO: 1348790 - DNA, 18 bp, Homo sapiens
cactcaaaagctgggcag

SEQ ID NO: 1348791 - DNA, 22 bp, Homo sapiens
cactcactaggcccccacttgc

SEQ ID NO: 1348792 - DNA, 21 bp, Homo sapiens
cactcattgctgagcctctgc

SEQ ID NO: 1348793 - DNA, 23 bp, Homo sapiens
cactcattgctgagcctctgctc

SEQ ID NO: 1348794 - DNA, 12 bp, Homo sapiens
cactcatttcat

SEQ ID NO: 1348795 - DNA, 14 bp, Homo sapiens
cactcatttcatct

SEQ ID NO: 1348796 - DNA, 15 bp, Homo sapiens
cactccagcctgggg

SEQ ID NO: 1348797 - DNA, 13 bp, Homo sapiens
cactccagggaca

SEQ ID NO: 1348798 - DNA, 20 bp, Homo sapiens
cactccagggacacacagcc

SEQ ID NO: 1348799 - DNA, 20 bp, Homo sapiens
cactcccttgctggccccag

SEQ ID NO: 1348800 - DNA, 22 bp, Homo sapiens
cactcccttgctggccccagcc

SEQ ID NO: 1348801 - DNA, 13 bp, Homo sapiens
cactcctcagggc

SEQ ID NO: 1348802 - DNA, 17 bp, Homo sapiens
cactcgtgcatccctga

SEQ ID NO: 1348803 - DNA, 16 bp, Homo sapiens
cactcgtgtgtttcta

SEQ ID NO: 1348804 - DNA, 21 bp, Homo sapiens
cactctaaaggcgctgagact

SEQ ID NO: 1348805 - DNA, 15 bp, Homo sapiens
cactctaagtcatgt

SEQ ID NO: 1348806 - DNA, 16 bp, Homo sapiens
cactctaagtcatgta

SEQ ID NO: 1348807 - DNA, 22 bp, Homo sapiens
cactctaagtcatgtatgtttc

SEQ ID NO: 1348808 - DNA, 14 bp, Homo sapiens
cactctgcttctct

SEQ ID NO: 1348809 - DNA, 16 bp, Homo sapiens
cactctgcttctctga

SEQ ID NO: 1348810 - DNA, 16 bp, Homo sapiens
cactcttaagcttccg

SEQ ID NO: 1348811 - DNA, 17 bp, Homo sapiens
cactcttgttcccacac

SEQ ID NO: 1348812 - DNA, 13 bp, Homo sapiens
cactgaaagtttt

SEQ ID NO: 1348813 - DNA, 14 bp, Homo sapiens
cactgcaacctccg

SEQ ID NO: 1348814 - DNA, 20 bp, Homo sapiens
cactgccacactctccatca

SEQ ID NO: 1348815 - DNA, 12 bp, Homo sapiens
cactgccagcag

SEQ ID NO: 1348816 - DNA, 16 bp, Homo sapiens
cactgccaggccagcc

SEQ ID NO: 1348817 - DNA, 17 bp, Homo sapiens
cactgccaggccagcct

SEQ ID NO: 1348818 - DNA, 18 bp, Homo sapiens
cactgccaggccagcctc

SEQ ID NO: 1348819 - DNA, 17 bp, Homo sapiens
cactgccatgccagctt

SEQ ID NO: 1348820 - DNA, 15 bp, Homo sapiens
cactgcctgccttaa

SEQ ID NO: 1348821 - DNA, 13 bp, Homo sapiens
cactgcctgggct

SEQ ID NO: 1348822 - DNA, 15 bp, Homo sapiens
cactgcctgggctga

SEQ ID NO: 1348823 - DNA, 19 bp, Homo sapiens
cactgccttcgcttcttgc

SEQ ID NO: 1348824 - DNA, 20 bp, Homo sapiens
cactgcgaagaccctcttgc

SEQ ID NO: 1348825 - DNA, 19 bp, Homo sapiens
cactggaaaggggagagcc

SEQ ID NO: 1348826 - DNA, 24 bp, Homo sapiens
cactggaaaggggagagcctgctg

SEQ ID NO: 1348827 - DNA, 15 bp, Homo sapiens
cactggatgcagaaa

SEQ ID NO: 1348828 - DNA, 21 bp, Homo sapiens
cactggggcagacaataaacc

SEQ ID NO: 1348829 - DNA, 14 bp, Homo sapiens
cactggggcctaca

SEQ ID NO: 1348830 - DNA, 21 bp, Homo sapiens
cactgggttgcgggacagagt

SEQ ID NO: 1348831 - DNA, 22 bp, Homo sapiens
cactggtccccaacaatgtgag

SEQ ID NO: 1348832 - DNA, 19 bp, Homo sapiens
cactgtgcgtcttggtgta

SEQ ID NO: 1348833 - DNA, 13 bp, Homo sapiens
cactgtgtatatt

SEQ ID NO: 1348834 - DNA, 17 bp, Homo sapiens
cactgtgtatatttgat

SEQ ID NO: 1348835 - DNA, 20 bp, Homo sapiens
cactgtgtatatttgattta

SEQ ID NO: 1348836 - DNA, 13 bp, Homo sapiens
cactgttgataaa

SEQ ID NO: 1348837 - DNA, 14 bp, Homo sapiens
cactgttgataaaa

SEQ ID NO: 1348838 - DNA, 13 bp, Homo sapiens
cactgtttcctgg

SEQ ID NO: 1348839 - DNA, 15 bp, Homo sapiens
cactgtttcctgggc

SEQ ID NO: 1348840 - DNA, 17 bp, Homo sapiens
cactgtttctcttgagc

SEQ ID NO: 1348841 - DNA, 20 bp, Homo sapiens
cactgtttctcttgagctgg

SEQ ID NO: 1348842 - DNA, 18 bp, Homo sapiens
cactgtttgtttttattt

SEQ ID NO: 1348843 - DNA, 16 bp, Homo sapiens
cacttaaaacacgttt

SEQ ID NO: 1348844 - DNA, 22 bp, Homo sapiens
cacttaaaacacgttttaagga

SEQ ID NO: 1348845 - DNA, 17 bp, Homo sapiens
cacttaagttagcctcc

SEQ ID NO: 1348846 - DNA, 21 bp, Homo sapiens
cacttactggtaggaccaagc

SEQ ID NO: 1348847 - DNA, 14 bp, Homo sapiens
cacttcaccctgga

SEQ ID NO: 1348848 - DNA, 21 bp, Homo sapiens
cacttcactgcgaagaccctc

SEQ ID NO: 1348849 - DNA, 21 bp, Homo sapiens
cacttcagctgacttttctgt

SEQ ID NO: 1348850 - DNA, 15 bp, Homo sapiens
cacttcatgtaaagt

SEQ ID NO: 1348851 - DNA, 16 bp, Homo sapiens
cacttcccaccctgcc

SEQ ID NO: 1348852 - DNA, 21 bp, Homo sapiens
cacttgaaacctttttttatc

SEQ ID NO: 1348853 - DNA, 16 bp, Homo sapiens
cacttgaggcctgatc

SEQ ID NO: 1348854 - DNA, 18 bp, Homo sapiens
cacttgaggtcaggagtt

SEQ ID NO: 1348855 - DNA, 14 bp, Homo sapiens
cacttgcctcttcc

SEQ ID NO: 1348856 - DNA, 17 bp, Homo sapiens
cacttgcctcttccttg

SEQ ID NO: 1348857 - DNA, 21 bp, Homo sapiens
cacttgcctcttccttgaaga

SEQ ID NO: 1348858 - DNA, 12 bp, Homo sapiens
cacttgcctggg

SEQ ID NO: 1348859 - DNA, 15 bp, Homo sapiens
cacttgtagatttga

SEQ ID NO: 1348860 - DNA, 16 bp, Homo sapiens
cactttgggaggccaa

SEQ ID NO: 1348861 - DNA, 12 bp, Homo sapiens
cactttggggga

SEQ ID NO: 1348862 - DNA, 21 bp, Homo sapiens
cactttgttgcaagatgtgaa

SEQ ID NO: 1348863 - DNA, 20 bp, Homo sapiens
cactttgtttcgtggggagg

SEQ ID NO: 1348864 - DNA, 13 bp, Homo sapiens
cagaaacactgcc

SEQ ID NO: 1348865 - DNA, 18 bp, Homo sapiens
cagaaacactgccttttt

SEQ ID NO: 1348866 - DNA, 21 bp, Homo sapiens
cagaaacactgcctttttatt

SEQ ID NO: 1348867 - DNA, 15 bp, Homo sapiens
cagaaatggaaagca

SEQ ID NO: 1348868 - DNA, 13 bp, Homo sapiens
cagaaattgtata

SEQ ID NO: 1348869 - DNA, 14 bp, Homo sapiens
cagaaattgtatat

SEQ ID NO: 1348870 - DNA, 15 bp, Homo sapiens
cagaaattgtatatt

SEQ ID NO: 1348871 - DNA, 16 bp, Homo sapiens
cagaaattgtatattg

SEQ ID NO: 1348872 - DNA, 18 bp, Homo sapiens
cagaaattgtatattgta

SEQ ID NO: 1348873 - DNA, 15 bp, Homo sapiens
cagaactcactgggg

SEQ ID NO: 1348874 - DNA, 15 bp, Homo sapiens
cagaacttgaatgtg

SEQ ID NO: 1348875 - DNA, 20 bp, Homo sapiens
cagaagcacagaatattttt

SEQ ID NO: 1348876 - DNA, 22 bp, Homo sapiens
cagaagtcacacattacaaagt

SEQ ID NO: 1348877 - DNA, 18 bp, Homo sapiens
cagaagtgcccttcctgc

SEQ ID NO: 1348878 - DNA, 20 bp, Homo sapiens
cagaagtgcccttcctgctg

SEQ ID NO: 1348879 - DNA, 22 bp, Homo sapiens
cagaagtttgagatcagcctgg

SEQ ID NO: 1348880 - DNA, 15 bp, Homo sapiens
cagaataagttattg

SEQ ID NO: 1348881 - DNA, 17 bp, Homo sapiens
cagaataagttattgca

SEQ ID NO: 1348882 - DNA, 19 bp, Homo sapiens
cagaataagttattgcagt

SEQ ID NO: 1348883 - DNA, 20 bp, Homo sapiens
cagaataagttattgcagtt

SEQ ID NO: 1348884 - DNA, 13 bp, Homo sapiens
cagaatcccttaa

SEQ ID NO: 1348885 - DNA, 18 bp, Homo sapiens
cagaatcccttaacagtt

SEQ ID NO: 1348886 - DNA, 18 bp, Homo sapiens
cagaatgtaagtgggccc

SEQ ID NO: 1348887 - DNA, 20 bp, Homo sapiens
cagaatgtaagtgggcccac

SEQ ID NO: 1348888 - DNA, 22 bp, Homo sapiens
cagacaataaaccctcagagcc

SEQ ID NO: 1348889 - DNA, 15 bp, Homo sapiens
cagacaccctcaacc

SEQ ID NO: 1348890 - DNA, 19 bp, Homo sapiens
cagacactaacgaaatatc

SEQ ID NO: 1348891 - DNA, 12 bp, Homo sapiens
cagacatgtttt

SEQ ID NO: 1348892 - DNA, 14 bp, Homo sapiens
cagaccacaaaact

SEQ ID NO: 1348893 - DNA, 23 bp, Homo sapiens
cagaccacgcccgtcctgcctgt

SEQ ID NO: 1348894 - DNA, 20 bp, Homo sapiens
cagactatttttagattttc

SEQ ID NO: 1348895 - DNA, 18 bp, Homo sapiens
cagactggggcatcctgt

SEQ ID NO: 1348896 - DNA, 23 bp, Homo sapiens
cagagaaaaatgctccccacagc

SEQ ID NO: 1348897 - DNA, 19 bp, Homo sapiens
cagagacagatacctccaa

SEQ ID NO: 1348898 - DNA, 16 bp, Homo sapiens
cagagagacccttgtg

SEQ ID NO: 1348899 - DNA, 19 bp, Homo sapiens
cagagagcctggtgctgct

SEQ ID NO: 1348900 - DNA, 20 bp, Homo sapiens
cagagaggactgtagggagg

SEQ ID NO: 1348901 - DNA, 19 bp, Homo sapiens
cagagatttctcattgact

SEQ ID NO: 1348902 - DNA, 14 bp, Homo sapiens
cagagcaagtgaga

SEQ ID NO: 1348903 - DNA, 20 bp, Homo sapiens
cagagccggcccgcctctcc

SEQ ID NO: 1348904 - DNA, 18 bp, Homo sapiens
cagagccttctcagaagc

SEQ ID NO: 1348905 - DNA, 17 bp, Homo sapiens
cagagctggctctgagc

SEQ ID NO: 1348906 - DNA, 18 bp, Homo sapiens
cagaggaatcctggcagc

SEQ ID NO: 1348907 - DNA, 20 bp, Homo sapiens
cagaggaatcctggcagccc

SEQ ID NO: 1348908 - DNA, 23 bp, Homo sapiens
cagaggaatcctggcagcccaga

SEQ ID NO: 1348909 - DNA, 22 bp, Homo sapiens
cagaggagcctttttaaaacac

SEQ ID NO: 1348910 - DNA, 13 bp, Homo sapiens
cagaggtaccctg

SEQ ID NO: 1348911 - DNA, 16 bp, Homo sapiens
cagagtcaaggcctgc

SEQ ID NO: 1348912 - DNA, 18 bp, Homo sapiens
cagagtcaaggcctgctc

SEQ ID NO: 1348913 - DNA, 18 bp, Homo sapiens
cagataccttatcttaca

SEQ ID NO: 1348914 - DNA, 20 bp, Homo sapiens
cagatgccaccctagccaat

SEQ ID NO: 1348915 - DNA, 18 bp, Homo sapiens
cagatgccacttctaaga

SEQ ID NO: 1348916 - DNA, 20 bp, Homo sapiens
cagatgcgtcccaagatgtt

SEQ ID NO: 1348917 - DNA, 19 bp, Homo sapiens
cagatgtcctaatggtgat

SEQ ID NO: 1348918 - DNA, 18 bp, Homo sapiens
cagatgtttccagacttc

SEQ ID NO: 1348919 - DNA, 14 bp, Homo sapiens
cagatttctgagga

SEQ ID NO: 1348920 - DNA, 14 bp, Homo sapiens
cagatttgtctttt

SEQ ID NO: 1348921 - DNA, 15 bp, Homo sapiens
cagattttacagagc

SEQ ID NO: 1348922 - DNA, 14 bp, Homo sapiens
cagcaaattttcag

SEQ ID NO: 1348923 - DNA, 14 bp, Homo sapiens
cagcaacacagcct

SEQ ID NO: 1348924 - DNA, 19 bp, Homo sapiens
cagcaacgatcacaaatga

SEQ ID NO: 1348925 - DNA, 14 bp, Homo sapiens
cagcaagtggtcct

SEQ ID NO: 1348926 - DNA, 17 bp, Homo sapiens
cagcaccgaggggcctt

SEQ ID NO: 1348927 - DNA, 13 bp, Homo sapiens
cagcaccttgtgc

SEQ ID NO: 1348928 - DNA, 15 bp, Homo sapiens
cagcactttgggagg

SEQ ID NO: 1348929 - DNA, 18 bp, Homo sapiens
cagcactttgggaggccg

SEQ ID NO: 1348930 - DNA, 16 bp, Homo sapiens
cagcagcagcaggtga

SEQ ID NO: 1348931 - DNA, 19 bp, Homo sapiens
cagcagcctggaccctgtg

SEQ ID NO: 1348932 - DNA, 22 bp, Homo sapiens
cagcagcctggaccctgtggat

SEQ ID NO: 1348933 - DNA, 21 bp, Homo sapiens
cagcagcttataatgggctct

SEQ ID NO: 1348934 - DNA, 20 bp, Homo sapiens
cagcaggtgattggaccagg

SEQ ID NO: 1348935 - DNA, 17 bp, Homo sapiens
cagcagttgctggtaaa

SEQ ID NO: 1348936 - DNA, 20 bp, Homo sapiens
cagcagttgctggtaaaatg

SEQ ID NO: 1348937 - DNA, 13 bp, Homo sapiens
cagcatcagggtt

SEQ ID NO: 1348938 - DNA, 23 bp, Homo sapiens
cagcatcagggttaagaagactt

SEQ ID NO: 1348939 - DNA, 16 bp, Homo sapiens
cagcattccagcccct

SEQ ID NO: 1348940 - DNA, 20 bp, Homo sapiens
cagcattccagcccctctgg

SEQ ID NO: 1348941 - DNA, 21 bp, Homo sapiens
cagcattccagcccctctggt

SEQ ID NO: 1348942 - DNA, 21 bp, Homo sapiens
cagcatttagctggccacatg

SEQ ID NO: 1348943 - DNA, 16 bp, Homo sapiens
cagccaaagcctcctc

SEQ ID NO: 1348944 - DNA, 23 bp, Homo sapiens
cagccaagattttcctcttgtga

SEQ ID NO: 1348945 - DNA, 23 bp, Homo sapiens
cagccagaccagattaaacttca

SEQ ID NO: 1348946 - DNA, 16 bp, Homo sapiens
cagccagcacctggca

SEQ ID NO: 1348947 - DNA, 22 bp, Homo sapiens
cagccaggaccataccgggtct

SEQ ID NO: 1348948 - DNA, 20 bp, Homo sapiens
cagccatgccagctggcctt

SEQ ID NO: 1348949 - DNA, 21 bp, Homo sapiens
cagccatgccagctggccttt

SEQ ID NO: 1348950 - DNA, 17 bp, Homo sapiens
cagcccaatctgccaga

SEQ ID NO: 1348951 - DNA, 16 bp, Homo sapiens
cagcccaccctgctgc

SEQ ID NO: 1348952 - DNA, 14 bp, Homo sapiens
cagcccagagactt

SEQ ID NO: 1348953 - DNA, 19 bp, Homo sapiens
cagcccagggctcctgcac

SEQ ID NO: 1348954 - DNA, 12 bp, Homo sapiens
cagccccactgc

SEQ ID NO: 1348955 - DNA, 13 bp, Homo sapiens
cagccccactgcc

SEQ ID NO: 1348956 - DNA, 15 bp, Homo sapiens
cagccccactgccag

SEQ ID NO: 1348957 - DNA, 20 bp, Homo sapiens
cagccccactgccagcagca

SEQ ID NO: 1348958 - DNA, 21 bp, Homo sapiens
cagccccactgccagcagcag

SEQ ID NO: 1348959 - DNA, 22 bp, Homo sapiens
cagccccactgccagcagcagc

SEQ ID NO: 1348960 - DNA, 15 bp, Homo sapiens
cagccccagcctgct

SEQ ID NO: 1348961 - DNA, 15 bp, Homo sapiens
cagccccgactccag

SEQ ID NO: 1348962 - DNA, 21 bp, Homo sapiens
cagccccgcgaccatgtggcc

SEQ ID NO: 1348963 - DNA, 13 bp, Homo sapiens
cagcccctctggt

SEQ ID NO: 1348964 - DNA, 21 bp, Homo sapiens
cagccctccccatggagccag

SEQ ID NO: 1348965 - DNA, 11 bp, Homo sapiens
cagccctgctg

SEQ ID NO: 1348966 - DNA, 13 bp, Homo sapiens
cagccctgctggg

SEQ ID NO: 1348967 - DNA, 21 bp, Homo sapiens
cagccgtgtaaccatggaccc

SEQ ID NO: 1348968 - DNA, 16 bp, Homo sapiens
cagcctactctccttg

SEQ ID NO: 1348969 - DNA, 20 bp, Homo sapiens
cagcctcagcgcggccctcc

SEQ ID NO: 1348970 - DNA, 20 bp, Homo sapiens
cagcctccgagagggagaga

SEQ ID NO: 1348971 - DNA, 15 bp, Homo sapiens
cagcctctcagtgcc

SEQ ID NO: 1348972 - DNA, 22 bp, Homo sapiens
cagcctctcagtgccctccagc

SEQ ID NO: 1348973 - DNA, 14 bp, Homo sapiens
cagcctctccccag

SEQ ID NO: 1348974 - DNA, 16 bp, Homo sapiens
cagcctctccccaggt

SEQ ID NO: 1348975 - DNA, 20 bp, Homo sapiens
cagcctctccccaggtccag

SEQ ID NO: 1348976 - DNA, 22 bp, Homo sapiens
cagcctgcacagtgtcccccag

SEQ ID NO: 1348977 - DNA, 18 bp, Homo sapiens
cagcctgcgcctgctgca

SEQ ID NO: 1348978 - DNA, 22 bp, Homo sapiens
cagcctgcgcctgctgcatgcc

SEQ ID NO: 1348979 - DNA, 23 bp, Homo sapiens
cagcctgcgcctgctgcatgccc

SEQ ID NO: 1348980 - DNA, 22 bp, Homo sapiens
cagcctgctagctagctcaact

SEQ ID NO: 1348981 - DNA, 15 bp, Homo sapiens
cagcctgctccagct

SEQ ID NO: 1348982 - DNA, 16 bp, Homo sapiens
cagcctgctccagctg

SEQ ID NO: 1348983 - DNA, 20 bp, Homo sapiens
cagcctgctccagctgttca

SEQ ID NO: 1348984 - DNA, 15 bp, Homo sapiens
cagcctggaccctgt

SEQ ID NO: 1348985 - DNA, 17 bp, Homo sapiens
cagcgactccgttggcc

SEQ ID NO: 1348986 - DNA, 21 bp, Homo sapiens
cagcgactccgttggccactc

SEQ ID NO: 1348987 - DNA, 22 bp, Homo sapiens
cagcgactccgttggccactcc

SEQ ID NO: 1348988 - DNA, 14 bp, Homo sapiens
cagcgagggcagct

SEQ ID NO: 1348989 - DNA, 16 bp, Homo sapiens
cagcgagggcagctgc

SEQ ID NO: 1348990 - DNA, 18 bp, Homo sapiens
cagcgagggcagctgcta

SEQ ID NO: 1348991 - DNA, 22 bp, Homo sapiens
cagcggaggtgtggagccgagg

SEQ ID NO: 1348992 - DNA, 21 bp, Homo sapiens
cagcgtcagctgctccctggc

SEQ ID NO: 1348993 - DNA, 14 bp, Homo sapiens
cagcgtccctggcg

SEQ ID NO: 1348994 - DNA, 16 bp, Homo sapiens
cagctacttgggaggc

SEQ ID NO: 1348995 - DNA, 17 bp, Homo sapiens
cagctcagaaccacagc

SEQ ID NO: 1348996 - DNA, 20 bp, Homo sapiens
cagctccagggaatccaagc

SEQ ID NO: 1348997 - DNA, 21 bp, Homo sapiens
cagctccagggaatccaagcc

SEQ ID NO: 1348998 - DNA, 15 bp, Homo sapiens
cagctcggctcagct

SEQ ID NO: 1348999 - DNA, 13 bp, Homo sapiens
cagctcggggagc

SEQ ID NO: 1349000 - DNA, 15 bp, Homo sapiens
cagctctgcaagaat

SEQ ID NO: 1349001 - DNA, 20 bp, Homo sapiens
cagctctgccgtctctggag

SEQ ID NO: 1349002 - DNA, 21 bp, Homo sapiens
cagctgcccttccgcagtgtg

SEQ ID NO: 1349003 - DNA, 13 bp, Homo sapiens
cagctggcctgga

SEQ ID NO: 1349004 - DNA, 16 bp, Homo sapiens
cagctggcctggacag

SEQ ID NO: 1349005 - DNA, 20 bp, Homo sapiens
cagctgggccgggacccagg

SEQ ID NO: 1349006 - DNA, 16 bp, Homo sapiens
cagctgttcagctggt

SEQ ID NO: 1349007 - DNA, 12 bp, Homo sapiens
cagcttattgtt

SEQ ID NO: 1349008 - DNA, 16 bp, Homo sapiens
cagcttgacctgaggc

SEQ ID NO: 1349009 - DNA, 19 bp, Homo sapiens
cagcttgacctgaggctgt

SEQ ID NO: 1349010 - DNA, 21 bp, Homo sapiens
cagcttgagccgggcccctgg

SEQ ID NO: 1349011 - DNA, 22 bp, Homo sapiens
cagcttgagccgggcccctggg

SEQ ID NO: 1349012 - DNA, 21 bp, Homo sapiens
cagcttggggccaccaaagct

SEQ ID NO: 1349013 - DNA, 16 bp, Homo sapiens
cagctttgatccctga

SEQ ID NO: 1349014 - DNA, 17 bp, Homo sapiens
cagctttgatccctgac

SEQ ID NO: 1349015 - DNA, 20 bp, Homo sapiens
cagctttgatccctgacatc

SEQ ID NO: 1349016 - DNA, 21 bp, Homo sapiens
cagctttgtttgttgtcagct

SEQ ID NO: 1349017 - DNA, 22 bp, Homo sapiens
cagctttgtttgttgtcagctg

SEQ ID NO: 1349018 - DNA, 23 bp, Homo sapiens
caggaaactccacatctgcctta

SEQ ID NO: 1349019 - DNA, 21 bp, Homo sapiens
caggaatgtgtggcctgcaca

SEQ ID NO: 1349020 - DNA, 23 bp, Homo sapiens
caggaatgtgtggcctgcacagt

SEQ ID NO: 1349021 - DNA, 19 bp, Homo sapiens
caggacatgcaataaaatt

SEQ ID NO: 1349022 - DNA, 13 bp, Homo sapiens
caggaccctcgcc

SEQ ID NO: 1349023 - DNA, 14 bp, Homo sapiens
caggacgccactca

SEQ ID NO: 1349024 - DNA, 17 bp, Homo sapiens
caggacgccactcattt

SEQ ID NO: 1349025 - DNA, 15 bp, Homo sapiens
caggacttccccgga

SEQ ID NO: 1349026 - DNA, 13 bp, Homo sapiens
caggagacaaaag

SEQ ID NO: 1349027 - DNA, 18 bp, Homo sapiens
caggagcaggcacgggtg

SEQ ID NO: 1349028 - DNA, 15 bp, Homo sapiens
caggaggcaggcatg

SEQ ID NO: 1349029 - DNA, 18 bp, Homo sapiens
caggaggcaggcatggcc

SEQ ID NO: 1349030 - DNA, 21 bp, Homo sapiens
caggaggcaggcatggccctg

SEQ ID NO: 1349031 - DNA, 20 bp, Homo sapiens
caggaggtggaggctgcagt

SEQ ID NO: 1349032 - DNA, 18 bp, Homo sapiens
caggagtccactttgttt

SEQ ID NO: 1349033 - DNA, 23 bp, Homo sapiens
caggatatcacattggagtcact

SEQ ID NO: 1349034 - DNA, 20 bp, Homo sapiens
caggcacgggtggtccccgt

SEQ ID NO: 1349035 - DNA, 18 bp, Homo sapiens
caggcagcctctgtcagg

SEQ ID NO: 1349036 - DNA, 17 bp, Homo sapiens
caggcatagaggcttct

SEQ ID NO: 1349037 - DNA, 19 bp, Homo sapiens
caggcatagaggcttctcc

SEQ ID NO: 1349038 - DNA, 22 bp, Homo sapiens
caggcatgaggaatctgggagg

SEQ ID NO: 1349039 - DNA, 14 bp, Homo sapiens
caggcatggccctg

SEQ ID NO: 1349040 - DNA, 15 bp, Homo sapiens
caggcatggccctgg

SEQ ID NO: 1349041 - DNA, 16 bp, Homo sapiens
caggcatggccctggg

SEQ ID NO: 1349042 - DNA, 17 bp, Homo sapiens
caggcatggccctgggc

SEQ ID NO: 1349043 - DNA, 19 bp, Homo sapiens
caggccaaagtgccggtga

SEQ ID NO: 1349044 - DNA, 20 bp, Homo sapiens
caggccacctccccagcatt

SEQ ID NO: 1349045 - DNA, 12 bp, Homo sapiens
caggccagcctc

SEQ ID NO: 1349046 - DNA, 13 bp, Homo sapiens
caggccagcctcc

SEQ ID NO: 1349047 - DNA, 15 bp, Homo sapiens
caggccagcctccga

SEQ ID NO: 1349048 - DNA, 16 bp, Homo sapiens
caggccctcctctccc

SEQ ID NO: 1349049 - DNA, 22 bp, Homo sapiens
caggccctggcctcccctgcca

SEQ ID NO: 1349050 - DNA, 20 bp, Homo sapiens
caggccggcagccccagcct

SEQ ID NO: 1349051 - DNA, 23 bp, Homo sapiens
caggccggcagccccagcctgct

SEQ ID NO: 1349052 - DNA, 13 bp, Homo sapiens
caggcctatttca

SEQ ID NO: 1349053 - DNA, 12 bp, Homo sapiens
caggcctctcca

SEQ ID NO: 1349054 - DNA, 21 bp, Homo sapiens
caggctatgtataaaatacat

SEQ ID NO: 1349055 - DNA, 16 bp, Homo sapiens
caggctcactcacaga

SEQ ID NO: 1349056 - DNA, 14 bp, Homo sapiens
caggctcactgcca

SEQ ID NO: 1349057 - DNA, 23 bp, Homo sapiens
caggctcactgccaggccagcct

SEQ ID NO: 1349058 - DNA, 22 bp, Homo sapiens
caggctcccaggagcctgccca

SEQ ID NO: 1349059 - DNA, 16 bp, Homo sapiens
caggctgccgtggggc

SEQ ID NO: 1349060 - DNA, 12 bp, Homo sapiens
caggctggccag

SEQ ID NO: 1349061 - DNA, 18 bp, Homo sapiens
caggctgggccatgtcca

SEQ ID NO: 1349062 - DNA, 22 bp, Homo sapiens
caggctgggccatgtccaaaga

SEQ ID NO: 1349063 - DNA, 23 bp, Homo sapiens
caggctgggccatgtccaaagag

SEQ ID NO: 1349064 - DNA, 17 bp, Homo sapiens
cagggaagccccacatg

SEQ ID NO: 1349065 - DNA, 23 bp, Homo sapiens
cagggaagccccacatgtccagc

SEQ ID NO: 1349066 - DNA, 23 bp, Homo sapiens
cagggaatccaagcctccacagc

SEQ ID NO: 1349067 - DNA, 22 bp, Homo sapiens
cagggagacggtttccagggag

SEQ ID NO: 1349068 - DNA, 19 bp, Homo sapiens
cagggaggggccggccctg

SEQ ID NO: 1349069 - DNA, 21 bp, Homo sapiens
cagggaggggccggccctgtg

SEQ ID NO: 1349070 - DNA, 22 bp, Homo sapiens
cagggaggggccggccctgtgt

SEQ ID NO: 1349071 - DNA, 18 bp, Homo sapiens
cagggcaagctccgcagg

SEQ ID NO: 1349072 - DNA, 21 bp, Homo sapiens
cagggcaagctccgcaggact

SEQ ID NO: 1349073 - DNA, 14 bp, Homo sapiens
cagggccatgctga

SEQ ID NO: 1349074 - DNA, 17 bp, Homo sapiens
cagggccatgctgaggc

SEQ ID NO: 1349075 - DNA, 22 bp, Homo sapiens
cagggccatgctgaggcctggg

SEQ ID NO: 1349076 - DNA, 14 bp, Homo sapiens
cagggccgaccaga

SEQ ID NO: 1349077 - DNA, 11 bp, Homo sapiens
cagggcctttt

SEQ ID NO: 1349078 - DNA, 20 bp, Homo sapiens
cagggccttttctggcaccg

SEQ ID NO: 1349079 - DNA, 11 bp, Homo sapiens
cagggctcctg

SEQ ID NO: 1349080 - DNA, 14 bp, Homo sapiens
cagggctcctgcac

SEQ ID NO: 1349081 - DNA, 16 bp, Homo sapiens
caggggacaggagtcc

SEQ ID NO: 1349082 - DNA, 13 bp, Homo sapiens
caggggcctggag

SEQ ID NO: 1349083 - DNA, 14 bp, Homo sapiens
caggggcctggaga

SEQ ID NO: 1349084 - DNA, 22 bp, Homo sapiens
caggggcctggagatcctcctg

SEQ ID NO: 1349085 - DNA, 13 bp, Homo sapiens
caggggctgcttc

SEQ ID NO: 1349086 - DNA, 15 bp, Homo sapiens
caggggtctccctgg

SEQ ID NO: 1349087 - DNA, 19 bp, Homo sapiens
caggggtctccctggctcc

SEQ ID NO: 1349088 - DNA, 21 bp, Homo sapiens
caggggtctccctggctccct

SEQ ID NO: 1349089 - DNA, 20 bp, Homo sapiens
caggggtgggggtggaggct

SEQ ID NO: 1349090 - DNA, 20 bp, Homo sapiens
cagggtattccagagtgggg

SEQ ID NO: 1349091 - DNA, 23 bp, Homo sapiens
cagggtgcagcccaatctgccag

SEQ ID NO: 1349092 - DNA, 20 bp, Homo sapiens
cagggtgggcctcggcccct

SEQ ID NO: 1349093 - DNA, 15 bp, Homo sapiens
cagggttaagaagac

SEQ ID NO: 1349094 - DNA, 13 bp, Homo sapiens
caggtaatgtgaa

SEQ ID NO: 1349095 - DNA, 19 bp, Homo sapiens
caggtaatgtgaataaatt

SEQ ID NO: 1349096 - DNA, 16 bp, Homo sapiens
caggtaccagctgcgc

SEQ ID NO: 1349097 - DNA, 18 bp, Homo sapiens
caggtaccagctgcgctt

SEQ ID NO: 1349098 - DNA, 23 bp, Homo sapiens
caggtagttgcaattgaattaaa

SEQ ID NO: 1349099 - DNA, 22 bp, Homo sapiens
caggtgagaaactgtttgaaaa

SEQ ID NO: 1349100 - DNA, 14 bp, Homo sapiens
caggtgcgaaagga

SEQ ID NO: 1349101 - DNA, 21 bp, Homo sapiens
caggtgctggagcactgggct

SEQ ID NO: 1349102 - DNA, 23 bp, Homo sapiens
caggtgggctggacttctacctg

SEQ ID NO: 1349103 - DNA, 21 bp, Homo sapiens
caggttggtgggggcctcggt

SEQ ID NO: 1349104 - DNA, 18 bp, Homo sapiens
caggtttaagctgttact

SEQ ID NO: 1349105 - DNA, 21 bp, Homo sapiens
cagtaaacgggaacatgcccc

SEQ ID NO: 1349106 - DNA, 20 bp, Homo sapiens
cagtaacccccttaaattta

SEQ ID NO: 1349107 - DNA, 14 bp, Homo sapiens
cagtaactgtcagg

SEQ ID NO: 1349108 - DNA, 15 bp, Homo sapiens
cagtaagatcactgt

SEQ ID NO: 1349109 - DNA, 16 bp, Homo sapiens
cagtaagatcactgtt

SEQ ID NO: 1349110 - DNA, 17 bp, Homo sapiens
cagtaagatcactgttt

SEQ ID NO: 1349111 - DNA, 20 bp, Homo sapiens
cagtaagttatctttgaata

SEQ ID NO: 1349112 - DNA, 16 bp, Homo sapiens
cagtacccaccacctt

SEQ ID NO: 1349113 - DNA, 22 bp, Homo sapiens
cagtactattcaggtaacacta

SEQ ID NO: 1349114 - DNA, 22 bp, Homo sapiens
cagtagaactccaggccctcct

SEQ ID NO: 1349115 - DNA, 13 bp, Homo sapiens
cagtagagccagc

SEQ ID NO: 1349116 - DNA, 16 bp, Homo sapiens
cagtagagccagcttg

SEQ ID NO: 1349117 - DNA, 17 bp, Homo sapiens
cagtagagccagcttgg

SEQ ID NO: 1349118 - DNA, 16 bp, Homo sapiens
cagtagattttccaaa

SEQ ID NO: 1349119 - DNA, 18 bp, Homo sapiens
cagtagtttaaaagttct

SEQ ID NO: 1349120 - DNA, 13 bp, Homo sapiens
cagtatctcaggg

SEQ ID NO: 1349121 - DNA, 12 bp, Homo sapiens
cagtattatgta

SEQ ID NO: 1349122 - DNA, 21 bp, Homo sapiens
cagtcaggtagttgcaattga

SEQ ID NO: 1349123 - DNA, 13 bp, Homo sapiens
cagtcattatgag

SEQ ID NO: 1349124 - DNA, 15 bp, Homo sapiens
cagtccaggctgccg

SEQ ID NO: 1349125 - DNA, 15 bp, Homo sapiens
cagtccccacccctg

SEQ ID NO: 1349126 - DNA, 20 bp, Homo sapiens
cagtccccacccctgccccc

SEQ ID NO: 1349127 - DNA, 21 bp, Homo sapiens
cagtccccacccctgccccca

SEQ ID NO: 1349128 - DNA, 22 bp, Homo sapiens
cagtcccttccccatgcttcct

SEQ ID NO: 1349129 - DNA, 15 bp, Homo sapiens
cagtcctactcaagc

SEQ ID NO: 1349130 - DNA, 21 bp, Homo sapiens
cagtcctactcaagcgggtgg

SEQ ID NO: 1349131 - DNA, 13 bp, Homo sapiens
cagtcgtgcctgt

SEQ ID NO: 1349132 - DNA, 14 bp, Homo sapiens
cagtcgtgcctgtg

SEQ ID NO: 1349133 - DNA, 15 bp, Homo sapiens
cagtctccggcctct

SEQ ID NO: 1349134 - DNA, 18 bp, Homo sapiens
cagtctccggcctctcca

SEQ ID NO: 1349135 - DNA, 20 bp, Homo sapiens
cagtctccggcctctccagc

SEQ ID NO: 1349136 - DNA, 22 bp, Homo sapiens
cagtctccggcctctccagcct

SEQ ID NO: 1349137 - DNA, 18 bp, Homo sapiens
cagtgcaaatgcatgctt

SEQ ID NO: 1349138 - DNA, 20 bp, Homo sapiens
cagtgcaaatgcatgcttct

SEQ ID NO: 1349139 - DNA, 14 bp, Homo sapiens
cagtgcagaatgta

SEQ ID NO: 1349140 - DNA, 22 bp, Homo sapiens
cagtgcagaatgtaagtgggcc

SEQ ID NO: 1349141 - DNA, 17 bp, Homo sapiens
cagtgcatggtggccag

SEQ ID NO: 1349142 - DNA, 20 bp, Homo sapiens
cagtgcatggtggccagagg

SEQ ID NO: 1349143 - DNA, 13 bp, Homo sapiens
cagtgccctccag

SEQ ID NO: 1349144 - DNA, 15 bp, Homo sapiens
cagtgcctattgata

SEQ ID NO: 1349145 - DNA, 22 bp, Homo sapiens
cagtggaccgcccttttcccct

SEQ ID NO: 1349146 - DNA, 20 bp, Homo sapiens
cagtggcgcattctaggctc

SEQ ID NO: 1349147 - DNA, 14 bp, Homo sapiens
cagtgggttaacat

SEQ ID NO: 1349148 - DNA, 21 bp, Homo sapiens
cagtgggttaacatcagtttt

SEQ ID NO: 1349149 - DNA, 15 bp, Homo sapiens
cagtggttttatact

SEQ ID NO: 1349150 - DNA, 18 bp, Homo sapiens
cagtgtatgtagaagcat

SEQ ID NO: 1349151 - DNA, 16 bp, Homo sapiens
cagtgtggccaggctg

SEQ ID NO: 1349152 - DNA, 15 bp, Homo sapiens
cagttattacatgta

SEQ ID NO: 1349153 - DNA, 17 bp, Homo sapiens
cagttgctggtaaaatg

SEQ ID NO: 1349154 - DNA, 19 bp, Homo sapiens
cagttgctggtaaaatgaa

SEQ ID NO: 1349155 - DNA, 14 bp, Homo sapiens
cagttgcttgtctt

SEQ ID NO: 1349156 - DNA, 16 bp, Homo sapiens
cagttggccagagagc

SEQ ID NO: 1349157 - DNA, 14 bp, Homo sapiens
catgcacttaaaga

SEQ ID NO: 1349158 - DNA, 16 bp, Homo sapiens
catgcacttaaagaag

SEQ ID NO: 1349159 - DNA, 21 bp, Homo sapiens
catgcatataatgaataaatc

SEQ ID NO: 1349160 - DNA, 13 bp, Homo sapiens
catgccagctggc

SEQ ID NO: 1349161 - DNA, 16 bp, Homo sapiens
catgccagctggcctt

SEQ ID NO: 1349162 - DNA, 16 bp, Homo sapiens
catgccctctcaggcc

SEQ ID NO: 1349163 - DNA, 21 bp, Homo sapiens
catgccctctcaggccggcag

SEQ ID NO: 1349164 - DNA, 16 bp, Homo sapiens
catgccgtctgccgga

SEQ ID NO: 1349165 - DNA, 21 bp, Homo sapiens
catgcgccccctccgccctgc

SEQ ID NO: 1349166 - DNA, 22 bp, Homo sapiens
catgcgctcagggccatgctga

SEQ ID NO: 1349167 - DNA, 16 bp, Homo sapiens
catgctcatctgctgg

SEQ ID NO: 1349168 - DNA, 18 bp, Homo sapiens
catgctcatctgctggtc

SEQ ID NO: 1349169 - DNA, 19 bp, Homo sapiens
catgctcatctgctggtcc

SEQ ID NO: 1349170 - DNA, 13 bp, Homo sapiens
catgctcctggcc

SEQ ID NO: 1349171 - DNA, 16 bp, Homo sapiens
catgctcctggcccac

SEQ ID NO: 1349172 - DNA, 16 bp, Homo sapiens
catgctgaggcctggg

SEQ ID NO: 1349173 - DNA, 19 bp, Homo sapiens
catgctgaggcctgggccg

SEQ ID NO: 1349174 - DNA, 10 bp, Homo sapiens
catggagcca

SEQ ID NO: 1349175 - DNA, 17 bp, Homo sapiens
catggagccagctccct

SEQ ID NO: 1349176 - DNA, 13 bp, Homo sapiens
catggccctgggc

SEQ ID NO: 1349177 - DNA, 14 bp, Homo sapiens
catggccctgggcg

SEQ ID NO: 1349178 - DNA, 16 bp, Homo sapiens
catggctccggcctct

SEQ ID NO: 1349179 - DNA, 14 bp, Homo sapiens
catgggagggggct

SEQ ID NO: 1349180 - DNA, 19 bp, Homo sapiens
catggtgaaaccccgtctc

SEQ ID NO: 1349181 - DNA, 18 bp, Homo sapiens
catggtgcctgagaggca

SEQ ID NO: 1349182 - DNA, 19 bp, Homo sapiens
catggttttgtgccatctg

SEQ ID NO: 1349183 - DNA, 22 bp, Homo sapiens
catgtactttttagtaatttct

SEQ ID NO: 1349184 - DNA, 18 bp, Homo sapiens
catgtagccccctggcct

SEQ ID NO: 1349185 - DNA, 22 bp, Homo sapiens
catgtatgtcagaagtgcagaa

SEQ ID NO: 1349186 - DNA, 13 bp, Homo sapiens
catgtatgtttct

SEQ ID NO: 1349187 - DNA, 14 bp, Homo sapiens
catgtatttgagca

SEQ ID NO: 1349188 - DNA, 17 bp, Homo sapiens
catgtccaaagaggctg

SEQ ID NO: 1349189 - DNA, 18 bp, Homo sapiens
catgtccaaagaggctgc

SEQ ID NO: 1349190 - DNA, 19 bp, Homo sapiens
catgtccaaagaggctgcc

SEQ ID NO: 1349191 - DNA, 22 bp, Homo sapiens
catgtccatacactttgttgca

SEQ ID NO: 1349192 - DNA, 23 bp, Homo sapiens
catgtccatacactttgttgcaa

SEQ ID NO: 1349193 - DNA, 21 bp, Homo sapiens
catgtgagtgacgatgatgta

SEQ ID NO: 1349194 - DNA, 18 bp, Homo sapiens
catgtgatggacactcca

SEQ ID NO: 1349195 - DNA, 18 bp, Homo sapiens
catgtgcatagtttcttt

SEQ ID NO: 1349196 - DNA, 15 bp, Homo sapiens
catgtgcttctgcca

SEQ ID NO: 1349197 - DNA, 20 bp, Homo sapiens
catgtggaaggcaagccagg

SEQ ID NO: 1349198 - DNA, 22 bp, Homo sapiens
catgtggaaggcaagccaggct

SEQ ID NO: 1349199 - DNA, 23 bp, Homo sapiens
catgtggaaggcaagccaggctc

SEQ ID NO: 1349200 - DNA, 17 bp, Homo sapiens
catgttgatcatgtact

SEQ ID NO: 1349201 - DNA, 20 bp, Homo sapiens
catgttgatcatgtactttt

SEQ ID NO: 1349202 - DNA, 21 bp, Homo sapiens
catgttgatcatgtacttttt

SEQ ID NO: 1349203 - DNA, 21 bp, Homo sapiens
catgttggccaggctggtctt

SEQ ID NO: 1349204 - DNA, 15 bp, Homo sapiens
catgttgggaaactt

SEQ ID NO: 1349205 - DNA, 21 bp, Homo sapiens
catgtttcctctagttctttg

SEQ ID NO: 1349206 - DNA, 14 bp, Homo sapiens
catgttttccgtga

SEQ ID NO: 1349207 - DNA, 12 bp, Homo sapiens
catgttttgtat

SEQ ID NO: 1349208 - DNA, 23 bp, Homo sapiens
cattaaaaaaatgtgcctagttt

SEQ ID NO: 1349209 - DNA, 10 bp, Homo sapiens
cattaaactg

SEQ ID NO: 1349210 - DNA, 11 bp, Homo sapiens
cattaaacttt

SEQ ID NO: 1349211 - DNA, 20 bp, Homo sapiens
cattaaaggcataaatgact

SEQ ID NO: 1349212 - DNA, 15 bp, Homo sapiens
cattaacaaataaaa

SEQ ID NO: 1349213 - DNA, 18 bp, Homo sapiens
cattaaggggaagaatga

SEQ ID NO: 1349214 - DNA, 19 bp, Homo sapiens
cattaaggggaagaatgaa

SEQ ID NO: 1349215 - DNA, 21 bp, Homo sapiens
cattacagaggtattaaaact

SEQ ID NO: 1349216 - DNA, 17 bp, Homo sapiens
cattacttgttgcctat

SEQ ID NO: 1349217 - DNA, 18 bp, Homo sapiens
cattacttgttgcctata

SEQ ID NO: 1349218 - DNA, 22 bp, Homo sapiens
cattatgagaggcaatgattgt

SEQ ID NO: 1349219 - DNA, 13 bp, Homo sapiens
cattcaaatttgt

SEQ ID NO: 1349220 - DNA, 15 bp, Homo sapiens
cattcaaatttgtct

SEQ ID NO: 1349221 - DNA, 19 bp, Homo sapiens
cattcaagtgtaaaatatt

SEQ ID NO: 1349222 - DNA, 20 bp, Homo sapiens
cattcaagtgtaaaatattt

SEQ ID NO: 1349223 - DNA, 21 bp, Homo sapiens
cattcaagtgtaaaatatttt

SEQ ID NO: 1349224 - DNA, 22 bp, Homo sapiens
cattcagagtcagccaggacca

SEQ ID NO: 1349225 - DNA, 13 bp, Homo sapiens
cattccacacaga

SEQ ID NO: 1349226 - DNA, 17 bp, Homo sapiens
cattccaggcagcctct

SEQ ID NO: 1349227 - DNA, 21 bp, Homo sapiens
cattccaggcagcctctgtca

SEQ ID NO: 1349228 - DNA, 22 bp, Homo sapiens
cattcctaaagaaaaatatctt

SEQ ID NO: 1349229 - DNA, 12 bp, Homo sapiens
cattctcccagg

SEQ ID NO: 1349230 - DNA, 15 bp, Homo sapiens
cattctcccaggtac

SEQ ID NO: 1349231 - DNA, 16 bp, Homo sapiens
cattctgactcggttt

SEQ ID NO: 1349232 - DNA, 21 bp, Homo sapiens
cattctgccgccccctcctga

SEQ ID NO: 1349233 - DNA, 12 bp, Homo sapiens
cattcttactaa

SEQ ID NO: 1349234 - DNA, 19 bp, Homo sapiens
cattcttactaaaaagtat

SEQ ID NO: 1349235 - DNA, 19 bp, Homo sapiens
cattcttggcttaatcatt

SEQ ID NO: 1349236 - DNA, 20 bp, Homo sapiens
cattcttggcttaatcattt

SEQ ID NO: 1349237 - DNA, 21 bp, Homo sapiens
cattgaagaatgttagagtaa

SEQ ID NO: 1349238 - DNA, 15 bp, Homo sapiens
cattgacctatttcc

SEQ ID NO: 1349239 - DNA, 21 bp, Homo sapiens
cattgacctatttccagaaat

SEQ ID NO: 1349240 - DNA, 14 bp, Homo sapiens
cattgagtattgtt

SEQ ID NO: 1349241 - DNA, 19 bp, Homo sapiens
cattgcacataagcttcca

SEQ ID NO: 1349242 - DNA, 14 bp, Homo sapiens
cattgctgagcctc

SEQ ID NO: 1349243 - DNA, 15 bp, Homo sapiens
cattgctgagcctct

SEQ ID NO: 1349244 - DNA, 18 bp, Homo sapiens
cattgctgggcttgtctg

SEQ ID NO: 1349245 - DNA, 22 bp, Homo sapiens
cattgtcgtataggcatgtaaa

SEQ ID NO: 1349246 - DNA, 20 bp, Homo sapiens
cattgttcttattctggcat

SEQ ID NO: 1349247 - DNA, 14 bp, Homo sapiens
catttaagggaaaa

SEQ ID NO: 1349248 - DNA, 19 bp, Homo sapiens
catttaagggaaaaatata

SEQ ID NO: 1349249 - DNA, 13 bp, Homo sapiens
catttcagaagtt

SEQ ID NO: 1349250 - DNA, 23 bp, Homo sapiens
catttcagaagttagtttgtata

SEQ ID NO: 1349251 - DNA, 14 bp, Homo sapiens
catttcatctcatt

SEQ ID NO: 1349252 - DNA, 13 bp, Homo sapiens
catttctaattaa

SEQ ID NO: 1349253 - DNA, 20 bp, Homo sapiens
catttgatgcatgtctttta

SEQ ID NO: 1349254 - DNA, 20 bp, Homo sapiens
catttgcaataacagctgca

SEQ ID NO: 1349255 - DNA, 20 bp, Homo sapiens
catttgctcttcagatgcca

SEQ ID NO: 1349256 - DNA, 23 bp, Homo sapiens
catttgggagtttttatgagaaa

SEQ ID NO: 1349257 - DNA, 21 bp, Homo sapiens
catttgtgctagaaattttca

SEQ ID NO: 1349258 - DNA, 15 bp, Homo sapiens
catttgttaaaatta

SEQ ID NO: 1349259 - DNA, 18 bp, Homo sapiens
catttgttaaaattatca

SEQ ID NO: 1349260 - DNA, 18 bp, Homo sapiens
cattttaaccctatttta

SEQ ID NO: 1349261 - DNA, 14 bp, Homo sapiens
cattttaattttaa

SEQ ID NO: 1349262 - DNA, 18 bp, Homo sapiens
cattttaattttaaagtg

SEQ ID NO: 1349263 - DNA, 14 bp, Homo sapiens
cattttgacctact

SEQ ID NO: 1349264 - DNA, 14 bp, Homo sapiens
catttttcaatata

SEQ ID NO: 1349265 - DNA, 15 bp, Homo sapiens
catttttcaatatat

SEQ ID NO: 1349266 - DNA, 21 bp, Homo sapiens
catttttcaatatattgaact

SEQ ID NO: 1349267 - DNA, 13 bp, Homo sapiens
catttttgtaaat

SEQ ID NO: 1349268 - DNA, 13 bp, Homo sapiens
cattttttaagct

SEQ ID NO: 1349269 - DNA, 16 bp, Homo sapiens
cattttttaatttact

SEQ ID NO: 1349270 - DNA, 23 bp, Homo sapiens
ccaaaatgtaggcttagtttgtg

SEQ ID NO: 1349271 - DNA, 16 bp, Homo sapiens
ccaaaccggcaggtgc

SEQ ID NO: 1349272 - DNA, 13 bp, Homo sapiens
ccaaacgcctccc

SEQ ID NO: 1349273 - DNA, 16 bp, Homo sapiens
ccaaagaggctgcccc

SEQ ID NO: 1349274 - DNA, 20 bp, Homo sapiens
ccaaagaggctgcccctctc

SEQ ID NO: 1349275 - DNA, 21 bp, Homo sapiens
ccaaagaggctgcccctctca

SEQ ID NO: 1349276 - DNA, 14 bp, Homo sapiens
ccaaagctgagcct

SEQ ID NO: 1349277 - DNA, 21 bp, Homo sapiens
cagttgtatttaacagaaatt

SEQ ID NO: 1349278 - DNA, 16 bp, Homo sapiens
cagtttatcattcaag

SEQ ID NO: 1349279 - DNA, 15 bp, Homo sapiens
cagtttgagacagga

SEQ ID NO: 1349280 - DNA, 21 bp, Homo sapiens
cagtttgaggattagtttaga

SEQ ID NO: 1349281 - DNA, 14 bp, Homo sapiens
cagtttgttggaaa

SEQ ID NO: 1349282 - DNA, 13 bp, Homo sapiens
cagttttcatagt

SEQ ID NO: 1349283 - DNA, 16 bp, Homo sapiens
cataaaagaaataaac

SEQ ID NO: 1349284 - DNA, 15 bp, Homo sapiens
cataaagtaaataca

SEQ ID NO: 1349285 - DNA, 12 bp, Homo sapiens
cataaattattt

SEQ ID NO: 1349286 - DNA, 22 bp, Homo sapiens
cataaattatttgattatttaa

SEQ ID NO: 1349287 - DNA, 20 bp, Homo sapiens
cataaattcaactttgtaaa

SEQ ID NO: 1349288 - DNA, 13 bp, Homo sapiens
cataagcttccat

SEQ ID NO: 1349289 - DNA, 17 bp, Homo sapiens
cataatactgaaccact

SEQ ID NO: 1349290 - DNA, 14 bp, Homo sapiens
cataattgaagtgt

SEQ ID NO: 1349291 - DNA, 15 bp, Homo sapiens
cataatttaaaaata

SEQ ID NO: 1349292 - DNA, 18 bp, Homo sapiens
cataatttaaaaatatat

SEQ ID NO: 1349293 - DNA, 20 bp, Homo sapiens
cataatttaaaaatatattt

SEQ ID NO: 1349294 - DNA, 19 bp, Homo sapiens
catacaagtttataaagag

SEQ ID NO: 1349295 - DNA, 20 bp, Homo sapiens
catacactttgttgcaagat

SEQ ID NO: 1349296 - DNA, 14 bp, Homo sapiens
catacataaaagaa

SEQ ID NO: 1349297 - DNA, 14 bp, Homo sapiens
catacgatttaagg

SEQ ID NO: 1349298 - DNA, 17 bp, Homo sapiens
catactggcttcaccat

SEQ ID NO: 1349299 - DNA, 14 bp, Homo sapiens
catacttacctagt

SEQ ID NO: 1349300 - DNA, 14 bp, Homo sapiens
catactttgtaaat

SEQ ID NO: 1349301 - DNA, 15 bp, Homo sapiens
catactttgtaaata

SEQ ID NO: 1349302 - DNA, 18 bp, Homo sapiens
catactttgtattttgat

SEQ ID NO: 1349303 - DNA, 23 bp, Homo sapiens
catagaaatggaaattttgctat

SEQ ID NO: 1349304 - DNA, 23 bp, Homo sapiens
catagaaatgtaggtcctcagaa

SEQ ID NO: 1349305 - DNA, 14 bp, Homo sapiens
catagacatgaaag

SEQ ID NO: 1349306 - DNA, 22 bp, Homo sapiens
catagaggcttctccgccagcc

SEQ ID NO: 1349307 - DNA, 18 bp, Homo sapiens
catagagtacactgcctg

SEQ ID NO: 1349308 - DNA, 19 bp, Homo sapiens
catagataatattgtttgg

SEQ ID NO: 1349309 - DNA, 13 bp, Homo sapiens
catagccataaat

SEQ ID NO: 1349310 - DNA, 15 bp, Homo sapiens
catagcccagtagac

SEQ ID NO: 1349311 - DNA, 18 bp, Homo sapiens
cataggacctttccacca

SEQ ID NO: 1349312 - DNA, 22 bp, Homo sapiens
cataggttcacaccattttgtt

SEQ ID NO: 1349313 - DNA, 21 bp, Homo sapiens
catagtactctttgtagcaaa

SEQ ID NO: 1349314 - DNA, 20 bp, Homo sapiens
catagtatccatattttatt

SEQ ID NO: 1349315 - DNA, 22 bp, Homo sapiens
catagtcacctgactaagaaat

SEQ ID NO: 1349316 - DNA, 21 bp, Homo sapiens
catagttctgagctgccagtg

SEQ ID NO: 1349317 - DNA, 22 bp, Homo sapiens
catagtttctttattttgtgta

SEQ ID NO: 1349318 - DNA, 15 bp, Homo sapiens
catagtttggcattt

SEQ ID NO: 1349319 - DNA, 18 bp, Homo sapiens
catagtttggcatttgca

SEQ ID NO: 1349320 - DNA, 16 bp, Homo sapiens
catagttttatttata

SEQ ID NO: 1349321 - DNA, 19 bp, Homo sapiens
catagttttatttatattt

SEQ ID NO: 1349322 - DNA, 11 bp, Homo sapiens
catataagaca

SEQ ID NO: 1349323 - DNA, 23 bp, Homo sapiens
catatacacgaatagacatcaaa

SEQ ID NO: 1349324 - DNA, 16 bp, Homo sapiens
catatatatatataac

SEQ ID NO: 1349325 - DNA, 13 bp, Homo sapiens
catatcccttcca

SEQ ID NO: 1349326 - DNA, 15 bp, Homo sapiens
catatcccttccaga

SEQ ID NO: 1349327 - DNA, 17 bp, Homo sapiens
catatcccttccagatg

SEQ ID NO: 1349328 - DNA, 20 bp, Homo sapiens
catatcttaatatatttcta

SEQ ID NO: 1349329 - DNA, 22 bp, Homo sapiens
catatgaaaaaaatgcatttta

SEQ ID NO: 1349330 - DNA, 16 bp, Homo sapiens
catatggatgttactc

SEQ ID NO: 1349331 - DNA, 21 bp, Homo sapiens
catattataaaggataaagaa

SEQ ID NO: 1349332 - DNA, 17 bp, Homo sapiens
catattttattactgtt

SEQ ID NO: 1349333 - DNA, 19 bp, Homo sapiens
catcaaaatatttcagtga

SEQ ID NO: 1349334 - DNA, 13 bp, Homo sapiens
catcaaataagaa

SEQ ID NO: 1349335 - DNA, 22 bp, Homo sapiens
catcagaaagctttattttgag

SEQ ID NO: 1349336 - DNA, 14 bp, Homo sapiens
catcatttcaggag

SEQ ID NO: 1349337 - DNA, 14 bp, Homo sapiens
catccaaccttccc

SEQ ID NO: 1349338 - DNA, 16 bp, Homo sapiens
catccaaccttcccaa

SEQ ID NO: 1349339 - DNA, 16 bp, Homo sapiens
catccaactccagcaa

SEQ ID NO: 1349340 - DNA, 17 bp, Homo sapiens
catccaactccagcaac

SEQ ID NO: 1349341 - DNA, 13 bp, Homo sapiens
catccagatgtgg

SEQ ID NO: 1349342 - DNA, 16 bp, Homo sapiens
catccagatgtggcta

SEQ ID NO: 1349343 - DNA, 13 bp, Homo sapiens
catccagggggca

SEQ ID NO: 1349344 - DNA, 18 bp, Homo sapiens
catcccaaccaggcacct

SEQ ID NO: 1349345 - DNA, 20 bp, Homo sapiens
catcccaaccaggcacctct

SEQ ID NO: 1349346 - DNA, 22 bp, Homo sapiens
catcccattccaggcagcctct

SEQ ID NO: 1349347 - DNA, 14 bp, Homo sapiens
catcccctgtagag

SEQ ID NO: 1349348 - DNA, 21 bp, Homo sapiens
catcccctgtagagtgggagc

SEQ ID NO: 1349349 - DNA, 19 bp, Homo sapiens
catccctaccgacccaggg

SEQ ID NO: 1349350 - DNA, 23 bp, Homo sapiens
catccctgagacagggagggaag

SEQ ID NO: 1349351 - DNA, 21 bp, Homo sapiens
catcctacaactcacattaga

SEQ ID NO: 1349352 - DNA, 19 bp, Homo sapiens
catcctgaccagctgctcc

SEQ ID NO: 1349353 - DNA, 14 bp, Homo sapiens
catcggcctagggc

SEQ ID NO: 1349354 - DNA, 16 bp, Homo sapiens
catcggcctagggccc

SEQ ID NO: 1349355 - DNA, 18 bp, Homo sapiens
catcgtgaagaagcctgt

SEQ ID NO: 1349356 - DNA, 13 bp, Homo sapiens
catctaattctga

SEQ ID NO: 1349357 - DNA, 14 bp, Homo sapiens
catctaattctgat

SEQ ID NO: 1349358 - DNA, 18 bp, Homo sapiens
catctaggggagccttga

SEQ ID NO: 1349359 - DNA, 19 bp, Homo sapiens
catctaggggagccttgat

SEQ ID NO: 1349360 - DNA, 20 bp, Homo sapiens
catctaggggagccttgatt

SEQ ID NO: 1349361 - DNA, 17 bp, Homo sapiens
catctatagaaagctat

SEQ ID NO: 1349362 - DNA, 16 bp, Homo sapiens
catctatctcaatcct

SEQ ID NO: 1349363 - DNA, 19 bp, Homo sapiens
catctcatttaagggaaaa

SEQ ID NO: 1349364 - DNA, 20 bp, Homo sapiens
catctcatttaagggaaaaa

SEQ ID NO: 1349365 - DNA, 14 bp, Homo sapiens
catctcccctcagc

SEQ ID NO: 1349366 - DNA, 17 bp, Homo sapiens
catctcccctcagctcg

SEQ ID NO: 1349367 - DNA, 15 bp, Homo sapiens
catctccctcccaca

SEQ ID NO: 1349368 - DNA, 13 bp, Homo sapiens
catctccctgcct

SEQ ID NO: 1349369 - DNA, 19 bp, Homo sapiens
catctccctgcctggcccc

SEQ ID NO: 1349370 - DNA, 23 bp, Homo sapiens
catctgcaccccttctctcctcc

SEQ ID NO: 1349371 - DNA, 16 bp, Homo sapiens
catctgccccacagtc

SEQ ID NO: 1349372 - DNA, 18 bp, Homo sapiens
catctgccttaaaaccaa

SEQ ID NO: 1349373 - DNA, 20 bp, Homo sapiens
catctgccttaaaaccaaag

SEQ ID NO: 1349374 - DNA, 21 bp, Homo sapiens
catctggaatctggagaccag

SEQ ID NO: 1349375 - DNA, 18 bp, Homo sapiens
catctgtctatattttat

SEQ ID NO: 1349376 - DNA, 17 bp, Homo sapiens
catctgtggactgacct

SEQ ID NO: 1349377 - DNA, 17 bp, Homo sapiens
catcttagacctccaca

SEQ ID NO: 1349378 - DNA, 23 bp, Homo sapiens
catcttgaatccttccattccac

SEQ ID NO: 1349379 - DNA, 15 bp, Homo sapiens
catcttgcctccagg

SEQ ID NO: 1349380 - DNA, 10 bp, Homo sapiens
catctttaag

SEQ ID NO: 1349381 - DNA, 14 bp, Homo sapiens
catctttgatgtgt

SEQ ID NO: 1349382 - DNA, 18 bp, Homo sapiens
catctttgatgtgttgtt

SEQ ID NO: 1349383 - DNA, 13 bp, Homo sapiens
catgaaataaaat

SEQ ID NO: 1349384 - DNA, 17 bp, Homo sapiens
catgaatcaaaagtgcc

SEQ ID NO: 1349385 - DNA, 15 bp, Homo sapiens
catgagactcagtgc

SEQ ID NO: 1349386 - DNA, 23 bp, Homo sapiens
catgagatgtgtggactgtggca

SEQ ID NO: 1349387 - DNA, 22 bp, Homo sapiens
catgaggaactgtagatgatgt

SEQ ID NO: 1349388 - DNA, 21 bp, Homo sapiens
catgagtagataatttcaggg

SEQ ID NO: 1349389 - DNA, 23 bp, Homo sapiens
catgattaaccacttcagctgac

SEQ ID NO: 1349390 - DNA, 24 bp, Homo sapiens
catgattaaccacttcagctgact

SEQ ID NO: 1349391 - DNA, 12 bp, Homo sapiens
catgattagcaa

SEQ ID NO: 1349392 - DNA, 16 bp, Homo sapiens
catgcaaaatatgttt

SEQ ID NO: 1349393 - DNA, 17 bp, Homo sapiens
catgcaaaatatgttta

SEQ ID NO: 1349394 - DNA, 16 bp, Homo sapiens
catgcaaatgagctct

SEQ ID NO: 1349395 - DNA, 22 bp, Homo sapiens
catgcaagcagaggaccagggc

SEQ ID NO: 1349396 - DNA, 15 bp, Homo sapiens
catgcaataaaattt

SEQ ID NO: 1349397 - DNA, 15 bp, Homo sapiens
ccaaagctgagcctg

SEQ ID NO: 1349398 - DNA, 20 bp, Homo sapiens
ccaaagctgagcctgcaggg

SEQ ID NO: 1349399 - DNA, 20 bp, Homo sapiens
ccaaagctgcccactgtttc

SEQ ID NO: 1349400 - DNA, 14 bp, Homo sapiens
ccaaatctggaagc

SEQ ID NO: 1349401 - DNA, 21 bp, Homo sapiens
ccaaatggagaagctgcaggc

SEQ ID NO: 1349402 - DNA, 14 bp, Homo sapiens
ccaaatgtttattt

SEQ ID NO: 1349403 - DNA, 17 bp, Homo sapiens
ccaaccagacctggaag

SEQ ID NO: 1349404 - DNA, 20 bp, Homo sapiens
ccaaccctatctcctgacag

SEQ ID NO: 1349405 - DNA, 12 bp, Homo sapiens
ccaaccctgccg

SEQ ID NO: 1349406 - DNA, 18 bp, Homo sapiens
ccaacctcagggctccca

SEQ ID NO: 1349407 - DNA, 22 bp, Homo sapiens
ccaacctcagggctcccagggg

SEQ ID NO: 1349408 - DNA, 12 bp, Homo sapiens
ccaaccttccca

SEQ ID NO: 1349409 - DNA, 17 bp, Homo sapiens
ccaacctttccctcacc

SEQ ID NO: 1349410 - DNA, 19 bp, Homo sapiens
ccaacctttccctcacccc

SEQ ID NO: 1349411 - DNA, 15 bp, Homo sapiens
ccaactccagcaact

SEQ ID NO: 1349412 - DNA, 23 bp, Homo sapiens
ccaacttgtattaaagacagagg

SEQ ID NO: 1349413 - DNA, 20 bp, Homo sapiens
ccaagaatgcaagatttcag

SEQ ID NO: 1349414 - DNA, 12 bp, Homo sapiens
ccaagaatgtac

SEQ ID NO: 1349415 - DNA, 19 bp, Homo sapiens
ccaagatttaaatgccata

SEQ ID NO: 1349416 - DNA, 18 bp, Homo sapiens
ccaagccaagggaacctg

SEQ ID NO: 1349417 - DNA, 22 bp, Homo sapiens
ccaagccaagggaacctgtgtc

SEQ ID NO: 1349418 - DNA, 19 bp, Homo sapiens
ccaagccagaggctgggtt

SEQ ID NO: 1349419 - DNA, 14 bp, Homo sapiens
ccaagcctccacag

SEQ ID NO: 1349420 - DNA, 16 bp, Homo sapiens
ccaagcctccacagcg

SEQ ID NO: 1349421 - DNA, 18 bp, Homo sapiens
ccaagcctccacagcgag

SEQ ID NO: 1349422 - DNA, 22 bp, Homo sapiens
ccaagggaaaggggtgctttta

SEQ ID NO: 1349423 - DNA, 19 bp, Homo sapiens
ccaagggaacctgtgtccg

SEQ ID NO: 1349424 - DNA, 18 bp, Homo sapiens
ccaagggccgactaagag

SEQ ID NO: 1349425 - DNA, 19 bp, Homo sapiens
ccaaggttttataaggctg

SEQ ID NO: 1349426 - DNA, 20 bp, Homo sapiens
ccaaggttttataaggctga

SEQ ID NO: 1349427 - DNA, 21 bp, Homo sapiens
ccaaggttttataaggctgat

SEQ ID NO: 1349428 - DNA, 20 bp, Homo sapiens
ccaagtcacacgcttttgaa

SEQ ID NO: 1349429 - DNA, 22 bp, Homo sapiens
ccaataataaatgccctcttct

SEQ ID NO: 1349430 - DNA, 23 bp, Homo sapiens
ccaataataaatgccctcttctc

SEQ ID NO: 1349431 - DNA, 19 bp, Homo sapiens
ccaatctattgcttcacca

SEQ ID NO: 1349432 - DNA, 21 bp, Homo sapiens
ccaatcttactttgtaaattc

SEQ ID NO: 1349433 - DNA, 20 bp, Homo sapiens
ccaatgggtttttccctgta

SEQ ID NO: 1349434 - DNA, 15 bp, Homo sapiens
ccaatgtaggagctg

SEQ ID NO: 1349435 - DNA, 20 bp, Homo sapiens
ccaatgttctctcttctcca

SEQ ID NO: 1349436 - DNA, 18 bp, Homo sapiens
ccacaaaggagagctagc

SEQ ID NO: 1349437 - DNA, 15 bp, Homo sapiens
ccacacccaaagctg

SEQ ID NO: 1349438 - DNA, 22 bp, Homo sapiens
ccacagcaacgatcacaaatga

SEQ ID NO: 1349439 - DNA, 15 bp, Homo sapiens
ccacagccagcacct

SEQ ID NO: 1349440 - DNA, 17 bp, Homo sapiens
ccacagccagcacctgg

SEQ ID NO: 1349441 - DNA, 18 bp, Homo sapiens
ccacagccagcacctggc

SEQ ID NO: 1349442 - DNA, 18 bp, Homo sapiens
ccacagcgccagcctcag

SEQ ID NO: 1349443 - DNA, 23 bp, Homo sapiens
ccacagcgccagcctcagactgg

SEQ ID NO: 1349444 - DNA, 17 bp, Homo sapiens
ccacagcgtccctggcg

SEQ ID NO: 1349445 - DNA, 14 bp, Homo sapiens
ccacagttgctcta

SEQ ID NO: 1349446 - DNA, 19 bp, Homo sapiens
ccacatccaactccagcaa

SEQ ID NO: 1349447 - DNA, 12 bp, Homo sapiens
ccacatctgcct

SEQ ID NO: 1349448 - DNA, 22 bp, Homo sapiens
ccacatctgccttaaaaccaaa

SEQ ID NO: 1349449 - DNA, 18 bp, Homo sapiens
ccacatggcggagagttt

SEQ ID NO: 1349450 - DNA, 13 bp, Homo sapiens
ccacatgtccagc

SEQ ID NO: 1349451 - DNA, 16 bp, Homo sapiens
ccacattgaagaatgt

SEQ ID NO: 1349452 - DNA, 14 bp, Homo sapiens
ccaccaaaaacaaa

SEQ ID NO: 1349453 - DNA, 14 bp, Homo sapiens
ccaccaaagctgcc

SEQ ID NO: 1349454 - DNA, 18 bp, Homo sapiens
ccaccacagccagcacct

SEQ ID NO: 1349455 - DNA, 19 bp, Homo sapiens
ccaccaggccacctcccca

SEQ ID NO: 1349456 - DNA, 18 bp, Homo sapiens
ccaccatcaccagacagg

SEQ ID NO: 1349457 - DNA, 16 bp, Homo sapiens
ccaccatgcctcacta

SEQ ID NO: 1349458 - DNA, 13 bp, Homo sapiens
ccacccaacccta

SEQ ID NO: 1349459 - DNA, 21 bp, Homo sapiens
ccacccaaccctatctcctga

SEQ ID NO: 1349460 - DNA, 16 bp, Homo sapiens
ccacccaggaggcagg

SEQ ID NO: 1349461 - DNA, 12 bp, Homo sapiens
ccaccccaacat

SEQ ID NO: 1349462 - DNA, 12 bp, Homo sapiens
ccaccccaggac

SEQ ID NO: 1349463 - DNA, 13 bp, Homo sapiens
ccaccccaggacg

SEQ ID NO: 1349464 - DNA, 16 bp, Homo sapiens
ccacccccagccccga

SEQ ID NO: 1349465 - DNA, 18 bp, Homo sapiens
ccaccccctgccctgcac

SEQ ID NO: 1349466 - DNA, 15 bp, Homo sapiens
ccaccccggccccct

SEQ ID NO: 1349467 - DNA, 19 bp, Homo sapiens
ccaccccggggaccctgtg

SEQ ID NO: 1349468 - DNA, 21 bp, Homo sapiens
ccaccctagccaatgtctcct

SEQ ID NO: 1349469 - DNA, 18 bp, Homo sapiens
ccaccctgaaagccctga

SEQ ID NO: 1349470 - DNA, 15 bp, Homo sapiens
ccaccctgagccggc

SEQ ID NO: 1349471 - DNA, 21 bp, Homo sapiens
ccaccctgagccggccccagg

SEQ ID NO: 1349472 - DNA, 22 bp, Homo sapiens
ccaccctgagccggccccaggc

SEQ ID NO: 1349473 - DNA, 15 bp, Homo sapiens
ccaccctgctgctgg

SEQ ID NO: 1349474 - DNA, 16 bp, Homo sapiens
ccaccctgggccctgg

SEQ ID NO: 1349475 - DNA, 17 bp, Homo sapiens
ccaccctgggccctggg

SEQ ID NO: 1349476 - DNA, 20 bp, Homo sapiens
ccaccctttcccccttctct

SEQ ID NO: 1349477 - DNA, 14 bp, Homo sapiens
ccaccgcgggtgtg

SEQ ID NO: 1349478 - DNA, 14 bp, Homo sapiens
ccacctcggtcact

SEQ ID NO: 1349479 - DNA, 24 bp, Homo sapiens
ccacctttggaaagctctgaccac

SEQ ID NO: 1349480 - DNA, 18 bp, Homo sapiens
ccacgaatttctgtgccc

SEQ ID NO: 1349481 - DNA, 15 bp, Homo sapiens
ccacgcccgtcctgc

SEQ ID NO: 1349482 - DNA, 18 bp, Homo sapiens
ccacgcccgtcctgcctg

SEQ ID NO: 1349483 - DNA, 23 bp, Homo sapiens
ccacgcccgtcctgcctgtggcg

SEQ ID NO: 1349484 - DNA, 17 bp, Homo sapiens
ccacgcctgtaatccca

SEQ ID NO: 1349485 - DNA, 20 bp, Homo sapiens
ccacgcgtgccgtggcacca

SEQ ID NO: 1349486 - DNA, 17 bp, Homo sapiens
ccacgcttctccggatc

SEQ ID NO: 1349487 - DNA, 20 bp, Homo sapiens
ccacgttggagaagcccgtg

SEQ ID NO: 1349488 - DNA, 21 bp, Homo sapiens
ccactaagaattcaaactggg

SEQ ID NO: 1349489 - DNA, 16 bp, Homo sapiens
ccactacacctggctg

SEQ ID NO: 1349490 - DNA, 18 bp, Homo sapiens
ccactcactaggccccca

SEQ ID NO: 1349491 - DNA, 13 bp, Homo sapiens
ccactcatttcat

SEQ ID NO: 1349492 - DNA, 14 bp, Homo sapiens
ccactcatttcatc

SEQ ID NO: 1349493 - DNA, 20 bp, Homo sapiens
ccactccgagaggtgggcca

SEQ ID NO: 1349494 - DNA, 19 bp, Homo sapiens
ccactctgcttctctgact

SEQ ID NO: 1349495 - DNA, 18 bp, Homo sapiens
ccactgcactccagcctg

SEQ ID NO: 1349496 - DNA, 23 bp, Homo sapiens
ccactgcatcgtttcatcttcca

SEQ ID NO: 1349497 - DNA, 15 bp, Homo sapiens
ccactgccagcagca

SEQ ID NO: 1349498 - DNA, 12 bp, Homo sapiens
ccactgccttcg

SEQ ID NO: 1349499 - DNA, 22 bp, Homo sapiens
ccactgccttcgcttcttgcct

SEQ ID NO: 1349500 - DNA, 23 bp, Homo sapiens
ccactgccttcgcttcttgcctc

SEQ ID NO: 1349501 - DNA, 17 bp, Homo sapiens
ccactgtttctcttgag

SEQ ID NO: 1349502 - DNA, 19 bp, Homo sapiens
ccactgtttctcttgagct

SEQ ID NO: 1349503 - DNA, 13 bp, Homo sapiens
ccacttgaggcct

SEQ ID NO: 1349504 - DNA, 22 bp, Homo sapiens
ccacttgaggcctgatctgccc

SEQ ID NO: 1349505 - DNA, 24 bp, Homo sapiens
ccacttgaggcctgatctgcccat

SEQ ID NO: 1349506 - DNA, 18 bp, Homo sapiens
ccacttgtagatttgatt

SEQ ID NO: 1349507 - DNA, 16 bp, Homo sapiens
ccactttgctgttcct

SEQ ID NO: 1349508 - DNA, 21 bp, Homo sapiens
ccagaataagttattgcagtt

SEQ ID NO: 1349509 - DNA, 21 bp, Homo sapiens
ccagaatactgatggaatttt

SEQ ID NO: 1349510 - DNA, 15 bp, Homo sapiens
ccagaccagattaaa

SEQ ID NO: 1349511 - DNA, 12 bp, Homo sapiens
ccagacctggaa

SEQ ID NO: 1349512 - DNA, 16 bp, Homo sapiens
ccagactcagagctct

SEQ ID NO: 1349513 - DNA, 14 bp, Homo sapiens
ccagacttccttga

SEQ ID NO: 1349514 - DNA, 22 bp, Homo sapiens
ccagagagcctggtgctgctgc

SEQ ID NO: 1349515 - DNA, 18 bp, Homo sapiens
ccagaggaatcctggcag

SEQ ID NO: 1349516 - DNA, 23 bp, Homo sapiens
ccagaggaatcctggcagcccag

SEQ ID NO: 1349517 - DNA, 15 bp, Homo sapiens
ccagaggagcctttt

SEQ ID NO: 1349518 - DNA, 19 bp, Homo sapiens
ccagaggttgtgcactgtt

SEQ ID NO: 1349519 - DNA, 16 bp, Homo sapiens
ccagatcactgccaca

SEQ ID NO: 1349520 - DNA, 20 bp, Homo sapiens
ccagatcactgccacactct

SEQ ID NO: 1349521 - DNA, 16 bp, Homo sapiens
ccagatctttcagaaa

SEQ ID NO: 1349522 - DNA, 16 bp, Homo sapiens
ccagatggtcatccag

SEQ ID NO: 1349523 - DNA, 18 bp, Homo sapiens
ccagatggtcatccagac

SEQ ID NO: 1349524 - DNA, 12 bp, Homo sapiens
ccagatttgtct

SEQ ID NO: 1349525 - DNA, 14 bp, Homo sapiens
ccagcaacacagcc

SEQ ID NO: 1349526 - DNA, 22 bp, Homo sapiens
ccagcaacacagcctgggcccc

SEQ ID NO: 1349527 - DNA, 14 bp, Homo sapiens
ccagcaccttgtgc

SEQ ID NO: 1349528 - DNA, 16 bp, Homo sapiens
ccagcaccttgtgcct

SEQ ID NO: 1349529 - DNA, 17 bp, Homo sapiens
ccagcactttgggaggc

SEQ ID NO: 1349530 - DNA, 15 bp, Homo sapiens
ccagcagcagcaggt

SEQ ID NO: 1349531 - DNA, 18 bp, Homo sapiens
ccagcagcagcaggtgat

SEQ ID NO: 1349532 - DNA, 11 bp, Homo sapiens
ccagcagcctg

SEQ ID NO: 1349533 - DNA, 12 bp, Homo sapiens
ccagcagcctgg

SEQ ID NO: 1349534 - DNA, 15 bp, Homo sapiens
ccagcagcctggacc

SEQ ID NO: 1349535 - DNA, 21 bp, Homo sapiens
ccagcattccagcccctctgg

SEQ ID NO: 1349536 - DNA, 19 bp, Homo sapiens
ccagcatttagctggccac

SEQ ID NO: 1349537 - DNA, 15 bp, Homo sapiens
ccagccaaagcctcc

SEQ ID NO: 1349538 - DNA, 18 bp, Homo sapiens
ccagccaaagcctcctcc

SEQ ID NO: 1349539 - DNA, 19 bp, Homo sapiens
ccagccaaagcctcctcca

SEQ ID NO: 1349540 - DNA, 17 bp, Homo sapiens
ccagccaactctgggaa

SEQ ID NO: 1349541 - DNA, 12 bp, Homo sapiens
ccagccagcgcc

SEQ ID NO: 1349542 - DNA, 13 bp, Homo sapiens
ccagccagcgcct

SEQ ID NO: 1349543 - DNA, 14 bp, Homo sapiens
ccagccatgccagc

SEQ ID NO: 1349544 - DNA, 16 bp, Homo sapiens
ccagccatgccagctg

SEQ ID NO: 1349545 - DNA, 17 bp, Homo sapiens
ccagccatgccagctgg

SEQ ID NO: 1349546 - DNA, 14 bp, Homo sapiens
ccagcccagggctc

SEQ ID NO: 1349547 - DNA, 15 bp, Homo sapiens
ccagccccgactcca

SEQ ID NO: 1349548 - DNA, 17 bp, Homo sapiens
ccagccccgactccagc

SEQ ID NO: 1349549 - DNA, 20 bp, Homo sapiens
ccagccccgactccagccag

SEQ ID NO: 1349550 - DNA, 14 bp, Homo sapiens
ccagcccctctggt

SEQ ID NO: 1349551 - DNA, 22 bp, Homo sapiens
ccagcccctctggtcgctcctg

SEQ ID NO: 1349552 - DNA, 13 bp, Homo sapiens
ccagccctgctgg

SEQ ID NO: 1349553 - DNA, 16 bp, Homo sapiens
ccagcctcagactgga

SEQ ID NO: 1349554 - DNA, 12 bp, Homo sapiens
ccagcctcagcg

SEQ ID NO: 1349555 - DNA, 13 bp, Homo sapiens
ccagcctcagcgc

SEQ ID NO: 1349556 - DNA, 18 bp, Homo sapiens
ccagcctccgagagggag

SEQ ID NO: 1349557 - DNA, 19 bp, Homo sapiens
ccagcctccgagagggaga

SEQ ID NO: 1349558 - DNA, 23 bp, Homo sapiens
ccagcctcctctggacggcaggc

SEQ ID NO: 1349559 - DNA, 14 bp, Homo sapiens
ccagcctgcgcctg

SEQ ID NO: 1349560 - DNA, 19 bp, Homo sapiens
ccagcctgctagctagctc

SEQ ID NO: 1349561 - DNA, 21 bp, Homo sapiens
ccagcctggggctgaggctga

SEQ ID NO: 1349562 - DNA, 17 bp, Homo sapiens
ccagccttgagccctgg

SEQ ID NO: 1349563 - DNA, 19 bp, Homo sapiens
ccagccttgagccctggct

SEQ ID NO: 1349564 - DNA, 20 bp, Homo sapiens
ccagccttgagccctggctg

SEQ ID NO: 1349565 - DNA, 20 bp, Homo sapiens
ccagcgatctctccactgtg

SEQ ID NO: 1349566 - DNA, 15 bp, Homo sapiens
ccagcgcctccctcc

SEQ ID NO: 1349567 - DNA, 20 bp, Homo sapiens
ccagcgcctccctccacccc

SEQ ID NO: 1349568 - DNA, 22 bp, Homo sapiens
ccagcgcctccctccaccccag

SEQ ID NO: 1349569 - DNA, 16 bp, Homo sapiens
ccagctacttgggagg

SEQ ID NO: 1349570 - DNA, 21 bp, Homo sapiens
ccagctctgccgtctctggag

SEQ ID NO: 1349571 - DNA, 22 bp, Homo sapiens
ccagctctgccgtctctggagc

SEQ ID NO: 1349572 - DNA, 19 bp, Homo sapiens
ccagctctggaggggaggg

SEQ ID NO: 1349573 - DNA, 17 bp, Homo sapiens
ccagctgcccttccgca

SEQ ID NO: 1349574 - DNA, 19 bp, Homo sapiens
ccagctgcgcttgcttttc

SEQ ID NO: 1349575 - DNA, 15 bp, Homo sapiens
ccagctggcctggac

SEQ ID NO: 1349576 - DNA, 14 bp, Homo sapiens
ccagcttggggcca

SEQ ID NO: 1349577 - DNA, 19 bp, Homo sapiens
ccaggaaactccacatctg

SEQ ID NO: 1349578 - DNA, 20 bp, Homo sapiens
ccaggaaactccacatctgc

SEQ ID NO: 1349579 - DNA, 18 bp, Homo sapiens
ccaggaagcccaggagcc

SEQ ID NO: 1349580 - DNA, 16 bp, Homo sapiens
ccaggaagccgtcctg

SEQ ID NO: 1349581 - DNA, 15 bp, Homo sapiens
ccaggacgccactca

SEQ ID NO: 1349582 - DNA, 15 bp, Homo sapiens
ccaggagcaggcacg

SEQ ID NO: 1349583 - DNA, 16 bp, Homo sapiens
ccaggagcaggcacgg

SEQ ID NO: 1349584 - DNA, 22 bp, Homo sapiens
ccaggcagcctctgtcaggcct

SEQ ID NO: 1349585 - DNA, 22 bp, Homo sapiens
ccaggcaggggtgggggtggag

SEQ ID NO: 1349586 - DNA, 21 bp, Homo sapiens
ccaggccacctccccagcatt

SEQ ID NO: 1349587 - DNA, 14 bp, Homo sapiens
ccaggccagcctcc

SEQ ID NO: 1349588 - DNA, 20 bp, Homo sapiens
ccaggccagcctccgagagg

SEQ ID NO: 1349589 - DNA, 23 bp, Homo sapiens
ccaggccagcctccgagagggag

SEQ ID NO: 1349590 - DNA, 19 bp, Homo sapiens
ccaggctatgtataaaata

SEQ ID NO: 1349591 - DNA, 20 bp, Homo sapiens
ccaggctcactcacagagtc

SEQ ID NO: 1349592 - DNA, 23 bp, Homo sapiens
ccaggctcgtggactgagtggga

SEQ ID NO: 1349593 - DNA, 15 bp, Homo sapiens
ccaggctgccgtggg

SEQ ID NO: 1349594 - DNA, 13 bp, Homo sapiens
ccaggctgcctcc

SEQ ID NO: 1349595 - DNA, 15 bp, Homo sapiens
ccagggaatccaagc

SEQ ID NO: 1349596 - DNA, 21 bp, Homo sapiens
ccagggaatccaagcctccac

SEQ ID NO: 1349597 - DNA, 14 bp, Homo sapiens
ccagggaggggccg

SEQ ID NO: 1349598 - DNA, 20 bp, Homo sapiens
ccagggcaagctccgcagga

SEQ ID NO: 1349599 - DNA, 20 bp, Homo sapiens
ccagggccttttctggcacc

SEQ ID NO: 1349600 - DNA, 20 bp, Homo sapiens
ccagggctcctgcacttact

SEQ ID NO: 1349601 - DNA, 19 bp, Homo sapiens
ccaggggaaaatcagcctg

SEQ ID NO: 1349602 - DNA, 17 bp, Homo sapiens
ccaggggtctccctggc

SEQ ID NO: 1349603 - DNA, 18 bp, Homo sapiens
ccaggggtctccctggct

SEQ ID NO: 1349604 - DNA, 21 bp, Homo sapiens
ccaggggtctccctggctccc

SEQ ID NO: 1349605 - DNA, 16 bp, Homo sapiens
ccagggtccctctgtg

SEQ ID NO: 1349606 - DNA, 17 bp, Homo sapiens
ccagggtccctctgtgt

SEQ ID NO: 1349607 - DNA, 13 bp, Homo sapiens
ccaggtagaaact

SEQ ID NO: 1349608 - DNA, 13 bp, Homo sapiens
ccaggtccagctc

SEQ ID NO: 1349609 - DNA, 19 bp, Homo sapiens
ccaggtccagctctggagg

SEQ ID NO: 1349610 - DNA, 23 bp, Homo sapiens
ccaggtgcagaggtaccctgggt

SEQ ID NO: 1349611 - DNA, 22 bp, Homo sapiens
ccagtagaccttgttacttctg

SEQ ID NO: 1349612 - DNA, 15 bp, Homo sapiens
ccagtccaggctgcc

SEQ ID NO: 1349613 - DNA, 17 bp, Homo sapiens
ccagtccccacccctgc

SEQ ID NO: 1349614 - DNA, 19 bp, Homo sapiens
ccagtccccacccctgccc

SEQ ID NO: 1349615 - DNA, 21 bp, Homo sapiens
ccagtccccacccctgccccc

SEQ ID NO: 1349616 - DNA, 12 bp, Homo sapiens
ccagtctgtgga

SEQ ID NO: 1349617 - DNA, 13 bp, Homo sapiens
ccagtctgtggat

SEQ ID NO: 1349618 - DNA, 15 bp, Homo sapiens
ccagtgaagatattt

SEQ ID NO: 1349619 - DNA, 14 bp, Homo sapiens
ccagtgcaaatgca

SEQ ID NO: 1349620 - DNA, 15 bp, Homo sapiens
ccagtgcatggtggc

SEQ ID NO: 1349621 - DNA, 18 bp, Homo sapiens
ccagtgcatggtggccag

SEQ ID NO: 1349622 - DNA, 21 bp, Homo sapiens
ccagtgtttgggatgaccagg

SEQ ID NO: 1349623 - DNA, 19 bp, Homo sapiens
ccagttaaaatgtgtttct

SEQ ID NO: 1349624 - DNA, 16 bp, Homo sapiens
ccatagagtacactgc

SEQ ID NO: 1349625 - DNA, 22 bp, Homo sapiens
ccatagagtacactgcctgcct

SEQ ID NO: 1349626 - DNA, 18 bp, Homo sapiens
ccatagtttggcatttgc

SEQ ID NO: 1349627 - DNA, 16 bp, Homo sapiens
ccatcccctgtagagt

SEQ ID NO: 1349628 - DNA, 12 bp, Homo sapiens
ccatcctgactg

SEQ ID NO: 1349629 - DNA, 17 bp, Homo sapiens
ccatcgtgaagaagcct

SEQ ID NO: 1349630 - DNA, 14 bp, Homo sapiens
ccatctagccagcc

SEQ ID NO: 1349631 - DNA, 23 bp, Homo sapiens
ccatctagccagcccctcttccc

SEQ ID NO: 1349632 - DNA, 21 bp, Homo sapiens
ccatctaggggagccttgatt

SEQ ID NO: 1349633 - DNA, 16 bp, Homo sapiens
ccatctccctgcctgg

SEQ ID NO: 1349634 - DNA, 17 bp, Homo sapiens
ccatctgcaccccttct

SEQ ID NO: 1349635 - DNA, 20 bp, Homo sapiens
ccatctgcaccccttctctc

SEQ ID NO: 1349636 - DNA, 16 bp, Homo sapiens
ccatctgccccacagt

SEQ ID NO: 1349637 - DNA, 20 bp, Homo sapiens
ccatctgccccacagtctcc

SEQ ID NO: 1349638 - DNA, 18 bp, Homo sapiens
ccatgaagggaccctttg

SEQ ID NO: 1349639 - DNA, 20 bp, Homo sapiens
ccatgacaatgttgtagtgt

SEQ ID NO: 1349640 - DNA, 19 bp, Homo sapiens
ccatgattaaccacttcag

SEQ ID NO: 1349641 - DNA, 16 bp, Homo sapiens
ccatgcaagcagagga

SEQ ID NO: 1349642 - DNA, 20 bp, Homo sapiens
ccatgcaagcagaggaccag

SEQ ID NO: 1349643 - DNA, 14 bp, Homo sapiens
ccatgccagctggc

SEQ ID NO: 1349644 - DNA, 20 bp, Homo sapiens
ccatgcgccccctccgccct

SEQ ID NO: 1349645 - DNA, 19 bp, Homo sapiens
ccatgctgaggcctgggcc

SEQ ID NO: 1349646 - DNA, 14 bp, Homo sapiens
ccatggagccagct

SEQ ID NO: 1349647 - DNA, 18 bp, Homo sapiens
ccatggagccagctccct

SEQ ID NO: 1349648 - DNA, 15 bp, Homo sapiens
ccatgtaagcactct

SEQ ID NO: 1349649 - DNA, 22 bp, Homo sapiens
ccatgtagccccctggcctctg

SEQ ID NO: 1349650 - DNA, 23 bp, Homo sapiens
ccatgtagccccctggcctctgt

SEQ ID NO: 1349651 - DNA, 17 bp, Homo sapiens
ccatgtccaaagaggct

SEQ ID NO: 1349652 - DNA, 20 bp, Homo sapiens
ccatgtgatggacactccag

SEQ ID NO: 1349653 - DNA, 18 bp, Homo sapiens
ccatgttttgtttacggt

SEQ ID NO: 1349654 - DNA, 15 bp, Homo sapiens
ccattaaagttctca

SEQ ID NO: 1349655 - DNA, 15 bp, Homo sapiens
ccattaaggggaaga

SEQ ID NO: 1349656 - DNA, 21 bp, Homo sapiens
ccattcgtacataatactgaa

SEQ ID NO: 1349657 - DNA, 11 bp, Homo sapiens
ccattctccca

SEQ ID NO: 1349658 - DNA, 12 bp, Homo sapiens
ccattctcccag

SEQ ID NO: 1349659 - DNA, 13 bp, Homo sapiens
ccattctcccagg

SEQ ID NO: 1349660 - DNA, 15 bp, Homo sapiens
ccattctcccaggta

SEQ ID NO: 1349661 - DNA, 13 bp, Homo sapiens
ccattctgactcg

SEQ ID NO: 1349662 - DNA, 20 bp, Homo sapiens
ccattctgactcggtttctc

SEQ ID NO: 1349663 - DNA, 22 bp, Homo sapiens
ccattctgccgccccctcctga

SEQ ID NO: 1349664 - DNA, 22 bp, Homo sapiens
ccattgagaccgtgaagatact

SEQ ID NO: 1349665 - DNA, 16 bp, Homo sapiens
ccatttcccatctgca

SEQ ID NO: 1349666 - DNA, 22 bp, Homo sapiens
ccatttgctcttcagatgccac

SEQ ID NO: 1349667 - DNA, 19 bp, Homo sapiens
cccaaacccaagtgccttc

SEQ ID NO: 1349668 - DNA, 21 bp, Homo sapiens
cccaaagatagacaggtcctg

SEQ ID NO: 1349669 - DNA, 14 bp, Homo sapiens
cccaaatcaataca

SEQ ID NO: 1349670 - DNA, 16 bp, Homo sapiens
cccaacctttccctca

SEQ ID NO: 1349671 - DNA, 24 bp, Homo sapiens
cccaagagaactcgcgctcagtaa

SEQ ID NO: 1349672 - DNA, 14 bp, Homo sapiens
cccaagccagaggc

SEQ ID NO: 1349673 - DNA, 15 bp, Homo sapiens
cccaagccagaggct

SEQ ID NO: 1349674 - DNA, 16 bp, Homo sapiens
cccaagccagaggctg

SEQ ID NO: 1349675 - DNA, 16 bp, Homo sapiens
cccaaggctggcaggt

SEQ ID NO: 1349676 - DNA, 17 bp, Homo sapiens
cccacagcgtccctggc

SEQ ID NO: 1349677 - DNA, 15 bp, Homo sapiens
cccacatgtccagca

SEQ ID NO: 1349678 - DNA, 16 bp, Homo sapiens
cccaccccctgccctg

SEQ ID NO: 1349679 - DNA, 16 bp, Homo sapiens
cccacccctgccccca

SEQ ID NO: 1349680 - DNA, 15 bp, Homo sapiens
cccaccctgctgctg

SEQ ID NO: 1349681 - DNA, 14 bp, Homo sapiens
cccacctgccggcc

SEQ ID NO: 1349682 - DNA, 20 bp, Homo sapiens
cccacggagtcgtggggtgt

SEQ ID NO: 1349683 - DNA, 19 bp, Homo sapiens
cccactcccttgctggccc

SEQ ID NO: 1349684 - DNA, 14 bp, Homo sapiens
cccactgccagcag

SEQ ID NO: 1349685 - DNA, 21 bp, Homo sapiens
cccactgtttctcttgagctg

SEQ ID NO: 1349686 - DNA, 14 bp, Homo sapiens
cccagaatactgat

SEQ ID NO: 1349687 - DNA, 21 bp, Homo sapiens
cccagagactttgtagatcct

SEQ ID NO: 1349688 - DNA, 18 bp, Homo sapiens
cccagcacagcttgacct

SEQ ID NO: 1349689 - DNA, 19 bp, Homo sapiens
cccagcacagcttgacctg

SEQ ID NO: 1349690 - DNA, 17 bp, Homo sapiens
cccagcacctcagcctg

SEQ ID NO: 1349691 - DNA, 17 bp, Homo sapiens
cccagcactttgggagg

SEQ ID NO: 1349692 - DNA, 23 bp, Homo sapiens
cccagcactttgggaggccgagg

SEQ ID NO: 1349693 - DNA, 18 bp, Homo sapiens
cccagcccagggctcctg

SEQ ID NO: 1349694 - DNA, 15 bp, Homo sapiens
cccagccccggggtg

SEQ ID NO: 1349695 - DNA, 17 bp, Homo sapiens
cccagccctgctgggga

SEQ ID NO: 1349696 - DNA, 19 bp, Homo sapiens
cccagcctgcgcctgctgc

SEQ ID NO: 1349697 - DNA, 16 bp, Homo sapiens
cccagcctgctagcta

SEQ ID NO: 1349698 - DNA, 21 bp, Homo sapiens
cccagcctgctagctagctca

SEQ ID NO: 1349699 - DNA, 15 bp, Homo sapiens
cccagcgtggcctcc

SEQ ID NO: 1349700 - DNA, 16 bp, Homo sapiens
cccagctcgcgggacc

SEQ ID NO: 1349701 - DNA, 22 bp, Homo sapiens
cccagcttaaaggggctagagt

SEQ ID NO: 1349702 - DNA, 14 bp, Homo sapiens
cccaggaagcccag

SEQ ID NO: 1349703 - DNA, 15 bp, Homo sapiens
cccaggaagcccagg

SEQ ID NO: 1349704 - DNA, 14 bp, Homo sapiens
cccaggagcctcac

SEQ ID NO: 1349705 - DNA, 15 bp, Homo sapiens
cccaggaggcaggga

SEQ ID NO: 1349706 - DNA, 22 bp, Homo sapiens
cccaggaggcagggaggcagcc

SEQ ID NO: 1349707 - DNA, 12 bp, Homo sapiens
cccaggcaggga

SEQ ID NO: 1349708 - DNA, 17 bp, Homo sapiens
cccaggcagggagacgg

SEQ ID NO: 1349709 - DNA, 19 bp, Homo sapiens
cccaggctggagtgcagtg

SEQ ID NO: 1349710 - DNA, 15 bp, Homo sapiens
cccagggctcctgca

SEQ ID NO: 1349711 - DNA, 19 bp, Homo sapiens
cccaggggtctccctggct

SEQ ID NO: 1349712 - DNA, 15 bp, Homo sapiens
cccaggtaccagctg

SEQ ID NO: 1349713 - DNA, 17 bp, Homo sapiens
cccaggtaccagctgcg

SEQ ID NO: 1349714 - DNA, 19 bp, Homo sapiens
cccaggtaccagctgcgct

SEQ ID NO: 1349715 - DNA, 13 bp, Homo sapiens
cccagtccccacc

SEQ ID NO: 1349716 - DNA, 14 bp, Homo sapiens
cccagtccccaccc

SEQ ID NO: 1349717 - DNA, 21 bp, Homo sapiens
cccagtccccacccctgcccc

SEQ ID NO: 1349718 - DNA, 17 bp, Homo sapiens
cccagtgcaaatgcatg

SEQ ID NO: 1349719 - DNA, 11 bp, Homo sapiens
cccagtgcaga

SEQ ID NO: 1349720 - DNA, 17 bp, Homo sapiens
cccagtgcagaatgtaa

SEQ ID NO: 1349721 - DNA, 14 bp, Homo sapiens
cccagtgcatggtg

SEQ ID NO: 1349722 - DNA, 19 bp, Homo sapiens
cccagtgcatggtggccag

SEQ ID NO: 1349723 - DNA, 17 bp, Homo sapiens
cccagtgccgagaagga

SEQ ID NO: 1349724 - DNA, 20 bp, Homo sapiens
cccatccagtctcccaactt

SEQ ID NO: 1349725 - DNA, 18 bp, Homo sapiens
cccatcgtgaagaagcct

SEQ ID NO: 1349726 - DNA, 14 bp, Homo sapiens
cccatctccctgcc

SEQ ID NO: 1349727 - DNA, 20 bp, Homo sapiens
cccatctccctgcctggccc

SEQ ID NO: 1349728 - DNA, 20 bp, Homo sapiens
cccatctgccccacagtctc

SEQ ID NO: 1349729 - DNA, 16 bp, Homo sapiens
cccatgcaagcagagg

SEQ ID NO: 1349730 - DNA, 19 bp, Homo sapiens
cccatggggagggattctg

SEQ ID NO: 1349731 - DNA, 23 bp, Homo sapiens
cccatgggttgtgtgtttatttc

SEQ ID NO: 1349732 - DNA, 14 bp, Homo sapiens
cccatgtagccccc

SEQ ID NO: 1349733 - DNA, 14 bp, Homo sapiens
ccccaaaacccggg

SEQ ID NO: 1349734 - DNA, 13 bp, Homo sapiens
ccccaaacagtga

SEQ ID NO: 1349735 - DNA, 22 bp, Homo sapiens
ccccaaagatagacaggtcctg

SEQ ID NO: 1349736 - DNA, 13 bp, Homo sapiens
ccccaacctcagg

SEQ ID NO: 1349737 - DNA, 19 bp, Homo sapiens
ccccaacctttccctcacc

SEQ ID NO: 1349738 - DNA, 19 bp, Homo sapiens
ccccaccccggggaccctg

SEQ ID NO: 1349739 - DNA, 20 bp, Homo sapiens
ccccaccctgggccctgggc

SEQ ID NO: 1349740 - DNA, 21 bp, Homo sapiens
ccccactcccttgctggcccc

SEQ ID NO: 1349741 - DNA, 15 bp, Homo sapiens
ccccactgccagcag

SEQ ID NO: 1349742 - DNA, 13 bp, Homo sapiens
ccccacttgcctc

SEQ ID NO: 1349743 - DNA, 18 bp, Homo sapiens
ccccagcacctcagcctg

SEQ ID NO: 1349744 - DNA, 17 bp, Homo sapiens
ccccagccatccagggg

SEQ ID NO: 1349745 - DNA, 12 bp, Homo sapiens
ccccagcccagg

SEQ ID NO: 1349746 - DNA, 21 bp, Homo sapiens
ccccagcccagggctcctgca

SEQ ID NO: 1349747 - DNA, 17 bp, Homo sapiens
ccccagccccgactcca

SEQ ID NO: 1349748 - DNA, 18 bp, Homo sapiens
ccccagccccgactccag

SEQ ID NO: 1349749 - DNA, 19 bp, Homo sapiens
ccccagccccgactccagc

SEQ ID NO: 1349750 - DNA, 20 bp, Homo sapiens
ccccagccctaatctcaccc

SEQ ID NO: 1349751 - DNA, 17 bp, Homo sapiens
ccccagccctgctgggg

SEQ ID NO: 1349752 - DNA, 10 bp, Homo sapiens
ccccagcctg

SEQ ID NO: 1349753 - DNA, 13 bp, Homo sapiens
ccccagcctgcta

SEQ ID NO: 1349754 - DNA, 17 bp, Homo sapiens
ccccaggtccagctctg

SEQ ID NO: 1349755 - DNA, 22 bp, Homo sapiens
ccccaggtggttatggagaggg

SEQ ID NO: 1349756 - DNA, 14 bp, Homo sapiens
ccccatctccctgc

SEQ ID NO: 1349757 - DNA, 14 bp, Homo sapiens
ccccatcttgcttc

SEQ ID NO: 1349758 - DNA, 17 bp, Homo sapiens
ccccatgcttccttgcc

SEQ ID NO: 1349759 - DNA, 18 bp, Homo sapiens
ccccatttcccatctgca

SEQ ID NO: 1349760 - DNA, 18 bp, Homo sapiens
cccccaccggtccagctg

SEQ ID NO: 1349761 - DNA, 13 bp, Homo sapiens
cccccagcccagg

SEQ ID NO: 1349762 - DNA, 23 bp, Homo sapiens
cccccagccccgactccagccag

SEQ ID NO: 1349763 - DNA, 17 bp, Homo sapiens
cccccgtggggcaggga

SEQ ID NO: 1349764 - DNA, 13 bp, Homo sapiens
ccccgactccagc

SEQ ID NO: 1349765 - DNA, 15 bp, Homo sapiens
ccccgactccagcca

SEQ ID NO: 1349766 - DNA, 17 bp, Homo sapiens
ccccgcctggccaggag

SEQ ID NO: 1349767 - DNA, 15 bp, Homo sapiens
ccccggagggctgcg

SEQ ID NO: 1349768 - DNA, 21 bp, Homo sapiens
ccccggcatgagactcagtgc

SEQ ID NO: 1349769 - DNA, 16 bp, Homo sapiens
ccccggggaccctgtg

SEQ ID NO: 1349770 - DNA, 20 bp, Homo sapiens
ccccggtggcggccccagca

SEQ ID NO: 1349771 - DNA, 17 bp, Homo sapiens
cccctaccaatattagg

SEQ ID NO: 1349772 - DNA, 17 bp, Homo sapiens
cccctagccggttcctg

SEQ ID NO: 1349773 - DNA, 19 bp, Homo sapiens
cccctagccggttcctgtc

SEQ ID NO: 1349774 - DNA, 16 bp, Homo sapiens
cccctcaacacctctg

SEQ ID NO: 1349775 - DNA, 12 bp, Homo sapiens
cccctgccccca

SEQ ID NO: 1349776 - DNA, 13 bp, Homo sapiens
cccctgcttcagt

SEQ ID NO: 1349777 - DNA, 23 bp, Homo sapiens
cccctggccgcgctccgggcttt

SEQ ID NO: 1349778 - DNA, 14 bp, Homo sapiens
cccctggcctctgt

SEQ ID NO: 1349779 - DNA, 19 bp, Homo sapiens
cccctgggcttggcctgct

SEQ ID NO: 1349780 - DNA, 23 bp, Homo sapiens
cccctgggcttggcctgctgtga

SEQ ID NO: 1349781 - DNA, 14 bp, Homo sapiens
ccccttctctcctc

SEQ ID NO: 1349782 - DNA, 19 bp, Homo sapiens
ccccttctctcctccccaa

SEQ ID NO: 1349783 - DNA, 17 bp, Homo sapiens
cccgactccagccagcg

SEQ ID NO: 1349784 - DNA, 13 bp, Homo sapiens
cccgcagccctgg

SEQ ID NO: 1349785 - DNA, 22 bp, Homo sapiens
cccgcggggctgtcggcgctgc

SEQ ID NO: 1349786 - DNA, 16 bp, Homo sapiens
cccggcagggtcctag

SEQ ID NO: 1349787 - DNA, 20 bp, Homo sapiens
cccggctctacgggggccgc

SEQ ID NO: 1349788 - DNA, 11 bp, Homo sapiens
cccgggcccca

SEQ ID NO: 1349789 - DNA, 18 bp, Homo sapiens
cccggggaccctgtgaca

SEQ ID NO: 1349790 - DNA, 21 bp, Homo sapiens
cccggggaccctgtgacatgg

SEQ ID NO: 1349791 - DNA, 15 bp, Homo sapiens
cccggggcccagggc

SEQ ID NO: 1349792 - DNA, 20 bp, Homo sapiens
cccggtgggacccccgtggg

SEQ ID NO: 1349793 - DNA, 16 bp, Homo sapiens
cccgtcctgcctgtgg

SEQ ID NO: 1349794 - DNA, 14 bp, Homo sapiens
cccgtgggctcccg

SEQ ID NO: 1349795 - DNA, 20 bp, Homo sapiens
ccctaaaagcactcctgctt

SEQ ID NO: 1349796 - DNA, 21 bp, Homo sapiens
ccctaaccccttccagatcac

SEQ ID NO: 1349797 - DNA, 20 bp, Homo sapiens
ccctagcagcccaccctgct

SEQ ID NO: 1349798 - DNA, 23 bp, Homo sapiens
ccctagccggttcctgtccctgc

SEQ ID NO: 1349799 - DNA, 14 bp, Homo sapiens
ccctatctcctgac

SEQ ID NO: 1349800 - DNA, 16 bp, Homo sapiens
ccctatctcctgacag

SEQ ID NO: 1349801 - DNA, 20 bp, Homo sapiens
ccctatctcctgacagaagg

SEQ ID NO: 1349802 - DNA, 16 bp, Homo sapiens
ccctcaacacctctgc

SEQ ID NO: 1349803 - DNA, 16 bp, Homo sapiens
ccctcagctcggctca

SEQ ID NO: 1349804 - DNA, 19 bp, Homo sapiens
ccctcagctcggctcagct

SEQ ID NO: 1349805 - DNA, 18 bp, Homo sapiens
ccctccagaaccaccccg

SEQ ID NO: 1349806 - DNA, 16 bp, Homo sapiens
ccctccgccctgccac

SEQ ID NO: 1349807 - DNA, 19 bp, Homo sapiens
ccctccgccctgccactca

SEQ ID NO: 1349808 - DNA, 23 bp, Homo sapiens
ccctcctccaggcctgcctccca

SEQ ID NO: 1349809 - DNA, 12 bp, Homo sapiens
ccctcctgaccc

SEQ ID NO: 1349810 - DNA, 16 bp, Homo sapiens
ccctctgcacccagaa

SEQ ID NO: 1349811 - DNA, 22 bp, Homo sapiens
ccctctggtcgctcctgcccac

SEQ ID NO: 1349812 - DNA, 15 bp, Homo sapiens
ccctcttcctgtgat

SEQ ID NO: 1349813 - DNA, 16 bp, Homo sapiens
ccctgagtctgggcag

SEQ ID NO: 1349814 - DNA, 13 bp, Homo sapiens
ccctgccactcac

SEQ ID NO: 1349815 - DNA, 16 bp, Homo sapiens
ccctgccgtcaccacc

SEQ ID NO: 1349816 - DNA, 14 bp, Homo sapiens
ccctgcgcctttcc

SEQ ID NO: 1349817 - DNA, 18 bp, Homo sapiens
ccctgcgcctttcctttt

SEQ ID NO: 1349818 - DNA, 13 bp, Homo sapiens
ccctgctgctggt

SEQ ID NO: 1349819 - DNA, 16 bp, Homo sapiens
ccctgcttccaggaaa

SEQ ID NO: 1349820 - DNA, 10 bp, Homo sapiens
ccctgctttt

SEQ ID NO: 1349821 - DNA, 11 bp, Homo sapiens
ccctggcctcc

SEQ ID NO: 1349822 - DNA, 13 bp, Homo sapiens
ccctggcctcccc

SEQ ID NO: 1349823 - DNA, 20 bp, Homo sapiens
ccctggctccctcctccagg

SEQ ID NO: 1349824 - DNA, 16 bp, Homo sapiens
ccctgggccctgggct

SEQ ID NO: 1349825 - DNA, 20 bp, Homo sapiens
ccctgggcttggcctgctgt

SEQ ID NO: 1349826 - DNA, 17 bp, Homo sapiens
ccctgggtgggctctgt

SEQ ID NO: 1349827 - DNA, 18 bp, Homo sapiens
ccctgggtgggctctgtg

SEQ ID NO: 1349828 - DNA, 20 bp, Homo sapiens
ccctgggtgtccccgctgct

SEQ ID NO: 1349829 - DNA, 22 bp, Homo sapiens
ccctgggtgtccccgctgctgt

SEQ ID NO: 1349830 - DNA, 21 bp, Homo sapiens
ccctgtagagtgggagctgag

SEQ ID NO: 1349831 - DNA, 17 bp, Homo sapiens
ccctgtgacatggtgcc

SEQ ID NO: 1349832 - DNA, 21 bp, Homo sapiens
ccctgtgacatggtgcctgag

SEQ ID NO: 1349833 - DNA, 11 bp, Homo sapiens
ccctgtgtgca

SEQ ID NO: 1349834 - DNA, 16 bp, Homo sapiens
ccctgtgttaatttaa

SEQ ID NO: 1349835 - DNA, 19 bp, Homo sapiens
cccttacctcggtgccttc

SEQ ID NO: 1349836 - DNA, 21 bp, Homo sapiens
cccttactggcttacctcctc

SEQ ID NO: 1349837 - DNA, 13 bp, Homo sapiens
cccttataaaatc

SEQ ID NO: 1349838 - DNA, 13 bp, Homo sapiens
cccttccagatca

SEQ ID NO: 1349839 - DNA, 18 bp, Homo sapiens
cccttccccatgcttcct

SEQ ID NO: 1349840 - DNA, 23 bp, Homo sapiens
cccttccgcagtgtggccaggct

SEQ ID NO: 1349841 - DNA, 22 bp, Homo sapiens
cccttccttttccctgcttcca

SEQ ID NO: 1349842 - DNA, 12 bp, Homo sapiens
cccttgcagccg

SEQ ID NO: 1349843 - DNA, 15 bp, Homo sapiens
cccttgcctccccat

SEQ ID NO: 1349844 - DNA, 18 bp, Homo sapiens
cccttgcctccccatttc

SEQ ID NO: 1349845 - DNA, 19 bp, Homo sapiens
cccttgcctccccatttcc

SEQ ID NO: 1349846 - DNA, 20 bp, Homo sapiens
cccttgcctccccatttccc

SEQ ID NO: 1349847 - DNA, 23 bp, Homo sapiens
cccttgcctccccatttcccatc

SEQ ID NO: 1349848 - DNA, 20 bp, Homo sapiens
cccttgctggccccagccct

SEQ ID NO: 1349849 - DNA, 23 bp, Homo sapiens
cccttgctggccccagccctgct

SEQ ID NO: 1349850 - DNA, 24 bp, Homo sapiens
cccttgctggccccagccctgctg

SEQ ID NO: 1349851 - DNA, 16 bp, Homo sapiens
cccttggcttctgtga

SEQ ID NO: 1349852 - DNA, 18 bp, Homo sapiens
cccttggcttctgtgatg

SEQ ID NO: 1349853 - DNA, 10 bp, Homo sapiens
cccttgtggg

SEQ ID NO: 1349854 - DNA, 16 bp, Homo sapiens
cccttttaaagttgat

SEQ ID NO: 1349855 - DNA, 12 bp, Homo sapiens
cccttttcccct

SEQ ID NO: 1349856 - DNA, 11 bp, Homo sapiens
ccgaataaatg

SEQ ID NO: 1349857 - DNA, 13 bp, Homo sapiens
ccgacctggccgc

SEQ ID NO: 1349858 - DNA, 10 bp, Homo sapiens
ccgactccag

SEQ ID NO: 1349859 - DNA, 14 bp, Homo sapiens
ccgactgctttgga

SEQ ID NO: 1349860 - DNA, 13 bp, Homo sapiens
ccgagaaggttta

SEQ ID NO: 1349861 - DNA, 19 bp, Homo sapiens
ccgagaggtgggccagtct

SEQ ID NO: 1349862 - DNA, 20 bp, Homo sapiens
ccgaggcgggtggatcacga

SEQ ID NO: 1349863 - DNA, 17 bp, Homo sapiens
ccgatagagggacggcc

SEQ ID NO: 1349864 - DNA, 13 bp, Homo sapiens
ccgcacagctcag

SEQ ID NO: 1349865 - DNA, 14 bp, Homo sapiens
ccgcagacaccttg

SEQ ID NO: 1349866 - DNA, 15 bp, Homo sapiens
ccgcagacaccttgg

SEQ ID NO: 1349867 - DNA, 16 bp, Homo sapiens
ccgcagacaccttgga

SEQ ID NO: 1349868 - DNA, 21 bp, Homo sapiens
ccgcagagcgcgcccctagcc

SEQ ID NO: 1349869 - DNA, 18 bp, Homo sapiens
ccgccagcctcctctgga

SEQ ID NO: 1349870 - DNA, 16 bp, Homo sapiens
ccgccatgctcctggc

SEQ ID NO: 1349871 - DNA, 13 bp, Homo sapiens
ccgcccatgcact

SEQ ID NO: 1349872 - DNA, 13 bp, Homo sapiens
ccgcctggccagg

SEQ ID NO: 1349873 - DNA, 21 bp, Homo sapiens
ccgcctggccaggagcaggca

SEQ ID NO: 1349874 - DNA, 23 bp, Homo sapiens
ccgcctggccaggagcaggcacg

SEQ ID NO: 1349875 - DNA, 15 bp, Homo sapiens
ccgcgccacaggacc

SEQ ID NO: 1349876 - DNA, 23 bp, Homo sapiens
ccgcgcgtccagctgcccttccg

SEQ ID NO: 1349877 - DNA, 17 bp, Homo sapiens
ccgcgtgtgcctgtgtg

SEQ ID NO: 1349878 - DNA, 20 bp, Homo sapiens
ccgctgccacgttggagaag

SEQ ID NO: 1349879 - DNA, 14 bp, Homo sapiens
ccgctgctgtgcaa

SEQ ID NO: 1349880 - DNA, 15 bp, Homo sapiens
ccgcttctgcctgca

SEQ ID NO: 1349881 - DNA, 15 bp, Homo sapiens
ccggacttttctgca

SEQ ID NO: 1349882 - DNA, 16 bp, Homo sapiens
ccggacttttctgcaa

SEQ ID NO: 1349883 - DNA, 23 bp, Homo sapiens
ccggagctggaggatcccctcca

SEQ ID NO: 1349884 - DNA, 13 bp, Homo sapiens
ccggagggctgcg

SEQ ID NO: 1349885 - DNA, 22 bp, Homo sapiens
ccggagtgtctggaattgtggc

SEQ ID NO: 1349886 - DNA, 16 bp, Homo sapiens
ccggatctgagggaga

SEQ ID NO: 1349887 - DNA, 19 bp, Homo sapiens
ccggcagccccagcctgct

SEQ ID NO: 1349888 - DNA, 21 bp, Homo sapiens
ccggcagccccagcctgctag

SEQ ID NO: 1349889 - DNA, 18 bp, Homo sapiens
ccggcagggtcctagaaa

SEQ ID NO: 1349890 - DNA, 23 bp, Homo sapiens
ccggcatgagactcagtgcagat

SEQ ID NO: 1349891 - DNA, 13 bp, Homo sapiens
ccggccctgtgtg

SEQ ID NO: 1349892 - DNA, 13 bp, Homo sapiens
ccggcctctccag

SEQ ID NO: 1349893 - DNA, 13 bp, Homo sapiens
ccggctcccagcc

SEQ ID NO: 1349894 - DNA, 15 bp, Homo sapiens
ccggctcccagcctc

SEQ ID NO: 1349895 - DNA, 17 bp, Homo sapiens
ccggctctacgggggcc

SEQ ID NO: 1349896 - DNA, 23 bp, Homo sapiens
ccggcttcctttcccaagccttc

SEQ ID NO: 1349897 - DNA, 21 bp, Homo sapiens
ccgggaacctccccagcctgc

SEQ ID NO: 1349898 - DNA, 14 bp, Homo sapiens
ccgggcccctgggc

SEQ ID NO: 1349899 - DNA, 15 bp, Homo sapiens
ccggtaactgtcctg

SEQ ID NO: 1349900 - DNA, 21 bp, Homo sapiens
ccggtaactgtcctgtcctgc

SEQ ID NO: 1349901 - DNA, 22 bp, Homo sapiens
ccgtcaccaccacccctaccac

SEQ ID NO: 1349902 - DNA, 13 bp, Homo sapiens
ccgtcctgcctgt

SEQ ID NO: 1349903 - DNA, 14 bp, Homo sapiens
ccgtcctgcctgtg

SEQ ID NO: 1349904 - DNA, 16 bp, Homo sapiens
ccgtcctgcctgtggc

SEQ ID NO: 1349905 - DNA, 17 bp, Homo sapiens
ccgtgaaaacggagctg

SEQ ID NO: 1349906 - DNA, 18 bp, Homo sapiens
ccgtgaagatactttgta

SEQ ID NO: 1349907 - DNA, 20 bp, Homo sapiens
ccgtgaagatactttgtatt

SEQ ID NO: 1349908 - DNA, 23 bp, Homo sapiens
ccgtggctgttgacgcacctgtg

SEQ ID NO: 1349909 - DNA, 15 bp, Homo sapiens
ccgtggggcagggag

SEQ ID NO: 1349910 - DNA, 17 bp, Homo sapiens
ccgtggggccgccgcct

SEQ ID NO: 1349911 - DNA, 16 bp, Homo sapiens
ccgtgtctgtctggca

SEQ ID NO: 1349912 - DNA, 17 bp, Homo sapiens
ccgtgtctgtctggcac

SEQ ID NO: 1349913 - DNA, 23 bp, Homo sapiens
ccgtgtgagaagtgaatgctggg

SEQ ID NO: 1349914 - DNA, 18 bp, Homo sapiens
ccgttagctcctgtggcc

SEQ ID NO: 1349915 - DNA, 15 bp, Homo sapiens
ccgttttccccatga

SEQ ID NO: 1349916 - DNA, 20 bp, Homo sapiens
cctaaagaaaaatatcttgg

SEQ ID NO: 1349917 - DNA, 13 bp, Homo sapiens
cctaaagagagta

SEQ ID NO: 1349918 - DNA, 18 bp, Homo sapiens
cctaaatggcctcatgtg

SEQ ID NO: 1349919 - DNA, 16 bp, Homo sapiens
cctaatttctcctccc

SEQ ID NO: 1349920 - DNA, 20 bp, Homo sapiens
cctaccccgcagacaccttg

SEQ ID NO: 1349921 - DNA, 19 bp, Homo sapiens
cctagacctaaacggctca

SEQ ID NO: 1349922 - DNA, 17 bp, Homo sapiens
cctagaggccctttgct

SEQ ID NO: 1349923 - DNA, 13 bp, Homo sapiens
cctagcacagcag

SEQ ID NO: 1349924 - DNA, 22 bp, Homo sapiens
cctagcagcccaccctgctgct

SEQ ID NO: 1349925 - DNA, 23 bp, Homo sapiens
cctagcagcccaccctgctgctg

SEQ ID NO: 1349926 - DNA, 20 bp, Homo sapiens
cctagccggttcctgtccct

SEQ ID NO: 1349927 - DNA, 22 bp, Homo sapiens
cctagctttagaccctgggtgg

SEQ ID NO: 1349928 - DNA, 22 bp, Homo sapiens
cctaggaaactcacactcccct

SEQ ID NO: 1349929 - DNA, 16 bp, Homo sapiens
cctagtttgtgagaaa

SEQ ID NO: 1349930 - DNA, 15 bp, Homo sapiens
cctatatatttctat

SEQ ID NO: 1349931 - DNA, 18 bp, Homo sapiens
cctatccgctgccagcct

SEQ ID NO: 1349932 - DNA, 13 bp, Homo sapiens
cctatctcctgac

SEQ ID NO: 1349933 - DNA, 14 bp, Homo sapiens
cctatctcctgaca

SEQ ID NO: 1349934 - DNA, 16 bp, Homo sapiens
cctattctataaaact

SEQ ID NO: 1349935 - DNA, 18 bp, Homo sapiens
cctattgatttaagcttt

SEQ ID NO: 1349936 - DNA, 15 bp, Homo sapiens
cctatttcatcacaa

SEQ ID NO: 1349937 - DNA, 18 bp, Homo sapiens
cctcaatagatctccagc

SEQ ID NO: 1349938 - DNA, 22 bp, Homo sapiens
cctcacctaataggctgggaga

SEQ ID NO: 1349939 - DNA, 17 bp, Homo sapiens
cctcacctcatgcccac

SEQ ID NO: 1349940 - DNA, 23 bp, Homo sapiens
cctcactcgggtttctctgtggc

SEQ ID NO: 1349941 - DNA, 14 bp, Homo sapiens
cctcagcgcggccc

SEQ ID NO: 1349942 - DNA, 18 bp, Homo sapiens
cctcaggcaggtgggatg

SEQ ID NO: 1349943 - DNA, 14 bp, Homo sapiens
cctcagggctccca

SEQ ID NO: 1349944 - DNA, 15 bp, Homo sapiens
cctcagggctcccag

SEQ ID NO: 1349945 - DNA, 20 bp, Homo sapiens
cctcaggtgagaagcagagg

SEQ ID NO: 1349946 - DNA, 13 bp, Homo sapiens
cctcatgcccacc

SEQ ID NO: 1349947 - DNA, 22 bp, Homo sapiens
cctcatgcccaccccctgccct

SEQ ID NO: 1349948 - DNA, 23 bp, Homo sapiens
cctcatgcccaccccctgccctg

SEQ ID NO: 1349949 - DNA, 16 bp, Homo sapiens
cctcatgtggctggaa

SEQ ID NO: 1349950 - DNA, 18 bp, Homo sapiens
cctcatgtggctggaaga

SEQ ID NO: 1349951 - DNA, 22 bp, Homo sapiens
cctccaaatggagaagctgcag

SEQ ID NO: 1349952 - DNA, 14 bp, Homo sapiens
cctccaaccctgcc

SEQ ID NO: 1349953 - DNA, 18 bp, Homo sapiens
cctccaaccctgccgtca

SEQ ID NO: 1349954 - DNA, 15 bp, Homo sapiens
cctccacagcgaggg

SEQ ID NO: 1349955 - DNA, 20 bp, Homo sapiens
cctccacagcgagggcagct

SEQ ID NO: 1349956 - DNA, 21 bp, Homo sapiens
cctccacagcgagggcagctg

SEQ ID NO: 1349957 - DNA, 15 bp, Homo sapiens
cctccaccccaggac

SEQ ID NO: 1349958 - DNA, 14 bp, Homo sapiens
cctccaggtgcaga

SEQ ID NO: 1349959 - DNA, 22 bp, Homo sapiens
cctcccacacccaaagctgagc

SEQ ID NO: 1349960 - DNA, 13 bp, Homo sapiens
cctcccaccccca

SEQ ID NO: 1349961 - DNA, 14 bp, Homo sapiens
cctcccacccccag

SEQ ID NO: 1349962 - DNA, 16 bp, Homo sapiens
cctcccacccccagcc

SEQ ID NO: 1349963 - DNA, 12 bp, Homo sapiens
cctcccactttg

SEQ ID NO: 1349964 - DNA, 14 bp, Homo sapiens
cctccccagcctgc

SEQ ID NO: 1349965 - DNA, 15 bp, Homo sapiens
cctccccagcctgcg

SEQ ID NO: 1349966 - DNA, 20 bp, Homo sapiens
cctccccatttcccatctgc

SEQ ID NO: 1349967 - DNA, 23 bp, Homo sapiens
cctccccatttcccatctgcacc

SEQ ID NO: 1349968 - DNA, 21 bp, Homo sapiens
cctcccccagccatgccagct

SEQ ID NO: 1349969 - DNA, 12 bp, Homo sapiens
cctcccctgcca

SEQ ID NO: 1349970 - DNA, 12 bp, Homo sapiens
cctccctccacc

SEQ ID NO: 1349971 - DNA, 15 bp, Homo sapiens
cctccctccacccca

SEQ ID NO: 1349972 - DNA, 17 bp, Homo sapiens
cctccctccaccccagg

SEQ ID NO: 1349973 - DNA, 15 bp, Homo sapiens
cctcccttccttttc

SEQ ID NO: 1349974 - DNA, 14 bp, Homo sapiens
cctccgccctgcca

SEQ ID NO: 1349975 - DNA, 16 bp, Homo sapiens
cctcctcccacccggc

SEQ ID NO: 1349976 - DNA, 23 bp, Homo sapiens
cctcctcccacccggctgcagag

SEQ ID NO: 1349977 - DNA, 20 bp, Homo sapiens
cctcctgaaccgcacagctc

SEQ ID NO: 1349978 - DNA, 20 bp, Homo sapiens
cctcctgacccattgctgtt

SEQ ID NO: 1349979 - DNA, 12 bp, Homo sapiens
cctccttcagac

SEQ ID NO: 1349980 - DNA, 22 bp, Homo sapiens
cctccttcagacaccctcaacc

SEQ ID NO: 1349981 - DNA, 17 bp, Homo sapiens
cctcgcgcttgctggcc

SEQ ID NO: 1349982 - DNA, 20 bp, Homo sapiens
cctctaacctcgccctctcc

SEQ ID NO: 1349983 - DNA, 14 bp, Homo sapiens
cctctagaggcaag

SEQ ID NO: 1349984 - DNA, 16 bp, Homo sapiens
cctctcagtgccctcc

SEQ ID NO: 1349985 - DNA, 14 bp, Homo sapiens
cctctccagcctca

SEQ ID NO: 1349986 - DNA, 17 bp, Homo sapiens
cctctccagcctcagcc

SEQ ID NO: 1349987 - DNA, 20 bp, Homo sapiens
cctctccatttgctcttcag

SEQ ID NO: 1349988 - DNA, 18 bp, Homo sapiens
cctctcctcggttcaagg

SEQ ID NO: 1349989 - DNA, 14 bp, Homo sapiens
cctctcctttgttc

SEQ ID NO: 1349990 - DNA, 19 bp, Homo sapiens
cctctctatatttcgggtc

SEQ ID NO: 1349991 - DNA, 17 bp, Homo sapiens
cctctgcacccagaaca

SEQ ID NO: 1349992 - DNA, 13 bp, Homo sapiens
cctctgcctgccc

SEQ ID NO: 1349993 - DNA, 13 bp, Homo sapiens
cctctgctcaccg

SEQ ID NO: 1349994 - DNA, 23 bp, Homo sapiens
cctctgctcaccgcccatcaggg

SEQ ID NO: 1349995 - DNA, 15 bp, Homo sapiens
cctctggacggcagg

SEQ ID NO: 1349996 - DNA, 16 bp, Homo sapiens
cctctggacggcaggc

SEQ ID NO: 1349997 - DNA, 16 bp, Homo sapiens
cctctggtcgctcctg

SEQ ID NO: 1349998 - DNA, 13 bp, Homo sapiens
cctctgtgctgtg

SEQ ID NO: 1349999 - DNA, 15 bp, Homo sapiens
cctctgtgctgtgtg

SEQ ID NO: 1350000 - DNA, 13 bp, Homo sapiens
cctcttcctgtga

SEQ ID NO: 1350001 - DNA, 21 bp, Homo sapiens
cctcttcctgtgatccaccca

SEQ ID NO: 1350002 - DNA, 19 bp, Homo sapiens
cctcttctcgtgcctcccc

SEQ ID NO: 1350003 - DNA, 14 bp, Homo sapiens
cctcttctgagctt

SEQ ID NO: 1350004 - DNA, 14 bp, Homo sapiens
cctcttgaccaggc

SEQ ID NO: 1350005 - DNA, 15 bp, Homo sapiens
cctcttgaccaggct

SEQ ID NO: 1350006 - DNA, 20 bp, Homo sapiens
cctcttgaccaggctgcctc

SEQ ID NO: 1350007 - DNA, 16 bp, Homo sapiens
cctcttgtaaagactg

SEQ ID NO: 1350008 - DNA, 14 bp, Homo sapiens
cctcttgtctgatt

SEQ ID NO: 1350009 - DNA, 23 bp, Homo sapiens
cctctttcaagcagtcgtgcctg

SEQ ID NO: 1350010 - DNA, 15 bp, Homo sapiens
cctctttccctagga

SEQ ID NO: 1350011 - DNA, 14 bp, Homo sapiens
cctgaaactatatt

SEQ ID NO: 1350012 - DNA, 19 bp, Homo sapiens
cctgaaactatattttgtc

SEQ ID NO: 1350013 - DNA, 14 bp, Homo sapiens
cctgaccagctgct

SEQ ID NO: 1350014 - DNA, 12 bp, Homo sapiens
cctgactggtgc

SEQ ID NO: 1350015 - DNA, 12 bp, Homo sapiens
cctgagaggcag

SEQ ID NO: 1350016 - DNA, 15 bp, Homo sapiens
cctgagaggcaggca

SEQ ID NO: 1350017 - DNA, 21 bp, Homo sapiens
cctgagccctactccctgcag

SEQ ID NO: 1350018 - DNA, 16 bp, Homo sapiens
cctgagccggccccag

SEQ ID NO: 1350019 - DNA, 17 bp, Homo sapiens
cctgagccggccccagg

SEQ ID NO: 1350020 - DNA, 15 bp, Homo sapiens
cctgaggctgtggtc

SEQ ID NO: 1350021 - DNA, 16 bp, Homo sapiens
cctgaggctgtggtca

SEQ ID NO: 1350022 - DNA, 16 bp, Homo sapiens
cctgagtctgggcagc

SEQ ID NO: 1350023 - DNA, 21 bp, Homo sapiens
cctgatcccattttcctctga

SEQ ID NO: 1350024 - DNA, 16 bp, Homo sapiens
cctgcaatatttgaat

SEQ ID NO: 1350025 - DNA, 19 bp, Homo sapiens
cctgcacagtgtcccccag

SEQ ID NO: 1350026 - DNA, 19 bp, Homo sapiens
cctgcacgtcatgggaggg

SEQ ID NO: 1350027 - DNA, 12 bp, Homo sapiens
cctgcactcctc

SEQ ID NO: 1350028 - DNA, 14 bp, Homo sapiens
cctgcagatgccac

SEQ ID NO: 1350029 - DNA, 20 bp, Homo sapiens
cctgcagatgccaccctagc

SEQ ID NO: 1350030 - DNA, 17 bp, Homo sapiens
cctgcagggccatggct

SEQ ID NO: 1350031 - DNA, 13 bp, Homo sapiens
cctgcatttcctc

SEQ ID NO: 1350032 - DNA, 22 bp, Homo sapiens
cctgccactcactaggccccca

SEQ ID NO: 1350033 - DNA, 13 bp, Homo sapiens
cctgccaggcagg

SEQ ID NO: 1350034 - DNA, 22 bp, Homo sapiens
cctgccaggcaggggtgggggt

SEQ ID NO: 1350035 - DNA, 15 bp, Homo sapiens
cctgcccccagcccc

SEQ ID NO: 1350036 - DNA, 18 bp, Homo sapiens
cctgccccgcccccagtc

SEQ ID NO: 1350037 - DNA, 18 bp, Homo sapiens
cctgccccggagctggag

SEQ ID NO: 1350038 - DNA, 16 bp, Homo sapiens
cctgcccctcagagac

SEQ ID NO: 1350039 - DNA, 11 bp, Homo sapiens
cctgccctgca

SEQ ID NO: 1350040 - DNA, 12 bp, Homo sapiens
cctgcctggccc

SEQ ID NO: 1350041 - DNA, 23 bp, Homo sapiens
cctgcctgtggcgccgtctccag

SEQ ID NO: 1350042 - DNA, 14 bp, Homo sapiens
cctgccttaagtga

SEQ ID NO: 1350043 - DNA, 14 bp, Homo sapiens
cctgcgaccctggg

SEQ ID NO: 1350044 - DNA, 16 bp, Homo sapiens
cctgcgaccctggggg

SEQ ID NO: 1350045 - DNA, 21 bp, Homo sapiens
cctgcgaccctgggggcacag

SEQ ID NO: 1350046 - DNA, 13 bp, Homo sapiens
cctgcgcctgctg

SEQ ID NO: 1350047 - DNA, 16 bp, Homo sapiens
cctgcgtcctcctcac

SEQ ID NO: 1350048 - DNA, 17 bp, Homo sapiens
cctgcgtcctcctcacc

SEQ ID NO: 1350049 - DNA, 22 bp, Homo sapiens
cctgcgtcctcctcacctcatg

SEQ ID NO: 1350050 - DNA, 12 bp, Homo sapiens
cctgctccagct

SEQ ID NO: 1350051 - DNA, 14 bp, Homo sapiens
cctgctccagctgt

SEQ ID NO: 1350052 - DNA, 21 bp, Homo sapiens
cctgctgcatgccctctcagg

SEQ ID NO: 1350053 - DNA, 15 bp, Homo sapiens
cctgctggcacccac

SEQ ID NO: 1350054 - DNA, 13 bp, Homo sapiens
cctgctggggatc

SEQ ID NO: 1350055 - DNA, 24 bp, Homo sapiens
cctgcttcagtcccttccccatgc

SEQ ID NO: 1350056 - DNA, 16 bp, Homo sapiens
cctgctttttgtgttt

SEQ ID NO: 1350057 - DNA, 19 bp, Homo sapiens
cctggaccttttgttttct

SEQ ID NO: 1350058 - DNA, 23 bp, Homo sapiens
cctggagacttagggcaccaggg

SEQ ID NO: 1350059 - DNA, 17 bp, Homo sapiens
cctggagatcctcctgc

SEQ ID NO: 1350060 - DNA, 19 bp, Homo sapiens
cctggagatcctcctgcag

SEQ ID NO: 1350061 - DNA, 16 bp, Homo sapiens
cctggatagacgagtt

SEQ ID NO: 1350062 - DNA, 11 bp, Homo sapiens
cctggcagccc

SEQ ID NO: 1350063 - DNA, 13 bp, Homo sapiens
cctggcagcccag

SEQ ID NO: 1350064 - DNA, 14 bp, Homo sapiens
cctggcagcccaga

SEQ ID NO: 1350065 - DNA, 17 bp, Homo sapiens
cctggcagcccagagac

SEQ ID NO: 1350066 - DNA, 12 bp, Homo sapiens
cctggccaggag

SEQ ID NO: 1350067 - DNA, 20 bp, Homo sapiens
cctggcccccaacctcaggg

SEQ ID NO: 1350068 - DNA, 17 bp, Homo sapiens
cctggccgcgctccggg

SEQ ID NO: 1350069 - DNA, 19 bp, Homo sapiens
cctggcctcccctgccacc

SEQ ID NO: 1350070 - DNA, 19 bp, Homo sapiens
cctggccttgtcctcagcc

SEQ ID NO: 1350071 - DNA, 15 bp, Homo sapiens
cctggcgcaggtggg

SEQ ID NO: 1350072 - DNA, 15 bp, Homo sapiens
cctggcgcctggcag

SEQ ID NO: 1350073 - DNA, 23 bp, Homo sapiens
cctggcgtcccctccctctgtct

SEQ ID NO: 1350074 - DNA, 16 bp, Homo sapiens
cctggctgaggttcct

SEQ ID NO: 1350075 - DNA, 23 bp, Homo sapiens
cctggctgaggttcctctgcctg

SEQ ID NO: 1350076 - DNA, 18 bp, Homo sapiens
cctggctgctgcccccac

SEQ ID NO: 1350077 - DNA, 20 bp, Homo sapiens
cctgggaggtcaaggctgca

SEQ ID NO: 1350078 - DNA, 20 bp, Homo sapiens
cctgggcacgcactgggttg

SEQ ID NO: 1350079 - DNA, 19 bp, Homo sapiens
cctgggccctgggctggaa

SEQ ID NO: 1350080 - DNA, 20 bp, Homo sapiens
cctgggccgtatctccggct

SEQ ID NO: 1350081 - DNA, 13 bp, Homo sapiens
cctgggcttggcc

SEQ ID NO: 1350082 - DNA, 16 bp, Homo sapiens
cctgggcttggcctgc

SEQ ID NO: 1350083 - DNA, 17 bp, Homo sapiens
cctgggtgggctctgtg

SEQ ID NO: 1350084 - DNA, 13 bp, Homo sapiens
cctggtctttgag

SEQ ID NO: 1350085 - DNA, 13 bp, Homo sapiens
cctggtgctgctg

SEQ ID NO: 1350086 - DNA, 15 bp, Homo sapiens
cctggtgcttccaaa

SEQ ID NO: 1350087 - DNA, 17 bp, Homo sapiens
cctgtaacactcctctg

SEQ ID NO: 1350088 - DNA, 15 bp, Homo sapiens
cctgtaatcccagca

SEQ ID NO: 1350089 - DNA, 16 bp, Homo sapiens
cctgtaatcccagcac

SEQ ID NO: 1350090 - DNA, 22 bp, Homo sapiens
cctgtacagtagattttccaaa

SEQ ID NO: 1350091 - DNA, 15 bp, Homo sapiens
cctgtagagtgggag

SEQ ID NO: 1350092 - DNA, 19 bp, Homo sapiens
cctgtagagtgggagctga

SEQ ID NO: 1350093 - DNA, 23 bp, Homo sapiens
cctgtagagtgggagctgagtgg

SEQ ID NO: 1350094 - DNA, 16 bp, Homo sapiens
cctgtatacagtgcag

SEQ ID NO: 1350095 - DNA, 14 bp, Homo sapiens
cctgtccccgcagc

SEQ ID NO: 1350096 - DNA, 16 bp, Homo sapiens
cctgtgaatgccactg

SEQ ID NO: 1350097 - DNA, 18 bp, Homo sapiens
cctgtgacatggtgcctg

SEQ ID NO: 1350098 - DNA, 19 bp, Homo sapiens
cctgtgacatggtgcctga

SEQ ID NO: 1350099 - DNA, 20 bp, Homo sapiens
cctgtggatgataaaacaca

SEQ ID NO: 1350100 - DNA, 20 bp, Homo sapiens
cctgtggccccaccctgggc

SEQ ID NO: 1350101 - DNA, 22 bp, Homo sapiens
cctgtggggggtaatccctgct

SEQ ID NO: 1350102 - DNA, 13 bp, Homo sapiens
cctgtgtgcaggt

SEQ ID NO: 1350103 - DNA, 17 bp, Homo sapiens
cctgtgttaatttaagt

SEQ ID NO: 1350104 - DNA, 13 bp, Homo sapiens
ccttaaatttaat

SEQ ID NO: 1350105 - DNA, 22 bp, Homo sapiens
ccttaagtgaggaaatcaaagt

SEQ ID NO: 1350106 - DNA, 13 bp, Homo sapiens
ccttaatttcctt

SEQ ID NO: 1350107 - DNA, 15 bp, Homo sapiens
ccttaatttcctttt

SEQ ID NO: 1350108 - DNA, 19 bp, Homo sapiens
ccttaatttcctttttgac

SEQ ID NO: 1350109 - DNA, 23 bp, Homo sapiens
ccttaatttcctttttgacactg

SEQ ID NO: 1350110 - DNA, 20 bp, Homo sapiens
ccttacctcggtgccttcct

SEQ ID NO: 1350111 - DNA, 18 bp, Homo sapiens
ccttactggcttacctcc

SEQ ID NO: 1350112 - DNA, 18 bp, Homo sapiens
ccttagaggtcctctgga

SEQ ID NO: 1350113 - DNA, 20 bp, Homo sapiens
ccttagaggtcctctggagc

SEQ ID NO: 1350114 - DNA, 15 bp, Homo sapiens
ccttaggccttcctc

SEQ ID NO: 1350115 - DNA, 12 bp, Homo sapiens
ccttataaaatc

SEQ ID NO: 1350116 - DNA, 12 bp, Homo sapiens
ccttccattcca

SEQ ID NO: 1350117 - DNA, 21 bp, Homo sapiens
ccttcccccaccggtccagct

SEQ ID NO: 1350118 - DNA, 22 bp, Homo sapiens
ccttcccccaccggtccagctg

SEQ ID NO: 1350119 - DNA, 12 bp, Homo sapiens
ccttccctagct

SEQ ID NO: 1350120 - DNA, 15 bp, Homo sapiens
ccttccctagcttta

SEQ ID NO: 1350121 - DNA, 17 bp, Homo sapiens
ccttcctctctccagat

SEQ ID NO: 1350122 - DNA, 15 bp, Homo sapiens
ccttccttttccctg

SEQ ID NO: 1350123 - DNA, 17 bp, Homo sapiens
ccttccttttccctgct

SEQ ID NO: 1350124 - DNA, 17 bp, Homo sapiens
ccttcgcttcttgcctc

SEQ ID NO: 1350125 - DNA, 19 bp, Homo sapiens
ccttctatagcatcactta

SEQ ID NO: 1350126 - DNA, 15 bp, Homo sapiens
ccttctcagaagcac

SEQ ID NO: 1350127 - DNA, 18 bp, Homo sapiens
ccttctcagaagcacaga

SEQ ID NO: 1350128 - DNA, 22 bp, Homo sapiens
ccttctccctagctcctcccct

SEQ ID NO: 1350129 - DNA, 16 bp, Homo sapiens
ccttctctcctcccca

SEQ ID NO: 1350130 - DNA, 17 bp, Homo sapiens
ccttctctcctccccaa

SEQ ID NO: 1350131 - DNA, 19 bp, Homo sapiens
ccttgaaactttgggaaaa

SEQ ID NO: 1350132 - DNA, 15 bp, Homo sapiens
ccttgagccctggct

SEQ ID NO: 1350133 - DNA, 13 bp, Homo sapiens
ccttgagggctgc

SEQ ID NO: 1350134 - DNA, 15 bp, Homo sapiens
ccttgagggctgcag

SEQ ID NO: 1350135 - DNA, 22 bp, Homo sapiens
ccttgagttgattcagctctgc

SEQ ID NO: 1350136 - DNA, 12 bp, Homo sapiens
ccttgcctcccc

SEQ ID NO: 1350137 - DNA, 12 bp, Homo sapiens
ccttgctggccc

SEQ ID NO: 1350138 - DNA, 15 bp, Homo sapiens
ccttgctggccccag

SEQ ID NO: 1350139 - DNA, 21 bp, Homo sapiens
ccttgctggccccagccctgc

SEQ ID NO: 1350140 - DNA, 21 bp, Homo sapiens
ccttgctgtttgtcctgagat

SEQ ID NO: 1350141 - DNA, 21 bp, Homo sapiens
ccttggttgtctggcaaggac

SEQ ID NO: 1350142 - DNA, 22 bp, Homo sapiens
ccttggttgtctggcaaggact

SEQ ID NO: 1350143 - DNA, 17 bp, Homo sapiens
ccttgtcctcagccagt

SEQ ID NO: 1350144 - DNA, 13 bp, Homo sapiens
ccttgtgcctggg

SEQ ID NO: 1350145 - DNA, 14 bp, Homo sapiens
ccttgtgcctgggg

SEQ ID NO: 1350146 - DNA, 12 bp, Homo sapiens
ccttgtggcttc

SEQ ID NO: 1350147 - DNA, 19 bp, Homo sapiens
ccttgttacttctgaggta

SEQ ID NO: 1350148 - DNA, 20 bp, Homo sapiens
cctttagaaactcaaaaact

SEQ ID NO: 1350149 - DNA, 12 bp, Homo sapiens
cctttatgtgaa

SEQ ID NO: 1350150 - DNA, 23 bp, Homo sapiens
cctttattaccccctccttcaga

SEQ ID NO: 1350151 - DNA, 23 bp, Homo sapiens
cctttccaccacagccagcacct

SEQ ID NO: 1350152 - DNA, 20 bp, Homo sapiens
cctttccccgacgcccaccc

SEQ ID NO: 1350153 - DNA, 16 bp, Homo sapiens
cctttccctcaccccc

SEQ ID NO: 1350154 - DNA, 18 bp, Homo sapiens
cctttgctgtcccatagt

SEQ ID NO: 1350155 - DNA, 17 bp, Homo sapiens
cctttggtcctgtcccc

SEQ ID NO: 1350156 - DNA, 15 bp, Homo sapiens
cctttggttctggcc

SEQ ID NO: 1350157 - DNA, 20 bp, Homo sapiens
cctttggttctggccagaat

SEQ ID NO: 1350158 - DNA, 18 bp, Homo sapiens
cctttgtcctttttcagg

SEQ ID NO: 1350159 - DNA, 14 bp, Homo sapiens
cctttgttcccggc

SEQ ID NO: 1350160 - DNA, 15 bp, Homo sapiens
cctttgttcccggct

SEQ ID NO: 1350161 - DNA, 13 bp, Homo sapiens
cctttgttctggg

SEQ ID NO: 1350162 - DNA, 11 bp, Homo sapiens
ccttttactgg

SEQ ID NO: 1350163 - DNA, 20 bp, Homo sapiens
ccttttactggttgcatgga

SEQ ID NO: 1350164 - DNA, 13 bp, Homo sapiens
ccttttccctgct

SEQ ID NO: 1350165 - DNA, 19 bp, Homo sapiens
ccttttccctgcttccagg

SEQ ID NO: 1350166 - DNA, 19 bp, Homo sapiens
ccttttcgcctttcctctc

SEQ ID NO: 1350167 - DNA, 15 bp, Homo sapiens
ccttttctggcaccg

SEQ ID NO: 1350168 - DNA, 15 bp, Homo sapiens
cctttttaaaacaca

SEQ ID NO: 1350169 - DNA, 12 bp, Homo sapiens
cctttttattta

SEQ ID NO: 1350170 - DNA, 22 bp, Homo sapiens
cctttttatttatatgtatgtg

SEQ ID NO: 1350171 - DNA, 14 bp, Homo sapiens
cctttttgacactg

SEQ ID NO: 1350172 - DNA, 15 bp, Homo sapiens
cctttttgacactga

SEQ ID NO: 1350173 - DNA, 16 bp, Homo sapiens
cctttttgacactgaa

SEQ ID NO: 1350174 - DNA, 18 bp, Homo sapiens
cgaaacctgggattcagg

SEQ ID NO: 1350175 - DNA, 17 bp, Homo sapiens
cgaaccttggcctgggc

SEQ ID NO: 1350176 - DNA, 16 bp, Homo sapiens
cgaagtcattaaactg

SEQ ID NO: 1350177 - DNA, 17 bp, Homo sapiens
cgaatagacatcaaact

SEQ ID NO: 1350178 - DNA, 16 bp, Homo sapiens
cgaatctctgtgcctt

SEQ ID NO: 1350179 - DNA, 16 bp, Homo sapiens
cgaccccccgtgggct

SEQ ID NO: 1350180 - DNA, 18 bp, Homo sapiens
cgaccccccgtgggctcc

SEQ ID NO: 1350181 - DNA, 17 bp, Homo sapiens
cgaccctgggggcacag

SEQ ID NO: 1350182 - DNA, 19 bp, Homo sapiens
cgacctggccgcggagcct

SEQ ID NO: 1350183 - DNA, 10 bp, Homo sapiens
cgactccagc

SEQ ID NO: 1350184 - DNA, 18 bp, Homo sapiens
cgactccagccagcgcct

SEQ ID NO: 1350185 - DNA, 20 bp, Homo sapiens
cgactccagccagcgcctcc

SEQ ID NO: 1350186 - DNA, 18 bp, Homo sapiens
cgactgaaaatattgttt

SEQ ID NO: 1350187 - DNA, 15 bp, Homo sapiens
cgactttctgcctgg

SEQ ID NO: 1350188 - DNA, 16 bp, Homo sapiens
cgactttctgcctgga

SEQ ID NO: 1350189 - DNA, 19 bp, Homo sapiens
cgagaaagaggcaccagga

SEQ ID NO: 1350190 - DNA, 13 bp, Homo sapiens
cgagaccatcctg

SEQ ID NO: 1350191 - DNA, 15 bp, Homo sapiens
cgagaccatcctggc

SEQ ID NO: 1350192 - DNA, 14 bp, Homo sapiens
cgagaggtgggcca

SEQ ID NO: 1350193 - DNA, 19 bp, Homo sapiens
cgagagtctggccctagac

SEQ ID NO: 1350194 - DNA, 20 bp, Homo sapiens
cgagagtctggccctagact

SEQ ID NO: 1350195 - DNA, 20 bp, Homo sapiens
cgagattgcaccactgcact

SEQ ID NO: 1350196 - DNA, 23 bp, Homo sapiens
cgaggattttaattttttttagt

SEQ ID NO: 1350197 - DNA, 17 bp, Homo sapiens
cgaggcctaccccgcag

SEQ ID NO: 1350198 - DNA, 14 bp, Homo sapiens
cgagtaagattaag

SEQ ID NO: 1350199 - DNA, 16 bp, Homo sapiens
cgagtagaaaatgtga

SEQ ID NO: 1350200 - DNA, 14 bp, Homo sapiens
cgagtcaaagttga

SEQ ID NO: 1350201 - DNA, 19 bp, Homo sapiens
cgatactgcgactttctgc

SEQ ID NO: 1350202 - DNA, 20 bp, Homo sapiens
cgatactgcgactttctgcc

SEQ ID NO: 1350203 - DNA, 14 bp, Homo sapiens
cgatcacaaatgac

SEQ ID NO: 1350204 - DNA, 19 bp, Homo sapiens
cgatcacaaatgactttat

SEQ ID NO: 1350205 - DNA, 17 bp, Homo sapiens
cgatgttattagatgtt

SEQ ID NO: 1350206 - DNA, 13 bp, Homo sapiens
cgcagagcgcgcc

SEQ ID NO: 1350207 - DNA, 16 bp, Homo sapiens
cgcagtgttttgcaag

SEQ ID NO: 1350208 - DNA, 15 bp, Homo sapiens
cgcataggacctttc

SEQ ID NO: 1350209 - DNA, 19 bp, Homo sapiens
cgcatcttgcctccaggtg

SEQ ID NO: 1350210 - DNA, 12 bp, Homo sapiens
cgccaaggctgg

SEQ ID NO: 1350211 - DNA, 13 bp, Homo sapiens
cgccaaggctggg

SEQ ID NO: 1350212 - DNA, 16 bp, Homo sapiens
cgccagcctcctctgg

SEQ ID NO: 1350213 - DNA, 22 bp, Homo sapiens
cgccaggggaaaatcagcctgc

SEQ ID NO: 1350214 - DNA, 17 bp, Homo sapiens
cgccatgctcctggccc

SEQ ID NO: 1350215 - DNA, 18 bp, Homo sapiens
cgcccccagtccccaccc

SEQ ID NO: 1350216 - DNA, 22 bp, Homo sapiens
cgcccccagtccccacccctgc

SEQ ID NO: 1350217 - DNA, 20 bp, Homo sapiens
cgccctctcctttgttcccg

SEQ ID NO: 1350218 - DNA, 14 bp, Homo sapiens
cgccctgccactca

SEQ ID NO: 1350219 - DNA, 11 bp, Homo sapiens
cgcccttggct

SEQ ID NO: 1350220 - DNA, 17 bp, Homo sapiens
cgcccttggcttctgtg

SEQ ID NO: 1350221 - DNA, 20 bp, Homo sapiens
cgccgatagagggacggcca

SEQ ID NO: 1350222 - DNA, 13 bp, Homo sapiens
cgccgccaccgcg

SEQ ID NO: 1350223 - DNA, 18 bp, Homo sapiens
cgcctccatccaaggcca

SEQ ID NO: 1350224 - DNA, 13 bp, Homo sapiens
cgcctccctccac

SEQ ID NO: 1350225 - DNA, 18 bp, Homo sapiens
cgcctccctccaccccag

SEQ ID NO: 1350226 - DNA, 20 bp, Homo sapiens
cgcctccctccaccccagga

SEQ ID NO: 1350227 - DNA, 15 bp, Homo sapiens
cgcctctcctcggtt

SEQ ID NO: 1350228 - DNA, 15 bp, Homo sapiens
cgcctctttcaagca

SEQ ID NO: 1350229 - DNA, 22 bp, Homo sapiens
cgcctgcactcctcagggcagc

SEQ ID NO: 1350230 - DNA, 19 bp, Homo sapiens
cgcctttcctctctatatt

SEQ ID NO: 1350231 - DNA, 16 bp, Homo sapiens
cgcgaccatgtggcca

SEQ ID NO: 1350232 - DNA, 16 bp, Homo sapiens
cgcgccacaggaccct

SEQ ID NO: 1350233 - DNA, 17 bp, Homo sapiens
cgcgccacaggaccctc

SEQ ID NO: 1350234 - DNA, 16 bp, Homo sapiens
cgcggagcctgcattt

SEQ ID NO: 1350235 - DNA, 19 bp, Homo sapiens
cgcggtggctcacgcctgt

SEQ ID NO: 1350236 - DNA, 22 bp, Homo sapiens
cgctaaagagcccttgcctccc

SEQ ID NO: 1350237 - DNA, 20 bp, Homo sapiens
cgctaggtagagtctgaggg

SEQ ID NO: 1350238 - DNA, 21 bp, Homo sapiens
cgctaggtagagtctgagggc

SEQ ID NO: 1350239 - DNA, 15 bp, Homo sapiens
cgctcagtaaacggg

SEQ ID NO: 1350240 - DNA, 20 bp, Homo sapiens
cgctctgtggatgccagggc

SEQ ID NO: 1350241 - DNA, 16 bp, Homo sapiens
cgctgagtggcagggg

SEQ ID NO: 1350242 - DNA, 20 bp, Homo sapiens
cgctgagtggcaggggacag

SEQ ID NO: 1350243 - DNA, 21 bp, Homo sapiens
cgctgccagccttgagccctg

SEQ ID NO: 1350244 - DNA, 23 bp, Homo sapiens
cgctgccagccttgagccctggc

SEQ ID NO: 1350245 - DNA, 18 bp, Homo sapiens
cgctgcccacctgccggc

SEQ ID NO: 1350246 - DNA, 21 bp, Homo sapiens
cgctgccccatctcccctcag

SEQ ID NO: 1350247 - DNA, 22 bp, Homo sapiens
cgcttcttgcctctgtgctgtg

SEQ ID NO: 1350248 - DNA, 14 bp, Homo sapiens
cgcttttccttggc

SEQ ID NO: 1350249 - DNA, 17 bp, Homo sapiens
cgcttttccttggcatt

SEQ ID NO: 1350250 - DNA, 17 bp, Homo sapiens
cggaacccaagcttaga

SEQ ID NO: 1350251 - DNA, 13 bp, Homo sapiens
cggaatttacctg

SEQ ID NO: 1350252 - DNA, 19 bp, Homo sapiens
cggaggcaaagctggctca

SEQ ID NO: 1350253 - DNA, 21 bp, Homo sapiens
cggaggcctgcgaccctgggg

SEQ ID NO: 1350254 - DNA, 12 bp, Homo sapiens
cggagggctgcg

SEQ ID NO: 1350255 - DNA, 17 bp, Homo sapiens
cggcagccccagcctgc

SEQ ID NO: 1350256 - DNA, 18 bp, Homo sapiens
cggcagccccagcctgct

SEQ ID NO: 1350257 - DNA, 22 bp, Homo sapiens
cggcagccccagcctgctagct

SEQ ID NO: 1350258 - DNA, 19 bp, Homo sapiens
cggcaggctcactgccagg

SEQ ID NO: 1350259 - DNA, 22 bp, Homo sapiens
cggcaggctcactgccaggcca

SEQ ID NO: 1350260 - DNA, 23 bp, Homo sapiens
cggcaggctcactgccaggccag

SEQ ID NO: 1350261 - DNA, 14 bp, Homo sapiens
cggcaggggcctgg

SEQ ID NO: 1350262 - DNA, 21 bp, Homo sapiens
cggcagtattgaagctcgtga

SEQ ID NO: 1350263 - DNA, 12 bp, Homo sapiens
cggccaagaatg

SEQ ID NO: 1350264 - DNA, 16 bp, Homo sapiens
cggcccgcgccacagg

SEQ ID NO: 1350265 - DNA, 16 bp, Homo sapiens
cggcgtacaggctggc

SEQ ID NO: 1350266 - DNA, 16 bp, Homo sapiens
cggcgtggcccaaggc

SEQ ID NO: 1350267 - DNA, 19 bp, Homo sapiens
cggctcccagcctcagcgc

SEQ ID NO: 1350268 - DNA, 23 bp, Homo sapiens
cggctgaccatgctcatctgctg

SEQ ID NO: 1350269 - DNA, 16 bp, Homo sapiens
cgggaacatgccccct

SEQ ID NO: 1350270 - DNA, 20 bp, Homo sapiens
cgggaacctccccagcctgc

SEQ ID NO: 1350271 - DNA, 18 bp, Homo sapiens
cgggaccaccctgagccg

SEQ ID NO: 1350272 - DNA, 20 bp, Homo sapiens
cggggaagagatccaaagac

SEQ ID NO: 1350273 - DNA, 14 bp, Homo sapiens
cggggaccctgtga

SEQ ID NO: 1350274 - DNA, 14 bp, Homo sapiens
cggggctgtcggcg

SEQ ID NO: 1350275 - DNA, 16 bp, Homo sapiens
cgggggcaggtgctgg

SEQ ID NO: 1350276 - DNA, 22 bp, Homo sapiens
cggggtgagtccattctcccag

SEQ ID NO: 1350277 - DNA, 16 bp, Homo sapiens
cggggtggccacagcg

SEQ ID NO: 1350278 - DNA, 14 bp, Homo sapiens
cgggtggggaaagg

SEQ ID NO: 1350279 - DNA, 21 bp, Homo sapiens
cgggtggggaaaggaggtggg

SEQ ID NO: 1350280 - DNA, 12 bp, Homo sapiens
cgggtggtcccc

SEQ ID NO: 1350281 - DNA, 18 bp, Homo sapiens
cggtaactgtcctgtcct

SEQ ID NO: 1350282 - DNA, 18 bp, Homo sapiens
cggtaggttcagccaagg

SEQ ID NO: 1350283 - DNA, 12 bp, Homo sapiens
cggtcactgatg

SEQ ID NO: 1350284 - DNA, 16 bp, Homo sapiens
cggtctcctgactggt

SEQ ID NO: 1350285 - DNA, 20 bp, Homo sapiens
cggtgcccaagccagaggct

SEQ ID NO: 1350286 - DNA, 18 bp, Homo sapiens
cggtgctcggagaagagc

SEQ ID NO: 1350287 - DNA, 19 bp, Homo sapiens
cggtgctgtgagggagggg

SEQ ID NO: 1350288 - DNA, 13 bp, Homo sapiens
cggtttccaggga

SEQ ID NO: 1350289 - DNA, 16 bp, Homo sapiens
cggtttccagggaggg

SEQ ID NO: 1350290 - DNA, 16 bp, Homo sapiens
cggttttactgcagct

SEQ ID NO: 1350291 - DNA, 19 bp, Homo sapiens
cgtacaagtagttctgtat

SEQ ID NO: 1350292 - DNA, 21 bp, Homo sapiens
cgtacaagtagttctgtattt

SEQ ID NO: 1350293 - DNA, 22 bp, Homo sapiens
cgtacaagtagttctgtatttg

SEQ ID NO: 1350294 - DNA, 20 bp, Homo sapiens
cgtacataatactgaaccac

SEQ ID NO: 1350295 - DNA, 16 bp, Homo sapiens
cgtataggcatgtaaa

SEQ ID NO: 1350296 - DNA, 15 bp, Homo sapiens
cgtatggctttattt

SEQ ID NO: 1350297 - DNA, 15 bp, Homo sapiens
cgtcaccaccacccc

SEQ ID NO: 1350298 - DNA, 21 bp, Homo sapiens
cgtccaggccgcgccctttcc

SEQ ID NO: 1350299 - DNA, 22 bp, Homo sapiens
cgtccaggccgcgccctttccc

SEQ ID NO: 1350300 - DNA, 11 bp, Homo sapiens
cgtccctggcg

SEQ ID NO: 1350301 - DNA, 20 bp, Homo sapiens
cgtctccaggggctgcttcc

SEQ ID NO: 1350302 - DNA, 21 bp, Homo sapiens
cgtctccaggggctgcttcct

SEQ ID NO: 1350303 - DNA, 23 bp, Homo sapiens
cgtctctggagcggaatttacct

SEQ ID NO: 1350304 - DNA, 18 bp, Homo sapiens
cgtgaaaacggagctgaa

SEQ ID NO: 1350305 - DNA, 19 bp, Homo sapiens
cgtgaaagtgcatttttgt

SEQ ID NO: 1350306 - DNA, 18 bp, Homo sapiens
cgtgaagatactttgtat

SEQ ID NO: 1350307 - DNA, 22 bp, Homo sapiens
cgtgaagatactttgtattgtc

SEQ ID NO: 1350308 - DNA, 20 bp, Homo sapiens
cgtgaccggacttttctgca

SEQ ID NO: 1350309 - DNA, 16 bp, Homo sapiens
cgtgccgcctgcactc

SEQ ID NO: 1350310 - DNA, 15 bp, Homo sapiens
cgtgcctgtgtccat

SEQ ID NO: 1350311 - DNA, 17 bp, Homo sapiens
cgtgctactgcactcca

SEQ ID NO: 1350312 - DNA, 20 bp, Homo sapiens
cgtggctcgactatagaaaa

SEQ ID NO: 1350313 - DNA, 19 bp, Homo sapiens
cgtgggacggtgcccaagc

SEQ ID NO: 1350314 - DNA, 12 bp, Homo sapiens
cgtgggctcccg

SEQ ID NO: 1350315 - DNA, 11 bp, Homo sapiens
cgtggggaggt

SEQ ID NO: 1350316 - DNA, 16 bp, Homo sapiens
cgtgggggggcgtgga

SEQ ID NO: 1350317 - DNA, 23 bp, Homo sapiens
cgtgtgagaagtgaatgctggga

SEQ ID NO: 1350318 - DNA, 13 bp, Homo sapiens
cgttagctcctgt

SEQ ID NO: 1350319 - DNA, 17 bp, Homo sapiens
cgttagctcctgtggcc

SEQ ID NO: 1350320 - DNA, 23 bp, Homo sapiens
cgttttaaggactgactgaggca

SEQ ID NO: 1350321 - DNA, 16 bp, Homo sapiens
cgttttttcctcagtg

SEQ ID NO: 1350322 - DNA, 13 bp, Homo sapiens
ctaaaaagtataa

SEQ ID NO: 1350323 - DNA, 15 bp, Homo sapiens
ctaaaaagtataaaa

SEQ ID NO: 1350324 - DNA, 12 bp, Homo sapiens
ctaaaatcatga

SEQ ID NO: 1350325 - DNA, 19 bp, Homo sapiens
ctaaacaatgctgatttgg

SEQ ID NO: 1350326 - DNA, 13 bp, Homo sapiens
ctaaacctcagtt

SEQ ID NO: 1350327 - DNA, 14 bp, Homo sapiens
ctaaagcaatagaa

SEQ ID NO: 1350328 - DNA, 22 bp, Homo sapiens
ctaaagcatgaaatgtgaattt

SEQ ID NO: 1350329 - DNA, 21 bp, Homo sapiens
ctaaagtaaaaagggaattat

SEQ ID NO: 1350330 - DNA, 19 bp, Homo sapiens
ctaaatcagagacaaaata

SEQ ID NO: 1350331 - DNA, 12 bp, Homo sapiens
ctaaatctattt

SEQ ID NO: 1350332 - DNA, 14 bp, Homo sapiens
ctaaatctatttat

SEQ ID NO: 1350333 - DNA, 12 bp, Homo sapiens
ctaaatggcctc

SEQ ID NO: 1350334 - DNA, 13 bp, Homo sapiens
ctaaatggcctca

SEQ ID NO: 1350335 - DNA, 14 bp, Homo sapiens
ctaaccccttccag

SEQ ID NO: 1350336 - DNA, 19 bp, Homo sapiens
ctaaccccttccagatcac

SEQ ID NO: 1350337 - DNA, 17 bp, Homo sapiens
ctaacctcgccctctcc

SEQ ID NO: 1350338 - DNA, 13 bp, Homo sapiens
ctaactgtaaatc

SEQ ID NO: 1350339 - DNA, 11 bp, Homo sapiens
ctaagagaagt

SEQ ID NO: 1350340 - DNA, 11 bp, Homo sapiens
ctaaggacctt

SEQ ID NO: 1350341 - DNA, 19 bp, Homo sapiens
ctaagtccagtgtttcttt

SEQ ID NO: 1350342 - DNA, 20 bp, Homo sapiens
ctaagtgggcattgccatgt

SEQ ID NO: 1350343 - DNA, 20 bp, Homo sapiens
ctaataatcttgtttctgaa

SEQ ID NO: 1350344 - DNA, 13 bp, Homo sapiens
ctaatatatatga

SEQ ID NO: 1350345 - DNA, 17 bp, Homo sapiens
ctaatatatatgaataa

SEQ ID NO: 1350346 - DNA, 14 bp, Homo sapiens
ctaatattttatgt

SEQ ID NO: 1350347 - DNA, 18 bp, Homo sapiens
ctaatctatggtcgggag

SEQ ID NO: 1350348 - DNA, 16 bp, Homo sapiens
ctaattaatctggaat

SEQ ID NO: 1350349 - DNA, 22 bp, Homo sapiens
ctaattgctgtgtgtcccaggc

SEQ ID NO: 1350350 - DNA, 14 bp, Homo sapiens
ctaatttctcctcc

SEQ ID NO: 1350351 - DNA, 18 bp, Homo sapiens
ctaatttctcctcccttc

SEQ ID NO: 1350352 - DNA, 19 bp, Homo sapiens
ctaattttacatgtttata

SEQ ID NO: 1350353 - DNA, 19 bp, Homo sapiens
ctaatttttgtattatttt

SEQ ID NO: 1350354 - DNA, 19 bp, Homo sapiens
ctacaaaaagcataaaaat

SEQ ID NO: 1350355 - DNA, 22 bp, Homo sapiens
ctacagaaatgaggaggatgct

SEQ ID NO: 1350356 - DNA, 16 bp, Homo sapiens
ctacagtggttttata

SEQ ID NO: 1350357 - DNA, 19 bp, Homo sapiens
ctacagttgaaaaacagct

SEQ ID NO: 1350358 - DNA, 17 bp, Homo sapiens
ctacatatcccttccag

SEQ ID NO: 1350359 - DNA, 21 bp, Homo sapiens
ctacatatcccttccagatgg

SEQ ID NO: 1350360 - DNA, 15 bp, Homo sapiens
ctaccctcagtgagc

SEQ ID NO: 1350361 - DNA, 21 bp, Homo sapiens
ctaccgacccagggttcccgc

SEQ ID NO: 1350362 - DNA, 14 bp, Homo sapiens
ctacctgccctcaa

SEQ ID NO: 1350363 - DNA, 16 bp, Homo sapiens
ctacctgccctcaagg

SEQ ID NO: 1350364 - DNA, 23 bp, Homo sapiens
ctacctgtatttaaaaatagaaa

SEQ ID NO: 1350365 - DNA, 16 bp, Homo sapiens
ctacctttcaaagctt

SEQ ID NO: 1350366 - DNA, 12 bp, Homo sapiens
ctacgtttcttt

SEQ ID NO: 1350367 - DNA, 14 bp, Homo sapiens
ctacgtttctttaa

SEQ ID NO: 1350368 - DNA, 17 bp, Homo sapiens
ctactcaagcgggtggc

SEQ ID NO: 1350369 - DNA, 20 bp, Homo sapiens
ctactcaagcgggtggctct

SEQ ID NO: 1350370 - DNA, 17 bp, Homo sapiens
ctactccctgcagatgc

SEQ ID NO: 1350371 - DNA, 22 bp, Homo sapiens
ctactccctgcagatgccaccc

SEQ ID NO: 1350372 - DNA, 21 bp, Homo sapiens
ctactctcacactggttctca

SEQ ID NO: 1350373 - DNA, 19 bp, Homo sapiens
ctactgacatatctacact

SEQ ID NO: 1350374 - DNA, 18 bp, Homo sapiens
ctactgcactccagcctg

SEQ ID NO: 1350375 - DNA, 21 bp, Homo sapiens
ctactgcactccagcctgggg

SEQ ID NO: 1350376 - DNA, 23 bp, Homo sapiens
ctactgcactccagcctggggga

SEQ ID NO: 1350377 - DNA, 19 bp, Homo sapiens
ctactgcatttagggagta

SEQ ID NO: 1350378 - DNA, 20 bp, Homo sapiens
ctactgtcaaatgatgtgca

SEQ ID NO: 1350379 - DNA, 16 bp, Homo sapiens
ctacttgggaggctga

SEQ ID NO: 1350380 - DNA, 17 bp, Homo sapiens
ctactttgtggcaatct

SEQ ID NO: 1350381 - DNA, 13 bp, Homo sapiens
ctagaagccaagg

SEQ ID NO: 1350382 - DNA, 16 bp, Homo sapiens
ctagaagccaagggaa

SEQ ID NO: 1350383 - DNA, 19 bp, Homo sapiens
ctagactagcaatctcttc

SEQ ID NO: 1350384 - DNA, 21 bp, Homo sapiens
ctagagtgaacttgggccact

SEQ ID NO: 1350385 - DNA, 16 bp, Homo sapiens
ctagataggaggatgg

SEQ ID NO: 1350386 - DNA, 12 bp, Homo sapiens
ctagattgacta

SEQ ID NO: 1350387 - DNA, 19 bp, Homo sapiens
ctagcaaaataaaacatag

SEQ ID NO: 1350388 - DNA, 19 bp, Homo sapiens
ctagcagcccaccctgctg

SEQ ID NO: 1350389 - DNA, 16 bp, Homo sapiens
ctagcgatctctcctg

SEQ ID NO: 1350390 - DNA, 17 bp, Homo sapiens
ctagcgatctctcctgg

SEQ ID NO: 1350391 - DNA, 19 bp, Homo sapiens
ctagcgatctctcctggcc

SEQ ID NO: 1350392 - DNA, 20 bp, Homo sapiens
ctagcgatctctcctggcct

SEQ ID NO: 1350393 - DNA, 15 bp, Homo sapiens
ctagctaattattta

SEQ ID NO: 1350394 - DNA, 15 bp, Homo sapiens
ctagctcctcccctt

SEQ ID NO: 1350395 - DNA, 18 bp, Homo sapiens
ctagcttctgcttttctg

SEQ ID NO: 1350396 - DNA, 23 bp, Homo sapiens
ctagcttctgcttttctgccctg

SEQ ID NO: 1350397 - DNA, 20 bp, Homo sapiens
ctagcttgggaggcttcccc

SEQ ID NO: 1350398 - DNA, 19 bp, Homo sapiens
ctaggcccccacttgcctc

SEQ ID NO: 1350399 - DNA, 22 bp, Homo sapiens
ctaggcccccacttgcctcttc

SEQ ID NO: 1350400 - DNA, 13 bp, Homo sapiens
ctaggcctgggga

SEQ ID NO: 1350401 - DNA, 14 bp, Homo sapiens
ctagggaagataat

SEQ ID NO: 1350402 - DNA, 16 bp, Homo sapiens
ctaggtagagtctgag

SEQ ID NO: 1350403 - DNA, 14 bp, Homo sapiens
ctagtcaccagaga

SEQ ID NO: 1350404 - DNA, 16 bp, Homo sapiens
ctagttctaacagtga

SEQ ID NO: 1350405 - DNA, 12 bp, Homo sapiens
ctagttgaatac

SEQ ID NO: 1350406 - DNA, 13 bp, Homo sapiens
ctagttgaatact

SEQ ID NO: 1350407 - DNA, 23 bp, Homo sapiens
ctagttgaatacttgaaccataa

SEQ ID NO: 1350408 - DNA, 13 bp, Homo sapiens
ctataaaactctg

SEQ ID NO: 1350409 - DNA, 18 bp, Homo sapiens
ctataaagcagtattttt

SEQ ID NO: 1350410 - DNA, 16 bp, Homo sapiens
ctatataatttatttc

SEQ ID NO: 1350411 - DNA, 17 bp, Homo sapiens
ctatatatataaatgta

SEQ ID NO: 1350412 - DNA, 18 bp, Homo sapiens
ctatattttaacctgcat

SEQ ID NO: 1350413 - DNA, 14 bp, Homo sapiens
ctatattttgtcat

SEQ ID NO: 1350414 - DNA, 14 bp, Homo sapiens
ctatccgctgccag

SEQ ID NO: 1350415 - DNA, 15 bp, Homo sapiens
ctatccgctgccagc

SEQ ID NO: 1350416 - DNA, 13 bp, Homo sapiens
ctatcctacccca

SEQ ID NO: 1350417 - DNA, 13 bp, Homo sapiens
ctatctatttgag

SEQ ID NO: 1350418 - DNA, 18 bp, Homo sapiens
ctatctcaatcctaattt

SEQ ID NO: 1350419 - DNA, 12 bp, Homo sapiens
ctatctcctgac

SEQ ID NO: 1350420 - DNA, 15 bp, Homo sapiens
ctatctcctgacaga

SEQ ID NO: 1350421 - DNA, 21 bp, Homo sapiens
ctatctgtctggtggccccgt

SEQ ID NO: 1350422 - DNA, 17 bp, Homo sapiens
ctatgctttccaaacct

SEQ ID NO: 1350423 - DNA, 22 bp, Homo sapiens
ctatggcagaaaaaatgtctgt

SEQ ID NO: 1350424 - DNA, 21 bp, Homo sapiens
ctatggtcgggagacagcatc

SEQ ID NO: 1350425 - DNA, 13 bp, Homo sapiens
ctatgtataaaat

SEQ ID NO: 1350426 - DNA, 12 bp, Homo sapiens
ctatgtgacaat

SEQ ID NO: 1350427 - DNA, 14 bp, Homo sapiens
ctattaatatatgt

SEQ ID NO: 1350428 - DNA, 15 bp, Homo sapiens
ctattagtgttatat

SEQ ID NO: 1350429 - DNA, 12 bp, Homo sapiens
ctattccaataa

SEQ ID NO: 1350430 - DNA, 15 bp, Homo sapiens
ctattccaataaact

SEQ ID NO: 1350431 - DNA, 16 bp, Homo sapiens
ctattctgagaaaaca

SEQ ID NO: 1350432 - DNA, 15 bp, Homo sapiens
ctattgccaaccagt

SEQ ID NO: 1350433 - DNA, 16 bp, Homo sapiens
ctattgctgcttgagg

SEQ ID NO: 1350434 - DNA, 14 bp, Homo sapiens
ctatttaagatgtg

SEQ ID NO: 1350435 - DNA, 20 bp, Homo sapiens
ctatttattaatatttaaca

SEQ ID NO: 1350436 - DNA, 19 bp, Homo sapiens
ctatttattgactctgggt

SEQ ID NO: 1350437 - DNA, 13 bp, Homo sapiens
ctatttattttcc

SEQ ID NO: 1350438 - DNA, 21 bp, Homo sapiens
ctatttattttcctaaagaga

SEQ ID NO: 1350439 - DNA, 15 bp, Homo sapiens
ctattttctaaagac

SEQ ID NO: 1350440 - DNA, 14 bp, Homo sapiens
ctatttttgtaaag

SEQ ID NO: 1350441 - DNA, 22 bp, Homo sapiens
ctcaaagcactgttgagaagga

SEQ ID NO: 1350442 - DNA, 15 bp, Homo sapiens
ctcaaagtttgacag

SEQ ID NO: 1350443 - DNA, 16 bp, Homo sapiens
ctcaaatacacatttg

SEQ ID NO: 1350444 - DNA, 18 bp, Homo sapiens
ctcaaatacacatttgct

SEQ ID NO: 1350445 - DNA, 21 bp, Homo sapiens
ctcaacctcttctggctcaaa

SEQ ID NO: 1350446 - DNA, 16 bp, Homo sapiens
ctcaagaggaatgaaa

SEQ ID NO: 1350447 - DNA, 20 bp, Homo sapiens
ctcaataaagtgctttaaaa

SEQ ID NO: 1350448 - DNA, 16 bp, Homo sapiens
ctcaatagatctccag

SEQ ID NO: 1350449 - DNA, 19 bp, Homo sapiens
ctcaatcctaatttctcct

SEQ ID NO: 1350450 - DNA, 13 bp, Homo sapiens
ctcaatgaaaaat

SEQ ID NO: 1350451 - DNA, 22 bp, Homo sapiens
ctcaatgcagttagctgaagaa

SEQ ID NO: 1350452 - DNA, 23 bp, Homo sapiens
ctcacactggttctcaatgaaaa

SEQ ID NO: 1350453 - DNA, 19 bp, Homo sapiens
ctcacagagtcaaggcctg

SEQ ID NO: 1350454 - DNA, 20 bp, Homo sapiens
ctcacagagtcaaggcctgc

SEQ ID NO: 1350455 - DNA, 15 bp, Homo sapiens
ctcacagctatgcaa

SEQ ID NO: 1350456 - DNA, 22 bp, Homo sapiens
ctcacagctatgcaaaaagcta

SEQ ID NO: 1350457 - DNA, 18 bp, Homo sapiens
ctcaccagccccactgcc

SEQ ID NO: 1350458 - DNA, 21 bp, Homo sapiens
ctcaccagccccactgccagc

SEQ ID NO: 1350459 - DNA, 15 bp, Homo sapiens
ctcaccccctcccac

SEQ ID NO: 1350460 - DNA, 21 bp, Homo sapiens
ctcaccccctcccacccccag

SEQ ID NO: 1350461 - DNA, 17 bp, Homo sapiens
ctcacctcatgcccacc

SEQ ID NO: 1350462 - DNA, 23 bp, Homo sapiens
ctcacctcatgcccaccccctgc

SEQ ID NO: 1350463 - DNA, 15 bp, Homo sapiens
ctcactaggccccca

SEQ ID NO: 1350464 - DNA, 21 bp, Homo sapiens
ctcactgccaggccagcctcc

SEQ ID NO: 1350465 - DNA, 22 bp, Homo sapiens
ctcactgccaggccagcctccg

SEQ ID NO: 1350466 - DNA, 18 bp, Homo sapiens
ctcactggggcctacagc

SEQ ID NO: 1350467 - DNA, 23 bp, Homo sapiens
ctcagaaagtgtataataagaaa

SEQ ID NO: 1350468 - DNA, 14 bp, Homo sapiens
ctcagaaccacagc

SEQ ID NO: 1350469 - DNA, 19 bp, Homo sapiens
ctcagagaaaaatgctccc

SEQ ID NO: 1350470 - DNA, 20 bp, Homo sapiens
ctcagagaaaaatgctcccc

SEQ ID NO: 1350471 - DNA, 16 bp, Homo sapiens
ctcagcctctcgaagt

SEQ ID NO: 1350472 - DNA, 17 bp, Homo sapiens
ctcagccttcagacaga

SEQ ID NO: 1350473 - DNA, 14 bp, Homo sapiens
ctcagcgcggccct

SEQ ID NO: 1350474 - DNA, 13 bp, Homo sapiens
ctcagctcggctc

SEQ ID NO: 1350475 - DNA, 14 bp, Homo sapiens
ctcagctcggctca

SEQ ID NO: 1350476 - DNA, 16 bp, Homo sapiens
ctcagctcggctcagc

SEQ ID NO: 1350477 - DNA, 17 bp, Homo sapiens
ctcagctcggctcagct

SEQ ID NO: 1350478 - DNA, 18 bp, Homo sapiens
ctcagctcggctcagctc

SEQ ID NO: 1350479 - DNA, 21 bp, Homo sapiens
ctcagctttgagaagccttca

SEQ ID NO: 1350480 - DNA, 22 bp, Homo sapiens
ctcagctttgagaagccttcag

SEQ ID NO: 1350481 - DNA, 20 bp, Homo sapiens
ctcaggaggcgcccttggct

SEQ ID NO: 1350482 - DNA, 14 bp, Homo sapiens
ctcagggcagcctc

SEQ ID NO: 1350483 - DNA, 13 bp, Homo sapiens
ctcagggccatgc

SEQ ID NO: 1350484 - DNA, 15 bp, Homo sapiens
ctcagggccatgctg

SEQ ID NO: 1350485 - DNA, 17 bp, Homo sapiens
ctcagggccatgctgag

SEQ ID NO: 1350486 - DNA, 18 bp, Homo sapiens
ctcagggccatgctgagg

SEQ ID NO: 1350487 - DNA, 16 bp, Homo sapiens
ctcagggctcccaggg

SEQ ID NO: 1350488 - DNA, 14 bp, Homo sapiens
ctcaggtgagaagc

SEQ ID NO: 1350489 - DNA, 11 bp, Homo sapiens
ctcagtgcaga

SEQ ID NO: 1350490 - DNA, 12 bp, Homo sapiens
ctcagtgcagat

SEQ ID NO: 1350491 - DNA, 14 bp, Homo sapiens
ctcagtgcatttgt

SEQ ID NO: 1350492 - DNA, 16 bp, Homo sapiens
ctcagtgcatttgtgc

SEQ ID NO: 1350493 - DNA, 22 bp, Homo sapiens
ctcagtgcatttgtgctagaaa

SEQ ID NO: 1350494 - DNA, 15 bp, Homo sapiens
ctcagtgccctccag

SEQ ID NO: 1350495 - DNA, 17 bp, Homo sapiens
ctcatcaatcaaataag

SEQ ID NO: 1350496 - DNA, 18 bp, Homo sapiens
ctcatctatctcaatcct

SEQ ID NO: 1350497 - DNA, 14 bp, Homo sapiens
ctcatctgctggtc

SEQ ID NO: 1350498 - DNA, 13 bp, Homo sapiens
ctcatgcccaccc

SEQ ID NO: 1350499 - DNA, 16 bp, Homo sapiens
ctcatgcccaccccct

SEQ ID NO: 1350500 - DNA, 23 bp, Homo sapiens
ctcatgcccaccccctgccctgc

SEQ ID NO: 1350501 - DNA, 13 bp, Homo sapiens
ctcatgtggctgg

SEQ ID NO: 1350502 - DNA, 14 bp, Homo sapiens
ctcatgtggctgga

SEQ ID NO: 1350503 - DNA, 18 bp, Homo sapiens
ctcattatgccacttcct

SEQ ID NO: 1350504 - DNA, 12 bp, Homo sapiens
ctcattgacttt

SEQ ID NO: 1350505 - DNA, 21 bp, Homo sapiens
ctcattgacttttataaagca

SEQ ID NO: 1350506 - DNA, 20 bp, Homo sapiens
ctcattgctgagcctctgct

SEQ ID NO: 1350507 - DNA, 18 bp, Homo sapiens
ctcatttaagggaaaaat

SEQ ID NO: 1350508 - DNA, 16 bp, Homo sapiens
ctcatttcatctcatt

SEQ ID NO: 1350509 - DNA, 14 bp, Homo sapiens
ctccaaccctgccg

SEQ ID NO: 1350510 - DNA, 23 bp, Homo sapiens
ctccaaccctgccgtcaccacca

SEQ ID NO: 1350511 - DNA, 15 bp, Homo sapiens
ctccaagccccatct

SEQ ID NO: 1350512 - DNA, 18 bp, Homo sapiens
ctccaagccccatcttct

SEQ ID NO: 1350513 - DNA, 13 bp, Homo sapiens
ctccacagcgagg

SEQ ID NO: 1350514 - DNA, 16 bp, Homo sapiens
ctccacagcgagggca

SEQ ID NO: 1350515 - DNA, 20 bp, Homo sapiens
ctccacagcgagggcagctg

SEQ ID NO: 1350516 - DNA, 13 bp, Homo sapiens
ctccacatctgcc

SEQ ID NO: 1350517 - DNA, 17 bp, Homo sapiens
ctccacatctgccttaa

SEQ ID NO: 1350518 - DNA, 20 bp, Homo sapiens
ctccaccagcatcacctgcc

SEQ ID NO: 1350519 - DNA, 23 bp, Homo sapiens
ctccaccagcatcacctgcctgt

SEQ ID NO: 1350520 - DNA, 11 bp, Homo sapiens
ctccaccccag

SEQ ID NO: 1350521 - DNA, 13 bp, Homo sapiens
ctccactctgctt

SEQ ID NO: 1350522 - DNA, 15 bp, Homo sapiens
ctccactctgcttct

SEQ ID NO: 1350523 - DNA, 17 bp, Homo sapiens
ctccactctgcttctct

SEQ ID NO: 1350524 - DNA, 20 bp, Homo sapiens
ctccactctgcttctctgac

SEQ ID NO: 1350525 - DNA, 19 bp, Homo sapiens
ctccagatgtttccagact

SEQ ID NO: 1350526 - DNA, 21 bp, Homo sapiens
ctccagcaacacagcctgggc

SEQ ID NO: 1350527 - DNA, 15 bp, Homo sapiens
ctccagcaacttctt

SEQ ID NO: 1350528 - DNA, 11 bp, Homo sapiens
ctccagccagc

SEQ ID NO: 1350529 - DNA, 13 bp, Homo sapiens
ctccagccagcgc

SEQ ID NO: 1350530 - DNA, 15 bp, Homo sapiens
ctccagccagcgcct

SEQ ID NO: 1350531 - DNA, 17 bp, Homo sapiens
ctccagccagcgcctcc

SEQ ID NO: 1350532 - DNA, 23 bp, Homo sapiens
ctccagccagcgcctccctccac

SEQ ID NO: 1350533 - DNA, 12 bp, Homo sapiens
ctccagcctggg

SEQ ID NO: 1350534 - DNA, 18 bp, Homo sapiens
ctccagcgtcagctgctc

SEQ ID NO: 1350535 - DNA, 12 bp, Homo sapiens
ctccaggccaaa

SEQ ID NO: 1350536 - DNA, 18 bp, Homo sapiens
ctccaggccctcctctcc

SEQ ID NO: 1350537 - DNA, 16 bp, Homo sapiens
ctccaggcctgcctcc

SEQ ID NO: 1350538 - DNA, 18 bp, Homo sapiens
ctccaggcctgcctccca

SEQ ID NO: 1350539 - DNA, 19 bp, Homo sapiens
ctccagggaatccaagcct

SEQ ID NO: 1350540 - DNA, 21 bp, Homo sapiens
ctccagggaatccaagcctcc

SEQ ID NO: 1350541 - DNA, 22 bp, Homo sapiens
ctccagggaatccaagcctcca

SEQ ID NO: 1350542 - DNA, 18 bp, Homo sapiens
ctccagggacacacagcc

SEQ ID NO: 1350543 - DNA, 20 bp, Homo sapiens
ctccagggacacacagccta

SEQ ID NO: 1350544 - DNA, 13 bp, Homo sapiens
ctccaggtgcaga

SEQ ID NO: 1350545 - DNA, 14 bp, Homo sapiens
ctccaggtgcagag

SEQ ID NO: 1350546 - DNA, 15 bp, Homo sapiens
ctccaggtgcagagg

SEQ ID NO: 1350547 - DNA, 18 bp, Homo sapiens
ctccaggtgcagaggtac

SEQ ID NO: 1350548 - DNA, 21 bp, Homo sapiens
ctccatagtttggcatttgca

SEQ ID NO: 1350549 - DNA, 15 bp, Homo sapiens
ctccatcaccctctt

SEQ ID NO: 1350550 - DNA, 22 bp, Homo sapiens
ctccatcaccctcttcctgtga

SEQ ID NO: 1350551 - DNA, 17 bp, Homo sapiens
ctccatttgctcttcag

SEQ ID NO: 1350552 - DNA, 15 bp, Homo sapiens
ctcccacaaaggaga

SEQ ID NO: 1350553 - DNA, 21 bp, Homo sapiens
ctcccacacccaaagctgagc

SEQ ID NO: 1350554 - DNA, 22 bp, Homo sapiens
ctcccacacccaaagctgagcc

SEQ ID NO: 1350555 - DNA, 15 bp, Homo sapiens
ctcccacttctgcca

SEQ ID NO: 1350556 - DNA, 19 bp, Homo sapiens
ctcccaggagcctgcccag

SEQ ID NO: 1350557 - DNA, 20 bp, Homo sapiens
ctcccaggagcctgcccagc

SEQ ID NO: 1350558 - DNA, 13 bp, Homo sapiens
ctcccaggggtct

SEQ ID NO: 1350559 - DNA, 22 bp, Homo sapiens
ctcccaggtaccagctgcgctt

SEQ ID NO: 1350560 - DNA, 15 bp, Homo sapiens
ctccccacagcgtcc

SEQ ID NO: 1350561 - DNA, 12 bp, Homo sapiens
ctccccagcctg

SEQ ID NO: 1350562 - DNA, 13 bp, Homo sapiens
ctccccagcctgc

SEQ ID NO: 1350563 - DNA, 19 bp, Homo sapiens
ctccccaggtccagctctg

SEQ ID NO: 1350564 - DNA, 23 bp, Homo sapiens
ctccccaggtccagctctggagg

SEQ ID NO: 1350565 - DNA, 17 bp, Homo sapiens
ctccccatggagccagc

SEQ ID NO: 1350566 - DNA, 18 bp, Homo sapiens
ctccccatttcccatctg

SEQ ID NO: 1350567 - DNA, 20 bp, Homo sapiens
ctccccatttcccatctgca

SEQ ID NO: 1350568 - DNA, 22 bp, Homo sapiens
ctccccctagtttgtgagaaac

SEQ ID NO: 1350569 - DNA, 11 bp, Homo sapiens
ctcccctgagg

SEQ ID NO: 1350570 - DNA, 13 bp, Homo sapiens
ctcccctgccacc

SEQ ID NO: 1350571 - DNA, 23 bp, Homo sapiens
ctcccctgccaccaggccacctc

SEQ ID NO: 1350572 - DNA, 16 bp, Homo sapiens
ctcccctttttttccc

SEQ ID NO: 1350573 - DNA, 23 bp, Homo sapiens
ctcccgagaccgggccctgggtt

SEQ ID NO: 1350574 - DNA, 18 bp, Homo sapiens
ctcccgggccccacagac

SEQ ID NO: 1350575 - DNA, 13 bp, Homo sapiens
ctccctccacccc

SEQ ID NO: 1350576 - DNA, 18 bp, Homo sapiens
ctccctccaccccaggac

SEQ ID NO: 1350577 - DNA, 14 bp, Homo sapiens
ctccctcctccagg

SEQ ID NO: 1350578 - DNA, 15 bp, Homo sapiens
ctccctcctccaggc

SEQ ID NO: 1350579 - DNA, 15 bp, Homo sapiens
ctccctgcagatgcc

SEQ ID NO: 1350580 - DNA, 23 bp, Homo sapiens
ctccctgcagatgccaccctagc

SEQ ID NO: 1350581 - DNA, 16 bp, Homo sapiens
ctccctgcctggcccc

SEQ ID NO: 1350582 - DNA, 12 bp, Homo sapiens
ctcccttccttt

SEQ ID NO: 1350583 - DNA, 18 bp, Homo sapiens
ctcccttgctggccccag

SEQ ID NO: 1350584 - DNA, 22 bp, Homo sapiens
ctcccttgctggccccagccct

SEQ ID NO: 1350585 - DNA, 14 bp, Homo sapiens
ctccgagaggtggg

SEQ ID NO: 1350586 - DNA, 12 bp, Homo sapiens
ctccgcaggact

SEQ ID NO: 1350587 - DNA, 12 bp, Homo sapiens
ctccgccagcct

SEQ ID NO: 1350588 - DNA, 16 bp, Homo sapiens
ctccgccctgccactc

SEQ ID NO: 1350589 - DNA, 19 bp, Homo sapiens
ctccggcctctgcctttgc

SEQ ID NO: 1350590 - DNA, 14 bp, Homo sapiens
ctccggctcccagc

SEQ ID NO: 1350591 - DNA, 20 bp, Homo sapiens
ctccggctcccagcctcagc

SEQ ID NO: 1350592 - DNA, 19 bp, Homo sapiens
ctcctacatatcccttcca

SEQ ID NO: 1350593 - DNA, 15 bp, Homo sapiens
ctcctatatatttct

SEQ ID NO: 1350594 - DNA, 18 bp, Homo sapiens
ctcctatatatttctatt

SEQ ID NO: 1350595 - DNA, 17 bp, Homo sapiens
ctcctcacctcatgccc

SEQ ID NO: 1350596 - DNA, 20 bp, Homo sapiens
ctcctcacctcatgcccacc

SEQ ID NO: 1350597 - DNA, 22 bp, Homo sapiens
ctcctccagccgccatgctcct

SEQ ID NO: 1350598 - DNA, 19 bp, Homo sapiens
ctcctccaggcctgcctcc

SEQ ID NO: 1350599 - DNA, 14 bp, Homo sapiens
ctcctcccttcctt

SEQ ID NO: 1350600 - DNA, 20 bp, Homo sapiens
ctcctcgtgaaagtgcattt

SEQ ID NO: 1350601 - DNA, 21 bp, Homo sapiens
ctcctctcctactcggctctg

SEQ ID NO: 1350602 - DNA, 21 bp, Homo sapiens
ctcctgaaccgcacagctcag

SEQ ID NO: 1350603 - DNA, 14 bp, Homo sapiens
ctcctgacagaagg

SEQ ID NO: 1350604 - DNA, 16 bp, Homo sapiens
ctcctgacagaaggtg

SEQ ID NO: 1350605 - DNA, 18 bp, Homo sapiens
ctcctgacagaaggtgcc

SEQ ID NO: 1350606 - DNA, 19 bp, Homo sapiens
ctcctgacagaaggtgcca

SEQ ID NO: 1350607 - DNA, 13 bp, Homo sapiens
ctcctgagctagg

SEQ ID NO: 1350608 - DNA, 17 bp, Homo sapiens
ctcctgcacttacttgc

SEQ ID NO: 1350609 - DNA, 20 bp, Homo sapiens
ctcctgcacttacttgctta

SEQ ID NO: 1350610 - DNA, 13 bp, Homo sapiens
ctcctggcctatc

SEQ ID NO: 1350611 - DNA, 23 bp, Homo sapiens
ctcctggcctatccgctgccagc

SEQ ID NO: 1350612 - DNA, 14 bp, Homo sapiens
ctccttagaaaaaa

SEQ ID NO: 1350613 - DNA, 19 bp, Homo sapiens
ctccttatttggcgtgacc

SEQ ID NO: 1350614 - DNA, 12 bp, Homo sapiens
ctccttcagaca

SEQ ID NO: 1350615 - DNA, 15 bp, Homo sapiens
ctcctttaattgtaa

SEQ ID NO: 1350616 - DNA, 17 bp, Homo sapiens
ctcggagaagagcgcag

SEQ ID NO: 1350617 - DNA, 18 bp, Homo sapiens
ctcggatagttgctattt

SEQ ID NO: 1350618 - DNA, 22 bp, Homo sapiens
ctcggatagttgctatttttgt

SEQ ID NO: 1350619 - DNA, 18 bp, Homo sapiens
ctcggatcaggctcccag

SEQ ID NO: 1350620 - DNA, 15 bp, Homo sapiens
ctcggcccctcccac

SEQ ID NO: 1350621 - DNA, 14 bp, Homo sapiens
ctcggggagcctta

SEQ ID NO: 1350622 - DNA, 18 bp, Homo sapiens
ctcggtacccggggccca

SEQ ID NO: 1350623 - DNA, 17 bp, Homo sapiens
ctcggtgtggagaagcg

SEQ ID NO: 1350624 - DNA, 23 bp, Homo sapiens
ctcggtgtggagaagcggctggc

SEQ ID NO: 1350625 - DNA, 13 bp, Homo sapiens
ctcggtttctcca

SEQ ID NO: 1350626 - DNA, 16 bp, Homo sapiens
ctcggtttgccaaaat

SEQ ID NO: 1350627 - DNA, 14 bp, Homo sapiens
ctcgtggctgtcaa

SEQ ID NO: 1350628 - DNA, 13 bp, Homo sapiens
ctctaacatttcc

SEQ ID NO: 1350629 - DNA, 20 bp, Homo sapiens
ctctaacctcgccctctcct

SEQ ID NO: 1350630 - DNA, 16 bp, Homo sapiens
ctctaagtcatgtatg

SEQ ID NO: 1350631 - DNA, 17 bp, Homo sapiens
ctctaagtcatgtatgt

SEQ ID NO: 1350632 - DNA, 21 bp, Homo sapiens
ctctaagtcatgtatgtttct

SEQ ID NO: 1350633 - DNA, 18 bp, Homo sapiens
ctctaagtgggcattgcc

SEQ ID NO: 1350634 - DNA, 13 bp, Homo sapiens
ctctacaaaaagc

SEQ ID NO: 1350635 - DNA, 20 bp, Homo sapiens
ctctaccatcccctgtagag

SEQ ID NO: 1350636 - DNA, 19 bp, Homo sapiens
ctctagaagccaagggaaa

SEQ ID NO: 1350637 - DNA, 14 bp, Homo sapiens
ctctatgctttcca

SEQ ID NO: 1350638 - DNA, 19 bp, Homo sapiens
ctctcacactggttctcaa

SEQ ID NO: 1350639 - DNA, 22 bp, Homo sapiens
ctctcacactggttctcaatga

SEQ ID NO: 1350640 - DNA, 13 bp, Homo sapiens
ctctccactgtgc

SEQ ID NO: 1350641 - DNA, 13 bp, Homo sapiens
ctctccagcctca

SEQ ID NO: 1350642 - DNA, 13 bp, Homo sapiens
ctctcccaaaaaa

SEQ ID NO: 1350643 - DNA, 16 bp, Homo sapiens
ctctccccaggtccag

SEQ ID NO: 1350644 - DNA, 23 bp, Homo sapiens
ctctccccaggtccagctctgga

SEQ ID NO: 1350645 - DNA, 21 bp, Homo sapiens
ctctccggggccatttgcaat

SEQ ID NO: 1350646 - DNA, 22 bp, Homo sapiens
ctctcctaactgccagccccct

SEQ ID NO: 1350647 - DNA, 18 bp, Homo sapiens
ctctcctttgttcccggc

SEQ ID NO: 1350648 - DNA, 23 bp, Homo sapiens
ctctgaaatcttcccatgcattc

SEQ ID NO: 1350649 - DNA, 15 bp, Homo sapiens
ctctgaacttgcctt

SEQ ID NO: 1350650 - DNA, 20 bp, Homo sapiens
ctctgaatttacttccttgc

SEQ ID NO: 1350651 - DNA, 15 bp, Homo sapiens
ctctgacttctgcct

SEQ ID NO: 1350652 - DNA, 21 bp, Homo sapiens
ctctgacttctgcctggagac

SEQ ID NO: 1350653 - DNA, 22 bp, Homo sapiens
ctctgcaagaattgaagcagga

SEQ ID NO: 1350654 - DNA, 10 bp, Homo sapiens
ctctgcacaa

SEQ ID NO: 1350655 - DNA, 17 bp, Homo sapiens
ctctgcacaagctgcac

SEQ ID NO: 1350656 - DNA, 14 bp, Homo sapiens
ctctgcacccagaa

SEQ ID NO: 1350657 - DNA, 16 bp, Homo sapiens
ctctgccgtctctgga

SEQ ID NO: 1350658 - DNA, 15 bp, Homo sapiens
ctctgcctgccccgc

SEQ ID NO: 1350659 - DNA, 21 bp, Homo sapiens
ctctgcgtctatcctgtgtag

SEQ ID NO: 1350660 - DNA, 13 bp, Homo sapiens
ctctgcttctctg

SEQ ID NO: 1350661 - DNA, 16 bp, Homo sapiens
ctctgcttctctgact

SEQ ID NO: 1350662 - DNA, 16 bp, Homo sapiens
ctctggacggcaggct

SEQ ID NO: 1350663 - DNA, 17 bp, Homo sapiens
ctctggacggcaggctc

SEQ ID NO: 1350664 - DNA, 14 bp, Homo sapiens
ctctggaggggagg

SEQ ID NO: 1350665 - DNA, 15 bp, Homo sapiens
ctctggaggggaggg

SEQ ID NO: 1350666 - DNA, 16 bp, Homo sapiens
ctctggcttttggaag

SEQ ID NO: 1350667 - DNA, 16 bp, Homo sapiens
ctctgggtccttcctg

SEQ ID NO: 1350668 - DNA, 16 bp, Homo sapiens
ctctggtcgctcctgc

SEQ ID NO: 1350669 - DNA, 18 bp, Homo sapiens
ctctggtcgctcctgccc

SEQ ID NO: 1350670 - DNA, 20 bp, Homo sapiens
ctctggtcgctcctgcccac

SEQ ID NO: 1350671 - DNA, 20 bp, Homo sapiens
ctctgtacttttcattctct

SEQ ID NO: 1350672 - DNA, 16 bp, Homo sapiens
ctctgtcacccttgtc

SEQ ID NO: 1350673 - DNA, 19 bp, Homo sapiens
ctctgtcacccttgtcctt

SEQ ID NO: 1350674 - DNA, 14 bp, Homo sapiens
ctctgtcaggcctt

SEQ ID NO: 1350675 - DNA, 22 bp, Homo sapiens
ctctgtgagaaggtttattgtt

SEQ ID NO: 1350676 - DNA, 13 bp, Homo sapiens
ctctgtgccttcg

SEQ ID NO: 1350677 - DNA, 11 bp, Homo sapiens
ctctgtggatg

SEQ ID NO: 1350678 - DNA, 14 bp, Homo sapiens
ctcttcagatgcca

SEQ ID NO: 1350679 - DNA, 20 bp, Homo sapiens
ctcttcagatgccacttcta

SEQ ID NO: 1350680 - DNA, 21 bp, Homo sapiens
ctcttcagatgccacttctaa

SEQ ID NO: 1350681 - DNA, 19 bp, Homo sapiens
ctcttcatcccattccagg

SEQ ID NO: 1350682 - DNA, 17 bp, Homo sapiens
ctcttcctgtgatccac

SEQ ID NO: 1350683 - DNA, 16 bp, Homo sapiens
ctcttccttttatcag

SEQ ID NO: 1350684 - DNA, 14 bp, Homo sapiens
ctcttctggctcaa

SEQ ID NO: 1350685 - DNA, 16 bp, Homo sapiens
ctcttcttggggccca

SEQ ID NO: 1350686 - DNA, 16 bp, Homo sapiens
ctcttgagcctgggag

SEQ ID NO: 1350687 - DNA, 16 bp, Homo sapiens
ctcttgcaccaaatta

SEQ ID NO: 1350688 - DNA, 20 bp, Homo sapiens
ctcttgcaccaaattatctt

SEQ ID NO: 1350689 - DNA, 19 bp, Homo sapiens
ctcttgcccatcctgactg

SEQ ID NO: 1350690 - DNA, 16 bp, Homo sapiens
ctcttgtaaagactgg

SEQ ID NO: 1350691 - DNA, 22 bp, Homo sapiens
ctcttgtaaagactggttttct

SEQ ID NO: 1350692 - DNA, 14 bp, Homo sapiens
ctcttgtgatttct

SEQ ID NO: 1350693 - DNA, 22 bp, Homo sapiens
ctgaaaatattgttttacaata

SEQ ID NO: 1350694 - DNA, 24 bp, Homo sapiens
ctgaaaatattgttttacaatagt

SEQ ID NO: 1350695 - DNA, 15 bp, Homo sapiens
ctgaaagccctgagc

SEQ ID NO: 1350696 - DNA, 16 bp, Homo sapiens
ctgaaagccctgagct

SEQ ID NO: 1350697 - DNA, 17 bp, Homo sapiens
ctgaaagccctgagctt

SEQ ID NO: 1350698 - DNA, 13 bp, Homo sapiens
ctgaaagttttgt

SEQ ID NO: 1350699 - DNA, 18 bp, Homo sapiens
ctgaaagttttgtaaaag

SEQ ID NO: 1350700 - DNA, 20 bp, Homo sapiens
ctgaaagttttgtaaaagaa

SEQ ID NO: 1350701 - DNA, 22 bp, Homo sapiens
ctgaaagttttgtaaaagaaat

SEQ ID NO: 1350702 - DNA, 21 bp, Homo sapiens
ctgaaatcttcccatgcattc

SEQ ID NO: 1350703 - DNA, 15 bp, Homo sapiens
ctgaaattctcctgg

SEQ ID NO: 1350704 - DNA, 16 bp, Homo sapiens
ctgaaattctcctgga

SEQ ID NO: 1350705 - DNA, 21 bp, Homo sapiens
ctgaacaataggctgttccca

SEQ ID NO: 1350706 - DNA, 20 bp, Homo sapiens
ctgaacacttttgttgtaaa

SEQ ID NO: 1350707 - DNA, 17 bp, Homo sapiens
ctgaaccacttgtagat

SEQ ID NO: 1350708 - DNA, 19 bp, Homo sapiens
ctgaaccgcacagctcagg

SEQ ID NO: 1350709 - DNA, 20 bp, Homo sapiens
ctgaaccgcacagctcagga

SEQ ID NO: 1350710 - DNA, 21 bp, Homo sapiens
ctgaaccgcacagctcaggag

SEQ ID NO: 1350711 - DNA, 18 bp, Homo sapiens
ctgaagaattgaaaagtt

SEQ ID NO: 1350712 - DNA, 14 bp, Homo sapiens
ctgaagcagcctct

SEQ ID NO: 1350713 - DNA, 16 bp, Homo sapiens
ctgaagcagcctctcc

SEQ ID NO: 1350714 - DNA, 16 bp, Homo sapiens
ctgaaggaaaaacaca

SEQ ID NO: 1350715 - DNA, 22 bp, Homo sapiens
ctgaaggaaaaacacaagcaaa

SEQ ID NO: 1350716 - DNA, 22 bp, Homo sapiens
ctgaagtcccagatacttgggg

SEQ ID NO: 1350717 - DNA, 18 bp, Homo sapiens
ctgaagttgcagatgtta

SEQ ID NO: 1350718 - DNA, 17 bp, Homo sapiens
ctgaagtttttttgctg

SEQ ID NO: 1350719 - DNA, 16 bp, Homo sapiens
ctgaatacagaggcaa

SEQ ID NO: 1350720 - DNA, 15 bp, Homo sapiens
ctgaatttttttgta

SEQ ID NO: 1350721 - DNA, 17 bp, Homo sapiens
ctgaatttttttgtaat

SEQ ID NO: 1350722 - DNA, 20 bp, Homo sapiens
ctgaatttttttgtaataag

SEQ ID NO: 1350723 - DNA, 16 bp, Homo sapiens
ctgacagaaggtgcca

SEQ ID NO: 1350724 - DNA, 18 bp, Homo sapiens
ctgacatttcttctagtg

SEQ ID NO: 1350725 - DNA, 21 bp, Homo sapiens
ctgaccatgctcatctgctgg

SEQ ID NO: 1350726 - DNA, 14 bp, Homo sapiens
ctgacccattgctg

SEQ ID NO: 1350727 - DNA, 20 bp, Homo sapiens
ctgaccccggtggcggcccc

SEQ ID NO: 1350728 - DNA, 19 bp, Homo sapiens
ctgaccttgtaaaagacag

SEQ ID NO: 1350729 - DNA, 13 bp, Homo sapiens
ctgacgtccacct

SEQ ID NO: 1350730 - DNA, 14 bp, Homo sapiens
ctgactaagaaatt

SEQ ID NO: 1350731 - DNA, 15 bp, Homo sapiens
ctgactcggtttctc

SEQ ID NO: 1350732 - DNA, 16 bp, Homo sapiens
ctgactcggtttctcc

SEQ ID NO: 1350733 - DNA, 17 bp, Homo sapiens
ctgactcggtttctcca

SEQ ID NO: 1350734 - DNA, 21 bp, Homo sapiens
ctgactgaaagtagggggctt

SEQ ID NO: 1350735 - DNA, 14 bp, Homo sapiens
ctgactgaggcagt

SEQ ID NO: 1350736 - DNA, 18 bp, Homo sapiens
ctgactgttttctcttga

SEQ ID NO: 1350737 - DNA, 22 bp, Homo sapiens
ctgacttagaatccctgtgtta

SEQ ID NO: 1350738 - DNA, 18 bp, Homo sapiens
ctgacttctgcctggaga

SEQ ID NO: 1350739 - DNA, 14 bp, Homo sapiens
ctgagaaaacaagc

SEQ ID NO: 1350740 - DNA, 12 bp, Homo sapiens
ctgagactgtgc

SEQ ID NO: 1350741 - DNA, 12 bp, Homo sapiens
ctgagagccagg

SEQ ID NO: 1350742 - DNA, 15 bp, Homo sapiens
ctgagaggcaggcat

SEQ ID NO: 1350743 - DNA, 18 bp, Homo sapiens
ctgagccctactccctgc

SEQ ID NO: 1350744 - DNA, 23 bp, Homo sapiens
ctgagccctactccctgcagatg

SEQ ID NO: 1350745 - DNA, 15 bp, Homo sapiens
ctgagcctctgctcc

SEQ ID NO: 1350746 - DNA, 14 bp, Homo sapiens
ctgagcctgcaggg

SEQ ID NO: 1350747 - DNA, 19 bp, Homo sapiens
ctgagcctgcagggaagcc

SEQ ID NO: 1350748 - DNA, 15 bp, Homo sapiens
ctgagcgcctccatc

SEQ ID NO: 1350749 - DNA, 15 bp, Homo sapiens
ctgagctttctgcta

SEQ ID NO: 1350750 - DNA, 20 bp, Homo sapiens
ctgaggccgttgctgactta

SEQ ID NO: 1350751 - DNA, 14 bp, Homo sapiens
ctgaggctgaggca

SEQ ID NO: 1350752 - DNA, 13 bp, Homo sapiens
ctgaggctgtggt

SEQ ID NO: 1350753 - DNA, 17 bp, Homo sapiens
ctgaggctgtggtcaca

SEQ ID NO: 1350754 - DNA, 16 bp, Homo sapiens
ctgagggaaatgtttt

SEQ ID NO: 1350755 - DNA, 22 bp, Homo sapiens
ctgagggaaatgttttgtaaac

SEQ ID NO: 1350756 - DNA, 17 bp, Homo sapiens
ctgagggcttgtagttc

SEQ ID NO: 1350757 - DNA, 12 bp, Homo sapiens
ctgaggtgggag

SEQ ID NO: 1350758 - DNA, 15 bp, Homo sapiens
ctgaggttcctctgc

SEQ ID NO: 1350759 - DNA, 16 bp, Homo sapiens
ctgaggttcctctgcc

SEQ ID NO: 1350760 - DNA, 17 bp, Homo sapiens
ctgaggttcctctgcct

SEQ ID NO: 1350761 - DNA, 18 bp, Homo sapiens
ctgaggttcctctgcctg

SEQ ID NO: 1350762 - DNA, 14 bp, Homo sapiens
ctgagtctgggcag

SEQ ID NO: 1350763 - DNA, 20 bp, Homo sapiens
ctgagtctgttctggtaatc

SEQ ID NO: 1350764 - DNA, 13 bp, Homo sapiens
ctgagtggcaggg

SEQ ID NO: 1350765 - DNA, 21 bp, Homo sapiens
ctgatctccataaacatgaaa

SEQ ID NO: 1350766 - DNA, 21 bp, Homo sapiens
ctgatctgcccatcgtgaaga

SEQ ID NO: 1350767 - DNA, 23 bp, Homo sapiens
ctgatctgcccatcgtgaagaag

SEQ ID NO: 1350768 - DNA, 12 bp, Homo sapiens
ctgatgaaaaca

SEQ ID NO: 1350769 - DNA, 16 bp, Homo sapiens
ctgatgacaataaagc

SEQ ID NO: 1350770 - DNA, 17 bp, Homo sapiens
ctgatgacaataaagct

SEQ ID NO: 1350771 - DNA, 20 bp, Homo sapiens
ctgatggccttaatttcctt

SEQ ID NO: 1350772 - DNA, 21 bp, Homo sapiens
ctgatggccttaatttccttt

SEQ ID NO: 1350773 - DNA, 18 bp, Homo sapiens
ctgatgtcaatttctgtg

SEQ ID NO: 1350774 - DNA, 22 bp, Homo sapiens
ctgattcttgttgctgtacaaa

SEQ ID NO: 1350775 - DNA, 13 bp, Homo sapiens
ctgatttcttcag

SEQ ID NO: 1350776 - DNA, 16 bp, Homo sapiens
ctgatttgctgctctt

SEQ ID NO: 1350777 - DNA, 17 bp, Homo sapiens
ctgatttgctgctcttc

SEQ ID NO: 1350778 - DNA, 15 bp, Homo sapiens
ctgcaaaaggcctct

SEQ ID NO: 1350779 - DNA, 16 bp, Homo sapiens
ctgcaatatttgaatt

SEQ ID NO: 1350780 - DNA, 14 bp, Homo sapiens
ctgcacaagctgca

SEQ ID NO: 1350781 - DNA, 16 bp, Homo sapiens
ctgcacaagctgcacc

SEQ ID NO: 1350782 - DNA, 22 bp, Homo sapiens
ctgcacaagctgcaccctcagg

SEQ ID NO: 1350783 - DNA, 22 bp, Homo sapiens
ctgcacatgactcgggggtggg

SEQ ID NO: 1350784 - DNA, 18 bp, Homo sapiens
ctgcacccagaacagtgg

SEQ ID NO: 1350785 - DNA, 13 bp, Homo sapiens
ctgcaccctcagg

SEQ ID NO: 1350786 - DNA, 14 bp, Homo sapiens
ctgcaccctcaggc

SEQ ID NO: 1350787 - DNA, 18 bp, Homo sapiens
ctgcaccctcaggcaggt

SEQ ID NO: 1350788 - DNA, 17 bp, Homo sapiens
ctgcactccagcctggg

SEQ ID NO: 1350789 - DNA, 19 bp, Homo sapiens
ctgcactccagcctgggtg

SEQ ID NO: 1350790 - DNA, 22 bp, Homo sapiens
ctgcactcctcagggcagcctc

SEQ ID NO: 1350791 - DNA, 21 bp, Homo sapiens
ctgcagaggccagaggccccc

SEQ ID NO: 1350792 - DNA, 14 bp, Homo sapiens
ctgcagatgccacc

SEQ ID NO: 1350793 - DNA, 16 bp, Homo sapiens
ctgcagcaccgagggg

SEQ ID NO: 1350794 - DNA, 19 bp, Homo sapiens
ctgcagcaccgaggggcct

SEQ ID NO: 1350795 - DNA, 15 bp, Homo sapiens
ctgcaggccctggcc

SEQ ID NO: 1350796 - DNA, 18 bp, Homo sapiens
ctgcagggccatggctca

SEQ ID NO: 1350797 - DNA, 20 bp, Homo sapiens
ctgcagggccatggctcagg

SEQ ID NO: 1350798 - DNA, 22 bp, Homo sapiens
ctgcagtcctactcaagcgggt

SEQ ID NO: 1350799 - DNA, 23 bp, Homo sapiens
ctgcagttctactcaggctggtg

SEQ ID NO: 1350800 - DNA, 19 bp, Homo sapiens
ctgcagtttgagacaggag

SEQ ID NO: 1350801 - DNA, 16 bp, Homo sapiens
ctgcatcgtttcatct

SEQ ID NO: 1350802 - DNA, 16 bp, Homo sapiens
ctgcattcatttttat

SEQ ID NO: 1350803 - DNA, 15 bp, Homo sapiens
ctgcatttaaaaaaa

SEQ ID NO: 1350804 - DNA, 22 bp, Homo sapiens
ctgcatttagggagtattctaa

SEQ ID NO: 1350805 - DNA, 21 bp, Homo sapiens
ctgccacactctccatcaccc

SEQ ID NO: 1350806 - DNA, 14 bp, Homo sapiens
ctgccaccaggcca

SEQ ID NO: 1350807 - DNA, 15 bp, Homo sapiens
ctgccaccaggccac

SEQ ID NO: 1350808 - DNA, 17 bp, Homo sapiens
ctgccaccaggccacct

SEQ ID NO: 1350809 - DNA, 12 bp, Homo sapiens
ctgccagcagca

SEQ ID NO: 1350810 - DNA, 15 bp, Homo sapiens
ctgccagcagcagca

SEQ ID NO: 1350811 - DNA, 17 bp, Homo sapiens
ctgccagcagcagcagg

SEQ ID NO: 1350812 - DNA, 21 bp, Homo sapiens
ctgccagcagcagcaggtgat

SEQ ID NO: 1350813 - DNA, 12 bp, Homo sapiens
ctgccaggcagg

SEQ ID NO: 1350814 - DNA, 13 bp, Homo sapiens
ctgccaggcaggg

SEQ ID NO: 1350815 - DNA, 11 bp, Homo sapiens
ctgccaggcat

SEQ ID NO: 1350816 - DNA, 13 bp, Homo sapiens
ctgccaggccagc

SEQ ID NO: 1350817 - DNA, 23 bp, Homo sapiens
ctgccaggccagcctccgagagg

SEQ ID NO: 1350818 - DNA, 14 bp, Homo sapiens
ctgccatctagcca

SEQ ID NO: 1350819 - DNA, 14 bp, Homo sapiens
ctgccatgccagct

SEQ ID NO: 1350820 - DNA, 23 bp, Homo sapiens
ctgccattacagaggtattaaaa

SEQ ID NO: 1350821 - DNA, 16 bp, Homo sapiens
ctgccatttctgagat

SEQ ID NO: 1350822 - DNA, 18 bp, Homo sapiens
ctgcccatcgtgaagaag

SEQ ID NO: 1350823 - DNA, 22 bp, Homo sapiens
ctgccccatctcccctcagctc

SEQ ID NO: 1350824 - DNA, 15 bp, Homo sapiens
ctgcccccaccccgg

SEQ ID NO: 1350825 - DNA, 16 bp, Homo sapiens
ctgcccccagccccgg

SEQ ID NO: 1350826 - DNA, 18 bp, Homo sapiens
ctgccccgcccccagtcc

SEQ ID NO: 1350827 - DNA, 22 bp, Homo sapiens
ctgccctctcccaaaaaactac

SEQ ID NO: 1350828 - DNA, 12 bp, Homo sapiens
ctgccctggctg

SEQ ID NO: 1350829 - DNA, 16 bp, Homo sapiens
ctgccctggctgctgc

SEQ ID NO: 1350830 - DNA, 18 bp, Homo sapiens
ctgccctggctgctgccc

SEQ ID NO: 1350831 - DNA, 15 bp, Homo sapiens
ctgcccttccgcagt

SEQ ID NO: 1350832 - DNA, 18 bp, Homo sapiens
ctgcccttccgcagtgtg

SEQ ID NO: 1350833 - DNA, 20 bp, Homo sapiens
ctgccgccgctaggtagagt

SEQ ID NO: 1350834 - DNA, 16 bp, Homo sapiens
ctgccgtcaccaccac

SEQ ID NO: 1350835 - DNA, 20 bp, Homo sapiens
ctgccgtcaccaccacccct

SEQ ID NO: 1350836 - DNA, 21 bp, Homo sapiens
ctgccgtggggccgccgcctc

SEQ ID NO: 1350837 - DNA, 14 bp, Homo sapiens
ctgcctcccacttc

SEQ ID NO: 1350838 - DNA, 16 bp, Homo sapiens
ctgcctcccttgtggc

SEQ ID NO: 1350839 - DNA, 21 bp, Homo sapiens
ctgcctcccttgtggcagcaa

SEQ ID NO: 1350840 - DNA, 18 bp, Homo sapiens
ctgcctctttccctagga

SEQ ID NO: 1350841 - DNA, 20 bp, Homo sapiens
ctgcctgacagagggatgga

SEQ ID NO: 1350842 - DNA, 17 bp, Homo sapiens
ctgcctgcaatatttga

SEQ ID NO: 1350843 - DNA, 19 bp, Homo sapiens
ctgcctgcaatatttgaat

SEQ ID NO: 1350844 - DNA, 20 bp, Homo sapiens
ctgcctgcaatatttgaatt

SEQ ID NO: 1350845 - DNA, 15 bp, Homo sapiens
ctgcctgcacccctg

SEQ ID NO: 1350846 - DNA, 17 bp, Homo sapiens
ctgcctgccttaagtga

SEQ ID NO: 1350847 - DNA, 15 bp, Homo sapiens
ctgcctggcccccaa

SEQ ID NO: 1350848 - DNA, 23 bp, Homo sapiens
ctgcctgtggcgccgtctccagg

SEQ ID NO: 1350849 - DNA, 22 bp, Homo sapiens
ctgcctgttaggagaagctgca

SEQ ID NO: 1350850 - DNA, 18 bp, Homo sapiens
ctgccttggctcagacat

SEQ ID NO: 1350851 - DNA, 20 bp, Homo sapiens
ctgcctttgcaccacgggac

SEQ ID NO: 1350852 - DNA, 20 bp, Homo sapiens
ctgcgaagaccctcttgccc

SEQ ID NO: 1350853 - DNA, 14 bp, Homo sapiens
ctgcgactttctgc

SEQ ID NO: 1350854 - DNA, 20 bp, Homo sapiens
ctgcgactttctgcctggag

SEQ ID NO: 1350855 - DNA, 13 bp, Homo sapiens
ctgcgggtggggc

SEQ ID NO: 1350856 - DNA, 15 bp, Homo sapiens
ctgctaaataaaatt

SEQ ID NO: 1350857 - DNA, 23 bp, Homo sapiens
ctgctaaataaaatttgttgcat

SEQ ID NO: 1350858 - DNA, 18 bp, Homo sapiens
ctgctacctttcaaagct

SEQ ID NO: 1350859 - DNA, 19 bp, Homo sapiens
ctgctacctttcaaagctt

SEQ ID NO: 1350860 - DNA, 14 bp, Homo sapiens
ctgctagctagctc

SEQ ID NO: 1350861 - DNA, 21 bp, Homo sapiens
ctgctagctagctcaactagt

SEQ ID NO: 1350862 - DNA, 21 bp, Homo sapiens
ctgctatccccatctccctgc

SEQ ID NO: 1350863 - DNA, 23 bp, Homo sapiens
ctgctatccccatctccctgcct

SEQ ID NO: 1350864 - DNA, 20 bp, Homo sapiens
ctgctccagctgttcagctg

SEQ ID NO: 1350865 - DNA, 13 bp, Homo sapiens
ctgctccctggca

SEQ ID NO: 1350866 - DNA, 19 bp, Homo sapiens
ctgctccctgtagggtcca

SEQ ID NO: 1350867 - DNA, 21 bp, Homo sapiens
ctgctgactgttttctcttga

SEQ ID NO: 1350868 - DNA, 14 bp, Homo sapiens
ctgctgcagagcag

SEQ ID NO: 1350869 - DNA, 22 bp, Homo sapiens
ctgctgcccccaccccggggac

SEQ ID NO: 1350870 - DNA, 13 bp, Homo sapiens
ctgctgcctcttt

SEQ ID NO: 1350871 - DNA, 16 bp, Homo sapiens
ctgctgctacaatgtc

SEQ ID NO: 1350872 - DNA, 21 bp, Homo sapiens
ctgctggggatccccgcctgg

SEQ ID NO: 1350873 - DNA, 15 bp, Homo sapiens
ctgctgtcataacat

SEQ ID NO: 1350874 - DNA, 19 bp, Homo sapiens
ctgctgtgaagctggaact

SEQ ID NO: 1350875 - DNA, 21 bp, Homo sapiens
ctgcttcccttactttgctga

SEQ ID NO: 1350876 - DNA, 12 bp, Homo sapiens
ctgcttcctcct

SEQ ID NO: 1350877 - DNA, 18 bp, Homo sapiens
ctgcttcctcctggaaat

SEQ ID NO: 1350878 - DNA, 17 bp, Homo sapiens
ctgcttctctgacttct

SEQ ID NO: 1350879 - DNA, 22 bp, Homo sapiens
ctgcttctctgacttctgcctg

SEQ ID NO: 1350880 - DNA, 22 bp, Homo sapiens
ctgcttgaataaacaccactgg

SEQ ID NO: 1350881 - DNA, 16 bp, Homo sapiens
ctgcttttctgccctg

SEQ ID NO: 1350882 - DNA, 20 bp, Homo sapiens
ctgcttttctgccctggctg

SEQ ID NO: 1350883 - DNA, 22 bp, Homo sapiens
ctggaaaggggagagcctgctg

SEQ ID NO: 1350884 - DNA, 19 bp, Homo sapiens
ctggaacaaattatttttg

SEQ ID NO: 1350885 - DNA, 17 bp, Homo sapiens
ctggaaccacattgaag

SEQ ID NO: 1350886 - DNA, 20 bp, Homo sapiens
ctggaacccttttaaagttg

SEQ ID NO: 1350887 - DNA, 15 bp, Homo sapiens
ctggaagaacaggcc

SEQ ID NO: 1350888 - DNA, 16 bp, Homo sapiens
ctggaagaacaggcct

SEQ ID NO: 1350889 - DNA, 18 bp, Homo sapiens
ctggaagaacaggcctct

SEQ ID NO: 1350890 - DNA, 19 bp, Homo sapiens
ctggaagaacaggcctctc

SEQ ID NO: 1350891 - DNA, 18 bp, Homo sapiens
ctggaagatcctgcgggt

SEQ ID NO: 1350892 - DNA, 23 bp, Homo sapiens
ctggaatcaggaatattttccaa

SEQ ID NO: 1350893 - DNA, 18 bp, Homo sapiens
ctggaattgccagctgac

SEQ ID NO: 1350894 - DNA, 22 bp, Homo sapiens
ctggaattgtggctatcctgat

SEQ ID NO: 1350895 - DNA, 18 bp, Homo sapiens
ctggacagtatcccacat

SEQ ID NO: 1350896 - DNA, 21 bp, Homo sapiens
ctggacggcaggctcactgcc

SEQ ID NO: 1350897 - DNA, 17 bp, Homo sapiens
ctggagaccagggagcc

SEQ ID NO: 1350898 - DNA, 18 bp, Homo sapiens
ctggagaccagggagcct

SEQ ID NO: 1350899 - DNA, 17 bp, Homo sapiens
ctggagcactgggctcc

SEQ ID NO: 1350900 - DNA, 23 bp, Homo sapiens
ctggagcactgggctcccgggcc

SEQ ID NO: 1350901 - DNA, 14 bp, Homo sapiens
ctggagccctaacc

SEQ ID NO: 1350902 - DNA, 22 bp, Homo sapiens
ctggagccctaaccccttccag

SEQ ID NO: 1350903 - DNA, 21 bp, Homo sapiens
ctggagctcatctgcaaaagg

SEQ ID NO: 1350904 - DNA, 18 bp, Homo sapiens
ctggaggaacacttgatg

SEQ ID NO: 1350905 - DNA, 22 bp, Homo sapiens
ctggaggatcccctccaagcct

SEQ ID NO: 1350906 - DNA, 13 bp, Homo sapiens
ctggaggggaggg

SEQ ID NO: 1350907 - DNA, 17 bp, Homo sapiens
ctggaggttgaagccaa

SEQ ID NO: 1350908 - DNA, 19 bp, Homo sapiens
ctggaggttgaagccaagt

SEQ ID NO: 1350909 - DNA, 13 bp, Homo sapiens
ctggagtctcctg

SEQ ID NO: 1350910 - DNA, 16 bp, Homo sapiens
ctggcaaacatgaaaa

SEQ ID NO: 1350911 - DNA, 19 bp, Homo sapiens
ctggcacccaccgtggagg

SEQ ID NO: 1350912 - DNA, 21 bp, Homo sapiens
ctggcactggatgcagaaaca

SEQ ID NO: 1350913 - DNA, 11 bp, Homo sapiens
ctggcagccca

SEQ ID NO: 1350914 - DNA, 12 bp, Homo sapiens
ctggcagcccag

SEQ ID NO: 1350915 - DNA, 15 bp, Homo sapiens
ctggcagggggcatg

SEQ ID NO: 1350916 - DNA, 21 bp, Homo sapiens
ctggcatctaattctgattct

SEQ ID NO: 1350917 - DNA, 12 bp, Homo sapiens
ctggccaggagc

SEQ ID NO: 1350918 - DNA, 18 bp, Homo sapiens
ctggccagtccaccctgc

SEQ ID NO: 1350919 - DNA, 16 bp, Homo sapiens
ctggccagtccaggct

SEQ ID NO: 1350920 - DNA, 17 bp, Homo sapiens
ctggccagtccaggctg

SEQ ID NO: 1350921 - DNA, 12 bp, Homo sapiens
ctggcccactgc

SEQ ID NO: 1350922 - DNA, 15 bp, Homo sapiens
ctggcccactgcatc

SEQ ID NO: 1350923 - DNA, 12 bp, Homo sapiens
ctggccccagcc

SEQ ID NO: 1350924 - DNA, 14 bp, Homo sapiens
ctggccccagccct

SEQ ID NO: 1350925 - DNA, 15 bp, Homo sapiens
ctggccccagccctg

SEQ ID NO: 1350926 - DNA, 19 bp, Homo sapiens
ctggccccagccctgctgg

SEQ ID NO: 1350927 - DNA, 18 bp, Homo sapiens
ctggcccccaacctcagg

SEQ ID NO: 1350928 - DNA, 20 bp, Homo sapiens
ctggccgcgctccgggcttt

SEQ ID NO: 1350929 - DNA, 18 bp, Homo sapiens
ctggccgcggagcctgca

SEQ ID NO: 1350930 - DNA, 21 bp, Homo sapiens
ctggcctcccctgccaccagg

SEQ ID NO: 1350931 - DNA, 17 bp, Homo sapiens
ctggcctctctagcaca

SEQ ID NO: 1350932 - DNA, 18 bp, Homo sapiens
ctggcctctctagcacaa

SEQ ID NO: 1350933 - DNA, 15 bp, Homo sapiens
ctggcctctgtgcct

SEQ ID NO: 1350934 - DNA, 19 bp, Homo sapiens
ctggccttgtcctcagcca

SEQ ID NO: 1350935 - DNA, 14 bp, Homo sapiens
ctggcctttgtaag

SEQ ID NO: 1350936 - DNA, 23 bp, Homo sapiens
ctggcgcagaacgaaccttggcc

SEQ ID NO: 1350937 - DNA, 13 bp, Homo sapiens
ctggcgcaggtgg

SEQ ID NO: 1350938 - DNA, 18 bp, Homo sapiens
ctggctccctcctccagg

SEQ ID NO: 1350939 - DNA, 13 bp, Homo sapiens
ctggctcctgatc

SEQ ID NO: 1350940 - DNA, 12 bp, Homo sapiens
ctggctctgagc

SEQ ID NO: 1350941 - DNA, 13 bp, Homo sapiens
ctggctctgagcg

SEQ ID NO: 1350942 - DNA, 20 bp, Homo sapiens
ctggctctgagcgcctccat

SEQ ID NO: 1350943 - DNA, 17 bp, Homo sapiens
ctggctgaggttcctct

SEQ ID NO: 1350944 - DNA, 19 bp, Homo sapiens
ctggctgaggttcctctgc

SEQ ID NO: 1350945 - DNA, 21 bp, Homo sapiens
ctggctgaggttcctctgcct

SEQ ID NO: 1350946 - DNA, 23 bp, Homo sapiens
ctggctgaggttcctctgcctgc

SEQ ID NO: 1350947 - DNA, 13 bp, Homo sapiens
ctggctgctgccc

SEQ ID NO: 1350948 - DNA, 14 bp, Homo sapiens
ctggctgctgcccc

SEQ ID NO: 1350949 - DNA, 15 bp, Homo sapiens
ctggctgctgccccc

SEQ ID NO: 1350950 - DNA, 22 bp, Homo sapiens
ctggctgggtggcaccagcagc

SEQ ID NO: 1350951 - DNA, 16 bp, Homo sapiens
ctggctttaagccttc

SEQ ID NO: 1350952 - DNA, 22 bp, Homo sapiens
ctggcttttattaatgcacttt

SEQ ID NO: 1350953 - DNA, 14 bp, Homo sapiens
ctggcttttggaag

SEQ ID NO: 1350954 - DNA, 20 bp, Homo sapiens
ctgggacctgccaggcaggg

SEQ ID NO: 1350955 - DNA, 17 bp, Homo sapiens
ctgggactcagccttca

SEQ ID NO: 1350956 - DNA, 18 bp, Homo sapiens
ctgggactcagccttcag

SEQ ID NO: 1350957 - DNA, 14 bp, Homo sapiens
ctgggaggagggag

SEQ ID NO: 1350958 - DNA, 15 bp, Homo sapiens
ctgggaggagggaga

SEQ ID NO: 1350959 - DNA, 18 bp, Homo sapiens
ctgggccatgtccaaaga

SEQ ID NO: 1350960 - DNA, 13 bp, Homo sapiens
ctgggccccagct

SEQ ID NO: 1350961 - DNA, 15 bp, Homo sapiens
ctgggccctgggctg

SEQ ID NO: 1350962 - DNA, 15 bp, Homo sapiens
ctgggccgctgccac

SEQ ID NO: 1350963 - DNA, 16 bp, Homo sapiens
ctgggccgctgccacg

SEQ ID NO: 1350964 - DNA, 18 bp, Homo sapiens
ctgggccgtatctccggc

SEQ ID NO: 1350965 - DNA, 21 bp, Homo sapiens
ctgggccgtatctccggctcc

SEQ ID NO: 1350966 - DNA, 20 bp, Homo sapiens
ctgggcttggcctgctgtga

SEQ ID NO: 1350967 - DNA, 23 bp, Homo sapiens
ctggggaaagacactgcctgggc

SEQ ID NO: 1350968 - DNA, 19 bp, Homo sapiens
ctggggacgctccgctgcc

SEQ ID NO: 1350969 - DNA, 22 bp, Homo sapiens
ctggggatccccgcctggccag

SEQ ID NO: 1350970 - DNA, 12 bp, Homo sapiens
ctggggcaggct

SEQ ID NO: 1350971 - DNA, 16 bp, Homo sapiens
ctggggcaggctgggc

SEQ ID NO: 1350972 - DNA, 21 bp, Homo sapiens
ctggggcaggctgggccatgt

SEQ ID NO: 1350973 - DNA, 15 bp, Homo sapiens
ctggggcctccagaa

SEQ ID NO: 1350974 - DNA, 17 bp, Homo sapiens
ctggggcctccagaact

SEQ ID NO: 1350975 - DNA, 13 bp, Homo sapiens
ctgggggcacagg

SEQ ID NO: 1350976 - DNA, 19 bp, Homo sapiens
ctgggggcacaggaggcag

SEQ ID NO: 1350977 - DNA, 14 bp, Homo sapiens
ctggggggacccag

SEQ ID NO: 1350978 - DNA, 17 bp, Homo sapiens
ctggggggacccagtgc

SEQ ID NO: 1350979 - DNA, 19 bp, Homo sapiens
ctggggggacccagtgcag

SEQ ID NO: 1350980 - DNA, 14 bp, Homo sapiens
ctgggtaggaaaga

SEQ ID NO: 1350981 - DNA, 15 bp, Homo sapiens
ctgggtaggaaagag

SEQ ID NO: 1350982 - DNA, 14 bp, Homo sapiens
ctgggtcacacacg

SEQ ID NO: 1350983 - DNA, 19 bp, Homo sapiens
ctgggtccttcctgaaact

SEQ ID NO: 1350984 - DNA, 20 bp, Homo sapiens
ctgggtggcaccagcagcct

SEQ ID NO: 1350985 - DNA, 23 bp, Homo sapiens
ctgggtggcaccagcagcctgga

SEQ ID NO: 1350986 - DNA, 21 bp, Homo sapiens
ctgggtgtccccgctgctgtg

SEQ ID NO: 1350987 - DNA, 20 bp, Homo sapiens
ctgggttgcgggacagagta

SEQ ID NO: 1350988 - DNA, 15 bp, Homo sapiens
ctggtaaaatgaaga

SEQ ID NO: 1350989 - DNA, 16 bp, Homo sapiens
ctggtaaaatgaagaa

SEQ ID NO: 1350990 - DNA, 17 bp, Homo sapiens
ctggtaggaccaagcat

SEQ ID NO: 1350991 - DNA, 12 bp, Homo sapiens
ctggtctttgag

SEQ ID NO: 1350992 - DNA, 16 bp, Homo sapiens
ctggtgaatattttca

SEQ ID NO: 1350993 - DNA, 17 bp, Homo sapiens
ctggtgctgcagcaccg

SEQ ID NO: 1350994 - DNA, 22 bp, Homo sapiens
ctggtggtctgttggcaggctg

SEQ ID NO: 1350995 - DNA, 14 bp, Homo sapiens
ctggtgtttcttga

SEQ ID NO: 1350996 - DNA, 20 bp, Homo sapiens
ctggttcattcttcagatat

SEQ ID NO: 1350997 - DNA, 14 bp, Homo sapiens
ctggttccagggtc

SEQ ID NO: 1350998 - DNA, 11 bp, Homo sapiens
ctgtaaatcat

SEQ ID NO: 1350999 - DNA, 12 bp, Homo sapiens
ctgtaataatag

SEQ ID NO: 1351000 - DNA, 17 bp, Homo sapiens
ctgtaatcccagcactt

SEQ ID NO: 1351001 - DNA, 20 bp, Homo sapiens
ctgtaatcctagcactttgg

SEQ ID NO: 1351002 - DNA, 15 bp, Homo sapiens
ctgtacaaaagcaat

SEQ ID NO: 1351003 - DNA, 17 bp, Homo sapiens
ctgtacgacacgggtgg

SEQ ID NO: 1351004 - DNA, 17 bp, Homo sapiens
ctgtactgtgtctcatg

SEQ ID NO: 1351005 - DNA, 18 bp, Homo sapiens
ctgtactgttactgggcc

SEQ ID NO: 1351006 - DNA, 20 bp, Homo sapiens
ctgtactgttactgggccct

SEQ ID NO: 1351007 - DNA, 13 bp, Homo sapiens
ctgtagagtggga

SEQ ID NO: 1351008 - DNA, 14 bp, Homo sapiens
ctgtagatatgtat

SEQ ID NO: 1351009 - DNA, 16 bp, Homo sapiens
ctgtagatgatgtatt

SEQ ID NO: 1351010 - DNA, 16 bp, Homo sapiens
ctgtagcttttaggaa

SEQ ID NO: 1351011 - DNA, 20 bp, Homo sapiens
ctgtagggagggcggcaggg

SEQ ID NO: 1351012 - DNA, 17 bp, Homo sapiens
ctgtagggtccaaccag

SEQ ID NO: 1351013 - DNA, 14 bp, Homo sapiens
ctgtagtcccagct

SEQ ID NO: 1351014 - DNA, 17 bp, Homo sapiens
ctgtatttaaaaataga

SEQ ID NO: 1351015 - DNA, 19 bp, Homo sapiens
ctgtatttaaaaatagaaa

SEQ ID NO: 1351016 - DNA, 21 bp, Homo sapiens
ctgtatttgaaagtgcctttg

SEQ ID NO: 1351017 - DNA, 23 bp, Homo sapiens
ctgtattttatttagacaagaga

SEQ ID NO: 1351018 - DNA, 18 bp, Homo sapiens
ctgtatttttttttctaa

SEQ ID NO: 1351019 - DNA, 14 bp, Homo sapiens
ctgtcaaatgatgt

SEQ ID NO: 1351020 - DNA, 22 bp, Homo sapiens
ctgtcaatgagagcataattta

SEQ ID NO: 1351021 - DNA, 15 bp, Homo sapiens
ctgtcaatgggacct

SEQ ID NO: 1351022 - DNA, 23 bp, Homo sapiens
ctgtcactcattgctgagcctct

SEQ ID NO: 1351023 - DNA, 16 bp, Homo sapiens
ctgtcaggctgaaaac

SEQ ID NO: 1351024 - DNA, 16 bp, Homo sapiens
ctgtcagtatgacatt

SEQ ID NO: 1351025 - DNA, 18 bp, Homo sapiens
ctgtcccatagtccctgc

SEQ ID NO: 1351026 - DNA, 15 bp, Homo sapiens
ctgtccccgcagccc

SEQ ID NO: 1351027 - DNA, 17 bp, Homo sapiens
ctgtccccgcagccctg

SEQ ID NO: 1351028 - DNA, 11 bp, Homo sapiens
ctgtccctgcg

SEQ ID NO: 1351029 - DNA, 13 bp, Homo sapiens
ctgtccctgcgcc

SEQ ID NO: 1351030 - DNA, 20 bp, Homo sapiens
ctgtcggcgctgccccatct

SEQ ID NO: 1351031 - DNA, 22 bp, Homo sapiens
ctgtcggcgctgccccatctcc

SEQ ID NO: 1351032 - DNA, 22 bp, Homo sapiens
ctgtctcaaaaaaagaaaaaga

SEQ ID NO: 1351033 - DNA, 15 bp, Homo sapiens
ctgtctggtggcccc

SEQ ID NO: 1351034 - DNA, 20 bp, Homo sapiens
ctgtgaacaagcttcagtaa

SEQ ID NO: 1351035 - DNA, 21 bp, Homo sapiens
ctgtgaacaagcttcagtaag

SEQ ID NO: 1351036 - DNA, 15 bp, Homo sapiens
ctgtgaagagaacca

SEQ ID NO: 1351037 - DNA, 21 bp, Homo sapiens
ctgtgacatggtgcctgagag

SEQ ID NO: 1351038 - DNA, 23 bp, Homo sapiens
ctgtgacatggtgcctgagaggc

SEQ ID NO: 1351039 - DNA, 23 bp, Homo sapiens
ctgtgagaacccagtttcccgtc

SEQ ID NO: 1351040 - DNA, 17 bp, Homo sapiens
ctgtgagaaggtttatt

SEQ ID NO: 1351041 - DNA, 14 bp, Homo sapiens
ctgtgagggagggg

SEQ ID NO: 1351042 - DNA, 15 bp, Homo sapiens
ctgtgagggagggga

SEQ ID NO: 1351043 - DNA, 13 bp, Homo sapiens
ctgtgatgagctg

SEQ ID NO: 1351044 - DNA, 16 bp, Homo sapiens
ctgtgatgagctgatc

SEQ ID NO: 1351045 - DNA, 22 bp, Homo sapiens
ctgtgatgagctgatctgcgga

SEQ ID NO: 1351046 - DNA, 23 bp, Homo sapiens
ctgtgatgtttgtgtatgtggga

SEQ ID NO: 1351047 - DNA, 18 bp, Homo sapiens
ctgtgcaacggtctcctg

SEQ ID NO: 1351048 - DNA, 22 bp, Homo sapiens
ctgtgcaacggtctcctgactg

SEQ ID NO: 1351049 - DNA, 21 bp, Homo sapiens
ctgtgcaatagacacatacat

SEQ ID NO: 1351050 - DNA, 18 bp, Homo sapiens
ctgtgcagtcactggagg

SEQ ID NO: 1351051 - DNA, 19 bp, Homo sapiens
ctgtgcgtcttggtgtaat

SEQ ID NO: 1351052 - DNA, 21 bp, Homo sapiens
ctgtgcgtcttggtgtaattt

SEQ ID NO: 1351053 - DNA, 21 bp, Homo sapiens
ctgtgcttcggtaggcgacca

SEQ ID NO: 1351054 - DNA, 18 bp, Homo sapiens
ctgtggcataaattgcat

SEQ ID NO: 1351055 - DNA, 16 bp, Homo sapiens
ctgtggccccaccctg

SEQ ID NO: 1351056 - DNA, 18 bp, Homo sapiens
ctgtggccccaccctggg

SEQ ID NO: 1351057 - DNA, 20 bp, Homo sapiens
ctgtggccccaccctgggcc

SEQ ID NO: 1351058 - DNA, 21 bp, Homo sapiens
ctgtggccccaccctgggccc

SEQ ID NO: 1351059 - DNA, 17 bp, Homo sapiens
ctgtggcgccgtctcca

SEQ ID NO: 1351060 - DNA, 19 bp, Homo sapiens
ctgtggcgccgtctccagg

SEQ ID NO: 1351061 - DNA, 18 bp, Homo sapiens
ctgtggctccaggccaaa

SEQ ID NO: 1351062 - DNA, 20 bp, Homo sapiens
ctgtggtcaaggctacagat

SEQ ID NO: 1351063 - DNA, 18 bp, Homo sapiens
ctgtggttggctgggaaa

SEQ ID NO: 1351064 - DNA, 14 bp, Homo sapiens
ctgtgtaaactcat

SEQ ID NO: 1351065 - DNA, 13 bp, Homo sapiens
ctgtgtactgttc

SEQ ID NO: 1351066 - DNA, 21 bp, Homo sapiens
ctgtgtatatggtatatatac

SEQ ID NO: 1351067 - DNA, 16 bp, Homo sapiens
ctgtgtatatttgatt

SEQ ID NO: 1351068 - DNA, 18 bp, Homo sapiens
ctgtgtatatttgattta

SEQ ID NO: 1351069 - DNA, 14 bp, Homo sapiens
ctgtgtatttgctt

SEQ ID NO: 1351070 - DNA, 23 bp, Homo sapiens
ctgtgtccatgcgctcagggcca

SEQ ID NO: 1351071 - DNA, 9 bp, Homo sapiens
ctgtgtgca

SEQ ID NO: 1351072 - DNA, 13 bp, Homo sapiens
ctgtgtgcaggtt

SEQ ID NO: 1351073 - DNA, 15 bp, Homo sapiens
ctgtgtgcgctctgt

SEQ ID NO: 1351074 - DNA, 16 bp, Homo sapiens
ctgtgtgtcagttttc

SEQ ID NO: 1351075 - DNA, 19 bp, Homo sapiens
ctgtgtgtcccaggcaggg

SEQ ID NO: 1351076 - DNA, 20 bp, Homo sapiens
ctgtgtgtcccaggcaggga

SEQ ID NO: 1351077 - DNA, 23 bp, Homo sapiens
ctgtgtgtcccaggcagggagac

SEQ ID NO: 1351078 - DNA, 23 bp, Homo sapiens
ctgtgtgtgtgtgtgtgcgtgtg

SEQ ID NO: 1351079 - DNA, 22 bp, Homo sapiens
ctgtgttgccacagtagaactg

SEQ ID NO: 1351080 - DNA, 17 bp, Homo sapiens
ctgtgtttataaaatat

SEQ ID NO: 1351081 - DNA, 16 bp, Homo sapiens
ctgttactgggccctg

SEQ ID NO: 1351082 - DNA, 20 bp, Homo sapiens
ctgttactgggccctgagtc

SEQ ID NO: 1351083 - DNA, 12 bp, Homo sapiens
ctgttcagctgg

SEQ ID NO: 1351084 - DNA, 16 bp, Homo sapiens
ctgttcagtaataaaa

SEQ ID NO: 1351085 - DNA, 22 bp, Homo sapiens
ctgttcggaaggggttcctcaa

SEQ ID NO: 1351086 - DNA, 18 bp, Homo sapiens
ctgttggcaggctggcca

SEQ ID NO: 1351087 - DNA, 19 bp, Homo sapiens
ctgttggcaggctggccag

SEQ ID NO: 1351088 - DNA, 15 bp, Homo sapiens
ctgttgtagaagaca

SEQ ID NO: 1351089 - DNA, 22 bp, Homo sapiens
ctgtttaatcatagttactgtg

SEQ ID NO: 1351090 - DNA, 23 bp, Homo sapiens
ctgtttaatcatagttactgtgt

SEQ ID NO: 1351091 - DNA, 19 bp, Homo sapiens
ctgtttagatttgccatag

SEQ ID NO: 1351092 - DNA, 21 bp, Homo sapiens
ctgtttagatttgccatagag

SEQ ID NO: 1351093 - DNA, 22 bp, Homo sapiens
ctgtttagatttgccatagagt

SEQ ID NO: 1351094 - DNA, 14 bp, Homo sapiens
ctgtttattacttc

SEQ ID NO: 1351095 - DNA, 13 bp, Homo sapiens
ctgtttcctgggc

SEQ ID NO: 1351096 - DNA, 15 bp, Homo sapiens
ctgtttctcttgagc

SEQ ID NO: 1351097 - DNA, 22 bp, Homo sapiens
ctgtttctcttgagctggcctc

SEQ ID NO: 1351098 - DNA, 19 bp, Homo sapiens
ctgtttgaaaacttcagaa

SEQ ID NO: 1351099 - DNA, 14 bp, Homo sapiens
ctgttttctcttga

SEQ ID NO: 1351100 - DNA, 17 bp, Homo sapiens
cttaaaaagtggaaaaa

SEQ ID NO: 1351101 - DNA, 20 bp, Homo sapiens
cttaaaacatcattcctttt

SEQ ID NO: 1351102 - DNA, 14 bp, Homo sapiens
cttaaaaccaaaga

SEQ ID NO: 1351103 - DNA, 15 bp, Homo sapiens
cttaaaaccaaagag

SEQ ID NO: 1351104 - DNA, 19 bp, Homo sapiens
cttaaacactcaccttcta

SEQ ID NO: 1351105 - DNA, 20 bp, Homo sapiens
cttaaagaagtatttttaga

SEQ ID NO: 1351106 - DNA, 19 bp, Homo sapiens
cttaaatcttaatgttcct

SEQ ID NO: 1351107 - DNA, 12 bp, Homo sapiens
cttaaatttaat

SEQ ID NO: 1351108 - DNA, 15 bp, Homo sapiens
cttaacatagccaaa

SEQ ID NO: 1351109 - DNA, 20 bp, Homo sapiens
cttaacatagccaaaatgtg

SEQ ID NO: 1351110 - DNA, 12 bp, Homo sapiens
cttaactgaaat

SEQ ID NO: 1351111 - DNA, 20 bp, Homo sapiens
cttaaggggtatcatgtatg

SEQ ID NO: 1351112 - DNA, 20 bp, Homo sapiens
cttaagtgaggaaatcaaag

SEQ ID NO: 1351113 - DNA, 20 bp, Homo sapiens
cttaataaattgtgtttcct

SEQ ID NO: 1351114 - DNA, 20 bp, Homo sapiens
cttaataatcaagagcctta

SEQ ID NO: 1351115 - DNA, 21 bp, Homo sapiens
cttaataatcaagagccttaa

SEQ ID NO: 1351116 - DNA, 20 bp, Homo sapiens
cttaatcattttcattccta

SEQ ID NO: 1351117 - DNA, 12 bp, Homo sapiens
cttaatgaaata

SEQ ID NO: 1351118 - DNA, 17 bp, Homo sapiens
cttaatggagttcttgt

SEQ ID NO: 1351119 - DNA, 12 bp, Homo sapiens
cttaatttcctt

SEQ ID NO: 1351120 - DNA, 13 bp, Homo sapiens
cttaatttccttt

SEQ ID NO: 1351121 - DNA, 21 bp, Homo sapiens
cttacactggcaatggtagtt

SEQ ID NO: 1351122 - DNA, 15 bp, Homo sapiens
cttacctaacatctg

SEQ ID NO: 1351123 - DNA, 18 bp, Homo sapiens
cttacctagtgaaacttt

SEQ ID NO: 1351124 - DNA, 21 bp, Homo sapiens
cttacctcggtgccttcctct

SEQ ID NO: 1351125 - DNA, 13 bp, Homo sapiens
cttactaaaaagt

SEQ ID NO: 1351126 - DNA, 17 bp, Homo sapiens
cttactaaaaagtataa

SEQ ID NO: 1351127 - DNA, 13 bp, Homo sapiens
cttagatcatagt

SEQ ID NO: 1351128 - DNA, 13 bp, Homo sapiens
cttaggccttcct

SEQ ID NO: 1351129 - DNA, 15 bp, Homo sapiens
cttaggggaaggaga

SEQ ID NO: 1351130 - DNA, 22 bp, Homo sapiens
cttagtttgtgtgttgtctctt

SEQ ID NO: 1351131 - DNA, 21 bp, Homo sapiens
cttataaaacagagtaatctt

SEQ ID NO: 1351132 - DNA, 15 bp, Homo sapiens
cttataatgggctct

SEQ ID NO: 1351133 - DNA, 16 bp, Homo sapiens
cttatatctggcctct

SEQ ID NO: 1351134 - DNA, 21 bp, Homo sapiens
cttatatctggcctctgcttt

SEQ ID NO: 1351135 - DNA, 17 bp, Homo sapiens
cttatatgggaaaccat

SEQ ID NO: 1351136 - DNA, 20 bp, Homo sapiens
cttatgattaaacttccttc

SEQ ID NO: 1351137 - DNA, 13 bp, Homo sapiens
cttattgaatata

SEQ ID NO: 1351138 - DNA, 14 bp, Homo sapiens
cttcaaatgaaaat

SEQ ID NO: 1351139 - DNA, 19 bp, Homo sapiens
cttcacacagacccctcgc

SEQ ID NO: 1351140 - DNA, 19 bp, Homo sapiens
cttcacagtagagccagct

SEQ ID NO: 1351141 - DNA, 22 bp, Homo sapiens
cttcacagtagagccagcttgg

SEQ ID NO: 1351142 - DNA, 19 bp, Homo sapiens
cttcaccatggccttatga

SEQ ID NO: 1351143 - DNA, 19 bp, Homo sapiens
cttcacggaagagccttgc

SEQ ID NO: 1351144 - DNA, 20 bp, Homo sapiens
cttcagacagagaggactgt

SEQ ID NO: 1351145 - DNA, 17 bp, Homo sapiens
cttcagatgccacttct

SEQ ID NO: 1351146 - DNA, 11 bp, Homo sapiens
cttcagctgac

SEQ ID NO: 1351147 - DNA, 15 bp, Homo sapiens
cttcagctgactttt

SEQ ID NO: 1351148 - DNA, 15 bp, Homo sapiens
cttcatatatttctc

SEQ ID NO: 1351149 - DNA, 15 bp, Homo sapiens
cttcatcccattcca

SEQ ID NO: 1351150 - DNA, 23 bp, Homo sapiens
cttcatcccattccaggcagcct

SEQ ID NO: 1351151 - DNA, 13 bp, Homo sapiens
cttcatgcactta

SEQ ID NO: 1351152 - DNA, 13 bp, Homo sapiens
cttccagatcact

SEQ ID NO: 1351153 - DNA, 15 bp, Homo sapiens
cttccagatcactgc

SEQ ID NO: 1351154 - DNA, 13 bp, Homo sapiens
cttccaggaaact

SEQ ID NO: 1351155 - DNA, 18 bp, Homo sapiens
cttccatgaattttaaaa

SEQ ID NO: 1351156 - DNA, 13 bp, Homo sapiens
cttcccaccctgc

SEQ ID NO: 1351157 - DNA, 13 bp, Homo sapiens
cttcccatgcatt

SEQ ID NO: 1351158 - DNA, 12 bp, Homo sapiens
cttccctaatct

SEQ ID NO: 1351159 - DNA, 22 bp, Homo sapiens
cttccctagctttagaccctgg

SEQ ID NO: 1351160 - DNA, 14 bp, Homo sapiens
cttcctcctggaaa

SEQ ID NO: 1351161 - DNA, 14 bp, Homo sapiens
cttcctcttgtctg

SEQ ID NO: 1351162 - DNA, 15 bp, Homo sapiens
cttcctgcgtcctcc

SEQ ID NO: 1351163 - DNA, 18 bp, Homo sapiens
cttcctgtgatccaccca

SEQ ID NO: 1351164 - DNA, 13 bp, Homo sapiens
cttccttttaact

SEQ ID NO: 1351165 - DNA, 17 bp, Homo sapiens
cttccttttatcagtag

SEQ ID NO: 1351166 - DNA, 19 bp, Homo sapiens
cttccttttccctgcttcc

SEQ ID NO: 1351167 - DNA, 15 bp, Homo sapiens
cttcgaaacctggga

SEQ ID NO: 1351168 - DNA, 15 bp, Homo sapiens
cttcgcttcttgcct

SEQ ID NO: 1351169 - DNA, 17 bp, Homo sapiens
cttcgcttcttgcctct

SEQ ID NO: 1351170 - DNA, 21 bp, Homo sapiens
cttcgtctttcccatggggag

SEQ ID NO: 1351171 - DNA, 23 bp, Homo sapiens
cttctaaatggcaaaggaaggtg

SEQ ID NO: 1351172 - DNA, 15 bp, Homo sapiens
cttctaattgctgtg

SEQ ID NO: 1351173 - DNA, 15 bp, Homo sapiens
cttctacctgccctc

SEQ ID NO: 1351174 - DNA, 16 bp, Homo sapiens
cttctacctgccctca

SEQ ID NO: 1351175 - DNA, 18 bp, Homo sapiens
cttctacctgccctcaag

SEQ ID NO: 1351176 - DNA, 22 bp, Homo sapiens
cttctaggatagctaactgtaa

SEQ ID NO: 1351177 - DNA, 13 bp, Homo sapiens
cttctcagaagca

SEQ ID NO: 1351178 - DNA, 14 bp, Homo sapiens
cttctcagatttct

SEQ ID NO: 1351179 - DNA, 13 bp, Homo sapiens
cttctccgccagc

SEQ ID NO: 1351180 - DNA, 16 bp, Homo sapiens
cttctccgccagcctc

SEQ ID NO: 1351181 - DNA, 17 bp, Homo sapiens
cttctccgccagcctcc

SEQ ID NO: 1351182 - DNA, 15 bp, Homo sapiens
cttctctgacttctg

SEQ ID NO: 1351183 - DNA, 13 bp, Homo sapiens
cttctcttagatt

SEQ ID NO: 1351184 - DNA, 17 bp, Homo sapiens
cttctgcttttctgccc

SEQ ID NO: 1351185 - DNA, 21 bp, Homo sapiens
cttctgcttttctgccctggc

SEQ ID NO: 1351186 - DNA, 23 bp, Homo sapiens
cttctgcttttctgccctggctg

SEQ ID NO: 1351187 - DNA, 14 bp, Homo sapiens
cttctgtgatgagc

SEQ ID NO: 1351188 - DNA, 16 bp, Homo sapiens
cttctgtgatgagctg

SEQ ID NO: 1351189 - DNA, 21 bp, Homo sapiens
cttctgtgcccagaatactga

SEQ ID NO: 1351190 - DNA, 15 bp, Homo sapiens
cttcttgcctctgtg

SEQ ID NO: 1351191 - DNA, 24 bp, Homo sapiens
cttcttggggcccagtgcatggtg

SEQ ID NO: 1351192 - DNA, 13 bp, Homo sapiens
cttcttttgatta

SEQ ID NO: 1351193 - DNA, 14 bp, Homo sapiens
cttcttttgattat

SEQ ID NO: 1351194 - DNA, 16 bp, Homo sapiens
cttcttttgattatgt

SEQ ID NO: 1351195 - DNA, 19 bp, Homo sapiens
cttcttttttcaaaagaaa

SEQ ID NO: 1351196 - DNA, 21 bp, Homo sapiens
cttgaaaagagacaggcaggt

SEQ ID NO: 1351197 - DNA, 16 bp, Homo sapiens
cttgaaactttgggaa

SEQ ID NO: 1351198 - DNA, 18 bp, Homo sapiens
cttgaacatgttttgtat

SEQ ID NO: 1351199 - DNA, 17 bp, Homo sapiens
cttgaaccataaaatgt

SEQ ID NO: 1351200 - DNA, 18 bp, Homo sapiens
cttgaactcctggactca

SEQ ID NO: 1351201 - DNA, 17 bp, Homo sapiens
cttgaagaactgcaggc

SEQ ID NO: 1351202 - DNA, 20 bp, Homo sapiens
cttgaagaactgcaggccct

SEQ ID NO: 1351203 - DNA, 22 bp, Homo sapiens
cttgaagaactgcaggccctgg

SEQ ID NO: 1351204 - DNA, 12 bp, Homo sapiens
cttgaagccaaa

SEQ ID NO: 1351205 - DNA, 15 bp, Homo sapiens
cttgaagccaaagaa

SEQ ID NO: 1351206 - DNA, 11 bp, Homo sapiens
cttgaagctgt

SEQ ID NO: 1351207 - DNA, 14 bp, Homo sapiens
cttgaatccttcca

SEQ ID NO: 1351208 - DNA, 15 bp, Homo sapiens
cttgaatccttccat

SEQ ID NO: 1351209 - DNA, 21 bp, Homo sapiens
cttgaatccttccattccaca

SEQ ID NO: 1351210 - DNA, 15 bp, Homo sapiens
cttgaatgtgtcagg

SEQ ID NO: 1351211 - DNA, 17 bp, Homo sapiens
cttgacctgaggctgtg

SEQ ID NO: 1351212 - DNA, 23 bp, Homo sapiens
cttgagaagacctcacctagaaa

SEQ ID NO: 1351213 - DNA, 22 bp, Homo sapiens
cttgagacacggagcccagccc

SEQ ID NO: 1351214 - DNA, 20 bp, Homo sapiens
cttgagagtagatggtttga

SEQ ID NO: 1351215 - DNA, 20 bp, Homo sapiens
cttgagccctggctgttctg

SEQ ID NO: 1351216 - DNA, 12 bp, Homo sapiens
cttgagcctggg

SEQ ID NO: 1351217 - DNA, 16 bp, Homo sapiens
cttgagcctgggaggt

SEQ ID NO: 1351218 - DNA, 13 bp, Homo sapiens
cttgagctcagga

SEQ ID NO: 1351219 - DNA, 14 bp, Homo sapiens
cttgagctggcctc

SEQ ID NO: 1351220 - DNA, 17 bp, Homo sapiens
cttgagctggcctctct

SEQ ID NO: 1351221 - DNA, 12 bp, Homo sapiens
cttgagggctgc

SEQ ID NO: 1351222 - DNA, 13 bp, Homo sapiens
cttgagggctgca

SEQ ID NO: 1351223 - DNA, 19 bp, Homo sapiens
cttgagttgattcagctct

SEQ ID NO: 1351224 - DNA, 22 bp, Homo sapiens
cttgagttgtttttgtatattg

SEQ ID NO: 1351225 - DNA, 12 bp, Homo sapiens
cttgagtttgtc

SEQ ID NO: 1351226 - DNA, 13 bp, Homo sapiens
cttgagtttgtcg

SEQ ID NO: 1351227 - DNA, 20 bp, Homo sapiens
cttgatacattcaaatttgt

SEQ ID NO: 1351228 - DNA, 15 bp, Homo sapiens
cttgattcagtcaca

SEQ ID NO: 1351229 - DNA, 17 bp, Homo sapiens
cttgcaagcatgcttgt

SEQ ID NO: 1351230 - DNA, 15 bp, Homo sapiens
cttgccatcagtgaa

SEQ ID NO: 1351231 - DNA, 17 bp, Homo sapiens
cttgccatcagtgaaaa

SEQ ID NO: 1351232 - DNA, 13 bp, Homo sapiens
cttgcccatcctg

SEQ ID NO: 1351233 - DNA, 14 bp, Homo sapiens
cttgcccatcctga

SEQ ID NO: 1351234 - DNA, 16 bp, Homo sapiens
cttgcccatcctgact

SEQ ID NO: 1351235 - DNA, 18 bp, Homo sapiens
cttgcccatcctgactga

SEQ ID NO: 1351236 - DNA, 14 bp, Homo sapiens
cttgcctccaggtg

SEQ ID NO: 1351237 - DNA, 19 bp, Homo sapiens
cttgcctccaggtgcagag

SEQ ID NO: 1351238 - DNA, 23 bp, Homo sapiens
cttgcctccaggtgcagaggtac

SEQ ID NO: 1351239 - DNA, 14 bp, Homo sapiens
cttgcctctgtgct

SEQ ID NO: 1351240 - DNA, 16 bp, Homo sapiens
cttgcctctgtgctgt

SEQ ID NO: 1351241 - DNA, 20 bp, Homo sapiens
cttgcctctgtgctgtgtgt

SEQ ID NO: 1351242 - DNA, 12 bp, Homo sapiens
cttgcctcttcc

SEQ ID NO: 1351243 - DNA, 18 bp, Homo sapiens
cttgcctcttccttgaag

SEQ ID NO: 1351244 - DNA, 13 bp, Homo sapiens
cttgcctgcaggg

SEQ ID NO: 1351245 - DNA, 20 bp, Homo sapiens
cttgcctgcagggccatggc

SEQ ID NO: 1351246 - DNA, 10 bp, Homo sapiens
cttgcctggg

SEQ ID NO: 1351247 - DNA, 18 bp, Homo sapiens
cttgctggccccagccct

SEQ ID NO: 1351248 - DNA, 20 bp, Homo sapiens
cttgctggccccagccctgc

SEQ ID NO: 1351249 - DNA, 17 bp, Homo sapiens
cttgcttaaatttctta

SEQ ID NO: 1351250 - DNA, 23 bp, Homo sapiens
cttgcttaaatttcttatgtgac

SEQ ID NO: 1351251 - DNA, 19 bp, Homo sapiens
cttgctttaccttttcagg

SEQ ID NO: 1351252 - DNA, 20 bp, Homo sapiens
cttgctttaccttttcaggg

SEQ ID NO: 1351253 - DNA, 19 bp, Homo sapiens
cttggaaattcctgtactg

SEQ ID NO: 1351254 - DNA, 22 bp, Homo sapiens
cttggcaataaattttgaaaag

SEQ ID NO: 1351255 - DNA, 22 bp, Homo sapiens
cttggcattccgcatccctacc

SEQ ID NO: 1351256 - DNA, 12 bp, Homo sapiens
cttggcctgggc

SEQ ID NO: 1351257 - DNA, 18 bp, Homo sapiens
cttggctcgaatctctgt

SEQ ID NO: 1351258 - DNA, 19 bp, Homo sapiens
cttggcttaatcattttca

SEQ ID NO: 1351259 - DNA, 13 bp, Homo sapiens
cttggcttctgtg

SEQ ID NO: 1351260 - DNA, 17 bp, Homo sapiens
cttggcttctgtgatga

SEQ ID NO: 1351261 - DNA, 21 bp, Homo sapiens
cttggcttctgtgatgagctg

SEQ ID NO: 1351262 - DNA, 14 bp, Homo sapiens
cttgggaggctgag

SEQ ID NO: 1351263 - DNA, 23 bp, Homo sapiens
cttgggaggctgaggcaggagaa

SEQ ID NO: 1351264 - DNA, 20 bp, Homo sapiens
cttgggcagagctggctctg

SEQ ID NO: 1351265 - DNA, 22 bp, Homo sapiens
cttgggcagagctggctctgag

SEQ ID NO: 1351266 - DNA, 14 bp, Homo sapiens
cttgggccactgtg

SEQ ID NO: 1351267 - DNA, 18 bp, Homo sapiens
cttgggccactgtgaaga

SEQ ID NO: 1351268 - DNA, 19 bp, Homo sapiens
cttggggccaccaaagctg

SEQ ID NO: 1351269 - DNA, 15 bp, Homo sapiens
cttggggggctgagg

SEQ ID NO: 1351270 - DNA, 18 bp, Homo sapiens
cttgggggggtggccgct

SEQ ID NO: 1351271 - DNA, 13 bp, Homo sapiens
cttggtgtaattt

SEQ ID NO: 1351272 - DNA, 18 bp, Homo sapiens
cttggtgtaatttgaaga

SEQ ID NO: 1351273 - DNA, 16 bp, Homo sapiens
cttggttctgtgaaca

SEQ ID NO: 1351274 - DNA, 14 bp, Homo sapiens
cttggttttatggt

SEQ ID NO: 1351275 - DNA, 18 bp, Homo sapiens
cttgtaaaagacagtgta

SEQ ID NO: 1351276 - DNA, 14 bp, Homo sapiens
cttgtagatttgat

SEQ ID NO: 1351277 - DNA, 15 bp, Homo sapiens
cttgtagatttgatt

SEQ ID NO: 1351278 - DNA, 17 bp, Homo sapiens
cttgtagatttgatttt

SEQ ID NO: 1351279 - DNA, 17 bp, Homo sapiens
cttgtagcgactaaact

SEQ ID NO: 1351280 - DNA, 13 bp, Homo sapiens
cttgtagttcttt

SEQ ID NO: 1351281 - DNA, 21 bp, Homo sapiens
cttgtatagcatgaaataaaa

SEQ ID NO: 1351282 - DNA, 13 bp, Homo sapiens
cttgtctgtagat

SEQ ID NO: 1351283 - DNA, 18 bp, Homo sapiens
cttgtcttctggtacttt

SEQ ID NO: 1351284 - DNA, 21 bp, Homo sapiens
cttgtcttctggtactttctg

SEQ ID NO: 1351285 - DNA, 14 bp, Homo sapiens
cttgtgaaaatgtg

SEQ ID NO: 1351286 - DNA, 16 bp, Homo sapiens
cttgtgggtccatgct

SEQ ID NO: 1351287 - DNA, 23 bp, Homo sapiens
cttgtgtctttggaggtgctgct

SEQ ID NO: 1351288 - DNA, 15 bp, Homo sapiens
cttgtgttttaaaat

SEQ ID NO: 1351289 - DNA, 17 bp, Homo sapiens
cttgttacttctgaggt

SEQ ID NO: 1351290 - DNA, 22 bp, Homo sapiens
cttgttcatcatccagatgtgg

SEQ ID NO: 1351291 - DNA, 20 bp, Homo sapiens
cttgttgcctataagccaaa

SEQ ID NO: 1351292 - DNA, 22 bp, Homo sapiens
cttgttggttcaccattgagac

SEQ ID NO: 1351293 - DNA, 19 bp, Homo sapiens
cttgtttacctttctctct

SEQ ID NO: 1351294 - DNA, 22 bp, Homo sapiens
cttgtttacctttctctctcta

SEQ ID NO: 1351295 - DNA, 21 bp, Homo sapiens
ctttaaaaagggaagaaactg

SEQ ID NO: 1351296 - DNA, 17 bp, Homo sapiens
ctttaaaaggaaagaaa

SEQ ID NO: 1351297 - DNA, 14 bp, Homo sapiens
ctttaaaatattgt

SEQ ID NO: 1351298 - DNA, 20 bp, Homo sapiens
ctttaaactgtcgtgtcata

SEQ ID NO: 1351299 - DNA, 17 bp, Homo sapiens
ctttaaccttgtataaa

SEQ ID NO: 1351300 - DNA, 18 bp, Homo sapiens
ctttaagccttcaaaact

SEQ ID NO: 1351301 - DNA, 20 bp, Homo sapiens
ctttaccttttcagggctgg

SEQ ID NO: 1351302 - DNA, 13 bp, Homo sapiens
ctttactgcctga

SEQ ID NO: 1351303 - DNA, 18 bp, Homo sapiens
ctttactgcctgaataaa

SEQ ID NO: 1351304 - DNA, 19 bp, Homo sapiens
ctttactgcctgaataaag

SEQ ID NO: 1351305 - DNA, 14 bp, Homo sapiens
ctttagaccctggg

SEQ ID NO: 1351306 - DNA, 21 bp, Homo sapiens
ctttagacttgaaaagagaca

SEQ ID NO: 1351307 - DNA, 14 bp, Homo sapiens
ctttagtttttggt

SEQ ID NO: 1351308 - DNA, 17 bp, Homo sapiens
ctttataaatccagtga

SEQ ID NO: 1351309 - DNA, 12 bp, Homo sapiens
ctttatgtgaat

SEQ ID NO: 1351310 - DNA, 15 bp, Homo sapiens
ctttatgtgaatttt

SEQ ID NO: 1351311 - DNA, 14 bp, Homo sapiens
ctttattaccccct

SEQ ID NO: 1351312 - DNA, 16 bp, Homo sapiens
ctttatttgtaaattt

SEQ ID NO: 1351313 - DNA, 17 bp, Homo sapiens
ctttatttttttgaact

SEQ ID NO: 1351314 - DNA, 15 bp, Homo sapiens
ctttcaaaggaacat

SEQ ID NO: 1351315 - DNA, 19 bp, Homo sapiens
ctttcacggaaactcccga

SEQ ID NO: 1351316 - DNA, 10 bp, Homo sapiens
ctttcagaaa

SEQ ID NO: 1351317 - DNA, 21 bp, Homo sapiens
ctttcagaaatataacacatt

SEQ ID NO: 1351318 - DNA, 21 bp, Homo sapiens
ctttcagaagtgcccttcctg

SEQ ID NO: 1351319 - DNA, 21 bp, Homo sapiens
ctttcagtacttttttaaata

SEQ ID NO: 1351320 - DNA, 17 bp, Homo sapiens
ctttccaccacagccag

SEQ ID NO: 1351321 - DNA, 22 bp, Homo sapiens
ctttccaccacagccagcacct

SEQ ID NO: 1351322 - DNA, 23 bp, Homo sapiens
ctttccaccacagccagcacctg

SEQ ID NO: 1351323 - DNA, 17 bp, Homo sapiens
ctttctatcctctgtaa

SEQ ID NO: 1351324 - DNA, 11 bp, Homo sapiens
ctttctgcctg

SEQ ID NO: 1351325 - DNA, 14 bp, Homo sapiens
ctttctgcctggag

SEQ ID NO: 1351326 - DNA, 13 bp, Homo sapiens
ctttctgttgcca

SEQ ID NO: 1351327 - DNA, 23 bp, Homo sapiens
ctttgaatatgtagtatctatat

SEQ ID NO: 1351328 - DNA, 17 bp, Homo sapiens
gaaatcaaagtgctatt

SEQ ID NO: 1351329 - DNA, 20 bp, Homo sapiens
gaaatcagccaagttttata

SEQ ID NO: 1351330 - DNA, 14 bp, Homo sapiens
gaaatggaaatttt

SEQ ID NO: 1351331 - DNA, 21 bp, Homo sapiens
gaaatggaggatctctaaaga

SEQ ID NO: 1351332 - DNA, 24 bp, Homo sapiens
gaaatggaggatctctaaagagca

SEQ ID NO: 1351333 - DNA, 22 bp, Homo sapiens
gaaatgtaggcatcatgcatgt

SEQ ID NO: 1351334 - DNA, 21 bp, Homo sapiens
gaaatgtgaatttttattgtt

SEQ ID NO: 1351335 - DNA, 14 bp, Homo sapiens
gaaatgttttgtaa

SEQ ID NO: 1351336 - DNA, 20 bp, Homo sapiens
gaaatgttttgtaaacattt

SEQ ID NO: 1351337 - DNA, 13 bp, Homo sapiens
gaaattgcatact

SEQ ID NO: 1351338 - DNA, 12 bp, Homo sapiens
gaaattttgtaa

SEQ ID NO: 1351339 - DNA, 14 bp, Homo sapiens
gaaattttgtaaga

SEQ ID NO: 1351340 - DNA, 20 bp, Homo sapiens
gaaattttgtaagaaggcaa

SEQ ID NO: 1351341 - DNA, 14 bp, Homo sapiens
gaacaaattatttt

SEQ ID NO: 1351342 - DNA, 13 bp, Homo sapiens
gaacaagcttcag

SEQ ID NO: 1351343 - DNA, 14 bp, Homo sapiens
gaacacacacatat

SEQ ID NO: 1351344 - DNA, 15 bp, Homo sapiens
gaacacatttctctg

SEQ ID NO: 1351345 - DNA, 23 bp, Homo sapiens
gaacactgcactcttaagcttcc

SEQ ID NO: 1351346 - DNA, 21 bp, Homo sapiens
gaacagagagacccttgtggg

SEQ ID NO: 1351347 - DNA, 21 bp, Homo sapiens
gaacagtggtggcaacattca

SEQ ID NO: 1351348 - DNA, 21 bp, Homo sapiens
gaacagtgtggcctcttctga

SEQ ID NO: 1351349 - DNA, 22 bp, Homo sapiens
gaacatactgttcactcactct

SEQ ID NO: 1351350 - DNA, 15 bp, Homo sapiens
gaacatgaatcaaaa

SEQ ID NO: 1351351 - DNA, 16 bp, Homo sapiens
gaaccaaatctggaag

SEQ ID NO: 1351352 - DNA, 17 bp, Homo sapiens
gaaccaaatctggaagc

SEQ ID NO: 1351353 - DNA, 18 bp, Homo sapiens
gaaccacttgtagatttg

SEQ ID NO: 1351354 - DNA, 18 bp, Homo sapiens
gaaccataaaatgtccag

SEQ ID NO: 1351355 - DNA, 15 bp, Homo sapiens
gaaccataaattcaa

SEQ ID NO: 1351356 - DNA, 14 bp, Homo sapiens
gaaccgcacagctc

SEQ ID NO: 1351357 - DNA, 21 bp, Homo sapiens
gaaccgcacagctcaggaggc

SEQ ID NO: 1351358 - DNA, 20 bp, Homo sapiens
gaacctaactccccacccca

SEQ ID NO: 1351359 - DNA, 15 bp, Homo sapiens
gaacctccccagcct

SEQ ID NO: 1351360 - DNA, 16 bp, Homo sapiens
gaacctccccagcctg

SEQ ID NO: 1351361 - DNA, 22 bp, Homo sapiens
gaacgaaccttggcctgggccg

SEQ ID NO: 1351362 - DNA, 13 bp, Homo sapiens
gaactctggcttt

SEQ ID NO: 1351363 - DNA, 23 bp, Homo sapiens
gaactgcaggccctggcctcccc

SEQ ID NO: 1351364 - DNA, 17 bp, Homo sapiens
gaacttgggccactgtg

SEQ ID NO: 1351365 - DNA, 21 bp, Homo sapiens
gaacttttgtactgaattttt

SEQ ID NO: 1351366 - DNA, 13 bp, Homo sapiens
gaagaactgcagg

SEQ ID NO: 1351367 - DNA, 14 bp, Homo sapiens
gaagaagggagaag

SEQ ID NO: 1351368 - DNA, 19 bp, Homo sapiens
gaagaatgttagagtaatg

SEQ ID NO: 1351369 - DNA, 18 bp, Homo sapiens
gaagaattgaaaagtttt

SEQ ID NO: 1351370 - DNA, 21 bp, Homo sapiens
gaagaattgaaaagtttttgt

SEQ ID NO: 1351371 - DNA, 23 bp, Homo sapiens
gaagaccctcttgcccatcctga

SEQ ID NO: 1351372 - DNA, 16 bp, Homo sapiens
gaagagatccaaagac

SEQ ID NO: 1351373 - DNA, 12 bp, Homo sapiens
gaagagccttgc

SEQ ID NO: 1351374 - DNA, 21 bp, Homo sapiens
gaagagcgcagtgttttgcaa

SEQ ID NO: 1351375 - DNA, 20 bp, Homo sapiens
gaagagttcccttgaaactt

SEQ ID NO: 1351376 - DNA, 21 bp, Homo sapiens
gaagagttcccttgaaacttt

SEQ ID NO: 1351377 - DNA, 20 bp, Homo sapiens
gaagataatattaaggaaga

SEQ ID NO: 1351378 - DNA, 14 bp, Homo sapiens
gaagatactttgta

SEQ ID NO: 1351379 - DNA, 22 bp, Homo sapiens
gaagcacaccaatcttactttg

SEQ ID NO: 1351380 - DNA, 16 bp, Homo sapiens
gaagcaccataacttt

SEQ ID NO: 1351381 - DNA, 20 bp, Homo sapiens
gaagcactacaccttgcctt

SEQ ID NO: 1351382 - DNA, 14 bp, Homo sapiens
gaagcagtggcctt

SEQ ID NO: 1351383 - DNA, 10 bp, Homo sapiens
gaagccaaag

SEQ ID NO: 1351384 - DNA, 16 bp, Homo sapiens
gaagccaaagaaaaat

SEQ ID NO: 1351385 - DNA, 17 bp, Homo sapiens
gaagcccatcctgacca

SEQ ID NO: 1351386 - DNA, 17 bp, Homo sapiens
gaagccccacatgtcca

SEQ ID NO: 1351387 - DNA, 23 bp, Homo sapiens
gaagccccacatgtccagcacct

SEQ ID NO: 1351388 - DNA, 22 bp, Homo sapiens
gaagccgtcctggcgcctggca

SEQ ID NO: 1351389 - DNA, 22 bp, Homo sapiens
gaagctgccaggtgagaaactg

SEQ ID NO: 1351390 - DNA, 16 bp, Homo sapiens
gaagcttcatgcactt

SEQ ID NO: 1351391 - DNA, 22 bp, Homo sapiens
gaaggcaagagggggtggaggg

SEQ ID NO: 1351392 - DNA, 12 bp, Homo sapiens
gaaggctgtacg

SEQ ID NO: 1351393 - DNA, 14 bp, Homo sapiens
gaagggtttctcta

SEQ ID NO: 1351394 - DNA, 16 bp, Homo sapiens
gaagggtttctctatt

SEQ ID NO: 1351395 - DNA, 13 bp, Homo sapiens
gaaggtttattgt

SEQ ID NO: 1351396 - DNA, 13 bp, Homo sapiens
gaagtaatgaatt

SEQ ID NO: 1351397 - DNA, 15 bp, Homo sapiens
gaagtatttttagaa

SEQ ID NO: 1351398 - DNA, 18 bp, Homo sapiens
gaagtctctaggttctga

SEQ ID NO: 1351399 - DNA, 17 bp, Homo sapiens
gaagtcttaaggacaaa

SEQ ID NO: 1351400 - DNA, 19 bp, Homo sapiens
gaagtcttactacagaaat

SEQ ID NO: 1351401 - DNA, 16 bp, Homo sapiens
gaagtgaatgctggga

SEQ ID NO: 1351402 - DNA, 17 bp, Homo sapiens
gaagtgaatgctgggac

SEQ ID NO: 1351403 - DNA, 14 bp, Homo sapiens
gaagtgtataatat

SEQ ID NO: 1351404 - DNA, 17 bp, Homo sapiens
gaagtgtataatataaa

SEQ ID NO: 1351405 - DNA, 21 bp, Homo sapiens
gaagtgtataatataaaaaat

SEQ ID NO: 1351406 - DNA, 15 bp, Homo sapiens
gaagttagtttgtat

SEQ ID NO: 1351407 - DNA, 15 bp, Homo sapiens
gaagttcaagatcaa

SEQ ID NO: 1351408 - DNA, 16 bp, Homo sapiens
gaataaatgtgttggg

SEQ ID NO: 1351409 - DNA, 12 bp, Homo sapiens
gaataagaattt

SEQ ID NO: 1351410 - DNA, 14 bp, Homo sapiens
gaataagaatttgc

SEQ ID NO: 1351411 - DNA, 13 bp, Homo sapiens
gaataagttattg

SEQ ID NO: 1351412 - DNA, 14 bp, Homo sapiens
gaataagttattgc

SEQ ID NO: 1351413 - DNA, 19 bp, Homo sapiens
gaataagttattgcagttt

SEQ ID NO: 1351414 - DNA, 17 bp, Homo sapiens
gaataatacagtatctc

SEQ ID NO: 1351415 - DNA, 21 bp, Homo sapiens
gaatacagaggcaactgcatt

SEQ ID NO: 1351416 - DNA, 22 bp, Homo sapiens
gaataccacatcaaataagaaa

SEQ ID NO: 1351417 - DNA, 16 bp, Homo sapiens
gaatactgatggaatt

SEQ ID NO: 1351418 - DNA, 17 bp, Homo sapiens
gaatactgcttgaataa

SEQ ID NO: 1351419 - DNA, 15 bp, Homo sapiens
gaatacttgaaccat

SEQ ID NO: 1351420 - DNA, 22 bp, Homo sapiens
gaatacttgaaccataaaatgt

SEQ ID NO: 1351421 - DNA, 20 bp, Homo sapiens
gaatatatctctatttgaga

SEQ ID NO: 1351422 - DNA, 21 bp, Homo sapiens
gaatatgattaaaaatatcaa

SEQ ID NO: 1351423 - DNA, 13 bp, Homo sapiens
gaatattgcaaaa

SEQ ID NO: 1351424 - DNA, 20 bp, Homo sapiens
gaatattgcaaaatacatga

SEQ ID NO: 1351425 - DNA, 22 bp, Homo sapiens
gaatatttttatatttccttta

SEQ ID NO: 1351426 - DNA, 23 bp, Homo sapiens
gaatcaggaatattttccaaaga

SEQ ID NO: 1351427 - DNA, 20 bp, Homo sapiens
gaatccaagcctccacagcg

SEQ ID NO: 1351428 - DNA, 16 bp, Homo sapiens
gaatccttccattcca

SEQ ID NO: 1351429 - DNA, 16 bp, Homo sapiens
gaatctggagaccagg

SEQ ID NO: 1351430 - DNA, 15 bp, Homo sapiens
gaatgaggtgggagg

SEQ ID NO: 1351431 - DNA, 22 bp, Homo sapiens
gaatgaggtgggaggtggaaga

SEQ ID NO: 1351432 - DNA, 21 bp, Homo sapiens
gaatgctgcaggacttgagaa

SEQ ID NO: 1351433 - DNA, 18 bp, Homo sapiens
gaatgctgggactcagcc

SEQ ID NO: 1351434 - DNA, 19 bp, Homo sapiens
gaatggtgtgaacccggga

SEQ ID NO: 1351435 - DNA, 23 bp, Homo sapiens
gaatgttagagtaatgaaatgga

SEQ ID NO: 1351436 - DNA, 23 bp, Homo sapiens
gaatgttgggactgctaaataaa

SEQ ID NO: 1351437 - DNA, 20 bp, Homo sapiens
gaattaaattaggaataaat

SEQ ID NO: 1351438 - DNA, 21 bp, Homo sapiens
gaattaaattaggaataaata

SEQ ID NO: 1351439 - DNA, 15 bp, Homo sapiens
gaattacgtgctctg

SEQ ID NO: 1351440 - DNA, 12 bp, Homo sapiens
gaattattgaca

SEQ ID NO: 1351441 - DNA, 14 bp, Homo sapiens
gaattattgacact

SEQ ID NO: 1351442 - DNA, 17 bp, Homo sapiens
gaattattgacactgaa

SEQ ID NO: 1351443 - DNA, 21 bp, Homo sapiens
gaattcaaactggggcctcca

SEQ ID NO: 1351444 - DNA, 23 bp, Homo sapiens
gaattcaaactggggcctccaga

SEQ ID NO: 1351445 - DNA, 22 bp, Homo sapiens
gaattgaaaagtttttgtttgg

SEQ ID NO: 1351446 - DNA, 11 bp, Homo sapiens
gaattgaaggt

SEQ ID NO: 1351447 - DNA, 17 bp, Homo sapiens
gaatttagtattatcaa

SEQ ID NO: 1351448 - DNA, 22 bp, Homo sapiens
ctttgagaagccttcagctcca

SEQ ID NO: 1351449 - DNA, 17 bp, Homo sapiens
ctttgagcctgggaaat

SEQ ID NO: 1351450 - DNA, 14 bp, Homo sapiens
ctttgagctcccac

SEQ ID NO: 1351451 - DNA, 21 bp, Homo sapiens
ctttgagtagatccatttcca

SEQ ID NO: 1351452 - DNA, 23 bp, Homo sapiens
ctttgagtagatccatttccatt

SEQ ID NO: 1351453 - DNA, 20 bp, Homo sapiens
ctttgatgtgttgttcttgg

SEQ ID NO: 1351454 - DNA, 20 bp, Homo sapiens
ctttgattatttgcatgtta

SEQ ID NO: 1351455 - DNA, 15 bp, Homo sapiens
ctttgccatgtgctt

SEQ ID NO: 1351456 - DNA, 14 bp, Homo sapiens
ctttggattctaaa

SEQ ID NO: 1351457 - DNA, 21 bp, Homo sapiens
ctttgggaaaacatgttaatg

SEQ ID NO: 1351458 - DNA, 13 bp, Homo sapiens
ctttgggaggcca

SEQ ID NO: 1351459 - DNA, 23 bp, Homo sapiens
ctttgggaggccaaggtgggagg

SEQ ID NO: 1351460 - DNA, 23 bp, Homo sapiens
ctttgggggaggagaacatgagt

SEQ ID NO: 1351461 - DNA, 21 bp, Homo sapiens
ctttggtactaataatcttgt

SEQ ID NO: 1351462 - DNA, 21 bp, Homo sapiens
ctttggttctggccagaatgc

SEQ ID NO: 1351463 - DNA, 11 bp, Homo sapiens
ctttggttttt

SEQ ID NO: 1351464 - DNA, 17 bp, Homo sapiens
ctttggtttttttcttc

SEQ ID NO: 1351465 - DNA, 23 bp, Homo sapiens
ctttggtttttttcttctgtatt

SEQ ID NO: 1351466 - DNA, 12 bp, Homo sapiens
ctttgtaaatag

SEQ ID NO: 1351467 - DNA, 12 bp, Homo sapiens
ctttgtaaattc

SEQ ID NO: 1351468 - DNA, 21 bp, Homo sapiens
ctttgtagatccttagaggtc

SEQ ID NO: 1351469 - DNA, 12 bp, Homo sapiens
ctttgtatagtt

SEQ ID NO: 1351470 - DNA, 19 bp, Homo sapiens
ctttgtatagttatgtaaa

SEQ ID NO: 1351471 - DNA, 22 bp, Homo sapiens
ctttgtattgtatattacaatg

SEQ ID NO: 1351472 - DNA, 15 bp, Homo sapiens
ctttgtattgtccta

SEQ ID NO: 1351473 - DNA, 18 bp, Homo sapiens
ctttgttcatagcccagt

SEQ ID NO: 1351474 - DNA, 19 bp, Homo sapiens
ctttgttgcaagatgtgaa

SEQ ID NO: 1351475 - DNA, 20 bp, Homo sapiens
ctttgttgcaagatgtgaat

SEQ ID NO: 1351476 - DNA, 20 bp, Homo sapiens
ctttgttttctgactaatta

SEQ ID NO: 1351477 - DNA, 18 bp, Homo sapiens
cttttaaaaacataacat

SEQ ID NO: 1351478 - DNA, 12 bp, Homo sapiens
cttttaaagacc

SEQ ID NO: 1351479 - DNA, 16 bp, Homo sapiens
cttttaaagttgatat

SEQ ID NO: 1351480 - DNA, 22 bp, Homo sapiens
cttttaaatgattgaattatat

SEQ ID NO: 1351481 - DNA, 20 bp, Homo sapiens
cttttaccttttttttttct

SEQ ID NO: 1351482 - DNA, 17 bp, Homo sapiens
cttttactggttgcatg

SEQ ID NO: 1351483 - DNA, 11 bp, Homo sapiens
cttttactgtg

SEQ ID NO: 1351484 - DNA, 14 bp, Homo sapiens
cttttattaatgca

SEQ ID NO: 1351485 - DNA, 22 bp, Homo sapiens
cttttattttacacagaaacac

SEQ ID NO: 1351486 - DNA, 15 bp, Homo sapiens
cttttcaccattcgt

SEQ ID NO: 1351487 - DNA, 23 bp, Homo sapiens
cttttcagggctggctcctgatc

SEQ ID NO: 1351488 - DNA, 14 bp, Homo sapiens
cttttcgcctttcc

SEQ ID NO: 1351489 - DNA, 17 bp, Homo sapiens
cttttctcagtgttggt

SEQ ID NO: 1351490 - DNA, 13 bp, Homo sapiens
cttttctgccctg

SEQ ID NO: 1351491 - DNA, 12 bp, Homo sapiens
cttttctggcac

SEQ ID NO: 1351492 - DNA, 21 bp, Homo sapiens
cttttctggggaaagacactg

SEQ ID NO: 1351493 - DNA, 23 bp, Homo sapiens
cttttctggggaaagacactgcc

SEQ ID NO: 1351494 - DNA, 23 bp, Homo sapiens
cttttctgtccgagctttgaaaa

SEQ ID NO: 1351495 - DNA, 21 bp, Homo sapiens
cttttgaagcatagataatat

SEQ ID NO: 1351496 - DNA, 16 bp, Homo sapiens
cttttgcaaccaggaa

SEQ ID NO: 1351497 - DNA, 20 bp, Homo sapiens
cttttgccttttgcaaccag

SEQ ID NO: 1351498 - DNA, 17 bp, Homo sapiens
cttttgcttttggcaaa

SEQ ID NO: 1351499 - DNA, 21 bp, Homo sapiens
cttttggtaaagactggcttt

SEQ ID NO: 1351500 - DNA, 18 bp, Homo sapiens
ctttttaaaaattgttat

SEQ ID NO: 1351501 - DNA, 20 bp, Homo sapiens
ctttttaaggtctttcagta

SEQ ID NO: 1351502 - DNA, 16 bp, Homo sapiens
ctttttagtaatttct

SEQ ID NO: 1351503 - DNA, 17 bp, Homo sapiens
ctttttatttatatgta

SEQ ID NO: 1351504 - DNA, 17 bp, Homo sapiens
ctttttcccctttctgt

SEQ ID NO: 1351505 - DNA, 13 bp, Homo sapiens
ctttttgacactg

SEQ ID NO: 1351506 - DNA, 21 bp, Homo sapiens
ctttttgttgtaaaacaaaat

SEQ ID NO: 1351507 - DNA, 17 bp, Homo sapiens
cttttttaaatattttc

SEQ ID NO: 1351508 - DNA, 22 bp, Homo sapiens
cttttttaaatattttctattt

SEQ ID NO: 1351509 - DNA, 14 bp, Homo sapiens
cttttttattaatc

SEQ ID NO: 1351510 - DNA, 13 bp, Homo sapiens
cttttttgttttg

SEQ ID NO: 1351511 - DNA, 16 bp, Homo sapiens
ctttttttccttttta

SEQ ID NO: 1351512 - DNA, 16 bp, Homo sapiens
ctttttttgtatgtgt

SEQ ID NO: 1351513 - DNA, 21 bp, Homo sapiens
ctttttttttaagttcttatg

SEQ ID NO: 1351514 - DNA, 16 bp, Homo sapiens
cttttttttttcttgg

SEQ ID NO: 1351515 - DNA, 22 bp, Homo sapiens
ctttttttttttttttttggtc

SEQ ID NO: 1351516 - DNA, 15 bp, Homo sapiens
gaaaaaaatactatt

SEQ ID NO: 1351517 - DNA, 19 bp, Homo sapiens
gaaaaaatattttcctgcc

SEQ ID NO: 1351518 - DNA, 14 bp, Homo sapiens
gaaaaacacaagca

SEQ ID NO: 1351519 - DNA, 15 bp, Homo sapiens
gaaaaaggaggaaga

SEQ ID NO: 1351520 - DNA, 19 bp, Homo sapiens
gaaaaagttaaacattgaa

SEQ ID NO: 1351521 - DNA, 12 bp, Homo sapiens
gaaaaatataaa

SEQ ID NO: 1351522 - DNA, 16 bp, Homo sapiens
gaaaaatgagcctggc

SEQ ID NO: 1351523 - DNA, 17 bp, Homo sapiens
gaaaaatgctccccaca

SEQ ID NO: 1351524 - DNA, 18 bp, Homo sapiens
gaaaacagtgtgtaaaca

SEQ ID NO: 1351525 - DNA, 20 bp, Homo sapiens
gaaaacatgttaatgacaat

SEQ ID NO: 1351526 - DNA, 12 bp, Homo sapiens
gaaaactgtgtt

SEQ ID NO: 1351527 - DNA, 13 bp, Homo sapiens
gaaaactgtgttg

SEQ ID NO: 1351528 - DNA, 18 bp, Homo sapiens
gaaaagaaaaatgagcct

SEQ ID NO: 1351529 - DNA, 23 bp, Homo sapiens
gaaaagaaaaatgagcctggcaa

SEQ ID NO: 1351530 - DNA, 15 bp, Homo sapiens
gaaaagattcttctg

SEQ ID NO: 1351531 - DNA, 15 bp, Homo sapiens
gaaaagcagacattt

SEQ ID NO: 1351532 - DNA, 16 bp, Homo sapiens
gaaaagcatttttcaa

SEQ ID NO: 1351533 - DNA, 21 bp, Homo sapiens
gaaaagcctaatcacagtttt

SEQ ID NO: 1351534 - DNA, 20 bp, Homo sapiens
gaaaagtaatatttattaaa

SEQ ID NO: 1351535 - DNA, 13 bp, Homo sapiens
gaaaatagtttat

SEQ ID NO: 1351536 - DNA, 20 bp, Homo sapiens
gaaaatagtttattttaaaa

SEQ ID NO: 1351537 - DNA, 22 bp, Homo sapiens
gaaaatgaatatctattaatat

SEQ ID NO: 1351538 - DNA, 22 bp, Homo sapiens
gaaaatggtcgagaaagaggca

SEQ ID NO: 1351539 - DNA, 22 bp, Homo sapiens
gaaaatgtctgtaataatagac

SEQ ID NO: 1351540 - DNA, 16 bp, Homo sapiens
gaaaattcttaaaagg

SEQ ID NO: 1351541 - DNA, 12 bp, Homo sapiens
gaaaattgagtt

SEQ ID NO: 1351542 - DNA, 12 bp, Homo sapiens
gaaaattgtatt

SEQ ID NO: 1351543 - DNA, 11 bp, Homo sapiens
gaaacactgcc

SEQ ID NO: 1351544 - DNA, 12 bp, Homo sapiens
gaaacactgcct

SEQ ID NO: 1351545 - DNA, 14 bp, Homo sapiens
gaaacactgccttt

SEQ ID NO: 1351546 - DNA, 17 bp, Homo sapiens
gaaacatctcaataaag

SEQ ID NO: 1351547 - DNA, 16 bp, Homo sapiens
gaaactccacatctgc

SEQ ID NO: 1351548 - DNA, 20 bp, Homo sapiens
gaaactccacatctgcctta

SEQ ID NO: 1351549 - DNA, 17 bp, Homo sapiens
gaaactttgggaaaaca

SEQ ID NO: 1351550 - DNA, 17 bp, Homo sapiens
gaaagccctgagctttc

SEQ ID NO: 1351551 - DNA, 20 bp, Homo sapiens
gaaagcgcggacgtgctggg

SEQ ID NO: 1351552 - DNA, 19 bp, Homo sapiens
gaaagctatataagacaag

SEQ ID NO: 1351553 - DNA, 17 bp, Homo sapiens
gaaagctcactgtagct

SEQ ID NO: 1351554 - DNA, 15 bp, Homo sapiens
gaaaggaggtggggg

SEQ ID NO: 1351555 - DNA, 20 bp, Homo sapiens
gaaaggggagagcctgctgg

SEQ ID NO: 1351556 - DNA, 23 bp, Homo sapiens
gaaaggtgagtttgagctgcctt

SEQ ID NO: 1351557 - DNA, 21 bp, Homo sapiens
gaaagtagggggctttctggg

SEQ ID NO: 1351558 - DNA, 20 bp, Homo sapiens
gaaagtcagccatatctcca

SEQ ID NO: 1351559 - DNA, 18 bp, Homo sapiens
gaaagtgcctttgcagct

SEQ ID NO: 1351560 - DNA, 20 bp, Homo sapiens
gaaagtgcctttgcagctca

SEQ ID NO: 1351561 - DNA, 23 bp, Homo sapiens
gaaagtgcctttgcagctcagaa

SEQ ID NO: 1351562 - DNA, 11 bp, Homo sapiens
gaaagtttttt

SEQ ID NO: 1351563 - DNA, 19 bp, Homo sapiens
gaaataatgctacaatttt

SEQ ID NO: 1351564 - DNA, 21 bp, Homo sapiens
gaaataatgctacaattttaa

SEQ ID NO: 1351565 - DNA, 23 bp, Homo sapiens
gaaataatgctacaattttaaga

SEQ ID NO: 1351566 - DNA, 15 bp, Homo sapiens
gaaataggaaacaag

SEQ ID NO: 1351567 - DNA, 17 bp, Homo sapiens
gaaatataacacatttt

SEQ ID NO: 1351568 - DNA, 19 bp, Homo sapiens
gaatttctgtgccctcctg

SEQ ID NO: 1351569 - DNA, 17 bp, Homo sapiens
gaatttgcatacttacc

SEQ ID NO: 1351570 - DNA, 23 bp, Homo sapiens
gaattttaaaatctgagggaaat

SEQ ID NO: 1351571 - DNA, 22 bp, Homo sapiens
gaattttgcaaagatttaatct

SEQ ID NO: 1351572 - DNA, 14 bp, Homo sapiens
gacaaaagtctgtc

SEQ ID NO: 1351573 - DNA, 16 bp, Homo sapiens
gacaaaatatttccca

SEQ ID NO: 1351574 - DNA, 18 bp, Homo sapiens
gacaaagtgccaaagaaa

SEQ ID NO: 1351575 - DNA, 11 bp, Homo sapiens
gacaaatattc

SEQ ID NO: 1351576 - DNA, 17 bp, Homo sapiens
gacaacgtttcagcgac

SEQ ID NO: 1351577 - DNA, 20 bp, Homo sapiens
gacaagagatgggaatgagg

SEQ ID NO: 1351578 - DNA, 20 bp, Homo sapiens
gacaagctggcttacactgg

SEQ ID NO: 1351579 - DNA, 13 bp, Homo sapiens
gacaataaagctt

SEQ ID NO: 1351580 - DNA, 20 bp, Homo sapiens
gacaatggaccctttttgtt

SEQ ID NO: 1351581 - DNA, 18 bp, Homo sapiens
gacaatgtgaaaagaaaa

SEQ ID NO: 1351582 - DNA, 17 bp, Homo sapiens
gacaatgttgtagtgtc

SEQ ID NO: 1351583 - DNA, 17 bp, Homo sapiens
gacacacacagactatt

SEQ ID NO: 1351584 - DNA, 14 bp, Homo sapiens
gacaccttggacat

SEQ ID NO: 1351585 - DNA, 13 bp, Homo sapiens
gacactgcctggg

SEQ ID NO: 1351586 - DNA, 14 bp, Homo sapiens
gacactgcctgggc

SEQ ID NO: 1351587 - DNA, 18 bp, Homo sapiens
gacagaacttgaatgtgt

SEQ ID NO: 1351588 - DNA, 22 bp, Homo sapiens
gacagatacctccaaccctgcc

SEQ ID NO: 1351589 - DNA, 18 bp, Homo sapiens
gacagccaaaggctggcg

SEQ ID NO: 1351590 - DNA, 18 bp, Homo sapiens
gacagctacacagagctt

SEQ ID NO: 1351591 - DNA, 22 bp, Homo sapiens
gacagcttgagccgggcccctg

SEQ ID NO: 1351592 - DNA, 18 bp, Homo sapiens
gacaggagacctggcact

SEQ ID NO: 1351593 - DNA, 15 bp, Homo sapiens
gacagtatcccacat

SEQ ID NO: 1351594 - DNA, 20 bp, Homo sapiens
gacagtgtatgtagaagcat

SEQ ID NO: 1351595 - DNA, 22 bp, Homo sapiens
gacatactccttccatcaaata

SEQ ID NO: 1351596 - DNA, 18 bp, Homo sapiens
gacatcctcctcccaccc

SEQ ID NO: 1351597 - DNA, 14 bp, Homo sapiens
gacatctggaatct

SEQ ID NO: 1351598 - DNA, 22 bp, Homo sapiens
gacatctggaatctggagacca

SEQ ID NO: 1351599 - DNA, 15 bp, Homo sapiens
gacatgcaataaaat

SEQ ID NO: 1351600 - DNA, 19 bp, Homo sapiens
gacatgcaataaaatttaa

SEQ ID NO: 1351601 - DNA, 16 bp, Homo sapiens
gacatggtgcctgaga

SEQ ID NO: 1351602 - DNA, 23 bp, Homo sapiens
gacatggtgcctgagaggcaggc

SEQ ID NO: 1351603 - DNA, 17 bp, Homo sapiens
gacatgttttccgtgaa

SEQ ID NO: 1351604 - DNA, 19 bp, Homo sapiens
gacattaacaaataaaaaa

SEQ ID NO: 1351605 - DNA, 21 bp, Homo sapiens
gaccacgcccgtcctgcctgt

SEQ ID NO: 1351606 - DNA, 16 bp, Homo sapiens
gaccacttgaggcctg

SEQ ID NO: 1351607 - DNA, 17 bp, Homo sapiens
gaccacttgaggcctga

SEQ ID NO: 1351608 - DNA, 15 bp, Homo sapiens
gaccagaggagcctt

SEQ ID NO: 1351609 - DNA, 18 bp, Homo sapiens
gaccagaggagccttttt

SEQ ID NO: 1351610 - DNA, 12 bp, Homo sapiens
gaccaggatccc

SEQ ID NO: 1351611 - DNA, 21 bp, Homo sapiens
gaccaggatcccaagcctcct

SEQ ID NO: 1351612 - DNA, 16 bp, Homo sapiens
gaccaggcttggcctt

SEQ ID NO: 1351613 - DNA, 19 bp, Homo sapiens
gaccagggccttttctggc

SEQ ID NO: 1351614 - DNA, 14 bp, Homo sapiens
gaccatcctggcta

SEQ ID NO: 1351615 - DNA, 19 bp, Homo sapiens
gaccattttttaatttact

SEQ ID NO: 1351616 - DNA, 20 bp, Homo sapiens
gaccattttttaatttactt

SEQ ID NO: 1351617 - DNA, 23 bp, Homo sapiens
gaccattttttaatttacttgtt

SEQ ID NO: 1351618 - DNA, 21 bp, Homo sapiens
gacccaggaaaggcaggattg

SEQ ID NO: 1351619 - DNA, 12 bp, Homo sapiens
gacccagtgcag

SEQ ID NO: 1351620 - DNA, 13 bp, Homo sapiens
gacccagtgcaga

SEQ ID NO: 1351621 - DNA, 14 bp, Homo sapiens
gacccattgctgtt

SEQ ID NO: 1351622 - DNA, 19 bp, Homo sapiens
gaccccagcaagtggtcct

SEQ ID NO: 1351623 - DNA, 15 bp, Homo sapiens
gaccccagccatcca

SEQ ID NO: 1351624 - DNA, 15 bp, Homo sapiens
gacccccgtggggca

SEQ ID NO: 1351625 - DNA, 18 bp, Homo sapiens
gaccctctaacctcgccc

SEQ ID NO: 1351626 - DNA, 13 bp, Homo sapiens
gaccctcttgccc

SEQ ID NO: 1351627 - DNA, 14 bp, Homo sapiens
gaccctcttgccca

SEQ ID NO: 1351628 - DNA, 11 bp, Homo sapiens
gaccctggggg

SEQ ID NO: 1351629 - DNA, 17 bp, Homo sapiens
gaccctgggggcacagg

SEQ ID NO: 1351630 - DNA, 17 bp, Homo sapiens
gaccctgggtgggctct

SEQ ID NO: 1351631 - DNA, 20 bp, Homo sapiens
gaccctgtgacatggtgcct

SEQ ID NO: 1351632 - DNA, 22 bp, Homo sapiens
gaccctgtgacatggtgcctga

SEQ ID NO: 1351633 - DNA, 17 bp, Homo sapiens
gaccgcccttttcccct

SEQ ID NO: 1351634 - DNA, 20 bp, Homo sapiens
gacctaaatggcctcatgtg

SEQ ID NO: 1351635 - DNA, 17 bp, Homo sapiens
gacctgaggctgtggtc

SEQ ID NO: 1351636 - DNA, 17 bp, Homo sapiens
gacctgtaacttttgta

SEQ ID NO: 1351637 - DNA, 23 bp, Homo sapiens
gacctgtatatttgtaaagctat

SEQ ID NO: 1351638 - DNA, 15 bp, Homo sapiens
gaccttaggccttcc

SEQ ID NO: 1351639 - DNA, 21 bp, Homo sapiens
gaccttaggccttcctctctc

SEQ ID NO: 1351640 - DNA, 16 bp, Homo sapiens
gaccttgtaaaagaca

SEQ ID NO: 1351641 - DNA, 21 bp, Homo sapiens
gacgaacatccaaccttccca

SEQ ID NO: 1351642 - DNA, 18 bp, Homo sapiens
gacgaggggtgtcttggg

SEQ ID NO: 1351643 - DNA, 14 bp, Homo sapiens
gacgccactcattt

SEQ ID NO: 1351644 - DNA, 16 bp, Homo sapiens
gacgccactcatttca

SEQ ID NO: 1351645 - DNA, 18 bp, Homo sapiens
gacgccactcatttcatc

SEQ ID NO: 1351646 - DNA, 16 bp, Homo sapiens
gacgccatgtgatgga

SEQ ID NO: 1351647 - DNA, 19 bp, Homo sapiens
gacggcaggctcactgcca

SEQ ID NO: 1351648 - DNA, 16 bp, Homo sapiens
gacggccaagaatgta

SEQ ID NO: 1351649 - DNA, 23 bp, Homo sapiens
gacggtgcccaagccagaggctg

SEQ ID NO: 1351650 - DNA, 22 bp, Homo sapiens
gacggtttccagggaggggccg

SEQ ID NO: 1351651 - DNA, 16 bp, Homo sapiens
gacgtacaagtagttc

SEQ ID NO: 1351652 - DNA, 22 bp, Homo sapiens
gacgtacaagtagttctgtatt

SEQ ID NO: 1351653 - DNA, 19 bp, Homo sapiens
gacgtttataaacagaaat

SEQ ID NO: 1351654 - DNA, 16 bp, Homo sapiens
gactaagagaagttgt

SEQ ID NO: 1351655 - DNA, 23 bp, Homo sapiens
gactaagagaagttgtaaagtat

SEQ ID NO: 1351656 - DNA, 18 bp, Homo sapiens
gactaattttacatgttt

SEQ ID NO: 1351657 - DNA, 20 bp, Homo sapiens
gactatatatataaatgtat

SEQ ID NO: 1351658 - DNA, 15 bp, Homo sapiens
gactcagccttcaga

SEQ ID NO: 1351659 - DNA, 14 bp, Homo sapiens
gactcagtgcagat

SEQ ID NO: 1351660 - DNA, 20 bp, Homo sapiens
gactcagtgcagatggagag

SEQ ID NO: 1351661 - DNA, 22 bp, Homo sapiens
gactcatcaatcaaataagtat

SEQ ID NO: 1351662 - DNA, 16 bp, Homo sapiens
gactcatcttatatgg

SEQ ID NO: 1351663 - DNA, 15 bp, Homo sapiens
gactccagccagcgc

SEQ ID NO: 1351664 - DNA, 20 bp, Homo sapiens
gactccagccagcgcctccc

SEQ ID NO: 1351665 - DNA, 21 bp, Homo sapiens
gactccagccagcgcctccct

SEQ ID NO: 1351666 - DNA, 23 bp, Homo sapiens
gactccagccagcgcctccctcc

SEQ ID NO: 1351667 - DNA, 17 bp, Homo sapiens
gactccgttggccactc

SEQ ID NO: 1351668 - DNA, 16 bp, Homo sapiens
gactcgactctgtgcc

SEQ ID NO: 1351669 - DNA, 14 bp, Homo sapiens
gactctgggtcctt

SEQ ID NO: 1351670 - DNA, 15 bp, Homo sapiens
gactgaaaatattgt

SEQ ID NO: 1351671 - DNA, 19 bp, Homo sapiens
gactgaaaatattgtttta

SEQ ID NO: 1351672 - DNA, 15 bp, Homo sapiens
gactgaaagtagggg

SEQ ID NO: 1351673 - DNA, 14 bp, Homo sapiens
gactgagtgggaag

SEQ ID NO: 1351674 - DNA, 22 bp, Homo sapiens
gactgagtgggaagcccatcct

SEQ ID NO: 1351675 - DNA, 21 bp, Homo sapiens
gactggcttttattaatgcac

SEQ ID NO: 1351676 - DNA, 22 bp, Homo sapiens
gactggcttttattaatgcact

SEQ ID NO: 1351677 - DNA, 16 bp, Homo sapiens
gactggtaagtaactg

SEQ ID NO: 1351678 - DNA, 22 bp, Homo sapiens
gactgtagggagggcggcaggg

SEQ ID NO: 1351679 - DNA, 21 bp, Homo sapiens
gactgtggcacttgcctgggt

SEQ ID NO: 1351680 - DNA, 18 bp, Homo sapiens
gactgttttctcttgaga

SEQ ID NO: 1351681 - DNA, 17 bp, Homo sapiens
gacttaacatagccaaa

SEQ ID NO: 1351682 - DNA, 19 bp, Homo sapiens
gacttccccggagggctgc

SEQ ID NO: 1351683 - DNA, 17 bp, Homo sapiens
gacttctgcctggagac

SEQ ID NO: 1351684 - DNA, 21 bp, Homo sapiens
gacttgccagagccgggcaca

SEQ ID NO: 1351685 - DNA, 22 bp, Homo sapiens
gacttgtatagcatgaaataaa

SEQ ID NO: 1351686 - DNA, 12 bp, Homo sapiens
gactttctgcct

SEQ ID NO: 1351687 - DNA, 16 bp, Homo sapiens
gactttctgcctggag

SEQ ID NO: 1351688 - DNA, 22 bp, Homo sapiens
gactttgatgtcagcagttgct

SEQ ID NO: 1351689 - DNA, 13 bp, Homo sapiens
gacttttctgcaa

SEQ ID NO: 1351690 - DNA, 14 bp, Homo sapiens
gacttttctgcaaa

SEQ ID NO: 1351691 - DNA, 23 bp, Homo sapiens
gacttttctgtccgagctttgaa

SEQ ID NO: 1351692 - DNA, 11 bp, Homo sapiens
gagaaatgaaa

SEQ ID NO: 1351693 - DNA, 13 bp, Homo sapiens
gagaaatgaaaac

SEQ ID NO: 1351694 - DNA, 14 bp, Homo sapiens
gagaactctggctt

SEQ ID NO: 1351695 - DNA, 16 bp, Homo sapiens
gagaagcagaggaagg

SEQ ID NO: 1351696 - DNA, 13 bp, Homo sapiens
gagaagccttcag

SEQ ID NO: 1351697 - DNA, 14 bp, Homo sapiens
gagaagccttcagc

SEQ ID NO: 1351698 - DNA, 13 bp, Homo sapiens
gagaagctgcagg

SEQ ID NO: 1351699 - DNA, 13 bp, Homo sapiens
gagaaggtttatt

SEQ ID NO: 1351700 - DNA, 20 bp, Homo sapiens
gagacactgttgataaaaac

SEQ ID NO: 1351701 - DNA, 12 bp, Homo sapiens
gagaccatcctg

SEQ ID NO: 1351702 - DNA, 14 bp, Homo sapiens
gagaccatcctggc

SEQ ID NO: 1351703 - DNA, 20 bp, Homo sapiens
gagaccgtgaagatactttg

SEQ ID NO: 1351704 - DNA, 22 bp, Homo sapiens
gagaccgtgaagatactttgta

SEQ ID NO: 1351705 - DNA, 19 bp, Homo sapiens
gagacggtttccagggagg

SEQ ID NO: 1351706 - DNA, 13 bp, Homo sapiens
gagactcagtgca

SEQ ID NO: 1351707 - DNA, 17 bp, Homo sapiens
gagactcgactctgtgc

SEQ ID NO: 1351708 - DNA, 12 bp, Homo sapiens
gagactgtgctg

SEQ ID NO: 1351709 - DNA, 13 bp, Homo sapiens
gagactgtgctgt

SEQ ID NO: 1351710 - DNA, 10 bp, Homo sapiens
gagactttga

SEQ ID NO: 1351711 - DNA, 22 bp, Homo sapiens
gagagaaagtgtgagcaaacta

SEQ ID NO: 1351712 - DNA, 13 bp, Homo sapiens
gagagagagagga

SEQ ID NO: 1351713 - DNA, 12 bp, Homo sapiens
gagagagaggac

SEQ ID NO: 1351714 - DNA, 17 bp, Homo sapiens
gagagaggttgaaaaac

SEQ ID NO: 1351715 - DNA, 18 bp, Homo sapiens
gagagcatcggcctaggg

SEQ ID NO: 1351716 - DNA, 17 bp, Homo sapiens
gagagcctggtgctgct

SEQ ID NO: 1351717 - DNA, 21 bp, Homo sapiens
gagagctagcagcagggaggg

SEQ ID NO: 1351718 - DNA, 18 bp, Homo sapiens
gagaggaaattctccact

SEQ ID NO: 1351719 - DNA, 10 bp, Homo sapiens
gagaggacag

SEQ ID NO: 1351720 - DNA, 18 bp, Homo sapiens
gagaggacagcttgagcc

SEQ ID NO: 1351721 - DNA, 14 bp, Homo sapiens
gagaggcaatgatt

SEQ ID NO: 1351722 - DNA, 11 bp, Homo sapiens
gagaggcaggc

SEQ ID NO: 1351723 - DNA, 12 bp, Homo sapiens
gagaggcaggca

SEQ ID NO: 1351724 - DNA, 13 bp, Homo sapiens
gagaggggcacag

SEQ ID NO: 1351725 - DNA, 22 bp, Homo sapiens
gagaggtgggccagtctgtgga

SEQ ID NO: 1351726 - DNA, 13 bp, Homo sapiens
gagagtctggccc

SEQ ID NO: 1351727 - DNA, 14 bp, Homo sapiens
gagagtctggccct

SEQ ID NO: 1351728 - DNA, 15 bp, Homo sapiens
gagagtctggcccta

SEQ ID NO: 1351729 - DNA, 16 bp, Homo sapiens
gagatcagcctgggca

SEQ ID NO: 1351730 - DNA, 13 bp, Homo sapiens
gagatcctcctgc

SEQ ID NO: 1351731 - DNA, 17 bp, Homo sapiens
gagatcctcctgcagac

SEQ ID NO: 1351732 - DNA, 18 bp, Homo sapiens
gagatcgagaccatcctg

SEQ ID NO: 1351733 - DNA, 22 bp, Homo sapiens
gagatcgagaccatcctggcta

SEQ ID NO: 1351734 - DNA, 20 bp, Homo sapiens
gagatcgcgccactgcactc

SEQ ID NO: 1351735 - DNA, 21 bp, Homo sapiens
gagatcgtgctactgcactcc

SEQ ID NO: 1351736 - DNA, 20 bp, Homo sapiens
gagatgggaatgaggtggga

SEQ ID NO: 1351737 - DNA, 14 bp, Homo sapiens
gagcactgggctcc

SEQ ID NO: 1351738 - DNA, 15 bp, Homo sapiens
gagcatgtcgtggac

SEQ ID NO: 1351739 - DNA, 12 bp, Homo sapiens
gagccacctcac

SEQ ID NO: 1351740 - DNA, 13 bp, Homo sapiens
gagccagctccct

SEQ ID NO: 1351741 - DNA, 20 bp, Homo sapiens
gagccagcttggggccacca

SEQ ID NO: 1351742 - DNA, 22 bp, Homo sapiens
gagccatggaccacgcaggaag

SEQ ID NO: 1351743 - DNA, 19 bp, Homo sapiens
gagccctactccctgcaga

SEQ ID NO: 1351744 - DNA, 22 bp, Homo sapiens
gagccctactccctgcagatgc

SEQ ID NO: 1351745 - DNA, 15 bp, Homo sapiens
gagcccttgcctccc

SEQ ID NO: 1351746 - DNA, 21 bp, Homo sapiens
gagccgggcacattgagctgt

SEQ ID NO: 1351747 - DNA, 18 bp, Homo sapiens
gagccggtaactgtcctg

SEQ ID NO: 1351748 - DNA, 14 bp, Homo sapiens
gagcctcactgggg

SEQ ID NO: 1351749 - DNA, 23 bp, Homo sapiens
gagcctcactggggcagacaata

SEQ ID NO: 1351750 - DNA, 16 bp, Homo sapiens
gagcctctgctcccca

SEQ ID NO: 1351751 - DNA, 11 bp, Homo sapiens
gagcctgctgg

SEQ ID NO: 1351752 - DNA, 16 bp, Homo sapiens
gagcctggtgctgctg

SEQ ID NO: 1351753 - DNA, 18 bp, Homo sapiens
gagcctttggttctggcc

SEQ ID NO: 1351754 - DNA, 15 bp, Homo sapiens
gagctagcagcaggg

SEQ ID NO: 1351755 - DNA, 16 bp, Homo sapiens
gagctccactctgctt

SEQ ID NO: 1351756 - DNA, 12 bp, Homo sapiens
gagctcttccta

SEQ ID NO: 1351757 - DNA, 15 bp, Homo sapiens
gagctgagtggggga

SEQ ID NO: 1351758 - DNA, 21 bp, Homo sapiens
gagctgccttggctcagacat

SEQ ID NO: 1351759 - DNA, 22 bp, Homo sapiens
gagctgccttggctcagacatg

SEQ ID NO: 1351760 - DNA, 22 bp, Homo sapiens
gagctggctctgagcgcctcca

SEQ ID NO: 1351761 - DNA, 13 bp, Homo sapiens
gagctgggcccga

SEQ ID NO: 1351762 - DNA, 19 bp, Homo sapiens
gagctgggcccgacatggc

SEQ ID NO: 1351763 - DNA, 23 bp, Homo sapiens
gagctgggcccgacatggctccg

SEQ ID NO: 1351764 - DNA, 20 bp, Homo sapiens
gaggaaatcaaagtgctatt

SEQ ID NO: 1351765 - DNA, 17 bp, Homo sapiens
gaggaaattctccactg

SEQ ID NO: 1351766 - DNA, 15 bp, Homo sapiens
gaggaatcctggcag

SEQ ID NO: 1351767 - DNA, 19 bp, Homo sapiens
gaggaatcctggcagccca

SEQ ID NO: 1351768 - DNA, 18 bp, Homo sapiens
gaggacagcttgagccgg

SEQ ID NO: 1351769 - DNA, 11 bp, Homo sapiens
gaggagccttt

SEQ ID NO: 1351770 - DNA, 15 bp, Homo sapiens
gaggagggtggggga

SEQ ID NO: 1351771 - DNA, 17 bp, Homo sapiens
gaggagggtgggggagg

SEQ ID NO: 1351772 - DNA, 17 bp, Homo sapiens
gaggatgctaaaaatgt

SEQ ID NO: 1351773 - DNA, 20 bp, Homo sapiens
gaggcaaagctggctcacct

SEQ ID NO: 1351774 - DNA, 13 bp, Homo sapiens
gaggcaccaggaa

SEQ ID NO: 1351775 - DNA, 16 bp, Homo sapiens
gaggcaggcatggccc

SEQ ID NO: 1351776 - DNA, 17 bp, Homo sapiens
gaggcagggaggcagcc

SEQ ID NO: 1351777 - DNA, 18 bp, Homo sapiens
gaggcagggaggcagccg

SEQ ID NO: 1351778 - DNA, 15 bp, Homo sapiens
gaggcaggtgagaga

SEQ ID NO: 1351779 - DNA, 16 bp, Homo sapiens
gaggcagtttgaggat

SEQ ID NO: 1351780 - DNA, 18 bp, Homo sapiens
gaggccaagaatattgca

SEQ ID NO: 1351781 - DNA, 22 bp, Homo sapiens
gaggccaaggtgggaggattgc

SEQ ID NO: 1351782 - DNA, 14 bp, Homo sapiens
gaggccatgtgcat

SEQ ID NO: 1351783 - DNA, 21 bp, Homo sapiens
gaggccatgtgcatagtttct

SEQ ID NO: 1351784 - DNA, 20 bp, Homo sapiens
gaggcccccagcccagggct

SEQ ID NO: 1351785 - DNA, 16 bp, Homo sapiens
gaggccctttgctgtc

SEQ ID NO: 1351786 - DNA, 22 bp, Homo sapiens
gaggcctgatctgcccatcgtg

SEQ ID NO: 1351787 - DNA, 16 bp, Homo sapiens
gaggcctgcgaccctg

SEQ ID NO: 1351788 - DNA, 20 bp, Homo sapiens
gaggcctgggccgctgccac

SEQ ID NO: 1351789 - DNA, 22 bp, Homo sapiens
gaggcctgggccgctgccacgt

SEQ ID NO: 1351790 - DNA, 14 bp, Homo sapiens
gaggcgcggagtga

SEQ ID NO: 1351791 - DNA, 15 bp, Homo sapiens
gaggcttctccgcca

SEQ ID NO: 1351792 - DNA, 21 bp, Homo sapiens
gaggcttctccgccagcctcc

SEQ ID NO: 1351793 - DNA, 22 bp, Homo sapiens
gagggagagagagagagagagg

SEQ ID NO: 1351794 - DNA, 17 bp, Homo sapiens
gagggaggccccagggg

SEQ ID NO: 1351795 - DNA, 14 bp, Homo sapiens
gagggcagctgcta

SEQ ID NO: 1351796 - DNA, 19 bp, Homo sapiens
gagggcttcctctagaagc

SEQ ID NO: 1351797 - DNA, 12 bp, Homo sapiens
gaggggagggta

SEQ ID NO: 1351798 - DNA, 17 bp, Homo sapiens
gaggggccggccctgtg

SEQ ID NO: 1351799 - DNA, 21 bp, Homo sapiens
gaggggccggccctgtgtgca

SEQ ID NO: 1351800 - DNA, 18 bp, Homo sapiens
gaggggtgtggcagtggt

SEQ ID NO: 1351801 - DNA, 14 bp, Homo sapiens
gagggtgggggagg

SEQ ID NO: 1351802 - DNA, 17 bp, Homo sapiens
gagggtgggggagggag

SEQ ID NO: 1351803 - DNA, 13 bp, Homo sapiens
gaggtaccctggg

SEQ ID NO: 1351804 - DNA, 14 bp, Homo sapiens
gaggtattaaaact

SEQ ID NO: 1351805 - DNA, 18 bp, Homo sapiens
gaggtcactggaaagggg

SEQ ID NO: 1351806 - DNA, 16 bp, Homo sapiens
gaggtggaagaaggga

SEQ ID NO: 1351807 - DNA, 18 bp, Homo sapiens
gaggtggaagaagggaga

SEQ ID NO: 1351808 - DNA, 19 bp, Homo sapiens
gaggtggaggctgcagtga

SEQ ID NO: 1351809 - DNA, 16 bp, Homo sapiens
gaggtggagggaggga

SEQ ID NO: 1351810 - DNA, 15 bp, Homo sapiens
gaggtgggaggtgga

SEQ ID NO: 1351811 - DNA, 18 bp, Homo sapiens
gaggttgaaaaacaaaat

SEQ ID NO: 1351812 - DNA, 15 bp, Homo sapiens
gaggttgaagccaag

SEQ ID NO: 1351813 - DNA, 21 bp, Homo sapiens
gaggttttatttcatttttca

SEQ ID NO: 1351814 - DNA, 20 bp, Homo sapiens
gagtattctaataagctagt

SEQ ID NO: 1351815 - DNA, 21 bp, Homo sapiens
gagtattctcggatagttgct

SEQ ID NO: 1351816 - DNA, 15 bp, Homo sapiens
gagtccattctccca

SEQ ID NO: 1351817 - DNA, 18 bp, Homo sapiens
gagtccattctcccaggt

SEQ ID NO: 1351818 - DNA, 18 bp, Homo sapiens
gagtcgtggggtgtgctg

SEQ ID NO: 1351819 - DNA, 18 bp, Homo sapiens
gagtctaatagtctttgc

SEQ ID NO: 1351820 - DNA, 20 bp, Homo sapiens
gagtctgagggcttgtagtt

SEQ ID NO: 1351821 - DNA, 16 bp, Homo sapiens
gagtggcaggggacag

SEQ ID NO: 1351822 - DNA, 19 bp, Homo sapiens
gagtggcaggggacaggag

SEQ ID NO: 1351823 - DNA, 23 bp, Homo sapiens
gagtggcaggggacaggagtcca

SEQ ID NO: 1351824 - DNA, 13 bp, Homo sapiens
gagtgggaagccc

SEQ ID NO: 1351825 - DNA, 13 bp, Homo sapiens
gagtgggtgaata

SEQ ID NO: 1351826 - DNA, 17 bp, Homo sapiens
gagtgtagactgtggct

SEQ ID NO: 1351827 - DNA, 20 bp, Homo sapiens
gagtgtgcctgaagtcccag

SEQ ID NO: 1351828 - DNA, 17 bp, Homo sapiens
gagttgattcagctctg

SEQ ID NO: 1351829 - DNA, 18 bp, Homo sapiens
gagttgattcagctctgc

SEQ ID NO: 1351830 - DNA, 14 bp, Homo sapiens
gagttgtttttgta

SEQ ID NO: 1351831 - DNA, 17 bp, Homo sapiens
gataaagaaaaaaatac

SEQ ID NO: 1351832 - DNA, 18 bp, Homo sapiens
gataaagaaaaaaatact

SEQ ID NO: 1351833 - DNA, 15 bp, Homo sapiens
gataatattgtttgg

SEQ ID NO: 1351834 - DNA, 15 bp, Homo sapiens
gataatttcagggtg

SEQ ID NO: 1351835 - DNA, 17 bp, Homo sapiens
gatactgcgactttctg

SEQ ID NO: 1351836 - DNA, 18 bp, Homo sapiens
gatactgcgactttctgc

SEQ ID NO: 1351837 - DNA, 21 bp, Homo sapiens
gatactgcgactttctgcctg

SEQ ID NO: 1351838 - DNA, 21 bp, Homo sapiens
gatagacgagttgatttcctc

SEQ ID NO: 1351839 - DNA, 15 bp, Homo sapiens
gatagcattgtaagc

SEQ ID NO: 1351840 - DNA, 20 bp, Homo sapiens
gatagctaactgtaaatcat

SEQ ID NO: 1351841 - DNA, 13 bp, Homo sapiens
gatagtaagcata

SEQ ID NO: 1351842 - DNA, 17 bp, Homo sapiens
gatagtgggatttccag

SEQ ID NO: 1351843 - DNA, 21 bp, Homo sapiens
gatataaatttttaagagaaa

SEQ ID NO: 1351844 - DNA, 23 bp, Homo sapiens
gatatcgacttgtttttgcacat

SEQ ID NO: 1351845 - DNA, 13 bp, Homo sapiens
gatattgaatgtt

SEQ ID NO: 1351846 - DNA, 18 bp, Homo sapiens
gatatttttcataaacaa

SEQ ID NO: 1351847 - DNA, 16 bp, Homo sapiens
gatcacaaatgacttt

SEQ ID NO: 1351848 - DNA, 14 bp, Homo sapiens
gatcacagcctctg

SEQ ID NO: 1351849 - DNA, 18 bp, Homo sapiens
gatcactgtttagatttg

SEQ ID NO: 1351850 - DNA, 12 bp, Homo sapiens
gatcagcctggg

SEQ ID NO: 1351851 - DNA, 22 bp, Homo sapiens
gatcatagttttatttatattt

SEQ ID NO: 1351852 - DNA, 15 bp, Homo sapiens
gatcatgtacttttt

SEQ ID NO: 1351853 - DNA, 12 bp, Homo sapiens
gatccaaagact

SEQ ID NO: 1351854 - DNA, 16 bp, Homo sapiens
gatccacccaacccta

SEQ ID NO: 1351855 - DNA, 16 bp, Homo sapiens
gatccccgcctggcca

SEQ ID NO: 1351856 - DNA, 17 bp, Homo sapiens
gatccccgcctggccag

SEQ ID NO: 1351857 - DNA, 19 bp, Homo sapiens
gatccccgcctggccagga

SEQ ID NO: 1351858 - DNA, 16 bp, Homo sapiens
gatcccgttttcccca

SEQ ID NO: 1351859 - DNA, 18 bp, Homo sapiens
gatcctaggcatttgctg

SEQ ID NO: 1351860 - DNA, 15 bp, Homo sapiens
gatcctcctgcagac

SEQ ID NO: 1351861 - DNA, 22 bp, Homo sapiens
gatcctcctgcagaccacgccc

SEQ ID NO: 1351862 - DNA, 16 bp, Homo sapiens
gatcctctcacctcag

SEQ ID NO: 1351863 - DNA, 19 bp, Homo sapiens
gatcctctcacctcagcct

SEQ ID NO: 1351864 - DNA, 19 bp, Homo sapiens
gatcctgggggcctgggtt

SEQ ID NO: 1351865 - DNA, 21 bp, Homo sapiens
gatccttagaggtcctctgga

SEQ ID NO: 1351866 - DNA, 17 bp, Homo sapiens
gatcgagaccatcctgg

SEQ ID NO: 1351867 - DNA, 18 bp, Homo sapiens
gatcgagaccatcctggc

SEQ ID NO: 1351868 - DNA, 22 bp, Homo sapiens
gatcgtgctactgcactccagc

SEQ ID NO: 1351869 - DNA, 23 bp, Homo sapiens
gatctacatgaggaactgtagat

SEQ ID NO: 1351870 - DNA, 16 bp, Homo sapiens
gatctcagctttgaga

SEQ ID NO: 1351871 - DNA, 11 bp, Homo sapiens
gatctccagcg

SEQ ID NO: 1351872 - DNA, 20 bp, Homo sapiens
gatctcggtttgccaaaatt

SEQ ID NO: 1351873 - DNA, 12 bp, Homo sapiens
gatctcttgagc

SEQ ID NO: 1351874 - DNA, 16 bp, Homo sapiens
gatctcttgagcctgg

SEQ ID NO: 1351875 - DNA, 11 bp, Homo sapiens
gatctgcccat

SEQ ID NO: 1351876 - DNA, 18 bp, Homo sapiens
gatctgctgcagagcagt

SEQ ID NO: 1351877 - DNA, 14 bp, Homo sapiens
gatgatcctaggca

SEQ ID NO: 1351878 - DNA, 14 bp, Homo sapiens
gatgatttaagtgt

SEQ ID NO: 1351879 - DNA, 14 bp, Homo sapiens
gatgcatgtctttt

SEQ ID NO: 1351880 - DNA, 16 bp, Homo sapiens
gatgcatgtcttttaa

SEQ ID NO: 1351881 - DNA, 14 bp, Homo sapiens
gatggacactccag

SEQ ID NO: 1351882 - DNA, 17 bp, Homo sapiens
gatggccttaatttcct

SEQ ID NO: 1351883 - DNA, 18 bp, Homo sapiens
gatggccttaatttcctt

SEQ ID NO: 1351884 - DNA, 23 bp, Homo sapiens
gatgggaatgaggtgggaggtgg

SEQ ID NO: 1351885 - DNA, 18 bp, Homo sapiens
gatgggggtttcaccata

SEQ ID NO: 1351886 - DNA, 14 bp, Homo sapiens
gatggtttcttgca

SEQ ID NO: 1351887 - DNA, 19 bp, Homo sapiens
gatgtctttttattaaaat

SEQ ID NO: 1351888 - DNA, 15 bp, Homo sapiens
gatgttgccatgtgt

SEQ ID NO: 1351889 - DNA, 22 bp, Homo sapiens
gatgtttaaaacaccttctata

SEQ ID NO: 1351890 - DNA, 13 bp, Homo sapiens
gattaaatacata

SEQ ID NO: 1351891 - DNA, 19 bp, Homo sapiens
gattaaatacatatggatg

SEQ ID NO: 1351892 - DNA, 19 bp, Homo sapiens
gattaaccacttcagctga

SEQ ID NO: 1351893 - DNA, 14 bp, Homo sapiens
gattagtttagaac

SEQ ID NO: 1351894 - DNA, 15 bp, Homo sapiens
gattagtttagaaca

SEQ ID NO: 1351895 - DNA, 17 bp, Homo sapiens
gattatggttttgtgat

SEQ ID NO: 1351896 - DNA, 20 bp, Homo sapiens
gattattagccaggtaatgt

SEQ ID NO: 1351897 - DNA, 16 bp, Homo sapiens
gattccttttttcaaa

SEQ ID NO: 1351898 - DNA, 16 bp, Homo sapiens
gattcggtatcccccc

SEQ ID NO: 1351899 - DNA, 13 bp, Homo sapiens
gattctaaataca

SEQ ID NO: 1351900 - DNA, 23 bp, Homo sapiens
gattctaccacacagcagcagtt

SEQ ID NO: 1351901 - DNA, 17 bp, Homo sapiens
gattctggttccagggt

SEQ ID NO: 1351902 - DNA, 22 bp, Homo sapiens
gattctggttccagggtccctc

SEQ ID NO: 1351903 - DNA, 18 bp, Homo sapiens
gattgaaaatgtccagga

SEQ ID NO: 1351904 - DNA, 19 bp, Homo sapiens
gattgaaaatgtccaggaa

SEQ ID NO: 1351905 - DNA, 20 bp, Homo sapiens
gattgaaaatgtccaggaaa

SEQ ID NO: 1351906 - DNA, 23 bp, Homo sapiens
gattgactaactcaaatacacat

SEQ ID NO: 1351907 - DNA, 23 bp, Homo sapiens
gattgcaccactgcactccagcc

SEQ ID NO: 1351908 - DNA, 13 bp, Homo sapiens
gattgcctctgaa

SEQ ID NO: 1351909 - DNA, 14 bp, Homo sapiens
gattggaccaggcc

SEQ ID NO: 1351910 - DNA, 13 bp, Homo sapiens
gattgttcatcat

SEQ ID NO: 1351911 - DNA, 13 bp, Homo sapiens
gatttaaggtatt

SEQ ID NO: 1351912 - DNA, 19 bp, Homo sapiens
gatttaatctgccaagggc

SEQ ID NO: 1351913 - DNA, 19 bp, Homo sapiens
gatttccagaaccacactt

SEQ ID NO: 1351914 - DNA, 16 bp, Homo sapiens
gatttctcattgactt

SEQ ID NO: 1351915 - DNA, 15 bp, Homo sapiens
gatttgaaaaatata

SEQ ID NO: 1351916 - DNA, 16 bp, Homo sapiens
gatttgaaaaatataa

SEQ ID NO: 1351917 - DNA, 21 bp, Homo sapiens
gatttgaaaaatataaaatta

SEQ ID NO: 1351918 - DNA, 20 bp, Homo sapiens
gattttaacttaactgaaat

SEQ ID NO: 1351919 - DNA, 23 bp, Homo sapiens
gattttctattatggaaaactgt

SEQ ID NO: 1351920 - DNA, 17 bp, Homo sapiens
gattttcttttgccttt

SEQ ID NO: 1351921 - DNA, 21 bp, Homo sapiens
gatttttaaaaaatattttct

SEQ ID NO: 1351922 - DNA, 16 bp, Homo sapiens
gatttttactgtgttt

SEQ ID NO: 1351923 - DNA, 20 bp, Homo sapiens
gatttttgcaataccaagta

SEQ ID NO: 1351924 - DNA, 18 bp, Homo sapiens
gattttttaattgtttaa

SEQ ID NO: 1351925 - DNA, 17 bp, Homo sapiens
gcaaaaccttttactgg

SEQ ID NO: 1351926 - DNA, 15 bp, Homo sapiens
gcaaaagatgcttct

SEQ ID NO: 1351927 - DNA, 22 bp, Homo sapiens
gcaaaagatgcttctcactgcc

SEQ ID NO: 1351928 - DNA, 21 bp, Homo sapiens
gcaaaataaaacatagcaaat

SEQ ID NO: 1351929 - DNA, 17 bp, Homo sapiens
gcaaaatacatgaagct

SEQ ID NO: 1351930 - DNA, 13 bp, Homo sapiens
gcaaatcagaaac

SEQ ID NO: 1351931 - DNA, 22 bp, Homo sapiens
gcaacaacaattggtaaaactc

SEQ ID NO: 1351932 - DNA, 22 bp, Homo sapiens
gcaacaagaccaccacttcgaa

SEQ ID NO: 1351933 - DNA, 14 bp, Homo sapiens
gcaacacagcctgg

SEQ ID NO: 1351934 - DNA, 14 bp, Homo sapiens
gcaacattcattgc

SEQ ID NO: 1351935 - DNA, 14 bp, Homo sapiens
gcaacctacccagc

SEQ ID NO: 1351936 - DNA, 16 bp, Homo sapiens
gcaacgatcacaaatg

SEQ ID NO: 1351937 - DNA, 22 bp, Homo sapiens
gcaacgatcacaaatgacttta

SEQ ID NO: 1351938 - DNA, 14 bp, Homo sapiens
gcaactcatcttag

SEQ ID NO: 1351939 - DNA, 18 bp, Homo sapiens
gcaacttcttctccatcc

SEQ ID NO: 1351940 - DNA, 17 bp, Homo sapiens
gcaagaattgaagcagg

SEQ ID NO: 1351941 - DNA, 23 bp, Homo sapiens
gcaagagggggtggaggggtgtg

SEQ ID NO: 1351942 - DNA, 17 bp, Homo sapiens
gcaagatgtgaattatt

SEQ ID NO: 1351943 - DNA, 12 bp, Homo sapiens
gcaagcagagga

SEQ ID NO: 1351944 - DNA, 16 bp, Homo sapiens
gcaagcagaggaccag

SEQ ID NO: 1351945 - DNA, 11 bp, Homo sapiens
gcaagcatgct

SEQ ID NO: 1351946 - DNA, 21 bp, Homo sapiens
gcaagccaggctcactcacag

SEQ ID NO: 1351947 - DNA, 15 bp, Homo sapiens
gcaagctccgcagga

SEQ ID NO: 1351948 - DNA, 20 bp, Homo sapiens
gcaaggcctggtgtttcttg

SEQ ID NO: 1351949 - DNA, 13 bp, Homo sapiens
gcaagtgtgaata

SEQ ID NO: 1351950 - DNA, 16 bp, Homo sapiens
gcaagtgtgaatactg

SEQ ID NO: 1351951 - DNA, 16 bp, Homo sapiens
gcaataacagctgcaa

SEQ ID NO: 1351952 - DNA, 10 bp, Homo sapiens
gcaatagaaa

SEQ ID NO: 1351953 - DNA, 14 bp, Homo sapiens
gcaatatttgaatt

SEQ ID NO: 1351954 - DNA, 14 bp, Homo sapiens
gcacaagctgcacc

SEQ ID NO: 1351955 - DNA, 19 bp, Homo sapiens
gcacagcttgacctgaggc

SEQ ID NO: 1351956 - DNA, 20 bp, Homo sapiens
gcacaggaggcaggcatggc

SEQ ID NO: 1351957 - DNA, 23 bp, Homo sapiens
gcacatatggaattttgcaaaga

SEQ ID NO: 1351958 - DNA, 19 bp, Homo sapiens
gcaccactgcactccagcc

SEQ ID NO: 1351959 - DNA, 15 bp, Homo sapiens
gcaccagcagcctgg

SEQ ID NO: 1351960 - DNA, 13 bp, Homo sapiens
gcaccaggaagcc

SEQ ID NO: 1351961 - DNA, 18 bp, Homo sapiens
gcaccaggaagccgtcct

SEQ ID NO: 1351962 - DNA, 12 bp, Homo sapiens
gcaccataactt

SEQ ID NO: 1351963 - DNA, 17 bp, Homo sapiens
gcaccattctgactcgg

SEQ ID NO: 1351964 - DNA, 18 bp, Homo sapiens
gcacccaccgtggaggag

SEQ ID NO: 1351965 - DNA, 13 bp, Homo sapiens
gcaccccttctct

SEQ ID NO: 1351966 - DNA, 16 bp, Homo sapiens
gcaccctcaggcaggt

SEQ ID NO: 1351967 - DNA, 15 bp, Homo sapiens
gcacctcagcctgca

SEQ ID NO: 1351968 - DNA, 18 bp, Homo sapiens
gcacctggcatcgcacca

SEQ ID NO: 1351969 - DNA, 17 bp, Homo sapiens
gcacctgtagtcccagc

SEQ ID NO: 1351970 - DNA, 18 bp, Homo sapiens
gcacctgtagtcccagct

SEQ ID NO: 1351971 - DNA, 18 bp, Homo sapiens
gcaccttgtgcctggggt

SEQ ID NO: 1351972 - DNA, 23 bp, Homo sapiens
gcacgcggattaatttgcatctg

SEQ ID NO: 1351973 - DNA, 13 bp, Homo sapiens
gcacgggtggtcc

SEQ ID NO: 1351974 - DNA, 14 bp, Homo sapiens
gcacgggtggtccc

SEQ ID NO: 1351975 - DNA, 15 bp, Homo sapiens
gcacgggtggtcccc

SEQ ID NO: 1351976 - DNA, 17 bp, Homo sapiens
gcactacaccttgcctt

SEQ ID NO: 1351977 - DNA, 14 bp, Homo sapiens
gcactccagcctgg

SEQ ID NO: 1351978 - DNA, 15 bp, Homo sapiens
gcactccagcctggg

SEQ ID NO: 1351979 - DNA, 19 bp, Homo sapiens
gcactccagcctgggggac

SEQ ID NO: 1351980 - DNA, 16 bp, Homo sapiens
gcactcttaagcttcc

SEQ ID NO: 1351981 - DNA, 15 bp, Homo sapiens
gcactggcgaggaga

SEQ ID NO: 1351982 - DNA, 13 bp, Homo sapiens
gcacttaaagaag

SEQ ID NO: 1351983 - DNA, 14 bp, Homo sapiens
gcacttaaagaagt

SEQ ID NO: 1351984 - DNA, 17 bp, Homo sapiens
gcacttattgaatatat

SEQ ID NO: 1351985 - DNA, 20 bp, Homo sapiens
gcacttattgaatatatgat

SEQ ID NO: 1351986 - DNA, 19 bp, Homo sapiens
gcacttattgaccattttt

SEQ ID NO: 1351987 - DNA, 15 bp, Homo sapiens
gcacttcatgtaaag

SEQ ID NO: 1351988 - DNA, 18 bp, Homo sapiens
gcacttgcctgggtcaca

SEQ ID NO: 1351989 - DNA, 20 bp, Homo sapiens
gcacttgtgattatttatta

SEQ ID NO: 1351990 - DNA, 22 bp, Homo sapiens
gcagaaaatcttttactagtgt

SEQ ID NO: 1351991 - DNA, 22 bp, Homo sapiens
gcagaacgaaccttggcctggg

SEQ ID NO: 1351992 - DNA, 19 bp, Homo sapiens
gcagaatgtaagtgggccc

SEQ ID NO: 1351993 - DNA, 22 bp, Homo sapiens
gcagaatgtaagtgggcccacc

SEQ ID NO: 1351994 - DNA, 21 bp, Homo sapiens
gcagacaataaaccctcagag

SEQ ID NO: 1351995 - DNA, 23 bp, Homo sapiens
gcagagatttctcattgactttt

SEQ ID NO: 1351996 - DNA, 14 bp, Homo sapiens
gcagagccttctca

SEQ ID NO: 1351997 - DNA, 19 bp, Homo sapiens
gcagagccttctcagaagc

SEQ ID NO: 1351998 - DNA, 18 bp, Homo sapiens
gcagagcgcgcccctagc

SEQ ID NO: 1351999 - DNA, 16 bp, Homo sapiens
gcagaggtaccctggg

SEQ ID NO: 1352000 - DNA, 14 bp, Homo sapiens
gcagcaaattttca

SEQ ID NO: 1352001 - DNA, 15 bp, Homo sapiens
gcagcagcaggtgat

SEQ ID NO: 1352002 - DNA, 18 bp, Homo sapiens
gcagcagggagggcttct

SEQ ID NO: 1352003 - DNA, 19 bp, Homo sapiens
gcagcagggagggcttctg

SEQ ID NO: 1352004 - DNA, 20 bp, Homo sapiens
gcagcagggagggcttctgc

SEQ ID NO: 1352005 - DNA, 13 bp, Homo sapiens
gcagccagttcaa

SEQ ID NO: 1352006 - DNA, 13 bp, Homo sapiens
gcagccccagcct

SEQ ID NO: 1352007 - DNA, 17 bp, Homo sapiens
gcagccccagcctgcta

SEQ ID NO: 1352008 - DNA, 19 bp, Homo sapiens
gcagccctggcagggggca

SEQ ID NO: 1352009 - DNA, 20 bp, Homo sapiens
gcagctcagaaccacagcaa

SEQ ID NO: 1352010 - DNA, 19 bp, Homo sapiens
gcagcttataatgggctct

SEQ ID NO: 1352011 - DNA, 23 bp, Homo sapiens
gcaggaggatcacttgagtccag

SEQ ID NO: 1352012 - DNA, 17 bp, Homo sapiens
gcaggcatagaggcttc

SEQ ID NO: 1352013 - DNA, 12 bp, Homo sapiens
gcaggccctggc

SEQ ID NO: 1352014 - DNA, 15 bp, Homo sapiens
gcaggcctatttcat

SEQ ID NO: 1352015 - DNA, 21 bp, Homo sapiens
gcaggctcactgccaggccag

SEQ ID NO: 1352016 - DNA, 23 bp, Homo sapiens
gcaggctcactgccaggccagcc

SEQ ID NO: 1352017 - DNA, 14 bp, Homo sapiens
gcaggctggccagt

SEQ ID NO: 1352018 - DNA, 15 bp, Homo sapiens
gcaggctgggccatg

SEQ ID NO: 1352019 - DNA, 23 bp, Homo sapiens
gcagggaagccccacatgtccag

SEQ ID NO: 1352020 - DNA, 16 bp, Homo sapiens
gcagggccatggctca

SEQ ID NO: 1352021 - DNA, 13 bp, Homo sapiens
gcaggggcctgga

SEQ ID NO: 1352022 - DNA, 14 bp, Homo sapiens
gcaggggcctggag

SEQ ID NO: 1352023 - DNA, 18 bp, Homo sapiens
gcaggtgattggaccagg

SEQ ID NO: 1352024 - DNA, 22 bp, Homo sapiens
gcaggtgattggaccaggccat

SEQ ID NO: 1352025 - DNA, 16 bp, Homo sapiens
gcaggtgctggagcac

SEQ ID NO: 1352026 - DNA, 19 bp, Homo sapiens
gcaggtgctggagcactgg

SEQ ID NO: 1352027 - DNA, 20 bp, Homo sapiens
gcaggtgctggagcactggg

SEQ ID NO: 1352028 - DNA, 21 bp, Homo sapiens
gcaggtgctggagcactgggc

SEQ ID NO: 1352029 - DNA, 14 bp, Homo sapiens
gcagtcactggagg

SEQ ID NO: 1352030 - DNA, 13 bp, Homo sapiens
gcagtcgtgcctg

SEQ ID NO: 1352031 - DNA, 17 bp, Homo sapiens
gcagtcgtgcctgtgtc

SEQ ID NO: 1352032 - DNA, 12 bp, Homo sapiens
gcagtggcctta

SEQ ID NO: 1352033 - DNA, 19 bp, Homo sapiens
gcagtggcgcattctaggc

SEQ ID NO: 1352034 - DNA, 24 bp, Homo sapiens
gcagtggttttggcaaacgctaaa

SEQ ID NO: 1352035 - DNA, 16 bp, Homo sapiens
gcagtgtggccaggct

SEQ ID NO: 1352036 - DNA, 17 bp, Homo sapiens
gcagtgtggccaggctg

SEQ ID NO: 1352037 - DNA, 19 bp, Homo sapiens
gcagttgctggtaaaatga

SEQ ID NO: 1352038 - DNA, 14 bp, Homo sapiens
gcagttggccagag

SEQ ID NO: 1352039 - DNA, 14 bp, Homo sapiens
gcagtttatcattc

SEQ ID NO: 1352040 - DNA, 20 bp, Homo sapiens
gcagtttatcattcaagtgt

SEQ ID NO: 1352041 - DNA, 13 bp, Homo sapiens
gcataaagtaaat

SEQ ID NO: 1352042 - DNA, 16 bp, Homo sapiens
gcataaagtaaataca

SEQ ID NO: 1352043 - DNA, 15 bp, Homo sapiens
gcataaattgcatca

SEQ ID NO: 1352044 - DNA, 20 bp, Homo sapiens
gcataatttaaaaatatatt

SEQ ID NO: 1352045 - DNA, 21 bp, Homo sapiens
gcatacttacctagtgaaact

SEQ ID NO: 1352046 - DNA, 15 bp, Homo sapiens
gcatactttgtaaat

SEQ ID NO: 1352047 - DNA, 16 bp, Homo sapiens
gcatagaggcttctcc

SEQ ID NO: 1352048 - DNA, 18 bp, Homo sapiens
gcatataatgaataaatc

SEQ ID NO: 1352049 - DNA, 23 bp, Homo sapiens
gcatattataaaggataaagaag

SEQ ID NO: 1352050 - DNA, 14 bp, Homo sapiens
gcatcacctgcctg

SEQ ID NO: 1352051 - DNA, 15 bp, Homo sapiens
gcatcacctgcctgt

SEQ ID NO: 1352052 - DNA, 20 bp, Homo sapiens
gcatcacttaaaacacgttt

SEQ ID NO: 1352053 - DNA, 16 bp, Homo sapiens
gcatcctgtgccacta

SEQ ID NO: 1352054 - DNA, 14 bp, Homo sapiens
gcatcggcctaggg

SEQ ID NO: 1352055 - DNA, 15 bp, Homo sapiens
gcatcggcctagggc

SEQ ID NO: 1352056 - DNA, 15 bp, Homo sapiens
gcatctgagggggag

SEQ ID NO: 1352057 - DNA, 13 bp, Homo sapiens
gcatctttgatgt

SEQ ID NO: 1352058 - DNA, 15 bp, Homo sapiens
gcatgaaataaaata

SEQ ID NO: 1352059 - DNA, 15 bp, Homo sapiens
gcatgaaatgtgaat

SEQ ID NO: 1352060 - DNA, 20 bp, Homo sapiens
gcatgaaatgtgaattttta

SEQ ID NO: 1352061 - DNA, 17 bp, Homo sapiens
gcatgcagctttgcaaa

SEQ ID NO: 1352062 - DNA, 14 bp, Homo sapiens
gcatgcatgcaaat

SEQ ID NO: 1352063 - DNA, 15 bp, Homo sapiens
gcatgccctctcagg

SEQ ID NO: 1352064 - DNA, 16 bp, Homo sapiens
gcatgccctctcaggc

SEQ ID NO: 1352065 - DNA, 16 bp, Homo sapiens
gcatgcttcttctcaa

SEQ ID NO: 1352066 - DNA, 13 bp, Homo sapiens
gcatggaaatcag

SEQ ID NO: 1352067 - DNA, 13 bp, Homo sapiens
gcatggccctggg

SEQ ID NO: 1352068 - DNA, 14 bp, Homo sapiens
gcatggccctgggc

SEQ ID NO: 1352069 - DNA, 14 bp, Homo sapiens
gcatggtggccaga

SEQ ID NO: 1352070 - DNA, 15 bp, Homo sapiens
gcatgtaaatgtaaa

SEQ ID NO: 1352071 - DNA, 17 bp, Homo sapiens
gcatgtaaatgtaaact

SEQ ID NO: 1352072 - DNA, 19 bp, Homo sapiens
gcatgtaaatgtaaactca

SEQ ID NO: 1352073 - DNA, 14 bp, Homo sapiens
gcatgtcttttaaa

SEQ ID NO: 1352074 - DNA, 19 bp, Homo sapiens
gcatgttatgtttaataag

SEQ ID NO: 1352075 - DNA, 12 bp, Homo sapiens
gcattccagccc

SEQ ID NO: 1352076 - DNA, 16 bp, Homo sapiens
gcattccagcccctct

SEQ ID NO: 1352077 - DNA, 19 bp, Homo sapiens
gcattccagcccctctggt

SEQ ID NO: 1352078 - DNA, 22 bp, Homo sapiens
gcattcgttgtgttttttaaga

SEQ ID NO: 1352079 - DNA, 21 bp, Homo sapiens
gcattgtaagcgtatggcttt

SEQ ID NO: 1352080 - DNA, 19 bp, Homo sapiens
gcatttagggagtattcta

SEQ ID NO: 1352081 - DNA, 22 bp, Homo sapiens
gcatttagggagtattctaata

SEQ ID NO: 1352082 - DNA, 13 bp, Homo sapiens
gcatttgctgaat

SEQ ID NO: 1352083 - DNA, 18 bp, Homo sapiens
gcatttgtcaatgacagt

SEQ ID NO: 1352084 - DNA, 22 bp, Homo sapiens
gcattttgctaaatgtgaatga

SEQ ID NO: 1352085 - DNA, 20 bp, Homo sapiens
gcatttttcaatatattgaa

SEQ ID NO: 1352086 - DNA, 17 bp, Homo sapiens
gccaaaatatttggaat

SEQ ID NO: 1352087 - DNA, 23 bp, Homo sapiens
gccaaaattaaggtgtttgaaaa

SEQ ID NO: 1352088 - DNA, 16 bp, Homo sapiens
gccaagaagcagtggc

SEQ ID NO: 1352089 - DNA, 19 bp, Homo sapiens
gccaagaagcagtggcctt

SEQ ID NO: 1352090 - DNA, 20 bp, Homo sapiens
gccaagaagcagtggcctta

SEQ ID NO: 1352091 - DNA, 12 bp, Homo sapiens
gccaagaatgta

SEQ ID NO: 1352092 - DNA, 16 bp, Homo sapiens
gccaagctccaagccc

SEQ ID NO: 1352093 - DNA, 18 bp, Homo sapiens
gccaagggaaaggggtgc

SEQ ID NO: 1352094 - DNA, 22 bp, Homo sapiens
gccaagggaaaggggtgctttt

SEQ ID NO: 1352095 - DNA, 23 bp, Homo sapiens
gccaaggtgggaggattgcttga

SEQ ID NO: 1352096 - DNA, 20 bp, Homo sapiens
gccaaggttttataaggctg

SEQ ID NO: 1352097 - DNA, 18 bp, Homo sapiens
gccaagtggggtgctggg

SEQ ID NO: 1352098 - DNA, 19 bp, Homo sapiens
gccaagtggggtgctggga

SEQ ID NO: 1352099 - DNA, 17 bp, Homo sapiens
gccacactctccatcac

SEQ ID NO: 1352100 - DNA, 15 bp, Homo sapiens
gccaccaaagctgcc

SEQ ID NO: 1352101 - DNA, 20 bp, Homo sapiens
gccaccaaagctgcccactg

SEQ ID NO: 1352102 - DNA, 15 bp, Homo sapiens
gccaccaggccacct

SEQ ID NO: 1352103 - DNA, 20 bp, Homo sapiens
gccaccaggccacctcccca

SEQ ID NO: 1352104 - DNA, 15 bp, Homo sapiens
gccactcactaggcc

SEQ ID NO: 1352105 - DNA, 12 bp, Homo sapiens
gccactcatttc

SEQ ID NO: 1352106 - DNA, 22 bp, Homo sapiens
gccactgccttcgcttcttgcc

SEQ ID NO: 1352107 - DNA, 18 bp, Homo sapiens
gccagaggaatcctggca

SEQ ID NO: 1352108 - DNA, 20 bp, Homo sapiens
gccagaggaatcctggcagc

SEQ ID NO: 1352109 - DNA, 23 bp, Homo sapiens
gccagaggaatcctggcagccca

SEQ ID NO: 1352110 - DNA, 18 bp, Homo sapiens
gccagaggcccccagccc

SEQ ID NO: 1352111 - DNA, 12 bp, Homo sapiens
gccagaggctgg

SEQ ID NO: 1352112 - DNA, 14 bp, Homo sapiens
gccagatttgtctt

SEQ ID NO: 1352113 - DNA, 13 bp, Homo sapiens
gccagcagcagca

SEQ ID NO: 1352114 - DNA, 15 bp, Homo sapiens
gccagcctcagactg

SEQ ID NO: 1352115 - DNA, 12 bp, Homo sapiens
gccagcctcctc

SEQ ID NO: 1352116 - DNA, 14 bp, Homo sapiens
gccagcctcctctg

SEQ ID NO: 1352117 - DNA, 17 bp, Homo sapiens
gccagccttgagccctg

SEQ ID NO: 1352118 - DNA, 19 bp, Homo sapiens
gccagccttgagccctggc

SEQ ID NO: 1352119 - DNA, 17 bp, Homo sapiens
gccagcgcctccctcca

SEQ ID NO: 1352120 - DNA, 15 bp, Homo sapiens
gccaggcaggggtgg

SEQ ID NO: 1352121 - DNA, 17 bp, Homo sapiens
gccaggctcactcacag

SEQ ID NO: 1352122 - DNA, 21 bp, Homo sapiens
gccaggtaatgtgaataaatt

SEQ ID NO: 1352123 - DNA, 15 bp, Homo sapiens
gccaggtgagaaact

SEQ ID NO: 1352124 - DNA, 14 bp, Homo sapiens
gccagtccaggctg

SEQ ID NO: 1352125 - DNA, 19 bp, Homo sapiens
gccatacataaaagaaata

SEQ ID NO: 1352126 - DNA, 18 bp, Homo sapiens
gccatagagtacactgcc

SEQ ID NO: 1352127 - DNA, 19 bp, Homo sapiens
gccatagagtacactgcct

SEQ ID NO: 1352128 - DNA, 18 bp, Homo sapiens
gccatccccagggggcat

SEQ ID NO: 1352129 - DNA, 16 bp, Homo sapiens
gccatctagccagccc

SEQ ID NO: 1352130 - DNA, 19 bp, Homo sapiens
gccatgccagcttatctca

SEQ ID NO: 1352131 - DNA, 20 bp, Homo sapiens
gccatgcgccccctccgccc

SEQ ID NO: 1352132 - DNA, 24 bp, Homo sapiens
gccatgctcctggcccactgcatc

SEQ ID NO: 1352133 - DNA, 13 bp, Homo sapiens
gccatgctgaggc

SEQ ID NO: 1352134 - DNA, 17 bp, Homo sapiens
gccatgctgaggcctgg

SEQ ID NO: 1352135 - DNA, 20 bp, Homo sapiens
gccatgctgaggcctgggcc

SEQ ID NO: 1352136 - DNA, 19 bp, Homo sapiens
gccatgtccaaagaggctg

SEQ ID NO: 1352137 - DNA, 22 bp, Homo sapiens
gccatgtccaaagaggctgccc

SEQ ID NO: 1352138 - DNA, 17 bp, Homo sapiens
gccatgtgcaccttggg

SEQ ID NO: 1352139 - DNA, 19 bp, Homo sapiens
gccatgtgcatagtttctt

SEQ ID NO: 1352140 - DNA, 19 bp, Homo sapiens
gccatgttggccaggctgg

SEQ ID NO: 1352141 - DNA, 19 bp, Homo sapiens
gccattcatgtatgtcaga

SEQ ID NO: 1352142 - DNA, 22 bp, Homo sapiens
gccattctgccgccccctcctg

SEQ ID NO: 1352143 - DNA, 12 bp, Homo sapiens
gccatttgcaat

SEQ ID NO: 1352144 - DNA, 22 bp, Homo sapiens
gccattttaaggaaaactacct

SEQ ID NO: 1352145 - DNA, 15 bp, Homo sapiens
gcccaagccagaggc

SEQ ID NO: 1352146 - DNA, 23 bp, Homo sapiens
gcccaagccagaggctgggttca

SEQ ID NO: 1352147 - DNA, 14 bp, Homo sapiens
gcccaccccctgcc

SEQ ID NO: 1352148 - DNA, 19 bp, Homo sapiens
gcccaccccctgccctgca

SEQ ID NO: 1352149 - DNA, 15 bp, Homo sapiens
gcccacccctcaaca

SEQ ID NO: 1352150 - DNA, 17 bp, Homo sapiens
gcccaccctgctgctgg

SEQ ID NO: 1352151 - DNA, 12 bp, Homo sapiens
gcccagccctcc

SEQ ID NO: 1352152 - DNA, 16 bp, Homo sapiens
gcccagccctccccat

SEQ ID NO: 1352153 - DNA, 20 bp, Homo sapiens
gcccaggctggagtgcagtg

SEQ ID NO: 1352154 - DNA, 16 bp, Homo sapiens
gcccagggcaagctcc

SEQ ID NO: 1352155 - DNA, 14 bp, Homo sapiens
gcccagggctcctg

SEQ ID NO: 1352156 - DNA, 18 bp, Homo sapiens
gcccagggctcctgcact

SEQ ID NO: 1352157 - DNA, 20 bp, Homo sapiens
gcccagtgcatggtggccag

SEQ ID NO: 1352158 - DNA, 15 bp, Homo sapiens
gcccatcctgactga

SEQ ID NO: 1352159 - DNA, 18 bp, Homo sapiens
gcccatcgccacaaactc

SEQ ID NO: 1352160 - DNA, 19 bp, Homo sapiens
gcccatcgtgaagaagcct

SEQ ID NO: 1352161 - DNA, 20 bp, Homo sapiens
gcccatcgtgaagaagcctg

SEQ ID NO: 1352162 - DNA, 17 bp, Homo sapiens
gcccatgcactggggac

SEQ ID NO: 1352163 - DNA, 23 bp, Homo sapiens
gccccacatgtccagcaccttgt

SEQ ID NO: 1352164 - DNA, 22 bp, Homo sapiens
gccccaccctgggccctgggct

SEQ ID NO: 1352165 - DNA, 22 bp, Homo sapiens
gccccactcccttgctggcccc

SEQ ID NO: 1352166 - DNA, 17 bp, Homo sapiens
gccccactgccagcagc

SEQ ID NO: 1352167 - DNA, 13 bp, Homo sapiens
gccccagcacagc

SEQ ID NO: 1352168 - DNA, 21 bp, Homo sapiens
gccccagcacctcagcctgca

SEQ ID NO: 1352169 - DNA, 17 bp, Homo sapiens
gccccagccctgctggg

SEQ ID NO: 1352170 - DNA, 18 bp, Homo sapiens
gccccagccctgctgggg

SEQ ID NO: 1352171 - DNA, 14 bp, Homo sapiens
gccccagcctgcta

SEQ ID NO: 1352172 - DNA, 15 bp, Homo sapiens
gccccagcctgctag

SEQ ID NO: 1352173 - DNA, 18 bp, Homo sapiens
gccccatctcccctcagc

SEQ ID NO: 1352174 - DNA, 20 bp, Homo sapiens
gcccccaaagatagacaggt

SEQ ID NO: 1352175 - DNA, 24 bp, Homo sapiens
gcccccaaagatagacaggtcctg

SEQ ID NO: 1352176 - DNA, 16 bp, Homo sapiens
gcccccaacctcaggg

SEQ ID NO: 1352177 - DNA, 23 bp, Homo sapiens
gcccccaacctcagggctcccag

SEQ ID NO: 1352178 - DNA, 21 bp, Homo sapiens
gcccccacttgcctcttcctt

SEQ ID NO: 1352179 - DNA, 21 bp, Homo sapiens
gcccccagcccagggctcctg

SEQ ID NO: 1352180 - DNA, 21 bp, Homo sapiens
gcccccagtccccacccctgc

SEQ ID NO: 1352181 - DNA, 22 bp, Homo sapiens
gcccccagtccccacccctgcc

SEQ ID NO: 1352182 - DNA, 22 bp, Homo sapiens
gccccctccgccctgccactca

SEQ ID NO: 1352183 - DNA, 12 bp, Homo sapiens
gccccctcctga

SEQ ID NO: 1352184 - DNA, 21 bp, Homo sapiens
gccccctcctgaaccgcacag

SEQ ID NO: 1352185 - DNA, 16 bp, Homo sapiens
gccccgactccagcca

SEQ ID NO: 1352186 - DNA, 17 bp, Homo sapiens
gccccgactccagccag

SEQ ID NO: 1352187 - DNA, 19 bp, Homo sapiens
gccccgactccagccagcg

SEQ ID NO: 1352188 - DNA, 18 bp, Homo sapiens
gcccctagccggttcctg

SEQ ID NO: 1352189 - DNA, 20 bp, Homo sapiens
gcccctagccggttcctgtc

SEQ ID NO: 1352190 - DNA, 21 bp, Homo sapiens
gcccctcccacacccaaagct

SEQ ID NO: 1352191 - DNA, 14 bp, Homo sapiens
gcccctctcaccaa

SEQ ID NO: 1352192 - DNA, 20 bp, Homo sapiens
gcccctctggtcgctcctgc

SEQ ID NO: 1352193 - DNA, 19 bp, Homo sapiens
gcccctggccgcgctccgg

SEQ ID NO: 1352194 - DNA, 20 bp, Homo sapiens
gcccctggccgcgctccggg

SEQ ID NO: 1352195 - DNA, 12 bp, Homo sapiens
gcccctgggctt

SEQ ID NO: 1352196 - DNA, 23 bp, Homo sapiens
gcccctgggcttggcctgctgtg

SEQ ID NO: 1352197 - DNA, 19 bp, Homo sapiens
gcccgacatggctccggcc

SEQ ID NO: 1352198 - DNA, 16 bp, Homo sapiens
gcccgcgccacaggac

SEQ ID NO: 1352199 - DNA, 16 bp, Homo sapiens
gcccggggtggccaca

SEQ ID NO: 1352200 - DNA, 18 bp, Homo sapiens
gcccgtcctgcctgtggc

SEQ ID NO: 1352201 - DNA, 19 bp, Homo sapiens
gccctccccatggagccag

SEQ ID NO: 1352202 - DNA, 14 bp, Homo sapiens
gccctcctctccca

SEQ ID NO: 1352203 - DNA, 17 bp, Homo sapiens
gccctgagtctgggcag

SEQ ID NO: 1352204 - DNA, 12 bp, Homo sapiens
gccctgccactc

SEQ ID NO: 1352205 - DNA, 19 bp, Homo sapiens
gccctgccactcactaggc

SEQ ID NO: 1352206 - DNA, 20 bp, Homo sapiens
gccctgccactcactaggcc

SEQ ID NO: 1352207 - DNA, 13 bp, Homo sapiens
gccctgctgggga

SEQ ID NO: 1352208 - DNA, 19 bp, Homo sapiens
gccctggcctcccctgcca

SEQ ID NO: 1352209 - DNA, 24 bp, Homo sapiens
gccctggcctcccctgccaccagg

SEQ ID NO: 1352210 - DNA, 14 bp, Homo sapiens
gccctggctgctgc

SEQ ID NO: 1352211 - DNA, 14 bp, Homo sapiens
gccctgtgtgcagg

SEQ ID NO: 1352212 - DNA, 15 bp, Homo sapiens
gcccttggcttctgt

SEQ ID NO: 1352213 - DNA, 19 bp, Homo sapiens
gccgagactcgactctgtg

SEQ ID NO: 1352214 - DNA, 18 bp, Homo sapiens
gccgaggccatgtgcata

SEQ ID NO: 1352215 - DNA, 23 bp, Homo sapiens
gccgcatctcacagctatgcaaa

SEQ ID NO: 1352216 - DNA, 16 bp, Homo sapiens
gccgccatgctcctgg

SEQ ID NO: 1352217 - DNA, 13 bp, Homo sapiens
gccgcctgcactc

SEQ ID NO: 1352218 - DNA, 18 bp, Homo sapiens
gccgcctgcactcctcag

SEQ ID NO: 1352219 - DNA, 19 bp, Homo sapiens
gccgcctgcactcctcagg

SEQ ID NO: 1352220 - DNA, 15 bp, Homo sapiens
gccgcggagcctgca

SEQ ID NO: 1352221 - DNA, 21 bp, Homo sapiens
gccgcgtggtgccatccccag

SEQ ID NO: 1352222 - DNA, 14 bp, Homo sapiens
gccggcagccccag

SEQ ID NO: 1352223 - DNA, 17 bp, Homo sapiens
gccggcagccccagcct

SEQ ID NO: 1352224 - DNA, 12 bp, Homo sapiens
gccggccccagg

SEQ ID NO: 1352225 - DNA, 16 bp, Homo sapiens
gccggccctgtgtgca

SEQ ID NO: 1352226 - DNA, 17 bp, Homo sapiens
gccggccctgtgtgcag

SEQ ID NO: 1352227 - DNA, 14 bp, Homo sapiens
gccgggcgcggtgg

SEQ ID NO: 1352228 - DNA, 18 bp, Homo sapiens
gccgggcgcggtggctca

SEQ ID NO: 1352229 - DNA, 17 bp, Homo sapiens
gccggtaactgtcctgt

SEQ ID NO: 1352230 - DNA, 22 bp, Homo sapiens
gccggtaactgtcctgtcctgc

SEQ ID NO: 1352231 - DNA, 16 bp, Homo sapiens
gccgtcaccaccaccc

SEQ ID NO: 1352232 - DNA, 18 bp, Homo sapiens
gccgtcaccaccacccct

SEQ ID NO: 1352233 - DNA, 21 bp, Homo sapiens
gccgtctccaggggctgcttc

SEQ ID NO: 1352234 - DNA, 23 bp, Homo sapiens
gccgtggggccgccgcctctttc

SEQ ID NO: 1352235 - DNA, 15 bp, Homo sapiens
gcctagcacagcagc

SEQ ID NO: 1352236 - DNA, 16 bp, Homo sapiens
gcctagcacagcagct

SEQ ID NO: 1352237 - DNA, 18 bp, Homo sapiens
gcctcaagaggaatgaaa

SEQ ID NO: 1352238 - DNA, 21 bp, Homo sapiens
gcctcaccatgtgagctcttc

SEQ ID NO: 1352239 - DNA, 17 bp, Homo sapiens
gcctcactggggcagac

SEQ ID NO: 1352240 - DNA, 12 bp, Homo sapiens
gcctcagactgg

SEQ ID NO: 1352241 - DNA, 19 bp, Homo sapiens
gcctcatgtggctggaaga

SEQ ID NO: 1352242 - DNA, 20 bp, Homo sapiens
gcctccacagcgagggcagc

SEQ ID NO: 1352243 - DNA, 18 bp, Homo sapiens
gcctccaggtgcagaggt

SEQ ID NO: 1352244 - DNA, 21 bp, Homo sapiens
gcctcccacgactgcccggca

SEQ ID NO: 1352245 - DNA, 16 bp, Homo sapiens
gcctccccatttccca

SEQ ID NO: 1352246 - DNA, 22 bp, Homo sapiens
gcctccccatttcccatctgca

SEQ ID NO: 1352247 - DNA, 14 bp, Homo sapiens
gcctccctccaccc

SEQ ID NO: 1352248 - DNA, 15 bp, Homo sapiens
gcctccctccacccc

SEQ ID NO: 1352249 - DNA, 14 bp, Homo sapiens
gcctcccttgtggc

SEQ ID NO: 1352250 - DNA, 18 bp, Homo sapiens
gcctccgagagggagaga

SEQ ID NO: 1352251 - DNA, 21 bp, Homo sapiens
gcctcctctcataaaagagac

SEQ ID NO: 1352252 - DNA, 18 bp, Homo sapiens
gcctcggcccctcccaca

SEQ ID NO: 1352253 - DNA, 16 bp, Homo sapiens
gcctctccatttgctc

SEQ ID NO: 1352254 - DNA, 13 bp, Homo sapiens
gcctctctagcac

SEQ ID NO: 1352255 - DNA, 16 bp, Homo sapiens
gcctctgtcaggcctt

SEQ ID NO: 1352256 - DNA, 18 bp, Homo sapiens
gcctctgtcaggccttca

SEQ ID NO: 1352257 - DNA, 12 bp, Homo sapiens
gcctctgtgcct

SEQ ID NO: 1352258 - DNA, 12 bp, Homo sapiens
gcctctgtgctg

SEQ ID NO: 1352259 - DNA, 17 bp, Homo sapiens
gcctctgtgctgtgtgt

SEQ ID NO: 1352260 - DNA, 23 bp, Homo sapiens
gcctcttctctactctagggaaa

SEQ ID NO: 1352261 - DNA, 13 bp, Homo sapiens
gcctcttgaccag

SEQ ID NO: 1352262 - DNA, 16 bp, Homo sapiens
gcctcttgaccaggct

SEQ ID NO: 1352263 - DNA, 22 bp, Homo sapiens
gcctcttgaccaggctgcctcc

SEQ ID NO: 1352264 - DNA, 12 bp, Homo sapiens
gcctgaataaag

SEQ ID NO: 1352265 - DNA, 16 bp, Homo sapiens
gcctgaataaagagcc

SEQ ID NO: 1352266 - DNA, 23 bp, Homo sapiens
gcctgaataaagagccctaagtt

SEQ ID NO: 1352267 - DNA, 14 bp, Homo sapiens
gcctgagaggcagg

SEQ ID NO: 1352268 - DNA, 15 bp, Homo sapiens
gcctgagaggcaggc

SEQ ID NO: 1352269 - DNA, 18 bp, Homo sapiens
gcctgagaggcaggcata

SEQ ID NO: 1352270 - DNA, 22 bp, Homo sapiens
gcctgagaggcaggcatagagg

SEQ ID NO: 1352271 - DNA, 19 bp, Homo sapiens
gcctgaggtcatcggcgtg

SEQ ID NO: 1352272 - DNA, 23 bp, Homo sapiens
gcctgatctgcccatcgtgaaga

SEQ ID NO: 1352273 - DNA, 15 bp, Homo sapiens
gcctgcagggaagcc

SEQ ID NO: 1352274 - DNA, 14 bp, Homo sapiens
gcctgcagggccat

SEQ ID NO: 1352275 - DNA, 18 bp, Homo sapiens
gcctgcagggccatggct

SEQ ID NO: 1352276 - DNA, 19 bp, Homo sapiens
gcctgcatttcctcgcagc

SEQ ID NO: 1352277 - DNA, 20 bp, Homo sapiens
gcctgccccgcccccagtcc

SEQ ID NO: 1352278 - DNA, 15 bp, Homo sapiens
gcctgcgaccctggg

SEQ ID NO: 1352279 - DNA, 16 bp, Homo sapiens
gcctgcgaccctgggg

SEQ ID NO: 1352280 - DNA, 13 bp, Homo sapiens
gcctgcgcctgct

SEQ ID NO: 1352281 - DNA, 14 bp, Homo sapiens
gcctgcgcctgctg

SEQ ID NO: 1352282 - DNA, 16 bp, Homo sapiens
gcctgctagctagctc

SEQ ID NO: 1352283 - DNA, 15 bp, Homo sapiens
gcctgctccagctgt

SEQ ID NO: 1352284 - DNA, 14 bp, Homo sapiens
gcctgctgcatgcc

SEQ ID NO: 1352285 - DNA, 10 bp, Homo sapiens
gcctgctggc

SEQ ID NO: 1352286 - DNA, 17 bp, Homo sapiens
gcctgctggcacccacc

SEQ ID NO: 1352287 - DNA, 21 bp, Homo sapiens
gcctggacagtatcccacatc

SEQ ID NO: 1352288 - DNA, 22 bp, Homo sapiens
gcctggacagtatcccacatcc

SEQ ID NO: 1352289 - DNA, 13 bp, Homo sapiens
gcctggactgcta

SEQ ID NO: 1352290 - DNA, 19 bp, Homo sapiens
gcctggagacttagggcac

SEQ ID NO: 1352291 - DNA, 16 bp, Homo sapiens
gcctggagatcctcct

SEQ ID NO: 1352292 - DNA, 17 bp, Homo sapiens
gcctggagatcctcctg

SEQ ID NO: 1352293 - DNA, 22 bp, Homo sapiens
gcctggagatcctcctgcagac

SEQ ID NO: 1352294 - DNA, 17 bp, Homo sapiens
gcctggccaggagcagg

SEQ ID NO: 1352295 - DNA, 10 bp, Homo sapiens
gcctggcccc

SEQ ID NO: 1352296 - DNA, 13 bp, Homo sapiens
gcctggcccccaa

SEQ ID NO: 1352297 - DNA, 18 bp, Homo sapiens
gcctgggaaataagcccc

SEQ ID NO: 1352298 - DNA, 22 bp, Homo sapiens
gcctgggaggtcaaggctgcag

SEQ ID NO: 1352299 - DNA, 20 bp, Homo sapiens
gcctgggccccagctcgcgg

SEQ ID NO: 1352300 - DNA, 20 bp, Homo sapiens
gcctgggggacagaaagaga

SEQ ID NO: 1352301 - DNA, 23 bp, Homo sapiens
gcctgggtgacaaagtgagactc

SEQ ID NO: 1352302 - DNA, 15 bp, Homo sapiens
gcctgtaatcccagc

SEQ ID NO: 1352303 - DNA, 23 bp, Homo sapiens
gcctgtggcgccgtctccagggg

SEQ ID NO: 1352304 - DNA, 15 bp, Homo sapiens
gcctgtggctgtcgg

SEQ ID NO: 1352305 - DNA, 14 bp, Homo sapiens
gcctgtgtccatgc

SEQ ID NO: 1352306 - DNA, 23 bp, Homo sapiens
gcctgtgtccatgcgctcagggc

SEQ ID NO: 1352307 - DNA, 19 bp, Homo sapiens
gcctgtttctgatttgctg

SEQ ID NO: 1352308 - DNA, 20 bp, Homo sapiens
gccttaaacactcaccttct

SEQ ID NO: 1352309 - DNA, 21 bp, Homo sapiens
gccttaagtgaggaaatcaaa

SEQ ID NO: 1352310 - DNA, 14 bp, Homo sapiens
gccttaatttcctt

SEQ ID NO: 1352311 - DNA, 17 bp, Homo sapiens
gccttaatttccttttt

SEQ ID NO: 1352312 - DNA, 19 bp, Homo sapiens
gccttaatttcctttttga

SEQ ID NO: 1352313 - DNA, 21 bp, Homo sapiens
gccttaatttcctttttgaca

SEQ ID NO: 1352314 - DNA, 19 bp, Homo sapiens
gccttcaaaactatagctt

SEQ ID NO: 1352315 - DNA, 18 bp, Homo sapiens
gccttccatttcccctct

SEQ ID NO: 1352316 - DNA, 23 bp, Homo sapiens
gccttccctagctttagaccctg

SEQ ID NO: 1352317 - DNA, 16 bp, Homo sapiens
gccttcctctctccag

SEQ ID NO: 1352318 - DNA, 17 bp, Homo sapiens
gccttcctctctccaga

SEQ ID NO: 1352319 - DNA, 18 bp, Homo sapiens
gccttcctctctccagat

SEQ ID NO: 1352320 - DNA, 22 bp, Homo sapiens
gccttcgcttcttgcctctgtg

SEQ ID NO: 1352321 - DNA, 19 bp, Homo sapiens
gccttcgtctttcccatgg

SEQ ID NO: 1352322 - DNA, 13 bp, Homo sapiens
gccttggaaattc

SEQ ID NO: 1352323 - DNA, 12 bp, Homo sapiens
gccttggctcag

SEQ ID NO: 1352324 - DNA, 14 bp, Homo sapiens
gccttggctcagac

SEQ ID NO: 1352325 - DNA, 22 bp, Homo sapiens
gccttgggctatttggactcag

SEQ ID NO: 1352326 - DNA, 18 bp, Homo sapiens
gccttgtcctcagccagt

SEQ ID NO: 1352327 - DNA, 14 bp, Homo sapiens
gcctttgttctggg

SEQ ID NO: 1352328 - DNA, 14 bp, Homo sapiens
gccttttaattttt

SEQ ID NO: 1352329 - DNA, 15 bp, Homo sapiens
gccttttctggcacc

SEQ ID NO: 1352330 - DNA, 22 bp, Homo sapiens
gcgaagaccctcttgcccatcc

SEQ ID NO: 1352331 - DNA, 19 bp, Homo sapiens
gcgaccctgggggcacagg

SEQ ID NO: 1352332 - DNA, 19 bp, Homo sapiens
gcgactccgttggccactc

SEQ ID NO: 1352333 - DNA, 12 bp, Homo sapiens
gcgactttctgc

SEQ ID NO: 1352334 - DNA, 12 bp, Homo sapiens
gcgagggcagct

SEQ ID NO: 1352335 - DNA, 16 bp, Homo sapiens
gcgagggcagctgcta

SEQ ID NO: 1352336 - DNA, 11 bp, Homo sapiens
gcgcatctaac

SEQ ID NO: 1352337 - DNA, 22 bp, Homo sapiens
gcgcatcttgcctccaggtgca

SEQ ID NO: 1352338 - DNA, 22 bp, Homo sapiens
gcgcccttaactgcatccagcc

SEQ ID NO: 1352339 - DNA, 20 bp, Homo sapiens
gcgcccttggcttctgtgat

SEQ ID NO: 1352340 - DNA, 12 bp, Homo sapiens
gcgcctccctcc

SEQ ID NO: 1352341 - DNA, 16 bp, Homo sapiens
gcgcctccctccaccc

SEQ ID NO: 1352342 - DNA, 22 bp, Homo sapiens
gcgcctccctccaccccaggac

SEQ ID NO: 1352343 - DNA, 13 bp, Homo sapiens
gcgctcagggcca

SEQ ID NO: 1352344 - DNA, 16 bp, Homo sapiens
gcgctcagggccatgc

SEQ ID NO: 1352345 - DNA, 15 bp, Homo sapiens
gcgctcagtaaacgg

SEQ ID NO: 1352346 - DNA, 19 bp, Homo sapiens
gcggaggttgcagtgagct

SEQ ID NO: 1352347 - DNA, 19 bp, Homo sapiens
gcggattaatttgcatctg

SEQ ID NO: 1352348 - DNA, 16 bp, Homo sapiens
gcggcaggggcctgga

SEQ ID NO: 1352349 - DNA, 18 bp, Homo sapiens
gcggggctgtcggcgctg

SEQ ID NO: 1352350 - DNA, 22 bp, Homo sapiens
gcggggctgtcggcgctgcccc

SEQ ID NO: 1352351 - DNA, 14 bp, Homo sapiens
gcgtacaggctggc

SEQ ID NO: 1352352 - DNA, 18 bp, Homo sapiens
gcgtatggctttattttt

SEQ ID NO: 1352353 - DNA, 14 bp, Homo sapiens
gcgtcccaagatgt

SEQ ID NO: 1352354 - DNA, 17 bp, Homo sapiens
gcgtcccaagatgttga

SEQ ID NO: 1352355 - DNA, 12 bp, Homo sapiens
gcgtccctggcg

SEQ ID NO: 1352356 - DNA, 14 bp, Homo sapiens
gcgtccctggcgca

SEQ ID NO: 1352357 - DNA, 13 bp, Homo sapiens
gcgtctgtgtgcg

SEQ ID NO: 1352358 - DNA, 15 bp, Homo sapiens
gcgtgccgtggcacc

SEQ ID NO: 1352359 - DNA, 23 bp, Homo sapiens
gcgtgcgcatcttgcctccaggt

SEQ ID NO: 1352360 - DNA, 14 bp, Homo sapiens
gcgtggagggaggc

SEQ ID NO: 1352361 - DNA, 17 bp, Homo sapiens
gcgtggagggaggcccc

SEQ ID NO: 1352362 - DNA, 21 bp, Homo sapiens
gcgtggagggaggccccaggg

SEQ ID NO: 1352363 - DNA, 22 bp, Homo sapiens
gcgtggagggaggccccagggg

SEQ ID NO: 1352364 - DNA, 23 bp, Homo sapiens
gcgtggctctaaaaggtaatgtg

SEQ ID NO: 1352365 - DNA, 14 bp, Homo sapiens
gcgtggtgccatcc

SEQ ID NO: 1352366 - DNA, 16 bp, Homo sapiens
gcgtgtgcctgtgtgc

SEQ ID NO: 1352367 - DNA, 17 bp, Homo sapiens
gcgtgtgcctgtgtgcg

SEQ ID NO: 1352368 - DNA, 14 bp, Homo sapiens
gctaaagagccctt

SEQ ID NO: 1352369 - DNA, 22 bp, Homo sapiens
gctaaagagcccttgcctcccc

SEQ ID NO: 1352370 - DNA, 23 bp, Homo sapiens
gctaaagagcccttgcctcccca

SEQ ID NO: 1352371 - DNA, 13 bp, Homo sapiens
gctaaatgtgaat

SEQ ID NO: 1352372 - DNA, 16 bp, Homo sapiens
gctaaatgtgaatgat

SEQ ID NO: 1352373 - DNA, 14 bp, Homo sapiens
gctaacaaagacaa

SEQ ID NO: 1352374 - DNA, 16 bp, Homo sapiens
gctacctttcaaagct

SEQ ID NO: 1352375 - DNA, 18 bp, Homo sapiens
gctactgcactccagcct

SEQ ID NO: 1352376 - DNA, 20 bp, Homo sapiens
gctactgcactccagcctgg

SEQ ID NO: 1352377 - DNA, 18 bp, Homo sapiens
gctactgttgtaagaatt

SEQ ID NO: 1352378 - DNA, 22 bp, Homo sapiens
gctagcagcagggagggcttct

SEQ ID NO: 1352379 - DNA, 17 bp, Homo sapiens
gctagctagctcaacta

SEQ ID NO: 1352380 - DNA, 12 bp, Homo sapiens
gctagctcaact

SEQ ID NO: 1352381 - DNA, 12 bp, Homo sapiens
gctagcttctgc

SEQ ID NO: 1352382 - DNA, 15 bp, Homo sapiens
gctagcttctgcttt

SEQ ID NO: 1352383 - DNA, 23 bp, Homo sapiens
gctagcttctgcttttctgccct

SEQ ID NO: 1352384 - DNA, 22 bp, Homo sapiens
gctagttgaatacttgaaccat

SEQ ID NO: 1352385 - DNA, 21 bp, Homo sapiens
gctatccccatctccctgcct

SEQ ID NO: 1352386 - DNA, 22 bp, Homo sapiens
gctatttatgggcccctggcac

SEQ ID NO: 1352387 - DNA, 22 bp, Homo sapiens
gctatttattttcctaaagaga

SEQ ID NO: 1352388 - DNA, 18 bp, Homo sapiens
gctattttctaaagactt

SEQ ID NO: 1352389 - DNA, 22 bp, Homo sapiens
gctattttctaaagacttgtat

SEQ ID NO: 1352390 - DNA, 12 bp, Homo sapiens
gctatttttgta

SEQ ID NO: 1352391 - DNA, 15 bp, Homo sapiens
gctatttttgtaaag

SEQ ID NO: 1352392 - DNA, 17 bp, Homo sapiens
gctcaccgcccatcagg

SEQ ID NO: 1352393 - DNA, 18 bp, Homo sapiens
gctcactcacagagtcaa

SEQ ID NO: 1352394 - DNA, 14 bp, Homo sapiens
gctcactgccaggc

SEQ ID NO: 1352395 - DNA, 23 bp, Homo sapiens
gctcagcaaaagatgcttctcac

SEQ ID NO: 1352396 - DNA, 20 bp, Homo sapiens
gctcagggccatgctgaggc

SEQ ID NO: 1352397 - DNA, 16 bp, Homo sapiens
gctcatctgctggtcc

SEQ ID NO: 1352398 - DNA, 17 bp, Homo sapiens
gctcattaaactttttt

SEQ ID NO: 1352399 - DNA, 19 bp, Homo sapiens
gctccaagccccatcttct

SEQ ID NO: 1352400 - DNA, 23 bp, Homo sapiens
gctccaccagcatcacctgcctg

SEQ ID NO: 1352401 - DNA, 15 bp, Homo sapiens
gctccactctgcttc

SEQ ID NO: 1352402 - DNA, 19 bp, Homo sapiens
gctccagcaacacagcctg

SEQ ID NO: 1352403 - DNA, 23 bp, Homo sapiens
gctccagcaacacagcctgggcc

SEQ ID NO: 1352404 - DNA, 21 bp, Homo sapiens
gctccagcgatctctccactg

SEQ ID NO: 1352405 - DNA, 20 bp, Homo sapiens
gctccagctgttcagctggt

SEQ ID NO: 1352406 - DNA, 21 bp, Homo sapiens
gctccagggaatccaagcctc

SEQ ID NO: 1352407 - DNA, 19 bp, Homo sapiens
gctccatagtttggcattt

SEQ ID NO: 1352408 - DNA, 17 bp, Homo sapiens
gctcccagcctcagcgc

SEQ ID NO: 1352409 - DNA, 20 bp, Homo sapiens
gctcccaggagcctgcccag

SEQ ID NO: 1352410 - DNA, 22 bp, Homo sapiens
gctcccaggggtctccctggct

SEQ ID NO: 1352411 - DNA, 20 bp, Homo sapiens
gctccccacagcgtccctgg

SEQ ID NO: 1352412 - DNA, 14 bp, Homo sapiens
gctccctcctccag

SEQ ID NO: 1352413 - DNA, 18 bp, Homo sapiens
gctccctcctccaggcct

SEQ ID NO: 1352414 - DNA, 15 bp, Homo sapiens
gctccgaggacccag

SEQ ID NO: 1352415 - DNA, 16 bp, Homo sapiens
gctccgaggacccagg

SEQ ID NO: 1352416 - DNA, 17 bp, Homo sapiens
gctccgcaggacttccc

SEQ ID NO: 1352417 - DNA, 23 bp, Homo sapiens
gctcctccccttcctcttgtctg

SEQ ID NO: 1352418 - DNA, 12 bp, Homo sapiens
gctcctgcccac

SEQ ID NO: 1352419 - DNA, 18 bp, Homo sapiens
gctcctggcccactgcat

SEQ ID NO: 1352420 - DNA, 16 bp, Homo sapiens
gctcgaatctctgtgc

SEQ ID NO: 1352421 - DNA, 23 bp, Homo sapiens
gctcggagaagagcgcagtgttt

SEQ ID NO: 1352422 - DNA, 23 bp, Homo sapiens
gctcggtacccggggcccagggc

SEQ ID NO: 1352423 - DNA, 23 bp, Homo sapiens
gctctaaaaggtaatgtgtggat

SEQ ID NO: 1352424 - DNA, 18 bp, Homo sapiens
gctctcaagttatcaggg

SEQ ID NO: 1352425 - DNA, 19 bp, Homo sapiens
gctctccggggccatttgc

SEQ ID NO: 1352426 - DNA, 22 bp, Homo sapiens
gctctccggggccatttgcaat

SEQ ID NO: 1352427 - DNA, 18 bp, Homo sapiens
gctctgagcgcctccatc

SEQ ID NO: 1352428 - DNA, 16 bp, Homo sapiens
gctctgcctgacagag

SEQ ID NO: 1352429 - DNA, 19 bp, Homo sapiens
gctcttcatcccattccag

SEQ ID NO: 1352430 - DNA, 19 bp, Homo sapiens
gctcttcctatccctctcc

SEQ ID NO: 1352431 - DNA, 12 bp, Homo sapiens
gctgaaaacaat

SEQ ID NO: 1352432 - DNA, 16 bp, Homo sapiens
gctgaagaattgaaaa

SEQ ID NO: 1352433 - DNA, 19 bp, Homo sapiens
gctgaagttgcagatgtta

SEQ ID NO: 1352434 - DNA, 16 bp, Homo sapiens
gctgacatcttgaatc

SEQ ID NO: 1352435 - DNA, 21 bp, Homo sapiens
gctgaccatgctcatctgctg

SEQ ID NO: 1352436 - DNA, 13 bp, Homo sapiens
gctgacttagaat

SEQ ID NO: 1352437 - DNA, 20 bp, Homo sapiens
gctgagcctctgctccccag

SEQ ID NO: 1352438 - DNA, 20 bp, Homo sapiens
gctgagcctgcagggaagcc

SEQ ID NO: 1352439 - DNA, 17 bp, Homo sapiens
gctgaggttcctctgcc

SEQ ID NO: 1352440 - DNA, 21 bp, Homo sapiens
gctgaggttcctctgcctgcc

SEQ ID NO: 1352441 - DNA, 21 bp, Homo sapiens
gctgagtggcaggggacagga

SEQ ID NO: 1352442 - DNA, 20 bp, Homo sapiens
gctgatgtcaatttctgtgt

SEQ ID NO: 1352443 - DNA, 16 bp, Homo sapiens
gctgcaattccctgga

SEQ ID NO: 1352444 - DNA, 15 bp, Homo sapiens
gctgcaccctcaggc

SEQ ID NO: 1352445 - DNA, 16 bp, Homo sapiens
gctgcaccctcaggca

SEQ ID NO: 1352446 - DNA, 19 bp, Homo sapiens
gctgcaccctcaggcaggt

SEQ ID NO: 1352447 - DNA, 20 bp, Homo sapiens
gctgcagcaccgaggggcct

SEQ ID NO: 1352448 - DNA, 23 bp, Homo sapiens
gctgcagcaccgaggggcctttg

SEQ ID NO: 1352449 - DNA, 17 bp, Homo sapiens
gctgcaggacttgagaa

SEQ ID NO: 1352450 - DNA, 20 bp, Homo sapiens
gctgcatgccctctcaggcc

SEQ ID NO: 1352451 - DNA, 22 bp, Homo sapiens
gctgcatgccctctcaggccgg

SEQ ID NO: 1352452 - DNA, 23 bp, Homo sapiens
gctgccccatctcccctcagctc

SEQ ID NO: 1352453 - DNA, 15 bp, Homo sapiens
gctgcccccaccccg

SEQ ID NO: 1352454 - DNA, 13 bp, Homo sapiens
gctgcccctctca

SEQ ID NO: 1352455 - DNA, 14 bp, Homo sapiens
gctgcccctctcac

SEQ ID NO: 1352456 - DNA, 16 bp, Homo sapiens
gctgcccctctcacca

SEQ ID NO: 1352457 - DNA, 20 bp, Homo sapiens
gctgcccttgggccacccct

SEQ ID NO: 1352458 - DNA, 18 bp, Homo sapiens
gctgccgtgccgcctgca

SEQ ID NO: 1352459 - DNA, 18 bp, Homo sapiens
gctgcctattgatttaag

SEQ ID NO: 1352460 - DNA, 16 bp, Homo sapiens
gctgccttccctagct

SEQ ID NO: 1352461 - DNA, 14 bp, Homo sapiens
gctgccttggctca

SEQ ID NO: 1352462 - DNA, 23 bp, Homo sapiens
gctgccttggctcagacatgttt

SEQ ID NO: 1352463 - DNA, 23 bp, Homo sapiens
gctgctatccccatctccctgcc

SEQ ID NO: 1352464 - DNA, 10 bp, Homo sapiens
gctgctcttc

SEQ ID NO: 1352465 - DNA, 17 bp, Homo sapiens
gctgctgcccccacccc

SEQ ID NO: 1352466 - DNA, 13 bp, Homo sapiens
gctgctgcctctt

SEQ ID NO: 1352467 - DNA, 22 bp, Homo sapiens
gctgctgggggcaactggccat

SEQ ID NO: 1352468 - DNA, 12 bp, Homo sapiens
gctgctgtgaag

SEQ ID NO: 1352469 - DNA, 14 bp, Homo sapiens
gctggaagatcctg

SEQ ID NO: 1352470 - DNA, 18 bp, Homo sapiens
gctggaagatcctgcggg

SEQ ID NO: 1352471 - DNA, 22 bp, Homo sapiens
gctggacttctacctgccctca

SEQ ID NO: 1352472 - DNA, 14 bp, Homo sapiens
gctggagcactggg

SEQ ID NO: 1352473 - DNA, 15 bp, Homo sapiens
gctggagcactgggc

SEQ ID NO: 1352474 - DNA, 16 bp, Homo sapiens
gctggagcactgggct

SEQ ID NO: 1352475 - DNA, 18 bp, Homo sapiens
gctggagcactgggctcc

SEQ ID NO: 1352476 - DNA, 21 bp, Homo sapiens
gctggagcactgggctcccgg

SEQ ID NO: 1352477 - DNA, 16 bp, Homo sapiens
gctggagtctcctgag

SEQ ID NO: 1352478 - DNA, 20 bp, Homo sapiens
gctggcacccaccgtggagg

SEQ ID NO: 1352479 - DNA, 22 bp, Homo sapiens
gctggccagtccaccctgcctg

SEQ ID NO: 1352480 - DNA, 16 bp, Homo sapiens
gctggccagtccaggc

SEQ ID NO: 1352481 - DNA, 15 bp, Homo sapiens
gctggccccagccct

SEQ ID NO: 1352482 - DNA, 15 bp, Homo sapiens
gctggcctctctagc

SEQ ID NO: 1352483 - DNA, 13 bp, Homo sapiens
gctggctcctgat

SEQ ID NO: 1352484 - DNA, 12 bp, Homo sapiens
gctgggactcag

SEQ ID NO: 1352485 - DNA, 15 bp, Homo sapiens
gctgggactcagcct

SEQ ID NO: 1352486 - DNA, 14 bp, Homo sapiens
gctgggagctccac

SEQ ID NO: 1352487 - DNA, 20 bp, Homo sapiens
gctgggagctccactctgct

SEQ ID NO: 1352488 - DNA, 20 bp, Homo sapiens
gctgggccatgtccaaagag

SEQ ID NO: 1352489 - DNA, 15 bp, Homo sapiens
gctggggaaggaagc

SEQ ID NO: 1352490 - DNA, 18 bp, Homo sapiens
gctgggggcaactggcca

SEQ ID NO: 1352491 - DNA, 23 bp, Homo sapiens
gctggtaaaatgaagaatttaaa

SEQ ID NO: 1352492 - DNA, 16 bp, Homo sapiens
gctggtccgtgggacg

SEQ ID NO: 1352493 - DNA, 21 bp, Homo sapiens
gctgtcccatagtccctgcca

SEQ ID NO: 1352494 - DNA, 23 bp, Homo sapiens
gctgtcccatagtccctgccacg

SEQ ID NO: 1352495 - DNA, 18 bp, Homo sapiens
gctgtcggcgctgcccca

SEQ ID NO: 1352496 - DNA, 13 bp, Homo sapiens
gctgtgagggagg

SEQ ID NO: 1352497 - DNA, 19 bp, Homo sapiens
gctgtgcaacgccgtgggc

SEQ ID NO: 1352498 - DNA, 19 bp, Homo sapiens
gctgtgcaacggtctcctg

SEQ ID NO: 1352499 - DNA, 17 bp, Homo sapiens
gctgtgctgccctgaag

SEQ ID NO: 1352500 - DNA, 19 bp, Homo sapiens
gctgtggtcaaggctacag

SEQ ID NO: 1352501 - DNA, 20 bp, Homo sapiens
gctgtgtgtcccaggcaggg

SEQ ID NO: 1352502 - DNA, 23 bp, Homo sapiens
gctgtgtgtcccaggcagggaga

SEQ ID NO: 1352503 - DNA, 14 bp, Homo sapiens
gctgttcagctggt

SEQ ID NO: 1352504 - DNA, 22 bp, Homo sapiens
gctgttcccatgtagccccctg

SEQ ID NO: 1352505 - DNA, 21 bp, Homo sapiens
gctgttctgtggttcctctgc

SEQ ID NO: 1352506 - DNA, 22 bp, Homo sapiens
gcttaatcttcaaagccttctc

SEQ ID NO: 1352507 - DNA, 18 bp, Homo sapiens
gcttaatgctacatgtga

SEQ ID NO: 1352508 - DNA, 14 bp, Homo sapiens
gcttacgtagttct

SEQ ID NO: 1352509 - DNA, 12 bp, Homo sapiens
gcttagtttgtg

SEQ ID NO: 1352510 - DNA, 21 bp, Homo sapiens
gcttagtttgtgtgttgtctc

SEQ ID NO: 1352511 - DNA, 22 bp, Homo sapiens
gcttataaaacagagtaatctt

SEQ ID NO: 1352512 - DNA, 15 bp, Homo sapiens
gcttatatctggcct

SEQ ID NO: 1352513 - DNA, 19 bp, Homo sapiens
gcttcacagtagagccagc

SEQ ID NO: 1352514 - DNA, 20 bp, Homo sapiens
gcttcacagtagagccagct

SEQ ID NO: 1352515 - DNA, 20 bp, Homo sapiens
gcttcaccatggccttatga

SEQ ID NO: 1352516 - DNA, 18 bp, Homo sapiens
gcttcacggaagagcctt

SEQ ID NO: 1352517 - DNA, 19 bp, Homo sapiens
gcttcacggaagagccttg

SEQ ID NO: 1352518 - DNA, 19 bp, Homo sapiens
gcttccattttaattttaa

SEQ ID NO: 1352519 - DNA, 16 bp, Homo sapiens
gcttcctcctggaaat

SEQ ID NO: 1352520 - DNA, 14 bp, Homo sapiens
gcttccttgcctga

SEQ ID NO: 1352521 - DNA, 24 bp, Homo sapiens
gcttctccgccagcctcctctgga

SEQ ID NO: 1352522 - DNA, 17 bp, Homo sapiens
gcttctctgacttctgc

SEQ ID NO: 1352523 - DNA, 18 bp, Homo sapiens
gcttctctgacttctgcc

SEQ ID NO: 1352524 - DNA, 22 bp, Homo sapiens
gcttctctgacttctgcctgga

SEQ ID NO: 1352525 - DNA, 14 bp, Homo sapiens
gcttctgcttttct

SEQ ID NO: 1352526 - DNA, 16 bp, Homo sapiens
gcttctgtgatgagct

SEQ ID NO: 1352527 - DNA, 17 bp, Homo sapiens
gcttctgtgatgagctg

SEQ ID NO: 1352528 - DNA, 18 bp, Homo sapiens
gcttctgtgatgagctga

SEQ ID NO: 1352529 - DNA, 20 bp, Homo sapiens
gcttctgtgatgagctgatc

SEQ ID NO: 1352530 - DNA, 21 bp, Homo sapiens
gcttctgtgcccagaatactg

SEQ ID NO: 1352531 - DNA, 13 bp, Homo sapiens
gcttcttgcctct

SEQ ID NO: 1352532 - DNA, 19 bp, Homo sapiens
gcttcttgcctctgtgctg

SEQ ID NO: 1352533 - DNA, 12 bp, Homo sapiens
gcttgaagccaa

SEQ ID NO: 1352534 - DNA, 14 bp, Homo sapiens
gcttgaagccaaag

SEQ ID NO: 1352535 - DNA, 20 bp, Homo sapiens
gcttgaccaggcttggcctt

SEQ ID NO: 1352536 - DNA, 12 bp, Homo sapiens
gcttgagccggg

SEQ ID NO: 1352537 - DNA, 14 bp, Homo sapiens
gcttggcctgctgt

SEQ ID NO: 1352538 - DNA, 15 bp, Homo sapiens
gcttggcctgctgtg

SEQ ID NO: 1352539 - DNA, 20 bp, Homo sapiens
gcttggggccaccaaagctg

SEQ ID NO: 1352540 - DNA, 16 bp, Homo sapiens
gcttggggctcacaca

SEQ ID NO: 1352541 - DNA, 13 bp, Homo sapiens
gcttgtagttctt

SEQ ID NO: 1352542 - DNA, 16 bp, Homo sapiens
gcttgtagttctttaa

SEQ ID NO: 1352543 - DNA, 20 bp, Homo sapiens
gcttgtctatactccttccc

SEQ ID NO: 1352544 - DNA, 18 bp, Homo sapiens
gcttgtgaaaatgtgttc

SEQ ID NO: 1352545 - DNA, 13 bp, Homo sapiens
gctttaagccttc

SEQ ID NO: 1352546 - DNA, 18 bp, Homo sapiens
gctttaccttttcagggc

SEQ ID NO: 1352547 - DNA, 23 bp, Homo sapiens
gctttactggggctggggaagga

SEQ ID NO: 1352548 - DNA, 14 bp, Homo sapiens
gctttagaccctgg

SEQ ID NO: 1352549 - DNA, 17 bp, Homo sapiens
gctttatttgtaaattt

SEQ ID NO: 1352550 - DNA, 20 bp, Homo sapiens
gctttcacggaaactcccga

SEQ ID NO: 1352551 - DNA, 15 bp, Homo sapiens
gctttcagaagtgcc

SEQ ID NO: 1352552 - DNA, 22 bp, Homo sapiens
gctttccaaaccttatctccac

SEQ ID NO: 1352553 - DNA, 21 bp, Homo sapiens
gctttcccacttcccaccctg

SEQ ID NO: 1352554 - DNA, 23 bp, Homo sapiens
gctttctggggcctagcgatctc

SEQ ID NO: 1352555 - DNA, 16 bp, Homo sapiens
gctttgccatgtgctt

SEQ ID NO: 1352556 - DNA, 14 bp, Homo sapiens
gcttttacttaaac

SEQ ID NO: 1352557 - DNA, 16 bp, Homo sapiens
gcttttatagaggcta

SEQ ID NO: 1352558 - DNA, 15 bp, Homo sapiens
gcttttattaatgca

SEQ ID NO: 1352559 - DNA, 18 bp, Homo sapiens
gcttttattaatgcactt

SEQ ID NO: 1352560 - DNA, 19 bp, Homo sapiens
gcttttattaatgcacttt

SEQ ID NO: 1352561 - DNA, 15 bp, Homo sapiens
gcttttccttggcat

SEQ ID NO: 1352562 - DNA, 22 bp, Homo sapiens
gcttttctgccctggctgctgc

SEQ ID NO: 1352563 - DNA, 18 bp, Homo sapiens
gcttttggggagccagaa

SEQ ID NO: 1352564 - DNA, 16 bp, Homo sapiens
gctttttgtgtttttt

SEQ ID NO: 1352565 - DNA, 13 bp, Homo sapiens
ggaaaacatttgc

SEQ ID NO: 1352566 - DNA, 14 bp, Homo sapiens
ggaaaacatttgct

SEQ ID NO: 1352567 - DNA, 13 bp, Homo sapiens
ggaaaactgtgtt

SEQ ID NO: 1352568 - DNA, 18 bp, Homo sapiens
ggaaactccacatctgcc

SEQ ID NO: 1352569 - DNA, 14 bp, Homo sapiens
ggaaagacactgcc

SEQ ID NO: 1352570 - DNA, 16 bp, Homo sapiens
ggaaagacactgcctg

SEQ ID NO: 1352571 - DNA, 18 bp, Homo sapiens
ggaaaggggagagcctgc

SEQ ID NO: 1352572 - DNA, 20 bp, Homo sapiens
ggaaaggggtcggctgacca

SEQ ID NO: 1352573 - DNA, 18 bp, Homo sapiens
ggaaatcagccaagtttt

SEQ ID NO: 1352574 - DNA, 23 bp, Homo sapiens
ggaaattttacaagggcataaag

SEQ ID NO: 1352575 - DNA, 13 bp, Homo sapiens
ggaacaagttgag

SEQ ID NO: 1352576 - DNA, 23 bp, Homo sapiens
ggaacaagttgagctatgactta

SEQ ID NO: 1352577 - DNA, 21 bp, Homo sapiens
ggaacctccccagcctgcgcc

SEQ ID NO: 1352578 - DNA, 16 bp, Homo sapiens
ggaagacaatgtgaaa

SEQ ID NO: 1352579 - DNA, 22 bp, Homo sapiens
ggaagacaatgtgaaaagaaaa

SEQ ID NO: 1352580 - DNA, 13 bp, Homo sapiens
ggaagagaaaaaa

SEQ ID NO: 1352581 - DNA, 20 bp, Homo sapiens
ggaagcccatcctgaccagc

SEQ ID NO: 1352582 - DNA, 15 bp, Homo sapiens
ggaagggtttctcta

SEQ ID NO: 1352583 - DNA, 21 bp, Homo sapiens
ggaataacttttacacgacca

SEQ ID NO: 1352584 - DNA, 13 bp, Homo sapiens
ggaatcctggcag

SEQ ID NO: 1352585 - DNA, 13 bp, Homo sapiens
ggaattgtggcta

SEQ ID NO: 1352586 - DNA, 12 bp, Homo sapiens
ggacaaagtgcc

SEQ ID NO: 1352587 - DNA, 22 bp, Homo sapiens
ggacactccagggacacacagc

SEQ ID NO: 1352588 - DNA, 18 bp, Homo sapiens
ggacatgcaataaaattt

SEQ ID NO: 1352589 - DNA, 18 bp, Homo sapiens
ggaccaccctgagccggc

SEQ ID NO: 1352590 - DNA, 12 bp, Homo sapiens
ggaccagggcct

SEQ ID NO: 1352591 - DNA, 16 bp, Homo sapiens
ggaccctgtgacatgg

SEQ ID NO: 1352592 - DNA, 17 bp, Homo sapiens
ggacctaaatggcctca

SEQ ID NO: 1352593 - DNA, 23 bp, Homo sapiens
ggacctcaggtgagaagcagagg

SEQ ID NO: 1352594 - DNA, 18 bp, Homo sapiens
ggacctttccaccacagc

SEQ ID NO: 1352595 - DNA, 16 bp, Homo sapiens
ggaccttttgttttct

SEQ ID NO: 1352596 - DNA, 12 bp, Homo sapiens
ggacggccaaga

SEQ ID NO: 1352597 - DNA, 16 bp, Homo sapiens
ggacgggttagacagc

SEQ ID NO: 1352598 - DNA, 21 bp, Homo sapiens
ggacggtgcccaagccagagg

SEQ ID NO: 1352599 - DNA, 16 bp, Homo sapiens
ggactgactgaggcag

SEQ ID NO: 1352600 - DNA, 17 bp, Homo sapiens
ggacttctacctgccct

SEQ ID NO: 1352601 - DNA, 12 bp, Homo sapiens
ggactttgtaca

SEQ ID NO: 1352602 - DNA, 13 bp, Homo sapiens
ggacttttctgca

SEQ ID NO: 1352603 - DNA, 18 bp, Homo sapiens
ggagaagcccgtgtgaga

SEQ ID NO: 1352604 - DNA, 17 bp, Homo sapiens
ggagaagcggctggcag

SEQ ID NO: 1352605 - DNA, 13 bp, Homo sapiens
ggagaagctgcag

SEQ ID NO: 1352606 - DNA, 17 bp, Homo sapiens
ggagaagggaagttgaa

SEQ ID NO: 1352607 - DNA, 19 bp, Homo sapiens
ggagacgccatgtgatgga

SEQ ID NO: 1352608 - DNA, 22 bp, Homo sapiens
ggagacttagggcaccaggggt

SEQ ID NO: 1352609 - DNA, 16 bp, Homo sapiens
ggagacttgccagagc

SEQ ID NO: 1352610 - DNA, 22 bp, Homo sapiens
ggagacttgccagagccgggca

SEQ ID NO: 1352611 - DNA, 19 bp, Homo sapiens
ggagactttgatgtcagca

SEQ ID NO: 1352612 - DNA, 12 bp, Homo sapiens
ggagagacagct

SEQ ID NO: 1352613 - DNA, 19 bp, Homo sapiens
ggagagagagagagagagg

SEQ ID NO: 1352614 - DNA, 14 bp, Homo sapiens
ggagagcctgctgg

SEQ ID NO: 1352615 - DNA, 16 bp, Homo sapiens
ggagagcctgctggca

SEQ ID NO: 1352616 - DNA, 15 bp, Homo sapiens
ggagagctagcagca

SEQ ID NO: 1352617 - DNA, 17 bp, Homo sapiens
ggagagctagcagcagg

SEQ ID NO: 1352618 - DNA, 21 bp, Homo sapiens
ggagagctagcagcagggagg

SEQ ID NO: 1352619 - DNA, 17 bp, Homo sapiens
ggagagggaggtcactg

SEQ ID NO: 1352620 - DNA, 15 bp, Homo sapiens
ggagaggggcacagg

SEQ ID NO: 1352621 - DNA, 15 bp, Homo sapiens
ggagatcctcctgca

SEQ ID NO: 1352622 - DNA, 12 bp, Homo sapiens
ggagattataat

SEQ ID NO: 1352623 - DNA, 14 bp, Homo sapiens
ggagattataataa

SEQ ID NO: 1352624 - DNA, 15 bp, Homo sapiens
ggagccagcctccct

SEQ ID NO: 1352625 - DNA, 21 bp, Homo sapiens
ggagccgaggcctaccccgca

SEQ ID NO: 1352626 - DNA, 19 bp, Homo sapiens
ggagccggtaactgtcctg

SEQ ID NO: 1352627 - DNA, 19 bp, Homo sapiens
ggagcggaggttgcagtga

SEQ ID NO: 1352628 - DNA, 20 bp, Homo sapiens
ggagctccactctgcttctc

SEQ ID NO: 1352629 - DNA, 12 bp, Homo sapiens
ggagctgggccc

SEQ ID NO: 1352630 - DNA, 18 bp, Homo sapiens
ggaggaacactgcactct

SEQ ID NO: 1352631 - DNA, 14 bp, Homo sapiens
ggaggaaggcaaga

SEQ ID NO: 1352632 - DNA, 13 bp, Homo sapiens
ggaggaggaaggc

SEQ ID NO: 1352633 - DNA, 23 bp, Homo sapiens
ggaggatcacttgagtccagaag

SEQ ID NO: 1352634 - DNA, 13 bp, Homo sapiens
ggaggcagccgcc

SEQ ID NO: 1352635 - DNA, 17 bp, Homo sapiens
ggaggcagggaggcagc

SEQ ID NO: 1352636 - DNA, 18 bp, Homo sapiens
ggaggcagggaggcagcc

SEQ ID NO: 1352637 - DNA, 14 bp, Homo sapiens
ggaggccccagggg

SEQ ID NO: 1352638 - DNA, 19 bp, Homo sapiens
ggaggcctgcgaccctggg

SEQ ID NO: 1352639 - DNA, 20 bp, Homo sapiens
ggaggcctgcgaccctgggg

SEQ ID NO: 1352640 - DNA, 20 bp, Homo sapiens
ggaggcggagcttgcagtga

SEQ ID NO: 1352641 - DNA, 15 bp, Homo sapiens
ggaggcttcctgcgt

SEQ ID NO: 1352642 - DNA, 13 bp, Homo sapiens
ggagggagaggga

SEQ ID NO: 1352643 - DNA, 17 bp, Homo sapiens
ggagggattctggttcc

SEQ ID NO: 1352644 - DNA, 21 bp, Homo sapiens
ggagggcggcaggggcctgga

SEQ ID NO: 1352645 - DNA, 17 bp, Homo sapiens
ggaggggtgtggcagtg

SEQ ID NO: 1352646 - DNA, 13 bp, Homo sapiens
ggagggtaaataa

SEQ ID NO: 1352647 - DNA, 13 bp, Homo sapiens
ggagggtgggaag

SEQ ID NO: 1352648 - DNA, 13 bp, Homo sapiens
ggaggtcactgga

SEQ ID NO: 1352649 - DNA, 18 bp, Homo sapiens
ggaggtgtggagccgagg

SEQ ID NO: 1352650 - DNA, 14 bp, Homo sapiens
ggaggttgaagcca

SEQ ID NO: 1352651 - DNA, 14 bp, Homo sapiens
ggaggttgcagtga

SEQ ID NO: 1352652 - DNA, 13 bp, Homo sapiens
ggagtattgaatg

SEQ ID NO: 1352653 - DNA, 22 bp, Homo sapiens
ggataaagaatactatttccaa

SEQ ID NO: 1352654 - DNA, 16 bp, Homo sapiens
ggatcaggctcccagg

SEQ ID NO: 1352655 - DNA, 23 bp, Homo sapiens
ggatccccgcctggccaggagca

SEQ ID NO: 1352656 - DNA, 18 bp, Homo sapiens
ggatctcttgagcctggg

SEQ ID NO: 1352657 - DNA, 23 bp, Homo sapiens
ggatgatgtctttttattaaaat

SEQ ID NO: 1352658 - DNA, 13 bp, Homo sapiens
ggatgatttaagt

SEQ ID NO: 1352659 - DNA, 18 bp, Homo sapiens
ggatggaggaagaactga

SEQ ID NO: 1352660 - DNA, 14 bp, Homo sapiens
ggatggccccagca

SEQ ID NO: 1352661 - DNA, 18 bp, Homo sapiens
ggatgttactctcttgca

SEQ ID NO: 1352662 - DNA, 14 bp, Homo sapiens
ggattagtttagaa

SEQ ID NO: 1352663 - DNA, 21 bp, Homo sapiens
ggattcaggaatgtgtggcct

SEQ ID NO: 1352664 - DNA, 22 bp, Homo sapiens
ggattccactcgtgtgtttcta

SEQ ID NO: 1352665 - DNA, 14 bp, Homo sapiens
ggattctaaataca

SEQ ID NO: 1352666 - DNA, 14 bp, Homo sapiens
ggattctggttcca

SEQ ID NO: 1352667 - DNA, 19 bp, Homo sapiens
ggattgaaaatgtccagga

SEQ ID NO: 1352668 - DNA, 15 bp, Homo sapiens
ggatttgttgccatg

SEQ ID NO: 1352669 - DNA, 15 bp, Homo sapiens
ggcaaaaaggcagga

SEQ ID NO: 1352670 - DNA, 12 bp, Homo sapiens
ggcaaaactcta

SEQ ID NO: 1352671 - DNA, 16 bp, Homo sapiens
ggcaaaggaaggtgga

SEQ ID NO: 1352672 - DNA, 17 bp, Homo sapiens
ggcaaaggaaggtggat

SEQ ID NO: 1352673 - DNA, 19 bp, Homo sapiens
ggcaaaggaaggtggatgg

SEQ ID NO: 1352674 - DNA, 18 bp, Homo sapiens
ggcaactgcattggcttt

SEQ ID NO: 1352675 - DNA, 18 bp, Homo sapiens
ggcaagctccgcaggact

SEQ ID NO: 1352676 - DNA, 16 bp, Homo sapiens
ggcaatggtagtttct

SEQ ID NO: 1352677 - DNA, 12 bp, Homo sapiens
ggcacaggaggc

SEQ ID NO: 1352678 - DNA, 16 bp, Homo sapiens
ggcacaggaggcaggc

SEQ ID NO: 1352679 - DNA, 18 bp, Homo sapiens
ggcacattgagctgtgca

SEQ ID NO: 1352680 - DNA, 17 bp, Homo sapiens
ggcaccagcagcctgga

SEQ ID NO: 1352681 - DNA, 17 bp, Homo sapiens
ggcacgcactgggttgc

SEQ ID NO: 1352682 - DNA, 16 bp, Homo sapiens
ggcactagccaaagcg

SEQ ID NO: 1352683 - DNA, 16 bp, Homo sapiens
ggcagagctggctctg

SEQ ID NO: 1352684 - DNA, 17 bp, Homo sapiens
ggcagagctggctctga

SEQ ID NO: 1352685 - DNA, 20 bp, Homo sapiens
ggcagattttacagagcgca

SEQ ID NO: 1352686 - DNA, 21 bp, Homo sapiens
ggcagattttacagagcgcac

SEQ ID NO: 1352687 - DNA, 13 bp, Homo sapiens
ggcagccccagcc

SEQ ID NO: 1352688 - DNA, 17 bp, Homo sapiens
ggcagccccagcctgct

SEQ ID NO: 1352689 - DNA, 18 bp, Homo sapiens
ggcagccccagcctgcta

SEQ ID NO: 1352690 - DNA, 16 bp, Homo sapiens
ggcaggcatggccctg

SEQ ID NO: 1352691 - DNA, 16 bp, Homo sapiens
ggcaggctcactgcca

SEQ ID NO: 1352692 - DNA, 19 bp, Homo sapiens
ggcaggctcactgccaggc

SEQ ID NO: 1352693 - DNA, 13 bp, Homo sapiens
ggcaggctgggcc

SEQ ID NO: 1352694 - DNA, 14 bp, Homo sapiens
ggcagggaggcagc

SEQ ID NO: 1352695 - DNA, 15 bp, Homo sapiens
ggcagggaggcagcc

SEQ ID NO: 1352696 - DNA, 14 bp, Homo sapiens
ggcaggggacagga

SEQ ID NO: 1352697 - DNA, 17 bp, Homo sapiens
ggcaggggcctggagat

SEQ ID NO: 1352698 - DNA, 13 bp, Homo sapiens
ggcaggggtgggg

SEQ ID NO: 1352699 - DNA, 19 bp, Homo sapiens
ggcaggtgctggagcactg

SEQ ID NO: 1352700 - DNA, 21 bp, Homo sapiens
ggcatagctccccgcttctgc

SEQ ID NO: 1352701 - DNA, 21 bp, Homo sapiens
ggcatcgcaccattctgactc

SEQ ID NO: 1352702 - DNA, 16 bp, Homo sapiens
ggcatctatctgtgct

SEQ ID NO: 1352703 - DNA, 19 bp, Homo sapiens
ggcattgagtattgtttaa

SEQ ID NO: 1352704 - DNA, 14 bp, Homo sapiens
ggcatttgctgaat

SEQ ID NO: 1352705 - DNA, 15 bp, Homo sapiens
ggccaagaagcagtg

SEQ ID NO: 1352706 - DNA, 12 bp, Homo sapiens
ggccacatggcg

SEQ ID NO: 1352707 - DNA, 11 bp, Homo sapiens
ggccactgtga

SEQ ID NO: 1352708 - DNA, 22 bp, Homo sapiens
ggccagagagcctggtgctgct

SEQ ID NO: 1352709 - DNA, 13 bp, Homo sapiens
ggccaggagcagg

SEQ ID NO: 1352710 - DNA, 15 bp, Homo sapiens
ggccagtccaggctg

SEQ ID NO: 1352711 - DNA, 21 bp, Homo sapiens
ggccagtccaggctgccgtgg

SEQ ID NO: 1352712 - DNA, 15 bp, Homo sapiens
ggccagtctgtggat

SEQ ID NO: 1352713 - DNA, 15 bp, Homo sapiens
ggccatgctgaggcc

SEQ ID NO: 1352714 - DNA, 18 bp, Homo sapiens
ggccatgctgaggcctgg

SEQ ID NO: 1352715 - DNA, 13 bp, Homo sapiens
ggccatgtccaaa

SEQ ID NO: 1352716 - DNA, 23 bp, Homo sapiens
ggccatttgcaataacagctgca

SEQ ID NO: 1352717 - DNA, 22 bp, Homo sapiens
ggcccagggcaagctccgcagg

SEQ ID NO: 1352718 - DNA, 13 bp, Homo sapiens
ggccccaccctgg

SEQ ID NO: 1352719 - DNA, 18 bp, Homo sapiens
ggccccagcacagcttga

SEQ ID NO: 1352720 - DNA, 17 bp, Homo sapiens
ggccccagcacctcagc

SEQ ID NO: 1352721 - DNA, 14 bp, Homo sapiens
ggccccagccctgc

SEQ ID NO: 1352722 - DNA, 16 bp, Homo sapiens
ggccccagccctgctg

SEQ ID NO: 1352723 - DNA, 20 bp, Homo sapiens
ggcccccaacctcagggctc

SEQ ID NO: 1352724 - DNA, 20 bp, Homo sapiens
ggcccccagcccagggctcc

SEQ ID NO: 1352725 - DNA, 11 bp, Homo sapiens
ggccccctgcc

SEQ ID NO: 1352726 - DNA, 18 bp, Homo sapiens
ggccccgtttctggtggt

SEQ ID NO: 1352727 - DNA, 13 bp, Homo sapiens
ggcccgacatggc

SEQ ID NO: 1352728 - DNA, 18 bp, Homo sapiens
ggcccgcgccacaggacc

SEQ ID NO: 1352729 - DNA, 22 bp, Homo sapiens
ggccctagactcggggtgcttc

SEQ ID NO: 1352730 - DNA, 18 bp, Homo sapiens
ggccctgagtctgggcag

SEQ ID NO: 1352731 - DNA, 12 bp, Homo sapiens
ggccctgggctg

SEQ ID NO: 1352732 - DNA, 15 bp, Homo sapiens
ggccctgggttcctc

SEQ ID NO: 1352733 - DNA, 14 bp, Homo sapiens
ggccctgtgtgcag

SEQ ID NO: 1352734 - DNA, 18 bp, Homo sapiens
ggccgcgcgtccagctgc

SEQ ID NO: 1352735 - DNA, 17 bp, Homo sapiens
ggccgctgagtggcagg

SEQ ID NO: 1352736 - DNA, 12 bp, Homo sapiens
ggccgctgccac

SEQ ID NO: 1352737 - DNA, 18 bp, Homo sapiens
ggccggcagccccagcct

SEQ ID NO: 1352738 - DNA, 18 bp, Homo sapiens
ggccgtatctccggctcc

SEQ ID NO: 1352739 - DNA, 23 bp, Homo sapiens
ggcctaccccgcagacaccttgg

SEQ ID NO: 1352740 - DNA, 22 bp, Homo sapiens
ggcctagcgatctctcctggcc

SEQ ID NO: 1352741 - DNA, 15 bp, Homo sapiens
ggcctcatgtggctg

SEQ ID NO: 1352742 - DNA, 16 bp, Homo sapiens
ggcctcatgtggctgg

SEQ ID NO: 1352743 - DNA, 19 bp, Homo sapiens
ggcctcccctgccaccagg

SEQ ID NO: 1352744 - DNA, 23 bp, Homo sapiens
ggcctgcgaccctgggggcacag

SEQ ID NO: 1352745 - DNA, 11 bp, Homo sapiens
ggcctggagat

SEQ ID NO: 1352746 - DNA, 14 bp, Homo sapiens
ggcctggagatcct

SEQ ID NO: 1352747 - DNA, 17 bp, Homo sapiens
ggcctggagatcctcct

SEQ ID NO: 1352748 - DNA, 20 bp, Homo sapiens
ggcctggagatcctcctgca

SEQ ID NO: 1352749 - DNA, 16 bp, Homo sapiens
ggccttaatttccttt

SEQ ID NO: 1352750 - DNA, 14 bp, Homo sapiens
ggcctttggcttca

SEQ ID NO: 1352751 - DNA, 22 bp, Homo sapiens
ggcgagagtctggccctagact

SEQ ID NO: 1352752 - DNA, 14 bp, Homo sapiens
ggcgcaggtgggct

SEQ ID NO: 1352753 - DNA, 21 bp, Homo sapiens
ggcgctgcccacctgccggcc

SEQ ID NO: 1352754 - DNA, 21 bp, Homo sapiens
ggcggagcttgcagtgagccg

SEQ ID NO: 1352755 - DNA, 20 bp, Homo sapiens
ggcggatcatctaattctct

SEQ ID NO: 1352756 - DNA, 18 bp, Homo sapiens
ggcggcaggggcctggag

SEQ ID NO: 1352757 - DNA, 18 bp, Homo sapiens
ggcgtggagggaggcccc

SEQ ID NO: 1352758 - DNA, 20 bp, Homo sapiens
ggctagcttctgcttttctg

SEQ ID NO: 1352759 - DNA, 22 bp, Homo sapiens
ggctagcttctgcttttctgcc

SEQ ID NO: 1352760 - DNA, 13 bp, Homo sapiens
ggctatcctgatt

SEQ ID NO: 1352761 - DNA, 18 bp, Homo sapiens
ggctattttctaaagact

SEQ ID NO: 1352762 - DNA, 20 bp, Homo sapiens
ggctattttctaaagacttg

SEQ ID NO: 1352763 - DNA, 13 bp, Homo sapiens
ggctcacgcctgt

SEQ ID NO: 1352764 - DNA, 16 bp, Homo sapiens
ggctcactgccaggcc

SEQ ID NO: 1352765 - DNA, 18 bp, Homo sapiens
ggctcactgccaggccag

SEQ ID NO: 1352766 - DNA, 21 bp, Homo sapiens
ggctcactgccaggccagcct

SEQ ID NO: 1352767 - DNA, 23 bp, Homo sapiens
ggctcagcaaaagatgcttctca

SEQ ID NO: 1352768 - DNA, 12 bp, Homo sapiens
ggctcagggtgg

SEQ ID NO: 1352769 - DNA, 16 bp, Homo sapiens
ggctcccagcctcagc

SEQ ID NO: 1352770 - DNA, 17 bp, Homo sapiens
ggctcccagcctcagcg

SEQ ID NO: 1352771 - DNA, 12 bp, Homo sapiens
ggctcccagggg

SEQ ID NO: 1352772 - DNA, 12 bp, Homo sapiens
ggctcccctgag

SEQ ID NO: 1352773 - DNA, 13 bp, Homo sapiens
ggctcccctgagg

SEQ ID NO: 1352774 - DNA, 14 bp, Homo sapiens
ggctccggcctctg

SEQ ID NO: 1352775 - DNA, 9 bp, Homo sapiens
ggctcctgc

SEQ ID NO: 1352776 - DNA, 13 bp, Homo sapiens
ggctcgtggactg

SEQ ID NO: 1352777 - DNA, 23 bp, Homo sapiens
ggctctattccaataaactatga

SEQ ID NO: 1352778 - DNA, 23 bp, Homo sapiens
ggctctccggggccatttgcaat

SEQ ID NO: 1352779 - DNA, 15 bp, Homo sapiens
ggctctgagcgcctc

SEQ ID NO: 1352780 - DNA, 22 bp, Homo sapiens
ggctctgcagtcctactcaagc

SEQ ID NO: 1352781 - DNA, 21 bp, Homo sapiens
ggctgaaattctcctggaggt

SEQ ID NO: 1352782 - DNA, 22 bp, Homo sapiens
ggctgaaattctcctggaggtc

SEQ ID NO: 1352783 - DNA, 13 bp, Homo sapiens
ggctgaggtggga

SEQ ID NO: 1352784 - DNA, 14 bp, Homo sapiens
ggctgaggttcctc

SEQ ID NO: 1352785 - DNA, 18 bp, Homo sapiens
ggctgaggttcctctgcc

SEQ ID NO: 1352786 - DNA, 23 bp, Homo sapiens
ggctgatggtgtggcctgtggct

SEQ ID NO: 1352787 - DNA, 18 bp, Homo sapiens
ggctgatgtcaatttctg

SEQ ID NO: 1352788 - DNA, 15 bp, Homo sapiens
ggctgcccctctcac

SEQ ID NO: 1352789 - DNA, 18 bp, Homo sapiens
ggctgcccttgggccacc

SEQ ID NO: 1352790 - DNA, 10 bp, Homo sapiens
ggctgctgcc

SEQ ID NO: 1352791 - DNA, 11 bp, Homo sapiens
ggctgctgccc

SEQ ID NO: 1352792 - DNA, 17 bp, Homo sapiens
ggctgctgcccccaccc

SEQ ID NO: 1352793 - DNA, 22 bp, Homo sapiens
ggctgctgggggcaactggcca

SEQ ID NO: 1352794 - DNA, 14 bp, Homo sapiens
ggctgctgtgaagc

SEQ ID NO: 1352795 - DNA, 16 bp, Homo sapiens
ggctgcttcctcctgg

SEQ ID NO: 1352796 - DNA, 20 bp, Homo sapiens
ggctggagtgcagtggcgca

SEQ ID NO: 1352797 - DNA, 13 bp, Homo sapiens
ggctggctcctga

SEQ ID NO: 1352798 - DNA, 15 bp, Homo sapiens
ggctgtcggcgctgc

SEQ ID NO: 1352799 - DNA, 14 bp, Homo sapiens
ggctgtgctgccct

SEQ ID NO: 1352800 - DNA, 15 bp, Homo sapiens
ggctgtgctgccctg

SEQ ID NO: 1352801 - DNA, 18 bp, Homo sapiens
ggctgttctgtggttcct

SEQ ID NO: 1352802 - DNA, 20 bp, Homo sapiens
ggcttcacggaagagccttg

SEQ ID NO: 1352803 - DNA, 21 bp, Homo sapiens
ggcttcacggaagagccttgc

SEQ ID NO: 1352804 - DNA, 20 bp, Homo sapiens
ggcttcctgcgtcctcctca

SEQ ID NO: 1352805 - DNA, 16 bp, Homo sapiens
ggcttctccgccagcc

SEQ ID NO: 1352806 - DNA, 17 bp, Homo sapiens
ggcttctccgccagcct

SEQ ID NO: 1352807 - DNA, 16 bp, Homo sapiens
ggcttgaagccaaaga

SEQ ID NO: 1352808 - DNA, 14 bp, Homo sapiens
ggcttgaagctgtg

SEQ ID NO: 1352809 - DNA, 15 bp, Homo sapiens
ggcttggcctgctgt

SEQ ID NO: 1352810 - DNA, 19 bp, Homo sapiens
ggcttgttcatcatccaga

SEQ ID NO: 1352811 - DNA, 19 bp, Homo sapiens
ggcttttattaatgcactt

SEQ ID NO: 1352812 - DNA, 20 bp, Homo sapiens
ggcttttattaatgcacttt

SEQ ID NO: 1352813 - DNA, 22 bp, Homo sapiens
gggaaaactgccaatatagaaa

SEQ ID NO: 1352814 - DNA, 23 bp, Homo sapiens
gggaaaagcatttttcaatatat

SEQ ID NO: 1352815 - DNA, 13 bp, Homo sapiens
gggaaagacactg

SEQ ID NO: 1352816 - DNA, 17 bp, Homo sapiens
gggaaagacactgcctg

SEQ ID NO: 1352817 - DNA, 23 bp, Homo sapiens
gggaaatcgagtgccgcatctca

SEQ ID NO: 1352818 - DNA, 16 bp, Homo sapiens
gggaacctccccagcc

SEQ ID NO: 1352819 - DNA, 18 bp, Homo sapiens
gggaacctccccagcctg

SEQ ID NO: 1352820 - DNA, 14 bp, Homo sapiens
gggaacctgtgtcc

SEQ ID NO: 1352821 - DNA, 15 bp, Homo sapiens
gggaacctgtgtccg

SEQ ID NO: 1352822 - DNA, 19 bp, Homo sapiens
gggaagcccatcctgacca

SEQ ID NO: 1352823 - DNA, 18 bp, Homo sapiens
gggaatccaagcctccac

SEQ ID NO: 1352824 - DNA, 22 bp, Homo sapiens
gggaatccaagcctccacagcg

SEQ ID NO: 1352825 - DNA, 22 bp, Homo sapiens
gggaatctaagagagctgccat

SEQ ID NO: 1352826 - DNA, 18 bp, Homo sapiens
gggacatcacagggtggg

SEQ ID NO: 1352827 - DNA, 12 bp, Homo sapiens
gggacccagtgc

SEQ ID NO: 1352828 - DNA, 20 bp, Homo sapiens
gggaccggcggaccccagcc

SEQ ID NO: 1352829 - DNA, 17 bp, Homo sapiens
gggacctgccaggcagg

SEQ ID NO: 1352830 - DNA, 22 bp, Homo sapiens
gggagaagaaaggtgagtttga

SEQ ID NO: 1352831 - DNA, 12 bp, Homo sapiens
gggagacagcat

SEQ ID NO: 1352832 - DNA, 13 bp, Homo sapiens
gggagagcctgct

SEQ ID NO: 1352833 - DNA, 19 bp, Homo sapiens
gggagccatgcgccccctc

SEQ ID NO: 1352834 - DNA, 22 bp, Homo sapiens
gggagcctttggttctggccag

SEQ ID NO: 1352835 - DNA, 13 bp, Homo sapiens
gggaggagggaga

SEQ ID NO: 1352836 - DNA, 17 bp, Homo sapiens
gggaggagggagaggga

SEQ ID NO: 1352837 - DNA, 23 bp, Homo sapiens
gggaggattgcttgagctcagga

SEQ ID NO: 1352838 - DNA, 14 bp, Homo sapiens
gggaggccccaggg

SEQ ID NO: 1352839 - DNA, 15 bp, Homo sapiens
gggaggccgaggcgg

SEQ ID NO: 1352840 - DNA, 22 bp, Homo sapiens
gggagggattctggttccaggg

SEQ ID NO: 1352841 - DNA, 21 bp, Homo sapiens
gggagggcggcaggggcctgg

SEQ ID NO: 1352842 - DNA, 16 bp, Homo sapiens
gggaggggaaaagcat

SEQ ID NO: 1352843 - DNA, 15 bp, Homo sapiens
gggaggtcgaggcag

SEQ ID NO: 1352844 - DNA, 17 bp, Homo sapiens
gggaggtcgaggcagga

SEQ ID NO: 1352845 - DNA, 23 bp, Homo sapiens
gggaggtggaagaagggagaaga

SEQ ID NO: 1352846 - DNA, 21 bp, Homo sapiens
gggatatgatttaaatcagcc

SEQ ID NO: 1352847 - DNA, 20 bp, Homo sapiens
gggatccccgcctggccagg

SEQ ID NO: 1352848 - DNA, 23 bp, Homo sapiens
gggatccccgcctggccaggagc

SEQ ID NO: 1352849 - DNA, 20 bp, Homo sapiens
gggatgaaactaaagcaata

SEQ ID NO: 1352850 - DNA, 14 bp, Homo sapiens
gggcaaacaggcag

SEQ ID NO: 1352851 - DNA, 13 bp, Homo sapiens
gggcaagaggaat

SEQ ID NO: 1352852 - DNA, 11 bp, Homo sapiens
gggcagagctg

SEQ ID NO: 1352853 - DNA, 19 bp, Homo sapiens
gggcagagctggctctgag

SEQ ID NO: 1352854 - DNA, 12 bp, Homo sapiens
gggcaggctggg

SEQ ID NO: 1352855 - DNA, 16 bp, Homo sapiens
gggcaggctgggccat

SEQ ID NO: 1352856 - DNA, 15 bp, Homo sapiens
gggcagggagctggg

SEQ ID NO: 1352857 - DNA, 18 bp, Homo sapiens
gggcagggagctgggccc

SEQ ID NO: 1352858 - DNA, 13 bp, Homo sapiens
gggcaggggctgg

SEQ ID NO: 1352859 - DNA, 17 bp, Homo sapiens
gggcaggttggtggggg

SEQ ID NO: 1352860 - DNA, 14 bp, Homo sapiens
gggccaccaaagct

SEQ ID NO: 1352861 - DNA, 19 bp, Homo sapiens
gggccaccaaagctgccca

SEQ ID NO: 1352862 - DNA, 22 bp, Homo sapiens
gggccactggtccccaacaatg

SEQ ID NO: 1352863 - DNA, 19 bp, Homo sapiens
gggccatgctgaggcctgg

SEQ ID NO: 1352864 - DNA, 15 bp, Homo sapiens
gggccatggctcagg

SEQ ID NO: 1352865 - DNA, 13 bp, Homo sapiens
gggcccagtgcat

SEQ ID NO: 1352866 - DNA, 20 bp, Homo sapiens
gggccgaccagaggagcctt

SEQ ID NO: 1352867 - DNA, 24 bp, Homo sapiens
gggccgtatctccggctcccagcc

SEQ ID NO: 1352868 - DNA, 12 bp, Homo sapiens
gggcctggagat

SEQ ID NO: 1352869 - DNA, 20 bp, Homo sapiens
gggcctttgttctgggggga

SEQ ID NO: 1352870 - DNA, 16 bp, Homo sapiens
gggcgcggtggctcac

SEQ ID NO: 1352871 - DNA, 21 bp, Homo sapiens
gggcggcaggggcctggagat

SEQ ID NO: 1352872 - DNA, 15 bp, Homo sapiens
gggcgtggagggagg

SEQ ID NO: 1352873 - DNA, 14 bp, Homo sapiens
gggctagggagacg

SEQ ID NO: 1352874 - DNA, 13 bp, Homo sapiens
gggctcccagggg

SEQ ID NO: 1352875 - DNA, 11 bp, Homo sapiens
gggctcctgca

SEQ ID NO: 1352876 - DNA, 22 bp, Homo sapiens
gggctcctgcacttacttgctt

SEQ ID NO: 1352877 - DNA, 20 bp, Homo sapiens
gggctgcggcgtacaggctg

SEQ ID NO: 1352878 - DNA, 22 bp, Homo sapiens
gggctgcggcgtacaggctggc

SEQ ID NO: 1352879 - DNA, 19 bp, Homo sapiens
gggctgcttcctcctggaa

SEQ ID NO: 1352880 - DNA, 19 bp, Homo sapiens
gggcttatatctggcctct

SEQ ID NO: 1352881 - DNA, 13 bp, Homo sapiens
gggcttgaagcca

SEQ ID NO: 1352882 - DNA, 15 bp, Homo sapiens
gggcttgaagccaaa

SEQ ID NO: 1352883 - DNA, 13 bp, Homo sapiens
gggcttggcctgc

SEQ ID NO: 1352884 - DNA, 17 bp, Homo sapiens
gggcttggcctgctgtg

SEQ ID NO: 1352885 - DNA, 17 bp, Homo sapiens
ggggaaaatcagcctgc

SEQ ID NO: 1352886 - DNA, 22 bp, Homo sapiens
ggggaaagacactgcctgggct

SEQ ID NO: 1352887 - DNA, 23 bp, Homo sapiens
ggggaaagacactgcctgggctg

SEQ ID NO: 1352888 - DNA, 15 bp, Homo sapiens
ggggacccagtgcag

SEQ ID NO: 1352889 - DNA, 14 bp, Homo sapiens
ggggaggagggggc

SEQ ID NO: 1352890 - DNA, 15 bp, Homo sapiens
ggggcaactgtatga

SEQ ID NO: 1352891 - DNA, 21 bp, Homo sapiens
ggggcagacaataaaccctca

SEQ ID NO: 1352892 - DNA, 19 bp, Homo sapiens
ggggcattgagtattgttt

SEQ ID NO: 1352893 - DNA, 19 bp, Homo sapiens
ggggccaccaaagctgccc

SEQ ID NO: 1352894 - DNA, 20 bp, Homo sapiens
ggggccggccctgtgtgcag

SEQ ID NO: 1352895 - DNA, 12 bp, Homo sapiens
gggggctttctg

SEQ ID NO: 1352896 - DNA, 13 bp, Homo sapiens
gggggtggccgct

SEQ ID NO: 1352897 - DNA, 14 bp, Homo sapiens
ggggtctccctggc

SEQ ID NO: 1352898 - DNA, 14 bp, Homo sapiens
ggggtgcttccttg

SEQ ID NO: 1352899 - DNA, 22 bp, Homo sapiens
ggggttcccttgagggctgcag

SEQ ID NO: 1352900 - DNA, 23 bp, Homo sapiens
ggggttcccttgagggctgcagt

SEQ ID NO: 1352901 - DNA, 21 bp, Homo sapiens
gggtcctgaggcctgcagcac

SEQ ID NO: 1352902 - DNA, 12 bp, Homo sapiens
gggtccttcctg

SEQ ID NO: 1352903 - DNA, 20 bp, Homo sapiens
gggtcggctgaccatgctca

SEQ ID NO: 1352904 - DNA, 19 bp, Homo sapiens
gggtcgggggcaggtgctg

SEQ ID NO: 1352905 - DNA, 15 bp, Homo sapiens
gggtgctgggaggag

SEQ ID NO: 1352906 - DNA, 16 bp, Homo sapiens
gggtggaggcttcctg

SEQ ID NO: 1352907 - DNA, 14 bp, Homo sapiens
gggtggaggggtgt

SEQ ID NO: 1352908 - DNA, 17 bp, Homo sapiens
gggtggatcacgaggtc

SEQ ID NO: 1352909 - DNA, 13 bp, Homo sapiens
gggtgggcctcgg

SEQ ID NO: 1352910 - DNA, 22 bp, Homo sapiens
gggtggtctcttcttggggccc

SEQ ID NO: 1352911 - DNA, 15 bp, Homo sapiens
gggtgtcttgggcag

SEQ ID NO: 1352912 - DNA, 21 bp, Homo sapiens
gggtgtcttgggcagagctgg

SEQ ID NO: 1352913 - DNA, 12 bp, Homo sapiens
ggtaaaatgaag

SEQ ID NO: 1352914 - DNA, 14 bp, Homo sapiens
ggtaaaatgaagaa

SEQ ID NO: 1352915 - DNA, 20 bp, Homo sapiens
ggtaaataaaccactgtgcg

SEQ ID NO: 1352916 - DNA, 16 bp, Homo sapiens
ggtaaatgtttctttt

SEQ ID NO: 1352917 - DNA, 21 bp, Homo sapiens
ggtaaatgtttcttttaaaga

SEQ ID NO: 1352918 - DNA, 18 bp, Homo sapiens
ggtaactagggaagataa

SEQ ID NO: 1352919 - DNA, 16 bp, Homo sapiens
ggtaactgtcctgtcc

SEQ ID NO: 1352920 - DNA, 19 bp, Homo sapiens
ggtaagaatagtagatgtg

SEQ ID NO: 1352921 - DNA, 14 bp, Homo sapiens
ggtacaacggaggc

SEQ ID NO: 1352922 - DNA, 15 bp, Homo sapiens
ggtaggttcagccaa

SEQ ID NO: 1352923 - DNA, 19 bp, Homo sapiens
ggtatttaaagtattttct

SEQ ID NO: 1352924 - DNA, 22 bp, Homo sapiens
ggtcaagttgtcaggttattta

SEQ ID NO: 1352925 - DNA, 13 bp, Homo sapiens
ggtcacaacttga

SEQ ID NO: 1352926 - DNA, 15 bp, Homo sapiens
ggtcacagcggaggt

SEQ ID NO: 1352927 - DNA, 18 bp, Homo sapiens
ggtcactgtttcctgggc

SEQ ID NO: 1352928 - DNA, 17 bp, Homo sapiens
ggtcaggagatcgagac

SEQ ID NO: 1352929 - DNA, 21 bp, Homo sapiens
ggtcagtagtttaaaagttct

SEQ ID NO: 1352930 - DNA, 12 bp, Homo sapiens
ggtccagctctg

SEQ ID NO: 1352931 - DNA, 13 bp, Homo sapiens
ggtccagctctgg

SEQ ID NO: 1352932 - DNA, 13 bp, Homo sapiens
ggtccagctggcc

SEQ ID NO: 1352933 - DNA, 15 bp, Homo sapiens
ggtccagctggcctg

SEQ ID NO: 1352934 - DNA, 22 bp, Homo sapiens
ggtccccgttccaccccaagag

SEQ ID NO: 1352935 - DNA, 20 bp, Homo sapiens
ggtcctgatttctagaaccc

SEQ ID NO: 1352936 - DNA, 12 bp, Homo sapiens
ggtcgctcctgc

SEQ ID NO: 1352937 - DNA, 13 bp, Homo sapiens
ggtcgctcctgcc

SEQ ID NO: 1352938 - DNA, 15 bp, Homo sapiens
ggtcggaacccaagc

SEQ ID NO: 1352939 - DNA, 13 bp, Homo sapiens
ggtctcacccatg

SEQ ID NO: 1352940 - DNA, 17 bp, Homo sapiens
ggtctccctggctccct

SEQ ID NO: 1352941 - DNA, 23 bp, Homo sapiens
ggtctcctgactggtgctgcagc

SEQ ID NO: 1352942 - DNA, 19 bp, Homo sapiens
ggtcttgattcagtcacat

SEQ ID NO: 1352943 - DNA, 18 bp, Homo sapiens
ggtctttaaaatattgtt

SEQ ID NO: 1352944 - DNA, 10 bp, Homo sapiens
ggtctttgag

SEQ ID NO: 1352945 - DNA, 17 bp, Homo sapiens
ggtctttgagctcccac

SEQ ID NO: 1352946 - DNA, 13 bp, Homo sapiens
ggtgaatattttc

SEQ ID NO: 1352947 - DNA, 15 bp, Homo sapiens
ggtgagaagcagagg

SEQ ID NO: 1352948 - DNA, 21 bp, Homo sapiens
ggtgagtttgagctgccttcc

SEQ ID NO: 1352949 - DNA, 23 bp, Homo sapiens
ggtgcccaagccagaggctgggt

SEQ ID NO: 1352950 - DNA, 23 bp, Homo sapiens
ggtgcccagaataagttattgca

SEQ ID NO: 1352951 - DNA, 19 bp, Homo sapiens
ggtgcctgagaggcaggca

SEQ ID NO: 1352952 - DNA, 18 bp, Homo sapiens
ggtgctggagcactgggc

SEQ ID NO: 1352953 - DNA, 22 bp, Homo sapiens
ggtgctggagcactgggctccc

SEQ ID NO: 1352954 - DNA, 15 bp, Homo sapiens
ggtgctgggaggagg

SEQ ID NO: 1352955 - DNA, 19 bp, Homo sapiens
ggtgcttttatagaggcta

SEQ ID NO: 1352956 - DNA, 19 bp, Homo sapiens
ggtggaagaagggagaaga

SEQ ID NO: 1352957 - DNA, 17 bp, Homo sapiens
ggtggccagaggtgtca

SEQ ID NO: 1352958 - DNA, 21 bp, Homo sapiens
ggtggccgctgagtggcaggg

SEQ ID NO: 1352959 - DNA, 19 bp, Homo sapiens
ggtggctcacgcctgtaat

SEQ ID NO: 1352960 - DNA, 22 bp, Homo sapiens
ggtgggcccggcccgcgccaca

SEQ ID NO: 1352961 - DNA, 12 bp, Homo sapiens
gtgtatatttga

SEQ ID NO: 1352962 - DNA, 16 bp, Homo sapiens
gtgtatgtagaagcat

SEQ ID NO: 1352963 - DNA, 19 bp, Homo sapiens
gtgtatttattttacagct

SEQ ID NO: 1352964 - DNA, 14 bp, Homo sapiens
gtgtatttgctttt

SEQ ID NO: 1352965 - DNA, 16 bp, Homo sapiens
gtgtcagcatagaagt

SEQ ID NO: 1352966 - DNA, 21 bp, Homo sapiens
gtgtccatgcgctcagggcca

SEQ ID NO: 1352967 - DNA, 13 bp, Homo sapiens
gtgtcccaggcag

SEQ ID NO: 1352968 - DNA, 21 bp, Homo sapiens
gtgtccccgctgctgtgcaac

SEQ ID NO: 1352969 - DNA, 12 bp, Homo sapiens
gtgtctttggag

SEQ ID NO: 1352970 - DNA, 17 bp, Homo sapiens
gtgtgactactccccca

SEQ ID NO: 1352971 - DNA, 23 bp, Homo sapiens
gtgtgcacatccgcgtgtgcctg

SEQ ID NO: 1352972 - DNA, 19 bp, Homo sapiens
gtgtgctgggagctccact

SEQ ID NO: 1352973 - DNA, 21 bp, Homo sapiens
gtgtggactgtggcacttgcc

SEQ ID NO: 1352974 - DNA, 21 bp, Homo sapiens
gtgtggagaagcggctggcag

SEQ ID NO: 1352975 - DNA, 23 bp, Homo sapiens
gtgtggattgcctctgaaaagtg

SEQ ID NO: 1352976 - DNA, 14 bp, Homo sapiens
gtgtggcagtggtt

SEQ ID NO: 1352977 - DNA, 12 bp, Homo sapiens
gtgtgtaaacaa

SEQ ID NO: 1352978 - DNA, 17 bp, Homo sapiens
gtgtgtgacaattctgt

SEQ ID NO: 1352979 - DNA, 14 bp, Homo sapiens
gtgtgtgtgtgcac

SEQ ID NO: 1352980 - DNA, 18 bp, Homo sapiens
gtgttaatttaagttttg

SEQ ID NO: 1352981 - DNA, 19 bp, Homo sapiens
gtgttgccacagtagaact

SEQ ID NO: 1352982 - DNA, 18 bp, Homo sapiens
gtgtttagaattgaaggt

SEQ ID NO: 1352983 - DNA, 19 bp, Homo sapiens
gtgtttcgcgggtaactgg

SEQ ID NO: 1352984 - DNA, 16 bp, Homo sapiens
gtgttttagatggttt

SEQ ID NO: 1352985 - DNA, 13 bp, Homo sapiens
gtgttttttaaga

SEQ ID NO: 1352986 - DNA, 15 bp, Homo sapiens
gttaaggtgggcccg

SEQ ID NO: 1352987 - DNA, 23 bp, Homo sapiens
gttaatttaagttttgacaagct

SEQ ID NO: 1352988 - DNA, 21 bp, Homo sapiens
gttactctcttgcaccaaatt

SEQ ID NO: 1352989 - DNA, 17 bp, Homo sapiens
gttactgtgtaaactca

SEQ ID NO: 1352990 - DNA, 16 bp, Homo sapiens
gttacttcttctctta

SEQ ID NO: 1352991 - DNA, 17 bp, Homo sapiens
gttagctgaagaattga

SEQ ID NO: 1352992 - DNA, 12 bp, Homo sapiens
gttataattttt

SEQ ID NO: 1352993 - DNA, 17 bp, Homo sapiens
gttatcaaaatagtcta

SEQ ID NO: 1352994 - DNA, 17 bp, Homo sapiens
gttattatctgggctta

SEQ ID NO: 1352995 - DNA, 13 bp, Homo sapiens
gttattgcagttt

SEQ ID NO: 1352996 - DNA, 17 bp, Homo sapiens
gttattttctacagtgg

SEQ ID NO: 1352997 - DNA, 22 bp, Homo sapiens
gttcaccttgaagaacctctca

SEQ ID NO: 1352998 - DNA, 18 bp, Homo sapiens
gttcagcagtacagccga

SEQ ID NO: 1352999 - DNA, 22 bp, Homo sapiens
gttcatcatccagatgtggcta

SEQ ID NO: 1353000 - DNA, 16 bp, Homo sapiens
gttcatcgattttcta

SEQ ID NO: 1353001 - DNA, 18 bp, Homo sapiens
gttcccatgtagccccct

SEQ ID NO: 1353002 - DNA, 19 bp, Homo sapiens
gttcccatgtagccccctg

SEQ ID NO: 1353003 - DNA, 16 bp, Homo sapiens
gttcccgcggggctgt

SEQ ID NO: 1353004 - DNA, 22 bp, Homo sapiens
gttcccttgaaactttgggaaa

SEQ ID NO: 1353005 - DNA, 12 bp, Homo sapiens
gttcctctgcct

SEQ ID NO: 1353006 - DNA, 14 bp, Homo sapiens
gttcctgtccctgc

SEQ ID NO: 1353007 - DNA, 13 bp, Homo sapiens
gttctcaatgaaa

SEQ ID NO: 1353008 - DNA, 15 bp, Homo sapiens
gttctcaatgaaaaa

SEQ ID NO: 1353009 - DNA, 19 bp, Homo sapiens
gttctccgttagctcctgt

SEQ ID NO: 1353010 - DNA, 21 bp, Homo sapiens
gttctccgttagctcctgtgg

SEQ ID NO: 1353011 - DNA, 12 bp, Homo sapiens
gttctggccaga

SEQ ID NO: 1353012 - DNA, 16 bp, Homo sapiens
gttctggctgtttgag

SEQ ID NO: 1353013 - DNA, 14 bp, Homo sapiens
gttctggggggacc

SEQ ID NO: 1353014 - DNA, 19 bp, Homo sapiens
gttctggggggacccagtg

SEQ ID NO: 1353015 - DNA, 21 bp, Homo sapiens
gttctggggggacccagtgca

SEQ ID NO: 1353016 - DNA, 15 bp, Homo sapiens
gttcttatgaggagg

SEQ ID NO: 1353017 - DNA, 23 bp, Homo sapiens
gttcttggcaataaattttgaaa

SEQ ID NO: 1353018 - DNA, 13 bp, Homo sapiens
gttctttgttcat

SEQ ID NO: 1353019 - DNA, 20 bp, Homo sapiens
gttctttgttcatagcccag

SEQ ID NO: 1353020 - DNA, 21 bp, Homo sapiens
gttgagcttcatataccagca

SEQ ID NO: 1353021 - DNA, 12 bp, Homo sapiens
gttgataaaaac

SEQ ID NO: 1353022 - DNA, 22 bp, Homo sapiens
gttgatcatgtactttttagta

SEQ ID NO: 1353023 - DNA, 17 bp, Homo sapiens
gttgatttttactgtgt

SEQ ID NO: 1353024 - DNA, 16 bp, Homo sapiens
gttgcaagatgtgaat

SEQ ID NO: 1353025 - DNA, 18 bp, Homo sapiens
gttgcaagatgtgaatta

SEQ ID NO: 1353026 - DNA, 15 bp, Homo sapiens
gttgcaggacctcag

SEQ ID NO: 1353027 - DNA, 14 bp, Homo sapiens
gttggcaaaaaggc

SEQ ID NO: 1353028 - DNA, 20 bp, Homo sapiens
gttggcaggctggccagtcc

SEQ ID NO: 1353029 - DNA, 21 bp, Homo sapiens
gttgggggaggggagactttg

SEQ ID NO: 1353030 - DNA, 21 bp, Homo sapiens
gttgggtgtctccttaagctg

SEQ ID NO: 1353031 - DNA, 14 bp, Homo sapiens
gttggtaaacagtt

SEQ ID NO: 1353032 - DNA, 18 bp, Homo sapiens
gttggtatattttatatt

SEQ ID NO: 1353033 - DNA, 18 bp, Homo sapiens
gttgtaaataatttattt

SEQ ID NO: 1353034 - DNA, 16 bp, Homo sapiens
gttgtaagaattctga

SEQ ID NO: 1353035 - DNA, 18 bp, Homo sapiens
gttgtcaggttatttatt

SEQ ID NO: 1353036 - DNA, 21 bp, Homo sapiens
gtttaaaataaaatgaaaatt

SEQ ID NO: 1353037 - DNA, 13 bp, Homo sapiens
gtttaaaatgtaa

SEQ ID NO: 1353038 - DNA, 19 bp, Homo sapiens
gtttaatattgagaaagaa

SEQ ID NO: 1353039 - DNA, 20 bp, Homo sapiens
gtttaatcatagttactgtg

SEQ ID NO: 1353040 - DNA, 12 bp, Homo sapiens
gtttagaacagg

SEQ ID NO: 1353041 - DNA, 15 bp, Homo sapiens
gtttagaacaggttt

SEQ ID NO: 1353042 - DNA, 14 bp, Homo sapiens
gtttagaattgaag

SEQ ID NO: 1353043 - DNA, 22 bp, Homo sapiens
gtttagatttgccatagagtac

SEQ ID NO: 1353044 - DNA, 18 bp, Homo sapiens
gtttataaaatataaaca

SEQ ID NO: 1353045 - DNA, 13 bp, Homo sapiens
gtttataaatctt

SEQ ID NO: 1353046 - DNA, 16 bp, Homo sapiens
gtttatcattcaagtg

SEQ ID NO: 1353047 - DNA, 23 bp, Homo sapiens
gtttattttctacgtttctttaa

SEQ ID NO: 1353048 - DNA, 14 bp, Homo sapiens
gtttccagggaggg

SEQ ID NO: 1353049 - DNA, 17 bp, Homo sapiens
gtttcctccaagctatt

SEQ ID NO: 1353050 - DNA, 18 bp, Homo sapiens
gtttcctctagttctttg

SEQ ID NO: 1353051 - DNA, 17 bp, Homo sapiens
gtttcctggcactggac

SEQ ID NO: 1353052 - DNA, 15 bp, Homo sapiens
gtttcgtggggaggt

SEQ ID NO: 1353053 - DNA, 15 bp, Homo sapiens
gtttctcctgagcta

SEQ ID NO: 1353054 - DNA, 18 bp, Homo sapiens
gtttctcttgagctggcc

SEQ ID NO: 1353055 - DNA, 19 bp, Homo sapiens
gtttctctttgattatttg

SEQ ID NO: 1353056 - DNA, 17 bp, Homo sapiens
gtttcttgcaagcatgc

SEQ ID NO: 1353057 - DNA, 18 bp, Homo sapiens
gtttcttttgtttggtaa

SEQ ID NO: 1353058 - DNA, 16 bp, Homo sapiens
gtttgaaaatagttta

SEQ ID NO: 1353059 - DNA, 17 bp, Homo sapiens
gtttgagatcagcctgg

SEQ ID NO: 1353060 - DNA, 15 bp, Homo sapiens
gtttgagattctcaa

SEQ ID NO: 1353061 - DNA, 15 bp, Homo sapiens
gtttgagctgccttc

SEQ ID NO: 1353062 - DNA, 18 bp, Homo sapiens
gtttgagctgccttccct

SEQ ID NO: 1353063 - DNA, 17 bp, Homo sapiens
gtttggaaaagtggcgt

SEQ ID NO: 1353064 - DNA, 22 bp, Homo sapiens
gtttggcatgtaaatgtaaact

SEQ ID NO: 1353065 - DNA, 11 bp, Homo sapiens
gttttacaata

SEQ ID NO: 1353066 - DNA, 15 bp, Homo sapiens
gttttactgtctatt

SEQ ID NO: 1353067 - DNA, 14 bp, Homo sapiens
gttttataaaatag

SEQ ID NO: 1353068 - DNA, 12 bp, Homo sapiens
gttttcagaaaa

SEQ ID NO: 1353069 - DNA, 15 bp, Homo sapiens
gttttccccatgaca

SEQ ID NO: 1353070 - DNA, 12 bp, Homo sapiens
gttttctcttga

SEQ ID NO: 1353071 - DNA, 15 bp, Homo sapiens
gttttgtaaaagaaa

SEQ ID NO: 1353072 - DNA, 13 bp, Homo sapiens
gttttgtaaacat

SEQ ID NO: 1353073 - DNA, 17 bp, Homo sapiens
gtttttatgagaaactt

SEQ ID NO: 1353074 - DNA, 14 bp, Homo sapiens
gtttttcctggaat

SEQ ID NO: 1353075 - DNA, 20 bp, Homo sapiens
gtttttctgtgtgtcagttt

SEQ ID NO: 1353076 - DNA, 18 bp, Homo sapiens
gttttttgtttttctgct

SEQ ID NO: 1353077 - DNA, 19 bp, Homo sapiens
gtttttttcttctgtattt

SEQ ID NO: 1353078 - DNA, 15 bp, Homo sapiens
taaaaaaaaagtcag

SEQ ID NO: 1353079 - DNA, 12 bp, Homo sapiens
taaaaaaaccac

SEQ ID NO: 1353080 - DNA, 20 bp, Homo sapiens
taaaaaactgctgactgttt

SEQ ID NO: 1353081 - DNA, 13 bp, Homo sapiens
taaaaaagagaca

SEQ ID NO: 1353082 - DNA, 18 bp, Homo sapiens
taaaaaagcatacttcta

SEQ ID NO: 1353083 - DNA, 15 bp, Homo sapiens
taaaaaagccttcct

SEQ ID NO: 1353084 - DNA, 13 bp, Homo sapiens
taaaaaatatttt

SEQ ID NO: 1353085 - DNA, 16 bp, Homo sapiens
taaaaaatattttctc

SEQ ID NO: 1353086 - DNA, 14 bp, Homo sapiens
taaaaaattttaaa

SEQ ID NO: 1353087 - DNA, 14 bp, Homo sapiens
taaaaagcaaaaat

SEQ ID NO: 1353088 - DNA, 17 bp, Homo sapiens
taaaaaggctaaatgga

SEQ ID NO: 1353089 - DNA, 13 bp, Homo sapiens
taaaaagtataaa

SEQ ID NO: 1353090 - DNA, 19 bp, Homo sapiens
taaaaagtataaaatagta

SEQ ID NO: 1353091 - DNA, 14 bp, Homo sapiens
taaaaagtattttt

SEQ ID NO: 1353092 - DNA, 15 bp, Homo sapiens
taaaaagtggaaaaa

SEQ ID NO: 1353093 - DNA, 12 bp, Homo sapiens
taaaaatagaaa

SEQ ID NO: 1353094 - DNA, 17 bp, Homo sapiens
taaaacaaaatttgact

SEQ ID NO: 1353095 - DNA, 21 bp, Homo sapiens
taaaacaaaatttgactaatt

SEQ ID NO: 1353096 - DNA, 21 bp, Homo sapiens
taaaacacacctaagagaaaa

SEQ ID NO: 1353097 - DNA, 13 bp, Homo sapiens
taaaacagaaaaa

SEQ ID NO: 1353098 - DNA, 17 bp, Homo sapiens
taaaacagagtaatctt

SEQ ID NO: 1353099 - DNA, 19 bp, Homo sapiens
taaaacagagtaatcttgt

SEQ ID NO: 1353100 - DNA, 11 bp, Homo sapiens
taaaaccaaag

SEQ ID NO: 1353101 - DNA, 13 bp, Homo sapiens
taaaaccaaagag

SEQ ID NO: 1353102 - DNA, 17 bp, Homo sapiens
taaaactaaatttcact

SEQ ID NO: 1353103 - DNA, 16 bp, Homo sapiens
taaaactcactgtgat

SEQ ID NO: 1353104 - DNA, 17 bp, Homo sapiens
taaaactcactgtgatc

SEQ ID NO: 1353105 - DNA, 16 bp, Homo sapiens
taaaagaaataaacca

SEQ ID NO: 1353106 - DNA, 21 bp, Homo sapiens
taaaagacagtgtatgtagaa

SEQ ID NO: 1353107 - DNA, 23 bp, Homo sapiens
taaaagacagtgtatgtagaagc

SEQ ID NO: 1353108 - DNA, 14 bp, Homo sapiens
taaaaggatggcaa

SEQ ID NO: 1353109 - DNA, 22 bp, Homo sapiens
taaaaggcccatagcagccagt

SEQ ID NO: 1353110 - DNA, 15 bp, Homo sapiens
taaaaggtaatgtgt

SEQ ID NO: 1353111 - DNA, 15 bp, Homo sapiens
taaaagtgatctaca

SEQ ID NO: 1353112 - DNA, 15 bp, Homo sapiens
taaaataaaatgaaa

SEQ ID NO: 1353113 - DNA, 22 bp, Homo sapiens
taaaataaaatgaaaattgtat

SEQ ID NO: 1353114 - DNA, 22 bp, Homo sapiens
taaaataaggatttttctctta

SEQ ID NO: 1353115 - DNA, 20 bp, Homo sapiens
taaaataattatataactgt

SEQ ID NO: 1353116 - DNA, 23 bp, Homo sapiens
taaaatagagtgtagtttacaga

SEQ ID NO: 1353117 - DNA, 14 bp, Homo sapiens
taaaatataaacaa

SEQ ID NO: 1353118 - DNA, 15 bp, Homo sapiens
taaaatgaagaattt

SEQ ID NO: 1353119 - DNA, 10 bp, Homo sapiens
taaaatgtaa

SEQ ID NO: 1353120 - DNA, 19 bp, Homo sapiens
taaaatgtaatttaaatga

SEQ ID NO: 1353121 - DNA, 21 bp, Homo sapiens
taaaatgtaatttaaatgaaa

SEQ ID NO: 1353122 - DNA, 19 bp, Homo sapiens
taaaatgtccagtaagatc

SEQ ID NO: 1353123 - DNA, 15 bp, Homo sapiens
taaaattatgagatt

SEQ ID NO: 1353124 - DNA, 23 bp, Homo sapiens
taaaattttgtatgttaaagaga

SEQ ID NO: 1353125 - DNA, 21 bp, Homo sapiens
taaacaatgctgatttggtga

SEQ ID NO: 1353126 - DNA, 14 bp, Homo sapiens
taaacactcacctt

SEQ ID NO: 1353127 - DNA, 17 bp, Homo sapiens
taaacagtaagatatct

SEQ ID NO: 1353128 - DNA, 22 bp, Homo sapiens
taaacatgaaaacacttgaaat

SEQ ID NO: 1353129 - DNA, 23 bp, Homo sapiens
taaacatttattttttttaaaga

SEQ ID NO: 1353130 - DNA, 22 bp, Homo sapiens
taaactataaaacaaaaatttg

SEQ ID NO: 1353131 - DNA, 22 bp, Homo sapiens
taaactcatctgaaatgttaca

SEQ ID NO: 1353132 - DNA, 22 bp, Homo sapiens
taaacttggtttttaaaaaact

SEQ ID NO: 1353133 - DNA, 14 bp, Homo sapiens
taaagaaaaaaata

SEQ ID NO: 1353134 - DNA, 16 bp, Homo sapiens
taaagaaaaaaatgtc

SEQ ID NO: 1353135 - DNA, 22 bp, Homo sapiens
taaagaaaaaaatgtcaaaagt

SEQ ID NO: 1353136 - DNA, 10 bp, Homo sapiens
taaagaaaag

SEQ ID NO: 1353137 - DNA, 16 bp, Homo sapiens
taaagaaggatgatgt

SEQ ID NO: 1353138 - DNA, 19 bp, Homo sapiens
taaagaagtatttttagaa

SEQ ID NO: 1353139 - DNA, 15 bp, Homo sapiens
taaagacaggagaca

SEQ ID NO: 1353140 - DNA, 22 bp, Homo sapiens
taaagactggttttctgccaat

SEQ ID NO: 1353141 - DNA, 12 bp, Homo sapiens
taaagagaatga

SEQ ID NO: 1353142 - DNA, 20 bp, Homo sapiens
taaagagcatctgattcttg

SEQ ID NO: 1353143 - DNA, 15 bp, Homo sapiens
taaagagcccttgcc

SEQ ID NO: 1353144 - DNA, 22 bp, Homo sapiens
taaagcacagtctgatgacaca

SEQ ID NO: 1353145 - DNA, 17 bp, Homo sapiens
taaagcagtatttttct

SEQ ID NO: 1353146 - DNA, 14 bp, Homo sapiens
taaagcatgaaatg

SEQ ID NO: 1353147 - DNA, 17 bp, Homo sapiens
taaagcatgaaatgtga

SEQ ID NO: 1353148 - DNA, 21 bp, Homo sapiens
taaagcatgaaatgtgaattt

SEQ ID NO: 1353149 - DNA, 14 bp, Homo sapiens
taaaggataaagaa

SEQ ID NO: 1353150 - DNA, 21 bp, Homo sapiens
taaagtaaaaagggaattatg

SEQ ID NO: 1353151 - DNA, 13 bp, Homo sapiens
taaagtaaataca

SEQ ID NO: 1353152 - DNA, 18 bp, Homo sapiens
taaagtgtaagttcacaa

SEQ ID NO: 1353153 - DNA, 13 bp, Homo sapiens
taaataaaatttg

SEQ ID NO: 1353154 - DNA, 19 bp, Homo sapiens
taaatacacatagcatgta

SEQ ID NO: 1353155 - DNA, 15 bp, Homo sapiens
taaatacatgcatat

SEQ ID NO: 1353156 - DNA, 13 bp, Homo sapiens
taaatattttcta

SEQ ID NO: 1353157 - DNA, 18 bp, Homo sapiens
taaatctatttattaata

SEQ ID NO: 1353158 - DNA, 22 bp, Homo sapiens
taaatgaaagaaaattgagttg

SEQ ID NO: 1353159 - DNA, 15 bp, Homo sapiens
taaatgccctcttct

SEQ ID NO: 1353160 - DNA, 12 bp, Homo sapiens
taaatggcctca

SEQ ID NO: 1353161 - DNA, 22 bp, Homo sapiens
taaatggcctcatgtggctgga

SEQ ID NO: 1353162 - DNA, 19 bp, Homo sapiens
taaatggtaataagcactg

SEQ ID NO: 1353163 - DNA, 15 bp, Homo sapiens
taaatgtaaactcag

SEQ ID NO: 1353164 - DNA, 15 bp, Homo sapiens
taaatgtataaatat

SEQ ID NO: 1353165 - DNA, 20 bp, Homo sapiens
taaatgtctagttgtaacac

SEQ ID NO: 1353166 - DNA, 22 bp, Homo sapiens
taaatgttaatggatttcagaa

SEQ ID NO: 1353167 - DNA, 19 bp, Homo sapiens
taaatgtttcttttgtttg

SEQ ID NO: 1353168 - DNA, 22 bp, Homo sapiens
taaatgtttggcatgtaaatgt

SEQ ID NO: 1353169 - DNA, 14 bp, Homo sapiens
taaattacaatttt

SEQ ID NO: 1353170 - DNA, 14 bp, Homo sapiens
taaattaggaataa

SEQ ID NO: 1353171 - DNA, 22 bp, Homo sapiens
taaattatttgattatttaaga

SEQ ID NO: 1353172 - DNA, 15 bp, Homo sapiens
taaattcaactttgt

SEQ ID NO: 1353173 - DNA, 11 bp, Homo sapiens
taaattctgat

SEQ ID NO: 1353174 - DNA, 12 bp, Homo sapiens
taaattctgatt

SEQ ID NO: 1353175 - DNA, 14 bp, Homo sapiens
taaatttaatacca

SEQ ID NO: 1353176 - DNA, 13 bp, Homo sapiens
taaatttagtgtt

SEQ ID NO: 1353177 - DNA, 15 bp, Homo sapiens
taaatttcttatgtg

SEQ ID NO: 1353178 - DNA, 18 bp, Homo sapiens
taaatttcttatgtgaca

SEQ ID NO: 1353179 - DNA, 16 bp, Homo sapiens
taaatttttttgtatg

SEQ ID NO: 1353180 - DNA, 17 bp, Homo sapiens
taaatttttttgtatga

SEQ ID NO: 1353181 - DNA, 21 bp, Homo sapiens
taaatttttttgtatgaaaac

SEQ ID NO: 1353182 - DNA, 12 bp, Homo sapiens
taacacattttt

SEQ ID NO: 1353183 - DNA, 17 bp, Homo sapiens
taacagaaattgtatat

SEQ ID NO: 1353184 - DNA, 22 bp, Homo sapiens
taacatgctggtgaatattttc

SEQ ID NO: 1353185 - DNA, 16 bp, Homo sapiens
taacattatttatatg

SEQ ID NO: 1353186 - DNA, 16 bp, Homo sapiens
taaccacttcagctga

SEQ ID NO: 1353187 - DNA, 19 bp, Homo sapiens
taacccccttaaatttaat

SEQ ID NO: 1353188 - DNA, 15 bp, Homo sapiens
taactcaccagcccc

SEQ ID NO: 1353189 - DNA, 19 bp, Homo sapiens
taactggaacaaattattt

SEQ ID NO: 1353190 - DNA, 12 bp, Homo sapiens
taactgtaaatc

SEQ ID NO: 1353191 - DNA, 12 bp, Homo sapiens
taactgtatttg

SEQ ID NO: 1353192 - DNA, 14 bp, Homo sapiens
taactgtatttgaa

SEQ ID NO: 1353193 - DNA, 12 bp, Homo sapiens
taactgtcctgt

SEQ ID NO: 1353194 - DNA, 15 bp, Homo sapiens
taactgtgtactgtt

SEQ ID NO: 1353195 - DNA, 14 bp, Homo sapiens
taacttaactgaaa

SEQ ID NO: 1353196 - DNA, 16 bp, Homo sapiens
taacttaataatcaag

SEQ ID NO: 1353197 - DNA, 15 bp, Homo sapiens
taagaaagtgaagca

SEQ ID NO: 1353198 - DNA, 18 bp, Homo sapiens
taagaaagtgaagcaaat

SEQ ID NO: 1353199 - DNA, 22 bp, Homo sapiens
taagaaagtgaagcaaatcaga

SEQ ID NO: 1353200 - DNA, 16 bp, Homo sapiens
taagaaatgtataaac

SEQ ID NO: 1353201 - DNA, 22 bp, Homo sapiens
taagaagaagttcatgtccaaa

SEQ ID NO: 1353202 - DNA, 18 bp, Homo sapiens
taagaataccacatcaaa

SEQ ID NO: 1353203 - DNA, 18 bp, Homo sapiens
taagaattcaaactgggg

SEQ ID NO: 1353204 - DNA, 16 bp, Homo sapiens
taagaattcagacatc

SEQ ID NO: 1353205 - DNA, 19 bp, Homo sapiens
taagaattctgattgattt

SEQ ID NO: 1353206 - DNA, 22 bp, Homo sapiens
taagacaatggaccctttttgt

SEQ ID NO: 1353207 - DNA, 20 bp, Homo sapiens
taagacatactccttccatc

SEQ ID NO: 1353208 - DNA, 20 bp, Homo sapiens
taagactatatatataaatg

SEQ ID NO: 1353209 - DNA, 17 bp, Homo sapiens
taagactgtagatatgt

SEQ ID NO: 1353210 - DNA, 15 bp, Homo sapiens
taagactgtgtattc

SEQ ID NO: 1353211 - DNA, 15 bp, Homo sapiens
taagaggcagcgtga

SEQ ID NO: 1353212 - DNA, 16 bp, Homo sapiens
taagatagtgtaactt

SEQ ID NO: 1353213 - DNA, 17 bp, Homo sapiens
taagatatctcaatgaa

SEQ ID NO: 1353214 - DNA, 14 bp, Homo sapiens
taagatcactgttt

SEQ ID NO: 1353215 - DNA, 14 bp, Homo sapiens
taagatgtgaaaat

SEQ ID NO: 1353216 - DNA, 16 bp, Homo sapiens
taagatgtgaaaatta

SEQ ID NO: 1353217 - DNA, 17 bp, Homo sapiens
taagattaagagcaaat

SEQ ID NO: 1353218 - DNA, 19 bp, Homo sapiens
taagcaaatgttaaaagtt

SEQ ID NO: 1353219 - DNA, 19 bp, Homo sapiens
taagcatactttgtaaata

SEQ ID NO: 1353220 - DNA, 19 bp, Homo sapiens
taagccaaaattaaggtgt

SEQ ID NO: 1353221 - DNA, 16 bp, Homo sapiens
taagccctaaggtcct

SEQ ID NO: 1353222 - DNA, 14 bp, Homo sapiens
taagccttcaaaac

SEQ ID NO: 1353223 - DNA, 15 bp, Homo sapiens
taagcgtatggcttt

SEQ ID NO: 1353224 - DNA, 18 bp, Homo sapiens
taagctactagcaaaata

SEQ ID NO: 1353225 - DNA, 18 bp, Homo sapiens
taagctagttgaatactt

SEQ ID NO: 1353226 - DNA, 20 bp, Homo sapiens
taagctagttgaatacttga

SEQ ID NO: 1353227 - DNA, 17 bp, Homo sapiens
taagcttcagttgcttg

SEQ ID NO: 1353228 - DNA, 16 bp, Homo sapiens
taagcttccattttaa

SEQ ID NO: 1353229 - DNA, 23 bp, Homo sapiens
taagcttccattttaattttaaa

SEQ ID NO: 1353230 - DNA, 14 bp, Homo sapiens
taaggactgactga

SEQ ID NO: 1353231 - DNA, 12 bp, Homo sapiens
taagggaaaaat

SEQ ID NO: 1353232 - DNA, 17 bp, Homo sapiens
taagggaaaaatatata

SEQ ID NO: 1353233 - DNA, 17 bp, Homo sapiens
taagggaacaagttgag

SEQ ID NO: 1353234 - DNA, 15 bp, Homo sapiens
taaggggaagaatga

SEQ ID NO: 1353235 - DNA, 20 bp, Homo sapiens
taaggggaagaatgaaagct

SEQ ID NO: 1353236 - DNA, 19 bp, Homo sapiens
taaggggaggaaccagagt

SEQ ID NO: 1353237 - DNA, 13 bp, Homo sapiens
taaggtcctaagg

SEQ ID NO: 1353238 - DNA, 18 bp, Homo sapiens
taaggtctttcagtactt

SEQ ID NO: 1353239 - DNA, 16 bp, Homo sapiens
taaggtgtttgaaaat

SEQ ID NO: 1353240 - DNA, 20 bp, Homo sapiens
taaggtgtttgaaaatagtt

SEQ ID NO: 1353241 - DNA, 21 bp, Homo sapiens
taaggtgtttgaaaatagttt

SEQ ID NO: 1353242 - DNA, 15 bp, Homo sapiens
taagtaatcatctaa

SEQ ID NO: 1353243 - DNA, 14 bp, Homo sapiens
taagtctttcatgg

SEQ ID NO: 1353244 - DNA, 18 bp, Homo sapiens
taagtgggcccacccggt

SEQ ID NO: 1353245 - DNA, 13 bp, Homo sapiens
taagttatctttg

SEQ ID NO: 1353246 - DNA, 17 bp, Homo sapiens
taataaaaaaagaaagc

SEQ ID NO: 1353247 - DNA, 18 bp, Homo sapiens
taataaatgccctcttct

SEQ ID NO: 1353248 - DNA, 13 bp, Homo sapiens
taataactgtgta

SEQ ID NO: 1353249 - DNA, 15 bp, Homo sapiens
taataagcactgtaa

SEQ ID NO: 1353250 - DNA, 19 bp, Homo sapiens
taataagctactagcaaaa

SEQ ID NO: 1353251 - DNA, 14 bp, Homo sapiens
taataatcaagagc

SEQ ID NO: 1353252 - DNA, 15 bp, Homo sapiens
taataatgtttaata

SEQ ID NO: 1353253 - DNA, 19 bp, Homo sapiens
taatacaaggtataataaa

SEQ ID NO: 1353254 - DNA, 14 bp, Homo sapiens
taatactgaaccac

SEQ ID NO: 1353255 - DNA, 15 bp, Homo sapiens
taatactgaaccact

SEQ ID NO: 1353256 - DNA, 18 bp, Homo sapiens
taataggctctgcctgac

SEQ ID NO: 1353257 - DNA, 15 bp, Homo sapiens
taatagggaatatat

SEQ ID NO: 1353258 - DNA, 20 bp, Homo sapiens
taatatatgtattatttata

SEQ ID NO: 1353259 - DNA, 17 bp, Homo sapiens
taatatattttctgttt

SEQ ID NO: 1353260 - DNA, 19 bp, Homo sapiens
taatattgagaaagaaact

SEQ ID NO: 1353261 - DNA, 23 bp, Homo sapiens
taatcaagagccttaaaacatca

SEQ ID NO: 1353262 - DNA, 15 bp, Homo sapiens
taatcaccatgtaag

SEQ ID NO: 1353263 - DNA, 22 bp, Homo sapiens
taatcacgagtaagattaagag

SEQ ID NO: 1353264 - DNA, 22 bp, Homo sapiens
taatcactgtgtatatttgatt

SEQ ID NO: 1353265 - DNA, 23 bp, Homo sapiens
taatcatagttactgtgtaaact

SEQ ID NO: 1353266 - DNA, 13 bp, Homo sapiens
taatcatttgttt

SEQ ID NO: 1353267 - DNA, 13 bp, Homo sapiens
taatcattttcat

SEQ ID NO: 1353268 - DNA, 18 bp, Homo sapiens
taatcattttcattccta

SEQ ID NO: 1353269 - DNA, 19 bp, Homo sapiens
taatccaatgggtttttcc

SEQ ID NO: 1353270 - DNA, 23 bp, Homo sapiens
taatccagttataagaagaagtt

SEQ ID NO: 1353271 - DNA, 21 bp, Homo sapiens
taatcccagcactttgggagg

SEQ ID NO: 1353272 - DNA, 23 bp, Homo sapiens
taatcccagcactttgggaggcc

SEQ ID NO: 1353273 - DNA, 19 bp, Homo sapiens
taatcccctaaaataacag

SEQ ID NO: 1353274 - DNA, 13 bp, Homo sapiens
taatccctgcttt

SEQ ID NO: 1353275 - DNA, 22 bp, Homo sapiens
taatccttaaatcttaatgttc

SEQ ID NO: 1353276 - DNA, 16 bp, Homo sapiens
taatcctttgttttct

SEQ ID NO: 1353277 - DNA, 18 bp, Homo sapiens
taatcttataattgttct

SEQ ID NO: 1353278 - DNA, 18 bp, Homo sapiens
taatgaaaatgaatatct

SEQ ID NO: 1353279 - DNA, 15 bp, Homo sapiens
taatgaaatggagga

SEQ ID NO: 1353280 - DNA, 16 bp, Homo sapiens
taatgaatttttatga

SEQ ID NO: 1353281 - DNA, 22 bp, Homo sapiens
taatgatgacaaaaaatgtttt

SEQ ID NO: 1353282 - DNA, 12 bp, Homo sapiens
taatgcactttc

SEQ ID NO: 1353283 - DNA, 13 bp, Homo sapiens
taatgcactttct

SEQ ID NO: 1353284 - DNA, 20 bp, Homo sapiens
taatgccattttaaggaaaa

SEQ ID NO: 1353285 - DNA, 15 bp, Homo sapiens
taatgctacaatttt

SEQ ID NO: 1353286 - DNA, 17 bp, Homo sapiens
taatgctatttgaacaa

SEQ ID NO: 1353287 - DNA, 20 bp, Homo sapiens
taatggaagtgtatttattt

SEQ ID NO: 1353288 - DNA, 15 bp, Homo sapiens
taatgtgtggattgc

SEQ ID NO: 1353289 - DNA, 23 bp, Homo sapiens
taatgtgtggattgcctctgaaa

SEQ ID NO: 1353290 - DNA, 18 bp, Homo sapiens
taattaaccttactaatt

SEQ ID NO: 1353291 - DNA, 16 bp, Homo sapiens
taattactgccttgaa

SEQ ID NO: 1353292 - DNA, 17 bp, Homo sapiens
taattactgccttgaaa

SEQ ID NO: 1353293 - DNA, 17 bp, Homo sapiens
taattattatttccagt

SEQ ID NO: 1353294 - DNA, 21 bp, Homo sapiens
taattcctatatcctgtgact

SEQ ID NO: 1353295 - DNA, 18 bp, Homo sapiens
taattcttttttattaat

SEQ ID NO: 1353296 - DNA, 19 bp, Homo sapiens
taattcttttttattaatc

SEQ ID NO: 1353297 - DNA, 22 bp, Homo sapiens
taattgtacaaaattaagcaaa

SEQ ID NO: 1353298 - DNA, 12 bp, Homo sapiens
taattgtgtgaa

SEQ ID NO: 1353299 - DNA, 22 bp, Homo sapiens
taatttaaaaatatatttataa

SEQ ID NO: 1353300 - DNA, 20 bp, Homo sapiens
taatttaagttttgacaagc

SEQ ID NO: 1353301 - DNA, 16 bp, Homo sapiens
taatttacttgttttg

SEQ ID NO: 1353302 - DNA, 19 bp, Homo sapiens
taatttatttccactaaaa

SEQ ID NO: 1353303 - DNA, 11 bp, Homo sapiens
taatttccttt

SEQ ID NO: 1353304 - DNA, 13 bp, Homo sapiens
taatttccttttt

SEQ ID NO: 1353305 - DNA, 20 bp, Homo sapiens
taatttctagaaacaaacat

SEQ ID NO: 1353306 - DNA, 14 bp, Homo sapiens
taatttctcctccc

SEQ ID NO: 1353307 - DNA, 13 bp, Homo sapiens
taatttgaagatt

SEQ ID NO: 1353308 - DNA, 15 bp, Homo sapiens
tacaaaattaagcaa

SEQ ID NO: 1353309 - DNA, 23 bp, Homo sapiens
tacaaaattaagcaaatgttaaa

SEQ ID NO: 1353310 - DNA, 17 bp, Homo sapiens
tacaaagttaaaattgt

SEQ ID NO: 1353311 - DNA, 18 bp, Homo sapiens
tacaaagttaaaattgtt

SEQ ID NO: 1353312 - DNA, 17 bp, Homo sapiens
tacaaatgcatctttga

SEQ ID NO: 1353313 - DNA, 18 bp, Homo sapiens
tacaaatgcatctttgat

SEQ ID NO: 1353314 - DNA, 15 bp, Homo sapiens
tacaacggaggcctg

SEQ ID NO: 1353315 - DNA, 18 bp, Homo sapiens
tacaacttaaataataaa

SEQ ID NO: 1353316 - DNA, 18 bp, Homo sapiens
tacaagggcataaagtaa

SEQ ID NO: 1353317 - DNA, 18 bp, Homo sapiens
tacaaggtataataaaat

SEQ ID NO: 1353318 - DNA, 16 bp, Homo sapiens
tacaagtagttctgta

SEQ ID NO: 1353319 - DNA, 17 bp, Homo sapiens
tacaagtagttctgtat

SEQ ID NO: 1353320 - DNA, 19 bp, Homo sapiens
tacaagtagttctgtattt

SEQ ID NO: 1353321 - DNA, 23 bp, Homo sapiens
tacaagtagttctgtatttgaaa

SEQ ID NO: 1353322 - DNA, 14 bp, Homo sapiens
tacaagtcagtagg

SEQ ID NO: 1353323 - DNA, 16 bp, Homo sapiens
tacaagtttatatata

SEQ ID NO: 1353324 - DNA, 14 bp, Homo sapiens
tacaatattgattg

SEQ ID NO: 1353325 - DNA, 20 bp, Homo sapiens
tacaatcaaaggaaaatagt

SEQ ID NO: 1353326 - DNA, 12 bp, Homo sapiens
tacaattttatc

SEQ ID NO: 1353327 - DNA, 11 bp, Homo sapiens
tacacagaaac

SEQ ID NO: 1353328 - DNA, 15 bp, Homo sapiens
tacacagaaacactg

SEQ ID NO: 1353329 - DNA, 18 bp, Homo sapiens
tacacatatttgaagggt

SEQ ID NO: 1353330 - DNA, 12 bp, Homo sapiens
tacacctggctg

SEQ ID NO: 1353331 - DNA, 14 bp, Homo sapiens
tacacctggctgag

SEQ ID NO: 1353332 - DNA, 21 bp, Homo sapiens
tacacgaatagacatcaaact

SEQ ID NO: 1353333 - DNA, 18 bp, Homo sapiens
tacactgcctgccttaag

SEQ ID NO: 1353334 - DNA, 22 bp, Homo sapiens
tacactggcaatggtagtttct

SEQ ID NO: 1353335 - DNA, 15 bp, Homo sapiens
tacagaaaaagactt

SEQ ID NO: 1353336 - DNA, 16 bp, Homo sapiens
tacagaggtattaaaa

SEQ ID NO: 1353337 - DNA, 18 bp, Homo sapiens
tacagatgaatgtattta

SEQ ID NO: 1353338 - DNA, 16 bp, Homo sapiens
tacagctcattaaact

SEQ ID NO: 1353339 - DNA, 18 bp, Homo sapiens
tacagctcattaaacttt

SEQ ID NO: 1353340 - DNA, 21 bp, Homo sapiens
tacagctcattaaactttttt

SEQ ID NO: 1353341 - DNA, 19 bp, Homo sapiens
tacagtccaaaatactgtt

SEQ ID NO: 1353342 - DNA, 22 bp, Homo sapiens
tacagtgcagagccttctcaga

SEQ ID NO: 1353343 - DNA, 11 bp, Homo sapiens
tacagtggttt

SEQ ID NO: 1353344 - DNA, 15 bp, Homo sapiens
tacagttttcagaaa

SEQ ID NO: 1353345 - DNA, 13 bp, Homo sapiens
tacataaaagaaa

SEQ ID NO: 1353346 - DNA, 20 bp, Homo sapiens
tacataatactgaaccactt

SEQ ID NO: 1353347 - DNA, 21 bp, Homo sapiens
tacatgaagaatagaaacaag

SEQ ID NO: 1353348 - DNA, 23 bp, Homo sapiens
tacatgaggaactgtagatgatg

SEQ ID NO: 1353349 - DNA, 20 bp, Homo sapiens
tacatgcatataatgaataa

SEQ ID NO: 1353350 - DNA, 15 bp, Homo sapiens
tacatgtgatacatt

SEQ ID NO: 1353351 - DNA, 16 bp, Homo sapiens
tacatgtgatacattt

SEQ ID NO: 1353352 - DNA, 18 bp, Homo sapiens
tacatgtgatacattttt

SEQ ID NO: 1353353 - DNA, 14 bp, Homo sapiens
tacatttatttatc

SEQ ID NO: 1353354 - DNA, 20 bp, Homo sapiens
tacatttatttatccagaaa

SEQ ID NO: 1353355 - DNA, 19 bp, Homo sapiens
tacatttgatgcatgtctt

SEQ ID NO: 1353356 - DNA, 21 bp, Homo sapiens
tacatttgggagtttttatga

SEQ ID NO: 1353357 - DNA, 15 bp, Homo sapiens
tacattttttaagct

SEQ ID NO: 1353358 - DNA, 13 bp, Homo sapiens
taccagctgcgct

SEQ ID NO: 1353359 - DNA, 14 bp, Homo sapiens
taccagctgcgctt

SEQ ID NO: 1353360 - DNA, 19 bp, Homo sapiens
taccatttagtaagaatac

SEQ ID NO: 1353361 - DNA, 17 bp, Homo sapiens
tacccatagacatgaaa

SEQ ID NO: 1353362 - DNA, 13 bp, Homo sapiens
taccccctccttc

SEQ ID NO: 1353363 - DNA, 17 bp, Homo sapiens
taccccgcagacacctt

SEQ ID NO: 1353364 - DNA, 15 bp, Homo sapiens
tacccttttctgggg

SEQ ID NO: 1353365 - DNA, 17 bp, Homo sapiens
tacctagctaattattt

SEQ ID NO: 1353366 - DNA, 18 bp, Homo sapiens
tacctagctaattattta

SEQ ID NO: 1353367 - DNA, 18 bp, Homo sapiens
tacctagtgaaacttttc

SEQ ID NO: 1353368 - DNA, 19 bp, Homo sapiens
tacctagtgaaacttttct

SEQ ID NO: 1353369 - DNA, 15 bp, Homo sapiens
tacctccaaccctgc

SEQ ID NO: 1353370 - DNA, 16 bp, Homo sapiens
tacctccaaccctgcc

SEQ ID NO: 1353371 - DNA, 12 bp, Homo sapiens
tacctgtataca

SEQ ID NO: 1353372 - DNA, 22 bp, Homo sapiens
tacctgtatttaaaaatagaaa

SEQ ID NO: 1353373 - DNA, 14 bp, Homo sapiens
tacctttcaaagct

SEQ ID NO: 1353374 - DNA, 18 bp, Homo sapiens
taccttttcagggctggc

SEQ ID NO: 1353375 - DNA, 18 bp, Homo sapiens
taccttttttttttcttg

SEQ ID NO: 1353376 - DNA, 21 bp, Homo sapiens
tacgacacgggtggggaaagg

SEQ ID NO: 1353377 - DNA, 15 bp, Homo sapiens
tactaaaaagtataa

SEQ ID NO: 1353378 - DNA, 18 bp, Homo sapiens
tactaaaaagtataaaat

SEQ ID NO: 1353379 - DNA, 19 bp, Homo sapiens
tactactttgttaggattt

SEQ ID NO: 1353380 - DNA, 14 bp, Homo sapiens
tactagcaaaataa

SEQ ID NO: 1353381 - DNA, 19 bp, Homo sapiens
tactagcaaaataaaacat

SEQ ID NO: 1353382 - DNA, 21 bp, Homo sapiens
tactagcaaaataaaacatag

SEQ ID NO: 1353383 - DNA, 22 bp, Homo sapiens
tactattcagtggcgagaaata

SEQ ID NO: 1353384 - DNA, 21 bp, Homo sapiens
tactatttaagatgtgaaaat

SEQ ID NO: 1353385 - DNA, 23 bp, Homo sapiens
tactcaggctggtggagaactct

SEQ ID NO: 1353386 - DNA, 16 bp, Homo sapiens
tactgaaccacttgta

SEQ ID NO: 1353387 - DNA, 22 bp, Homo sapiens
tactgaaccacttgtagatttg

SEQ ID NO: 1353388 - DNA, 19 bp, Homo sapiens
tactgaaggaaaaacacaa

SEQ ID NO: 1353389 - DNA, 18 bp, Homo sapiens
tactgaatttttttgtaa

SEQ ID NO: 1353390 - DNA, 19 bp, Homo sapiens
tactgaatttttttgtaat

SEQ ID NO: 1353391 - DNA, 14 bp, Homo sapiens
tactgacatttctt

SEQ ID NO: 1353392 - DNA, 16 bp, Homo sapiens
tactgacatttcttct

SEQ ID NO: 1353393 - DNA, 18 bp, Homo sapiens
tactgcactccagcctgg

SEQ ID NO: 1353394 - DNA, 19 bp, Homo sapiens
tactgcactccagcctggg

SEQ ID NO: 1353395 - DNA, 20 bp, Homo sapiens
tactgcactccagcctgggg

SEQ ID NO: 1353396 - DNA, 15 bp, Homo sapiens
tactgcatttaggga

SEQ ID NO: 1353397 - DNA, 18 bp, Homo sapiens
tactgcgactttctgcct

SEQ ID NO: 1353398 - DNA, 19 bp, Homo sapiens
tactgcgactttctgcctg

SEQ ID NO: 1353399 - DNA, 18 bp, Homo sapiens
tactgggccctgagtctg

SEQ ID NO: 1353400 - DNA, 19 bp, Homo sapiens
tactggtgcagtcattatg

SEQ ID NO: 1353401 - DNA, 13 bp, Homo sapiens
tactggttgcatg

SEQ ID NO: 1353402 - DNA, 18 bp, Homo sapiens
tactggttgcatggaaat

SEQ ID NO: 1353403 - DNA, 18 bp, Homo sapiens
tactgtctattaatattc

SEQ ID NO: 1353404 - DNA, 19 bp, Homo sapiens
tactgtctattaatattca

SEQ ID NO: 1353405 - DNA, 21 bp, Homo sapiens
tactgtcttcagtaagccgtg

SEQ ID NO: 1353406 - DNA, 18 bp, Homo sapiens
tactgttactgggccctg

SEQ ID NO: 1353407 - DNA, 15 bp, Homo sapiens
tactgtttattactt

SEQ ID NO: 1353408 - DNA, 21 bp, Homo sapiens
tacttaaatggtaataagcac

SEQ ID NO: 1353409 - DNA, 20 bp, Homo sapiens
tacttcttttttcaaaagaa

SEQ ID NO: 1353410 - DNA, 21 bp, Homo sapiens
tacttgaaccataaaatgtcc

SEQ ID NO: 1353411 - DNA, 18 bp, Homo sapiens
tacttgggaggctgaggc

SEQ ID NO: 1353412 - DNA, 17 bp, Homo sapiens
tactttgtaaattctga

SEQ ID NO: 1353413 - DNA, 18 bp, Homo sapiens
tactttgtattgtcctat

SEQ ID NO: 1353414 - DNA, 16 bp, Homo sapiens
tactttgtattttgat

SEQ ID NO: 1353415 - DNA, 19 bp, Homo sapiens
tactttgttaggattttca

SEQ ID NO: 1353416 - DNA, 18 bp, Homo sapiens
tacttttaaaaacataac

SEQ ID NO: 1353417 - DNA, 23 bp, Homo sapiens
tacttttattttacacagaaaca

SEQ ID NO: 1353418 - DNA, 18 bp, Homo sapiens
tacttttttaaatatttt

SEQ ID NO: 1353419 - DNA, 22 bp, Homo sapiens
tacttttttaaatattttctat

SEQ ID NO: 1353420 - DNA, 15 bp, Homo sapiens
tagaaaaataaaaat

SEQ ID NO: 1353421 - DNA, 18 bp, Homo sapiens
tagaaaagaactggaaac

SEQ ID NO: 1353422 - DNA, 17 bp, Homo sapiens
tagaaacaaacatctaa

SEQ ID NO: 1353423 - DNA, 16 bp, Homo sapiens
tagaaatggaaatttt

SEQ ID NO: 1353424 - DNA, 16 bp, Homo sapiens
tagaaatgtaggtcct

SEQ ID NO: 1353425 - DNA, 13 bp, Homo sapiens
tagaaattttcaa

SEQ ID NO: 1353426 - DNA, 14 bp, Homo sapiens
tagaaattttgtaa

SEQ ID NO: 1353427 - DNA, 16 bp, Homo sapiens
tagaacactaactcac

SEQ ID NO: 1353428 - DNA, 13 bp, Homo sapiens
tagaacaggtttt

SEQ ID NO: 1353429 - DNA, 16 bp, Homo sapiens
tagaactgtctgtgaa

SEQ ID NO: 1353430 - DNA, 19 bp, Homo sapiens
tagaactttaagcaacaag

SEQ ID NO: 1353431 - DNA, 14 bp, Homo sapiens
tagaagagagaggt

SEQ ID NO: 1353432 - DNA, 22 bp, Homo sapiens
tagaagcactacaccttgcctt

SEQ ID NO: 1353433 - DNA, 12 bp, Homo sapiens
tagaagccaagg

SEQ ID NO: 1353434 - DNA, 18 bp, Homo sapiens
tagaataagaatttgcat

SEQ ID NO: 1353435 - DNA, 20 bp, Homo sapiens
tagaatccctgtgttaattt

SEQ ID NO: 1353436 - DNA, 18 bp, Homo sapiens
tagaattatttttcactc

SEQ ID NO: 1353437 - DNA, 18 bp, Homo sapiens
tagaattgaaggtttttg

SEQ ID NO: 1353438 - DNA, 20 bp, Homo sapiens
tagaattgaaggtttttgat

SEQ ID NO: 1353439 - DNA, 16 bp, Homo sapiens
tagacaggtcctgatt

SEQ ID NO: 1353440 - DNA, 12 bp, Homo sapiens
tagacatgaaag

SEQ ID NO: 1353441 - DNA, 23 bp, Homo sapiens
tagaccatttatctgggattatg

SEQ ID NO: 1353442 - DNA, 18 bp, Homo sapiens
tagaccccatacaagttt

SEQ ID NO: 1353443 - DNA, 12 bp, Homo sapiens
tagaccctgggt

SEQ ID NO: 1353444 - DNA, 20 bp, Homo sapiens
tagaccctgggtgggctctg

SEQ ID NO: 1353445 - DNA, 12 bp, Homo sapiens
tagacttgaaaa

SEQ ID NO: 1353446 - DNA, 14 bp, Homo sapiens
tagacttgaaaaga

SEQ ID NO: 1353447 - DNA, 17 bp, Homo sapiens
tagagctttcaagtaca

SEQ ID NO: 1353448 - DNA, 18 bp, Homo sapiens
tagaggcttctccgccag

SEQ ID NO: 1353449 - DNA, 19 bp, Homo sapiens
tagaggcttctccgccagc

SEQ ID NO: 1353450 - DNA, 17 bp, Homo sapiens
tagaggtcctctggagc

SEQ ID NO: 1353451 - DNA, 18 bp, Homo sapiens
tagaggtcctctggagcc

SEQ ID NO: 1353452 - DNA, 19 bp, Homo sapiens
tagaggtcctctggagccc

SEQ ID NO: 1353453 - DNA, 20 bp, Homo sapiens
tagaggtcctctggagccct

SEQ ID NO: 1353454 - DNA, 21 bp, Homo sapiens
tagagtctgagggcttgtagt

SEQ ID NO: 1353455 - DNA, 22 bp, Homo sapiens
tagatattgaggccaagaatat

SEQ ID NO: 1353456 - DNA, 15 bp, Homo sapiens
tagatatttttcata

SEQ ID NO: 1353457 - DNA, 15 bp, Homo sapiens
tagatccatttccat

SEQ ID NO: 1353458 - DNA, 12 bp, Homo sapiens
tagatctccagc

SEQ ID NO: 1353459 - DNA, 13 bp, Homo sapiens
tagatctccagcg

SEQ ID NO: 1353460 - DNA, 19 bp, Homo sapiens
tagatggtttgagcctgag

SEQ ID NO: 1353461 - DNA, 14 bp, Homo sapiens
tagatgttgccatg

SEQ ID NO: 1353462 - DNA, 22 bp, Homo sapiens
tagattttagaccctattgctg

SEQ ID NO: 1353463 - DNA, 15 bp, Homo sapiens
tagcaaaataaaaca

SEQ ID NO: 1353464 - DNA, 16 bp, Homo sapiens
tagcaaaataaaacat

SEQ ID NO: 1353465 - DNA, 13 bp, Homo sapiens
tagcaacttttgt

SEQ ID NO: 1353466 - DNA, 12 bp, Homo sapiens
tagcacagcagc

SEQ ID NO: 1353467 - DNA, 16 bp, Homo sapiens
tagcactttgggaggc

SEQ ID NO: 1353468 - DNA, 16 bp, Homo sapiens
tagcagcccaccctgc

SEQ ID NO: 1353469 - DNA, 17 bp, Homo sapiens
tagcagtgagtcatatc

SEQ ID NO: 1353470 - DNA, 15 bp, Homo sapiens
tagcatcacttaaaa

SEQ ID NO: 1353471 - DNA, 22 bp, Homo sapiens
tagcatctcaggagatttcatg

SEQ ID NO: 1353472 - DNA, 18 bp, Homo sapiens
tagcatctggaagatcat

SEQ ID NO: 1353473 - DNA, 16 bp, Homo sapiens
tagcattttgctaaat

SEQ ID NO: 1353474 - DNA, 22 bp, Homo sapiens
tagcattttgctaaatgtgaat

SEQ ID NO: 1353475 - DNA, 13 bp, Homo sapiens
tagccaaaatgtg

SEQ ID NO: 1353476 - DNA, 21 bp, Homo sapiens
tagccaatgtctcctcccctt

SEQ ID NO: 1353477 - DNA, 16 bp, Homo sapiens
tagccccctggcctct

SEQ ID NO: 1353478 - DNA, 20 bp, Homo sapiens
tagcgatctctcctggccta

SEQ ID NO: 1353479 - DNA, 13 bp, Homo sapiens
tagctaattattt

SEQ ID NO: 1353480 - DNA, 16 bp, Homo sapiens
tagctcctccccttcc

SEQ ID NO: 1353481 - DNA, 12 bp, Homo sapiens
tagctcctgtgg

SEQ ID NO: 1353482 - DNA, 15 bp, Homo sapiens
tagcttctgcttttc

SEQ ID NO: 1353483 - DNA, 22 bp, Homo sapiens
tagcttctgcttttctgccctg

SEQ ID NO: 1353484 - DNA, 18 bp, Homo sapiens
tagctttagaccctgggt

SEQ ID NO: 1353485 - DNA, 23 bp, Homo sapiens
taggaagaacgttttttcctcag

SEQ ID NO: 1353486 - DNA, 22 bp, Homo sapiens
taggaatcattcagaaatgttg

SEQ ID NO: 1353487 - DNA, 22 bp, Homo sapiens
taggacctttccaccacagcca

SEQ ID NO: 1353488 - DNA, 17 bp, Homo sapiens
taggagacttgccagag

SEQ ID NO: 1353489 - DNA, 20 bp, Homo sapiens
taggagacttgccagagccg

SEQ ID NO: 1353490 - DNA, 23 bp, Homo sapiens
taggagctgccttggctcagaca

SEQ ID NO: 1353491 - DNA, 18 bp, Homo sapiens
taggatagctaactgtaa

SEQ ID NO: 1353492 - DNA, 18 bp, Homo sapiens
taggatgaaaagattctt

SEQ ID NO: 1353493 - DNA, 19 bp, Homo sapiens
tagggaaaaaccagcgtgt

SEQ ID NO: 1353494 - DNA, 15 bp, Homo sapiens
tagggaactggggaa

SEQ ID NO: 1353495 - DNA, 13 bp, Homo sapiens
tagggaagataat

SEQ ID NO: 1353496 - DNA, 20 bp, Homo sapiens
tagggcaccaggggtttctc

SEQ ID NO: 1353497 - DNA, 23 bp, Homo sapiens
taggtgatcccgttttccccatg

SEQ ID NO: 1353498 - DNA, 21 bp, Homo sapiens
taggttggcaaaaaggcagga

SEQ ID NO: 1353499 - DNA, 11 bp, Homo sapiens
tagtaagaata

SEQ ID NO: 1353500 - DNA, 22 bp, Homo sapiens
tagtaagaataccacatcaaat

SEQ ID NO: 1353501 - DNA, 16 bp, Homo sapiens
tagtaagcatagaaac

SEQ ID NO: 1353502 - DNA, 15 bp, Homo sapiens
tagtaatgttttata

SEQ ID NO: 1353503 - DNA, 15 bp, Homo sapiens
tagtatctatatgac

SEQ ID NO: 1353504 - DNA, 23 bp, Homo sapiens
tagtattatcaaagggataaaga

SEQ ID NO: 1353505 - DNA, 23 bp, Homo sapiens
tagtcaacagtaccctggttgtg

SEQ ID NO: 1353506 - DNA, 18 bp, Homo sapiens
tagtcaatggcttgttca

SEQ ID NO: 1353507 - DNA, 18 bp, Homo sapiens
tagtctctttaaaaggaa

SEQ ID NO: 1353508 - DNA, 14 bp, Homo sapiens
tagtcttttgcttt

SEQ ID NO: 1353509 - DNA, 15 bp, Homo sapiens
tagtcttttgctttt

SEQ ID NO: 1353510 - DNA, 21 bp, Homo sapiens
tagtcttttgcttttggcaaa

SEQ ID NO: 1353511 - DNA, 20 bp, Homo sapiens
tagtgaaaattgtttagtga

SEQ ID NO: 1353512 - DNA, 17 bp, Homo sapiens
tagtgatcaagaagact

SEQ ID NO: 1353513 - DNA, 23 bp, Homo sapiens
tagtgtacatttctataaataga

SEQ ID NO: 1353514 - DNA, 11 bp, Homo sapiens
tagttactgtg

SEQ ID NO: 1353515 - DNA, 21 bp, Homo sapiens
tagttatgtaaataattcttt

SEQ ID NO: 1353516 - DNA, 16 bp, Homo sapiens
tagttctgtatttgaa

SEQ ID NO: 1353517 - DNA, 21 bp, Homo sapiens
tagttctgtatttgaaagtgc

SEQ ID NO: 1353518 - DNA, 12 bp, Homo sapiens
tagttctttaaa

SEQ ID NO: 1353519 - DNA, 16 bp, Homo sapiens
tagttgaatacttgaa

SEQ ID NO: 1353520 - DNA, 19 bp, Homo sapiens
tagttgaatacttgaacca

SEQ ID NO: 1353521 - DNA, 18 bp, Homo sapiens
tagttgtaaaccaagtga

SEQ ID NO: 1353522 - DNA, 14 bp, Homo sapiens
tagtttctgtggtt

SEQ ID NO: 1353523 - DNA, 14 bp, Homo sapiens
tagtttgtgagaaa

SEQ ID NO: 1353524 - DNA, 14 bp, Homo sapiens
tagttttatttata

SEQ ID NO: 1353525 - DNA, 20 bp, Homo sapiens
tataaaaaccccaaactgtt

SEQ ID NO: 1353526 - DNA, 14 bp, Homo sapiens
tataaaagaaacac

SEQ ID NO: 1353527 - DNA, 12 bp, Homo sapiens
tataaaatacat

SEQ ID NO: 1353528 - DNA, 12 bp, Homo sapiens
tataaaattatg

SEQ ID NO: 1353529 - DNA, 18 bp, Homo sapiens
tataaacagaaatggaaa

SEQ ID NO: 1353530 - DNA, 15 bp, Homo sapiens
tataaatatcattgt

SEQ ID NO: 1353531 - DNA, 16 bp, Homo sapiens
tataaatgtataaata

SEQ ID NO: 1353532 - DNA, 22 bp, Homo sapiens
tataaatttttaagagaaagaa

SEQ ID NO: 1353533 - DNA, 14 bp, Homo sapiens
tataacacattttt

SEQ ID NO: 1353534 - DNA, 17 bp, Homo sapiens
tataaccagctgaagtt

SEQ ID NO: 1353535 - DNA, 21 bp, Homo sapiens
tataagccaaaattaaggtgt

SEQ ID NO: 1353536 - DNA, 22 bp, Homo sapiens
tataagccaaaattaaggtgtt

SEQ ID NO: 1353537 - DNA, 22 bp, Homo sapiens
tataaggaaagcaataaatgaa

SEQ ID NO: 1353538 - DNA, 23 bp, Homo sapiens
tataaggaaagcaataaatgaat

SEQ ID NO: 1353539 - DNA, 22 bp, Homo sapiens
tataatccttaaatcttaatgt

SEQ ID NO: 1353540 - DNA, 21 bp, Homo sapiens
tataattcctatatcctgtga

SEQ ID NO: 1353541 - DNA, 14 bp, Homo sapiens
tataattgtacaaa

SEQ ID NO: 1353542 - DNA, 19 bp, Homo sapiens
tataatttatttccactaa

SEQ ID NO: 1353543 - DNA, 19 bp, Homo sapiens
tatacacgaatagacatca

SEQ ID NO: 1353544 - DNA, 17 bp, Homo sapiens
tatacagtgcagagcct

SEQ ID NO: 1353545 - DNA, 19 bp, Homo sapiens
tatacatatatatatataa

SEQ ID NO: 1353546 - DNA, 22 bp, Homo sapiens
tatacatgaagaatagaaacaa

SEQ ID NO: 1353547 - DNA, 12 bp, Homo sapiens
tatactgaagga

SEQ ID NO: 1353548 - DNA, 21 bp, Homo sapiens
tatagaggctagcttctgctt

SEQ ID NO: 1353549 - DNA, 16 bp, Homo sapiens
tatagcatcacttaaa

SEQ ID NO: 1353550 - DNA, 19 bp, Homo sapiens
tatagcctatggcagaaaa

SEQ ID NO: 1353551 - DNA, 19 bp, Homo sapiens
tataggaacatatgaaaat

SEQ ID NO: 1353552 - DNA, 15 bp, Homo sapiens
tatagtcaatggctt

SEQ ID NO: 1353553 - DNA, 18 bp, Homo sapiens
tatagtctaagactatat

SEQ ID NO: 1353554 - DNA, 22 bp, Homo sapiens
tatagttatgtaaataattctt

SEQ ID NO: 1353555 - DNA, 19 bp, Homo sapiens
tatataaaacggtgctgtg

SEQ ID NO: 1353556 - DNA, 12 bp, Homo sapiens
tatataaatgta

SEQ ID NO: 1353557 - DNA, 16 bp, Homo sapiens
tatatacaaaaagaaa

SEQ ID NO: 1353558 - DNA, 21 bp, Homo sapiens
tatatagcatctggaagatca

SEQ ID NO: 1353559 - DNA, 14 bp, Homo sapiens
tatatatacatata

SEQ ID NO: 1353560 - DNA, 14 bp, Homo sapiens
tatatatataaatg

SEQ ID NO: 1353561 - DNA, 14 bp, Homo sapiens
tatatatatataac

SEQ ID NO: 1353562 - DNA, 23 bp, Homo sapiens
tatatatgtgtatgcacagtaaa

SEQ ID NO: 1353563 - DNA, 17 bp, Homo sapiens
tatatatttctattatt

SEQ ID NO: 1353564 - DNA, 16 bp, Homo sapiens
tatatattttgtgtga

SEQ ID NO: 1353565 - DNA, 18 bp, Homo sapiens
tatatattttgtgtgaaa

SEQ ID NO: 1353566 - DNA, 15 bp, Homo sapiens
tatatcctgtgactg

SEQ ID NO: 1353567 - DNA, 18 bp, Homo sapiens
tatatcctgtgactgtct

SEQ ID NO: 1353568 - DNA, 17 bp, Homo sapiens
tatatctatatatataa

SEQ ID NO: 1353569 - DNA, 15 bp, Homo sapiens
tatatggtatatata

SEQ ID NO: 1353570 - DNA, 18 bp, Homo sapiens
tatatggtatatatacat

SEQ ID NO: 1353571 - DNA, 13 bp, Homo sapiens
tatatgtatgtgt

SEQ ID NO: 1353572 - DNA, 14 bp, Homo sapiens
tatatgtatgtgtt

SEQ ID NO: 1353573 - DNA, 19 bp, Homo sapiens
tatatgtatgtgtttagaa

SEQ ID NO: 1353574 - DNA, 19 bp, Homo sapiens
tatatgtattatttataat

SEQ ID NO: 1353575 - DNA, 14 bp, Homo sapiens
tatatgtgtatgca

SEQ ID NO: 1353576 - DNA, 11 bp, Homo sapiens
tatattacaag

SEQ ID NO: 1353577 - DNA, 12 bp, Homo sapiens
tatattacaatg

SEQ ID NO: 1353578 - DNA, 17 bp, Homo sapiens
tatattacaatgatcac

SEQ ID NO: 1353579 - DNA, 16 bp, Homo sapiens
tatattagtatgtatg

SEQ ID NO: 1353580 - DNA, 21 bp, Homo sapiens
tatattgaacttttgtactga

SEQ ID NO: 1353581 - DNA, 15 bp, Homo sapiens
tatattggttttatg

SEQ ID NO: 1353582 - DNA, 17 bp, Homo sapiens
tatattggttttatgat

SEQ ID NO: 1353583 - DNA, 14 bp, Homo sapiens
tatattgtaattta

SEQ ID NO: 1353584 - DNA, 12 bp, Homo sapiens
tatatttattga

SEQ ID NO: 1353585 - DNA, 21 bp, Homo sapiens
tatatttattgactcttgagt

SEQ ID NO: 1353586 - DNA, 17 bp, Homo sapiens
tatatttcctttatgtg

SEQ ID NO: 1353587 - DNA, 18 bp, Homo sapiens
tatatttcctttatgtga

SEQ ID NO: 1353588 - DNA, 13 bp, Homo sapiens
tatatttctaaat

SEQ ID NO: 1353589 - DNA, 17 bp, Homo sapiens
tatatttgatttattaa

SEQ ID NO: 1353590 - DNA, 20 bp, Homo sapiens
tatatttgatttattaactt

SEQ ID NO: 1353591 - DNA, 17 bp, Homo sapiens
tatatttgtaaagctat

SEQ ID NO: 1353592 - DNA, 14 bp, Homo sapiens
tatattttctgttt

SEQ ID NO: 1353593 - DNA, 22 bp, Homo sapiens
tatattttgtgtgaaattgcat

SEQ ID NO: 1353594 - DNA, 14 bp, Homo sapiens
tatcaaattaattg

SEQ ID NO: 1353595 - DNA, 17 bp, Homo sapiens
tatcaaattaattgtgt

SEQ ID NO: 1353596 - DNA, 18 bp, Homo sapiens
tatcaatatctaatatat

SEQ ID NO: 1353597 - DNA, 21 bp, Homo sapiens
tatcagtaacccccttaaatt

SEQ ID NO: 1353598 - DNA, 17 bp, Homo sapiens
tatccagaaaactgtga

SEQ ID NO: 1353599 - DNA, 14 bp, Homo sapiens
tatccagttactgc

SEQ ID NO: 1353600 - DNA, 20 bp, Homo sapiens
tatccccccatcttgcttcc

SEQ ID NO: 1353601 - DNA, 22 bp, Homo sapiens
tatcctgattataggattttaa

SEQ ID NO: 1353602 - DNA, 21 bp, Homo sapiens
tatcctggaacaatattttat

SEQ ID NO: 1353603 - DNA, 22 bp, Homo sapiens
tatcctgggggacccaatgtag

SEQ ID NO: 1353604 - DNA, 13 bp, Homo sapiens
tatcctgtgactg

SEQ ID NO: 1353605 - DNA, 14 bp, Homo sapiens
tatcctgtgactgt

SEQ ID NO: 1353606 - DNA, 18 bp, Homo sapiens
tatctaatatatatgaat

SEQ ID NO: 1353607 - DNA, 21 bp, Homo sapiens
tatctaatatatatgaataaa

SEQ ID NO: 1353608 - DNA, 18 bp, Homo sapiens
tatctagttctaacagtg

SEQ ID NO: 1353609 - DNA, 18 bp, Homo sapiens
tatctataaaatagatat

SEQ ID NO: 1353610 - DNA, 13 bp, Homo sapiens
tatctattaatat

SEQ ID NO: 1353611 - DNA, 15 bp, Homo sapiens
tatctattaatatat

SEQ ID NO: 1353612 - DNA, 18 bp, Homo sapiens
tatctattaatatatgta

SEQ ID NO: 1353613 - DNA, 12 bp, Homo sapiens
tatctatttgag

SEQ ID NO: 1353614 - DNA, 16 bp, Homo sapiens
tatctcaatgaaccat

SEQ ID NO: 1353615 - DNA, 17 bp, Homo sapiens
tatctctatttgagaat

SEQ ID NO: 1353616 - DNA, 20 bp, Homo sapiens
tatctgtttcctgacattgt

SEQ ID NO: 1353617 - DNA, 14 bp, Homo sapiens
tatcttacaatatt

SEQ ID NO: 1353618 - DNA, 16 bp, Homo sapiens
tatcttgatacattca

SEQ ID NO: 1353619 - DNA, 19 bp, Homo sapiens
tatgaaaaattggggagga

SEQ ID NO: 1353620 - DNA, 13 bp, Homo sapiens
tatgaaaacatgg

SEQ ID NO: 1353621 - DNA, 20 bp, Homo sapiens
tatgaaaacatggaacagtg

SEQ ID NO: 1353622 - DNA, 12 bp, Homo sapiens
tatgaataaagt

SEQ ID NO: 1353623 - DNA, 16 bp, Homo sapiens
tatgaatgatttgcat

SEQ ID NO: 1353624 - DNA, 21 bp, Homo sapiens
tatgagattggttttcctgtg

SEQ ID NO: 1353625 - DNA, 11 bp, Homo sapiens
tatgcaaaagg

SEQ ID NO: 1353626 - DNA, 14 bp, Homo sapiens
tatgcacagtaaaa

SEQ ID NO: 1353627 - DNA, 13 bp, Homo sapiens
tatgctttattaa

SEQ ID NO: 1353628 - DNA, 13 bp, Homo sapiens
tatggaaaactgt

SEQ ID NO: 1353629 - DNA, 18 bp, Homo sapiens
tatggactatctgtctgg

SEQ ID NO: 1353630 - DNA, 21 bp, Homo sapiens
tatggactatctgtctggtgg

SEQ ID NO: 1353631 - DNA, 13 bp, Homo sapiens
tatgtaaataatt

SEQ ID NO: 1353632 - DNA, 12 bp, Homo sapiens
tatgtataaaat

SEQ ID NO: 1353633 - DNA, 19 bp, Homo sapiens
tatgtattatttacattta

SEQ ID NO: 1353634 - DNA, 21 bp, Homo sapiens
tatgtattatttacatttaat

SEQ ID NO: 1353635 - DNA, 14 bp, Homo sapiens
tatgtattcttttc

SEQ ID NO: 1353636 - DNA, 19 bp, Homo sapiens
tatgtgggatattgaatgt

SEQ ID NO: 1353637 - DNA, 17 bp, Homo sapiens
tatgtggttttgtaatt

SEQ ID NO: 1353638 - DNA, 16 bp, Homo sapiens
tatgtgtttagaattg

SEQ ID NO: 1353639 - DNA, 13 bp, Homo sapiens
tatgtttttctgt

SEQ ID NO: 1353640 - DNA, 15 bp, Homo sapiens
tatgtttttctgtgt

SEQ ID NO: 1353641 - DNA, 22 bp, Homo sapiens
tatgtttttctgtgtgtcagtt

SEQ ID NO: 1353642 - DNA, 12 bp, Homo sapiens
tattaaagacag

SEQ ID NO: 1353643 - DNA, 17 bp, Homo sapiens
tattaaatttttttgta

SEQ ID NO: 1353644 - DNA, 20 bp, Homo sapiens
tattaaatttttttgtatga

SEQ ID NO: 1353645 - DNA, 15 bp, Homo sapiens
tattaacttaataat

SEQ ID NO: 1353646 - DNA, 16 bp, Homo sapiens
tattaacttaataatc

SEQ ID NO: 1353647 - DNA, 20 bp, Homo sapiens
tattaacttaataatcaaga

SEQ ID NO: 1353648 - DNA, 22 bp, Homo sapiens
tattaatattcagggtaaatag

SEQ ID NO: 1353649 - DNA, 12 bp, Homo sapiens
tattaatcactg

SEQ ID NO: 1353650 - DNA, 19 bp, Homo sapiens
tattaatcactgtgtatat

SEQ ID NO: 1353651 - DNA, 17 bp, Homo sapiens
tattaatgcactttcta

SEQ ID NO: 1353652 - DNA, 18 bp, Homo sapiens
tattaatgttttcaaaag

SEQ ID NO: 1353653 - DNA, 15 bp, Homo sapiens
tattacaatgatcac

SEQ ID NO: 1353654 - DNA, 16 bp, Homo sapiens
tattactgacatttct

SEQ ID NO: 1353655 - DNA, 13 bp, Homo sapiens
tattacttccatg

SEQ ID NO: 1353656 - DNA, 19 bp, Homo sapiens
tattaggaagtgtttatgt

SEQ ID NO: 1353657 - DNA, 17 bp, Homo sapiens
tattagtgttatatgaa

SEQ ID NO: 1353658 - DNA, 21 bp, Homo sapiens
tattagtgttatatgaacata

SEQ ID NO: 1353659 - DNA, 16 bp, Homo sapiens
tattataaaggataaa

SEQ ID NO: 1353660 - DNA, 19 bp, Homo sapiens
tattataatcttataattg

SEQ ID NO: 1353661 - DNA, 20 bp, Homo sapiens
tattatcaaagggataaaga

SEQ ID NO: 1353662 - DNA, 15 bp, Homo sapiens
tattcagatgtatgt

SEQ ID NO: 1353663 - DNA, 22 bp, Homo sapiens
tattcgatactgcgactttctg

SEQ ID NO: 1353664 - DNA, 12 bp, Homo sapiens
tattgacactga

SEQ ID NO: 1353665 - DNA, 13 bp, Homo sapiens
tattgacactgaa

SEQ ID NO: 1353666 - DNA, 24 bp, Homo sapiens
tattgacactgaacttaataactg

SEQ ID NO: 1353667 - DNA, 14 bp, Homo sapiens
tattgaccattttt

SEQ ID NO: 1353668 - DNA, 14 bp, Homo sapiens
tattgactctgggt

SEQ ID NO: 1353669 - DNA, 22 bp, Homo sapiens
tattgactctgggtccttcctg

SEQ ID NO: 1353670 - DNA, 22 bp, Homo sapiens
tattgattgggaaaacatttgc

SEQ ID NO: 1353671 - DNA, 11 bp, Homo sapiens
tattgcagttt

SEQ ID NO: 1353672 - DNA, 20 bp, Homo sapiens
tattgcagtttatcattcaa

SEQ ID NO: 1353673 - DNA, 17 bp, Homo sapiens
tattgccttttaatttt

SEQ ID NO: 1353674 - DNA, 21 bp, Homo sapiens
tattgccttttaatttttaat

SEQ ID NO: 1353675 - DNA, 14 bp, Homo sapiens
tattggttttatga

SEQ ID NO: 1353676 - DNA, 17 bp, Homo sapiens
tattgtatattacaatg

SEQ ID NO: 1353677 - DNA, 19 bp, Homo sapiens
tattgtatattacaatgat

SEQ ID NO: 1353678 - DNA, 18 bp, Homo sapiens
tattgtcctattagtgtt

SEQ ID NO: 1353679 - DNA, 17 bp, Homo sapiens
tattgtttaaaatgtaa

SEQ ID NO: 1353680 - DNA, 16 bp, Homo sapiens
tattgtttctctgaaa

SEQ ID NO: 1353681 - DNA, 16 bp, Homo sapiens
tatttaaaaaaaaagt

SEQ ID NO: 1353682 - DNA, 15 bp, Homo sapiens
tatttaaaaatagaa

SEQ ID NO: 1353683 - DNA, 16 bp, Homo sapiens
tatttaaaaatagaaa

SEQ ID NO: 1353684 - DNA, 12 bp, Homo sapiens
tatttaacagaa

SEQ ID NO: 1353685 - DNA, 13 bp, Homo sapiens
tatttaagatgtg

SEQ ID NO: 1353686 - DNA, 20 bp, Homo sapiens
tatttaatggaagtgtattt

SEQ ID NO: 1353687 - DNA, 20 bp, Homo sapiens
tatttagacaagagatggga

SEQ ID NO: 1353688 - DNA, 12 bp, Homo sapiens
tatttatatgta

SEQ ID NO: 1353689 - DNA, 16 bp, Homo sapiens
tatttatatgtactgt

SEQ ID NO: 1353690 - DNA, 17 bp, Homo sapiens
tatttatatgtactgtt

SEQ ID NO: 1353691 - DNA, 14 bp, Homo sapiens
tatttatatgtatg

SEQ ID NO: 1353692 - DNA, 18 bp, Homo sapiens
tatttatatgtatgtgtt

SEQ ID NO: 1353693 - DNA, 21 bp, Homo sapiens
tatttatatgtatgtgtttag

SEQ ID NO: 1353694 - DNA, 15 bp, Homo sapiens
tatttatatttattg

SEQ ID NO: 1353695 - DNA, 23 bp, Homo sapiens
tatttatccagaaaactgtgatt

SEQ ID NO: 1353696 - DNA, 16 bp, Homo sapiens
tatttatctgattaag

SEQ ID NO: 1353697 - DNA, 21 bp, Homo sapiens
tatttatctgattaagttgtc

SEQ ID NO: 1353698 - DNA, 15 bp, Homo sapiens
tatttatgtactttt

SEQ ID NO: 1353699 - DNA, 18 bp, Homo sapiens
tatttattaatatttaac

SEQ ID NO: 1353700 - DNA, 17 bp, Homo sapiens
tatttattgactcttga

SEQ ID NO: 1353701 - DNA, 20 bp, Homo sapiens
tatttattttcctaaagaga

SEQ ID NO: 1353702 - DNA, 13 bp, Homo sapiens
tatttcagtgaat

SEQ ID NO: 1353703 - DNA, 20 bp, Homo sapiens
tatttcatcacaagaacaca

SEQ ID NO: 1353704 - DNA, 17 bp, Homo sapiens
tatttccactaaaaata

SEQ ID NO: 1353705 - DNA, 11 bp, Homo sapiens
tatttccttta

SEQ ID NO: 1353706 - DNA, 18 bp, Homo sapiens
tatttctactgtcaaatg

SEQ ID NO: 1353707 - DNA, 20 bp, Homo sapiens
tatttgaaagtgcctttgca

SEQ ID NO: 1353708 - DNA, 15 bp, Homo sapiens
tatttgaacaagtgg

SEQ ID NO: 1353709 - DNA, 19 bp, Homo sapiens
tatttgaattttaaatcta

SEQ ID NO: 1353710 - DNA, 14 bp, Homo sapiens
tatttgattattta

SEQ ID NO: 1353711 - DNA, 16 bp, Homo sapiens
tatttgcatgttatgt

SEQ ID NO: 1353712 - DNA, 19 bp, Homo sapiens
tatttgcatgttatgttta

SEQ ID NO: 1353713 - DNA, 11 bp, Homo sapiens
tatttgctttt

SEQ ID NO: 1353714 - DNA, 17 bp, Homo sapiens
tatttggtactgtattt

SEQ ID NO: 1353715 - DNA, 13 bp, Homo sapiens
tatttgtaaagct

SEQ ID NO: 1353716 - DNA, 14 bp, Homo sapiens
tatttgtaaagcta

SEQ ID NO: 1353717 - DNA, 13 bp, Homo sapiens
tattttaaaacaa

SEQ ID NO: 1353718 - DNA, 18 bp, Homo sapiens
tattttaacctgcataaa

SEQ ID NO: 1353719 - DNA, 19 bp, Homo sapiens
tattttacacagaaacact

SEQ ID NO: 1353720 - DNA, 24 bp, Homo sapiens
tattttacacagaaacactgcctt

SEQ ID NO: 1353721 - DNA, 21 bp, Homo sapiens
tattttacagctcattaaact

SEQ ID NO: 1353722 - DNA, 16 bp, Homo sapiens
tattttatggttatgt

SEQ ID NO: 1353723 - DNA, 19 bp, Homo sapiens
tattttatggttatgtttt

SEQ ID NO: 1353724 - DNA, 20 bp, Homo sapiens
tattttatttagacaagaga

SEQ ID NO: 1353725 - DNA, 16 bp, Homo sapiens
tattttcatacaaatt

SEQ ID NO: 1353726 - DNA, 14 bp, Homo sapiens
tattttcatgaaaa

SEQ ID NO: 1353727 - DNA, 15 bp, Homo sapiens
tattttctaaagact

SEQ ID NO: 1353728 - DNA, 15 bp, Homo sapiens
tattttctacagtgg

SEQ ID NO: 1353729 - DNA, 12 bp, Homo sapiens
tattttgaatca

SEQ ID NO: 1353730 - DNA, 15 bp, Homo sapiens
tattttgaatcaata

SEQ ID NO: 1353731 - DNA, 16 bp, Homo sapiens
tattttgaatcaataa

SEQ ID NO: 1353732 - DNA, 23 bp, Homo sapiens
tattttgaatcaataatatattt

SEQ ID NO: 1353733 - DNA, 12 bp, Homo sapiens
tattttgtgtaa

SEQ ID NO: 1353734 - DNA, 13 bp, Homo sapiens
tattttgtgtaaa

SEQ ID NO: 1353735 - DNA, 16 bp, Homo sapiens
tattttgtgtaaaaaa

SEQ ID NO: 1353736 - DNA, 16 bp, Homo sapiens
tatttttatatttcct

SEQ ID NO: 1353737 - DNA, 21 bp, Homo sapiens
tatttttatatttcctttatg

SEQ ID NO: 1353738 - DNA, 12 bp, Homo sapiens
tatttttcactc

SEQ ID NO: 1353739 - DNA, 12 bp, Homo sapiens
tatttttcttga

SEQ ID NO: 1353740 - DNA, 12 bp, Homo sapiens
tatttttgtaaa

SEQ ID NO: 1353741 - DNA, 16 bp, Homo sapiens
tatttttgtaaagttt

SEQ ID NO: 1353742 - DNA, 11 bp, Homo sapiens
tattttttcct

SEQ ID NO: 1353743 - DNA, 14 bp, Homo sapiens
tattttttcctttt

SEQ ID NO: 1353744 - DNA, 21 bp, Homo sapiens
tattttttggacttcaaagca

SEQ ID NO: 1353745 - DNA, 16 bp, Homo sapiens
tattttttttaattgt

SEQ ID NO: 1353746 - DNA, 19 bp, Homo sapiens
tattttttttttcttcttg

SEQ ID NO: 1353747 - DNA, 14 bp, Homo sapiens
tcaaaaaaagaaaa

SEQ ID NO: 1353748 - DNA, 13 bp, Homo sapiens
tcaaaaaatgagc

SEQ ID NO: 1353749 - DNA, 22 bp, Homo sapiens
tcaaaacggttttactgcagct

SEQ ID NO: 1353750 - DNA, 18 bp, Homo sapiens
tcaaaagtagaactttgt

SEQ ID NO: 1353751 - DNA, 16 bp, Homo sapiens
tcaaaatccaaaaaga

SEQ ID NO: 1353752 - DNA, 18 bp, Homo sapiens
tcaaactacatattgtaa

SEQ ID NO: 1353753 - DNA, 14 bp, Homo sapiens
tcaaactcttaaaa

SEQ ID NO: 1353754 - DNA, 14 bp, Homo sapiens
tcaaactggggcct

SEQ ID NO: 1353755 - DNA, 20 bp, Homo sapiens
tcaaactggggcctccagaa

SEQ ID NO: 1353756 - DNA, 17 bp, Homo sapiens
tcaaactgtagaaatga

SEQ ID NO: 1353757 - DNA, 20 bp, Homo sapiens
tcaaactgtagaaatgatga

SEQ ID NO: 1353758 - DNA, 23 bp, Homo sapiens
tcaaagaggttttaaaaaaatcc

SEQ ID NO: 1353759 - DNA, 21 bp, Homo sapiens
tcaaagcttggattaaataca

SEQ ID NO: 1353760 - DNA, 18 bp, Homo sapiens
tcaaagggcccacagtga

SEQ ID NO: 1353761 - DNA, 21 bp, Homo sapiens
tcaaagtctgctctcatataa

SEQ ID NO: 1353762 - DNA, 14 bp, Homo sapiens
tcaaagttgaaaat

SEQ ID NO: 1353763 - DNA, 18 bp, Homo sapiens
tcaaagttgaaaattcat

SEQ ID NO: 1353764 - DNA, 12 bp, Homo sapiens
tcaaataagaaa

SEQ ID NO: 1353765 - DNA, 16 bp, Homo sapiens
tcaaatacacatttgc

SEQ ID NO: 1353766 - DNA, 15 bp, Homo sapiens
tcaaatgatgtgcaa

SEQ ID NO: 1353767 - DNA, 21 bp, Homo sapiens
tcaaatgatgtgcaaaacctt

SEQ ID NO: 1353768 - DNA, 15 bp, Homo sapiens
tcaaattaattgtgt

SEQ ID NO: 1353769 - DNA, 18 bp, Homo sapiens
tcaaattaattgtgtgaa

SEQ ID NO: 1353770 - DNA, 14 bp, Homo sapiens
tcaaattttttgac

SEQ ID NO: 1353771 - DNA, 22 bp, Homo sapiens
tcaacaaatattcactggcccc

SEQ ID NO: 1353772 - DNA, 18 bp, Homo sapiens
tcaacaataaaatttttt

SEQ ID NO: 1353773 - DNA, 15 bp, Homo sapiens
tcaaccgtacaatgg

SEQ ID NO: 1353774 - DNA, 18 bp, Homo sapiens
tcaacctcgcgcttgctg

SEQ ID NO: 1353775 - DNA, 21 bp, Homo sapiens
tcaacctcgcgcttgctggcc

SEQ ID NO: 1353776 - DNA, 21 bp, Homo sapiens
tcaactagtggggtttcctgg

SEQ ID NO: 1353777 - DNA, 18 bp, Homo sapiens
tcaactgggtccagaaga

SEQ ID NO: 1353778 - DNA, 13 bp, Homo sapiens
tcaactttgtaaa

SEQ ID NO: 1353779 - DNA, 19 bp, Homo sapiens
tcaactttgtaaaaatctt

SEQ ID NO: 1353780 - DNA, 16 bp, Homo sapiens
tcaagagccttaaaac

SEQ ID NO: 1353781 - DNA, 17 bp, Homo sapiens
tcaagatcaaaaaggct

SEQ ID NO: 1353782 - DNA, 21 bp, Homo sapiens
tcaagcagtcgtgcctgtgtc

SEQ ID NO: 1353783 - DNA, 22 bp, Homo sapiens
tcaagcagtcgtgcctgtgtcc

SEQ ID NO: 1353784 - DNA, 20 bp, Homo sapiens
tcaaggctacagatgtgctg

SEQ ID NO: 1353785 - DNA, 15 bp, Homo sapiens
tcaagggctgtcatt

SEQ ID NO: 1353786 - DNA, 16 bp, Homo sapiens
tcaagtaattgtgaaa

SEQ ID NO: 1353787 - DNA, 16 bp, Homo sapiens
tcaagttgtaaataat

SEQ ID NO: 1353788 - DNA, 17 bp, Homo sapiens
tcaagttgtcaggttat

SEQ ID NO: 1353789 - DNA, 21 bp, Homo sapiens
tcaataaagtgctttaaaaag

SEQ ID NO: 1353790 - DNA, 17 bp, Homo sapiens
tcaatatattgaacttt

SEQ ID NO: 1353791 - DNA, 20 bp, Homo sapiens
tcaatatattgaacttttgt

SEQ ID NO: 1353792 - DNA, 16 bp, Homo sapiens
tcaatatttttatatc

SEQ ID NO: 1353793 - DNA, 19 bp, Homo sapiens
tcaatgagagcataattta

SEQ ID NO: 1353794 - DNA, 16 bp, Homo sapiens
tcaatgctttatttgt

SEQ ID NO: 1353795 - DNA, 19 bp, Homo sapiens
tcaatgctttatttgtaaa

SEQ ID NO: 1353796 - DNA, 17 bp, Homo sapiens
tcaattgtcacttttta

SEQ ID NO: 1353797 - DNA, 23 bp, Homo sapiens
tcaatttctgtgttgccaagctc

SEQ ID NO: 1353798 - DNA, 12 bp, Homo sapiens
tcacaaatgact

SEQ ID NO: 1353799 - DNA, 18 bp, Homo sapiens
tcacaaatgactttatta

SEQ ID NO: 1353800 - DNA, 15 bp, Homo sapiens
tcacactggttctca

SEQ ID NO: 1353801 - DNA, 20 bp, Homo sapiens
tcacactggttctcaatgaa

SEQ ID NO: 1353802 - DNA, 21 bp, Homo sapiens
tcacactggttctcaatgaaa

SEQ ID NO: 1353803 - DNA, 16 bp, Homo sapiens
tcacagagtcaaggcc

SEQ ID NO: 1353804 - DNA, 13 bp, Homo sapiens
tcacagcctctga

SEQ ID NO: 1353805 - DNA, 15 bp, Homo sapiens
tcacagggtgggcct

SEQ ID NO: 1353806 - DNA, 16 bp, Homo sapiens
tcacagggtgggcctc

SEQ ID NO: 1353807 - DNA, 17 bp, Homo sapiens
tcacagggtgggcctcg

SEQ ID NO: 1353808 - DNA, 15 bp, Homo sapiens
tcacagtagagccag

SEQ ID NO: 1353809 - DNA, 17 bp, Homo sapiens
tcacagtttttcctgga

SEQ ID NO: 1353810 - DNA, 14 bp, Homo sapiens
tcacattcttggct

SEQ ID NO: 1353811 - DNA, 16 bp, Homo sapiens
tcacattgttaagaaa

SEQ ID NO: 1353812 - DNA, 21 bp, Homo sapiens
tcaccagcccatcgccacaaa

SEQ ID NO: 1353813 - DNA, 21 bp, Homo sapiens
tcaccagccccactgccagca

SEQ ID NO: 1353814 - DNA, 22 bp, Homo sapiens
tcaccagccccactgccagcag

SEQ ID NO: 1353815 - DNA, 23 bp, Homo sapiens
tcaccagccccactgccagcagc

SEQ ID NO: 1353816 - DNA, 16 bp, Homo sapiens
tcaccatgtaagcact

SEQ ID NO: 1353817 - DNA, 17 bp, Homo sapiens
tcaccatgtaagcactc

SEQ ID NO: 1353818 - DNA, 18 bp, Homo sapiens
tcaccatgtgagctcttc

SEQ ID NO: 1353819 - DNA, 20 bp, Homo sapiens
tcaccccctcccacccccag

SEQ ID NO: 1353820 - DNA, 18 bp, Homo sapiens
tcaccctcttcctgtgat

SEQ ID NO: 1353821 - DNA, 22 bp, Homo sapiens
tcaccgactgaaaatattgttt

SEQ ID NO: 1353822 - DNA, 13 bp, Homo sapiens
tcaccgcccatca

SEQ ID NO: 1353823 - DNA, 15 bp, Homo sapiens
tcaccgcccatcagg

SEQ ID NO: 1353824 - DNA, 20 bp, Homo sapiens
tcaccgcccatcagggttct

SEQ ID NO: 1353825 - DNA, 23 bp, Homo sapiens
tcacctcatgcccaccccctgcc

SEQ ID NO: 1353826 - DNA, 20 bp, Homo sapiens
tcaccttctagtcttggcca

SEQ ID NO: 1353827 - DNA, 14 bp, Homo sapiens
tcacggaagagcct

SEQ ID NO: 1353828 - DNA, 16 bp, Homo sapiens
tcacggaagagccttg

SEQ ID NO: 1353829 - DNA, 21 bp, Homo sapiens
tcacgtttggtgcttctcaga

SEQ ID NO: 1353830 - DNA, 23 bp, Homo sapiens
tcactaaagcatgaaatgtgaat

SEQ ID NO: 1353831 - DNA, 15 bp, Homo sapiens
tcactaatttttgta

SEQ ID NO: 1353832 - DNA, 16 bp, Homo sapiens
tcactaatttttgtat

SEQ ID NO: 1353833 - DNA, 19 bp, Homo sapiens
tcactaggcccccacttgc

SEQ ID NO: 1353834 - DNA, 15 bp, Homo sapiens
tcactcactctaaag

SEQ ID NO: 1353835 - DNA, 15 bp, Homo sapiens
tcactcattgctgag

SEQ ID NO: 1353836 - DNA, 17 bp, Homo sapiens
tcactcattgctgagcc

SEQ ID NO: 1353837 - DNA, 18 bp, Homo sapiens
tcactcattgctgagcct

SEQ ID NO: 1353838 - DNA, 22 bp, Homo sapiens
tcactcattgctgagcctctgc

SEQ ID NO: 1353839 - DNA, 20 bp, Homo sapiens
tcactctaagtcatgtatgt

SEQ ID NO: 1353840 - DNA, 20 bp, Homo sapiens
tcactgccacactctccatc

SEQ ID NO: 1353841 - DNA, 16 bp, Homo sapiens
tcactgccaggccagc

SEQ ID NO: 1353842 - DNA, 18 bp, Homo sapiens
tcactgccaggccagcct

SEQ ID NO: 1353843 - DNA, 20 bp, Homo sapiens
tcactgccaggccagcctcc

SEQ ID NO: 1353844 - DNA, 23 bp, Homo sapiens
tcactgccaggccagcctccgag

SEQ ID NO: 1353845 - DNA, 18 bp, Homo sapiens
tcactggaaaggggagag

SEQ ID NO: 1353846 - DNA, 23 bp, Homo sapiens
tcactggaaaggggagagcctgc

SEQ ID NO: 1353847 - DNA, 13 bp, Homo sapiens
tcactggggcaga

SEQ ID NO: 1353848 - DNA, 18 bp, Homo sapiens
tcactgtatcattttctt

SEQ ID NO: 1353849 - DNA, 14 bp, Homo sapiens
tcactgtgtatatt

SEQ ID NO: 1353850 - DNA, 19 bp, Homo sapiens
tcactgtgtatatttgatt

SEQ ID NO: 1353851 - DNA, 12 bp, Homo sapiens
tcactgtttaga

SEQ ID NO: 1353852 - DNA, 16 bp, Homo sapiens
tcactgtttagatttg

SEQ ID NO: 1353853 - DNA, 13 bp, Homo sapiens
tcacttaaaacac

SEQ ID NO: 1353854 - DNA, 16 bp, Homo sapiens
tcagaaagctttattt

SEQ ID NO: 1353855 - DNA, 13 bp, Homo sapiens
tcagaaatataac

SEQ ID NO: 1353856 - DNA, 14 bp, Homo sapiens
tcagaagcaaacaa

SEQ ID NO: 1353857 - DNA, 20 bp, Homo sapiens
tcagaagcacagaatatttt

SEQ ID NO: 1353858 - DNA, 17 bp, Homo sapiens
tcagacagagaggactg

SEQ ID NO: 1353859 - DNA, 14 bp, Homo sapiens
tcagagacaaaata

SEQ ID NO: 1353860 - DNA, 16 bp, Homo sapiens
tcagagatgcaccacc

SEQ ID NO: 1353861 - DNA, 21 bp, Homo sapiens
tcagagatgcaccaccaagcc

SEQ ID NO: 1353862 - DNA, 16 bp, Homo sapiens
tcagagtcagccagga

SEQ ID NO: 1353863 - DNA, 16 bp, Homo sapiens
tcagatgtttaaaaca

SEQ ID NO: 1353864 - DNA, 15 bp, Homo sapiens
tcagcaaaagatgct

SEQ ID NO: 1353865 - DNA, 19 bp, Homo sapiens
tcagcagttgctggtaaaa

SEQ ID NO: 1353866 - DNA, 22 bp, Homo sapiens
tcagccaaggttttataaggct

SEQ ID NO: 1353867 - DNA, 23 bp, Homo sapiens
tcagccaggaccataccgggtct

SEQ ID NO: 1353868 - DNA, 18 bp, Homo sapiens
tcagcctgctccagctgt

SEQ ID NO: 1353869 - DNA, 12 bp, Homo sapiens
tcagcctgggca

SEQ ID NO: 1353870 - DNA, 20 bp, Homo sapiens
tcagcgactccgttggccac

SEQ ID NO: 1353871 - DNA, 12 bp, Homo sapiens
tcagctccagct

SEQ ID NO: 1353872 - DNA, 18 bp, Homo sapiens
tcaggagaattagatttc

SEQ ID NO: 1353873 - DNA, 21 bp, Homo sapiens
tcaggagttactggatttgtt

SEQ ID NO: 1353874 - DNA, 18 bp, Homo sapiens
tcaggcaggtgggatgga

SEQ ID NO: 1353875 - DNA, 23 bp, Homo sapiens
tcaggccggcagccccagcctgc

SEQ ID NO: 1353876 - DNA, 13 bp, Homo sapiens
tcaggctcccagg

SEQ ID NO: 1353877 - DNA, 18 bp, Homo sapiens
tcagggccatgctgaggc

SEQ ID NO: 1353878 - DNA, 21 bp, Homo sapiens
tcagggccatgctgaggcctg

SEQ ID NO: 1353879 - DNA, 23 bp, Homo sapiens
tcagggccatgctgaggcctggg

SEQ ID NO: 1353880 - DNA, 18 bp, Homo sapiens
tcagggctggctcctgat

SEQ ID NO: 1353881 - DNA, 19 bp, Homo sapiens
tcaggggtgtgcggccttt

SEQ ID NO: 1353882 - DNA, 23 bp, Homo sapiens
tcagtaacccccttaaatttaat

SEQ ID NO: 1353883 - DNA, 15 bp, Homo sapiens
tcagtaactgtcagg

SEQ ID NO: 1353884 - DNA, 14 bp, Homo sapiens
tcagtactttttta

SEQ ID NO: 1353885 - DNA, 15 bp, Homo sapiens
tcagtgccctccagc

SEQ ID NO: 1353886 - DNA, 17 bp, Homo sapiens
tcagtggcgagaaataa

SEQ ID NO: 1353887 - DNA, 19 bp, Homo sapiens
tcagtttgttggaaagtaa

SEQ ID NO: 1353888 - DNA, 22 bp, Homo sapiens
tcataaattatttgattattta

SEQ ID NO: 1353889 - DNA, 16 bp, Homo sapiens
tcatactcgagtctga

SEQ ID NO: 1353890 - DNA, 17 bp, Homo sapiens
tcatagccataaatgat

SEQ ID NO: 1353891 - DNA, 20 bp, Homo sapiens
tcatagtactctttgtagca

SEQ ID NO: 1353892 - DNA, 22 bp, Homo sapiens
tcatagtactctttgtagcaaa

SEQ ID NO: 1353893 - DNA, 17 bp, Homo sapiens
tcatagtatccatattt

SEQ ID NO: 1353894 - DNA, 21 bp, Homo sapiens
tcatagttactgtgtaaactc

SEQ ID NO: 1353895 - DNA, 15 bp, Homo sapiens
tcatatattaaacat

SEQ ID NO: 1353896 - DNA, 21 bp, Homo sapiens
tcatatattaaacatccacaa

SEQ ID NO: 1353897 - DNA, 11 bp, Homo sapiens
tcatatgaaaa

SEQ ID NO: 1353898 - DNA, 21 bp, Homo sapiens
tcatatgaaaaaaatgcattt

SEQ ID NO: 1353899 - DNA, 16 bp, Homo sapiens
tcatatgtaatctcta

SEQ ID NO: 1353900 - DNA, 22 bp, Homo sapiens
tcatatgtaatctctaggaagt

SEQ ID NO: 1353901 - DNA, 14 bp, Homo sapiens
tcatattgtttcct

SEQ ID NO: 1353902 - DNA, 17 bp, Homo sapiens
tcatcaaagaacaaaca

SEQ ID NO: 1353903 - DNA, 23 bp, Homo sapiens
tcatcaatcaaataagtatttat

SEQ ID NO: 1353904 - DNA, 16 bp, Homo sapiens
tcatcatccagatgtg

SEQ ID NO: 1353905 - DNA, 21 bp, Homo sapiens
tcatctcatttaagggaaaaa

SEQ ID NO: 1353906 - DNA, 14 bp, Homo sapiens
tcatctgaaatgtt

SEQ ID NO: 1353907 - DNA, 13 bp, Homo sapiens
tcatctgcaaaag

SEQ ID NO: 1353908 - DNA, 14 bp, Homo sapiens
tcatctggagttct

SEQ ID NO: 1353909 - DNA, 14 bp, Homo sapiens
tcatgaccagtaaa

SEQ ID NO: 1353910 - DNA, 15 bp, Homo sapiens
tcatgaccagtaaag

SEQ ID NO: 1353911 - DNA, 19 bp, Homo sapiens
tcatgaggagggtggggga

SEQ ID NO: 1353912 - DNA, 13 bp, Homo sapiens
tcatgattagcaa

SEQ ID NO: 1353913 - DNA, 13 bp, Homo sapiens
tcatgatttataa

SEQ ID NO: 1353914 - DNA, 16 bp, Homo sapiens
tcatgatttataaatg

SEQ ID NO: 1353915 - DNA, 21 bp, Homo sapiens
tcatgcacttaaagaagtatt

SEQ ID NO: 1353916 - DNA, 16 bp, Homo sapiens
tcatggctgctgttgc

SEQ ID NO: 1353917 - DNA, 18 bp, Homo sapiens
tcatgtaaaacagaaaaa

SEQ ID NO: 1353918 - DNA, 21 bp, Homo sapiens
tcatgtccaaacgtcctcttt

SEQ ID NO: 1353919 - DNA, 17 bp, Homo sapiens
tcattacttgttgccta

SEQ ID NO: 1353920 - DNA, 17 bp, Homo sapiens
tcattattctctgctat

SEQ ID NO: 1353921 - DNA, 14 bp, Homo sapiens
tcattcagaaatgt

SEQ ID NO: 1353922 - DNA, 19 bp, Homo sapiens
tcattcagcagcaaatttt

SEQ ID NO: 1353923 - DNA, 21 bp, Homo sapiens
tcattcagcagcaaattttca

SEQ ID NO: 1353924 - DNA, 23 bp, Homo sapiens
tcattcagcagcaaattttcagc

SEQ ID NO: 1353925 - DNA, 20 bp, Homo sapiens
tcattcctttttatttatat

SEQ ID NO: 1353926 - DNA, 15 bp, Homo sapiens
tcattcttactaaaa

SEQ ID NO: 1353927 - DNA, 17 bp, Homo sapiens
tcattgcacataagctt

SEQ ID NO: 1353928 - DNA, 17 bp, Homo sapiens
tcattgctgagcctctg

SEQ ID NO: 1353929 - DNA, 23 bp, Homo sapiens
tcattgctgagcctctgctcccc

SEQ ID NO: 1353930 - DNA, 14 bp, Homo sapiens
tcatttaagggaaa

SEQ ID NO: 1353931 - DNA, 19 bp, Homo sapiens
tcatttaagggaaagaaaa

SEQ ID NO: 1353932 - DNA, 21 bp, Homo sapiens
tcatttcagaagttagtttgt

SEQ ID NO: 1353933 - DNA, 16 bp, Homo sapiens
tcatttcatctcattt

SEQ ID NO: 1353934 - DNA, 17 bp, Homo sapiens
tcatttcatctcattta

SEQ ID NO: 1353935 - DNA, 18 bp, Homo sapiens
tcatttcatctcatttaa

SEQ ID NO: 1353936 - DNA, 22 bp, Homo sapiens
tcatttgttaaaattatcaata

SEQ ID NO: 1353937 - DNA, 14 bp, Homo sapiens
tcattttgaaattg

SEQ ID NO: 1353938 - DNA, 16 bp, Homo sapiens
tcatttttatagcaac

SEQ ID NO: 1353939 - DNA, 21 bp, Homo sapiens
tcatttttatagcaacaacaa

SEQ ID NO: 1353940 - DNA, 19 bp, Homo sapiens
tcatttttcaatagcacat

SEQ ID NO: 1353941 - DNA, 19 bp, Homo sapiens
tccaaaaagctcctggggc

SEQ ID NO: 1353942 - DNA, 16 bp, Homo sapiens
tccaaagaggctgccc

SEQ ID NO: 1353943 - DNA, 19 bp, Homo sapiens
tccaaagaggctgcccctc

SEQ ID NO: 1353944 - DNA, 21 bp, Homo sapiens
tccaaatggagaagctgcagg

SEQ ID NO: 1353945 - DNA, 21 bp, Homo sapiens
tccaaatttttttttaaagca

SEQ ID NO: 1353946 - DNA, 15 bp, Homo sapiens
tccaaccagacctgg

SEQ ID NO: 1353947 - DNA, 17 bp, Homo sapiens
tccaaccagacctggaa

SEQ ID NO: 1353948 - DNA, 20 bp, Homo sapiens
tccaagatttaaatgccata

SEQ ID NO: 1353949 - DNA, 19 bp, Homo sapiens
tccaagccccatcttctaa

SEQ ID NO: 1353950 - DNA, 23 bp, Homo sapiens
tccaagccccatcttctaaatgg

SEQ ID NO: 1353951 - DNA, 15 bp, Homo sapiens
tccaagcctccacag

SEQ ID NO: 1353952 - DNA, 20 bp, Homo sapiens
tccaagcctccacagcgagg

SEQ ID NO: 1353953 - DNA, 18 bp, Homo sapiens
tccacatctgccttaaaa

SEQ ID NO: 1353954 - DNA, 19 bp, Homo sapiens
tccacccaaccctatctcc

SEQ ID NO: 1353955 - DNA, 21 bp, Homo sapiens
tccacgcgtgccgtggcacca

SEQ ID NO: 1353956 - DNA, 15 bp, Homo sapiens
tccactacacctggc

SEQ ID NO: 1353957 - DNA, 16 bp, Homo sapiens
tccactacacctggct

SEQ ID NO: 1353958 - DNA, 15 bp, Homo sapiens
tccactcgtgtgttt

SEQ ID NO: 1353959 - DNA, 16 bp, Homo sapiens
tccactcgtgtgtttc

SEQ ID NO: 1353960 - DNA, 15 bp, Homo sapiens
tccactctgcttctc

SEQ ID NO: 1353961 - DNA, 24 bp, Homo sapiens
tccactctgcttctctgacttctg

SEQ ID NO: 1353962 - DNA, 15 bp, Homo sapiens
tccactttgtttcgt

SEQ ID NO: 1353963 - DNA, 18 bp, Homo sapiens
tccactttgtttcgtggg

SEQ ID NO: 1353964 - DNA, 22 bp, Homo sapiens
tccactttgtttcgtggggagg

SEQ ID NO: 1353965 - DNA, 23 bp, Homo sapiens
tccagaaaactgtgatttcagga

SEQ ID NO: 1353966 - DNA, 19 bp, Homo sapiens
tccagaaatacaattttag

SEQ ID NO: 1353967 - DNA, 14 bp, Homo sapiens
tccagacttccttg

SEQ ID NO: 1353968 - DNA, 14 bp, Homo sapiens
tccagatgtggcta

SEQ ID NO: 1353969 - DNA, 22 bp, Homo sapiens
tccagcaacacagcctgggccc

SEQ ID NO: 1353970 - DNA, 14 bp, Homo sapiens
tccagcaccttgtg

SEQ ID NO: 1353971 - DNA, 23 bp, Homo sapiens
tccagccaaagcctcctccagcc

SEQ ID NO: 1353972 - DNA, 13 bp, Homo sapiens
tccagccagcgcc

SEQ ID NO: 1353973 - DNA, 19 bp, Homo sapiens
tccagccagcgcctccctc

SEQ ID NO: 1353974 - DNA, 23 bp, Homo sapiens
tccagccagcgcctccctccacc

SEQ ID NO: 1353975 - DNA, 18 bp, Homo sapiens
tccagcccctctggtcgc

SEQ ID NO: 1353976 - DNA, 23 bp, Homo sapiens
tccagcccctctggtcgctcctg

SEQ ID NO: 1353977 - DNA, 12 bp, Homo sapiens
tccagctctgga

SEQ ID NO: 1353978 - DNA, 20 bp, Homo sapiens
tccagctctggaggggaggg

SEQ ID NO: 1353979 - DNA, 21 bp, Homo sapiens
tccagctgcccttccgcagtg

SEQ ID NO: 1353980 - DNA, 12 bp, Homo sapiens
tccagctggcct

SEQ ID NO: 1353981 - DNA, 17 bp, Homo sapiens
tccagctggcctggaca

SEQ ID NO: 1353982 - DNA, 16 bp, Homo sapiens
tccagctttctgccat

SEQ ID NO: 1353983 - DNA, 22 bp, Homo sapiens
tccaggaaagtggccaagaagc

SEQ ID NO: 1353984 - DNA, 19 bp, Homo sapiens
tccaggcctgcctcccact

SEQ ID NO: 1353985 - DNA, 19 bp, Homo sapiens
tccagggaatccaagcctc

SEQ ID NO: 1353986 - DNA, 17 bp, Homo sapiens
tccagggacacacagcc

SEQ ID NO: 1353987 - DNA, 23 bp, Homo sapiens
tccaggggctgcttcctcctgga

SEQ ID NO: 1353988 - DNA, 16 bp, Homo sapiens
tccagggtccctctgt

SEQ ID NO: 1353989 - DNA, 17 bp, Homo sapiens
tccagggtccctctgtg

SEQ ID NO: 1353990 - DNA, 18 bp, Homo sapiens
tccagggtccctctgtgt

SEQ ID NO: 1353991 - DNA, 17 bp, Homo sapiens
tccaggtttaagctgtt

SEQ ID NO: 1353992 - DNA, 18 bp, Homo sapiens
tccaggtttaagctgtta

SEQ ID NO: 1353993 - DNA, 22 bp, Homo sapiens
tccagtaagatcactgtttaga

SEQ ID NO: 1353994 - DNA, 23 bp, Homo sapiens
tccagtaagatcactgtttagat

SEQ ID NO: 1353995 - DNA, 13 bp, Homo sapiens
tccagttataaga

SEQ ID NO: 1353996 - DNA, 16 bp, Homo sapiens
tccagttataagaaga

SEQ ID NO: 1353997 - DNA, 22 bp, Homo sapiens
tccatacactttgttgcaagat

SEQ ID NO: 1353998 - DNA, 17 bp, Homo sapiens
tccatattttattactg

SEQ ID NO: 1353999 - DNA, 17 bp, Homo sapiens
tccatcaccctcttcct

SEQ ID NO: 1354000 - DNA, 23 bp, Homo sapiens
tccatcaccctcttcctgtgatc

SEQ ID NO: 1354001 - DNA, 16 bp, Homo sapiens
tccatcactataataa

SEQ ID NO: 1354002 - DNA, 14 bp, Homo sapiens
tccattctcccagg

SEQ ID NO: 1354003 - DNA, 15 bp, Homo sapiens
tccattctcccaggt

SEQ ID NO: 1354004 - DNA, 14 bp, Homo sapiens
tccatttgctcttc

SEQ ID NO: 1354005 - DNA, 13 bp, Homo sapiens
tcccaagaatgca

SEQ ID NO: 1354006 - DNA, 16 bp, Homo sapiens
tcccaagaatgcaaga

SEQ ID NO: 1354007 - DNA, 13 bp, Homo sapiens
tcccaagcctcct

SEQ ID NO: 1354008 - DNA, 14 bp, Homo sapiens
tcccaagccttcgg

SEQ ID NO: 1354009 - DNA, 21 bp, Homo sapiens
tcccaagtaactgggattaca

SEQ ID NO: 1354010 - DNA, 14 bp, Homo sapiens
tcccacaaaggaga

SEQ ID NO: 1354011 - DNA, 16 bp, Homo sapiens
tcccacaaaggagagc

SEQ ID NO: 1354012 - DNA, 19 bp, Homo sapiens
tcccacatccaactccagc

SEQ ID NO: 1354013 - DNA, 16 bp, Homo sapiens
tcccacttcccaccct

SEQ ID NO: 1354014 - DNA, 19 bp, Homo sapiens
tcccagcactttgggaggc

SEQ ID NO: 1354015 - DNA, 16 bp, Homo sapiens
tcccagctacttggga

SEQ ID NO: 1354016 - DNA, 16 bp, Homo sapiens
tcccaggaagcccagg

SEQ ID NO: 1354017 - DNA, 15 bp, Homo sapiens
tcccaggcagggaga

SEQ ID NO: 1354018 - DNA, 19 bp, Homo sapiens
tcccaggggtctccctggc

SEQ ID NO: 1354019 - DNA, 18 bp, Homo sapiens
tcccaggtaccagctgcg

SEQ ID NO: 1354020 - DNA, 21 bp, Homo sapiens
tcccatgtagccccctggcct

SEQ ID NO: 1354021 - DNA, 17 bp, Homo sapiens
tcccatttgtgccagag

SEQ ID NO: 1354022 - DNA, 19 bp, Homo sapiens
tccccacagcgtccctggc

SEQ ID NO: 1354023 - DNA, 23 bp, Homo sapiens
tccccaccctgaaagccctgagc

SEQ ID NO: 1354024 - DNA, 17 bp, Homo sapiens
tccccacctccaggctt

SEQ ID NO: 1354025 - DNA, 12 bp, Homo sapiens
tccccagcctgc

SEQ ID NO: 1354026 - DNA, 13 bp, Homo sapiens
tccccagcctgcg

SEQ ID NO: 1354027 - DNA, 19 bp, Homo sapiens
tccccagcctgcgcctgct

SEQ ID NO: 1354028 - DNA, 15 bp, Homo sapiens
tccccaggggagttg

SEQ ID NO: 1354029 - DNA, 15 bp, Homo sapiens
tccccaggtccagct

SEQ ID NO: 1354030 - DNA, 16 bp, Homo sapiens
tccccatctccctgcc

SEQ ID NO: 1354031 - DNA, 18 bp, Homo sapiens
tccccatgcttccttgcc

SEQ ID NO: 1354032 - DNA, 19 bp, Homo sapiens
tcccccaccggtccagctg

SEQ ID NO: 1354033 - DNA, 20 bp, Homo sapiens
tcccccaccggtccagctgg

SEQ ID NO: 1354034 - DNA, 23 bp, Homo sapiens
tcccccaccggtccagctggcct

SEQ ID NO: 1354035 - DNA, 22 bp, Homo sapiens
tcccccagccatgccagctggc

SEQ ID NO: 1354036 - DNA, 18 bp, Homo sapiens
tccccgacgcccacccaa

SEQ ID NO: 1354037 - DNA, 18 bp, Homo sapiens
tccccgcagccctggcag

SEQ ID NO: 1354038 - DNA, 13 bp, Homo sapiens
tccccgcctggcc

SEQ ID NO: 1354039 - DNA, 19 bp, Homo sapiens
tccccgcctggccaggagc

SEQ ID NO: 1354040 - DNA, 22 bp, Homo sapiens
tccccggcatgagactcagtgc

SEQ ID NO: 1354041 - DNA, 14 bp, Homo sapiens
tcccctgccaccag

SEQ ID NO: 1354042 - DNA, 16 bp, Homo sapiens
tcccctgccaccaggc

SEQ ID NO: 1354043 - DNA, 14 bp, Homo sapiens
tccccttgcagccg

SEQ ID NO: 1354044 - DNA, 16 bp, Homo sapiens
tccctaatctatggtc

SEQ ID NO: 1354045 - DNA, 17 bp, Homo sapiens
tccctagcagcccaccc

SEQ ID NO: 1354046 - DNA, 19 bp, Homo sapiens
tccctagctttagaccctg

SEQ ID NO: 1354047 - DNA, 16 bp, Homo sapiens
tccctccaccccagga

SEQ ID NO: 1354048 - DNA, 18 bp, Homo sapiens
tccctccaccccaggacg

SEQ ID NO: 1354049 - DNA, 16 bp, Homo sapiens
tccctgcagatgccac

SEQ ID NO: 1354050 - DNA, 18 bp, Homo sapiens
tccctgcttccaggaaac

SEQ ID NO: 1354051 - DNA, 11 bp, Homo sapiens
tccctggcgca

SEQ ID NO: 1354052 - DNA, 20 bp, Homo sapiens
tccctgtgttaatttaagtt

SEQ ID NO: 1354053 - DNA, 22 bp, Homo sapiens
tcccttaacagttgtatttaac

SEQ ID NO: 1354054 - DNA, 18 bp, Homo sapiens
tcccttccttttccctgc

SEQ ID NO: 1354055 - DNA, 20 bp, Homo sapiens
tcccttccttttccctgctt

SEQ ID NO: 1354056 - DNA, 14 bp, Homo sapiens
tcccttgaccttaa

SEQ ID NO: 1354057 - DNA, 15 bp, Homo sapiens
tcccttgctggcccc

SEQ ID NO: 1354058 - DNA, 16 bp, Homo sapiens
tcccttgctggcccca

SEQ ID NO: 1354059 - DNA, 17 bp, Homo sapiens
tcccttgctggccccag

SEQ ID NO: 1354060 - DNA, 19 bp, Homo sapiens
tcccttgctggccccagcc

SEQ ID NO: 1354061 - DNA, 20 bp, Homo sapiens
tcccttgcttgcctgcaggg

SEQ ID NO: 1354062 - DNA, 23 bp, Homo sapiens
tcccttgcttgcctgcagggcca

SEQ ID NO: 1354063 - DNA, 15 bp, Homo sapiens
tccgagagggagaga

SEQ ID NO: 1354064 - DNA, 16 bp, Homo sapiens
tccgagaggtgggcca

SEQ ID NO: 1354065 - DNA, 21 bp, Homo sapiens
tccgaggacccaggaaaggca

SEQ ID NO: 1354066 - DNA, 16 bp, Homo sapiens
tccgccctgccactca

SEQ ID NO: 1354067 - DNA, 18 bp, Homo sapiens
tccgcgtgtgcctgtgtg

SEQ ID NO: 1354068 - DNA, 14 bp, Homo sapiens
tccgctgccagcct

SEQ ID NO: 1354069 - DNA, 15 bp, Homo sapiens
tccggcctctccagc

SEQ ID NO: 1354070 - DNA, 12 bp, Homo sapiens
tccggctcccag

SEQ ID NO: 1354071 - DNA, 15 bp, Homo sapiens
tccggctcccagcct

SEQ ID NO: 1354072 - DNA, 20 bp, Homo sapiens
tccggtcggatctctctcct

SEQ ID NO: 1354073 - DNA, 16 bp, Homo sapiens
tccgtgggacggtgcc

SEQ ID NO: 1354074 - DNA, 23 bp, Homo sapiens
tccgtgggacggtgcccaagcca

SEQ ID NO: 1354075 - DNA, 16 bp, Homo sapiens
tccgttagctcctgtg

SEQ ID NO: 1354076 - DNA, 17 bp, Homo sapiens
tccgttagctcctgtgg

SEQ ID NO: 1354077 - DNA, 19 bp, Homo sapiens
tccgttagctcctgtggcc

SEQ ID NO: 1354078 - DNA, 17 bp, Homo sapiens
tcctaatggtgatgcag

SEQ ID NO: 1354079 - DNA, 16 bp, Homo sapiens
tcctaatttctcctcc

SEQ ID NO: 1354080 - DNA, 19 bp, Homo sapiens
tcctaatttctcctccctt

SEQ ID NO: 1354081 - DNA, 18 bp, Homo sapiens
tcctacatatcccttcca

SEQ ID NO: 1354082 - DNA, 19 bp, Homo sapiens
tcctacatatcccttccag

SEQ ID NO: 1354083 - DNA, 16 bp, Homo sapiens
tcctactcggctctgc

SEQ ID NO: 1354084 - DNA, 19 bp, Homo sapiens
tcctagaggccctttgctg

SEQ ID NO: 1354085 - DNA, 19 bp, Homo sapiens
tcctaggcatttgctgaat

SEQ ID NO: 1354086 - DNA, 14 bp, Homo sapiens
tcctatatatttct

SEQ ID NO: 1354087 - DNA, 12 bp, Homo sapiens
tcctattagtgt

SEQ ID NO: 1354088 - DNA, 17 bp, Homo sapiens
tcctattagtgttatat

SEQ ID NO: 1354089 - DNA, 15 bp, Homo sapiens
tcctattctataaaa

SEQ ID NO: 1354090 - DNA, 18 bp, Homo sapiens
tcctattctataaaactc

SEQ ID NO: 1354091 - DNA, 23 bp, Homo sapiens
tcctcactcgggtttctctgtgg

SEQ ID NO: 1354092 - DNA, 12 bp, Homo sapiens
tcctcagccagt

SEQ ID NO: 1354093 - DNA, 19 bp, Homo sapiens
tcctcatggcagcctactc

SEQ ID NO: 1354094 - DNA, 17 bp, Homo sapiens
tcctcattagcattttg

SEQ ID NO: 1354095 - DNA, 13 bp, Homo sapiens
tcctccaacagct

SEQ ID NO: 1354096 - DNA, 22 bp, Homo sapiens
tcctccagtgtgggcttgacca

SEQ ID NO: 1354097 - DNA, 23 bp, Homo sapiens
tcctcccaggaagcccaggagcc

SEQ ID NO: 1354098 - DNA, 16 bp, Homo sapiens
tcctccccaaatcaat

SEQ ID NO: 1354099 - DNA, 13 bp, Homo sapiens
tcctcccttcctt

SEQ ID NO: 1354100 - DNA, 19 bp, Homo sapiens
tcctcccttccttttccct

SEQ ID NO: 1354101 - DNA, 18 bp, Homo sapiens
tcctcctcacctcatgcc

SEQ ID NO: 1354102 - DNA, 20 bp, Homo sapiens
tcctcctcccacccggctgc

SEQ ID NO: 1354103 - DNA, 14 bp, Homo sapiens
tcctcgcagcctct

SEQ ID NO: 1354104 - DNA, 16 bp, Homo sapiens
tcctcggtactcccat

SEQ ID NO: 1354105 - DNA, 18 bp, Homo sapiens
tcctctagaagccaaggg

SEQ ID NO: 1354106 - DNA, 19 bp, Homo sapiens
tcctctagaagccaaggga

SEQ ID NO: 1354107 - DNA, 14 bp, Homo sapiens
tcctctctatattt

SEQ ID NO: 1354108 - DNA, 19 bp, Homo sapiens
tcctctctccagatgtttc

SEQ ID NO: 1354109 - DNA, 22 bp, Homo sapiens
tcctctggacggcaggctcact

SEQ ID NO: 1354110 - DNA, 20 bp, Homo sapiens
tcctcttgtctgatttctta

SEQ ID NO: 1354111 - DNA, 19 bp, Homo sapiens
tcctctttagtttttggtt

SEQ ID NO: 1354112 - DNA, 16 bp, Homo sapiens
tcctgaaccgcacagc

SEQ ID NO: 1354113 - DNA, 19 bp, Homo sapiens
tcctgaaccgcacagctca

SEQ ID NO: 1354114 - DNA, 17 bp, Homo sapiens
tcctgacccattgctgt

SEQ ID NO: 1354115 - DNA, 13 bp, Homo sapiens
tcctgactggtgc

SEQ ID NO: 1354116 - DNA, 14 bp, Homo sapiens
tcctgcctcagcct

SEQ ID NO: 1354117 - DNA, 12 bp, Homo sapiens
tcctgcctgtgg

SEQ ID NO: 1354118 - DNA, 14 bp, Homo sapiens
tcctgcgggtgggg

SEQ ID NO: 1354119 - DNA, 18 bp, Homo sapiens
tcctgcgtcctcctcacc

SEQ ID NO: 1354120 - DNA, 21 bp, Homo sapiens
tcctgcgtcctcctcacctca

SEQ ID NO: 1354121 - DNA, 22 bp, Homo sapiens
tcctgctcattatgccacttcc

SEQ ID NO: 1354122 - DNA, 19 bp, Homo sapiens
tcctggaacaatattttat

SEQ ID NO: 1354123 - DNA, 20 bp, Homo sapiens
tcctggaattgccagctgac

SEQ ID NO: 1354124 - DNA, 21 bp, Homo sapiens
tcctggcactggaccccagca

SEQ ID NO: 1354125 - DNA, 16 bp, Homo sapiens
tcctggcagcccagag

SEQ ID NO: 1354126 - DNA, 20 bp, Homo sapiens
tcctggcgcctggcagtccg

SEQ ID NO: 1354127 - DNA, 15 bp, Homo sapiens
tcctggggcgtccag

SEQ ID NO: 1354128 - DNA, 14 bp, Homo sapiens
tcctgtccctgcgc

SEQ ID NO: 1354129 - DNA, 17 bp, Homo sapiens
tcctgtcccttgacctt

SEQ ID NO: 1354130 - DNA, 16 bp, Homo sapiens
tcctgtgaatgccact

SEQ ID NO: 1354131 - DNA, 22 bp, Homo sapiens
tcctgtgatagagttcttttaa

SEQ ID NO: 1354132 - DNA, 22 bp, Homo sapiens
tcctgtggccccaccctgggcc

SEQ ID NO: 1354133 - DNA, 15 bp, Homo sapiens
tccttaaatcttaat

SEQ ID NO: 1354134 - DNA, 19 bp, Homo sapiens
tccttaaatcttaatgttc

SEQ ID NO: 1354135 - DNA, 20 bp, Homo sapiens
tccttaagctgcagagattt

SEQ ID NO: 1354136 - DNA, 20 bp, Homo sapiens
tccttagaggtcctctggag

SEQ ID NO: 1354137 - DNA, 14 bp, Homo sapiens
tccttccattccac

SEQ ID NO: 1354138 - DNA, 14 bp, Homo sapiens
tccttcctgaaact

SEQ ID NO: 1354139 - DNA, 19 bp, Homo sapiens
tccttgaagaactgcaggc

SEQ ID NO: 1354140 - DNA, 20 bp, Homo sapiens
tccttgaagaactgcaggcc

SEQ ID NO: 1354141 - DNA, 21 bp, Homo sapiens
tccttggagaaatgaaaacag

SEQ ID NO: 1354142 - DNA, 19 bp, Homo sapiens
tccttggtcctagtaagaa

SEQ ID NO: 1354143 - DNA, 14 bp, Homo sapiens
tcctttatgtgaat

SEQ ID NO: 1354144 - DNA, 17 bp, Homo sapiens
tcctttatgtgaatttt

SEQ ID NO: 1354145 - DNA, 20 bp, Homo sapiens
tcctttatgtgaatttttaa

SEQ ID NO: 1354146 - DNA, 23 bp, Homo sapiens
tcctttatgtgaatttttaagct

SEQ ID NO: 1354147 - DNA, 16 bp, Homo sapiens
tcctttcccaagcctt

SEQ ID NO: 1354148 - DNA, 22 bp, Homo sapiens
tcctttgttttctgactaatta

SEQ ID NO: 1354149 - DNA, 14 bp, Homo sapiens
tccttttccctgct

SEQ ID NO: 1354150 - DNA, 15 bp, Homo sapiens
tccttttccctgctt

SEQ ID NO: 1354151 - DNA, 12 bp, Homo sapiens
tcctttttaagg

SEQ ID NO: 1354152 - DNA, 14 bp, Homo sapiens
tcctttttgacact

SEQ ID NO: 1354153 - DNA, 14 bp, Homo sapiens
tcgaatctctgtgc

SEQ ID NO: 1354154 - DNA, 22 bp, Homo sapiens
tcgaatctctgtgccttcgtct

SEQ ID NO: 1354155 - DNA, 12 bp, Homo sapiens
tcgactctgtgc

SEQ ID NO: 1354156 - DNA, 19 bp, Homo sapiens
tcgagaaagaggcaccagg

SEQ ID NO: 1354157 - DNA, 20 bp, Homo sapiens
tcgagtgccgcatctcacag

SEQ ID NO: 1354158 - DNA, 22 bp, Homo sapiens
tcgagtgccgcatctcacagct

SEQ ID NO: 1354159 - DNA, 19 bp, Homo sapiens
tcgatactgcgactttctg

SEQ ID NO: 1354160 - DNA, 13 bp, Homo sapiens
tcgcatttgtcaa

SEQ ID NO: 1354161 - DNA, 14 bp, Homo sapiens
tcgcgctcagtaaa

SEQ ID NO: 1354162 - DNA, 14 bp, Homo sapiens
tcgctcctgcccac

SEQ ID NO: 1354163 - DNA, 22 bp, Homo sapiens
tcgctgagggcagactggggca

SEQ ID NO: 1354164 - DNA, 23 bp, Homo sapiens
tcgctgtgtcagcatagaagtaa

SEQ ID NO: 1354165 - DNA, 14 bp, Homo sapiens
tcgcttcttgcctc

SEQ ID NO: 1354166 - DNA, 19 bp, Homo sapiens
tcggaacccaagcttagaa

SEQ ID NO: 1354167 - DNA, 18 bp, Homo sapiens
tcggatagttgctatttt

SEQ ID NO: 1354168 - DNA, 22 bp, Homo sapiens
tcggcgtggcccaaggctggca

SEQ ID NO: 1354169 - DNA, 15 bp, Homo sapiens
tcggctgaccatgct

SEQ ID NO: 1354170 - DNA, 16 bp, Homo sapiens
tcggctgaccatgctc

SEQ ID NO: 1354171 - DNA, 13 bp, Homo sapiens
tcggggagcctta

SEQ ID NO: 1354172 - DNA, 18 bp, Homo sapiens
tcgggtttctctgtggct

SEQ ID NO: 1354173 - DNA, 15 bp, Homo sapiens
tcgtacataatactg

SEQ ID NO: 1354174 - DNA, 18 bp, Homo sapiens
tcgtcactaatacacagt

SEQ ID NO: 1354175 - DNA, 18 bp, Homo sapiens
tcgtctttcccatgggga

SEQ ID NO: 1354176 - DNA, 22 bp, Homo sapiens
tcgtgaaagtgcatttttgtaa

SEQ ID NO: 1354177 - DNA, 12 bp, Homo sapiens
tcgtgcctgtgt

SEQ ID NO: 1354178 - DNA, 13 bp, Homo sapiens
tcgtgcctgtgtc

SEQ ID NO: 1354179 - DNA, 16 bp, Homo sapiens
tcgtgctactgcactc

SEQ ID NO: 1354180 - DNA, 22 bp, Homo sapiens
tcgtggactgagtgggaagccc

SEQ ID NO: 1354181 - DNA, 11 bp, Homo sapiens
tcgtttttgta

SEQ ID NO: 1354182 - DNA, 13 bp, Homo sapiens
tctaaaaacttct

SEQ ID NO: 1354183 - DNA, 17 bp, Homo sapiens
tctaaaaggtaatgtgt

SEQ ID NO: 1354184 - DNA, 18 bp, Homo sapiens
tctaaaaggtaatgtgtg

SEQ ID NO: 1354185 - DNA, 18 bp, Homo sapiens
tctaaaggtggtgaggca

SEQ ID NO: 1354186 - DNA, 17 bp, Homo sapiens
tctaaatctatttatta

SEQ ID NO: 1354187 - DNA, 12 bp, Homo sapiens
tctaagagaagt

SEQ ID NO: 1354188 - DNA, 18 bp, Homo sapiens
tctaagcagcttattgtt

SEQ ID NO: 1354189 - DNA, 18 bp, Homo sapiens
tctaagtcatgtatgttt

SEQ ID NO: 1354190 - DNA, 19 bp, Homo sapiens
tctaagtcatgtatgtttc

SEQ ID NO: 1354191 - DNA, 20 bp, Homo sapiens
tctaagtcatgtatgtttct

SEQ ID NO: 1354192 - DNA, 18 bp, Homo sapiens
tctaataagctagttgaa

SEQ ID NO: 1354193 - DNA, 15 bp, Homo sapiens
tctaattctctgtgg

SEQ ID NO: 1354194 - DNA, 12 bp, Homo sapiens
tctaattctgat

SEQ ID NO: 1354195 - DNA, 14 bp, Homo sapiens
tctaattctgattc

SEQ ID NO: 1354196 - DNA, 16 bp, Homo sapiens
tctacaatgacacaca

SEQ ID NO: 1354197 - DNA, 12 bp, Homo sapiens
tctacagtggtt

SEQ ID NO: 1354198 - DNA, 23 bp, Homo sapiens
tctacagtggttttatactgaag

SEQ ID NO: 1354199 - DNA, 12 bp, Homo sapiens
tctacctgccct

SEQ ID NO: 1354200 - DNA, 22 bp, Homo sapiens
tctactgtcaaatgatgtgcaa

SEQ ID NO: 1354201 - DNA, 21 bp, Homo sapiens
tctagaagccaagggaaaggg

SEQ ID NO: 1354202 - DNA, 15 bp, Homo sapiens
tctagatatcgactt

SEQ ID NO: 1354203 - DNA, 22 bp, Homo sapiens
tctagcacaatttgcactaaat

SEQ ID NO: 1354204 - DNA, 16 bp, Homo sapiens
tctagcagcacctcct

SEQ ID NO: 1354205 - DNA, 13 bp, Homo sapiens
tctagttctttgt

SEQ ID NO: 1354206 - DNA, 18 bp, Homo sapiens
tctataggaacatatgaa

SEQ ID NO: 1354207 - DNA, 14 bp, Homo sapiens
tctatcctctgtaa

SEQ ID NO: 1354208 - DNA, 23 bp, Homo sapiens
tctatgctttccaaaccttatct

SEQ ID NO: 1354209 - DNA, 16 bp, Homo sapiens
tctattaatattcagg

SEQ ID NO: 1354210 - DNA, 20 bp, Homo sapiens
tctattatggaaaactgtgt

SEQ ID NO: 1354211 - DNA, 13 bp, Homo sapiens
tctatttatgttt

SEQ ID NO: 1354212 - DNA, 16 bp, Homo sapiens
tctatttattaatatt

SEQ ID NO: 1354213 - DNA, 20 bp, Homo sapiens
tctattttttgaaaagcaga

SEQ ID NO: 1354214 - DNA, 16 bp, Homo sapiens
tctcaaaaaaagaaaa

SEQ ID NO: 1354215 - DNA, 17 bp, Homo sapiens
tctcaaagaaatattaa

SEQ ID NO: 1354216 - DNA, 17 bp, Homo sapiens
tctcaaagacctggggc

SEQ ID NO: 1354217 - DNA, 14 bp, Homo sapiens
tctcaagtaatata

SEQ ID NO: 1354218 - DNA, 22 bp, Homo sapiens
tctcaatcctaatttctcctcc

SEQ ID NO: 1354219 - DNA, 23 bp, Homo sapiens
tctcaatcctaatttctcctccc

SEQ ID NO: 1354220 - DNA, 12 bp, Homo sapiens
tctcaatgaaaa

SEQ ID NO: 1354221 - DNA, 21 bp, Homo sapiens
tctcaatgaaccataaattca

SEQ ID NO: 1354222 - DNA, 19 bp, Homo sapiens
tctcacactggttctcaat

SEQ ID NO: 1354223 - DNA, 14 bp, Homo sapiens
tctcacagctatgc

SEQ ID NO: 1354224 - DNA, 14 bp, Homo sapiens
tctcagaagcacag

SEQ ID NO: 1354225 - DNA, 13 bp, Homo sapiens
tctcagctttgag

SEQ ID NO: 1354226 - DNA, 15 bp, Homo sapiens
tctcagggcctggtc

SEQ ID NO: 1354227 - DNA, 14 bp, Homo sapiens
tctcagtgccctcc

SEQ ID NO: 1354228 - DNA, 19 bp, Homo sapiens
tctcattaatactctttat

SEQ ID NO: 1354229 - DNA, 14 bp, Homo sapiens
tctcattacttgtt

SEQ ID NO: 1354230 - DNA, 22 bp, Homo sapiens
tctcattgacttttataaagca

SEQ ID NO: 1354231 - DNA, 15 bp, Homo sapiens
tctcatttaagggaa

SEQ ID NO: 1354232 - DNA, 17 bp, Homo sapiens
tctcatttaagggaaaa

SEQ ID NO: 1354233 - DNA, 22 bp, Homo sapiens
tctccaaactgaagcagcctct

SEQ ID NO: 1354234 - DNA, 19 bp, Homo sapiens
tctccactgtgcacaccca

SEQ ID NO: 1354235 - DNA, 18 bp, Homo sapiens
tctccactgtgctttcag

SEQ ID NO: 1354236 - DNA, 15 bp, Homo sapiens
tctccagatgtttcc

SEQ ID NO: 1354237 - DNA, 22 bp, Homo sapiens
tctccagcctcagccccctgct

SEQ ID NO: 1354238 - DNA, 23 bp, Homo sapiens
tctccagcctcagccccctgctt

SEQ ID NO: 1354239 - DNA, 17 bp, Homo sapiens
tctccaggggctgcttc

SEQ ID NO: 1354240 - DNA, 18 bp, Homo sapiens
tctccaggggctgcttcc

SEQ ID NO: 1354241 - DNA, 21 bp, Homo sapiens
tctccataaacatgaaaacac

SEQ ID NO: 1354242 - DNA, 20 bp, Homo sapiens
tctccatcaccctcttcctg

SEQ ID NO: 1354243 - DNA, 16 bp, Homo sapiens
tctccatttgctcttc

SEQ ID NO: 1354244 - DNA, 20 bp, Homo sapiens
tctccctagctcctcccctt

SEQ ID NO: 1354245 - DNA, 14 bp, Homo sapiens
tctccctgcctggc

SEQ ID NO: 1354246 - DNA, 14 bp, Homo sapiens
tctccctggctccc

SEQ ID NO: 1354247 - DNA, 23 bp, Homo sapiens
tctccctggctccctcctccagg

SEQ ID NO: 1354248 - DNA, 13 bp, Homo sapiens
tctccgccagcct

SEQ ID NO: 1354249 - DNA, 21 bp, Homo sapiens
tctccgccagcctcctctgga

SEQ ID NO: 1354250 - DNA, 14 bp, Homo sapiens
tctccggcctctcc

SEQ ID NO: 1354251 - DNA, 18 bp, Homo sapiens
tctccggcctctccagcc

SEQ ID NO: 1354252 - DNA, 14 bp, Homo sapiens
tctccggctcccag

SEQ ID NO: 1354253 - DNA, 17 bp, Homo sapiens
tctccggctcccagcct

SEQ ID NO: 1354254 - DNA, 18 bp, Homo sapiens
tctccggctcccagcctc

SEQ ID NO: 1354255 - DNA, 15 bp, Homo sapiens
tctcctatatatttc

SEQ ID NO: 1354256 - DNA, 13 bp, Homo sapiens
tctcctcccttcc

SEQ ID NO: 1354257 - DNA, 14 bp, Homo sapiens
tctcctcccttcct

SEQ ID NO: 1354258 - DNA, 23 bp, Homo sapiens
tctcctcccttccttttccctgc

SEQ ID NO: 1354259 - DNA, 13 bp, Homo sapiens
tctcctgactggt

SEQ ID NO: 1354260 - DNA, 12 bp, Homo sapiens
tctccttaagct

SEQ ID NO: 1354261 - DNA, 19 bp, Homo sapiens
tctccttctaaaaacttct

SEQ ID NO: 1354262 - DNA, 15 bp, Homo sapiens
tctcctttaattgta

SEQ ID NO: 1354263 - DNA, 22 bp, Homo sapiens
tctcctttaattgtaaagtaaa

SEQ ID NO: 1354264 - DNA, 16 bp, Homo sapiens
tctcgcataggacctt

SEQ ID NO: 1354265 - DNA, 18 bp, Homo sapiens
tctcggatagttgctatt

SEQ ID NO: 1354266 - DNA, 20 bp, Homo sapiens
tctcggatcaggctcccagg

SEQ ID NO: 1354267 - DNA, 15 bp, Homo sapiens
tctctaagtgggcat

SEQ ID NO: 1354268 - DNA, 12 bp, Homo sapiens
tctctcctggcc

SEQ ID NO: 1354269 - DNA, 15 bp, Homo sapiens
tctctcttctcagag

SEQ ID NO: 1354270 - DNA, 13 bp, Homo sapiens
tctctgacttctg

SEQ ID NO: 1354271 - DNA, 17 bp, Homo sapiens
tctctgacttctgcctg

SEQ ID NO: 1354272 - DNA, 18 bp, Homo sapiens
tctctgacttctgcctgg

SEQ ID NO: 1354273 - DNA, 19 bp, Homo sapiens
tctctgacttctgcctgga

SEQ ID NO: 1354274 - DNA, 20 bp, Homo sapiens
tctctgcatttaaaaaaatc

SEQ ID NO: 1354275 - DNA, 13 bp, Homo sapiens
tctctgctatata

SEQ ID NO: 1354276 - DNA, 21 bp, Homo sapiens
tctctgtacttttcattctct

SEQ ID NO: 1354277 - DNA, 15 bp, Homo sapiens
tctctgtgagaaggt

SEQ ID NO: 1354278 - DNA, 17 bp, Homo sapiens
tctctgtgccttcgtct

SEQ ID NO: 1354279 - DNA, 14 bp, Homo sapiens
tctcttgagcctgg

SEQ ID NO: 1354280 - DNA, 17 bp, Homo sapiens
tctcttgagcctgggag

SEQ ID NO: 1354281 - DNA, 14 bp, Homo sapiens
tctcttgagctggc

SEQ ID NO: 1354282 - DNA, 16 bp, Homo sapiens
tctcttgagctggcct

SEQ ID NO: 1354283 - DNA, 15 bp, Homo sapiens
tctcttgagtttgtc

SEQ ID NO: 1354284 - DNA, 22 bp, Homo sapiens
tctcttgcaccaaattatcttg

SEQ ID NO: 1354285 - DNA, 12 bp, Homo sapiens
tctcttttccac

SEQ ID NO: 1354286 - DNA, 12 bp, Homo sapiens
tctctttttgtt

SEQ ID NO: 1354287 - DNA, 15 bp, Homo sapiens
tctgaaaagtgtgta

SEQ ID NO: 1354288 - DNA, 17 bp, Homo sapiens
tctgaaataggaaacaa

SEQ ID NO: 1354289 - DNA, 22 bp, Homo sapiens
tctgaaatcttcccatgcattc

SEQ ID NO: 1354290 - DNA, 20 bp, Homo sapiens
tctgaatttacttccttgca

SEQ ID NO: 1354291 - DNA, 20 bp, Homo sapiens
tctgaccacttgaggcctga

SEQ ID NO: 1354292 - DNA, 18 bp, Homo sapiens
tctgactcggtttctcca

SEQ ID NO: 1354293 - DNA, 20 bp, Homo sapiens
tctgactcggtttctccaaa

SEQ ID NO: 1354294 - DNA, 12 bp, Homo sapiens
tctgacttctgc

SEQ ID NO: 1354295 - DNA, 15 bp, Homo sapiens
tctgacttctgcctg

SEQ ID NO: 1354296 - DNA, 16 bp, Homo sapiens
tctgacttctgcctgg

SEQ ID NO: 1354297 - DNA, 19 bp, Homo sapiens
tctgacttctgcctggaga

SEQ ID NO: 1354298 - DNA, 20 bp, Homo sapiens
tctgacttctgcctggagac

SEQ ID NO: 1354299 - DNA, 21 bp, Homo sapiens
tctgagcgcctccatccaagg

SEQ ID NO: 1354300 - DNA, 16 bp, Homo sapiens
tctgagggaaatgttt

SEQ ID NO: 1354301 - DNA, 12 bp, Homo sapiens
tctgagggggag

SEQ ID NO: 1354302 - DNA, 21 bp, Homo sapiens
tctgatggccttaatttcctt

SEQ ID NO: 1354303 - DNA, 20 bp, Homo sapiens
tctgatttgtccctatgcat

SEQ ID NO: 1354304 - DNA, 14 bp, Homo sapiens
tctgcacccagaac

SEQ ID NO: 1354305 - DNA, 22 bp, Homo sapiens
tctgcaccccttctctcctccc

SEQ ID NO: 1354306 - DNA, 16 bp, Homo sapiens
tctgcattcattttta

SEQ ID NO: 1354307 - DNA, 21 bp, Homo sapiens
tctgcattcatttttatagca

SEQ ID NO: 1354308 - DNA, 23 bp, Homo sapiens
tctgccagatgtcctaatggtga

SEQ ID NO: 1354309 - DNA, 14 bp, Homo sapiens
tctgccctggctgc

SEQ ID NO: 1354310 - DNA, 21 bp, Homo sapiens
tctgcctggagtgtatgactg

SEQ ID NO: 1354311 - DNA, 14 bp, Homo sapiens
tctgctatatataa

SEQ ID NO: 1354312 - DNA, 15 bp, Homo sapiens
tctgctcaccgccca

SEQ ID NO: 1354313 - DNA, 20 bp, Homo sapiens
tctgctcaccgcccatcagg

SEQ ID NO: 1354314 - DNA, 16 bp, Homo sapiens
tctgcttctctgactt

SEQ ID NO: 1354315 - DNA, 16 bp, Homo sapiens
tctgctttagacttga

SEQ ID NO: 1354316 - DNA, 16 bp, Homo sapiens
tctgcttttctgccct

SEQ ID NO: 1354317 - DNA, 18 bp, Homo sapiens
tctgcttttctgccctgg

SEQ ID NO: 1354318 - DNA, 19 bp, Homo sapiens
tctgcttttctgccctggc

SEQ ID NO: 1354319 - DNA, 17 bp, Homo sapiens
tctggacggcaggctca

SEQ ID NO: 1354320 - DNA, 22 bp, Homo sapiens
tctggacggcaggctcactgcc

SEQ ID NO: 1354321 - DNA, 20 bp, Homo sapiens
tctggagaccagggagcctt

SEQ ID NO: 1354322 - DNA, 16 bp, Homo sapiens
tctggagccctaaccc

SEQ ID NO: 1354323 - DNA, 14 bp, Homo sapiens
tctggccctagact

SEQ ID NO: 1354324 - DNA, 14 bp, Homo sapiens
tctggctttaagcc

SEQ ID NO: 1354325 - DNA, 22 bp, Homo sapiens
tctgggacctgccaggcagggg

SEQ ID NO: 1354326 - DNA, 21 bp, Homo sapiens
tctgggacttggtttccccaa

SEQ ID NO: 1354327 - DNA, 22 bp, Homo sapiens
tctggggaaagacactgcctgg

SEQ ID NO: 1354328 - DNA, 17 bp, Homo sapiens
tctggggcaggctgggc

SEQ ID NO: 1354329 - DNA, 19 bp, Homo sapiens
tctggggggacccagtgca

SEQ ID NO: 1354330 - DNA, 16 bp, Homo sapiens
tctgggtccttcctga

SEQ ID NO: 1354331 - DNA, 17 bp, Homo sapiens
tctggtcgctcctgccc

SEQ ID NO: 1354332 - DNA, 12 bp, Homo sapiens
tctggtggcccc

SEQ ID NO: 1354333 - DNA, 12 bp, Homo sapiens
tctgtaataata

SEQ ID NO: 1354334 - DNA, 20 bp, Homo sapiens
tctgtatcctggaacaatat

SEQ ID NO: 1354335 - DNA, 13 bp, Homo sapiens
tctgtatttgaaa

SEQ ID NO: 1354336 - DNA, 14 bp, Homo sapiens
tctgtatttgaaag

SEQ ID NO: 1354337 - DNA, 18 bp, Homo sapiens
tctgtatttgaaagtgcc

SEQ ID NO: 1354338 - DNA, 23 bp, Homo sapiens
tctgtattttatttagacaagag

SEQ ID NO: 1354339 - DNA, 11 bp, Homo sapiens
tctgtctttcc

SEQ ID NO: 1354340 - DNA, 19 bp, Homo sapiens
tctgtgaacaagcttcagt

SEQ ID NO: 1354341 - DNA, 23 bp, Homo sapiens
tctgtgagaaggtttattgttaa

SEQ ID NO: 1354342 - DNA, 15 bp, Homo sapiens
tctgtgccctcctga

SEQ ID NO: 1354343 - DNA, 20 bp, Homo sapiens
tctgtgcctccctccccagt

SEQ ID NO: 1354344 - DNA, 18 bp, Homo sapiens
tctgtgccttcttttgat

SEQ ID NO: 1354345 - DNA, 20 bp, Homo sapiens
tctgtggttggctgggaaat

SEQ ID NO: 1354346 - DNA, 13 bp, Homo sapiens
tctgtgtgtcagt

SEQ ID NO: 1354347 - DNA, 13 bp, Homo sapiens
tctgtgtttataa

SEQ ID NO: 1354348 - DNA, 15 bp, Homo sapiens
tctgttatgggcttt

SEQ ID NO: 1354349 - DNA, 20 bp, Homo sapiens
tctgtttcctgacattgtct

SEQ ID NO: 1354350 - DNA, 19 bp, Homo sapiens
tctgtttttaatgctattt

SEQ ID NO: 1354351 - DNA, 18 bp, Homo sapiens
tcttaaaaagtggaaaaa

SEQ ID NO: 1354352 - DNA, 22 bp, Homo sapiens
tcttaaagtattcttctcttcc

SEQ ID NO: 1354353 - DNA, 12 bp, Homo sapiens
tcttaagcttcc

SEQ ID NO: 1354354 - DNA, 19 bp, Homo sapiens
tcttaaggacaaagtgcca

SEQ ID NO: 1354355 - DNA, 14 bp, Homo sapiens
tcttagattcttaa

SEQ ID NO: 1354356 - DNA, 20 bp, Homo sapiens
tcttaggttggcaaaaaggc

SEQ ID NO: 1354357 - DNA, 16 bp, Homo sapiens
tcttatgaggagggga

SEQ ID NO: 1354358 - DNA, 21 bp, Homo sapiens
tcttatgctctcactgtttgt

SEQ ID NO: 1354359 - DNA, 12 bp, Homo sapiens
tcttatgtgaca

SEQ ID NO: 1354360 - DNA, 14 bp, Homo sapiens
tcttcaaagccttc

SEQ ID NO: 1354361 - DNA, 13 bp, Homo sapiens
tcttcagatgcca

SEQ ID NO: 1354362 - DNA, 16 bp, Homo sapiens
tcttcatcccattcca

SEQ ID NO: 1354363 - DNA, 22 bp, Homo sapiens
tcttccttgaagaactgcaggc

SEQ ID NO: 1354364 - DNA, 18 bp, Homo sapiens
tcttccttgatgtttggg

SEQ ID NO: 1354365 - DNA, 14 bp, Homo sapiens
tcttctctgtgaga

SEQ ID NO: 1354366 - DNA, 18 bp, Homo sapiens
tcttctctgtgagaaggt

SEQ ID NO: 1354367 - DNA, 22 bp, Homo sapiens
tcttctgagcttacgtagttct

SEQ ID NO: 1354368 - DNA, 22 bp, Homo sapiens
tcttctggggcaggctgggcca

SEQ ID NO: 1354369 - DNA, 22 bp, Homo sapiens
tcttctggtactttctgttatg

SEQ ID NO: 1354370 - DNA, 19 bp, Homo sapiens
tcttcttggggcccagtgc

SEQ ID NO: 1354371 - DNA, 13 bp, Homo sapiens
tcttgagcctggg

SEQ ID NO: 1354372 - DNA, 16 bp, Homo sapiens
tcttgagcctgggagg

SEQ ID NO: 1354373 - DNA, 14 bp, Homo sapiens
tcttgagctggcct

SEQ ID NO: 1354374 - DNA, 23 bp, Homo sapiens
tcttgagctggcctctctagcac

SEQ ID NO: 1354375 - DNA, 14 bp, Homo sapiens
tcttgagtttgtcg

SEQ ID NO: 1354376 - DNA, 21 bp, Homo sapiens
tcttgagtttgtcgctcatgt

SEQ ID NO: 1354377 - DNA, 19 bp, Homo sapiens
tcttgatacattcaaattt

SEQ ID NO: 1354378 - DNA, 16 bp, Homo sapiens
tcttgcaagcatgctt

SEQ ID NO: 1354379 - DNA, 17 bp, Homo sapiens
tcttgcaagcatgcttg

SEQ ID NO: 1354380 - DNA, 13 bp, Homo sapiens
tcttgcccatcct

SEQ ID NO: 1354381 - DNA, 16 bp, Homo sapiens
tcttgcctctgtgctg

SEQ ID NO: 1354382 - DNA, 19 bp, Homo sapiens
tcttggcaataaattttga

SEQ ID NO: 1354383 - DNA, 24 bp, Homo sapiens
tcttggcaataaattttgaaaagt

SEQ ID NO: 1354384 - DNA, 19 bp, Homo sapiens
tcttgggggggtggccgct

SEQ ID NO: 1354385 - DNA, 13 bp, Homo sapiens
tcttgtaaagact

SEQ ID NO: 1354386 - DNA, 20 bp, Homo sapiens
tcttgtgtctttggaggtgc

SEQ ID NO: 1354387 - DNA, 18 bp, Homo sapiens
tcttgttgctgtacaaaa

SEQ ID NO: 1354388 - DNA, 11 bp, Homo sapiens
tcttgttggtt

SEQ ID NO: 1354389 - DNA, 18 bp, Homo sapiens
tctttaaaaggaaagaaa

SEQ ID NO: 1354390 - DNA, 17 bp, Homo sapiens
tctttaaccttgtataa

SEQ ID NO: 1354391 - DNA, 18 bp, Homo sapiens
tctttaaccttgtataaa

SEQ ID NO: 1354392 - DNA, 15 bp, Homo sapiens
tctttaggagattta

SEQ ID NO: 1354393 - DNA, 12 bp, Homo sapiens
tctttattttgt

SEQ ID NO: 1354394 - DNA, 16 bp, Homo sapiens
tctttattttgtgtaa

SEQ ID NO: 1354395 - DNA, 17 bp, Homo sapiens
tctttattttgtgtaaa

SEQ ID NO: 1354396 - DNA, 14 bp, Homo sapiens
tctttcagaaagct

SEQ ID NO: 1354397 - DNA, 10 bp, Homo sapiens
tctttcatgg

SEQ ID NO: 1354398 - DNA, 23 bp, Homo sapiens
tctttccaggctatgtataaaat

SEQ ID NO: 1354399 - DNA, 21 bp, Homo sapiens
tctttccagtggatcataaga

SEQ ID NO: 1354400 - DNA, 15 bp, Homo sapiens
tctttggattctaaa

SEQ ID NO: 1354401 - DNA, 16 bp, Homo sapiens
tctttggattctaaat

SEQ ID NO: 1354402 - DNA, 17 bp, Homo sapiens
tctttggtgtacagact

SEQ ID NO: 1354403 - DNA, 16 bp, Homo sapiens
tctttgttcatagccc

SEQ ID NO: 1354404 - DNA, 18 bp, Homo sapiens
tcttttaaagaccctcct

SEQ ID NO: 1354405 - DNA, 21 bp, Homo sapiens
tcttttttaaccggtaagagt

SEQ ID NO: 1354406 - DNA, 21 bp, Homo sapiens
tcttttttattaatcactgtg

SEQ ID NO: 1354407 - DNA, 16 bp, Homo sapiens
tcttttttcaaaagaa

SEQ ID NO: 1354408 - DNA, 17 bp, Homo sapiens
tcttttttcaaaagaaa

SEQ ID NO: 1354409 - DNA, 18 bp, Homo sapiens
tctttttttttaagttct

SEQ ID NO: 1354410 - DNA, 20 bp, Homo sapiens
tgaaaaaggaggaagagaaa

SEQ ID NO: 1354411 - DNA, 22 bp, Homo sapiens
tgaaaaaggaggaagagaaaaa

SEQ ID NO: 1354412 - DNA, 19 bp, Homo sapiens
tgaaaaatataaaattatg

SEQ ID NO: 1354413 - DNA, 20 bp, Homo sapiens
tgaaaacagtgtgtaaacaa

SEQ ID NO: 1354414 - DNA, 19 bp, Homo sapiens
tgaaaagaaaaatgagcct

SEQ ID NO: 1354415 - DNA, 18 bp, Homo sapiens
tgaaaagatggtatcata

SEQ ID NO: 1354416 - DNA, 21 bp, Homo sapiens
tgaaaagtaatatttattaaa

SEQ ID NO: 1354417 - DNA, 18 bp, Homo sapiens
tgaaaagtgtgtatatat

SEQ ID NO: 1354418 - DNA, 15 bp, Homo sapiens
tgaaaagtttttgtt

SEQ ID NO: 1354419 - DNA, 19 bp, Homo sapiens
tgaaaatacaacttaaata

SEQ ID NO: 1354420 - DNA, 13 bp, Homo sapiens
tgaaaataccatt

SEQ ID NO: 1354421 - DNA, 19 bp, Homo sapiens
tgaaaatgaatatctatta

SEQ ID NO: 1354422 - DNA, 21 bp, Homo sapiens
tgaaaatgaatatctattaat

SEQ ID NO: 1354423 - DNA, 11 bp, Homo sapiens
tgaaaatggaa

SEQ ID NO: 1354424 - DNA, 16 bp, Homo sapiens
tgaaaatgtccaggaa

SEQ ID NO: 1354425 - DNA, 20 bp, Homo sapiens
tgaaaatgtccaggaaagtg

SEQ ID NO: 1354426 - DNA, 14 bp, Homo sapiens
tgaaaattcagtgg

SEQ ID NO: 1354427 - DNA, 23 bp, Homo sapiens
tgaaaattggacagattgcctgt

SEQ ID NO: 1354428 - DNA, 13 bp, Homo sapiens
tgaaaattgtatt

SEQ ID NO: 1354429 - DNA, 13 bp, Homo sapiens
tgaaagaaaattg

SEQ ID NO: 1354430 - DNA, 22 bp, Homo sapiens
tgaaagaaaattgagttgcact

SEQ ID NO: 1354431 - DNA, 22 bp, Homo sapiens
tgaaaggagagcatcggcctag

SEQ ID NO: 1354432 - DNA, 23 bp, Homo sapiens
tgaaaggcaggcctatttcatca

SEQ ID NO: 1354433 - DNA, 20 bp, Homo sapiens
tgaaagtgcatttttgtaaa

SEQ ID NO: 1354434 - DNA, 14 bp, Homo sapiens
tgaaagtgcctttg

SEQ ID NO: 1354435 - DNA, 14 bp, Homo sapiens
tgaaataactggaa

SEQ ID NO: 1354436 - DNA, 19 bp, Homo sapiens
tgaaatcttcccatgcatt

SEQ ID NO: 1354437 - DNA, 22 bp, Homo sapiens
tgaaatcttcccatgcattctg

SEQ ID NO: 1354438 - DNA, 13 bp, Homo sapiens
tgaaatgttacaa

SEQ ID NO: 1354439 - DNA, 16 bp, Homo sapiens
tgaaattctcctggag

SEQ ID NO: 1354440 - DNA, 16 bp, Homo sapiens
tgaacatacaaatgca

SEQ ID NO: 1354441 - DNA, 21 bp, Homo sapiens
tgaactcttctcattacttgt

SEQ ID NO: 1354442 - DNA, 23 bp, Homo sapiens
tgaacttaataactgtgtactgt

SEQ ID NO: 1354443 - DNA, 12 bp, Homo sapiens
tgaacttttgta

SEQ ID NO: 1354444 - DNA, 14 bp, Homo sapiens
tgaacttttgtact

SEQ ID NO: 1354445 - DNA, 16 bp, Homo sapiens
tgaagaactgcaggcc

SEQ ID NO: 1354446 - DNA, 20 bp, Homo sapiens
tgaagaactgcaggccctgg

SEQ ID NO: 1354447 - DNA, 12 bp, Homo sapiens
tgaagaagcctg

SEQ ID NO: 1354448 - DNA, 15 bp, Homo sapiens
tgaagaatggcgcca

SEQ ID NO: 1354449 - DNA, 16 bp, Homo sapiens
tgaagaatttaaagaa

SEQ ID NO: 1354450 - DNA, 14 bp, Homo sapiens
tgaagcaaatcaga

SEQ ID NO: 1354451 - DNA, 22 bp, Homo sapiens
tgaagcatagataatattgttt

SEQ ID NO: 1354452 - DNA, 11 bp, Homo sapiens
tgaagccaaag

SEQ ID NO: 1354453 - DNA, 18 bp, Homo sapiens
tgaaggtttttgatagca

SEQ ID NO: 1354454 - DNA, 21 bp, Homo sapiens
tgaagtcttactacagaaatg

SEQ ID NO: 1354455 - DNA, 19 bp, Homo sapiens
tgaagtctttaataaataa

SEQ ID NO: 1354456 - DNA, 18 bp, Homo sapiens
tgaagtgtataatataaa

SEQ ID NO: 1354457 - DNA, 16 bp, Homo sapiens
tgaagttgaaaatcat

SEQ ID NO: 1354458 - DNA, 17 bp, Homo sapiens
tgaagttttactgtcta

SEQ ID NO: 1354459 - DNA, 13 bp, Homo sapiens
tgaataatacagt

SEQ ID NO: 1354460 - DNA, 19 bp, Homo sapiens
tgaatacttgaaccataaa

SEQ ID NO: 1354461 - DNA, 12 bp, Homo sapiens
tgaatatatgat

SEQ ID NO: 1354462 - DNA, 16 bp, Homo sapiens
tgaatatctattaata

SEQ ID NO: 1354463 - DNA, 21 bp, Homo sapiens
tgaatatctattaatatatgt

SEQ ID NO: 1354464 - DNA, 13 bp, Homo sapiens
tgaatatgattaa

SEQ ID NO: 1354465 - DNA, 14 bp, Homo sapiens
tgaatatgattaaa

SEQ ID NO: 1354466 - DNA, 21 bp, Homo sapiens
tgaatatgattaaaaatatca

SEQ ID NO: 1354467 - DNA, 22 bp, Homo sapiens
tgaatatgattaaaaatatcaa

SEQ ID NO: 1354468 - DNA, 12 bp, Homo sapiens
tgaatattttca

SEQ ID NO: 1354469 - DNA, 15 bp, Homo sapiens
tgaatcaaaagtgcc

SEQ ID NO: 1354470 - DNA, 13 bp, Homo sapiens
tgaatcaataata

SEQ ID NO: 1354471 - DNA, 19 bp, Homo sapiens
tgaatcaataatatatttt

SEQ ID NO: 1354472 - DNA, 16 bp, Homo sapiens
tgaatgacaaagtatg

SEQ ID NO: 1354473 - DNA, 18 bp, Homo sapiens
tgaatgagtctgttgtgt

SEQ ID NO: 1354474 - DNA, 21 bp, Homo sapiens
tgaatgagtctgttgtgtgtc

SEQ ID NO: 1354475 - DNA, 14 bp, Homo sapiens
tgaatgatttgcat

SEQ ID NO: 1354476 - DNA, 13 bp, Homo sapiens
tgaatgctgggac

SEQ ID NO: 1354477 - DNA, 19 bp, Homo sapiens
tgaatgctgggactcagcc

SEQ ID NO: 1354478 - DNA, 15 bp, Homo sapiens
tgaattatatgttca

SEQ ID NO: 1354479 - DNA, 15 bp, Homo sapiens
tgaattattgacact

SEQ ID NO: 1354480 - DNA, 16 bp, Homo sapiens
tgaattattgacactg

SEQ ID NO: 1354481 - DNA, 17 bp, Homo sapiens
tgaattattgacactga

SEQ ID NO: 1354482 - DNA, 15 bp, Homo sapiens
tgaattttaaaatct

SEQ ID NO: 1354483 - DNA, 23 bp, Homo sapiens
tgaattttaaatctaaatctatt

SEQ ID NO: 1354484 - DNA, 15 bp, Homo sapiens
tgaatttttattgtt

SEQ ID NO: 1354485 - DNA, 15 bp, Homo sapiens
tgaatttttctcttc

SEQ ID NO: 1354486 - DNA, 18 bp, Homo sapiens
tgaatttttttgtaataa

SEQ ID NO: 1354487 - DNA, 17 bp, Homo sapiens
tgacaaccgagaaggtt

SEQ ID NO: 1354488 - DNA, 14 bp, Homo sapiens
tgacaactgtgact

SEQ ID NO: 1354489 - DNA, 17 bp, Homo sapiens
tgacaaggcacttcatg

SEQ ID NO: 1354490 - DNA, 14 bp, Homo sapiens
tgacaataaagctt

SEQ ID NO: 1354491 - DNA, 13 bp, Homo sapiens
tgacaatgttgta

SEQ ID NO: 1354492 - DNA, 16 bp, Homo sapiens
tgacaattttgtacaa

SEQ ID NO: 1354493 - DNA, 15 bp, Homo sapiens
tgacatatctacact

SEQ ID NO: 1354494 - DNA, 17 bp, Homo sapiens
tgacatcttgaatcctt

SEQ ID NO: 1354495 - DNA, 21 bp, Homo sapiens
tgacatggtgcctgagaggca

SEQ ID NO: 1354496 - DNA, 16 bp, Homo sapiens
tgaccacttgaggcct

SEQ ID NO: 1354497 - DNA, 18 bp, Homo sapiens
tgaccacttgaggcctga

SEQ ID NO: 1354498 - DNA, 14 bp, Homo sapiens
tgaccagaaatggt

SEQ ID NO: 1354499 - DNA, 16 bp, Homo sapiens
tgaccatgctcatctg

SEQ ID NO: 1354500 - DNA, 15 bp, Homo sapiens
tgacccattgctgtt

SEQ ID NO: 1354501 - DNA, 13 bp, Homo sapiens
tgaccctccaaat

SEQ ID NO: 1354502 - DNA, 12 bp, Homo sapiens
tgacctgaggct

SEQ ID NO: 1354503 - DNA, 22 bp, Homo sapiens
tgacctggcatctaattctgat

SEQ ID NO: 1354504 - DNA, 21 bp, Homo sapiens
tgacgatgatgtacagattct

SEQ ID NO: 1354505 - DNA, 19 bp, Homo sapiens
tgacgtacaagtagttctg

SEQ ID NO: 1354506 - DNA, 22 bp, Homo sapiens
tgacgtgaccggacttttctgc

SEQ ID NO: 1354507 - DNA, 15 bp, Homo sapiens
tgactaagaaattct

SEQ ID NO: 1354508 - DNA, 11 bp, Homo sapiens
tgactaattag

SEQ ID NO: 1354509 - DNA, 18 bp, Homo sapiens
tgactaattttacatgtt

SEQ ID NO: 1354510 - DNA, 22 bp, Homo sapiens
tgactaattttacatgtttata

SEQ ID NO: 1354511 - DNA, 17 bp, Homo sapiens
tgactctgggtccttcc

SEQ ID NO: 1354512 - DNA, 22 bp, Homo sapiens
tgacttaacatagccaaaatgt

SEQ ID NO: 1354513 - DNA, 15 bp, Homo sapiens
tgacttctgcctgga

SEQ ID NO: 1354514 - DNA, 18 bp, Homo sapiens
tgacttctgcctggagac

SEQ ID NO: 1354515 - DNA, 20 bp, Homo sapiens
tgactttattatttattttt

SEQ ID NO: 1354516 - DNA, 17 bp, Homo sapiens
tgacttttataaagcat

SEQ ID NO: 1354517 - DNA, 14 bp, Homo sapiens
tgactttttataaa

SEQ ID NO: 1354518 - DNA, 19 bp, Homo sapiens
tgactttttataaaatggc

SEQ ID NO: 1354519 - DNA, 14 bp, Homo sapiens
tgactttttttgta

SEQ ID NO: 1354520 - DNA, 23 bp, Homo sapiens
tgagaaaacaagcaagttctgag

SEQ ID NO: 1354521 - DNA, 18 bp, Homo sapiens
tgagaaggtttattgtta

SEQ ID NO: 1354522 - DNA, 17 bp, Homo sapiens
tgagacacggagcccag

SEQ ID NO: 1354523 - DNA, 19 bp, Homo sapiens
tgagactacaagtgtgtgc

SEQ ID NO: 1354524 - DNA, 13 bp, Homo sapiens
tgagaggcaggca

SEQ ID NO: 1354525 - DNA, 14 bp, Homo sapiens
tgagaggcaggcat

SEQ ID NO: 1354526 - DNA, 16 bp, Homo sapiens
tgagaggcaggcatag

SEQ ID NO: 1354527 - DNA, 14 bp, Homo sapiens
tgagatcagcctgg

SEQ ID NO: 1354528 - DNA, 18 bp, Homo sapiens
tgcatagtttctttattt

SEQ ID NO: 1354529 - DNA, 23 bp, Homo sapiens
tgcatagtttctttattttgtgt

SEQ ID NO: 1354530 - DNA, 23 bp, Homo sapiens
tgcatattataaaggataaagaa

SEQ ID NO: 1354531 - DNA, 19 bp, Homo sapiens
tgcatcagaaagctttatt

SEQ ID NO: 1354532 - DNA, 12 bp, Homo sapiens
tgcatctttgat

SEQ ID NO: 1354533 - DNA, 11 bp, Homo sapiens
tgcatgaaaat

SEQ ID NO: 1354534 - DNA, 15 bp, Homo sapiens
tgcatgcaaatgagc

SEQ ID NO: 1354535 - DNA, 15 bp, Homo sapiens
tgcatgccctctcag

SEQ ID NO: 1354536 - DNA, 12 bp, Homo sapiens
tgcatggaaatc

SEQ ID NO: 1354537 - DNA, 14 bp, Homo sapiens
tgcatggaaatcag

SEQ ID NO: 1354538 - DNA, 14 bp, Homo sapiens
tgcatggtggccag

SEQ ID NO: 1354539 - DNA, 14 bp, Homo sapiens
tgcatgttatgttt

SEQ ID NO: 1354540 - DNA, 16 bp, Homo sapiens
tgcatgttatgtttaa

SEQ ID NO: 1354541 - DNA, 11 bp, Homo sapiens
tgcattcattt

SEQ ID NO: 1354542 - DNA, 14 bp, Homo sapiens
tgcattcattttta

SEQ ID NO: 1354543 - DNA, 20 bp, Homo sapiens
tgcattcatttttatagcaa

SEQ ID NO: 1354544 - DNA, 19 bp, Homo sapiens
tgcatttagggagtattct

SEQ ID NO: 1354545 - DNA, 20 bp, Homo sapiens
tgcatttcctcgcagcctct

SEQ ID NO: 1354546 - DNA, 11 bp, Homo sapiens
tgcatttttgt

SEQ ID NO: 1354547 - DNA, 15 bp, Homo sapiens
tgccaagctccaagc

SEQ ID NO: 1354548 - DNA, 16 bp, Homo sapiens
tgccaagctccaagcc

SEQ ID NO: 1354549 - DNA, 23 bp, Homo sapiens
tgccaagctccaagccccatctt

SEQ ID NO: 1354550 - DNA, 17 bp, Homo sapiens
tgccacagtagaactgt

SEQ ID NO: 1354551 - DNA, 22 bp, Homo sapiens
tgccacagtagaactgtctgtg

SEQ ID NO: 1354552 - DNA, 13 bp, Homo sapiens
tgccaccaggcca

SEQ ID NO: 1354553 - DNA, 17 bp, Homo sapiens
tgccaccaggccacctc

SEQ ID NO: 1354554 - DNA, 18 bp, Homo sapiens
tgccaccaggccacctcc

SEQ ID NO: 1354555 - DNA, 13 bp, Homo sapiens
tgccactcactag

SEQ ID NO: 1354556 - DNA, 17 bp, Homo sapiens
tgccactcactaggccc

SEQ ID NO: 1354557 - DNA, 19 bp, Homo sapiens
tgccactcactaggccccc

SEQ ID NO: 1354558 - DNA, 12 bp, Homo sapiens
tgccagagccgg

SEQ ID NO: 1354559 - DNA, 17 bp, Homo sapiens
tgccagcagcagcaggt

SEQ ID NO: 1354560 - DNA, 18 bp, Homo sapiens
tgccagctgacatcttga

SEQ ID NO: 1354561 - DNA, 12 bp, Homo sapiens
tgccaggcaggg

SEQ ID NO: 1354562 - DNA, 14 bp, Homo sapiens
tgccaggccagcct

SEQ ID NO: 1354563 - DNA, 16 bp, Homo sapiens
tgccaggccagcctcc

SEQ ID NO: 1354564 - DNA, 14 bp, Homo sapiens
tgccaggtgagaaa

SEQ ID NO: 1354565 - DNA, 18 bp, Homo sapiens
tgccatagagtacactgc

SEQ ID NO: 1354566 - DNA, 15 bp, Homo sapiens
tgccatcagtgaaaa

SEQ ID NO: 1354567 - DNA, 14 bp, Homo sapiens
tgccatcgctgtga

SEQ ID NO: 1354568 - DNA, 18 bp, Homo sapiens
tgccatctagccagcccc

SEQ ID NO: 1354569 - DNA, 16 bp, Homo sapiens
tgccatctatctagtt

SEQ ID NO: 1354570 - DNA, 22 bp, Homo sapiens
tgccatggctaggtagaagtga

SEQ ID NO: 1354571 - DNA, 20 bp, Homo sapiens
tgccatgtgcttctgccacc

SEQ ID NO: 1354572 - DNA, 22 bp, Homo sapiens
tgccatgtggaaggcaagccag

SEQ ID NO: 1354573 - DNA, 13 bp, Homo sapiens
tgcccaagccaga

SEQ ID NO: 1354574 - DNA, 22 bp, Homo sapiens
tgcccaagccagaggctgggtt

SEQ ID NO: 1354575 - DNA, 20 bp, Homo sapiens
tgcccaccccctgccctgca

SEQ ID NO: 1354576 - DNA, 21 bp, Homo sapiens
tgcccactgtttctcttgagc

SEQ ID NO: 1354577 - DNA, 16 bp, Homo sapiens
tgcccagaatactgat

SEQ ID NO: 1354578 - DNA, 18 bp, Homo sapiens
tgcccagaatactgatgg

SEQ ID NO: 1354579 - DNA, 15 bp, Homo sapiens
tgcccatcctgactg

SEQ ID NO: 1354580 - DNA, 21 bp, Homo sapiens
tgccccatctcccctcagctc

SEQ ID NO: 1354581 - DNA, 14 bp, Homo sapiens
tgcccctcagagac

SEQ ID NO: 1354582 - DNA, 16 bp, Homo sapiens
tgcccctcagagactg

SEQ ID NO: 1354583 - DNA, 12 bp, Homo sapiens
tgcccctctcac

SEQ ID NO: 1354584 - DNA, 23 bp, Homo sapiens
tgccctcctgacccattgctgtt

SEQ ID NO: 1354585 - DNA, 22 bp, Homo sapiens
tgccctgcacgtcatgggaggg

SEQ ID NO: 1354586 - DNA, 12 bp, Homo sapiens
tgccctggctgc

SEQ ID NO: 1354587 - DNA, 16 bp, Homo sapiens
tgccctggctgctgcc

SEQ ID NO: 1354588 - DNA, 18 bp, Homo sapiens
tgccgccgctaggtagag

SEQ ID NO: 1354589 - DNA, 13 bp, Homo sapiens
tgccgtcaccacc

SEQ ID NO: 1354590 - DNA, 22 bp, Homo sapiens
tgccgtggcaccaggcgctgcc

SEQ ID NO: 1354591 - DNA, 17 bp, Homo sapiens
tgcctataagccaaaat

SEQ ID NO: 1354592 - DNA, 20 bp, Homo sapiens
tgcctataagccaaaattaa

SEQ ID NO: 1354593 - DNA, 21 bp, Homo sapiens
tgcctataagccaaaattaag

SEQ ID NO: 1354594 - DNA, 15 bp, Homo sapiens
tgcctccaggtgcag

SEQ ID NO: 1354595 - DNA, 16 bp, Homo sapiens
tgcctccaggtgcaga

SEQ ID NO: 1354596 - DNA, 16 bp, Homo sapiens
tgcctcccacttcact

SEQ ID NO: 1354597 - DNA, 17 bp, Homo sapiens
tgcctcccacttcactg

SEQ ID NO: 1354598 - DNA, 18 bp, Homo sapiens
tgcctccctccccagtgc

SEQ ID NO: 1354599 - DNA, 17 bp, Homo sapiens
tgcctcttccttgaaga

SEQ ID NO: 1354600 - DNA, 13 bp, Homo sapiens
tgcctgcagggcc

SEQ ID NO: 1354601 - DNA, 16 bp, Homo sapiens
tgcctgcagggccatg

SEQ ID NO: 1354602 - DNA, 14 bp, Homo sapiens
tgcctgctttgaat

SEQ ID NO: 1354603 - DNA, 11 bp, Homo sapiens
tgcctggcccc

SEQ ID NO: 1354604 - DNA, 21 bp, Homo sapiens
tgcctgtggcgccgtctccag

SEQ ID NO: 1354605 - DNA, 22 bp, Homo sapiens
tgcctgtggcgccgtctccagg

SEQ ID NO: 1354606 - DNA, 15 bp, Homo sapiens
tgcctgtgtccatgc

SEQ ID NO: 1354607 - DNA, 15 bp, Homo sapiens
tgccttaaaaccaaa

SEQ ID NO: 1354608 - DNA, 22 bp, Homo sapiens
tgccttaaacactcaccttcta

SEQ ID NO: 1354609 - DNA, 15 bp, Homo sapiens
tgccttaagtgagga

SEQ ID NO: 1354610 - DNA, 21 bp, Homo sapiens
tgccttaagtgaggaaatcaa

SEQ ID NO: 1354611 - DNA, 22 bp, Homo sapiens
tgccttaagtgaggaaatcaaa

SEQ ID NO: 1354612 - DNA, 13 bp, Homo sapiens
tgccttccctagc

SEQ ID NO: 1354613 - DNA, 21 bp, Homo sapiens
tgccttcgcttcttgcctctg

SEQ ID NO: 1354614 - DNA, 13 bp, Homo sapiens
tgccttgctgttt

SEQ ID NO: 1354615 - DNA, 19 bp, Homo sapiens
tgccttggctcagacatgt

SEQ ID NO: 1354616 - DNA, 18 bp, Homo sapiens
tgcctttgcagctcagaa

SEQ ID NO: 1354617 - DNA, 16 bp, Homo sapiens
tgccttttaattttta

SEQ ID NO: 1354618 - DNA, 13 bp, Homo sapiens
tgcctttttattt

SEQ ID NO: 1354619 - DNA, 13 bp, Homo sapiens
tgcgaaaggatga

SEQ ID NO: 1354620 - DNA, 15 bp, Homo sapiens
tgcgactttctgcct

SEQ ID NO: 1354621 - DNA, 16 bp, Homo sapiens
tgcgactttctgcctg

SEQ ID NO: 1354622 - DNA, 21 bp, Homo sapiens
tgcgactttctgcctggagtg

SEQ ID NO: 1354623 - DNA, 15 bp, Homo sapiens
tgcgcatcttgcctc

SEQ ID NO: 1354624 - DNA, 21 bp, Homo sapiens
tgcgccccctccgccctgcca

SEQ ID NO: 1354625 - DNA, 11 bp, Homo sapiens
tgcgcctgctg

SEQ ID NO: 1354626 - DNA, 15 bp, Homo sapiens
tgcggatctcagctt

SEQ ID NO: 1354627 - DNA, 19 bp, Homo sapiens
tgcggcctttggcttcacg

SEQ ID NO: 1354628 - DNA, 16 bp, Homo sapiens
tgcggcgtacaggctg

SEQ ID NO: 1354629 - DNA, 23 bp, Homo sapiens
tgcgtccccccccaacctttccc

SEQ ID NO: 1354630 - DNA, 16 bp, Homo sapiens
tgcgtcctcctcacct

SEQ ID NO: 1354631 - DNA, 19 bp, Homo sapiens
tgcgtcctcctcacctcat

SEQ ID NO: 1354632 - DNA, 14 bp, Homo sapiens
tgctacaattttaa

SEQ ID NO: 1354633 - DNA, 20 bp, Homo sapiens
tgctactgcactccagcctg

SEQ ID NO: 1354634 - DNA, 23 bp, Homo sapiens
tgctactgttgtaagaattctga

SEQ ID NO: 1354635 - DNA, 14 bp, Homo sapiens
tgctagaaattttc

SEQ ID NO: 1354636 - DNA, 15 bp, Homo sapiens
tgctagaagctgtaa

SEQ ID NO: 1354637 - DNA, 13 bp, Homo sapiens
tgctagctagctc

SEQ ID NO: 1354638 - DNA, 21 bp, Homo sapiens
tgctatatataaaacggtgct

SEQ ID NO: 1354639 - DNA, 19 bp, Homo sapiens
tgctatcaacaataaaatt

SEQ ID NO: 1354640 - DNA, 20 bp, Homo sapiens
tgctatccccatctccctgc

SEQ ID NO: 1354641 - DNA, 18 bp, Homo sapiens
tgctattacgaagttcaa

SEQ ID NO: 1354642 - DNA, 19 bp, Homo sapiens
tgctattacgaagttcaag

SEQ ID NO: 1354643 - DNA, 16 bp, Homo sapiens
tgctatttattttcct

SEQ ID NO: 1354644 - DNA, 18 bp, Homo sapiens
tgctatttattttcctaa

SEQ ID NO: 1354645 - DNA, 23 bp, Homo sapiens
tgctcaccgcccatcagggttct

SEQ ID NO: 1354646 - DNA, 14 bp, Homo sapiens
tgctcagaagggct

SEQ ID NO: 1354647 - DNA, 18 bp, Homo sapiens
tgctcatctgctggtccg

SEQ ID NO: 1354648 - DNA, 14 bp, Homo sapiens
tgctccccacagcg

SEQ ID NO: 1354649 - DNA, 20 bp, Homo sapiens
tgagatcgtgctactgcact

SEQ ID NO: 1354650 - DNA, 19 bp, Homo sapiens
tgagattggttttcctgtg

SEQ ID NO: 1354651 - DNA, 19 bp, Homo sapiens
tgagccgggcccctgggct

SEQ ID NO: 1354652 - DNA, 16 bp, Homo sapiens
tgagcctctgctcccc

SEQ ID NO: 1354653 - DNA, 13 bp, Homo sapiens
tgagcctgcaggg

SEQ ID NO: 1354654 - DNA, 14 bp, Homo sapiens
tgagcctgggaggt

SEQ ID NO: 1354655 - DNA, 22 bp, Homo sapiens
tgagcctgggaggtcaaggctg

SEQ ID NO: 1354656 - DNA, 16 bp, Homo sapiens
tgagctaggaagagtc

SEQ ID NO: 1354657 - DNA, 20 bp, Homo sapiens
tgagctcccacttctgccag

SEQ ID NO: 1354658 - DNA, 12 bp, Homo sapiens
tgagctctgaaa

SEQ ID NO: 1354659 - DNA, 16 bp, Homo sapiens
tgagctgccttcccta

SEQ ID NO: 1354660 - DNA, 15 bp, Homo sapiens
tgaggaaaattctta

SEQ ID NO: 1354661 - DNA, 22 bp, Homo sapiens
tgaggaaatcaaagtgctatta

SEQ ID NO: 1354662 - DNA, 21 bp, Homo sapiens
tgaggaactgtagatgatgta

SEQ ID NO: 1354663 - DNA, 19 bp, Homo sapiens
tgaggattagtttagaaca

SEQ ID NO: 1354664 - DNA, 15 bp, Homo sapiens
tgaggcactggcgag

SEQ ID NO: 1354665 - DNA, 21 bp, Homo sapiens
tgaggccgttgctgacttaga

SEQ ID NO: 1354666 - DNA, 22 bp, Homo sapiens
tgaggcctgggccgctgccacg

SEQ ID NO: 1354667 - DNA, 13 bp, Homo sapiens
tgagggaaatgtt

SEQ ID NO: 1354668 - DNA, 16 bp, Homo sapiens
tgagggaaatgttttg

SEQ ID NO: 1354669 - DNA, 17 bp, Homo sapiens
tgagggagaacaagacc

SEQ ID NO: 1354670 - DNA, 22 bp, Homo sapiens
tgaggggtccctagcagcccac

SEQ ID NO: 1354671 - DNA, 21 bp, Homo sapiens
tgaggtgggaggtggaagaag

SEQ ID NO: 1354672 - DNA, 19 bp, Homo sapiens
tgaggttcctctgcctgcc

SEQ ID NO: 1354673 - DNA, 17 bp, Homo sapiens
tgagtagagttgatcaa

SEQ ID NO: 1354674 - DNA, 19 bp, Homo sapiens
tgagtagatccatttccat

SEQ ID NO: 1354675 - DNA, 12 bp, Homo sapiens
tgagtattgttt

SEQ ID NO: 1354676 - DNA, 13 bp, Homo sapiens
tgagtccagaagt

SEQ ID NO: 1354677 - DNA, 14 bp, Homo sapiens
tgagtctgggcagc

SEQ ID NO: 1354678 - DNA, 21 bp, Homo sapiens
tgagtctgtactaaacagtaa

SEQ ID NO: 1354679 - DNA, 16 bp, Homo sapiens
tgagtctgttctggta

SEQ ID NO: 1354680 - DNA, 15 bp, Homo sapiens
tgagtctgttgtgtg

SEQ ID NO: 1354681 - DNA, 23 bp, Homo sapiens
tgagtgggggatcacagcctctg

SEQ ID NO: 1354682 - DNA, 18 bp, Homo sapiens
tgagtgtatgagtagcca

SEQ ID NO: 1354683 - DNA, 16 bp, Homo sapiens
tgagttgattcagctc

SEQ ID NO: 1354684 - DNA, 17 bp, Homo sapiens
tgagttgtttttgtata

SEQ ID NO: 1354685 - DNA, 18 bp, Homo sapiens
tgagttgtttttgtatat

SEQ ID NO: 1354686 - DNA, 17 bp, Homo sapiens
tgagtttgagctgcctt

SEQ ID NO: 1354687 - DNA, 21 bp, Homo sapiens
tgagtttgagctgccttccct

SEQ ID NO: 1354688 - DNA, 13 bp, Homo sapiens
tgataaaaactca

SEQ ID NO: 1354689 - DNA, 13 bp, Homo sapiens
tgataaatccatc

SEQ ID NO: 1354690 - DNA, 16 bp, Homo sapiens
tgatacattcaaattt

SEQ ID NO: 1354691 - DNA, 13 bp, Homo sapiens
tgatactgatggt

SEQ ID NO: 1354692 - DNA, 18 bp, Homo sapiens
tgatactggaggaacact

SEQ ID NO: 1354693 - DNA, 22 bp, Homo sapiens
tgatattacatttatttatcca

SEQ ID NO: 1354694 - DNA, 19 bp, Homo sapiens
tgatcatgtactttttagt

SEQ ID NO: 1354695 - DNA, 15 bp, Homo sapiens
tgatccacccaaccc

SEQ ID NO: 1354696 - DNA, 21 bp, Homo sapiens
tgatccacccaaccctatctc

SEQ ID NO: 1354697 - DNA, 23 bp, Homo sapiens
tgatccactttgggggaggagaa

SEQ ID NO: 1354698 - DNA, 14 bp, Homo sapiens
tgatgagattttta

SEQ ID NO: 1354699 - DNA, 20 bp, Homo sapiens
tgatgctgggagttctaaca

SEQ ID NO: 1354700 - DNA, 20 bp, Homo sapiens
tgatgctgtgctatgaattt

SEQ ID NO: 1354701 - DNA, 19 bp, Homo sapiens
tgatggacactccagggac

SEQ ID NO: 1354702 - DNA, 16 bp, Homo sapiens
tgatggccttaatttc

SEQ ID NO: 1354703 - DNA, 13 bp, Homo sapiens
tgatgggaaaact

SEQ ID NO: 1354704 - DNA, 19 bp, Homo sapiens
tgatggttcttcacctcct

SEQ ID NO: 1354705 - DNA, 23 bp, Homo sapiens
tgatgtggccctggctgccggca

SEQ ID NO: 1354706 - DNA, 22 bp, Homo sapiens
tgatgtgttgttcttggcaata

SEQ ID NO: 1354707 - DNA, 12 bp, Homo sapiens
tgattatttgca

SEQ ID NO: 1354708 - DNA, 18 bp, Homo sapiens
tgattattttttttttct

SEQ ID NO: 1354709 - DNA, 13 bp, Homo sapiens
tgattcagctctg

SEQ ID NO: 1354710 - DNA, 14 bp, Homo sapiens
tgattcagctctgc

SEQ ID NO: 1354711 - DNA, 13 bp, Homo sapiens
tgattcagtcaca

SEQ ID NO: 1354712 - DNA, 20 bp, Homo sapiens
tgattccactacacctggct

SEQ ID NO: 1354713 - DNA, 23 bp, Homo sapiens
tgattccactacacctggctgag

SEQ ID NO: 1354714 - DNA, 21 bp, Homo sapiens
tgattctggctttaagccttc

SEQ ID NO: 1354715 - DNA, 21 bp, Homo sapiens
tgattgggaaaacatttgctg

SEQ ID NO: 1354716 - DNA, 20 bp, Homo sapiens
tgatttataaatgccattta

SEQ ID NO: 1354717 - DNA, 22 bp, Homo sapiens
tgatttattaacttaataatca

SEQ ID NO: 1354718 - DNA, 13 bp, Homo sapiens
tgatttctagaac

SEQ ID NO: 1354719 - DNA, 22 bp, Homo sapiens
tgatttcttaggggaaggagaa

SEQ ID NO: 1354720 - DNA, 17 bp, Homo sapiens
tgatttgcaataaaaat

SEQ ID NO: 1354721 - DNA, 13 bp, Homo sapiens
tgatttttttcca

SEQ ID NO: 1354722 - DNA, 16 bp, Homo sapiens
tgcaaaaccttttact

SEQ ID NO: 1354723 - DNA, 17 bp, Homo sapiens
tgcaaccaggaacagca

SEQ ID NO: 1354724 - DNA, 20 bp, Homo sapiens
tgcaaccaggaacagcaaat

SEQ ID NO: 1354725 - DNA, 16 bp, Homo sapiens
tgcaagatgtgaatta

SEQ ID NO: 1354726 - DNA, 18 bp, Homo sapiens
tgcaagatgtgaattatt

SEQ ID NO: 1354727 - DNA, 13 bp, Homo sapiens
tgcaagcagagga

SEQ ID NO: 1354728 - DNA, 21 bp, Homo sapiens
tgcaaggcctggtgtttcttg

SEQ ID NO: 1354729 - DNA, 23 bp, Homo sapiens
tgcaaggcctggtgtttcttgat

SEQ ID NO: 1354730 - DNA, 13 bp, Homo sapiens
tgcaagtgctgga

SEQ ID NO: 1354731 - DNA, 21 bp, Homo sapiens
tgcacaagctgcaccctcagg

SEQ ID NO: 1354732 - DNA, 21 bp, Homo sapiens
tgcacataagcttccatttta

SEQ ID NO: 1354733 - DNA, 20 bp, Homo sapiens
tgcacatccgcgtgtgcctg

SEQ ID NO: 1354734 - DNA, 21 bp, Homo sapiens
tgcacatccgcgtgtgcctgt

SEQ ID NO: 1354735 - DNA, 16 bp, Homo sapiens
tgcacatgtttcctct

SEQ ID NO: 1354736 - DNA, 17 bp, Homo sapiens
tgcacatgtttcctcta

SEQ ID NO: 1354737 - DNA, 19 bp, Homo sapiens
tgcaccaccaagccaaggg

SEQ ID NO: 1354738 - DNA, 22 bp, Homo sapiens
tgcacggtttcgaagtcattaa

SEQ ID NO: 1354739 - DNA, 13 bp, Homo sapiens
tgcactccagcct

SEQ ID NO: 1354740 - DNA, 14 bp, Homo sapiens
tgcactccagcctg

SEQ ID NO: 1354741 - DNA, 17 bp, Homo sapiens
tgcactccagcctgggg

SEQ ID NO: 1354742 - DNA, 16 bp, Homo sapiens
tgcactcctcagggca

SEQ ID NO: 1354743 - DNA, 14 bp, Homo sapiens
tgcacttaaagaag

SEQ ID NO: 1354744 - DNA, 16 bp, Homo sapiens
tgcacttacttgctta

SEQ ID NO: 1354745 - DNA, 23 bp, Homo sapiens
tgcacttattgaccattttttaa

SEQ ID NO: 1354746 - DNA, 20 bp, Homo sapiens
tgcacttgtgattatttatt

SEQ ID NO: 1354747 - DNA, 12 bp, Homo sapiens
tgcagaatgtaa

SEQ ID NO: 1354748 - DNA, 23 bp, Homo sapiens
tgcagaccacgcccgtcctgcct

SEQ ID NO: 1354749 - DNA, 16 bp, Homo sapiens
tgcagagccttctcag

SEQ ID NO: 1354750 - DNA, 18 bp, Homo sapiens
tgcagaggtaccctgggt

SEQ ID NO: 1354751 - DNA, 20 bp, Homo sapiens
tgcagcaccgaggggccttt

SEQ ID NO: 1354752 - DNA, 18 bp, Homo sapiens
tgcagctcagaaccacag

SEQ ID NO: 1354753 - DNA, 19 bp, Homo sapiens
tgcagctcagaaccacagc

SEQ ID NO: 1354754 - DNA, 15 bp, Homo sapiens
tgcaggacctcaggt

SEQ ID NO: 1354755 - DNA, 15 bp, Homo sapiens
tgcaggacttgagaa

SEQ ID NO: 1354756 - DNA, 18 bp, Homo sapiens
tgcaggacttgagaagac

SEQ ID NO: 1354757 - DNA, 16 bp, Homo sapiens
tgcaggccctggcctc

SEQ ID NO: 1354758 - DNA, 17 bp, Homo sapiens
tgcaggccctggcctcc

SEQ ID NO: 1354759 - DNA, 20 bp, Homo sapiens
tgcaggccctggcctcccct

SEQ ID NO: 1354760 - DNA, 15 bp, Homo sapiens
tgcaggctcccctga

SEQ ID NO: 1354761 - DNA, 17 bp, Homo sapiens
tgcaggctcccctgagg

SEQ ID NO: 1354762 - DNA, 10 bp, Homo sapiens
tgcagggcca

SEQ ID NO: 1354763 - DNA, 21 bp, Homo sapiens
tgcaggtcaagttgtcaggtt

SEQ ID NO: 1354764 - DNA, 14 bp, Homo sapiens
tgcaggttttctgt

SEQ ID NO: 1354765 - DNA, 18 bp, Homo sapiens
tgcagtggcgcattctag

SEQ ID NO: 1354766 - DNA, 21 bp, Homo sapiens
tgcagtggcgcattctaggct

SEQ ID NO: 1354767 - DNA, 17 bp, Homo sapiens
tgcagttctactcaggc

SEQ ID NO: 1354768 - DNA, 16 bp, Homo sapiens
tgcagtttatcattca

SEQ ID NO: 1354769 - DNA, 19 bp, Homo sapiens
tgctccccacagcgtccct

SEQ ID NO: 1354770 - DNA, 22 bp, Homo sapiens
tgctccccacagcgtccctggc

SEQ ID NO: 1354771 - DNA, 20 bp, Homo sapiens
tgctccgaggacccaggaaa

SEQ ID NO: 1354772 - DNA, 19 bp, Homo sapiens
tgctcggagaagagcgcag

SEQ ID NO: 1354773 - DNA, 20 bp, Homo sapiens
tgctcggagaagagcgcagt

SEQ ID NO: 1354774 - DNA, 12 bp, Homo sapiens
tgctctatgctt

SEQ ID NO: 1354775 - DNA, 14 bp, Homo sapiens
tgctctcactgttt

SEQ ID NO: 1354776 - DNA, 19 bp, Homo sapiens
tgctcttgtcctagcttgg

SEQ ID NO: 1354777 - DNA, 18 bp, Homo sapiens
tgctgaatgttgggactg

SEQ ID NO: 1354778 - DNA, 12 bp, Homo sapiens
tgctgagcctct

SEQ ID NO: 1354779 - DNA, 16 bp, Homo sapiens
tgctgagcctctgctc

SEQ ID NO: 1354780 - DNA, 18 bp, Homo sapiens
tgctgatttggtgaccaa

SEQ ID NO: 1354781 - DNA, 15 bp, Homo sapiens
tgctgcatgccctct

SEQ ID NO: 1354782 - DNA, 22 bp, Homo sapiens
tgctgcccccaccccggggacc

SEQ ID NO: 1354783 - DNA, 15 bp, Homo sapiens
tgctgccctgaagaa

SEQ ID NO: 1354784 - DNA, 12 bp, Homo sapiens
tgctgctggtgc

SEQ ID NO: 1354785 - DNA, 18 bp, Homo sapiens
tgctggagcactgggctc

SEQ ID NO: 1354786 - DNA, 13 bp, Homo sapiens
tgctggccccagc

SEQ ID NO: 1354787 - DNA, 19 bp, Homo sapiens
tgctggccccagccctgct

SEQ ID NO: 1354788 - DNA, 22 bp, Homo sapiens
tgctgggactcagccttcagac

SEQ ID NO: 1354789 - DNA, 17 bp, Homo sapiens
tgctgggagctccactc

SEQ ID NO: 1354790 - DNA, 20 bp, Homo sapiens
tgctgggagctccactctgc

SEQ ID NO: 1354791 - DNA, 23 bp, Homo sapiens
tgctgggagctccactctgcttc

SEQ ID NO: 1354792 - DNA, 18 bp, Homo sapiens
tgctgggaggagggagag

SEQ ID NO: 1354793 - DNA, 14 bp, Homo sapiens
tgctgggcggctgt

SEQ ID NO: 1354794 - DNA, 15 bp, Homo sapiens
tgctgggggcaactg

SEQ ID NO: 1354795 - DNA, 19 bp, Homo sapiens
tgctgggggcaactggcca

SEQ ID NO: 1354796 - DNA, 18 bp, Homo sapiens
tgctggtaaaatgaagaa

SEQ ID NO: 1354797 - DNA, 17 bp, Homo sapiens
tgctgtgaagctggaac

SEQ ID NO: 1354798 - DNA, 18 bp, Homo sapiens
tgctgtgaagctggaact

SEQ ID NO: 1354799 - DNA, 23 bp, Homo sapiens
tgctgtgtatatggtatatatac

SEQ ID NO: 1354800 - DNA, 14 bp, Homo sapiens
tgcttagaaaagaa

SEQ ID NO: 1354801 - DNA, 23 bp, Homo sapiens
tgcttatttgacaacgtttcagc

SEQ ID NO: 1354802 - DNA, 13 bp, Homo sapiens
tgcttcacagtag

SEQ ID NO: 1354803 - DNA, 12 bp, Homo sapiens
tgcttcctcctg

SEQ ID NO: 1354804 - DNA, 14 bp, Homo sapiens
tgcttctctgactt

SEQ ID NO: 1354805 - DNA, 17 bp, Homo sapiens
tgcttctctgacttctg

SEQ ID NO: 1354806 - DNA, 20 bp, Homo sapiens
tgcttgaataaacaccactg

SEQ ID NO: 1354807 - DNA, 15 bp, Homo sapiens
tgcttgcctgcaggg

SEQ ID NO: 1354808 - DNA, 18 bp, Homo sapiens
tgctttattaatgttttc

SEQ ID NO: 1354809 - DNA, 20 bp, Homo sapiens
tgctttattaatgttttcaa

SEQ ID NO: 1354810 - DNA, 21 bp, Homo sapiens
tgctttattaatgttttcaaa

SEQ ID NO: 1354811 - DNA, 14 bp, Homo sapiens
tgctttatttgtaa

SEQ ID NO: 1354812 - DNA, 15 bp, Homo sapiens
tgctttatttgtaaa

SEQ ID NO: 1354813 - DNA, 23 bp, Homo sapiens
tgctttcagaagtgcccttcctg

SEQ ID NO: 1354814 - DNA, 14 bp, Homo sapiens
tgctttccaaacct

SEQ ID NO: 1354815 - DNA, 23 bp, Homo sapiens
tgctttggacctaaatggcctca

SEQ ID NO: 1354816 - DNA, 16 bp, Homo sapiens
tgcttttctgccctgg

SEQ ID NO: 1354817 - DNA, 17 bp, Homo sapiens
tgcttttctgtatttta

SEQ ID NO: 1354818 - DNA, 19 bp, Homo sapiens
tgcttttggcaaaactcta

SEQ ID NO: 1354819 - DNA, 14 bp, Homo sapiens
tgctttttcttgtt

SEQ ID NO: 1354820 - DNA, 15 bp, Homo sapiens
tggaaaactgtgttg

SEQ ID NO: 1354821 - DNA, 15 bp, Homo sapiens
tggaaagtaactgtg

SEQ ID NO: 1354822 - DNA, 20 bp, Homo sapiens
tggaaatcagccaagtttta

SEQ ID NO: 1354823 - DNA, 22 bp, Homo sapiens
tggaacccttttaaagttgata

SEQ ID NO: 1354824 - DNA, 21 bp, Homo sapiens
tggaagatcctgcgggtgggg

SEQ ID NO: 1354825 - DNA, 22 bp, Homo sapiens
tggaagcacaccaatcttactt

SEQ ID NO: 1354826 - DNA, 22 bp, Homo sapiens
tggaagtatgtatattaaaaaa

SEQ ID NO: 1354827 - DNA, 19 bp, Homo sapiens
tggaagttttcctacactt

SEQ ID NO: 1354828 - DNA, 15 bp, Homo sapiens
tggaataaaaggctt

SEQ ID NO: 1354829 - DNA, 21 bp, Homo sapiens
tggaatcaggaatattttcca

SEQ ID NO: 1354830 - DNA, 23 bp, Homo sapiens
tggaatcaggaatattttccaaa

SEQ ID NO: 1354831 - DNA, 18 bp, Homo sapiens
tggaatctggagaccagg

SEQ ID NO: 1354832 - DNA, 13 bp, Homo sapiens
tggaattgtggct

SEQ ID NO: 1354833 - DNA, 20 bp, Homo sapiens
tggaattgtggctatcctga

SEQ ID NO: 1354834 - DNA, 13 bp, Homo sapiens
tggacactccagg

SEQ ID NO: 1354835 - DNA, 14 bp, Homo sapiens
tggacactccaggg

SEQ ID NO: 1354836 - DNA, 16 bp, Homo sapiens
tggacactccagggac

SEQ ID NO: 1354837 - DNA, 18 bp, Homo sapiens
tggacactccagggacac

SEQ ID NO: 1354838 - DNA, 22 bp, Homo sapiens
tggacactccagggacacacag

SEQ ID NO: 1354839 - DNA, 23 bp, Homo sapiens
tggaccctgtggatgataaaaca

SEQ ID NO: 1354840 - DNA, 16 bp, Homo sapiens
tggacccttataaaat

SEQ ID NO: 1354841 - DNA, 18 bp, Homo sapiens
tggacctaaatggcctca

SEQ ID NO: 1354842 - DNA, 21 bp, Homo sapiens
tggacctaaatggcctcatgt

SEQ ID NO: 1354843 - DNA, 19 bp, Homo sapiens
tggaccttaggccttcctc

SEQ ID NO: 1354844 - DNA, 13 bp, Homo sapiens
tggacggcaggct

SEQ ID NO: 1354845 - DNA, 18 bp, Homo sapiens
tggacggcaggctcactg

SEQ ID NO: 1354846 - DNA, 22 bp, Homo sapiens
tggacggcaggctcactgccag

SEQ ID NO: 1354847 - DNA, 15 bp, Homo sapiens
tggactatctgtctg

SEQ ID NO: 1354848 - DNA, 23 bp, Homo sapiens
tggactatctgtctggtggcccc

SEQ ID NO: 1354849 - DNA, 23 bp, Homo sapiens
tggactgctacctttcaaagctt

SEQ ID NO: 1354850 - DNA, 12 bp, Homo sapiens
tggactgtggca

SEQ ID NO: 1354851 - DNA, 13 bp, Homo sapiens
tggactgtggcac

SEQ ID NO: 1354852 - DNA, 20 bp, Homo sapiens
tggactgtggcacttgcctg

SEQ ID NO: 1354853 - DNA, 18 bp, Homo sapiens
tggacttcaaagcaagct

SEQ ID NO: 1354854 - DNA, 17 bp, Homo sapiens
tggacttctacctgccc

SEQ ID NO: 1354855 - DNA, 15 bp, Homo sapiens
tggagaaatgaaaac

SEQ ID NO: 1354856 - DNA, 13 bp, Homo sapiens
tggagaagctgca

SEQ ID NO: 1354857 - DNA, 18 bp, Homo sapiens
tggagaagctgcaggctt

SEQ ID NO: 1354858 - DNA, 18 bp, Homo sapiens
tggagaccagggagcctt

SEQ ID NO: 1354859 - DNA, 19 bp, Homo sapiens
tggagaccagggagccttt

SEQ ID NO: 1354860 - DNA, 16 bp, Homo sapiens
tggagacttagggcac

SEQ ID NO: 1354861 - DNA, 21 bp, Homo sapiens
tggagacttagggcaccaggg

SEQ ID NO: 1354862 - DNA, 21 bp, Homo sapiens
tggagatcctcctgcagacca

SEQ ID NO: 1354863 - DNA, 15 bp, Homo sapiens
tggagcactgggctc

SEQ ID NO: 1354864 - DNA, 17 bp, Homo sapiens
tggagcactgggctccc

SEQ ID NO: 1354865 - DNA, 13 bp, Homo sapiens
tggagccccaggg

SEQ ID NO: 1354866 - DNA, 19 bp, Homo sapiens
tggaggaacacttgatgga

SEQ ID NO: 1354867 - DNA, 22 bp, Homo sapiens
tggaggcttcctgcgtcctcct

SEQ ID NO: 1354868 - DNA, 14 bp, Homo sapiens
tggagggaggcccc

SEQ ID NO: 1354869 - DNA, 13 bp, Homo sapiens
tggagggagggaa

SEQ ID NO: 1354870 - DNA, 18 bp, Homo sapiens
tggaggggtgtggcagtg

SEQ ID NO: 1354871 - DNA, 13 bp, Homo sapiens
tggagtctcctga

SEQ ID NO: 1354872 - DNA, 19 bp, Homo sapiens
tggagttctcaaagacctg

SEQ ID NO: 1354873 - DNA, 19 bp, Homo sapiens
tggatcataagacaatgga

SEQ ID NO: 1354874 - DNA, 16 bp, Homo sapiens
tggatggccccagcac

SEQ ID NO: 1354875 - DNA, 15 bp, Homo sapiens
tggatgttactctct

SEQ ID NO: 1354876 - DNA, 15 bp, Homo sapiens
tggattaaatacata

SEQ ID NO: 1354877 - DNA, 16 bp, Homo sapiens
tggattgcctctgaaa

SEQ ID NO: 1354878 - DNA, 12 bp, Homo sapiens
tggcaaaaaggc

SEQ ID NO: 1354879 - DNA, 20 bp, Homo sapiens
tggcaaggactttgtacatt

SEQ ID NO: 1354880 - DNA, 21 bp, Homo sapiens
tggcaataaattttgaaaagt

SEQ ID NO: 1354881 - DNA, 16 bp, Homo sapiens
tggcaatggtagtttc

SEQ ID NO: 1354882 - DNA, 18 bp, Homo sapiens
tggcaatggtagtttctg

SEQ ID NO: 1354883 - DNA, 19 bp, Homo sapiens
tggcaatggtagtttctgt

SEQ ID NO: 1354884 - DNA, 17 bp, Homo sapiens
tggcaccagcagcctgg

SEQ ID NO: 1354885 - DNA, 18 bp, Homo sapiens
tggcaccagcagcctgga

SEQ ID NO: 1354886 - DNA, 22 bp, Homo sapiens
tggcacccaccgtggaggagga

SEQ ID NO: 1354887 - DNA, 23 bp, Homo sapiens
tggcaccgcctccccacctccag

SEQ ID NO: 1354888 - DNA, 18 bp, Homo sapiens
tggcactggaccccagca

SEQ ID NO: 1354889 - DNA, 13 bp, Homo sapiens
tggcactggatgc

SEQ ID NO: 1354890 - DNA, 20 bp, Homo sapiens
tggcagcaacggcacagcta

SEQ ID NO: 1354891 - DNA, 13 bp, Homo sapiens
tggcaggctggcc

SEQ ID NO: 1354892 - DNA, 22 bp, Homo sapiens
tggcatcgcaccattctgactc

SEQ ID NO: 1354893 - DNA, 23 bp, Homo sapiens
tggcatcgcaccattctgactcg

SEQ ID NO: 1354894 - DNA, 21 bp, Homo sapiens
tggcatggttttgtgccatct

SEQ ID NO: 1354895 - DNA, 23 bp, Homo sapiens
tggcatggttttgtgccatctgt

SEQ ID NO: 1354896 - DNA, 13 bp, Homo sapiens
tggccaagaagca

SEQ ID NO: 1354897 - DNA, 16 bp, Homo sapiens
tggccaagaagcagtg

SEQ ID NO: 1354898 - DNA, 20 bp, Homo sapiens
tggccacagcgccagcctca

SEQ ID NO: 1354899 - DNA, 14 bp, Homo sapiens
tggccaggagcagg

SEQ ID NO: 1354900 - DNA, 22 bp, Homo sapiens
tggccagtccaccctgcctgcc

SEQ ID NO: 1354901 - DNA, 23 bp, Homo sapiens
tggccagtccaggctgccgtggg

SEQ ID NO: 1354902 - DNA, 14 bp, Homo sapiens
tggccatgtatgaa

SEQ ID NO: 1354903 - DNA, 16 bp, Homo sapiens
tggcccaaggctggca

SEQ ID NO: 1354904 - DNA, 23 bp, Homo sapiens
tggcccaaggctggcaggtcaac

SEQ ID NO: 1354905 - DNA, 20 bp, Homo sapiens
tggcccacgcctgtaatccc

SEQ ID NO: 1354906 - DNA, 13 bp, Homo sapiens
tggcccactgcat

SEQ ID NO: 1354907 - DNA, 17 bp, Homo sapiens
tggccccagcacagctt

SEQ ID NO: 1354908 - DNA, 15 bp, Homo sapiens
tggccccgtttctgg

SEQ ID NO: 1354909 - DNA, 12 bp, Homo sapiens
tggccctgggcg

SEQ ID NO: 1354910 - DNA, 18 bp, Homo sapiens
tggccgcgctccgggctt

SEQ ID NO: 1354911 - DNA, 18 bp, Homo sapiens
tggcctatccgctgccag

SEQ ID NO: 1354912 - DNA, 19 bp, Homo sapiens
tggcctatccgctgccagc

SEQ ID NO: 1354913 - DNA, 18 bp, Homo sapiens
tggcctcatgtggctgga

SEQ ID NO: 1354914 - DNA, 21 bp, Homo sapiens
tggcctcatgtggctggaaga

SEQ ID NO: 1354915 - DNA, 17 bp, Homo sapiens
tggcctcccctgccacc

SEQ ID NO: 1354916 - DNA, 23 bp, Homo sapiens
tggcctcccctgccaccaggcca

SEQ ID NO: 1354917 - DNA, 12 bp, Homo sapiens
tggcctctgctt

SEQ ID NO: 1354918 - DNA, 11 bp, Homo sapiens
tggcctgggcc

SEQ ID NO: 1354919 - DNA, 17 bp, Homo sapiens
tggcctgtggctgtcgg

SEQ ID NO: 1354920 - DNA, 15 bp, Homo sapiens
tggccttaatttcct

SEQ ID NO: 1354921 - DNA, 16 bp, Homo sapiens
tggccttaatttcctt

SEQ ID NO: 1354922 - DNA, 20 bp, Homo sapiens
tggcctttgtaagtgcagga

SEQ ID NO: 1354923 - DNA, 15 bp, Homo sapiens
tggcgccgtctccag

SEQ ID NO: 1354924 - DNA, 14 bp, Homo sapiens
tggcggagagtttt

SEQ ID NO: 1354925 - DNA, 12 bp, Homo sapiens
tggcgtgacccg

SEQ ID NO: 1354926 - DNA, 14 bp, Homo sapiens
tggctcaccttccg

SEQ ID NO: 1354927 - DNA, 13 bp, Homo sapiens
tggctcacgcctg

SEQ ID NO: 1354928 - DNA, 14 bp, Homo sapiens
tggctcacgcctgt

SEQ ID NO: 1354929 - DNA, 19 bp, Homo sapiens
tggctcacgcctgtaatcc

SEQ ID NO: 1354930 - DNA, 14 bp, Homo sapiens
tggctcagctcggg

SEQ ID NO: 1354931 - DNA, 15 bp, Homo sapiens
tggctccctcctcca

SEQ ID NO: 1354932 - DNA, 19 bp, Homo sapiens
tggctccctcctccaggcc

SEQ ID NO: 1354933 - DNA, 20 bp, Homo sapiens
tggctccctcctccaggcct

SEQ ID NO: 1354934 - DNA, 19 bp, Homo sapiens
tggctcgaatctctgtgcc

SEQ ID NO: 1354935 - DNA, 17 bp, Homo sapiens
tggctgaggttcctctg

SEQ ID NO: 1354936 - DNA, 20 bp, Homo sapiens
tggctgaggttcctctgcct

SEQ ID NO: 1354937 - DNA, 15 bp, Homo sapiens
tggctgctgccccca

SEQ ID NO: 1354938 - DNA, 13 bp, Homo sapiens
tggctgtaatcat

SEQ ID NO: 1354939 - DNA, 22 bp, Homo sapiens
tggctgtcaatgggacctgtgg

SEQ ID NO: 1354940 - DNA, 20 bp, Homo sapiens
tggctgttgacgcacctgtg

SEQ ID NO: 1354941 - DNA, 13 bp, Homo sapiens
tggcttacactgg

SEQ ID NO: 1354942 - DNA, 14 bp, Homo sapiens
tggcttcacggaag

SEQ ID NO: 1354943 - DNA, 22 bp, Homo sapiens
tggcttcacggaagagccttgc

SEQ ID NO: 1354944 - DNA, 23 bp, Homo sapiens
tggctttaagccttcaaaactat

SEQ ID NO: 1354945 - DNA, 22 bp, Homo sapiens
tggcttttattaatgcactttc

SEQ ID NO: 1354946 - DNA, 21 bp, Homo sapiens
tgggaaaacatgttaatgaca

SEQ ID NO: 1354947 - DNA, 14 bp, Homo sapiens
tgggaaaacatttg

SEQ ID NO: 1354948 - DNA, 18 bp, Homo sapiens
tgggaaacttggctcgaa

SEQ ID NO: 1354949 - DNA, 17 bp, Homo sapiens
tgggacccccgtggggc

SEQ ID NO: 1354950 - DNA, 18 bp, Homo sapiens
tgggacctgccaggcagg

SEQ ID NO: 1354951 - DNA, 23 bp, Homo sapiens
tgggacggtgcccaagccagagg

SEQ ID NO: 1354952 - DNA, 17 bp, Homo sapiens
tgggactgctaaataaa

SEQ ID NO: 1354953 - DNA, 20 bp, Homo sapiens
tgggagccatgccgtctgcc

SEQ ID NO: 1354954 - DNA, 16 bp, Homo sapiens
tgggagctccactctg

SEQ ID NO: 1354955 - DNA, 18 bp, Homo sapiens
tgggaggagcagattttt

SEQ ID NO: 1354956 - DNA, 13 bp, Homo sapiens
tgggaggagggag

SEQ ID NO: 1354957 - DNA, 20 bp, Homo sapiens
tgggaggccaaggtgggagg

SEQ ID NO: 1354958 - DNA, 14 bp, Homo sapiens
tgggaggcttcccc

SEQ ID NO: 1354959 - DNA, 18 bp, Homo sapiens
tgggaggtcaaggctgca

SEQ ID NO: 1354960 - DNA, 19 bp, Homo sapiens
tgggaggtcaaggctgcag

SEQ ID NO: 1354961 - DNA, 18 bp, Homo sapiens
tgggaggtggaagaaggg

SEQ ID NO: 1354962 - DNA, 22 bp, Homo sapiens
tgggaggtggaagaagggagaa

SEQ ID NO: 1354963 - DNA, 14 bp, Homo sapiens
tgggatgaatgcca

SEQ ID NO: 1354964 - DNA, 16 bp, Homo sapiens
tgggcaaacaggcagt

SEQ ID NO: 1354965 - DNA, 19 bp, Homo sapiens
tgggcagctgtcccttgct

SEQ ID NO: 1354966 - DNA, 18 bp, Homo sapiens
tgggcattgccatgtgga

SEQ ID NO: 1354967 - DNA, 17 bp, Homo sapiens
tgggccacccctcctag

SEQ ID NO: 1354968 - DNA, 16 bp, Homo sapiens
tgggccagtctgtgga

SEQ ID NO: 1354969 - DNA, 12 bp, Homo sapiens
tgggccccagct

SEQ ID NO: 1354970 - DNA, 12 bp, Homo sapiens
tgggcccctggc

SEQ ID NO: 1354971 - DNA, 15 bp, Homo sapiens
tgggcccctggcact

SEQ ID NO: 1354972 - DNA, 22 bp, Homo sapiens
tgggccctgagtctgggcagct

SEQ ID NO: 1354973 - DNA, 16 bp, Homo sapiens
tgggccctgggctgga

SEQ ID NO: 1354974 - DNA, 19 bp, Homo sapiens
tgggccgggacccagggcc

SEQ ID NO: 1354975 - DNA, 19 bp, Homo sapiens
tgggctacatgctggggtc

SEQ ID NO: 1354976 - DNA, 16 bp, Homo sapiens
tgggctcccgtgtttt

SEQ ID NO: 1354977 - DNA, 13 bp, Homo sapiens
tgggctctccggg

SEQ ID NO: 1354978 - DNA, 12 bp, Homo sapiens
tgggctctgtgc

SEQ ID NO: 1354979 - DNA, 17 bp, Homo sapiens
tgggctctgtgcagtca

SEQ ID NO: 1354980 - DNA, 12 bp, Homo sapiens
tgggctggactt

SEQ ID NO: 1354981 - DNA, 21 bp, Homo sapiens
tgggcttatatctggcctctg

SEQ ID NO: 1354982 - DNA, 14 bp, Homo sapiens
tgggcttggcctgc

SEQ ID NO: 1354983 - DNA, 17 bp, Homo sapiens
tgggcttgtctgtagat

SEQ ID NO: 1354984 - DNA, 20 bp, Homo sapiens
tgggcttttggggagccaga

SEQ ID NO: 1354985 - DNA, 22 bp, Homo sapiens
tgggcttttggggagccagaag

SEQ ID NO: 1354986 - DNA, 18 bp, Homo sapiens
tggggaaagacactgcct

SEQ ID NO: 1354987 - DNA, 19 bp, Homo sapiens
tggggaaaggaggtggggg

SEQ ID NO: 1354988 - DNA, 21 bp, Homo sapiens
tggggacgctccgctgccgtg

SEQ ID NO: 1354989 - DNA, 18 bp, Homo sapiens
tggggagggattctggtt

SEQ ID NO: 1354990 - DNA, 22 bp, Homo sapiens
tggggagggattctggttccag

SEQ ID NO: 1354991 - DNA, 16 bp, Homo sapiens
tggggcaggctgggcc

SEQ ID NO: 1354992 - DNA, 19 bp, Homo sapiens
tggggcccagtgcatggtg

SEQ ID NO: 1354993 - DNA, 21 bp, Homo sapiens
tggggcctagcgatctctcct

SEQ ID NO: 1354994 - DNA, 14 bp, Homo sapiens
tggggctgctgtga

SEQ ID NO: 1354995 - DNA, 21 bp, Homo sapiens
tgggggatcacagcctctgaa

SEQ ID NO: 1354996 - DNA, 16 bp, Homo sapiens
tgggggcacaggaggc

SEQ ID NO: 1354997 - DNA, 14 bp, Homo sapiens
tgggggctagggag

SEQ ID NO: 1354998 - DNA, 17 bp, Homo sapiens
tggggggacccagtgca

SEQ ID NO: 1354999 - DNA, 14 bp, Homo sapiens
tgggggggtggccg

SEQ ID NO: 1355000 - DNA, 23 bp, Homo sapiens
tgggggggtggccgctgagtggc

SEQ ID NO: 1355001 - DNA, 23 bp, Homo sapiens
tggggtctcaaagtttgacagga

SEQ ID NO: 1355002 - DNA, 17 bp, Homo sapiens
tggggtttcctggcact

SEQ ID NO: 1355003 - DNA, 23 bp, Homo sapiens
tgggtaggaaagaggaagcaaat

SEQ ID NO: 1355004 - DNA, 19 bp, Homo sapiens
tgggtcacacacggaggca

SEQ ID NO: 1355005 - DNA, 15 bp, Homo sapiens
tgggtccttcctgaa

SEQ ID NO: 1355006 - DNA, 17 bp, Homo sapiens
tgggtggcaccagcagc

SEQ ID NO: 1355007 - DNA, 15 bp, Homo sapiens
tgggtgggctctgtg

SEQ ID NO: 1355008 - DNA, 20 bp, Homo sapiens
tgggtggggggcattgagta

SEQ ID NO: 1355009 - DNA, 14 bp, Homo sapiens
tgggtttttccctg

SEQ ID NO: 1355010 - DNA, 15 bp, Homo sapiens
tggtaaatgtttctt

SEQ ID NO: 1355011 - DNA, 16 bp, Homo sapiens
tggtaataagcactgt

SEQ ID NO: 1355012 - DNA, 19 bp, Homo sapiens
tggtagaagtttggctgct

SEQ ID NO: 1355013 - DNA, 17 bp, Homo sapiens
tggtagtttctgtggtt

SEQ ID NO: 1355014 - DNA, 14 bp, Homo sapiens
tggtatatatacat

SEQ ID NO: 1355015 - DNA, 23 bp, Homo sapiens
tggtcaagggctgtcattgcaca

SEQ ID NO: 1355016 - DNA, 21 bp, Homo sapiens
tggtcacagcggaggtgtgga

SEQ ID NO: 1355017 - DNA, 16 bp, Homo sapiens
tggtcaccatgaaact

SEQ ID NO: 1355018 - DNA, 17 bp, Homo sapiens
tggtccccgttccaccc

SEQ ID NO: 1355019 - DNA, 17 bp, Homo sapiens
tggtcctagtaagaaga

SEQ ID NO: 1355020 - DNA, 13 bp, Homo sapiens
tggtcgctcctgc

SEQ ID NO: 1355021 - DNA, 15 bp, Homo sapiens
tggtcgctcctgccc

SEQ ID NO: 1355022 - DNA, 23 bp, Homo sapiens
tggtctgtgtgtgtgtgtgtgcg

SEQ ID NO: 1355023 - DNA, 15 bp, Homo sapiens
tggtgaagtgcttgg

SEQ ID NO: 1355024 - DNA, 14 bp, Homo sapiens
tggtgatttgaaaa

SEQ ID NO: 1355025 - DNA, 21 bp, Homo sapiens
tggtgccatccccagggggca

SEQ ID NO: 1355026 - DNA, 16 bp, Homo sapiens
tggtgggggcctcggt

SEQ ID NO: 1355027 - DNA, 17 bp, Homo sapiens
tggtgtaatttgaagat

SEQ ID NO: 1355028 - DNA, 17 bp, Homo sapiens
tggtgtgaacccgggag

SEQ ID NO: 1355029 - DNA, 14 bp, Homo sapiens
tggtgtggcctgtg

SEQ ID NO: 1355030 - DNA, 15 bp, Homo sapiens
tggtgtggcctgtgg

SEQ ID NO: 1355031 - DNA, 14 bp, Homo sapiens
tggttatggagagg

SEQ ID NO: 1355032 - DNA, 14 bp, Homo sapiens
tggttctcaatgaa

SEQ ID NO: 1355033 - DNA, 16 bp, Homo sapiens
tggttctcaatgaaaa

SEQ ID NO: 1355034 - DNA, 16 bp, Homo sapiens
tggttgggaatgagga

SEQ ID NO: 1355035 - DNA, 23 bp, Homo sapiens
tggttgggaatgaggaaaattct

SEQ ID NO: 1355036 - DNA, 12 bp, Homo sapiens
tggttttaagaa

SEQ ID NO: 1355037 - DNA, 16 bp, Homo sapiens
tggttttgtgccatct

SEQ ID NO: 1355038 - DNA, 22 bp, Homo sapiens
tggttttgtgccatctgtagct

SEQ ID NO: 1355039 - DNA, 12 bp, Homo sapiens
tgtaaaaatctt

SEQ ID NO: 1355040 - DNA, 14 bp, Homo sapiens
tgtaaaacaaaatt

SEQ ID NO: 1355041 - DNA, 12 bp, Homo sapiens
tgtaaaagaaat

SEQ ID NO: 1355042 - DNA, 13 bp, Homo sapiens
tgtaaaagaaatc

SEQ ID NO: 1355043 - DNA, 11 bp, Homo sapiens
tgtaaacattt

SEQ ID NO: 1355044 - DNA, 12 bp, Homo sapiens
tgtaaagactgg

SEQ ID NO: 1355045 - DNA, 14 bp, Homo sapiens
tgtaaataattctt

SEQ ID NO: 1355046 - DNA, 17 bp, Homo sapiens
tgtaaataggattttta

SEQ ID NO: 1355047 - DNA, 21 bp, Homo sapiens
tgtaaatcatgttgatcatgt

SEQ ID NO: 1355048 - DNA, 14 bp, Homo sapiens
tgtaaatgtaaact

SEQ ID NO: 1355049 - DNA, 19 bp, Homo sapiens
tgtaacttccaaataaata

SEQ ID NO: 1355050 - DNA, 14 bp, Homo sapiens
tgtaagaaggcaat

SEQ ID NO: 1355051 - DNA, 17 bp, Homo sapiens
tgtaagcgtatggcttt

SEQ ID NO: 1355052 - DNA, 14 bp, Homo sapiens
tgtaagttcacaac

SEQ ID NO: 1355053 - DNA, 17 bp, Homo sapiens
tgtaataaactttaata

SEQ ID NO: 1355054 - DNA, 15 bp, Homo sapiens
tgtaatttaaatgaa

SEQ ID NO: 1355055 - DNA, 17 bp, Homo sapiens
tgtaatttaaatgaaag

SEQ ID NO: 1355056 - DNA, 13 bp, Homo sapiens
tgtacaaaattaa

SEQ ID NO: 1355057 - DNA, 22 bp, Homo sapiens
tgtacagaacacatttctctga

SEQ ID NO: 1355058 - DNA, 18 bp, Homo sapiens
tgtacagattctttcagt

SEQ ID NO: 1355059 - DNA, 20 bp, Homo sapiens
tgtacagtagattttccaaa

SEQ ID NO: 1355060 - DNA, 16 bp, Homo sapiens
tgtacatttctataaa

SEQ ID NO: 1355061 - DNA, 21 bp, Homo sapiens
tgtacatttctataaatagat

SEQ ID NO: 1355062 - DNA, 16 bp, Homo sapiens
tgtaccaagtgaaatt

SEQ ID NO: 1355063 - DNA, 23 bp, Homo sapiens
tgtacgacacgggtggggaaagg

SEQ ID NO: 1355064 - DNA, 23 bp, Homo sapiens
tgtacgacgtcagatgtttaaaa

SEQ ID NO: 1355065 - DNA, 17 bp, Homo sapiens
tgtacgtccagcctgcc

SEQ ID NO: 1355066 - DNA, 15 bp, Homo sapiens
tgtactgttactggg

SEQ ID NO: 1355067 - DNA, 15 bp, Homo sapiens
tgtacttaaatggta

SEQ ID NO: 1355068 - DNA, 18 bp, Homo sapiens
tgtacttttcattctctt

SEQ ID NO: 1355069 - DNA, 22 bp, Homo sapiens
tgtacttttcattctcttttaa

SEQ ID NO: 1355070 - DNA, 15 bp, Homo sapiens
tgtactttttagtaa

SEQ ID NO: 1355071 - DNA, 21 bp, Homo sapiens
tgtactttttagtaatttctt

SEQ ID NO: 1355072 - DNA, 14 bp, Homo sapiens
tgtagagtgggagc

SEQ ID NO: 1355073 - DNA, 17 bp, Homo sapiens
tgtagagtgtagactgt

SEQ ID NO: 1355074 - DNA, 20 bp, Homo sapiens
tgtagagttttgtcattcag

SEQ ID NO: 1355075 - DNA, 12 bp, Homo sapiens
tgtagatgatgt

SEQ ID NO: 1355076 - DNA, 15 bp, Homo sapiens
tgtagcacttactgg

SEQ ID NO: 1355077 - DNA, 15 bp, Homo sapiens
tgtagccctcccact

SEQ ID NO: 1355078 - DNA, 22 bp, Homo sapiens
tgtaggagctgccttggctcag

SEQ ID NO: 1355079 - DNA, 17 bp, Homo sapiens
tgtaggcatcatgcatg

SEQ ID NO: 1355080 - DNA, 18 bp, Homo sapiens
tgtaggcatcatgcatgt

SEQ ID NO: 1355081 - DNA, 13 bp, Homo sapiens
tgtagggagggcg

SEQ ID NO: 1355082 - DNA, 22 bp, Homo sapiens
tgtataaaatacatagtgaaaa

SEQ ID NO: 1355083 - DNA, 12 bp, Homo sapiens
tgtataaatata

SEQ ID NO: 1355084 - DNA, 23 bp, Homo sapiens
tgtatacagtgcagagccttctc

SEQ ID NO: 1355085 - DNA, 13 bp, Homo sapiens
tgtatagcatgaa

SEQ ID NO: 1355086 - DNA, 21 bp, Homo sapiens
tgtatatggtatatatacata

SEQ ID NO: 1355087 - DNA, 19 bp, Homo sapiens
tgtatattacaatgatcac

SEQ ID NO: 1355088 - DNA, 13 bp, Homo sapiens
tgtatattggttt

SEQ ID NO: 1355089 - DNA, 17 bp, Homo sapiens
tgtatattgtaatttaa

SEQ ID NO: 1355090 - DNA, 12 bp, Homo sapiens
tgtatatttgat

SEQ ID NO: 1355091 - DNA, 19 bp, Homo sapiens
tgtatatttgatttattaa

SEQ ID NO: 1355092 - DNA, 22 bp, Homo sapiens
tgtatatttgtaaagctattta

SEQ ID NO: 1355093 - DNA, 17 bp, Homo sapiens
tgtatcctggaacaata

SEQ ID NO: 1355094 - DNA, 18 bp, Homo sapiens
tgtatgaaaaattgggga

SEQ ID NO: 1355095 - DNA, 17 bp, Homo sapiens
tgtatgactgcacatga

SEQ ID NO: 1355096 - DNA, 16 bp, Homo sapiens
tgtatgcacagtaaaa

SEQ ID NO: 1355097 - DNA, 18 bp, Homo sapiens
tgtatgccaagtgagaag

SEQ ID NO: 1355098 - DNA, 20 bp, Homo sapiens
tgtatgccaagtgagaagat

SEQ ID NO: 1355099 - DNA, 11 bp, Homo sapiens
tgtatgtgttt

SEQ ID NO: 1355100 - DNA, 14 bp, Homo sapiens
tgtatgtgtttaga

SEQ ID NO: 1355101 - DNA, 15 bp, Homo sapiens
tgtatgtgtttagaa

SEQ ID NO: 1355102 - DNA, 20 bp, Homo sapiens
tgtatgtgtttagaattgaa

SEQ ID NO: 1355103 - DNA, 14 bp, Homo sapiens
tgtattgtcctatt

SEQ ID NO: 1355104 - DNA, 19 bp, Homo sapiens
tgtattgtcctattagtgt

SEQ ID NO: 1355105 - DNA, 16 bp, Homo sapiens
tgtatttaacagaaat

SEQ ID NO: 1355106 - DNA, 21 bp, Homo sapiens
tgtatttaacagaaattgtat

SEQ ID NO: 1355107 - DNA, 12 bp, Homo sapiens
tgtatttgaaag

SEQ ID NO: 1355108 - DNA, 15 bp, Homo sapiens
tgtatttgagcatat

SEQ ID NO: 1355109 - DNA, 19 bp, Homo sapiens
tgtattttatttagacaag

SEQ ID NO: 1355110 - DNA, 16 bp, Homo sapiens
tgtattttcatgaaaa

SEQ ID NO: 1355111 - DNA, 22 bp, Homo sapiens
tgtcaaaagtagaactttgtat

SEQ ID NO: 1355112 - DNA, 18 bp, Homo sapiens
tgtcaaatgatgtgcaaa

SEQ ID NO: 1355113 - DNA, 17 bp, Homo sapiens
tgtcaatgagagcataa

SEQ ID NO: 1355114 - DNA, 16 bp, Homo sapiens
tgtcaatttctgtgtt

SEQ ID NO: 1355115 - DNA, 18 bp, Homo sapiens
tgtcacgaatatggacat

SEQ ID NO: 1355116 - DNA, 19 bp, Homo sapiens
tgtcacgaatatggacata

SEQ ID NO: 1355117 - DNA, 16 bp, Homo sapiens
tgtcactcattgctga

SEQ ID NO: 1355118 - DNA, 16 bp, Homo sapiens
tgtcactttttatgct

SEQ ID NO: 1355119 - DNA, 17 bp, Homo sapiens
tgtcaggctgaaaacaa

SEQ ID NO: 1355120 - DNA, 21 bp, Homo sapiens
tgtcataacatccagagcttt

SEQ ID NO: 1355121 - DNA, 23 bp, Homo sapiens
tgtcatagttctgagctgccagt

SEQ ID NO: 1355122 - DNA, 16 bp, Homo sapiens
tgtcatttcagaagtt

SEQ ID NO: 1355123 - DNA, 21 bp, Homo sapiens
tgtccaaacgtcctctttagt

SEQ ID NO: 1355124 - DNA, 11 bp, Homo sapiens
tgtccaaagag

SEQ ID NO: 1355125 - DNA, 17 bp, Homo sapiens
tgtccaaagaggctgcc

SEQ ID NO: 1355126 - DNA, 20 bp, Homo sapiens
tgtccaaagaggctgcccct

SEQ ID NO: 1355127 - DNA, 20 bp, Homo sapiens
tgtccagcaccttgtgcctg

SEQ ID NO: 1355128 - DNA, 22 bp, Homo sapiens
tgtccagcaccttgtgcctggg

SEQ ID NO: 1355129 - DNA, 22 bp, Homo sapiens
tgtccatgcgctcagggccatg

SEQ ID NO: 1355130 - DNA, 17 bp, Homo sapiens
tgtccctatgcatatca

SEQ ID NO: 1355131 - DNA, 23 bp, Homo sapiens
tgtcccttgcttgcctgcagggc

SEQ ID NO: 1355132 - DNA, 14 bp, Homo sapiens
tgtccgagctttga

SEQ ID NO: 1355133 - DNA, 15 bp, Homo sapiens
tgtcctgtcctgctc

SEQ ID NO: 1355134 - DNA, 15 bp, Homo sapiens
tgtcgctcatgtgtg

SEQ ID NO: 1355135 - DNA, 16 bp, Homo sapiens
tgtcgctcatgtgtgc

SEQ ID NO: 1355136 - DNA, 22 bp, Homo sapiens
tgtcgtatttggcacacagcag

SEQ ID NO: 1355137 - DNA, 21 bp, Homo sapiens
tgtctaaacaatgctgatttg

SEQ ID NO: 1355138 - DNA, 17 bp, Homo sapiens
tgtctcactaaagcatg

SEQ ID NO: 1355139 - DNA, 22 bp, Homo sapiens
tgtctcctatatatttctatta

SEQ ID NO: 1355140 - DNA, 18 bp, Homo sapiens
tgtctctcttctcagagt

SEQ ID NO: 1355141 - DNA, 17 bp, Homo sapiens
tgtctcttgagtttgtc

SEQ ID NO: 1355142 - DNA, 13 bp, Homo sapiens
tgtctgatttctt

SEQ ID NO: 1355143 - DNA, 20 bp, Homo sapiens
tgtctggcaaggactttgta

SEQ ID NO: 1355144 - DNA, 17 bp, Homo sapiens
tgtctgggtttgagaaa

SEQ ID NO: 1355145 - DNA, 16 bp, Homo sapiens
tgtcttcctcaaaata

SEQ ID NO: 1355146 - DNA, 12 bp, Homo sapiens
tgtcttgggcag

SEQ ID NO: 1355147 - DNA, 16 bp, Homo sapiens
tgtctttggaggtgct

SEQ ID NO: 1355148 - DNA, 15 bp, Homo sapiens
tgtcttttaaaatgc

SEQ ID NO: 1355149 - DNA, 21 bp, Homo sapiens
tgtctttttattaaaatattt

SEQ ID NO: 1355150 - DNA, 13 bp, Homo sapiens
tgtgaaaagaaaa

SEQ ID NO: 1355151 - DNA, 15 bp, Homo sapiens
tgtgaaaagaaaaat

SEQ ID NO: 1355152 - DNA, 18 bp, Homo sapiens
tgtgaaattgcatacttt

SEQ ID NO: 1355153 - DNA, 20 bp, Homo sapiens
tgtgaattattgacactgaa

SEQ ID NO: 1355154 - DNA, 15 bp, Homo sapiens
tgtgaatttttaagc

SEQ ID NO: 1355155 - DNA, 16 bp, Homo sapiens
tgtgaatttttattgt

SEQ ID NO: 1355156 - DNA, 19 bp, Homo sapiens
tgtgacaattttgtacaaa

SEQ ID NO: 1355157 - DNA, 18 bp, Homo sapiens
tgtgacatggtgcctgag

SEQ ID NO: 1355158 - DNA, 11 bp, Homo sapiens
tgtgaccctcc

SEQ ID NO: 1355159 - DNA, 21 bp, Homo sapiens
tgtgagaagccagccagaggc

SEQ ID NO: 1355160 - DNA, 21 bp, Homo sapiens
tgtgagaagtgaatgctggga

SEQ ID NO: 1355161 - DNA, 24 bp, Homo sapiens
tgtgagaagtgaatgctgggactc

SEQ ID NO: 1355162 - DNA, 15 bp, Homo sapiens
tgtgagctcttccta

SEQ ID NO: 1355163 - DNA, 14 bp, Homo sapiens
tgtgagtggttgaa

SEQ ID NO: 1355164 - DNA, 22 bp, Homo sapiens
tgtgatacattttttaagcttc

SEQ ID NO: 1355165 - DNA, 18 bp, Homo sapiens
tgtgatggacactccagg

SEQ ID NO: 1355166 - DNA, 20 bp, Homo sapiens
tgtgcaacagggtatggact

SEQ ID NO: 1355167 - DNA, 20 bp, Homo sapiens
tgtgcaatagacacatacat

SEQ ID NO: 1355168 - DNA, 23 bp, Homo sapiens
tgtgcacatccgcgtgtgcctgt

SEQ ID NO: 1355169 - DNA, 16 bp, Homo sapiens
tgtgcatagtttcttt

SEQ ID NO: 1355170 - DNA, 17 bp, Homo sapiens
tgtgccaccatgcctca

SEQ ID NO: 1355171 - DNA, 22 bp, Homo sapiens
tgtgccagaggaatcctggcag

SEQ ID NO: 1355172 - DNA, 18 bp, Homo sapiens
tgtgcccagaatactgat

SEQ ID NO: 1355173 - DNA, 14 bp, Homo sapiens
tgtgctatgaattt

SEQ ID NO: 1355174 - DNA, 15 bp, Homo sapiens
tgtgctatgaatttt

SEQ ID NO: 1355175 - DNA, 15 bp, Homo sapiens
tgtgctcagaagggc

SEQ ID NO: 1355176 - DNA, 17 bp, Homo sapiens
tgtgctgccctgaagaa

SEQ ID NO: 1355177 - DNA, 18 bp, Homo sapiens
tgtgctgccctgaagaat

SEQ ID NO: 1355178 - DNA, 15 bp, Homo sapiens
tgtgcttcacagtag

SEQ ID NO: 1355179 - DNA, 15 bp, Homo sapiens
tgtgcttctgccacc

SEQ ID NO: 1355180 - DNA, 14 bp, Homo sapiens
tgtggatcagagat

SEQ ID NO: 1355181 - DNA, 18 bp, Homo sapiens
tgtggcaatctgtgggct

SEQ ID NO: 1355182 - DNA, 16 bp, Homo sapiens
tgtggcacttgcctgg

SEQ ID NO: 1355183 - DNA, 15 bp, Homo sapiens
tgtggcagtggtttt

SEQ ID NO: 1355184 - DNA, 23 bp, Homo sapiens
tgtggcataaattgcatcactgt

SEQ ID NO: 1355185 - DNA, 16 bp, Homo sapiens
tgtggccctggctgcc

SEQ ID NO: 1355186 - DNA, 23 bp, Homo sapiens
tgtggcgccgtctccaggggctg

SEQ ID NO: 1355187 - DNA, 14 bp, Homo sapiens
tgtggctccaggcc

SEQ ID NO: 1355188 - DNA, 22 bp, Homo sapiens
tgtggctccaggccaaagtgcc

SEQ ID NO: 1355189 - DNA, 13 bp, Homo sapiens
tgtggtagaaaca

SEQ ID NO: 1355190 - DNA, 14 bp, Homo sapiens
tgtggtagaaacaa

SEQ ID NO: 1355191 - DNA, 20 bp, Homo sapiens
tgtggtagcttatcttagaa

SEQ ID NO: 1355192 - DNA, 23 bp, Homo sapiens
tgtggtcacagcggaggtgtgga

SEQ ID NO: 1355193 - DNA, 16 bp, Homo sapiens
tgtgtaaaaaaaccac

SEQ ID NO: 1355194 - DNA, 19 bp, Homo sapiens
tgtgtagcatactggcttc

SEQ ID NO: 1355195 - DNA, 14 bp, Homo sapiens
tgtgtcatgccagt

SEQ ID NO: 1355196 - DNA, 14 bp, Homo sapiens
tgtgtcccaggcag

SEQ ID NO: 1355197 - DNA, 14 bp, Homo sapiens
tgtgtgaaattgca

SEQ ID NO: 1355198 - DNA, 22 bp, Homo sapiens
tgtgtgcaacagggtatggact

SEQ ID NO: 1355199 - DNA, 16 bp, Homo sapiens
tgtgtggactgtggca

SEQ ID NO: 1355200 - DNA, 15 bp, Homo sapiens
tgtgtgtcccaggca

SEQ ID NO: 1355201 - DNA, 16 bp, Homo sapiens
tgtgtgtgtgtgtgcg

SEQ ID NO: 1355202 - DNA, 13 bp, Homo sapiens
tgtgttaatttaa

SEQ ID NO: 1355203 - DNA, 17 bp, Homo sapiens
tgtgttggtgtggccca

SEQ ID NO: 1355204 - DNA, 15 bp, Homo sapiens
tgtgtttatttcact

SEQ ID NO: 1355205 - DNA, 20 bp, Homo sapiens
tgtgtttctatgtgacaatt

SEQ ID NO: 1355206 - DNA, 21 bp, Homo sapiens
tgtgtttctcctgagctagga

SEQ ID NO: 1355207 - DNA, 14 bp, Homo sapiens
tgtgttttttaaga

SEQ ID NO: 1355208 - DNA, 21 bp, Homo sapiens
tgttaaaattatcaatatcta

SEQ ID NO: 1355209 - DNA, 23 bp, Homo sapiens
tgttaaaattatcaatatctaat

SEQ ID NO: 1355210 - DNA, 12 bp, Homo sapiens
tgttaaagagaa

SEQ ID NO: 1355211 - DNA, 17 bp, Homo sapiens
tgttaatacaaggtata

SEQ ID NO: 1355212 - DNA, 22 bp, Homo sapiens
tgttactctcttgcaccaaatt

SEQ ID NO: 1355213 - DNA, 23 bp, Homo sapiens
tgttagatatttttcataaacaa

SEQ ID NO: 1355214 - DNA, 14 bp, Homo sapiens
tgttagtggcaccg

SEQ ID NO: 1355215 - DNA, 12 bp, Homo sapiens
tgttatatgaac

SEQ ID NO: 1355216 - DNA, 18 bp, Homo sapiens
tgttcactcactctaaag

SEQ ID NO: 1355217 - DNA, 23 bp, Homo sapiens
tgttcatagcccagtagaccttg

SEQ ID NO: 1355218 - DNA, 20 bp, Homo sapiens
tgttcggaaggggttcctca

SEQ ID NO: 1355219 - DNA, 22 bp, Homo sapiens
tgttctcagaatcccttaacag

SEQ ID NO: 1355220 - DNA, 17 bp, Homo sapiens
tgttcttggcaataaat

SEQ ID NO: 1355221 - DNA, 14 bp, Homo sapiens
tgttctttcagaaa

SEQ ID NO: 1355222 - DNA, 15 bp, Homo sapiens
tgttgacaactgtga

SEQ ID NO: 1355223 - DNA, 23 bp, Homo sapiens
tgttgagcaagcagtagcatttg

SEQ ID NO: 1355224 - DNA, 17 bp, Homo sapiens
tgttgatcatgtacttt

SEQ ID NO: 1355225 - DNA, 19 bp, Homo sapiens
tgttgatcatgtacttttt

SEQ ID NO: 1355226 - DNA, 22 bp, Homo sapiens
tgttgatcatgtactttttagt

SEQ ID NO: 1355227 - DNA, 16 bp, Homo sapiens
tgttgattattagcca

SEQ ID NO: 1355228 - DNA, 17 bp, Homo sapiens
tgttgtaaaacaaaatt

SEQ ID NO: 1355229 - DNA, 11 bp, Homo sapiens
tgttgtagtgt

SEQ ID NO: 1355230 - DNA, 16 bp, Homo sapiens
tgttgttctttcagaa

SEQ ID NO: 1355231 - DNA, 22 bp, Homo sapiens
tgtttaaaaaccgaataaatgt

SEQ ID NO: 1355232 - DNA, 14 bp, Homo sapiens
tgtttaaaataaaa

SEQ ID NO: 1355233 - DNA, 19 bp, Homo sapiens
tgtttaaaataaaatgaaa

SEQ ID NO: 1355234 - DNA, 22 bp, Homo sapiens
tgtttaaaataaaatgaaaatt

SEQ ID NO: 1355235 - DNA, 14 bp, Homo sapiens
tgtttaaaatgtaa

SEQ ID NO: 1355236 - DNA, 22 bp, Homo sapiens
tgtttaaaatgtaatttaaatg

SEQ ID NO: 1355237 - DNA, 17 bp, Homo sapiens
tgtttacatttgatgca

SEQ ID NO: 1355238 - DNA, 23 bp, Homo sapiens
tgtttacctttctctctctaagg

SEQ ID NO: 1355239 - DNA, 14 bp, Homo sapiens
tgtttagaattgaa

SEQ ID NO: 1355240 - DNA, 23 bp, Homo sapiens
tgtttagaattgaaggtttttga

SEQ ID NO: 1355241 - DNA, 13 bp, Homo sapiens
tgtttatttacaa

SEQ ID NO: 1355242 - DNA, 14 bp, Homo sapiens
tgtttatttacaag

SEQ ID NO: 1355243 - DNA, 12 bp, Homo sapiens
tgtttattttct

SEQ ID NO: 1355244 - DNA, 20 bp, Homo sapiens
tgtttattttctacgtttct

SEQ ID NO: 1355245 - DNA, 14 bp, Homo sapiens
tgtttcctctagtt

SEQ ID NO: 1355246 - DNA, 21 bp, Homo sapiens
tgtttcctgacattgtctcct

SEQ ID NO: 1355247 - DNA, 15 bp, Homo sapiens
tgtttctcctgagct

SEQ ID NO: 1355248 - DNA, 15 bp, Homo sapiens
tgtttcttttgtttg

SEQ ID NO: 1355249 - DNA, 18 bp, Homo sapiens
tgtttcttttgtttggta

SEQ ID NO: 1355250 - DNA, 16 bp, Homo sapiens
tgtttgaaaatagttt

SEQ ID NO: 1355251 - DNA, 18 bp, Homo sapiens
tgtttgaaaatagtttat

SEQ ID NO: 1355252 - DNA, 13 bp, Homo sapiens
tgtttgccaggac

SEQ ID NO: 1355253 - DNA, 16 bp, Homo sapiens
tgtttgccaggacatg

SEQ ID NO: 1355254 - DNA, 19 bp, Homo sapiens
tgtttgccaggacatgcaa

SEQ ID NO: 1355255 - DNA, 14 bp, Homo sapiens
tgtttggtaaatgt

SEQ ID NO: 1355256 - DNA, 19 bp, Homo sapiens
tgttttaaagaatatgact

SEQ ID NO: 1355257 - DNA, 17 bp, Homo sapiens
tgttttacaatagttct

SEQ ID NO: 1355258 - DNA, 16 bp, Homo sapiens
tgttttccgtgaaaac

SEQ ID NO: 1355259 - DNA, 19 bp, Homo sapiens
tgttttccgtgaaaacgga

SEQ ID NO: 1355260 - DNA, 17 bp, Homo sapiens
tgttttctgactaatta

SEQ ID NO: 1355261 - DNA, 15 bp, Homo sapiens
tgttttgcaagtgct

SEQ ID NO: 1355262 - DNA, 19 bp, Homo sapiens
tgtttttaatgctatttga

SEQ ID NO: 1355263 - DNA, 14 bp, Homo sapiens
tgtttttctgcttt

SEQ ID NO: 1355264 - DNA, 19 bp, Homo sapiens
tgtttttctgctttagact

SEQ ID NO: 1355265 - DNA, 18 bp, Homo sapiens
tgtttttgaggctttctg

SEQ ID NO: 1355266 - DNA, 10 bp, Homo sapiens
tgtttttggg

SEQ ID NO: 1355267 - DNA, 21 bp, Homo sapiens
tgtttttgtatattggtttta

SEQ ID NO: 1355268 - DNA, 12 bp, Homo sapiens
tgtttttgtgaa

SEQ ID NO: 1355269 - DNA, 18 bp, Homo sapiens
tgttttttgtttttctgc

SEQ ID NO: 1355270 - DNA, 20 bp, Homo sapiens
ttaaaaaaaaagtcagagac

SEQ ID NO: 1355271 - DNA, 16 bp, Homo sapiens
ttaaaaaatattttct

SEQ ID NO: 1355272 - DNA, 19 bp, Homo sapiens
ttaaaaacataacataaat

SEQ ID NO: 1355273 - DNA, 18 bp, Homo sapiens
ttaaaaactgaaaaatct

SEQ ID NO: 1355274 - DNA, 21 bp, Homo sapiens
ttaaaaagggaagaaactgct

SEQ ID NO: 1355275 - DNA, 18 bp, Homo sapiens
ttaaaaatatcaaattaa

SEQ ID NO: 1355276 - DNA, 13 bp, Homo sapiens
ttaaaacacgttt

SEQ ID NO: 1355277 - DNA, 16 bp, Homo sapiens
ttaaaacatcattcct

SEQ ID NO: 1355278 - DNA, 12 bp, Homo sapiens
ttaaaagaatga

SEQ ID NO: 1355279 - DNA, 15 bp, Homo sapiens
ttaaaataattatat

SEQ ID NO: 1355280 - DNA, 20 bp, Homo sapiens
ttaaaatagaaattttgtaa

SEQ ID NO: 1355281 - DNA, 13 bp, Homo sapiens
ttaaaatgtaatt

SEQ ID NO: 1355282 - DNA, 13 bp, Homo sapiens
ttaaacattgaag

SEQ ID NO: 1355283 - DNA, 14 bp, Homo sapiens
ttaaaccacttaaa

SEQ ID NO: 1355284 - DNA, 20 bp, Homo sapiens
ttaaactgtcgtgtcatact

SEQ ID NO: 1355285 - DNA, 16 bp, Homo sapiens
ttaaagaaaagatgaa

SEQ ID NO: 1355286 - DNA, 18 bp, Homo sapiens
ttaaagacaggagacaaa

SEQ ID NO: 1355287 - DNA, 12 bp, Homo sapiens
ttaaatgaaaga

SEQ ID NO: 1355288 - DNA, 16 bp, Homo sapiens
ttaaatgaaagaaaat

SEQ ID NO: 1355289 - DNA, 22 bp, Homo sapiens
ttaaatggtaataagcactgta

SEQ ID NO: 1355290 - DNA, 23 bp, Homo sapiens
ttaaatttttttgtatgaaaaca

SEQ ID NO: 1355291 - DNA, 15 bp, Homo sapiens
ttaacagaaattgta

SEQ ID NO: 1355292 - DNA, 16 bp, Homo sapiens
ttaacagaaattgtat

SEQ ID NO: 1355293 - DNA, 17 bp, Homo sapiens
ttaacagaaattgtata

SEQ ID NO: 1355294 - DNA, 21 bp, Homo sapiens
ttaaccttactaattatacta

SEQ ID NO: 1355295 - DNA, 15 bp, Homo sapiens
ttaaccttgtataaa

SEQ ID NO: 1355296 - DNA, 21 bp, Homo sapiens
ttaaccttgtataaattattc

SEQ ID NO: 1355297 - DNA, 14 bp, Homo sapiens
ttaacttaataatc

SEQ ID NO: 1355298 - DNA, 17 bp, Homo sapiens
ttaagctgtggtcaagg

SEQ ID NO: 1355299 - DNA, 23 bp, Homo sapiens
ttaaggaaaactacctgtattta

SEQ ID NO: 1355300 - DNA, 18 bp, Homo sapiens
ttaaggactgactgaggc

SEQ ID NO: 1355301 - DNA, 16 bp, Homo sapiens
ttaagggaaaaatata

SEQ ID NO: 1355302 - DNA, 16 bp, Homo sapiens
ttaaggtctttcagta

SEQ ID NO: 1355303 - DNA, 14 bp, Homo sapiens
ttaaggtgtttgaa

SEQ ID NO: 1355304 - DNA, 20 bp, Homo sapiens
ttaataatcaagagccttaa

SEQ ID NO: 1355305 - DNA, 22 bp, Homo sapiens
ttaatacaaggtataataaaat

SEQ ID NO: 1355306 - DNA, 23 bp, Homo sapiens
ttaatacaaggtataataaaatt

SEQ ID NO: 1355307 - DNA, 17 bp, Homo sapiens
ttaatagggaatatatc

SEQ ID NO: 1355308 - DNA, 23 bp, Homo sapiens
ttaatagtcatcacatttctatg

SEQ ID NO: 1355309 - DNA, 15 bp, Homo sapiens
ttaatatatgtatta

SEQ ID NO: 1355310 - DNA, 12 bp, Homo sapiens
ttaatatttcct

SEQ ID NO: 1355311 - DNA, 13 bp, Homo sapiens
ttaatcactgtgt

SEQ ID NO: 1355312 - DNA, 15 bp, Homo sapiens
ttaatcactgtgtat

SEQ ID NO: 1355313 - DNA, 20 bp, Homo sapiens
ttaatcactgtgtatatttg

SEQ ID NO: 1355314 - DNA, 15 bp, Homo sapiens
ttaatcattttcatt

SEQ ID NO: 1355315 - DNA, 21 bp, Homo sapiens
ttaatccagttataagaagaa

SEQ ID NO: 1355316 - DNA, 23 bp, Homo sapiens
ttaatcctttgttttctgactaa

SEQ ID NO: 1355317 - DNA, 15 bp, Homo sapiens
ttaatctactgcatt

SEQ ID NO: 1355318 - DNA, 21 bp, Homo sapiens
ttaatctactgcatttaggga

SEQ ID NO: 1355319 - DNA, 18 bp, Homo sapiens
ttaatcttcaaagccttc

SEQ ID NO: 1355320 - DNA, 20 bp, Homo sapiens
ttaatcttcaaagccttctc

SEQ ID NO: 1355321 - DNA, 12 bp, Homo sapiens
ttaatgcacttt

SEQ ID NO: 1355322 - DNA, 15 bp, Homo sapiens
ttaatgcactttcta

SEQ ID NO: 1355323 - DNA, 21 bp, Homo sapiens
ttaatgctatttgaacaagtg

SEQ ID NO: 1355324 - DNA, 16 bp, Homo sapiens
ttaatttcctttttga

SEQ ID NO: 1355325 - DNA, 22 bp, Homo sapiens
ttaatttcctttttgacactga

SEQ ID NO: 1355326 - DNA, 18 bp, Homo sapiens
ttaatttgcatctgaaat

SEQ ID NO: 1355327 - DNA, 12 bp, Homo sapiens
ttaattttcact

SEQ ID NO: 1355328 - DNA, 18 bp, Homo sapiens
ttacaagggaagatttat

SEQ ID NO: 1355329 - DNA, 20 bp, Homo sapiens
ttacaagggaagatttatgt

SEQ ID NO: 1355330 - DNA, 20 bp, Homo sapiens
ttacaagggcataaagtaaa

SEQ ID NO: 1355331 - DNA, 12 bp, Homo sapiens
ttacaatcaaag

SEQ ID NO: 1355332 - DNA, 18 bp, Homo sapiens
ttacaattttatctgttt

SEQ ID NO: 1355333 - DNA, 14 bp, Homo sapiens
ttacacagaaacac

SEQ ID NO: 1355334 - DNA, 20 bp, Homo sapiens
ttacactggcaatggtagtt

SEQ ID NO: 1355335 - DNA, 21 bp, Homo sapiens
ttacactggcaatggtagttt

SEQ ID NO: 1355336 - DNA, 15 bp, Homo sapiens
ttacatgtaatttga

SEQ ID NO: 1355337 - DNA, 20 bp, Homo sapiens
ttacatttgatgcatgtctt

SEQ ID NO: 1355338 - DNA, 18 bp, Homo sapiens
ttacctgtatacagtgca

SEQ ID NO: 1355339 - DNA, 19 bp, Homo sapiens
ttacgaagttcaagatcaa

SEQ ID NO: 1355340 - DNA, 22 bp, Homo sapiens
ttactggggctggggaaggaag

SEQ ID NO: 1355341 - DNA, 19 bp, Homo sapiens
ttactggttgcatggaaat

SEQ ID NO: 1355342 - DNA, 16 bp, Homo sapiens
ttactgtgtaaactca

SEQ ID NO: 1355343 - DNA, 14 bp, Homo sapiens
ttactgtgttttat

SEQ ID NO: 1355344 - DNA, 20 bp, Homo sapiens
ttactgtgttttataaaata

SEQ ID NO: 1355345 - DNA, 18 bp, Homo sapiens
ttacttaggtgtggggga

SEQ ID NO: 1355346 - DNA, 15 bp, Homo sapiens
ttacttccatgaatt

SEQ ID NO: 1355347 - DNA, 13 bp, Homo sapiens
ttacttcttctct

SEQ ID NO: 1355348 - DNA, 18 bp, Homo sapiens
ttacttgctttacctttt

SEQ ID NO: 1355349 - DNA, 18 bp, Homo sapiens
ttactttgtaaattctga

SEQ ID NO: 1355350 - DNA, 23 bp, Homo sapiens
ttactttgtaaattctgatttct

SEQ ID NO: 1355351 - DNA, 14 bp, Homo sapiens
ttagaacaggtttt

SEQ ID NO: 1355352 - DNA, 20 bp, Homo sapiens
ttagaatccctgtgttaatt

SEQ ID NO: 1355353 - DNA, 13 bp, Homo sapiens
ttagaattaaaaa

SEQ ID NO: 1355354 - DNA, 16 bp, Homo sapiens
ttagaattgaaggttt

SEQ ID NO: 1355355 - DNA, 17 bp, Homo sapiens
ttagaattgaaggtttt

SEQ ID NO: 1355356 - DNA, 16 bp, Homo sapiens
ttagacaagagatggg

SEQ ID NO: 1355357 - DNA, 13 bp, Homo sapiens
ttagacagccaaa

SEQ ID NO: 1355358 - DNA, 17 bp, Homo sapiens
ttagaccccatacaagt

SEQ ID NO: 1355359 - DNA, 20 bp, Homo sapiens
ttagacttgaaaagagacag

SEQ ID NO: 1355360 - DNA, 15 bp, Homo sapiens
ttagatcatagtttt

SEQ ID NO: 1355361 - DNA, 17 bp, Homo sapiens
ttagatcatagttttat

SEQ ID NO: 1355362 - DNA, 19 bp, Homo sapiens
ttagatgttgccatgtgtt

SEQ ID NO: 1355363 - DNA, 16 bp, Homo sapiens
ttagatttgccataga

SEQ ID NO: 1355364 - DNA, 23 bp, Homo sapiens
ttagatttgccatagagtacact

SEQ ID NO: 1355365 - DNA, 18 bp, Homo sapiens
ttagcaaattctgttttt

SEQ ID NO: 1355366 - DNA, 17 bp, Homo sapiens
ttagccagatttgtctt

SEQ ID NO: 1355367 - DNA, 17 bp, Homo sapiens
ttagccgcccatgcact

SEQ ID NO: 1355368 - DNA, 13 bp, Homo sapiens
ttagccgggcgtg

SEQ ID NO: 1355369 - DNA, 16 bp, Homo sapiens
ttagctgaagaattga

SEQ ID NO: 1355370 - DNA, 16 bp, Homo sapiens
ttaggccttcctctct

SEQ ID NO: 1355371 - DNA, 15 bp, Homo sapiens
ttagtgttatatgaa

SEQ ID NO: 1355372 - DNA, 18 bp, Homo sapiens
ttagtttttggttgggaa

SEQ ID NO: 1355373 - DNA, 19 bp, Homo sapiens
ttataaaacagagtaatct

SEQ ID NO: 1355374 - DNA, 13 bp, Homo sapiens
ttataaaatataa

SEQ ID NO: 1355375 - DNA, 18 bp, Homo sapiens
ttataaaatataaacaaa

SEQ ID NO: 1355376 - DNA, 18 bp, Homo sapiens
ttataaaatcctgtgcaa

SEQ ID NO: 1355377 - DNA, 17 bp, Homo sapiens
ttataaacagaaatgga

SEQ ID NO: 1355378 - DNA, 19 bp, Homo sapiens
ttataaagtggaagtatgt

SEQ ID NO: 1355379 - DNA, 17 bp, Homo sapiens
ttataaggaaattttac

SEQ ID NO: 1355380 - DNA, 11 bp, Homo sapiens
ttataatagca

SEQ ID NO: 1355381 - DNA, 24 bp, Homo sapiens
ttataatccttaaatcttaatgtt

SEQ ID NO: 1355382 - DNA, 20 bp, Homo sapiens
ttatacatgtgatacatttt

SEQ ID NO: 1355383 - DNA, 16 bp, Homo sapiens
ttatataactgtattt

SEQ ID NO: 1355384 - DNA, 17 bp, Homo sapiens
ttatatagcatctggaa

SEQ ID NO: 1355385 - DNA, 14 bp, Homo sapiens
ttatatcatgcaaa

SEQ ID NO: 1355386 - DNA, 16 bp, Homo sapiens
ttatatcatgcaaaat

SEQ ID NO: 1355387 - DNA, 20 bp, Homo sapiens
ttatatgctttattaatgtt

SEQ ID NO: 1355388 - DNA, 14 bp, Homo sapiens
ttatatgtatgtgt

SEQ ID NO: 1355389 - DNA, 20 bp, Homo sapiens
ttatatgtatgtgtttagaa

SEQ ID NO: 1355390 - DNA, 14 bp, Homo sapiens
ttatatttccttta

SEQ ID NO: 1355391 - DNA, 23 bp, Homo sapiens
ttatcaaaatagtctaaggccat

SEQ ID NO: 1355392 - DNA, 22 bp, Homo sapiens
ttatcaatatctaatatatatg

SEQ ID NO: 1355393 - DNA, 18 bp, Homo sapiens
ttatccagaaaactgtga

SEQ ID NO: 1355394 - DNA, 21 bp, Homo sapiens
ttatctccacaacctcttccc

SEQ ID NO: 1355395 - DNA, 16 bp, Homo sapiens
ttatcttgatacattc

SEQ ID NO: 1355396 - DNA, 21 bp, Homo sapiens
ttatgaaagcaacaaagaaat

SEQ ID NO: 1355397 - DNA, 20 bp, Homo sapiens
ttatgagattggttttcctg

SEQ ID NO: 1355398 - DNA, 15 bp, Homo sapiens
ttatgatgacgtaca

SEQ ID NO: 1355399 - DNA, 20 bp, Homo sapiens
ttatgatggttttaaacttt

SEQ ID NO: 1355400 - DNA, 19 bp, Homo sapiens
ttatgctctcactgtttgt

SEQ ID NO: 1355401 - DNA, 14 bp, Homo sapiens
ttatggttacttct

SEQ ID NO: 1355402 - DNA, 15 bp, Homo sapiens
ttatggttatgtttt

SEQ ID NO: 1355403 - DNA, 11 bp, Homo sapiens
ttatggttttg

SEQ ID NO: 1355404 - DNA, 13 bp, Homo sapiens
ttatgtaaataat

SEQ ID NO: 1355405 - DNA, 13 bp, Homo sapiens
ttatgtgagagaa

SEQ ID NO: 1355406 - DNA, 19 bp, Homo sapiens
ttatgttgtttataataaa

SEQ ID NO: 1355407 - DNA, 22 bp, Homo sapiens
ttattaaatttttttgtatgaa

SEQ ID NO: 1355408 - DNA, 11 bp, Homo sapiens
ttattaatatt

SEQ ID NO: 1355409 - DNA, 13 bp, Homo sapiens
ttattaatcactg

SEQ ID NO: 1355410 - DNA, 16 bp, Homo sapiens
ttattaatcactgtgt

SEQ ID NO: 1355411 - DNA, 13 bp, Homo sapiens
ttattaatgcact

SEQ ID NO: 1355412 - DNA, 13 bp, Homo sapiens
ttattactgttta

SEQ ID NO: 1355413 - DNA, 15 bp, Homo sapiens
ttattacttccatga

SEQ ID NO: 1355414 - DNA, 13 bp, Homo sapiens
ttattcaacagca

SEQ ID NO: 1355415 - DNA, 11 bp, Homo sapiens
ttattgacact

SEQ ID NO: 1355416 - DNA, 15 bp, Homo sapiens
ttattgacactgaac

SEQ ID NO: 1355417 - DNA, 22 bp, Homo sapiens
ttattgactctgggtccttcct

SEQ ID NO: 1355418 - DNA, 18 bp, Homo sapiens
ttattgcagtttatcatt

SEQ ID NO: 1355419 - DNA, 21 bp, Homo sapiens
ttattgcagtttatcattcaa

SEQ ID NO: 1355420 - DNA, 22 bp, Homo sapiens
ttattgcagtttatcattcaag

SEQ ID NO: 1355421 - DNA, 14 bp, Homo sapiens
ttatttaagactaa

SEQ ID NO: 1355422 - DNA, 15 bp, Homo sapiens
ttatttaagactaaa

SEQ ID NO: 1355423 - DNA, 13 bp, Homo sapiens
ttatttacattta

SEQ ID NO: 1355424 - DNA, 16 bp, Homo sapiens
ttatttacatttaata

SEQ ID NO: 1355425 - DNA, 16 bp, Homo sapiens
ttatttagacaagaga

SEQ ID NO: 1355426 - DNA, 13 bp, Homo sapiens
ttatttatatgta

SEQ ID NO: 1355427 - DNA, 14 bp, Homo sapiens
ttatttatatgtac

SEQ ID NO: 1355428 - DNA, 15 bp, Homo sapiens
ttatttatatgtact

SEQ ID NO: 1355429 - DNA, 21 bp, Homo sapiens
ttatttatatgtactgtttta

SEQ ID NO: 1355430 - DNA, 14 bp, Homo sapiens
ttatttatatgtat

SEQ ID NO: 1355431 - DNA, 23 bp, Homo sapiens
ttatttatccagaaaactgtgat

SEQ ID NO: 1355432 - DNA, 14 bp, Homo sapiens
ttatttcacttgat

SEQ ID NO: 1355433 - DNA, 17 bp, Homo sapiens
ttatttcctttgtcctt

SEQ ID NO: 1355434 - DNA, 14 bp, Homo sapiens
ttatttgcatgtta

SEQ ID NO: 1355435 - DNA, 15 bp, Homo sapiens
ttatttgcatgttat

SEQ ID NO: 1355436 - DNA, 16 bp, Homo sapiens
ttatttgcatgttatg

SEQ ID NO: 1355437 - DNA, 13 bp, Homo sapiens
ttatttgtaaatt

SEQ ID NO: 1355438 - DNA, 16 bp, Homo sapiens
ttattttacacagaaa

SEQ ID NO: 1355439 - DNA, 19 bp, Homo sapiens
ttattttacacagaaacac

SEQ ID NO: 1355440 - DNA, 12 bp, Homo sapiens
ttattttctaca

SEQ ID NO: 1355441 - DNA, 14 bp, Homo sapiens
ttatttttataatt

SEQ ID NO: 1355442 - DNA, 18 bp, Homo sapiens
ttatttttataattgtac

SEQ ID NO: 1355443 - DNA, 16 bp, Homo sapiens
ttcaaagttttgttgt

SEQ ID NO: 1355444 - DNA, 19 bp, Homo sapiens
ttcaacagcaagtgtgaat

SEQ ID NO: 1355445 - DNA, 19 bp, Homo sapiens
ttcaactgtcttcctcaaa

SEQ ID NO: 1355446 - DNA, 18 bp, Homo sapiens
ttcaagcagtcgtgcctg

SEQ ID NO: 1355447 - DNA, 24 bp, Homo sapiens
ttcaaggggagccaaaatctcaag

SEQ ID NO: 1355448 - DNA, 16 bp, Homo sapiens
ttcaagtaattgtgaa

SEQ ID NO: 1355449 - DNA, 14 bp, Homo sapiens
ttcaattgtcactt

SEQ ID NO: 1355450 - DNA, 21 bp, Homo sapiens
ttcacattgttaagaaaaata

SEQ ID NO: 1355451 - DNA, 17 bp, Homo sapiens
ttcaccatcaatcctga

SEQ ID NO: 1355452 - DNA, 18 bp, Homo sapiens
ttcacggaagagccttgc

SEQ ID NO: 1355453 - DNA, 22 bp, Homo sapiens
ttcactggcccctactttgtgg

SEQ ID NO: 1355454 - DNA, 16 bp, Homo sapiens
ttcagaaaaagaaatg

SEQ ID NO: 1355455 - DNA, 17 bp, Homo sapiens
ttcagaagtcacacatt

SEQ ID NO: 1355456 - DNA, 22 bp, Homo sapiens
ttcagaagtcacacattacaaa

SEQ ID NO: 1355457 - DNA, 20 bp, Homo sapiens
ttcagaagttagtttgtata

SEQ ID NO: 1355458 - DNA, 22 bp, Homo sapiens
ttcagaggataaatatcaatgg

SEQ ID NO: 1355459 - DNA, 13 bp, Homo sapiens
ttcagatgtatgt

SEQ ID NO: 1355460 - DNA, 19 bp, Homo sapiens
ttcagcagcaaattttcag

SEQ ID NO: 1355461 - DNA, 24 bp, Homo sapiens
ttcagctctgcaagaattgaagca

SEQ ID NO: 1355462 - DNA, 21 bp, Homo sapiens
ttcagctggttgaggtttcaa

SEQ ID NO: 1355463 - DNA, 17 bp, Homo sapiens
ttcagtcacatggcatg

SEQ ID NO: 1355464 - DNA, 19 bp, Homo sapiens
ttcagttgcttgtcttctg

SEQ ID NO: 1355465 - DNA, 22 bp, Homo sapiens
ttcagttggttcgttctgtact

SEQ ID NO: 1355466 - DNA, 15 bp, Homo sapiens
ttcataaacaagttc

SEQ ID NO: 1355467 - DNA, 13 bp, Homo sapiens
ttcatatgtaatc

SEQ ID NO: 1355468 - DNA, 14 bp, Homo sapiens
ttcatcccattcca

SEQ ID NO: 1355469 - DNA, 15 bp, Homo sapiens
ttcatcccattccag

SEQ ID NO: 1355470 - DNA, 22 bp, Homo sapiens
ttcatggctgctgttgcttaaa

SEQ ID NO: 1355471 - DNA, 16 bp, Homo sapiens
ttcatgtaaagtgtca

SEQ ID NO: 1355472 - DNA, 14 bp, Homo sapiens
ttcattctctttta

SEQ ID NO: 1355473 - DNA, 16 bp, Homo sapiens
ttccaaataaataatt

SEQ ID NO: 1355474 - DNA, 23 bp, Homo sapiens
ttccaattatttataataaatca

SEQ ID NO: 1355475 - DNA, 18 bp, Homo sapiens
ttccactaaaaatattgt

SEQ ID NO: 1355476 - DNA, 22 bp, Homo sapiens
ttccactacacctggctgaggt

SEQ ID NO: 1355477 - DNA, 16 bp, Homo sapiens
ttccactccattgtcg

SEQ ID NO: 1355478 - DNA, 18 bp, Homo sapiens
ttccagatcactgccaca

SEQ ID NO: 1355479 - DNA, 14 bp, Homo sapiens
ttccagcccctctg

SEQ ID NO: 1355480 - DNA, 23 bp, Homo sapiens
ttccaggaaactccacatctgcc

SEQ ID NO: 1355481 - DNA, 20 bp, Homo sapiens
ttccaggctatgtataaaat

SEQ ID NO: 1355482 - DNA, 20 bp, Homo sapiens
ttccagggtccctctgtgta

SEQ ID NO: 1355483 - DNA, 18 bp, Homo sapiens
ttccaggtttaagctgtt

SEQ ID NO: 1355484 - DNA, 22 bp, Homo sapiens
ttccagtgtctataaaagaaac

SEQ ID NO: 1355485 - DNA, 13 bp, Homo sapiens
ttccattgcttat

SEQ ID NO: 1355486 - DNA, 11 bp, Homo sapiens
ttcccaccctg

SEQ ID NO: 1355487 - DNA, 14 bp, Homo sapiens
ttcccatggggagg

SEQ ID NO: 1355488 - DNA, 18 bp, Homo sapiens
ttcccccaccggtccagc

SEQ ID NO: 1355489 - DNA, 19 bp, Homo sapiens
ttccctcaccccctcccac

SEQ ID NO: 1355490 - DNA, 22 bp, Homo sapiens
ttccctcaccccctcccacccc

SEQ ID NO: 1355491 - DNA, 13 bp, Homo sapiens
ttccctgcttcca

SEQ ID NO: 1355492 - DNA, 22 bp, Homo sapiens
ttcccttgaaactttgggaaaa

SEQ ID NO: 1355493 - DNA, 16 bp, Homo sapiens
ttccgtgcgtggcact

SEQ ID NO: 1355494 - DNA, 23 bp, Homo sapiens
ttcctacgtaggatgaaaagatt

SEQ ID NO: 1355495 - DNA, 21 bp, Homo sapiens
ttcctcaaaataaagaagtat

SEQ ID NO: 1355496 - DNA, 18 bp, Homo sapiens
ttcctcaaagcttggatt

SEQ ID NO: 1355497 - DNA, 22 bp, Homo sapiens
ttcctcaaattttttgactttt

SEQ ID NO: 1355498 - DNA, 13 bp, Homo sapiens
ttcctcattagca

SEQ ID NO: 1355499 - DNA, 17 bp, Homo sapiens
ttcctccatttgagaaa

SEQ ID NO: 1355500 - DNA, 17 bp, Homo sapiens
ttcctctagaagccaag

SEQ ID NO: 1355501 - DNA, 13 bp, Homo sapiens
ttcctctgcctgc

SEQ ID NO: 1355502 - DNA, 14 bp, Homo sapiens
ttcctctgcctgcc

SEQ ID NO: 1355503 - DNA, 15 bp, Homo sapiens
ttcctctgcctgccc

SEQ ID NO: 1355504 - DNA, 14 bp, Homo sapiens
ttcctctgctcacc

SEQ ID NO: 1355505 - DNA, 15 bp, Homo sapiens
ttcctcttgtctgat

SEQ ID NO: 1355506 - DNA, 15 bp, Homo sapiens
ttcctgcgtcctcct

SEQ ID NO: 1355507 - DNA, 17 bp, Homo sapiens
ttcctggaattgccagc

SEQ ID NO: 1355508 - DNA, 18 bp, Homo sapiens
ttcctggaattgccagct

SEQ ID NO: 1355509 - DNA, 16 bp, Homo sapiens
ttcctgtactgtgtct

SEQ ID NO: 1355510 - DNA, 21 bp, Homo sapiens
ttccttgagttgattcagctc

SEQ ID NO: 1355511 - DNA, 23 bp, Homo sapiens
ttccttggtcctagtaagaagac

SEQ ID NO: 1355512 - DNA, 14 bp, Homo sapiens
ttcctttatgtgaa

SEQ ID NO: 1355513 - DNA, 19 bp, Homo sapiens
ttcctttatgtgaattttt

SEQ ID NO: 1355514 - DNA, 14 bp, Homo sapiens
ttccttttccctgc

SEQ ID NO: 1355515 - DNA, 16 bp, Homo sapiens
ttccttttccctgctt

SEQ ID NO: 1355516 - DNA, 14 bp, Homo sapiens
ttcgaagtcattaa

SEQ ID NO: 1355517 - DNA, 15 bp, Homo sapiens
ttcgaagtcattaaa

SEQ ID NO: 1355518 - DNA, 18 bp, Homo sapiens
ttcgaagtcattaaactg

SEQ ID NO: 1355519 - DNA, 16 bp, Homo sapiens
ttcgcctttcctctct

SEQ ID NO: 1355520 - DNA, 20 bp, Homo sapiens
ttcggaaggggttcctcaaa

SEQ ID NO: 1355521 - DNA, 17 bp, Homo sapiens
ttcgttctgtactgtta

SEQ ID NO: 1355522 - DNA, 18 bp, Homo sapiens
ttctaaaatcatgaaact

SEQ ID NO: 1355523 - DNA, 23 bp, Homo sapiens
ttctaaatacatgccacatcaaa

SEQ ID NO: 1355524 - DNA, 13 bp, Homo sapiens
ttctaagagaagt

SEQ ID NO: 1355525 - DNA, 18 bp, Homo sapiens
ttctaagagaagttattt

SEQ ID NO: 1355526 - DNA, 17 bp, Homo sapiens
ttctaataagctagttg

SEQ ID NO: 1355527 - DNA, 19 bp, Homo sapiens
ttctaataagctagttgaa

SEQ ID NO: 1355528 - DNA, 20 bp, Homo sapiens
ttctaataagctagttgaat

SEQ ID NO: 1355529 - DNA, 13 bp, Homo sapiens
ttctacgccaggg

SEQ ID NO: 1355530 - DNA, 13 bp, Homo sapiens
ttctacgtttctt

SEQ ID NO: 1355531 - DNA, 14 bp, Homo sapiens
ttctacgtttcttt

SEQ ID NO: 1355532 - DNA, 17 bp, Homo sapiens
ttctactgtcaaatgat

SEQ ID NO: 1355533 - DNA, 19 bp, Homo sapiens
ttctactgtcaaatgatgt

SEQ ID NO: 1355534 - DNA, 13 bp, Homo sapiens
ttctaggcctggg

SEQ ID NO: 1355535 - DNA, 23 bp, Homo sapiens
ttctagtgatgatggttcacgtt

SEQ ID NO: 1355536 - DNA, 22 bp, Homo sapiens
ttctatagcatcacttaaaaca

SEQ ID NO: 1355537 - DNA, 20 bp, Homo sapiens
ttctataggaacatatgaaa

SEQ ID NO: 1355538 - DNA, 19 bp, Homo sapiens
ttctattatggaaaactgt

SEQ ID NO: 1355539 - DNA, 13 bp, Homo sapiens
ttctcaatgaaaa

SEQ ID NO: 1355540 - DNA, 21 bp, Homo sapiens
ttctcagaagcacagaatatt

SEQ ID NO: 1355541 - DNA, 20 bp, Homo sapiens
ttctcattgacttttataaa

SEQ ID NO: 1355542 - DNA, 21 bp, Homo sapiens
ttctccacctcccacaaagga

SEQ ID NO: 1355543 - DNA, 14 bp, Homo sapiens
ttctccgccagcct

SEQ ID NO: 1355544 - DNA, 18 bp, Homo sapiens
ttctccgccagcctcctc

SEQ ID NO: 1355545 - DNA, 17 bp, Homo sapiens
ttctccgttagctcctg

SEQ ID NO: 1355546 - DNA, 19 bp, Homo sapiens
ttctcctcccttccttttc

SEQ ID NO: 1355547 - DNA, 20 bp, Homo sapiens
ttctcctcccttccttttcc

SEQ ID NO: 1355548 - DNA, 10 bp, Homo sapiens
ttctcctgga

SEQ ID NO: 1355549 - DNA, 17 bp, Homo sapiens
ttctcgtgcctccccac

SEQ ID NO: 1355550 - DNA, 17 bp, Homo sapiens
ttctctcctccccaaat

SEQ ID NO: 1355551 - DNA, 16 bp, Homo sapiens
ttctctgacttctgcc

SEQ ID NO: 1355552 - DNA, 18 bp, Homo sapiens
ttctctgtacttttcatt

SEQ ID NO: 1355553 - DNA, 21 bp, Homo sapiens
ttctctgtacttttcattctc

SEQ ID NO: 1355554 - DNA, 14 bp, Homo sapiens
ttctcttgagctgg

SEQ ID NO: 1355555 - DNA, 20 bp, Homo sapiens
ttctcttgagctggcctctc

SEQ ID NO: 1355556 - DNA, 22 bp, Homo sapiens
ttctctttgattatttgcatgt

SEQ ID NO: 1355557 - DNA, 14 bp, Homo sapiens
ttctgagaaaacaa

SEQ ID NO: 1355558 - DNA, 15 bp, Homo sapiens
ttctgagctgccagt

SEQ ID NO: 1355559 - DNA, 20 bp, Homo sapiens
ttctgagcttacgtagttct

SEQ ID NO: 1355560 - DNA, 20 bp, Homo sapiens
ttctgatttcttttcaccat

SEQ ID NO: 1355561 - DNA, 17 bp, Homo sapiens
ttctgcaacaagcatgc

SEQ ID NO: 1355562 - DNA, 18 bp, Homo sapiens
ttctgccctggctgctgc

SEQ ID NO: 1355563 - DNA, 20 bp, Homo sapiens
ttctgccctggctgctgccc

SEQ ID NO: 1355564 - DNA, 15 bp, Homo sapiens
ttctgccgccccctc

SEQ ID NO: 1355565 - DNA, 13 bp, Homo sapiens
ttctgctttagac

SEQ ID NO: 1355566 - DNA, 13 bp, Homo sapiens
ttctgcttttctg

SEQ ID NO: 1355567 - DNA, 19 bp, Homo sapiens
ttctgcttttctgccctgg

SEQ ID NO: 1355568 - DNA, 14 bp, Homo sapiens
ttctggggaaagac

SEQ ID NO: 1355569 - DNA, 22 bp, Homo sapiens
ttctggggaaagacactgcctg

SEQ ID NO: 1355570 - DNA, 21 bp, Homo sapiens
ttctggggcaggctgggccat

SEQ ID NO: 1355571 - DNA, 23 bp, Homo sapiens
ttctggggggacccagtgcagaa

SEQ ID NO: 1355572 - DNA, 22 bp, Homo sapiens
ttctggtcaagggctgtcattg

SEQ ID NO: 1355573 - DNA, 14 bp, Homo sapiens
ttctgtatttgaaa

SEQ ID NO: 1355574 - DNA, 15 bp, Homo sapiens
ttctgtatttgaaag

SEQ ID NO: 1355575 - DNA, 20 bp, Homo sapiens
ttctgtgcccagaatactga

SEQ ID NO: 1355576 - DNA, 13 bp, Homo sapiens
ttctgtgccctcc

SEQ ID NO: 1355577 - DNA, 16 bp, Homo sapiens
ttctgtggttcctctg

SEQ ID NO: 1355578 - DNA, 20 bp, Homo sapiens
ttctgtggttcctctgctca

SEQ ID NO: 1355579 - DNA, 16 bp, Homo sapiens
ttctgtgtgtcagttt

SEQ ID NO: 1355580 - DNA, 12 bp, Homo sapiens
ttctgtgtttat

SEQ ID NO: 1355581 - DNA, 19 bp, Homo sapiens
ttctgtttaattttcactt

SEQ ID NO: 1355582 - DNA, 13 bp, Homo sapiens
ttctgtttttaat

SEQ ID NO: 1355583 - DNA, 20 bp, Homo sapiens
ttcttaaccctttccagagt

SEQ ID NO: 1355584 - DNA, 22 bp, Homo sapiens
ttcttaagtatgttattttctg

SEQ ID NO: 1355585 - DNA, 19 bp, Homo sapiens
ttcttaattcatgaggagg

SEQ ID NO: 1355586 - DNA, 22 bp, Homo sapiens
ttcttctctgtgagaaggttta

SEQ ID NO: 1355587 - DNA, 13 bp, Homo sapiens
ttcttctgtattt

SEQ ID NO: 1355588 - DNA, 21 bp, Homo sapiens
ttcttctgtgtttataaaata

SEQ ID NO: 1355589 - DNA, 16 bp, Homo sapiens
ttcttgcctctgtgct

SEQ ID NO: 1355590 - DNA, 13 bp, Homo sapiens
ttctttaaaagaa

SEQ ID NO: 1355591 - DNA, 18 bp, Homo sapiens
ttctttaaaagaatgact

SEQ ID NO: 1355592 - DNA, 14 bp, Homo sapiens
ttctttaaacactc

SEQ ID NO: 1355593 - DNA, 16 bp, Homo sapiens
ttctttaaccttgtat

SEQ ID NO: 1355594 - DNA, 22 bp, Homo sapiens
ttcttttggtaaagactggctt

SEQ ID NO: 1355595 - DNA, 23 bp, Homo sapiens
ttcttttggtaaagactggcttt

SEQ ID NO: 1355596 - DNA, 15 bp, Homo sapiens
ttcttttttattaat

SEQ ID NO: 1355597 - DNA, 17 bp, Homo sapiens
ttctttttttttaagtt

SEQ ID NO: 1355598 - DNA, 20 bp, Homo sapiens
ttgaaaaatataaaattatg

SEQ ID NO: 1355599 - DNA, 16 bp, Homo sapiens
ttgaaaacttcagaag

SEQ ID NO: 1355600 - DNA, 15 bp, Homo sapiens
ttgaaaagcagacat

SEQ ID NO: 1355601 - DNA, 17 bp, Homo sapiens
ttgaaaagcagacattt

SEQ ID NO: 1355602 - DNA, 22 bp, Homo sapiens
ttgaaaagtaatatttattaaa

SEQ ID NO: 1355603 - DNA, 20 bp, Homo sapiens
ttgaaactttgggaaaacat

SEQ ID NO: 1355604 - DNA, 16 bp, Homo sapiens
ttgaaataactggaac

SEQ ID NO: 1355605 - DNA, 21 bp, Homo sapiens
ttgaaataactggaacaaatt

SEQ ID NO: 1355606 - DNA, 21 bp, Homo sapiens
ttgaactcttctcattacttg

SEQ ID NO: 1355607 - DNA, 14 bp, Homo sapiens
ttgaacttttgtac

SEQ ID NO: 1355608 - DNA, 23 bp, Homo sapiens
ttgaacttttgtactgaattttt

SEQ ID NO: 1355609 - DNA, 11 bp, Homo sapiens
ttgaagcatag

SEQ ID NO: 1355610 - DNA, 19 bp, Homo sapiens
ttgaagcatagataatatt

SEQ ID NO: 1355611 - DNA, 16 bp, Homo sapiens
ttgaagccatctaaag

SEQ ID NO: 1355612 - DNA, 12 bp, Homo sapiens
ttgaagtaatga

SEQ ID NO: 1355613 - DNA, 18 bp, Homo sapiens
ttgaagtctttaataaat

SEQ ID NO: 1355614 - DNA, 22 bp, Homo sapiens
ttgaataaacaccactggatta

SEQ ID NO: 1355615 - DNA, 23 bp, Homo sapiens
ttgaataaacaccactggattaa

SEQ ID NO: 1355616 - DNA, 14 bp, Homo sapiens
ttgaataaatgtgt

SEQ ID NO: 1355617 - DNA, 12 bp, Homo sapiens
ttgaatacttga

SEQ ID NO: 1355618 - DNA, 16 bp, Homo sapiens
ttgaatacttgaacca

SEQ ID NO: 1355619 - DNA, 13 bp, Homo sapiens
ttgaatatatgat

SEQ ID NO: 1355620 - DNA, 14 bp, Homo sapiens
ttgaatatgattaa

SEQ ID NO: 1355621 - DNA, 16 bp, Homo sapiens
ttgaattttaaatcta

SEQ ID NO: 1355622 - DNA, 11 bp, Homo sapiens
ttgacactgaa

SEQ ID NO: 1355623 - DNA, 19 bp, Homo sapiens
ttgacctgaggctgtggtc

SEQ ID NO: 1355624 - DNA, 15 bp, Homo sapiens
ttgactaattttaca

SEQ ID NO: 1355625 - DNA, 15 bp, Homo sapiens
ttgactcatcttata

SEQ ID NO: 1355626 - DNA, 18 bp, Homo sapiens
ttgactctgggtccttcc

SEQ ID NO: 1355627 - DNA, 21 bp, Homo sapiens
ttgactctgggtccttcctga

SEQ ID NO: 1355628 - DNA, 18 bp, Homo sapiens
ttgacttttataaagcat

SEQ ID NO: 1355629 - DNA, 21 bp, Homo sapiens
ttgagaccgtgaagatacttt

SEQ ID NO: 1355630 - DNA, 13 bp, Homo sapiens
ttgagccctggct

SEQ ID NO: 1355631 - DNA, 15 bp, Homo sapiens
ttgagctatgactta

SEQ ID NO: 1355632 - DNA, 12 bp, Homo sapiens
ttgagctgcctt

SEQ ID NO: 1355633 - DNA, 13 bp, Homo sapiens
ttgagctgccttc

SEQ ID NO: 1355634 - DNA, 19 bp, Homo sapiens
ttgagctgccttccctagc

SEQ ID NO: 1355635 - DNA, 11 bp, Homo sapiens
ttgagctggcc

SEQ ID NO: 1355636 - DNA, 13 bp, Homo sapiens
ttgagctggcctc

SEQ ID NO: 1355637 - DNA, 14 bp, Homo sapiens
ttgaggattagttt

SEQ ID NO: 1355638 - DNA, 19 bp, Homo sapiens
ttgaggattagtttagaac

SEQ ID NO: 1355639 - DNA, 13 bp, Homo sapiens
ttgagggctgcag

SEQ ID NO: 1355640 - DNA, 20 bp, Homo sapiens
ttgagtattgtttaaaatgt

SEQ ID NO: 1355641 - DNA, 15 bp, Homo sapiens
ttgagtgtatgagta

SEQ ID NO: 1355642 - DNA, 17 bp, Homo sapiens
ttgagttgtttttgtat

SEQ ID NO: 1355643 - DNA, 15 bp, Homo sapiens
ttgataaatccatca

SEQ ID NO: 1355644 - DNA, 16 bp, Homo sapiens
ttgatcatgtactttt

SEQ ID NO: 1355645 - DNA, 21 bp, Homo sapiens
ttgatggagtgtgagccacct

SEQ ID NO: 1355646 - DNA, 13 bp, Homo sapiens
ttgatgtggccct

SEQ ID NO: 1355647 - DNA, 18 bp, Homo sapiens
ttgatgtggccctggctg

SEQ ID NO: 1355648 - DNA, 19 bp, Homo sapiens
ttgatgtggccctggctgc

SEQ ID NO: 1355649 - DNA, 12 bp, Homo sapiens
ttgatgtgttgt

SEQ ID NO: 1355650 - DNA, 14 bp, Homo sapiens
ttgatgtgttgttc

SEQ ID NO: 1355651 - DNA, 16 bp, Homo sapiens
ttgattattagccagg

SEQ ID NO: 1355652 - DNA, 12 bp, Homo sapiens
ttgattatttgc

SEQ ID NO: 1355653 - DNA, 20 bp, Homo sapiens
ttgattatttgcatgttatg

SEQ ID NO: 1355654 - DNA, 13 bp, Homo sapiens
ttgatttattaac

SEQ ID NO: 1355655 - DNA, 14 bp, Homo sapiens
ttgatttattaact

SEQ ID NO: 1355656 - DNA, 14 bp, Homo sapiens
ttgatttcaaagtt

SEQ ID NO: 1355657 - DNA, 11 bp, Homo sapiens
ttgatttcctc

SEQ ID NO: 1355658 - DNA, 18 bp, Homo sapiens
ttgatttgattgggatga

SEQ ID NO: 1355659 - DNA, 19 bp, Homo sapiens
ttgatttttttttttaatc

SEQ ID NO: 1355660 - DNA, 16 bp, Homo sapiens
ttgcaaaatacatgaa

SEQ ID NO: 1355661 - DNA, 16 bp, Homo sapiens
ttgcaagatgtgaatt

SEQ ID NO: 1355662 - DNA, 19 bp, Homo sapiens
ttgcaagatgtgaattatt

SEQ ID NO: 1355663 - DNA, 14 bp, Homo sapiens
ttgcaccactgcac

SEQ ID NO: 1355664 - DNA, 16 bp, Homo sapiens
ttgcactgtttaatca

SEQ ID NO: 1355665 - DNA, 20 bp, Homo sapiens
ttgcacttgtgattatttat

SEQ ID NO: 1355666 - DNA, 18 bp, Homo sapiens
ttgcagctcagaaccaca

SEQ ID NO: 1355667 - DNA, 13 bp, Homo sapiens
ttgcagtttatca

SEQ ID NO: 1355668 - DNA, 18 bp, Homo sapiens
ttgcagtttatcattcaa

SEQ ID NO: 1355669 - DNA, 21 bp, Homo sapiens
ttgcatactttgtattttgat

SEQ ID NO: 1355670 - DNA, 16 bp, Homo sapiens
ttgcatgttatgttta

SEQ ID NO: 1355671 - DNA, 18 bp, Homo sapiens
ttgccacagtagaactgt

SEQ ID NO: 1355672 - DNA, 18 bp, Homo sapiens
ttgccagctgacatcttg

SEQ ID NO: 1355673 - DNA, 15 bp, Homo sapiens
ttgccaggacatgca

SEQ ID NO: 1355674 - DNA, 16 bp, Homo sapiens
ttgccaggacatgcaa

SEQ ID NO: 1355675 - DNA, 17 bp, Homo sapiens
ttgccaggacatgcaat

SEQ ID NO: 1355676 - DNA, 23 bp, Homo sapiens
ttgccatagagtacactgcctgc

SEQ ID NO: 1355677 - DNA, 14 bp, Homo sapiens
ttgcctagacagct

SEQ ID NO: 1355678 - DNA, 17 bp, Homo sapiens
ttgcctccccatttccc

SEQ ID NO: 1355679 - DNA, 15 bp, Homo sapiens
ttgcctgcagggcca

SEQ ID NO: 1355680 - DNA, 16 bp, Homo sapiens
ttgccttgctgtttgt

SEQ ID NO: 1355681 - DNA, 19 bp, Homo sapiens
ttgccttttgcaaccagga

SEQ ID NO: 1355682 - DNA, 19 bp, Homo sapiens
ttgctactgttgtaagaat

SEQ ID NO: 1355683 - DNA, 18 bp, Homo sapiens
ttgctatcaacaataaaa

SEQ ID NO: 1355684 - DNA, 16 bp, Homo sapiens
ttgctatttttgtaaa

SEQ ID NO: 1355685 - DNA, 18 bp, Homo sapiens
ttgctcaaaaaatgagct

SEQ ID NO: 1355686 - DNA, 19 bp, Homo sapiens
ttgctctatgctttccaaa

SEQ ID NO: 1355687 - DNA, 19 bp, Homo sapiens
ttgctgaatacagaggcaa

SEQ ID NO: 1355688 - DNA, 22 bp, Homo sapiens
ttgctgagcctctgctccccag

SEQ ID NO: 1355689 - DNA, 12 bp, Homo sapiens
ttgctgctcttc

SEQ ID NO: 1355690 - DNA, 17 bp, Homo sapiens
ttgctggccccagccct

SEQ ID NO: 1355691 - DNA, 23 bp, Homo sapiens
ttgctggtaaaatgaagaattta

SEQ ID NO: 1355692 - DNA, 14 bp, Homo sapiens
ttgcttaaatttct

SEQ ID NO: 1355693 - DNA, 23 bp, Homo sapiens
ttgcttaaatttcttatgtgaca

SEQ ID NO: 1355694 - DNA, 16 bp, Homo sapiens
ttgctttaccttttca

SEQ ID NO: 1355695 - DNA, 20 bp, Homo sapiens
ttgctttgtattgtatatta

SEQ ID NO: 1355696 - DNA, 18 bp, Homo sapiens
ttggaaattcctgtactg

SEQ ID NO: 1355697 - DNA, 22 bp, Homo sapiens
ttggaagcacaccaatcttact

SEQ ID NO: 1355698 - DNA, 18 bp, Homo sapiens
ttggagaaatgaaaacag

SEQ ID NO: 1355699 - DNA, 15 bp, Homo sapiens
ttggagtcactgcca

SEQ ID NO: 1355700 - DNA, 16 bp, Homo sapiens
ttggatgttgagaggt

SEQ ID NO: 1355701 - DNA, 15 bp, Homo sapiens
ttggattaaatacat

SEQ ID NO: 1355702 - DNA, 23 bp, Homo sapiens
ttggattaaatacatatggatgt

SEQ ID NO: 1355703 - DNA, 13 bp, Homo sapiens
ttggcattccgca

SEQ ID NO: 1355704 - DNA, 13 bp, Homo sapiens
ttggccctattta

SEQ ID NO: 1355705 - DNA, 14 bp, Homo sapiens
ttggcctgctgtga

SEQ ID NO: 1355706 - DNA, 12 bp, Homo sapiens
ttggcctgggcc

SEQ ID NO: 1355707 - DNA, 13 bp, Homo sapiens
ttggcgtgacccg

SEQ ID NO: 1355708 - DNA, 20 bp, Homo sapiens
ttggctcgaatctctgtgcc

SEQ ID NO: 1355709 - DNA, 19 bp, Homo sapiens
ttggctgaaattctcctgg

SEQ ID NO: 1355710 - DNA, 16 bp, Homo sapiens
ttggcttaatcatttt

SEQ ID NO: 1355711 - DNA, 22 bp, Homo sapiens
ttggcttctgtgatgagctgat

SEQ ID NO: 1355712 - DNA, 13 bp, Homo sapiens
ttgggagttttta

SEQ ID NO: 1355713 - DNA, 22 bp, Homo sapiens
ttgggcagagctggctctgagc

SEQ ID NO: 1355714 - DNA, 23 bp, Homo sapiens
ttggggccaccaaagctgcccac

SEQ ID NO: 1355715 - DNA, 15 bp, Homo sapiens
ttggggcccagtgca

SEQ ID NO: 1355716 - DNA, 22 bp, Homo sapiens
ttgggggaggggagactttgat

SEQ ID NO: 1355717 - DNA, 22 bp, Homo sapiens
ttggggggctgaggtgggagga

SEQ ID NO: 1355718 - DNA, 20 bp, Homo sapiens
ttgggggggtggccgctgag

SEQ ID NO: 1355719 - DNA, 20 bp, Homo sapiens
ttgggtgtctccttaagctg

SEQ ID NO: 1355720 - DNA, 19 bp, Homo sapiens
ttggtaaaactcactgtga

SEQ ID NO: 1355721 - DNA, 20 bp, Homo sapiens
ttggtaaaactcactgtgat

SEQ ID NO: 1355722 - DNA, 16 bp, Homo sapiens
ttggtaaagactggct

SEQ ID NO: 1355723 - DNA, 12 bp, Homo sapiens
ttggtatatttt

SEQ ID NO: 1355724 - DNA, 17 bp, Homo sapiens
ttggtcctgtccccgca

SEQ ID NO: 1355725 - DNA, 12 bp, Homo sapiens
ttggtggttttt

SEQ ID NO: 1355726 - DNA, 15 bp, Homo sapiens
ttggtgtaatttgaa

SEQ ID NO: 1355727 - DNA, 17 bp, Homo sapiens
ttggttttcctgtggca

SEQ ID NO: 1355728 - DNA, 12 bp, Homo sapiens
ttgtaaattctg

SEQ ID NO: 1355729 - DNA, 22 bp, Homo sapiens
ttgtaagcgtatggctttattt

SEQ ID NO: 1355730 - DNA, 21 bp, Homo sapiens
ttgtactgaatttttttgtaa

SEQ ID NO: 1355731 - DNA, 23 bp, Homo sapiens
ttgtacttaaatggtaataagca

SEQ ID NO: 1355732 - DNA, 14 bp, Homo sapiens
ttgtagatttgatt

SEQ ID NO: 1355733 - DNA, 16 bp, Homo sapiens
ttgtatagttatgtaa

SEQ ID NO: 1355734 - DNA, 21 bp, Homo sapiens
ttgtatagttatgtaaataat

SEQ ID NO: 1355735 - DNA, 19 bp, Homo sapiens
ttgtatatattattataat

SEQ ID NO: 1355736 - DNA, 21 bp, Homo sapiens
ttgtatatattattataatct

SEQ ID NO: 1355737 - DNA, 13 bp, Homo sapiens
ttgtatattacaa

SEQ ID NO: 1355738 - DNA, 13 bp, Homo sapiens
ttgtatattggtt

SEQ ID NO: 1355739 - DNA, 16 bp, Homo sapiens
ttgtatattggtttta

SEQ ID NO: 1355740 - DNA, 12 bp, Homo sapiens
ttgtatgaaaac

SEQ ID NO: 1355741 - DNA, 16 bp, Homo sapiens
ttgtatttatgtgtat

SEQ ID NO: 1355742 - DNA, 9 bp, Homo sapiens
ttgtatttt

SEQ ID NO: 1355743 - DNA, 17 bp, Homo sapiens
ttgtcctattagtgtta

SEQ ID NO: 1355744 - DNA, 20 bp, Homo sapiens
ttgtcctattagtgttatat

SEQ ID NO: 1355745 - DNA, 21 bp, Homo sapiens
ttgtctggcaaggactttgta

SEQ ID NO: 1355746 - DNA, 15 bp, Homo sapiens
ttgtcttaaaaagtg

SEQ ID NO: 1355747 - DNA, 21 bp, Homo sapiens
ttgtgagaaacatctcaataa

SEQ ID NO: 1355748 - DNA, 23 bp, Homo sapiens
ttgtgatttctttaaaagaatga

SEQ ID NO: 1355749 - DNA, 12 bp, Homo sapiens
ttgtgcactgtt

SEQ ID NO: 1355750 - DNA, 21 bp, Homo sapiens
ttgtgccagaggaatcctggc

SEQ ID NO: 1355751 - DNA, 13 bp, Homo sapiens
ttgtgccatctgt

SEQ ID NO: 1355752 - DNA, 21 bp, Homo sapiens
ttgtgcttcacagtagagcca

SEQ ID NO: 1355753 - DNA, 23 bp, Homo sapiens
ttgtgtaatgaaaatgaatatct

SEQ ID NO: 1355754 - DNA, 15 bp, Homo sapiens
ttgtgtgtcatgcca

SEQ ID NO: 1355755 - DNA, 13 bp, Homo sapiens
ttgtgtgttgtct

SEQ ID NO: 1355756 - DNA, 18 bp, Homo sapiens
ttgttaatacaaggtata

SEQ ID NO: 1355757 - DNA, 14 bp, Homo sapiens
ttgttacttctgag

SEQ ID NO: 1355758 - DNA, 16 bp, Homo sapiens
ttgttatcaaaatagt

SEQ ID NO: 1355759 - DNA, 15 bp, Homo sapiens
ttgttattaaacaaa

SEQ ID NO: 1355760 - DNA, 16 bp, Homo sapiens
ttgttcatcatccaga

SEQ ID NO: 1355761 - DNA, 17 bp, Homo sapiens
ttgttcatcatccagat

SEQ ID NO: 1355762 - DNA, 18 bp, Homo sapiens
ttgttcttattctggcat

SEQ ID NO: 1355763 - DNA, 16 bp, Homo sapiens
ttgttgcaagatgtga

SEQ ID NO: 1355764 - DNA, 17 bp, Homo sapiens
ttgttgcaagatgtgaa

SEQ ID NO: 1355765 - DNA, 12 bp, Homo sapiens
ttgttgtactta

SEQ ID NO: 1355766 - DNA, 21 bp, Homo sapiens
ttgtttaaaatgtaatttaaa

SEQ ID NO: 1355767 - DNA, 15 bp, Homo sapiens
ttgtttataataaaa

SEQ ID NO: 1355768 - DNA, 16 bp, Homo sapiens
ttgtttataataaaaa

SEQ ID NO: 1355769 - DNA, 18 bp, Homo sapiens
ttgtttataataaaaata

SEQ ID NO: 1355770 - DNA, 21 bp, Homo sapiens
ttgtttggagacgtttataaa

SEQ ID NO: 1355771 - DNA, 17 bp, Homo sapiens
ttgtttggtaaatgttt

SEQ ID NO: 1355772 - DNA, 13 bp, Homo sapiens
ttgttttacaata

SEQ ID NO: 1355773 - DNA, 12 bp, Homo sapiens
ttgtttttctgc

SEQ ID NO: 1355774 - DNA, 12 bp, Homo sapiens
tttaaaaaataa

SEQ ID NO: 1355775 - DNA, 22 bp, Homo sapiens
tttaaaaaataaataaaaacta

SEQ ID NO: 1355776 - DNA, 16 bp, Homo sapiens
tttaaaaaatattttc

SEQ ID NO: 1355777 - DNA, 16 bp, Homo sapiens
tttaaaaaatggtcac

SEQ ID NO: 1355778 - DNA, 20 bp, Homo sapiens
tttaaaaagggaagaaactg

SEQ ID NO: 1355779 - DNA, 17 bp, Homo sapiens
tttaaaaatagaaacat

SEQ ID NO: 1355780 - DNA, 12 bp, Homo sapiens
tttaaaaattgt

SEQ ID NO: 1355781 - DNA, 13 bp, Homo sapiens
tttaaaacacatg

SEQ ID NO: 1355782 - DNA, 18 bp, Homo sapiens
tttaaaacaccttctata

SEQ ID NO: 1355783 - DNA, 21 bp, Homo sapiens
tttaaaatagaaattttgtaa

SEQ ID NO: 1355784 - DNA, 23 bp, Homo sapiens
tttaaaatgtaatttaaatgaaa

SEQ ID NO: 1355785 - DNA, 11 bp, Homo sapiens
tttaaactttc

SEQ ID NO: 1355786 - DNA, 17 bp, Homo sapiens
tttaaagaaaaaaatgt

SEQ ID NO: 1355787 - DNA, 21 bp, Homo sapiens
tttaaagaaaagatgaaaggc

SEQ ID NO: 1355788 - DNA, 17 bp, Homo sapiens
tttaaagaccctcctat

SEQ ID NO: 1355789 - DNA, 13 bp, Homo sapiens
tttaaatattttc

SEQ ID NO: 1355790 - DNA, 19 bp, Homo sapiens
tttaaatcctgaagagcat

SEQ ID NO: 1355791 - DNA, 23 bp, Homo sapiens
tttaaccggtaagagtttcagtt

SEQ ID NO: 1355792 - DNA, 16 bp, Homo sapiens
tttaacttaactgaaa

SEQ ID NO: 1355793 - DNA, 18 bp, Homo sapiens
tttaagccttcaaaacta

SEQ ID NO: 1355794 - DNA, 14 bp, Homo sapiens
tttaaggaaaacta

SEQ ID NO: 1355795 - DNA, 18 bp, Homo sapiens
tttaaggactgactgagg

SEQ ID NO: 1355796 - DNA, 19 bp, Homo sapiens
tttaaggactgactgaggc

SEQ ID NO: 1355797 - DNA, 22 bp, Homo sapiens
tttaaggcagattttacagagc

SEQ ID NO: 1355798 - DNA, 15 bp, Homo sapiens
tttaagggaaagaaa

SEQ ID NO: 1355799 - DNA, 17 bp, Homo sapiens
tttaagtgaaaatggtc

SEQ ID NO: 1355800 - DNA, 23 bp, Homo sapiens
tttaatataaagtagtcctgtga

SEQ ID NO: 1355801 - DNA, 14 bp, Homo sapiens
tttaattgtatttt

SEQ ID NO: 1355802 - DNA, 20 bp, Homo sapiens
tttacaagggcataaagtaa

SEQ ID NO: 1355803 - DNA, 11 bp, Homo sapiens
tttacagaaaa

SEQ ID NO: 1355804 - DNA, 16 bp, Homo sapiens
tttacccacctagaac

SEQ ID NO: 1355805 - DNA, 19 bp, Homo sapiens
tttactcatcctccaggaa

SEQ ID NO: 1355806 - DNA, 17 bp, Homo sapiens
tttactgcctgaataaa

SEQ ID NO: 1355807 - DNA, 16 bp, Homo sapiens
tttactggttgcatgg

SEQ ID NO: 1355808 - DNA, 12 bp, Homo sapiens
tttactgtgttt

SEQ ID NO: 1355809 - DNA, 14 bp, Homo sapiens
tttagaacaggttt

SEQ ID NO: 1355810 - DNA, 13 bp, Homo sapiens
tttagaattaaaa

SEQ ID NO: 1355811 - DNA, 18 bp, Homo sapiens
tttagaattgaaggtttt

SEQ ID NO: 1355812 - DNA, 22 bp, Homo sapiens
tttagacaagagatgggaatga

SEQ ID NO: 1355813 - DNA, 15 bp, Homo sapiens
tttagaccatttatc

SEQ ID NO: 1355814 - DNA, 13 bp, Homo sapiens
tttagacttgaaa

SEQ ID NO: 1355815 - DNA, 20 bp, Homo sapiens
tttagacttgaaaagagaca

SEQ ID NO: 1355816 - DNA, 21 bp, Homo sapiens
tttagacttgaaaagagacag

SEQ ID NO: 1355817 - DNA, 22 bp, Homo sapiens
tttagacttgaaaagagacagg

SEQ ID NO: 1355818 - DNA, 15 bp, Homo sapiens
tttagtaatttcttt

SEQ ID NO: 1355819 - DNA, 21 bp, Homo sapiens
tttataaaatagagtgtagtt

SEQ ID NO: 1355820 - DNA, 15 bp, Homo sapiens
tttataaacagaaat

SEQ ID NO: 1355821 - DNA, 23 bp, Homo sapiens
tttataaacagaaatggaaagca

SEQ ID NO: 1355822 - DNA, 14 bp, Homo sapiens
tttataaatccagt

SEQ ID NO: 1355823 - DNA, 16 bp, Homo sapiens
tttataataaaaatat

SEQ ID NO: 1355824 - DNA, 19 bp, Homo sapiens
tttataataaaaatatatt

SEQ ID NO: 1355825 - DNA, 16 bp, Homo sapiens
tttatactgtttactg

SEQ ID NO: 1355826 - DNA, 14 bp, Homo sapiens
tttatatgtactgt

SEQ ID NO: 1355827 - DNA, 15 bp, Homo sapiens
tttatatgtatgtgt

SEQ ID NO: 1355828 - DNA, 18 bp, Homo sapiens
tttatattactgacattt

SEQ ID NO: 1355829 - DNA, 21 bp, Homo sapiens
tttatatttattgactcttga

SEQ ID NO: 1355830 - DNA, 17 bp, Homo sapiens
tttatatttcctttatg

SEQ ID NO: 1355831 - DNA, 21 bp, Homo sapiens
tttatatttcctttatgtgaa

SEQ ID NO: 1355832 - DNA, 13 bp, Homo sapiens
tttatcaagaagt

SEQ ID NO: 1355833 - DNA, 20 bp, Homo sapiens
tttatctattctgagaaaac

SEQ ID NO: 1355834 - DNA, 17 bp, Homo sapiens
tttatctgggattatgg

SEQ ID NO: 1355835 - DNA, 16 bp, Homo sapiens
tttatgcaaaaggttt

SEQ ID NO: 1355836 - DNA, 16 bp, Homo sapiens
tttatgtgaattttta

SEQ ID NO: 1355837 - DNA, 23 bp, Homo sapiens
tttatgtttgcacttgtgattat

SEQ ID NO: 1355838 - DNA, 14 bp, Homo sapiens
tttattaaaatatt

SEQ ID NO: 1355839 - DNA, 13 bp, Homo sapiens
tttattaaatttt

SEQ ID NO: 1355840 - DNA, 17 bp, Homo sapiens
tttattaacttaataat

SEQ ID NO: 1355841 - DNA, 19 bp, Homo sapiens
tttattaatcactgtgtat

SEQ ID NO: 1355842 - DNA, 17 bp, Homo sapiens
tttattaatgcactttc

SEQ ID NO: 1355843 - DNA, 15 bp, Homo sapiens
tttattactgtttat

SEQ ID NO: 1355844 - DNA, 15 bp, Homo sapiens
tttatttatatttat

SEQ ID NO: 1355845 - DNA, 21 bp, Homo sapiens
tttatttatccagaaaactgt

SEQ ID NO: 1355846 - DNA, 12 bp, Homo sapiens
tttatttccact

SEQ ID NO: 1355847 - DNA, 14 bp, Homo sapiens
tttatttctactgt

SEQ ID NO: 1355848 - DNA, 23 bp, Homo sapiens
tttatttgaacaatgaagttgaa

SEQ ID NO: 1355849 - DNA, 13 bp, Homo sapiens
tttattttacaca

SEQ ID NO: 1355850 - DNA, 21 bp, Homo sapiens
tttattttacacagaaacact

SEQ ID NO: 1355851 - DNA, 18 bp, Homo sapiens
tttattttgagatgtaaa

SEQ ID NO: 1355852 - DNA, 21 bp, Homo sapiens
tttcaaaaggtattatacatg

SEQ ID NO: 1355853 - DNA, 22 bp, Homo sapiens
tttcaagagtctaatagtcttt

SEQ ID NO: 1355854 - DNA, 19 bp, Homo sapiens
tttcaatatattgaacttt

SEQ ID NO: 1355855 - DNA, 22 bp, Homo sapiens
tttcaatatattgaacttttgt

SEQ ID NO: 1355856 - DNA, 15 bp, Homo sapiens
tttcacgggagattt

SEQ ID NO: 1355857 - DNA, 18 bp, Homo sapiens
tttcactctaagtcatgt

SEQ ID NO: 1355858 - DNA, 20 bp, Homo sapiens
tttcactctaagtcatgtat

SEQ ID NO: 1355859 - DNA, 22 bp, Homo sapiens
tttcactctaagtcatgtatgt

SEQ ID NO: 1355860 - DNA, 23 bp, Homo sapiens
tttcagcgactccgttggccact

SEQ ID NO: 1355861 - DNA, 22 bp, Homo sapiens
tttcagttctttggattctaaa

SEQ ID NO: 1355862 - DNA, 14 bp, Homo sapiens
tttcataaacaagt

SEQ ID NO: 1355863 - DNA, 18 bp, Homo sapiens
tttcataaattatttgat

SEQ ID NO: 1355864 - DNA, 19 bp, Homo sapiens
tttcataaattatttgatt

SEQ ID NO: 1355865 - DNA, 12 bp, Homo sapiens
tttcatctcatt

SEQ ID NO: 1355866 - DNA, 17 bp, Homo sapiens
tttcatgaaaataccat

SEQ ID NO: 1355867 - DNA, 21 bp, Homo sapiens
tttcatgattagcaagttaca

SEQ ID NO: 1355868 - DNA, 21 bp, Homo sapiens
tttcatttactctaaaaactg

SEQ ID NO: 1355869 - DNA, 23 bp, Homo sapiens
tttccaccacagccagcacctgg

SEQ ID NO: 1355870 - DNA, 23 bp, Homo sapiens
tttccaggctatgtataaaatac

SEQ ID NO: 1355871 - DNA, 12 bp, Homo sapiens
tttcccatctgc

SEQ ID NO: 1355872 - DNA, 16 bp, Homo sapiens
tttcccatggggaggg

SEQ ID NO: 1355873 - DNA, 15 bp, Homo sapiens
tttccctcaccccct

SEQ ID NO: 1355874 - DNA, 20 bp, Homo sapiens
tttcctccctctgcccctcc

SEQ ID NO: 1355875 - DNA, 22 bp, Homo sapiens
tttcctcgcagcctctcagtgc

SEQ ID NO: 1355876 - DNA, 12 bp, Homo sapiens
tttcctcttgtg

SEQ ID NO: 1355877 - DNA, 19 bp, Homo sapiens
tttcctggaattgccagct

SEQ ID NO: 1355878 - DNA, 20 bp, Homo sapiens
tttcctggaattgccagctg

SEQ ID NO: 1355879 - DNA, 12 bp, Homo sapiens
tttcctgttgaa

SEQ ID NO: 1355880 - DNA, 19 bp, Homo sapiens
tttcctttatgtgaatttt

SEQ ID NO: 1355881 - DNA, 21 bp, Homo sapiens
tttcctttatgtgaattttta

SEQ ID NO: 1355882 - DNA, 14 bp, Homo sapiens
tttcctttgtcctt

SEQ ID NO: 1355883 - DNA, 16 bp, Homo sapiens
tttcgcctttcctctc

SEQ ID NO: 1355884 - DNA, 15 bp, Homo sapiens
tttctcctcccttcc

SEQ ID NO: 1355885 - DNA, 18 bp, Homo sapiens
tttctcctttaattgtaa

SEQ ID NO: 1355886 - DNA, 18 bp, Homo sapiens
tttctctgtacttttcat

SEQ ID NO: 1355887 - DNA, 16 bp, Homo sapiens
tttctctgtggctcca

SEQ ID NO: 1355888 - DNA, 21 bp, Homo sapiens
tttctctttgattatttgcat

SEQ ID NO: 1355889 - DNA, 22 bp, Homo sapiens
tttctctttgattatttgcatg

SEQ ID NO: 1355890 - DNA, 13 bp, Homo sapiens
tttctgaaaagat

SEQ ID NO: 1355891 - DNA, 15 bp, Homo sapiens
tttctgccctggctg

SEQ ID NO: 1355892 - DNA, 22 bp, Homo sapiens
tttctggggaaagacactgcct

SEQ ID NO: 1355893 - DNA, 15 bp, Homo sapiens
tttctggtggtctgt

SEQ ID NO: 1355894 - DNA, 20 bp, Homo sapiens
tttcttctctgtgagaaggt

SEQ ID NO: 1355895 - DNA, 23 bp, Homo sapiens
tttcttctgtatttttttttcta

SEQ ID NO: 1355896 - DNA, 23 bp, Homo sapiens
tttcttttggtaaagactggctt

SEQ ID NO: 1355897 - DNA, 17 bp, Homo sapiens
tttctttttttttaagt

SEQ ID NO: 1355898 - DNA, 18 bp, Homo sapiens
tttctttttttttaagtt

SEQ ID NO: 1355899 - DNA, 21 bp, Homo sapiens
tttgaaaaatataaaattatg

SEQ ID NO: 1355900 - DNA, 13 bp, Homo sapiens
tttgaaaacttca

SEQ ID NO: 1355901 - DNA, 19 bp, Homo sapiens
tttgaaaacttcagaagca

SEQ ID NO: 1355902 - DNA, 11 bp, Homo sapiens
tttgaaaagta

SEQ ID NO: 1355903 - DNA, 14 bp, Homo sapiens
tttgaaaagtaata

SEQ ID NO: 1355904 - DNA, 23 bp, Homo sapiens
tttgaaagtgcctttgcagctca

SEQ ID NO: 1355905 - DNA, 22 bp, Homo sapiens
tttgaactcttctcattacttg

SEQ ID NO: 1355906 - DNA, 13 bp, Homo sapiens
tttgacactgaaa

SEQ ID NO: 1355907 - DNA, 18 bp, Homo sapiens
tttgacactgaaagtttt

SEQ ID NO: 1355908 - DNA, 14 bp, Homo sapiens
tttgactaatttta

SEQ ID NO: 1355909 - DNA, 20 bp, Homo sapiens
tttgagaaatgaaatattgt

SEQ ID NO: 1355910 - DNA, 16 bp, Homo sapiens
tttgagatcagcctgg

SEQ ID NO: 1355911 - DNA, 17 bp, Homo sapiens
tttgagatcagcctggg

SEQ ID NO: 1355912 - DNA, 15 bp, Homo sapiens
tttgagatgtaaaaa

SEQ ID NO: 1355913 - DNA, 10 bp, Homo sapiens
tttgagctcc

SEQ ID NO: 1355914 - DNA, 16 bp, Homo sapiens
tttgaggattagttta

SEQ ID NO: 1355915 - DNA, 17 bp, Homo sapiens
tttgaggattagtttag

SEQ ID NO: 1355916 - DNA, 20 bp, Homo sapiens
tttgataaaaatttagaaca

SEQ ID NO: 1355917 - DNA, 22 bp, Homo sapiens
tttgatgcatgtcttttaaaat

SEQ ID NO: 1355918 - DNA, 16 bp, Homo sapiens
tttgattatttgcatg

SEQ ID NO: 1355919 - DNA, 17 bp, Homo sapiens
tttgattatttgcatgt

SEQ ID NO: 1355920 - DNA, 21 bp, Homo sapiens
tttgattgaataatgccacca

SEQ ID NO: 1355921 - DNA, 16 bp, Homo sapiens
tttgatttattaactt

SEQ ID NO: 1355922 - DNA, 18 bp, Homo sapiens
tttgcaataaaaatgata

SEQ ID NO: 1355923 - DNA, 17 bp, Homo sapiens
tttgcaataacagctgc

SEQ ID NO: 1355924 - DNA, 14 bp, Homo sapiens
tttgcactaaatca

SEQ ID NO: 1355925 - DNA, 14 bp, Homo sapiens
tttgcatgttatgt

SEQ ID NO: 1355926 - DNA, 23 bp, Homo sapiens
tttgccaaaattcatttctaatt

SEQ ID NO: 1355927 - DNA, 23 bp, Homo sapiens
tttgctgtcccatagtccctgcc

SEQ ID NO: 1355928 - DNA, 19 bp, Homo sapiens
tttggcaaacgctaaagag

SEQ ID NO: 1355929 - DNA, 21 bp, Homo sapiens
tttggctgaaattctcctgga

SEQ ID NO: 1355930 - DNA, 14 bp, Homo sapiens
tttggtactaataa

SEQ ID NO: 1355931 - DNA, 21 bp, Homo sapiens
tttggtgcttctcagatttct

SEQ ID NO: 1355932 - DNA, 15 bp, Homo sapiens
tttggtgtacagact

SEQ ID NO: 1355933 - DNA, 13 bp, Homo sapiens
tttgtaaacattt

SEQ ID NO: 1355934 - DNA, 14 bp, Homo sapiens
tttgtaaagctatt

SEQ ID NO: 1355935 - DNA, 15 bp, Homo sapiens
tttgtaaagtttccg

SEQ ID NO: 1355936 - DNA, 20 bp, Homo sapiens
tttgtaaataggatttttag

SEQ ID NO: 1355937 - DNA, 16 bp, Homo sapiens
tttgtaaattctgatt

SEQ ID NO: 1355938 - DNA, 19 bp, Homo sapiens
tttgtaaattctgatttct

SEQ ID NO: 1355939 - DNA, 20 bp, Homo sapiens
tttgtaagaaggcaatatta

SEQ ID NO: 1355940 - DNA, 23 bp, Homo sapiens
tttgtaataagcaatcaaggtta

SEQ ID NO: 1355941 - DNA, 15 bp, Homo sapiens
tttgtactgaatttt

SEQ ID NO: 1355942 - DNA, 16 bp, Homo sapiens
tttgtactgaattttt

SEQ ID NO: 1355943 - DNA, 22 bp, Homo sapiens
tttgtactgaatttttttgtaa

SEQ ID NO: 1355944 - DNA, 14 bp, Homo sapiens
tttgtatagttatg

SEQ ID NO: 1355945 - DNA, 17 bp, Homo sapiens
tttgtatagttatgtaa

SEQ ID NO: 1355946 - DNA, 22 bp, Homo sapiens
tttgtatagttatgtaaataat

SEQ ID NO: 1355947 - DNA, 13 bp, Homo sapiens
tttgtatgaaaac

SEQ ID NO: 1355948 - DNA, 14 bp, Homo sapiens
tttgtattgtatat

SEQ ID NO: 1355949 - DNA, 14 bp, Homo sapiens
tttgtcaaactgta

SEQ ID NO: 1355950 - DNA, 13 bp, Homo sapiens
tttgtcatatcaa

SEQ ID NO: 1355951 - DNA, 13 bp, Homo sapiens
tttgtcattcaga

SEQ ID NO: 1355952 - DNA, 19 bp, Homo sapiens
tttgtcgctcatgtgtgca

SEQ ID NO: 1355953 - DNA, 13 bp, Homo sapiens
tttgtctggttaa

SEQ ID NO: 1355954 - DNA, 13 bp, Homo sapiens
tttgtctttttgt

SEQ ID NO: 1355955 - DNA, 22 bp, Homo sapiens
tttgtgagaaacatctcaataa

SEQ ID NO: 1355956 - DNA, 20 bp, Homo sapiens
tttgtgctagaaattttcaa

SEQ ID NO: 1355957 - DNA, 22 bp, Homo sapiens
tttgtgctgaatgttgggactg

SEQ ID NO: 1355958 - DNA, 17 bp, Homo sapiens
tttgttaggattttcac

SEQ ID NO: 1355959 - DNA, 18 bp, Homo sapiens
ttttaaaaaactgctgac

SEQ ID NO: 1355960 - DNA, 21 bp, Homo sapiens
ttttaaaaaactgctgactgt

SEQ ID NO: 1355961 - DNA, 16 bp, Homo sapiens
ttttaaaaaatggtca

SEQ ID NO: 1355962 - DNA, 13 bp, Homo sapiens
ttttaaaaaccta

SEQ ID NO: 1355963 - DNA, 21 bp, Homo sapiens
ttttaaaaatctaagcagctt

SEQ ID NO: 1355964 - DNA, 19 bp, Homo sapiens
ttttaaaaattgttattta

SEQ ID NO: 1355965 - DNA, 11 bp, Homo sapiens
ttttaaaacac

SEQ ID NO: 1355966 - DNA, 15 bp, Homo sapiens
ttttaaaactggacc

SEQ ID NO: 1355967 - DNA, 17 bp, Homo sapiens
ttttaaaataaggattt

SEQ ID NO: 1355968 - DNA, 23 bp, Homo sapiens
ttttaaaatctgagggaaatgtt

SEQ ID NO: 1355969 - DNA, 19 bp, Homo sapiens
ttttaaagaaaagatgaaa

SEQ ID NO: 1355970 - DNA, 16 bp, Homo sapiens
ttttaaaggtggattt

SEQ ID NO: 1355971 - DNA, 18 bp, Homo sapiens
ttttaaaggtggattttg

SEQ ID NO: 1355972 - DNA, 14 bp, Homo sapiens
ttttaaagtgcaaa

SEQ ID NO: 1355973 - DNA, 14 bp, Homo sapiens
ttttaaagttgata

SEQ ID NO: 1355974 - DNA, 17 bp, Homo sapiens
ttttaaatattttctat

SEQ ID NO: 1355975 - DNA, 18 bp, Homo sapiens
ttttaaatctaaatctat

SEQ ID NO: 1355976 - DNA, 13 bp, Homo sapiens
ttttaagatagtg

SEQ ID NO: 1355977 - DNA, 15 bp, Homo sapiens
ttttaagatagtgta

SEQ ID NO: 1355978 - DNA, 16 bp, Homo sapiens
ttttaagatagtgtaa

SEQ ID NO: 1355979 - DNA, 15 bp, Homo sapiens
ttttaaggactgact

SEQ ID NO: 1355980 - DNA, 12 bp, Homo sapiens
ttttaagttctt

SEQ ID NO: 1355981 - DNA, 13 bp, Homo sapiens
ttttaagttctta

SEQ ID NO: 1355982 - DNA, 15 bp, Homo sapiens
ttttaatgatgacaa

SEQ ID NO: 1355983 - DNA, 12 bp, Homo sapiens
ttttaattgtat

SEQ ID NO: 1355984 - DNA, 13 bp, Homo sapiens
ttttaattgtatt

SEQ ID NO: 1355985 - DNA, 18 bp, Homo sapiens
ttttaatttacttgtttt

SEQ ID NO: 1355986 - DNA, 15 bp, Homo sapiens
ttttacaagatgtat

SEQ ID NO: 1355987 - DNA, 15 bp, Homo sapiens
ttttacacagaaaca

SEQ ID NO: 1355988 - DNA, 22 bp, Homo sapiens
ttttacacagaaacactgcctt

SEQ ID NO: 1355989 - DNA, 21 bp, Homo sapiens
ttttactggttgcatggaaat

SEQ ID NO: 1355990 - DNA, 13 bp, Homo sapiens
ttttactgtctat

SEQ ID NO: 1355991 - DNA, 17 bp, Homo sapiens
ttttagaataagaattt

SEQ ID NO: 1355992 - DNA, 20 bp, Homo sapiens
ttttagaataagaatttgca

SEQ ID NO: 1355993 - DNA, 23 bp, Homo sapiens
ttttagtatttatttatgtactt

SEQ ID NO: 1355994 - DNA, 17 bp, Homo sapiens
ttttatagcctggactg

SEQ ID NO: 1355995 - DNA, 23 bp, Homo sapiens
ttttatatttcctttatgtgaat

SEQ ID NO: 1355996 - DNA, 15 bp, Homo sapiens
ttttattaatcactg

SEQ ID NO: 1355997 - DNA, 22 bp, Homo sapiens
ttttattaatcactgtgtatat

SEQ ID NO: 1355998 - DNA, 14 bp, Homo sapiens
ttttatttatatgt

SEQ ID NO: 1355999 - DNA, 16 bp, Homo sapiens
ttttatttatatgtat

SEQ ID NO: 1356000 - DNA, 17 bp, Homo sapiens
ttttcaaaaggtattat

SEQ ID NO: 1356001 - DNA, 21 bp, Homo sapiens
ttttcaatatattgaactttt

SEQ ID NO: 1356002 - DNA, 19 bp, Homo sapiens
ttttcactctaagtcatgt

SEQ ID NO: 1356003 - DNA, 21 bp, Homo sapiens
ttttcactctaagtcatgtat

SEQ ID NO: 1356004 - DNA, 23 bp, Homo sapiens
ttttcataaattatttgattatt

SEQ ID NO: 1356005 - DNA, 11 bp, Homo sapiens
ttttccaaatg

SEQ ID NO: 1356006 - DNA, 18 bp, Homo sapiens
ttttccactccattgtcg

SEQ ID NO: 1356007 - DNA, 20 bp, Homo sapiens
ttttcccctaccaatattag

SEQ ID NO: 1356008 - DNA, 15 bp, Homo sapiens
ttttcccctttctgt

SEQ ID NO: 1356009 - DNA, 18 bp, Homo sapiens
ttttccctattagagaag

SEQ ID NO: 1356010 - DNA, 15 bp, Homo sapiens
ttttccctgtacagt

SEQ ID NO: 1356011 - DNA, 14 bp, Homo sapiens
ttttcctcttgtga

SEQ ID NO: 1356012 - DNA, 16 bp, Homo sapiens
ttttcctcttgtgatt

SEQ ID NO: 1356013 - DNA, 14 bp, Homo sapiens
ttttcgcctttcct

SEQ ID NO: 1356014 - DNA, 14 bp, Homo sapiens
ttttctaaagactt

SEQ ID NO: 1356015 - DNA, 13 bp, Homo sapiens
ttttctaagagaa

SEQ ID NO: 1356016 - DNA, 18 bp, Homo sapiens
ttttctacagtggtttta

SEQ ID NO: 1356017 - DNA, 17 bp, Homo sapiens
ttttctactttttttaa

SEQ ID NO: 1356018 - DNA, 14 bp, Homo sapiens
ttttctctgtactt

SEQ ID NO: 1356019 - DNA, 12 bp, Homo sapiens
ttttctgccctg

SEQ ID NO: 1356020 - DNA, 13 bp, Homo sapiens
ttttctgccctgg

SEQ ID NO: 1356021 - DNA, 15 bp, Homo sapiens
ttttctgctttagac

SEQ ID NO: 1356022 - DNA, 22 bp, Homo sapiens
ttttctgctttagacttgaaaa

SEQ ID NO: 1356023 - DNA, 12 bp, Homo sapiens
ttttctgtattt

SEQ ID NO: 1356024 - DNA, 23 bp, Homo sapiens
ttttctgtgtgtcagttttcata

SEQ ID NO: 1356025 - DNA, 20 bp, Homo sapiens
ttttgaaaagcagacatttt

SEQ ID NO: 1356026 - DNA, 13 bp, Homo sapiens
ttttgagcacttt

SEQ ID NO: 1356027 - DNA, 19 bp, Homo sapiens
ttttgatagcattgtaagc

SEQ ID NO: 1356028 - DNA, 12 bp, Homo sapiens
ttttgcatgaaa

SEQ ID NO: 1356029 - DNA, 15 bp, Homo sapiens
ttttgccttttgcaa

SEQ ID NO: 1356030 - DNA, 21 bp, Homo sapiens
ttttgcttttggcaaaactct

SEQ ID NO: 1356031 - DNA, 18 bp, Homo sapiens
ttttggagattataataa

SEQ ID NO: 1356032 - DNA, 19 bp, Homo sapiens
ttttggcaaacgctaaaga

SEQ ID NO: 1356033 - DNA, 15 bp, Homo sapiens
ttttgtaaaagaaat

SEQ ID NO: 1356034 - DNA, 13 bp, Homo sapiens
ttttgtaaacatt

SEQ ID NO: 1356035 - DNA, 14 bp, Homo sapiens
ttttgtaaacattt

SEQ ID NO: 1356036 - DNA, 16 bp, Homo sapiens
ttttgtaaacatttat

SEQ ID NO: 1356037 - DNA, 16 bp, Homo sapiens
ttttgtttttgtctta

SEQ ID NO: 1356038 - DNA, 18 bp, Homo sapiens
tttttaaaacacatgttt

SEQ ID NO: 1356039 - DNA, 16 bp, Homo sapiens
tttttaaaatatttat

SEQ ID NO: 1356040 - DNA, 11 bp, Homo sapiens
tttttaagata

SEQ ID NO: 1356041 - DNA, 16 bp, Homo sapiens
tttttaagatagtgta

SEQ ID NO: 1356042 - DNA, 20 bp, Homo sapiens
tttttaagatagtgtaactt

SEQ ID NO: 1356043 - DNA, 22 bp, Homo sapiens
tttttaatctactgcatttagg

SEQ ID NO: 1356044 - DNA, 16 bp, Homo sapiens
tttttaattgtttaaa

SEQ ID NO: 1356045 - DNA, 23 bp, Homo sapiens
tttttagtatttatttatgtact

SEQ ID NO: 1356046 - DNA, 18 bp, Homo sapiens
tttttataaaatggctgt

SEQ ID NO: 1356047 - DNA, 18 bp, Homo sapiens
tttttatagcaacaacaa

SEQ ID NO: 1356048 - DNA, 15 bp, Homo sapiens
tttttatatttcctt

SEQ ID NO: 1356049 - DNA, 16 bp, Homo sapiens
tttttatgctatttct

SEQ ID NO: 1356050 - DNA, 15 bp, Homo sapiens
tttttatttctactg

SEQ ID NO: 1356051 - DNA, 17 bp, Homo sapiens
tttttcaatatattgaa

SEQ ID NO: 1356052 - DNA, 13 bp, Homo sapiens
tttttcataaaca

SEQ ID NO: 1356053 - DNA, 16 bp, Homo sapiens
tttttctaagagaagt

SEQ ID NO: 1356054 - DNA, 18 bp, Homo sapiens
tttttctgtgtgtcagtt

SEQ ID NO: 1356055 - DNA, 16 bp, Homo sapiens
tttttcttctgtattt

SEQ ID NO: 1356056 - DNA, 20 bp, Homo sapiens
tttttgaaaagcagacattt

SEQ ID NO: 1356057 - DNA, 20 bp, Homo sapiens
tttttgaactcttctcatta

SEQ ID NO: 1356058 - DNA, 14 bp, Homo sapiens
tttttgatagcatt

SEQ ID NO: 1356059 - DNA, 22 bp, Homo sapiens
tttttggggggttttcttgcct

SEQ ID NO: 1356060 - DNA, 9 bp, Homo sapiens
tttttgtat

SEQ ID NO: 1356061 - DNA, 11 bp, Homo sapiens
tttttgtttgg

SEQ ID NO: 1356062 - DNA, 16 bp, Homo sapiens
tttttgtttttctgct

SEQ ID NO: 1356063 - DNA, 15 bp, Homo sapiens
ttttttaagcttcag

SEQ ID NO: 1356064 - DNA, 12 bp, Homo sapiens
ttttttatttct

SEQ ID NO: 1356065 - DNA, 12 bp, Homo sapiens
ttttttctaaga

SEQ ID NO: 1356066 - DNA, 19 bp, Homo sapiens
ttttttgaactcttctcat

SEQ ID NO: 1356067 - DNA, 13 bp, Homo sapiens
ttttttgtatgtg

SEQ ID NO: 1356068 - DNA, 12 bp, Homo sapiens
ttttttgttatt

SEQ ID NO: 1356069 - DNA, 13 bp, Homo sapiens
tttttttcctttt

SEQ ID NO: 1356070 - DNA, 14 bp, Homo sapiens
tttttttctaagag

SEQ ID NO: 1356071 - DNA, 14 bp, Homo sapiens
tttttttgtacgac

SEQ ID NO: 1356072 - DNA, 13 bp, Homo sapiens
ttttttttttggt

SEQ ID NO: 1356073 - DNA, 10 bp, Homo sapiens
aaaaaactac

SEQ ID NO: 1356074 - DNA, 22 bp, Homo sapiens
aaaaaactgctgactgttttct

SEQ ID NO: 1356075 - DNA, 13 bp, Homo sapiens
aaaaaatactatt

SEQ ID NO: 1356076 - DNA, 17 bp, Homo sapiens
aaaaaccgaataaatgt

SEQ ID NO: 1356077 - DNA, 15 bp, Homo sapiens
aaaaagagacatcca

SEQ ID NO: 1356078 - DNA, 14 bp, Homo sapiens
aaaaagtataaaat

SEQ ID NO: 1356079 - DNA, 19 bp, Homo sapiens
aaaaagtcagagacagata

SEQ ID NO: 1356080 - DNA, 16 bp, Homo sapiens
aaaaatagaaacatat

SEQ ID NO: 1356081 - DNA, 17 bp, Homo sapiens
aaaaatagtgtctttgt

SEQ ID NO: 1356082 - DNA, 22 bp, Homo sapiens
aaaacatcattcctttttattt

SEQ ID NO: 1356083 - DNA, 13 bp, Homo sapiens
aaaacatttgctg

SEQ ID NO: 1356084 - DNA, 12 bp, Homo sapiens
aaaacccaagtg

SEQ ID NO: 1356085 - DNA, 14 bp, Homo sapiens
aaaaccgaataaat

SEQ ID NO: 1356086 - DNA, 15 bp, Homo sapiens
aaaaccgaataaatg

SEQ ID NO: 1356087 - DNA, 23 bp, Homo sapiens
aaaaccttttactggttgcatgg

SEQ ID NO: 1356088 - DNA, 18 bp, Homo sapiens
aaaactcaggcaaagaaa

SEQ ID NO: 1356089 - DNA, 15 bp, Homo sapiens
aaaactctacttaat

SEQ ID NO: 1356090 - DNA, 13 bp, Homo sapiens
aaaactgaaaaat

SEQ ID NO: 1356091 - DNA, 11 bp, Homo sapiens
aaaagaaaaag

SEQ ID NO: 1356092 - DNA, 11 bp, Homo sapiens
aaaagaatgac

SEQ ID NO: 1356093 - DNA, 21 bp, Homo sapiens
aaaagagcagtggtaagaata

SEQ ID NO: 1356094 - DNA, 14 bp, Homo sapiens
aaaagcagacattt

SEQ ID NO: 1356095 - DNA, 17 bp, Homo sapiens
aaaagcatttttcaata

SEQ ID NO: 1356096 - DNA, 16 bp, Homo sapiens
aaaagcgcttttcctt

SEQ ID NO: 1356097 - DNA, 15 bp, Homo sapiens
aaaagctcttttaat

SEQ ID NO: 1356098 - DNA, 14 bp, Homo sapiens
aaaaggaaagaaaa

SEQ ID NO: 1356099 - DNA, 15 bp, Homo sapiens
aaaaggcctcttgta

SEQ ID NO: 1356100 - DNA, 23 bp, Homo sapiens
aaaaggcctcttgtaaagactgg

SEQ ID NO: 1356101 - DNA, 19 bp, Homo sapiens
aaaaggctgtgctgccctg

SEQ ID NO: 1356102 - DNA, 20 bp, Homo sapiens
aaaaggcttataaaacagag

SEQ ID NO: 1356103 - DNA, 14 bp, Homo sapiens
aaaaggcttgaagc

SEQ ID NO: 1356104 - DNA, 14 bp, Homo sapiens
aaaaggtattatac

SEQ ID NO: 1356105 - DNA, 13 bp, Homo sapiens
aaaagtaatattt

SEQ ID NO: 1356106 - DNA, 19 bp, Homo sapiens
aaaagtattttttcaagtt

SEQ ID NO: 1356107 - DNA, 14 bp, Homo sapiens
aaaagtctgtcttt

SEQ ID NO: 1356108 - DNA, 20 bp, Homo sapiens
aaaagtgcctcaagaggaat

SEQ ID NO: 1356109 - DNA, 21 bp, Homo sapiens
aaaagtgtgtatatattttgt

SEQ ID NO: 1356110 - DNA, 12 bp, Homo sapiens
aaaataaaacat

SEQ ID NO: 1356111 - DNA, 17 bp, Homo sapiens
aaaatactatttaagat

SEQ ID NO: 1356112 - DNA, 14 bp, Homo sapiens
aaaatagtttattt

SEQ ID NO: 1356113 - DNA, 14 bp, Homo sapiens
aaaatataaaatta

SEQ ID NO: 1356114 - DNA, 13 bp, Homo sapiens
aaaatatcaaatt

SEQ ID NO: 1356115 - DNA, 14 bp, Homo sapiens
aaaatattgtttct

SEQ ID NO: 1356116 - DNA, 20 bp, Homo sapiens
aaaatattgttttacaatag

SEQ ID NO: 1356117 - DNA, 13 bp, Homo sapiens
aaaatattttctc

SEQ ID NO: 1356118 - DNA, 21 bp, Homo sapiens
aaaatcagcctgctccagctg

SEQ ID NO: 1356119 - DNA, 15 bp, Homo sapiens
aaaatcctgtgcaat

SEQ ID NO: 1356120 - DNA, 21 bp, Homo sapiens
aaaatctgagggaaatgtttt

SEQ ID NO: 1356121 - DNA, 21 bp, Homo sapiens
aaaatctgttgataaatccat

SEQ ID NO: 1356122 - DNA, 14 bp, Homo sapiens
aaaatgaagaattt

SEQ ID NO: 1356123 - DNA, 16 bp, Homo sapiens
aaaatgaagaatttaa

SEQ ID NO: 1356124 - DNA, 22 bp, Homo sapiens
aaaatgaatatctattaatata

SEQ ID NO: 1356125 - DNA, 14 bp, Homo sapiens
aaaatgagcctggc

SEQ ID NO: 1356126 - DNA, 23 bp, Homo sapiens
aaaatgtcaaaagtagaactttg

SEQ ID NO: 1356127 - DNA, 11 bp, Homo sapiens
aaaatgtgttc

SEQ ID NO: 1356128 - DNA, 12 bp, Homo sapiens
aaaatgttttaa

SEQ ID NO: 1356129 - DNA, 20 bp, Homo sapiens
aaaattaagcaaatgttaaa

SEQ ID NO: 1356130 - DNA, 13 bp, Homo sapiens
aaaattcatttct

SEQ ID NO: 1356131 - DNA, 13 bp, Homo sapiens
aaaatttgttgca

SEQ ID NO: 1356132 - DNA, 17 bp, Homo sapiens
aaaattttaaaaatcta

SEQ ID NO: 1356133 - DNA, 13 bp, Homo sapiens
aaacaaaatttga

SEQ ID NO: 1356134 - DNA, 17 bp, Homo sapiens
aaacaaccatgtcattt

SEQ ID NO: 1356135 - DNA, 20 bp, Homo sapiens
aaacacccgacgtcatgtat

SEQ ID NO: 1356136 - DNA, 13 bp, Homo sapiens
aaacactgccttt

SEQ ID NO: 1356137 - DNA, 14 bp, Homo sapiens
aaacagaaaaaaag

SEQ ID NO: 1356138 - DNA, 13 bp, Homo sapiens
aaacagtgactgt

SEQ ID NO: 1356139 - DNA, 15 bp, Homo sapiens
aaacagtgtgtaaac

SEQ ID NO: 1356140 - DNA, 19 bp, Homo sapiens
aaacatcattcctttttat

SEQ ID NO: 1356141 - DNA, 22 bp, Homo sapiens
aaacatcattcctttttattta

SEQ ID NO: 1356142 - DNA, 15 bp, Homo sapiens
aaacatgagatgtgt

SEQ ID NO: 1356143 - DNA, 17 bp, Homo sapiens
aaaccaaagagggcttc

SEQ ID NO: 1356144 - DNA, 19 bp, Homo sapiens
aaaccaaagagggcttcct

SEQ ID NO: 1356145 - DNA, 20 bp, Homo sapiens
aaaccaaagagggcttcctc

SEQ ID NO: 1356146 - DNA, 17 bp, Homo sapiens
aaaccccatctctacaa

SEQ ID NO: 1356147 - DNA, 15 bp, Homo sapiens
aaaccctcagagcct

SEQ ID NO: 1356148 - DNA, 20 bp, Homo sapiens
aaaccgagtagaaaatgtga

SEQ ID NO: 1356149 - DNA, 16 bp, Homo sapiens
aaaccgccaaggctgg

SEQ ID NO: 1356150 - DNA, 22 bp, Homo sapiens
aaaccttatctccacaacctct

SEQ ID NO: 1356151 - DNA, 22 bp, Homo sapiens
aaacgctaaagagcccttgcct

SEQ ID NO: 1356152 - DNA, 17 bp, Homo sapiens
aaacgggaacatgcccc

SEQ ID NO: 1356153 - DNA, 14 bp, Homo sapiens
aaacgtcctcttta

SEQ ID NO: 1356154 - DNA, 17 bp, Homo sapiens
aaactatattttgtcat

SEQ ID NO: 1356155 - DNA, 14 bp, Homo sapiens
aaactcaatgcttt

SEQ ID NO: 1356156 - DNA, 23 bp, Homo sapiens
aaactcaatgctttatttgtaaa

SEQ ID NO: 1356157 - DNA, 17 bp, Homo sapiens
aaactcatattacaaaa

SEQ ID NO: 1356158 - DNA, 22 bp, Homo sapiens
aaactcatattacaaaaacaaa

SEQ ID NO: 1356159 - DNA, 17 bp, Homo sapiens
aaactcatctgaaatgt

SEQ ID NO: 1356160 - DNA, 13 bp, Homo sapiens
aaactcatctgga

SEQ ID NO: 1356161 - DNA, 22 bp, Homo sapiens
aaactgcttcccttactttgct

SEQ ID NO: 1356162 - DNA, 19 bp, Homo sapiens
aaactgggatgaaactaaa

SEQ ID NO: 1356163 - DNA, 17 bp, Homo sapiens
aaactggggcctccaga

SEQ ID NO: 1356164 - DNA, 20 bp, Homo sapiens
aaactggggcctccagaact

SEQ ID NO: 1356165 - DNA, 16 bp, Homo sapiens
aaactgtagaaatgat

SEQ ID NO: 1356166 - DNA, 18 bp, Homo sapiens
aaactgtagaaatgatga

SEQ ID NO: 1356167 - DNA, 14 bp, Homo sapiens
aaactgtttgaaaa

SEQ ID NO: 1356168 - DNA, 23 bp, Homo sapiens
aaactgtttgaaaacttcagaag

SEQ ID NO: 1356169 - DNA, 16 bp, Homo sapiens
aaacttaaatgttatt

SEQ ID NO: 1356170 - DNA, 17 bp, Homo sapiens
aaactttgggaaaacat

SEQ ID NO: 1356171 - DNA, 12 bp, Homo sapiens
aaacttttctag

SEQ ID NO: 1356172 - DNA, 13 bp, Homo sapiens
aaagaaaatgaaa

SEQ ID NO: 1356173 - DNA, 13 bp, Homo sapiens
aaagaaaattgag

SEQ ID NO: 1356174 - DNA, 18 bp, Homo sapiens
aaagaaatcatgtccata

SEQ ID NO: 1356175 - DNA, 20 bp, Homo sapiens
aaagaaatccggagaagctg

SEQ ID NO: 1356176 - DNA, 20 bp, Homo sapiens
aaagaatatgactttttata

SEQ ID NO: 1356177 - DNA, 16 bp, Homo sapiens
aaagaatttagtatta

SEQ ID NO: 1356178 - DNA, 18 bp, Homo sapiens
aaagacaaaagtctgtct

SEQ ID NO: 1356179 - DNA, 17 bp, Homo sapiens
aaagacactgcctgggc

SEQ ID NO: 1356180 - DNA, 19 bp, Homo sapiens
aaagacactgcctgggctg

SEQ ID NO: 1356181 - DNA, 16 bp, Homo sapiens
aaagactggttttctg

SEQ ID NO: 1356182 - DNA, 12 bp, Homo sapiens
aaagagaatgag

SEQ ID NO: 1356183 - DNA, 18 bp, Homo sapiens
aaagagagaacaggacta

SEQ ID NO: 1356184 - DNA, 15 bp, Homo sapiens
aaagagggcttcctc

SEQ ID NO: 1356185 - DNA, 20 bp, Homo sapiens
aaagatggtatcatatattt

SEQ ID NO: 1356186 - DNA, 15 bp, Homo sapiens
aaagcaataaatgaa

SEQ ID NO: 1356187 - DNA, 15 bp, Homo sapiens
aaagcaatagaaaca

SEQ ID NO: 1356188 - DNA, 18 bp, Homo sapiens
aaagcatgaaatgtgaat

SEQ ID NO: 1356189 - DNA, 12 bp, Homo sapiens
aatacaaggtat

SEQ ID NO: 1356190 - DNA, 22 bp, Homo sapiens
aatacaaggtataataaaatta

SEQ ID NO: 1356191 - DNA, 14 bp, Homo sapiens
aatacacatttgct

SEQ ID NO: 1356192 - DNA, 17 bp, Homo sapiens
aatacactagttgtttc

SEQ ID NO: 1356193 - DNA, 13 bp, Homo sapiens
aatacagaggcaa

SEQ ID NO: 1356194 - DNA, 15 bp, Homo sapiens
aatacatgcatataa

SEQ ID NO: 1356195 - DNA, 15 bp, Homo sapiens
aataccatttagtaa

SEQ ID NO: 1356196 - DNA, 22 bp, Homo sapiens
aatactctaccctcttagaaaa

SEQ ID NO: 1356197 - DNA, 15 bp, Homo sapiens
aatactgaaccactt

SEQ ID NO: 1356198 - DNA, 20 bp, Homo sapiens
aatactgaaccacttgtaga

SEQ ID NO: 1356199 - DNA, 17 bp, Homo sapiens
aatacttgaaccataaa

SEQ ID NO: 1356200 - DNA, 16 bp, Homo sapiens
aatagaaattttgtaa

SEQ ID NO: 1356201 - DNA, 17 bp, Homo sapiens
aatagaaattttgtaag

SEQ ID NO: 1356202 - DNA, 18 bp, Homo sapiens
aatagaaattttgtaaga

SEQ ID NO: 1356203 - DNA, 13 bp, Homo sapiens
aatagacatcaaa

SEQ ID NO: 1356204 - DNA, 15 bp, Homo sapiens
aatagacatcaaact

SEQ ID NO: 1356205 - DNA, 23 bp, Homo sapiens
aatagagtgtagtttacagaaaa

SEQ ID NO: 1356206 - DNA, 17 bp, Homo sapiens
aatagcaacttttgtgt

SEQ ID NO: 1356207 - DNA, 14 bp, Homo sapiens
aataggatgggctt

SEQ ID NO: 1356208 - DNA, 18 bp, Homo sapiens
aatagtatgaaaatggaa

SEQ ID NO: 1356209 - DNA, 14 bp, Homo sapiens
aatataacacattt

SEQ ID NO: 1356210 - DNA, 15 bp, Homo sapiens
aatataacacatttt

SEQ ID NO: 1356211 - DNA, 21 bp, Homo sapiens
aatataaggaaagcaataaat

SEQ ID NO: 1356212 - DNA, 18 bp, Homo sapiens
aatatacattcaaactta

SEQ ID NO: 1356213 - DNA, 19 bp, Homo sapiens
aatatacattcaaacttaa

SEQ ID NO: 1356214 - DNA, 13 bp, Homo sapiens
aatatatatgaat

SEQ ID NO: 1356215 - DNA, 14 bp, Homo sapiens
aatatatgtattat

SEQ ID NO: 1356216 - DNA, 18 bp, Homo sapiens
aatatatgtattatttat

SEQ ID NO: 1356217 - DNA, 21 bp, Homo sapiens
aatatatgtattatttataat

SEQ ID NO: 1356218 - DNA, 20 bp, Homo sapiens
aatatattgaacttttgtac

SEQ ID NO: 1356219 - DNA, 23 bp, Homo sapiens
aatatattgaacttttgtactga

SEQ ID NO: 1356220 - DNA, 17 bp, Homo sapiens
aatatatttctaaatgt

SEQ ID NO: 1356221 - DNA, 19 bp, Homo sapiens
aatatatttctaaatgttt

SEQ ID NO: 1356222 - DNA, 21 bp, Homo sapiens
aatatattttctgttttcttt

SEQ ID NO: 1356223 - DNA, 18 bp, Homo sapiens
aatatatttttagactca

SEQ ID NO: 1356224 - DNA, 13 bp, Homo sapiens
aatatcaaattaa

SEQ ID NO: 1356225 - DNA, 14 bp, Homo sapiens
aatatcaaattaat

SEQ ID NO: 1356226 - DNA, 17 bp, Homo sapiens
aatatcaaattaattgt

SEQ ID NO: 1356227 - DNA, 21 bp, Homo sapiens
aatatcaaattaattgtgtga

SEQ ID NO: 1356228 - DNA, 15 bp, Homo sapiens
aatatcttggcctaa

SEQ ID NO: 1356229 - DNA, 19 bp, Homo sapiens
aatatgactttttataaaa

SEQ ID NO: 1356230 - DNA, 18 bp, Homo sapiens
aatatgattaaaaatatc

SEQ ID NO: 1356231 - DNA, 17 bp, Homo sapiens
aatatgcaacattgtcc

SEQ ID NO: 1356232 - DNA, 23 bp, Homo sapiens
aatatgcctgcaatctgagccag

SEQ ID NO: 1356233 - DNA, 18 bp, Homo sapiens
aatattccagatctttca

SEQ ID NO: 1356234 - DNA, 19 bp, Homo sapiens
aatattgagaaagaaacta

SEQ ID NO: 1356235 - DNA, 16 bp, Homo sapiens
aatattgattgggaaa

SEQ ID NO: 1356236 - DNA, 13 bp, Homo sapiens
aatattgcaaaat

SEQ ID NO: 1356237 - DNA, 23 bp, Homo sapiens
aatattgcaaaatacatgaagct

SEQ ID NO: 1356238 - DNA, 16 bp, Homo sapiens
aatattgttgacaact

SEQ ID NO: 1356239 - DNA, 14 bp, Homo sapiens
aatattgtttctgc

SEQ ID NO: 1356240 - DNA, 15 bp, Homo sapiens
aatattgtttctgca

SEQ ID NO: 1356241 - DNA, 16 bp, Homo sapiens
aatattgtttggtaaa

SEQ ID NO: 1356242 - DNA, 20 bp, Homo sapiens
aatattgtttggtaaatgtt

SEQ ID NO: 1356243 - DNA, 23 bp, Homo sapiens
aatattgtttggtaaatgtttct

SEQ ID NO: 1356244 - DNA, 18 bp, Homo sapiens
aatattgttttacaatag

SEQ ID NO: 1356245 - DNA, 12 bp, Homo sapiens
aatatttattaa

SEQ ID NO: 1356246 - DNA, 20 bp, Homo sapiens
aatatttcaggttcttcaga

SEQ ID NO: 1356247 - DNA, 12 bp, Homo sapiens
aatattttatgg

SEQ ID NO: 1356248 - DNA, 21 bp, Homo sapiens
aatattttatggttatgtttt

SEQ ID NO: 1356249 - DNA, 13 bp, Homo sapiens
aatattttctatt

SEQ ID NO: 1356250 - DNA, 16 bp, Homo sapiens
aatattttctatttta

SEQ ID NO: 1356251 - DNA, 22 bp, Homo sapiens
aatattttctctgtacttttca

SEQ ID NO: 1356252 - DNA, 13 bp, Homo sapiens
aatattttgaatc

SEQ ID NO: 1356253 - DNA, 14 bp, Homo sapiens
aatattttgaatca

SEQ ID NO: 1356254 - DNA, 16 bp, Homo sapiens
aatattttgaatcaat

SEQ ID NO: 1356255 - DNA, 18 bp, Homo sapiens
aatatttttatatttcct

SEQ ID NO: 1356256 - DNA, 21 bp, Homo sapiens
aatatttttatatttccttta

SEQ ID NO: 1356257 - DNA, 13 bp, Homo sapiens
aatcaaagtgcta

SEQ ID NO: 1356258 - DNA, 19 bp, Homo sapiens
aatcaagagccttaaaaca

SEQ ID NO: 1356259 - DNA, 14 bp, Homo sapiens
aatcaatacactag

SEQ ID NO: 1356260 - DNA, 13 bp, Homo sapiens
aatcaccatgtaa

SEQ ID NO: 1356261 - DNA, 14 bp, Homo sapiens
aatcaccatgtaag

SEQ ID NO: 1356262 - DNA, 15 bp, Homo sapiens
aatcaccatgtaagc

SEQ ID NO: 1356263 - DNA, 10 bp, Homo sapiens
aatcactgtg

SEQ ID NO: 1356264 - DNA, 14 bp, Homo sapiens
aatcactgtgtata

SEQ ID NO: 1356265 - DNA, 13 bp, Homo sapiens
aatcagagacaaa

SEQ ID NO: 1356266 - DNA, 18 bp, Homo sapiens
aatcagccaagttttata

SEQ ID NO: 1356267 - DNA, 19 bp, Homo sapiens
aatcatagtactctttgta

SEQ ID NO: 1356268 - DNA, 14 bp, Homo sapiens
aaatttgttgcata

SEQ ID NO: 1356269 - DNA, 17 bp, Homo sapiens
aaattttgaaaagtaat

SEQ ID NO: 1356270 - DNA, 18 bp, Homo sapiens
aaattttgaaaagtaata

SEQ ID NO: 1356271 - DNA, 13 bp, Homo sapiens
aaattttttgact

SEQ ID NO: 1356272 - DNA, 23 bp, Homo sapiens
aaattttttgactttttttgtat

SEQ ID NO: 1356273 - DNA, 19 bp, Homo sapiens
aaatttttttgtatgaaaa

SEQ ID NO: 1356274 - DNA, 19 bp, Homo sapiens
aacaaataaaaaagctctt

SEQ ID NO: 1356275 - DNA, 13 bp, Homo sapiens
aacaagcatgcag

SEQ ID NO: 1356276 - DNA, 16 bp, Homo sapiens
aacaataaaatttttt

SEQ ID NO: 1356277 - DNA, 19 bp, Homo sapiens
aacacaaacgggctcagca

SEQ ID NO: 1356278 - DNA, 13 bp, Homo sapiens
aacacaagcaaaa

SEQ ID NO: 1356279 - DNA, 15 bp, Homo sapiens
aacacacacatatac

SEQ ID NO: 1356280 - DNA, 13 bp, Homo sapiens
aacacagcctggg

SEQ ID NO: 1356281 - DNA, 14 bp, Homo sapiens
aacacagcctgggc

SEQ ID NO: 1356282 - DNA, 20 bp, Homo sapiens
aacacatttttttgcatgca

SEQ ID NO: 1356283 - DNA, 19 bp, Homo sapiens
aacacctctgcacaagctg

SEQ ID NO: 1356284 - DNA, 19 bp, Homo sapiens
aacaccttctatagcatca

SEQ ID NO: 1356285 - DNA, 13 bp, Homo sapiens
aacacgttttaag

SEQ ID NO: 1356286 - DNA, 18 bp, Homo sapiens
aacactaactcaccagcc

SEQ ID NO: 1356287 - DNA, 14 bp, Homo sapiens
aacactgccttttt

SEQ ID NO: 1356288 - DNA, 15 bp, Homo sapiens
aacagaaattgtata

SEQ ID NO: 1356289 - DNA, 17 bp, Homo sapiens
aacagaaattgtatatt

SEQ ID NO: 1356290 - DNA, 16 bp, Homo sapiens
aacagcaagtgtgaat

SEQ ID NO: 1356291 - DNA, 19 bp, Homo sapiens
aacagctgcaattccctgg

SEQ ID NO: 1356292 - DNA, 21 bp, Homo sapiens
aacagctgcaattccctggat

SEQ ID NO: 1356293 - DNA, 21 bp, Homo sapiens
aacagtaccctggttgtgtgt

SEQ ID NO: 1356294 - DNA, 20 bp, Homo sapiens
aacagtatgtgggatattga

SEQ ID NO: 1356295 - DNA, 21 bp, Homo sapiens
aacagtatgtgggatattgaa

SEQ ID NO: 1356296 - DNA, 21 bp, Homo sapiens
aacagtgaagttttactgtct

SEQ ID NO: 1356297 - DNA, 21 bp, Homo sapiens
aacagtgtgtaaacaaaatga

SEQ ID NO: 1356298 - DNA, 16 bp, Homo sapiens
aacagtttggaaaagt

SEQ ID NO: 1356299 - DNA, 21 bp, Homo sapiens
aacatacaaatgcatctttga

SEQ ID NO: 1356300 - DNA, 23 bp, Homo sapiens
aacatagaaatggaaattttgct

SEQ ID NO: 1356301 - DNA, 12 bp, Homo sapiens
aacatatatgga

SEQ ID NO: 1356302 - DNA, 17 bp, Homo sapiens
aacatatgaaaatacaa

SEQ ID NO: 1356303 - DNA, 14 bp, Homo sapiens
aacatcattccttt

SEQ ID NO: 1356304 - DNA, 22 bp, Homo sapiens
aacatcattcctttttatttat

SEQ ID NO: 1356305 - DNA, 17 bp, Homo sapiens
aacatccaaccttccca

SEQ ID NO: 1356306 - DNA, 23 bp, Homo sapiens
aacatggtttgactcatcttata

SEQ ID NO: 1356307 - DNA, 20 bp, Homo sapiens
aacatgttaatgacaatatt

SEQ ID NO: 1356308 - DNA, 13 bp, Homo sapiens
aacatttgctgcc

SEQ ID NO: 1356309 - DNA, 16 bp, Homo sapiens
aacatttgctgccatt

SEQ ID NO: 1356310 - DNA, 20 bp, Homo sapiens
aaccaagtgatcaaactaca

SEQ ID NO: 1356311 - DNA, 16 bp, Homo sapiens
aaccacaaaactcatc

SEQ ID NO: 1356312 - DNA, 14 bp, Homo sapiens
aaccacattgaaga

SEQ ID NO: 1356313 - DNA, 16 bp, Homo sapiens
aaccacattgaagaat

SEQ ID NO: 1356314 - DNA, 22 bp, Homo sapiens
aaccaccccggccccctgcccg

SEQ ID NO: 1356315 - DNA, 15 bp, Homo sapiens
aaccacttcagctga

SEQ ID NO: 1356316 - DNA, 15 bp, Homo sapiens
aaccctatctcctga

SEQ ID NO: 1356317 - DNA, 16 bp, Homo sapiens
aaccctatctcctgac

SEQ ID NO: 1356318 - DNA, 23 bp, Homo sapiens
aaccctatctcctgacagaaggt

SEQ ID NO: 1356319 - DNA, 15 bp, Homo sapiens
aaccctgccgtcacc

SEQ ID NO: 1356320 - DNA, 18 bp, Homo sapiens
aaccctgccgtcaccacc

SEQ ID NO: 1356321 - DNA, 19 bp, Homo sapiens
aaccctgccgtcaccacca

SEQ ID NO: 1356322 - DNA, 21 bp, Homo sapiens
aaccctgccgtcaccaccacc

SEQ ID NO: 1356323 - DNA, 20 bp, Homo sapiens
aacctaatcaccatgtaagc

SEQ ID NO: 1356324 - DNA, 21 bp, Homo sapiens
aacctaatcaccatgtaagca

SEQ ID NO: 1356325 - DNA, 18 bp, Homo sapiens
aacctcagggctcccagg

SEQ ID NO: 1356326 - DNA, 15 bp, Homo sapiens
aacctccccagcctg

SEQ ID NO: 1356327 - DNA, 17 bp, Homo sapiens
aacctccccagcctgcg

SEQ ID NO: 1356328 - DNA, 19 bp, Homo sapiens
aacctcgcgcttgctggcc

SEQ ID NO: 1356329 - DNA, 17 bp, Homo sapiens
aacctcttctggctcaa

SEQ ID NO: 1356330 - DNA, 13 bp, Homo sapiens
aaccttgtataaa

SEQ ID NO: 1356331 - DNA, 14 bp, Homo sapiens
aaccttgtataaat

SEQ ID NO: 1356332 - DNA, 17 bp, Homo sapiens
aacctttccctcacccc

SEQ ID NO: 1356333 - DNA, 22 bp, Homo sapiens
aacctttccctcaccccctccc

SEQ ID NO: 1356334 - DNA, 21 bp, Homo sapiens
aacctttgagtagatccattt

SEQ ID NO: 1356335 - DNA, 13 bp, Homo sapiens
aaccttttactgg

SEQ ID NO: 1356336 - DNA, 21 bp, Homo sapiens
aaccttttactggttgcatgg

SEQ ID NO: 1356337 - DNA, 16 bp, Homo sapiens
aacgaaatatcaaagt

SEQ ID NO: 1356338 - DNA, 15 bp, Homo sapiens
aacgaaccttggcct

SEQ ID NO: 1356339 - DNA, 21 bp, Homo sapiens
aacgaaccttggcctgggccg

SEQ ID NO: 1356340 - DNA, 16 bp, Homo sapiens
aacgaagagttccctt

SEQ ID NO: 1356341 - DNA, 23 bp, Homo sapiens
aacgaagagttcccttgaaactt

SEQ ID NO: 1356342 - DNA, 17 bp, Homo sapiens
aacgatcacaaatgact

SEQ ID NO: 1356343 - DNA, 22 bp, Homo sapiens
aacgatcacaaatgactttatt

SEQ ID NO: 1356344 - DNA, 17 bp, Homo sapiens
aacgcctcccctgcccc

SEQ ID NO: 1356345 - DNA, 22 bp, Homo sapiens
aacgctaaagagcccttgcctc

SEQ ID NO: 1356346 - DNA, 19 bp, Homo sapiens
aacggaggcctgcgaccct

SEQ ID NO: 1356347 - DNA, 23 bp, Homo sapiens
aacggaggcctgcgaccctgggg

SEQ ID NO: 1356348 - DNA, 17 bp, Homo sapiens
aacgggaacatgccccc

SEQ ID NO: 1356349 - DNA, 19 bp, Homo sapiens
aacgggaacatgccccctg

SEQ ID NO: 1356350 - DNA, 15 bp, Homo sapiens
aactaaaatttgaag

SEQ ID NO: 1356351 - DNA, 13 bp, Homo sapiens
aactaaagcaata

SEQ ID NO: 1356352 - DNA, 22 bp, Homo sapiens
aactaaatttcactactagatt

SEQ ID NO: 1356353 - DNA, 17 bp, Homo sapiens
aactagggaagataata

SEQ ID NO: 1356354 - DNA, 24 bp, Homo sapiens
aactattgtgctcagagacactgt

SEQ ID NO: 1356355 - DNA, 13 bp, Homo sapiens
aactcaatgcttt

SEQ ID NO: 1356356 - DNA, 16 bp, Homo sapiens
aactcaatgctttatt

SEQ ID NO: 1356357 - DNA, 18 bp, Homo sapiens
aactcaggcaaagaaaat

SEQ ID NO: 1356358 - DNA, 14 bp, Homo sapiens
aactcatctgaaat

SEQ ID NO: 1356359 - DNA, 19 bp, Homo sapiens
aactcatctgaaatgttac

SEQ ID NO: 1356360 - DNA, 20 bp, Homo sapiens
aactcatctggagttctcaa

SEQ ID NO: 1356361 - DNA, 15 bp, Homo sapiens
aactccacatctgcc

SEQ ID NO: 1356362 - DNA, 17 bp, Homo sapiens
aagcaatagaaacaaca

SEQ ID NO: 1356363 - DNA, 13 bp, Homo sapiens
aagcaatggttga

SEQ ID NO: 1356364 - DNA, 18 bp, Homo sapiens
aagcacaccaatcttact

SEQ ID NO: 1356365 - DNA, 16 bp, Homo sapiens
aagcacagaatatttt

SEQ ID NO: 1356366 - DNA, 21 bp, Homo sapiens
aagcagaggaaggagaggaga

SEQ ID NO: 1356367 - DNA, 19 bp, Homo sapiens
aagcagaggaccagggcct

SEQ ID NO: 1356368 - DNA, 16 bp, Homo sapiens
aagcagcctctcccca

SEQ ID NO: 1356369 - DNA, 19 bp, Homo sapiens
aagcagtcgtgcctgtgtc

SEQ ID NO: 1356370 - DNA, 17 bp, Homo sapiens
aagcatactttgtaaat

SEQ ID NO: 1356371 - DNA, 20 bp, Homo sapiens
aagcatagataatattgttt

SEQ ID NO: 1356372 - DNA, 21 bp, Homo sapiens
aagcatagataatattgtttg

SEQ ID NO: 1356373 - DNA, 22 bp, Homo sapiens
aagcatagataatattgtttgg

SEQ ID NO: 1356374 - DNA, 14 bp, Homo sapiens
aagcatgaaatgtg

SEQ ID NO: 1356375 - DNA, 22 bp, Homo sapiens
aagcatgcttgtgaaaatgtgt

SEQ ID NO: 1356376 - DNA, 14 bp, Homo sapiens
aagccaaaattaag

SEQ ID NO: 1356377 - DNA, 23 bp, Homo sapiens
aagccaagggaaaggggtgcttt

SEQ ID NO: 1356378 - DNA, 19 bp, Homo sapiens
aagccaatctacaatctct

SEQ ID NO: 1356379 - DNA, 14 bp, Homo sapiens
aagccagaggctgg

SEQ ID NO: 1356380 - DNA, 16 bp, Homo sapiens
aagccaggctcactca

SEQ ID NO: 1356381 - DNA, 14 bp, Homo sapiens
aagcccatcctgac

SEQ ID NO: 1356382 - DNA, 19 bp, Homo sapiens
aagccctgagctttctgct

SEQ ID NO: 1356383 - DNA, 13 bp, Homo sapiens
aagccgtcctggc

SEQ ID NO: 1356384 - DNA, 21 bp, Homo sapiens
aagccgtgattttcattgctg

SEQ ID NO: 1356385 - DNA, 20 bp, Homo sapiens
aagcctagaagagcttctga

SEQ ID NO: 1356386 - DNA, 15 bp, Homo sapiens
aagcctccacagcga

SEQ ID NO: 1356387 - DNA, 17 bp, Homo sapiens
aagcctgtaacactcct

SEQ ID NO: 1356388 - DNA, 21 bp, Homo sapiens
aagcctgtaacactcctctgc

SEQ ID NO: 1356389 - DNA, 22 bp, Homo sapiens
aagccttcaaaactatagcttg

SEQ ID NO: 1356390 - DNA, 16 bp, Homo sapiens
aagccttcagctccag

SEQ ID NO: 1356391 - DNA, 11 bp, Homo sapiens
aagccttccta

SEQ ID NO: 1356392 - DNA, 22 bp, Homo sapiens
aagccttcgggcgtctgtgtgc

SEQ ID NO: 1356393 - DNA, 15 bp, Homo sapiens
aagcgtatggcttta

SEQ ID NO: 1356394 - DNA, 15 bp, Homo sapiens
agatcactgtttaga

SEQ ID NO: 1356395 - DNA, 19 bp, Homo sapiens
agatcactgtttagatttg

SEQ ID NO: 1356396 - DNA, 14 bp, Homo sapiens
agatcatagtttta

SEQ ID NO: 1356397 - DNA, 16 bp, Homo sapiens
agatcatagttttatt

SEQ ID NO: 1356398 - DNA, 19 bp, Homo sapiens
agatcatagttttatttat

SEQ ID NO: 1356399 - DNA, 18 bp, Homo sapiens
agatccatttccattgct

SEQ ID NO: 1356400 - DNA, 17 bp, Homo sapiens
agatcctgcgggtgggg

SEQ ID NO: 1356401 - DNA, 18 bp, Homo sapiens
agatcctgcgggtggggc

SEQ ID NO: 1356402 - DNA, 16 bp, Homo sapiens
agatctcggtttgcca

SEQ ID NO: 1356403 - DNA, 17 bp, Homo sapiens
agatctttcagaaatat

SEQ ID NO: 1356404 - DNA, 12 bp, Homo sapiens
agatgatgtatt

SEQ ID NO: 1356405 - DNA, 20 bp, Homo sapiens
agatgcaccaccaagccaag

SEQ ID NO: 1356406 - DNA, 21 bp, Homo sapiens
agatgcaccaccaagccaagg

SEQ ID NO: 1356407 - DNA, 19 bp, Homo sapiens
agatgctccagcaacacag

SEQ ID NO: 1356408 - DNA, 19 bp, Homo sapiens
agatgctgtgtatatggta

SEQ ID NO: 1356409 - DNA, 13 bp, Homo sapiens
agatgggaatgag

SEQ ID NO: 1356410 - DNA, 18 bp, Homo sapiens
agatgggaatgaggtggg

SEQ ID NO: 1356411 - DNA, 15 bp, Homo sapiens
agatgtgaaaattac

SEQ ID NO: 1356412 - DNA, 11 bp, Homo sapiens
agatgtgaatt

SEQ ID NO: 1356413 - DNA, 21 bp, Homo sapiens
agatgtgattaaagctaagga

SEQ ID NO: 1356414 - DNA, 22 bp, Homo sapiens
agatgttgatttttactgtgtt

SEQ ID NO: 1356415 - DNA, 17 bp, Homo sapiens
agatgttgccatgtgtt

SEQ ID NO: 1356416 - DNA, 18 bp, Homo sapiens
agattataataaatatat

SEQ ID NO: 1356417 - DNA, 13 bp, Homo sapiens
agattcttaattc

SEQ ID NO: 1356418 - DNA, 13 bp, Homo sapiens
agattcttctgtg

SEQ ID NO: 1356419 - DNA, 21 bp, Homo sapiens
agattctttcagttctttgga

SEQ ID NO: 1356420 - DNA, 17 bp, Homo sapiens
agattgactaactcaaa

SEQ ID NO: 1356421 - DNA, 20 bp, Homo sapiens
agattgatatctataaaata

SEQ ID NO: 1356422 - DNA, 16 bp, Homo sapiens
agattgcaccactgca

SEQ ID NO: 1356423 - DNA, 20 bp, Homo sapiens
agatttaatctgccaagggc

SEQ ID NO: 1356424 - DNA, 21 bp, Homo sapiens
agatttgccatagagtacact

SEQ ID NO: 1356425 - DNA, 17 bp, Homo sapiens
agattttcctcttgtga

SEQ ID NO: 1356426 - DNA, 13 bp, Homo sapiens
agatttttgcaat

SEQ ID NO: 1356427 - DNA, 22 bp, Homo sapiens
agcaaatgcaaaaactctttga

SEQ ID NO: 1356428 - DNA, 15 bp, Homo sapiens
agcaacacagcctgg

SEQ ID NO: 1356429 - DNA, 17 bp, Homo sapiens
agcaacacagcctgggc

SEQ ID NO: 1356430 - DNA, 15 bp, Homo sapiens
agcaacctacccagc

SEQ ID NO: 1356431 - DNA, 21 bp, Homo sapiens
agcaacttcttctccatccct

SEQ ID NO: 1356432 - DNA, 15 bp, Homo sapiens
agcaacttttgtgta

SEQ ID NO: 1356433 - DNA, 20 bp, Homo sapiens
agcaacttttgtgtaatgaa

SEQ ID NO: 1356434 - DNA, 14 bp, Homo sapiens
agcaataaatgaat

SEQ ID NO: 1356435 - DNA, 14 bp, Homo sapiens
agcaatagaaacaa

SEQ ID NO: 1356436 - DNA, 22 bp, Homo sapiens
agcaatcaaggttataattttt

SEQ ID NO: 1356437 - DNA, 18 bp, Homo sapiens
agcaatctcttcattatt

SEQ ID NO: 1356438 - DNA, 19 bp, Homo sapiens
agcacaccaatcttacttt

SEQ ID NO: 1356439 - DNA, 16 bp, Homo sapiens
agcacatatggaattt

SEQ ID NO: 1356440 - DNA, 16 bp, Homo sapiens
agcacctcagcctgca

SEQ ID NO: 1356441 - DNA, 17 bp, Homo sapiens
agcaccttgtgcctggg

SEQ ID NO: 1356442 - DNA, 18 bp, Homo sapiens
agcactacaccttgcctt

SEQ ID NO: 1356443 - DNA, 18 bp, Homo sapiens
agcactgggctcccgggc

SEQ ID NO: 1356444 - DNA, 20 bp, Homo sapiens
agcactttgggaggccgagg

SEQ ID NO: 1356445 - DNA, 13 bp, Homo sapiens
agcacttttcaaa

SEQ ID NO: 1356446 - DNA, 23 bp, Homo sapiens
agcagaaaaaggctgtgctgccc

SEQ ID NO: 1356447 - DNA, 17 bp, Homo sapiens
agcagaggaaggagagg

SEQ ID NO: 1356448 - DNA, 13 bp, Homo sapiens
agcagagttttca

SEQ ID NO: 1356449 - DNA, 13 bp, Homo sapiens
agcagcagcaggt

SEQ ID NO: 1356450 - DNA, 16 bp, Homo sapiens
agcagcagcaggtgat

SEQ ID NO: 1356451 - DNA, 12 bp, Homo sapiens
agcagcccaccc

SEQ ID NO: 1356452 - DNA, 14 bp, Homo sapiens
agcagcccaccctg

SEQ ID NO: 1356453 - DNA, 15 bp, Homo sapiens
agcagcttattgttt

SEQ ID NO: 1356454 - DNA, 22 bp, Homo sapiens
agcaggtgattggaccaggcca

SEQ ID NO: 1356455 - DNA, 23 bp, Homo sapiens
agcaggtgattggaccaggccat

SEQ ID NO: 1356456 - DNA, 12 bp, Homo sapiens
agcagtattttt

SEQ ID NO: 1356457 - DNA, 17 bp, Homo sapiens
agcagtcgtgcctgtgt

SEQ ID NO: 1356458 - DNA, 19 bp, Homo sapiens
agcagtggccttattgcat

SEQ ID NO: 1356459 - DNA, 16 bp, Homo sapiens
agcagttgctggtaaa

SEQ ID NO: 1356460 - DNA, 17 bp, Homo sapiens
agcataatttaaaaata

SEQ ID NO: 1356461 - DNA, 21 bp, Homo sapiens
agcataatttaaaaatatatt

SEQ ID NO: 1356462 - DNA, 21 bp, Homo sapiens
agcatactggcttcaccatca

SEQ ID NO: 1356463 - DNA, 15 bp, Homo sapiens
agcatacttctagga

SEQ ID NO: 1356464 - DNA, 13 bp, Homo sapiens
agcatactttgta

SEQ ID NO: 1356465 - DNA, 17 bp, Homo sapiens
agcatactttgtaaata

SEQ ID NO: 1356466 - DNA, 18 bp, Homo sapiens
agcatcacttaaaacacg

SEQ ID NO: 1356467 - DNA, 22 bp, Homo sapiens
agcatcacttaaaacacgtttt

SEQ ID NO: 1356468 - DNA, 23 bp, Homo sapiens
agcatctggaagatcattttgaa

SEQ ID NO: 1356469 - DNA, 17 bp, Homo sapiens
agcatgaaataaaatat

SEQ ID NO: 1356470 - DNA, 14 bp, Homo sapiens
agcatgaaatgtga

SEQ ID NO: 1356471 - DNA, 20 bp, Homo sapiens
agcattaagctgttcctgtt

SEQ ID NO: 1356472 - DNA, 22 bp, Homo sapiens
agcattttgctaaatgtgaatg

SEQ ID NO: 1356473 - DNA, 22 bp, Homo sapiens
agcatttttcaatatattgaac

SEQ ID NO: 1356474 - DNA, 23 bp, Homo sapiens
agcatttttcaatatattgaact

SEQ ID NO: 1356475 - DNA, 15 bp, Homo sapiens
agccaaaattaaggt

SEQ ID NO: 1356476 - DNA, 23 bp, Homo sapiens
agccaaggccctgagttggcagt

SEQ ID NO: 1356477 - DNA, 14 bp, Homo sapiens
agccaagggaaagg

SEQ ID NO: 1356478 - DNA, 23 bp, Homo sapiens
agccaagggaaaggggtgctttt

SEQ ID NO: 1356479 - DNA, 19 bp, Homo sapiens
agccaagggaacctgtgtc

SEQ ID NO: 1356480 - DNA, 21 bp, Homo sapiens
agccaagggaacctgtgtccg

SEQ ID NO: 1356481 - DNA, 22 bp, Homo sapiens
agccaaggttttataaggctga

SEQ ID NO: 1356482 - DNA, 20 bp, Homo sapiens
agccaatgtctcctcccctt

SEQ ID NO: 1356483 - DNA, 11 bp, Homo sapiens
agccagaggct

SEQ ID NO: 1356484 - DNA, 14 bp, Homo sapiens
agccagcacctggc

SEQ ID NO: 1356485 - DNA, 15 bp, Homo sapiens
agccagcacctggca

SEQ ID NO: 1356486 - DNA, 12 bp, Homo sapiens
agccagcgcctc

SEQ ID NO: 1356487 - DNA, 14 bp, Homo sapiens
agccagcgcctccc

SEQ ID NO: 1356488 - DNA, 15 bp, Homo sapiens
agccagctccctcta

SEQ ID NO: 1356489 - DNA, 16 bp, Homo sapiens
agccatacataaaaga

SEQ ID NO: 1356490 - DNA, 17 bp, Homo sapiens
agccatacataaaagaa

SEQ ID NO: 1356491 - DNA, 14 bp, Homo sapiens
agccatgccagctg

SEQ ID NO: 1356492 - DNA, 12 bp, Homo sapiens
agcccaccctgc

SEQ ID NO: 1356493 - DNA, 14 bp, Homo sapiens
agcccaccctgctg

SEQ ID NO: 1356494 - DNA, 19 bp, Homo sapiens
agcccaccctgctgctggt

SEQ ID NO: 1356495 - DNA, 20 bp, Homo sapiens
agcccagagactttgtagat

SEQ ID NO: 1356496 - DNA, 12 bp, Homo sapiens
agcccaggagcc

SEQ ID NO: 1356497 - DNA, 15 bp, Homo sapiens
agcccaggagcctca

SEQ ID NO: 1356498 - DNA, 17 bp, Homo sapiens
agcccaggagcctcact

SEQ ID NO: 1356499 - DNA, 15 bp, Homo sapiens
agcccagggctcctg

SEQ ID NO: 1356500 - DNA, 16 bp, Homo sapiens
agcccagggctcctgc

SEQ ID NO: 1356501 - DNA, 15 bp, Homo sapiens
agcccatcctgacca

SEQ ID NO: 1356502 - DNA, 17 bp, Homo sapiens
agcccatcctgaccagc

SEQ ID NO: 1356503 - DNA, 13 bp, Homo sapiens
agccccagcctgc

SEQ ID NO: 1356504 - DNA, 19 bp, Homo sapiens
agccccctggcctctgtgc

SEQ ID NO: 1356505 - DNA, 18 bp, Homo sapiens
agccccctggtctttgag

SEQ ID NO: 1356506 - DNA, 22 bp, Homo sapiens
agccccctggtctttgagctcc

SEQ ID NO: 1356507 - DNA, 17 bp, Homo sapiens
agccccgactccagcca

SEQ ID NO: 1356508 - DNA, 13 bp, Homo sapiens
agcccctctggtc

SEQ ID NO: 1356509 - DNA, 17 bp, Homo sapiens
agccctaaccccttcca

SEQ ID NO: 1356510 - DNA, 18 bp, Homo sapiens
agccctaaccccttccag

SEQ ID NO: 1356511 - DNA, 17 bp, Homo sapiens
agccctaaggtcctaag

SEQ ID NO: 1356512 - DNA, 20 bp, Homo sapiens
agccctactccctgcagatg

SEQ ID NO: 1356513 - DNA, 12 bp, Homo sapiens
agccctcccact

SEQ ID NO: 1356514 - DNA, 13 bp, Homo sapiens
agccctcccactt

SEQ ID NO: 1356515 - DNA, 21 bp, Homo sapiens
actttgtatagttatgtaaat

SEQ ID NO: 1356516 - DNA, 23 bp, Homo sapiens
actttgtatagttatgtaaataa

SEQ ID NO: 1356517 - DNA, 24 bp, Homo sapiens
actttgtattgtcctattagtgtt

SEQ ID NO: 1356518 - DNA, 20 bp, Homo sapiens
actttgttaggattttcaca

SEQ ID NO: 1356519 - DNA, 20 bp, Homo sapiens
actttgtttcgtggggaggt

SEQ ID NO: 1356520 - DNA, 14 bp, Homo sapiens
acttttataaagca

SEQ ID NO: 1356521 - DNA, 20 bp, Homo sapiens
acttttattttacacagaaa

SEQ ID NO: 1356522 - DNA, 18 bp, Homo sapiens
acttttctagaattattt

SEQ ID NO: 1356523 - DNA, 17 bp, Homo sapiens
actttttagtaatttct

SEQ ID NO: 1356524 - DNA, 18 bp, Homo sapiens
acttttttaaatattttc

SEQ ID NO: 1356525 - DNA, 19 bp, Homo sapiens
acttttttaaatattttct

SEQ ID NO: 1356526 - DNA, 17 bp, Homo sapiens
actttttttgtatgtgt

SEQ ID NO: 1356527 - DNA, 13 bp, Homo sapiens
agaaaaagaaatg

SEQ ID NO: 1356528 - DNA, 15 bp, Homo sapiens
agaaaaataaccctt

SEQ ID NO: 1356529 - DNA, 18 bp, Homo sapiens
agaaaaatgagcctggca

SEQ ID NO: 1356530 - DNA, 14 bp, Homo sapiens
agaaaactgtgatt

SEQ ID NO: 1356531 - DNA, 11 bp, Homo sapiens
agaaaatgtga

SEQ ID NO: 1356532 - DNA, 13 bp, Homo sapiens
agaaaattgagtt

SEQ ID NO: 1356533 - DNA, 20 bp, Homo sapiens
agaaacttaaatgttattat

SEQ ID NO: 1356534 - DNA, 22 bp, Homo sapiens
agaaacttatttctcatatcaa

SEQ ID NO: 1356535 - DNA, 12 bp, Homo sapiens
agaaagagctac

SEQ ID NO: 1356536 - DNA, 15 bp, Homo sapiens
agaaagagctacctg

SEQ ID NO: 1356537 - DNA, 15 bp, Homo sapiens
agaaagtgaagcaaa

SEQ ID NO: 1356538 - DNA, 23 bp, Homo sapiens
agaaagtgaagcaaatcagaaac

SEQ ID NO: 1356539 - DNA, 17 bp, Homo sapiens
agaaagtgtgagcaaac

SEQ ID NO: 1356540 - DNA, 23 bp, Homo sapiens
agaaagtgtgagcaaactaactt

SEQ ID NO: 1356541 - DNA, 13 bp, Homo sapiens
agaaataaaccaa

SEQ ID NO: 1356542 - DNA, 14 bp, Homo sapiens
agaaataaaccaaa

SEQ ID NO: 1356543 - DNA, 19 bp, Homo sapiens
agaaataatgctacaattt

SEQ ID NO: 1356544 - DNA, 18 bp, Homo sapiens
agaaatataacacatttt

SEQ ID NO: 1356545 - DNA, 16 bp, Homo sapiens
agaaatcatgtccata

SEQ ID NO: 1356546 - DNA, 22 bp, Homo sapiens
agaaatgaggaggatgctaaaa

SEQ ID NO: 1356547 - DNA, 18 bp, Homo sapiens
agaaatgatgttggagaa

SEQ ID NO: 1356548 - DNA, 16 bp, Homo sapiens
agaaatgtataaactt

SEQ ID NO: 1356549 - DNA, 14 bp, Homo sapiens
agaaattgtatatt

SEQ ID NO: 1356550 - DNA, 13 bp, Homo sapiens
agaaattttcaag

SEQ ID NO: 1356551 - DNA, 17 bp, Homo sapiens
agaaattttgtaagaag

SEQ ID NO: 1356552 - DNA, 21 bp, Homo sapiens
agaaattttgtaagaaggcaa

SEQ ID NO: 1356553 - DNA, 18 bp, Homo sapiens
agaacactaactcaccag

SEQ ID NO: 1356554 - DNA, 17 bp, Homo sapiens
agaacaggcctctccat

SEQ ID NO: 1356555 - DNA, 13 bp, Homo sapiens
agaaccactatga

SEQ ID NO: 1356556 - DNA, 13 bp, Homo sapiens
agaacctaacatg

SEQ ID NO: 1356557 - DNA, 14 bp, Homo sapiens
agaactcactgggg

SEQ ID NO: 1356558 - DNA, 16 bp, Homo sapiens
agaactcactggggcc

SEQ ID NO: 1356559 - DNA, 20 bp, Homo sapiens
agaactcgcgctcagtaaac

SEQ ID NO: 1356560 - DNA, 18 bp, Homo sapiens
agaactgcaggccctggc

SEQ ID NO: 1356561 - DNA, 18 bp, Homo sapiens
agaacttgaatgtgtcag

SEQ ID NO: 1356562 - DNA, 12 bp, Homo sapiens
agaagacaaaat

SEQ ID NO: 1356563 - DNA, 12 bp, Homo sapiens
agaagagcgcag

SEQ ID NO: 1356564 - DNA, 14 bp, Homo sapiens
agaagagcgcagtg

SEQ ID NO: 1356565 - DNA, 21 bp, Homo sapiens
agaagcacagaatatttttat

SEQ ID NO: 1356566 - DNA, 17 bp, Homo sapiens
agaagcatgaagtctta

SEQ ID NO: 1356567 - DNA, 18 bp, Homo sapiens
agaagccaagggaaaggg

SEQ ID NO: 1356568 - DNA, 20 bp, Homo sapiens
agaagcccgtgtgagaagtg

SEQ ID NO: 1356569 - DNA, 21 bp, Homo sapiens
agaagccgagagccttttgtg

SEQ ID NO: 1356570 - DNA, 18 bp, Homo sapiens
agaagcctgtaacactcc

SEQ ID NO: 1356571 - DNA, 22 bp, Homo sapiens
agaagcctgtaacactcctctg

SEQ ID NO: 1356572 - DNA, 13 bp, Homo sapiens
agaagccttcagc

SEQ ID NO: 1356573 - DNA, 17 bp, Homo sapiens
agaagccttcagctcca

SEQ ID NO: 1356574 - DNA, 13 bp, Homo sapiens
agaagctgcaggc

SEQ ID NO: 1356575 - DNA, 23 bp, Homo sapiens
agaagctgccaggtgagaaactg

SEQ ID NO: 1356576 - DNA, 15 bp, Homo sapiens
agaagggagaagaaa

SEQ ID NO: 1356577 - DNA, 14 bp, Homo sapiens
agaagtaacttact

SEQ ID NO: 1356578 - DNA, 15 bp, Homo sapiens
agaagtatttttaga

SEQ ID NO: 1356579 - DNA, 19 bp, Homo sapiens
agaagtatttttagaataa

SEQ ID NO: 1356580 - DNA, 21 bp, Homo sapiens
agaagtatttttagaataaga

SEQ ID NO: 1356581 - DNA, 19 bp, Homo sapiens
agaagtgaatgctgggact

SEQ ID NO: 1356582 - DNA, 15 bp, Homo sapiens
agaagttagtttgta

SEQ ID NO: 1356583 - DNA, 23 bp, Homo sapiens
agaagttattttctacagtggtt

SEQ ID NO: 1356584 - DNA, 21 bp, Homo sapiens
agaagtttggctgctgtcata

SEQ ID NO: 1356585 - DNA, 14 bp, Homo sapiens
agaataagttattg

SEQ ID NO: 1356586 - DNA, 19 bp, Homo sapiens
agaataagttattgcagtt

SEQ ID NO: 1356587 - DNA, 20 bp, Homo sapiens
agaataagttattgcagttt

SEQ ID NO: 1356588 - DNA, 18 bp, Homo sapiens
agaataccacatcaaata

SEQ ID NO: 1356589 - DNA, 22 bp, Homo sapiens
aatgaaaacagtgtgtaaacaa

SEQ ID NO: 1356590 - DNA, 13 bp, Homo sapiens
aatgaaaattgta

SEQ ID NO: 1356591 - DNA, 17 bp, Homo sapiens
aatgaaaattgtattat

SEQ ID NO: 1356592 - DNA, 13 bp, Homo sapiens
aatgaaagaaaat

SEQ ID NO: 1356593 - DNA, 16 bp, Homo sapiens
aatgaaagctgttcct

SEQ ID NO: 1356594 - DNA, 17 bp, Homo sapiens
aatgaaccataaattca

SEQ ID NO: 1356595 - DNA, 15 bp, Homo sapiens
aatgaagaatttaaa

SEQ ID NO: 1356596 - DNA, 16 bp, Homo sapiens
aatgaagaatttaaag

SEQ ID NO: 1356597 - DNA, 17 bp, Homo sapiens
aatgaagaatttaaaga

SEQ ID NO: 1356598 - DNA, 18 bp, Homo sapiens
aatgaatatctattaata

SEQ ID NO: 1356599 - DNA, 20 bp, Homo sapiens
aatgaatatctattaatata

SEQ ID NO: 1356600 - DNA, 17 bp, Homo sapiens
aatgaatttttatgata

SEQ ID NO: 1356601 - DNA, 15 bp, Homo sapiens
aatgactatataatt

SEQ ID NO: 1356602 - DNA, 21 bp, Homo sapiens
aatgactatataatttatttc

SEQ ID NO: 1356603 - DNA, 13 bp, Homo sapiens
aatgactttatta

SEQ ID NO: 1356604 - DNA, 15 bp, Homo sapiens
aatgactttattatt

SEQ ID NO: 1356605 - DNA, 12 bp, Homo sapiens
aatgagagcata

SEQ ID NO: 1356606 - DNA, 14 bp, Homo sapiens
aatgagcctggcaa

SEQ ID NO: 1356607 - DNA, 17 bp, Homo sapiens
aatgaggaaaattctta

SEQ ID NO: 1356608 - DNA, 23 bp, Homo sapiens
aatgaggtgggaggtggaagaag

SEQ ID NO: 1356609 - DNA, 19 bp, Homo sapiens
aatgatgacaaaaaatgtt

SEQ ID NO: 1356610 - DNA, 15 bp, Homo sapiens
aatgatgtgcaaaac

SEQ ID NO: 1356611 - DNA, 21 bp, Homo sapiens
aatgcaatgtaagcatacttt

SEQ ID NO: 1356612 - DNA, 11 bp, Homo sapiens
aatgcactttc

SEQ ID NO: 1356613 - DNA, 13 bp, Homo sapiens
aatgcactttcta

SEQ ID NO: 1356614 - DNA, 16 bp, Homo sapiens
aatgcagtttcttcat

SEQ ID NO: 1356615 - DNA, 14 bp, Homo sapiens
aatgcatatttgca

SEQ ID NO: 1356616 - DNA, 23 bp, Homo sapiens
aatgcatatttgcaaagtgtatt

SEQ ID NO: 1356617 - DNA, 15 bp, Homo sapiens
aatgcatctttgatg

SEQ ID NO: 1356618 - DNA, 18 bp, Homo sapiens
aatgcatctttgatgtgt

SEQ ID NO: 1356619 - DNA, 22 bp, Homo sapiens
aatgccactgccttcgcttctt

SEQ ID NO: 1356620 - DNA, 17 bp, Homo sapiens
aatgccatctatctagt

SEQ ID NO: 1356621 - DNA, 16 bp, Homo sapiens
aatgctatttgaacaa

SEQ ID NO: 1356622 - DNA, 17 bp, Homo sapiens
aatgctttatttgtaaa

SEQ ID NO: 1356623 - DNA, 21 bp, Homo sapiens
aatgctttatttgtaaattta

SEQ ID NO: 1356624 - DNA, 15 bp, Homo sapiens
aatgctttccaaaac

SEQ ID NO: 1356625 - DNA, 15 bp, Homo sapiens
aatggaaattttgct

SEQ ID NO: 1356626 - DNA, 22 bp, Homo sapiens
aatggaataaaaggcttgaagc

SEQ ID NO: 1356627 - DNA, 17 bp, Homo sapiens
aatggagaagctgcagg

SEQ ID NO: 1356628 - DNA, 20 bp, Homo sapiens
aatggaggatctctaaagag

SEQ ID NO: 1356629 - DNA, 15 bp, Homo sapiens
aatggcctcatgtgg

SEQ ID NO: 1356630 - DNA, 20 bp, Homo sapiens
aatggcctcatgtggctgga

SEQ ID NO: 1356631 - DNA, 14 bp, Homo sapiens
aatgggacctgtgg

SEQ ID NO: 1356632 - DNA, 16 bp, Homo sapiens
aatgggtttttccctg

SEQ ID NO: 1356633 - DNA, 12 bp, Homo sapiens
aatggtagtttc

SEQ ID NO: 1356634 - DNA, 14 bp, Homo sapiens
aatggtagtttctg

SEQ ID NO: 1356635 - DNA, 22 bp, Homo sapiens
aatggtcacgtttggtgcttct

SEQ ID NO: 1356636 - DNA, 23 bp, Homo sapiens
aatggtcacgtttggtgcttctc

SEQ ID NO: 1356637 - DNA, 22 bp, Homo sapiens
aatggtgtgaacccgggagcgg

SEQ ID NO: 1356638 - DNA, 15 bp, Homo sapiens
aatgtaagtgggccc

SEQ ID NO: 1356639 - DNA, 17 bp, Homo sapiens
aatgtaatttaaatgaa

SEQ ID NO: 1356640 - DNA, 19 bp, Homo sapiens
aatgtaggcttagtttgtg

SEQ ID NO: 1356641 - DNA, 22 bp, Homo sapiens
aatgtaggcttagtttgtgtgt

SEQ ID NO: 1356642 - DNA, 14 bp, Homo sapiens
aatgtatttttcct

SEQ ID NO: 1356643 - DNA, 15 bp, Homo sapiens
aatgtcaaaagtaga

SEQ ID NO: 1356644 - DNA, 17 bp, Homo sapiens
aatgtccagtaagatca

SEQ ID NO: 1356645 - DNA, 15 bp, Homo sapiens
aatgtccatatgcta

SEQ ID NO: 1356646 - DNA, 13 bp, Homo sapiens
aatgtctcctccc

SEQ ID NO: 1356647 - DNA, 18 bp, Homo sapiens
aatgtctgtaataataga

SEQ ID NO: 1356648 - DNA, 18 bp, Homo sapiens
aatgtgaatttttattgt

SEQ ID NO: 1356649 - DNA, 20 bp, Homo sapiens
aatgtgaatttttattgttg

SEQ ID NO: 1356650 - DNA, 15 bp, Homo sapiens
aatgtgagaagccag

SEQ ID NO: 1356651 - DNA, 22 bp, Homo sapiens
aatgtgagtggttgaatatgat

SEQ ID NO: 1356652 - DNA, 23 bp, Homo sapiens
aatgtgtggattgcctctgaaaa

SEQ ID NO: 1356653 - DNA, 19 bp, Homo sapiens
aatgtgttctcggagtgtg

SEQ ID NO: 1356654 - DNA, 21 bp, Homo sapiens
aatgttaatggatttcagaag

SEQ ID NO: 1356655 - DNA, 22 bp, Homo sapiens
aatgttcctcaaagcttggatt

SEQ ID NO: 1356656 - DNA, 21 bp, Homo sapiens
aatgttctctcttctccacct

SEQ ID NO: 1356657 - DNA, 21 bp, Homo sapiens
aatgttgggactgctaaataa

SEQ ID NO: 1356658 - DNA, 14 bp, Homo sapiens
aatgttgtagtgtc

SEQ ID NO: 1356659 - DNA, 12 bp, Homo sapiens
aatgttttgtaa

SEQ ID NO: 1356660 - DNA, 14 bp, Homo sapiens
aattaaattaggaa

SEQ ID NO: 1356661 - DNA, 22 bp, Homo sapiens
aattaagcaaatgttaaaagtt

SEQ ID NO: 1356662 - DNA, 19 bp, Homo sapiens
aattaagccctaaggtcct

SEQ ID NO: 1356663 - DNA, 14 bp, Homo sapiens
accactcgtgcatc

SEQ ID NO: 1356664 - DNA, 20 bp, Homo sapiens
accactgcactccagcctgg

SEQ ID NO: 1356665 - DNA, 13 bp, Homo sapiens
accacttcagctg

SEQ ID NO: 1356666 - DNA, 14 bp, Homo sapiens
accacttcagctga

SEQ ID NO: 1356667 - DNA, 14 bp, Homo sapiens
accacttgtagatt

SEQ ID NO: 1356668 - DNA, 19 bp, Homo sapiens
accacttgtagatttgatt

SEQ ID NO: 1356669 - DNA, 23 bp, Homo sapiens
accagacctggaagaacaggcct

SEQ ID NO: 1356670 - DNA, 14 bp, Homo sapiens
accagaggagcctt

SEQ ID NO: 1356671 - DNA, 16 bp, Homo sapiens
accagaggagcctttt

SEQ ID NO: 1356672 - DNA, 14 bp, Homo sapiens
accagcagcctgga

SEQ ID NO: 1356673 - DNA, 19 bp, Homo sapiens
accagcatcacctgcctgt

SEQ ID NO: 1356674 - DNA, 18 bp, Homo sapiens
accagccccactgccagc

SEQ ID NO: 1356675 - DNA, 23 bp, Homo sapiens
accagctgaagttgcagatgtta

SEQ ID NO: 1356676 - DNA, 19 bp, Homo sapiens
accagctgcgcttgctttt

SEQ ID NO: 1356677 - DNA, 12 bp, Homo sapiens
accaggaagccg

SEQ ID NO: 1356678 - DNA, 17 bp, Homo sapiens
accaggcacctcttcct

SEQ ID NO: 1356679 - DNA, 13 bp, Homo sapiens
accagggcctttt

SEQ ID NO: 1356680 - DNA, 16 bp, Homo sapiens
accagggccttttctg

SEQ ID NO: 1356681 - DNA, 22 bp, Homo sapiens
accataaattcaactttgtaaa

SEQ ID NO: 1356682 - DNA, 16 bp, Homo sapiens
accatcaatcctgatt

SEQ ID NO: 1356683 - DNA, 13 bp, Homo sapiens
accatcctggcta

SEQ ID NO: 1356684 - DNA, 18 bp, Homo sapiens
accatcctgtattcttca

SEQ ID NO: 1356685 - DNA, 23 bp, Homo sapiens
accatgattaaccacttcagctg

SEQ ID NO: 1356686 - DNA, 20 bp, Homo sapiens
accatgcctcactaattttt

SEQ ID NO: 1356687 - DNA, 24 bp, Homo sapiens
accattctgactcggtttctccaa

SEQ ID NO: 1356688 - DNA, 17 bp, Homo sapiens
accattttttaatttac

SEQ ID NO: 1356689 - DNA, 20 bp, Homo sapiens
acccaaccctatctcctgac

SEQ ID NO: 1356690 - DNA, 15 bp, Homo sapiens
acccaagcttagaac

SEQ ID NO: 1356691 - DNA, 13 bp, Homo sapiens
acccaggaggcag

SEQ ID NO: 1356692 - DNA, 22 bp, Homo sapiens
acccagggttcccgcggggctg

SEQ ID NO: 1356693 - DNA, 18 bp, Homo sapiens
acccagtgcagaatgtaa

SEQ ID NO: 1356694 - DNA, 22 bp, Homo sapiens
acccattaaggggaagaatgaa

SEQ ID NO: 1356695 - DNA, 16 bp, Homo sapiens
accccaagagaactcg

SEQ ID NO: 1356696 - DNA, 21 bp, Homo sapiens
accccaagccagcccggccgc

SEQ ID NO: 1356697 - DNA, 17 bp, Homo sapiens
accccaggacgccactc

SEQ ID NO: 1356698 - DNA, 21 bp, Homo sapiens
accccaggacgccactcattt

SEQ ID NO: 1356699 - DNA, 23 bp, Homo sapiens
accccaggacgccactcatttca

SEQ ID NO: 1356700 - DNA, 12 bp, Homo sapiens
acccccagcccc

SEQ ID NO: 1356701 - DNA, 22 bp, Homo sapiens
acccccagccccgactccagcc

SEQ ID NO: 1356702 - DNA, 13 bp, Homo sapiens
accccctcccacc

SEQ ID NO: 1356703 - DNA, 11 bp, Homo sapiens
accccctcctt

SEQ ID NO: 1356704 - DNA, 15 bp, Homo sapiens
accccctgccctgca

SEQ ID NO: 1356705 - DNA, 15 bp, Homo sapiens
accccgcagacacct

SEQ ID NO: 1356706 - DNA, 17 bp, Homo sapiens
accccggggaccctgtg

SEQ ID NO: 1356707 - DNA, 19 bp, Homo sapiens
accccggtggcggccccag

SEQ ID NO: 1356708 - DNA, 10 bp, Homo sapiens
acccctgccc

SEQ ID NO: 1356709 - DNA, 13 bp, Homo sapiens
acccctgccccca

SEQ ID NO: 1356710 - DNA, 13 bp, Homo sapiens
accccttccagat

SEQ ID NO: 1356711 - DNA, 15 bp, Homo sapiens
accccttccagatca

SEQ ID NO: 1356712 - DNA, 21 bp, Homo sapiens
acccgaccccccgtgggctcc

SEQ ID NO: 1356713 - DNA, 14 bp, Homo sapiens
acccggaggccgag

SEQ ID NO: 1356714 - DNA, 14 bp, Homo sapiens
acccggctgcagag

SEQ ID NO: 1356715 - DNA, 22 bp, Homo sapiens
acccgggaacctccccagcctg

SEQ ID NO: 1356716 - DNA, 22 bp, Homo sapiens
acccggggcccagggcaagctc

SEQ ID NO: 1356717 - DNA, 19 bp, Homo sapiens
accctagccaatgtctcct

SEQ ID NO: 1356718 - DNA, 21 bp, Homo sapiens
accctcaacctcttctggctc

SEQ ID NO: 1356719 - DNA, 23 bp, Homo sapiens
accctccaaatggagaagctgca

SEQ ID NO: 1356720 - DNA, 13 bp, Homo sapiens
accctcgccggac

SEQ ID NO: 1356721 - DNA, 19 bp, Homo sapiens
accttcccaaacgcctccc

SEQ ID NO: 1356722 - DNA, 22 bp, Homo sapiens
accttcccaaacgcctcccctg

SEQ ID NO: 1356723 - DNA, 19 bp, Homo sapiens
accttggacatcctcctcc

SEQ ID NO: 1356724 - DNA, 14 bp, Homo sapiens
accttggcctgggc

SEQ ID NO: 1356725 - DNA, 12 bp, Homo sapiens
accttgtgcctg

SEQ ID NO: 1356726 - DNA, 15 bp, Homo sapiens
accttgttacttctg

SEQ ID NO: 1356727 - DNA, 21 bp, Homo sapiens
acctttagaaactcaaaaact

SEQ ID NO: 1356728 - DNA, 24 bp, Homo sapiens
accttttactggttgcatggaaat

SEQ ID NO: 1356729 - DNA, 16 bp, Homo sapiens
accttttactgtgatg

SEQ ID NO: 1356730 - DNA, 24 bp, Homo sapiens
acctttttttatcgtttttgtatt

SEQ ID NO: 1356731 - DNA, 18 bp, Homo sapiens
acgaatagacatcaaact

SEQ ID NO: 1356732 - DNA, 18 bp, Homo sapiens
acgaatatggacatatca

SEQ ID NO: 1356733 - DNA, 14 bp, Homo sapiens
acgagaccccggct

SEQ ID NO: 1356734 - DNA, 18 bp, Homo sapiens
acgaggggtgtcttgggc

SEQ ID NO: 1356735 - DNA, 21 bp, Homo sapiens
acgaggggtgtcttgggcaga

SEQ ID NO: 1356736 - DNA, 14 bp, Homo sapiens
acgatcacaaatga

SEQ ID NO: 1356737 - DNA, 15 bp, Homo sapiens
acgatcacaaatgac

SEQ ID NO: 1356738 - DNA, 17 bp, Homo sapiens
acgccactcatttcatc

SEQ ID NO: 1356739 - DNA, 21 bp, Homo sapiens
acgccactcatttcatctcat

SEQ ID NO: 1356740 - DNA, 23 bp, Homo sapiens
acgccaggggaaaatcagcctgc

SEQ ID NO: 1356741 - DNA, 19 bp, Homo sapiens
acgccatgtgatggacact

SEQ ID NO: 1356742 - DNA, 19 bp, Homo sapiens
acgcccgtcctgcctgtgg

SEQ ID NO: 1356743 - DNA, 20 bp, Homo sapiens
acgcccgtcctgcctgtggc

SEQ ID NO: 1356744 - DNA, 21 bp, Homo sapiens
acgcctgtaatcccagcactt

SEQ ID NO: 1356745 - DNA, 20 bp, Homo sapiens
acgcgtatctaggctttggt

SEQ ID NO: 1356746 - DNA, 16 bp, Homo sapiens
acgcgtgccgtggcac

SEQ ID NO: 1356747 - DNA, 16 bp, Homo sapiens
acgctaaagagccctt

SEQ ID NO: 1356748 - DNA, 20 bp, Homo sapiens
acgctaaagagcccttgcct

SEQ ID NO: 1356749 - DNA, 13 bp, Homo sapiens
acgctccgctgcc

SEQ ID NO: 1356750 - DNA, 22 bp, Homo sapiens
acggcaggctcactgccaggcc

SEQ ID NO: 1356751 - DNA, 15 bp, Homo sapiens
acggccaagaatgta

SEQ ID NO: 1356752 - DNA, 18 bp, Homo sapiens
acggcttttacttaaacc

SEQ ID NO: 1356753 - DNA, 19 bp, Homo sapiens
acgggacatcacagggtgg

SEQ ID NO: 1356754 - DNA, 13 bp, Homo sapiens
acgggtggtcccc

SEQ ID NO: 1356755 - DNA, 14 bp, Homo sapiens
acgggtggtccccg

SEQ ID NO: 1356756 - DNA, 14 bp, Homo sapiens
acggtgcccaagcc

SEQ ID NO: 1356757 - DNA, 21 bp, Homo sapiens
acggtggtcggtgggaccctg

SEQ ID NO: 1356758 - DNA, 15 bp, Homo sapiens
acgtacaagtagttc

SEQ ID NO: 1356759 - DNA, 18 bp, Homo sapiens
acgtacaagtagttctgt

SEQ ID NO: 1356760 - DNA, 21 bp, Homo sapiens
acgtacaagtagttctgtatt

SEQ ID NO: 1356761 - DNA, 24 bp, Homo sapiens
acgtacaagtagttctgtatttga

SEQ ID NO: 1356762 - DNA, 17 bp, Homo sapiens
acgtcagacttggctca

SEQ ID NO: 1356763 - DNA, 18 bp, Homo sapiens
acgtcatgtatttgagca

SEQ ID NO: 1356764 - DNA, 20 bp, Homo sapiens
acgtggccatgtatgaagcc

SEQ ID NO: 1356765 - DNA, 10 bp, Homo sapiens
acgtttcttt

SEQ ID NO: 1356766 - DNA, 12 bp, Homo sapiens
acgtttctttaa

SEQ ID NO: 1356767 - DNA, 14 bp, Homo sapiens
acgttttaaggact

SEQ ID NO: 1356768 - DNA, 21 bp, Homo sapiens
actaaaaatattgtttctgca

SEQ ID NO: 1356769 - DNA, 18 bp, Homo sapiens
actaactcaaatacacat

SEQ ID NO: 1356770 - DNA, 17 bp, Homo sapiens
actaacttgacttttaa

SEQ ID NO: 1356771 - DNA, 18 bp, Homo sapiens
actaagaattcaaactgg

SEQ ID NO: 1356772 - DNA, 17 bp, Homo sapiens
actaagagaagttgtaa

SEQ ID NO: 1356773 - DNA, 15 bp, Homo sapiens
actaatgcaaactgg

SEQ ID NO: 1356774 - DNA, 21 bp, Homo sapiens
actaattttacatgtttataa

SEQ ID NO: 1356775 - DNA, 19 bp, Homo sapiens
actaatttttgtattattt

SEQ ID NO: 1356776 - DNA, 23 bp, Homo sapiens
actacagaaatgaggaggatgct

SEQ ID NO: 1356777 - DNA, 18 bp, Homo sapiens
actacctgtatttaaaaa

SEQ ID NO: 1356778 - DNA, 19 bp, Homo sapiens
actactttgttaggatttt

SEQ ID NO: 1356779 - DNA, 13 bp, Homo sapiens
actagcaaaataa

SEQ ID NO: 1356780 - DNA, 15 bp, Homo sapiens
actagcaaaataaaa

SEQ ID NO: 1356781 - DNA, 18 bp, Homo sapiens
actaggcccccacttgcc

SEQ ID NO: 1356782 - DNA, 22 bp, Homo sapiens
actaggcccccacttgcctctt

SEQ ID NO: 1356783 - DNA, 23 bp, Homo sapiens
actagtgtacatttctataaata

SEQ ID NO: 1356784 - DNA, 17 bp, Homo sapiens
aaaggcttataaaacag

SEQ ID NO: 1356785 - DNA, 14 bp, Homo sapiens
aaaggggagagcct

SEQ ID NO: 1356786 - DNA, 16 bp, Homo sapiens
aaaggggagagcctgc

SEQ ID NO: 1356787 - DNA, 24 bp, Homo sapiens
aaaggggtcggctgaccatgctca

SEQ ID NO: 1356788 - DNA, 15 bp, Homo sapiens
aaaggggtgctttta

SEQ ID NO: 1356789 - DNA, 14 bp, Homo sapiens
aaagtaactcattt

SEQ ID NO: 1356790 - DNA, 15 bp, Homo sapiens
aaagtaactcatttg

SEQ ID NO: 1356791 - DNA, 22 bp, Homo sapiens
aaagtaactcatttgttaaaat

SEQ ID NO: 1356792 - DNA, 17 bp, Homo sapiens
aaagtagaactttgtat

SEQ ID NO: 1356793 - DNA, 21 bp, Homo sapiens
aaagtagaactttgtatagtt

SEQ ID NO: 1356794 - DNA, 12 bp, Homo sapiens
aaagtagggggc

SEQ ID NO: 1356795 - DNA, 13 bp, Homo sapiens
aaagtcagagaca

SEQ ID NO: 1356796 - DNA, 15 bp, Homo sapiens
aaagtcagagacaga

SEQ ID NO: 1356797 - DNA, 18 bp, Homo sapiens
aaagtcagagacagatac

SEQ ID NO: 1356798 - DNA, 15 bp, Homo sapiens
aaagtgccaaagaaa

SEQ ID NO: 1356799 - DNA, 12 bp, Homo sapiens
aaagtgcctttg

SEQ ID NO: 1356800 - DNA, 14 bp, Homo sapiens
aaagtgcctttgca

SEQ ID NO: 1356801 - DNA, 13 bp, Homo sapiens
aaagtggaaaaat

SEQ ID NO: 1356802 - DNA, 18 bp, Homo sapiens
aaagtgtgagcaaactaa

SEQ ID NO: 1356803 - DNA, 23 bp, Homo sapiens
aaagtgtgtatatattttgtgtg

SEQ ID NO: 1356804 - DNA, 17 bp, Homo sapiens
aaagttaaaattgttat

SEQ ID NO: 1356805 - DNA, 13 bp, Homo sapiens
aaagttttgtaaa

SEQ ID NO: 1356806 - DNA, 14 bp, Homo sapiens
aaagttttgttgta

SEQ ID NO: 1356807 - DNA, 15 bp, Homo sapiens
aaataaaaactaatt

SEQ ID NO: 1356808 - DNA, 16 bp, Homo sapiens
aaataaaacatagcaa

SEQ ID NO: 1356809 - DNA, 21 bp, Homo sapiens
aaataaaatgaaaattgtatt

SEQ ID NO: 1356810 - DNA, 16 bp, Homo sapiens
aaataaaatttgttgc

SEQ ID NO: 1356811 - DNA, 17 bp, Homo sapiens
aaataaaatttgttgca

SEQ ID NO: 1356812 - DNA, 22 bp, Homo sapiens
aaataaagagagaacaggacta

SEQ ID NO: 1356813 - DNA, 20 bp, Homo sapiens
aaataactggaacaaattat

SEQ ID NO: 1356814 - DNA, 14 bp, Homo sapiens
aaataagaaataat

SEQ ID NO: 1356815 - DNA, 20 bp, Homo sapiens
aaataagaacgaggatttta

SEQ ID NO: 1356816 - DNA, 15 bp, Homo sapiens
aaataagtatttata

SEQ ID NO: 1356817 - DNA, 21 bp, Homo sapiens
aaataattatataactgtatt

SEQ ID NO: 1356818 - DNA, 15 bp, Homo sapiens
aaatacagtactgtt

SEQ ID NO: 1356819 - DNA, 14 bp, Homo sapiens
aaatacatgaagct

SEQ ID NO: 1356820 - DNA, 20 bp, Homo sapiens
aaatacatgaagcttcatgc

SEQ ID NO: 1356821 - DNA, 18 bp, Homo sapiens
aaatacattgtatatatg

SEQ ID NO: 1356822 - DNA, 12 bp, Homo sapiens
aaataccattta

SEQ ID NO: 1356823 - DNA, 22 bp, Homo sapiens
aaataccatttagtaagaatac

SEQ ID NO: 1356824 - DNA, 21 bp, Homo sapiens
aaatactatttaagatgtgaa

SEQ ID NO: 1356825 - DNA, 12 bp, Homo sapiens
aaatagaaattt

SEQ ID NO: 1356826 - DNA, 19 bp, Homo sapiens
aaatagtatgaaaatggaa

SEQ ID NO: 1356827 - DNA, 13 bp, Homo sapiens
aaatataaaatta

SEQ ID NO: 1356828 - DNA, 13 bp, Homo sapiens
aaatataaacaaa

SEQ ID NO: 1356829 - DNA, 20 bp, Homo sapiens
aaatatattctttcaaagga

SEQ ID NO: 1356830 - DNA, 12 bp, Homo sapiens
aaatatcaaagt

SEQ ID NO: 1356831 - DNA, 21 bp, Homo sapiens
aaatatcaaagtcattaaaga

SEQ ID NO: 1356832 - DNA, 12 bp, Homo sapiens
aaatatcaaatt

SEQ ID NO: 1356833 - DNA, 20 bp, Homo sapiens
aaatatcaaattaattgtgt

SEQ ID NO: 1356834 - DNA, 21 bp, Homo sapiens
aaatattgtttctgcattcat

SEQ ID NO: 1356835 - DNA, 16 bp, Homo sapiens
aaatatttcagtgaat

SEQ ID NO: 1356836 - DNA, 14 bp, Homo sapiens
aaatattttctatt

SEQ ID NO: 1356837 - DNA, 17 bp, Homo sapiens
aaatattttctatttta

SEQ ID NO: 1356838 - DNA, 19 bp, Homo sapiens
aaatattttctattttaag

SEQ ID NO: 1356839 - DNA, 21 bp, Homo sapiens
aaatattttctctgtactttt

SEQ ID NO: 1356840 - DNA, 21 bp, Homo sapiens
aaatattttgaatcaataata

SEQ ID NO: 1356841 - DNA, 22 bp, Homo sapiens
aaatattttgaatcaataatat

SEQ ID NO: 1356842 - DNA, 13 bp, Homo sapiens
aaatcaaagtgct

SEQ ID NO: 1356843 - DNA, 15 bp, Homo sapiens
aaatcaaagtgctat

SEQ ID NO: 1356844 - DNA, 19 bp, Homo sapiens
aaatcagccgtgtaaccat

SEQ ID NO: 1356845 - DNA, 18 bp, Homo sapiens
aaatcagcctgctccagc

SEQ ID NO: 1356846 - DNA, 23 bp, Homo sapiens
aaatcataggcaccttttactgt

SEQ ID NO: 1356847 - DNA, 15 bp, Homo sapiens
aaatcctgaagagca

SEQ ID NO: 1356848 - DNA, 17 bp, Homo sapiens
aaatcctgaagagcatt

SEQ ID NO: 1356849 - DNA, 15 bp, Homo sapiens
aaatctaaatctatt

SEQ ID NO: 1356850 - DNA, 16 bp, Homo sapiens
aaatctaaatctattt

SEQ ID NO: 1356851 - DNA, 20 bp, Homo sapiens
aaatctgagggaaatgtttt

SEQ ID NO: 1356852 - DNA, 15 bp, Homo sapiens
aaatcttttgaagca

SEQ ID NO: 1356853 - DNA, 12 bp, Homo sapiens
aaatgaaatgca

SEQ ID NO: 1356854 - DNA, 15 bp, Homo sapiens
aaatgaagaatttaa

SEQ ID NO: 1356855 - DNA, 18 bp, Homo sapiens
aaatgaagaatttaaaga

SEQ ID NO: 1356856 - DNA, 17 bp, Homo sapiens
aaatgaatatctattaa

SEQ ID NO: 1356857 - DNA, 13 bp, Homo sapiens
aaatgagcctggc

SEQ ID NO: 1356858 - DNA, 23 bp, Homo sapiens
aaatgagctcgcatttgtcaatg

SEQ ID NO: 1356859 - DNA, 15 bp, Homo sapiens
aaatgaggaggatgc

SEQ ID NO: 1356860 - DNA, 19 bp, Homo sapiens
aaatgatgatgtggaagaa

SEQ ID NO: 1356861 - DNA, 14 bp, Homo sapiens
aaatgcatctttga

SEQ ID NO: 1356862 - DNA, 19 bp, Homo sapiens
aaatgcatctttgatgtgt

SEQ ID NO: 1356863 - DNA, 21 bp, Homo sapiens
aaatgcatctttgatgtgttg

SEQ ID NO: 1356864 - DNA, 12 bp, Homo sapiens
aaatggaaattt

SEQ ID NO: 1356865 - DNA, 18 bp, Homo sapiens
aaatggagaagctgcagg

SEQ ID NO: 1356866 - DNA, 14 bp, Homo sapiens
aaatgtaatttaaa

SEQ ID NO: 1356867 - DNA, 13 bp, Homo sapiens
aaatgtaggtcct

SEQ ID NO: 1356868 - DNA, 16 bp, Homo sapiens
aaatgtataaatatac

SEQ ID NO: 1356869 - DNA, 20 bp, Homo sapiens
aaatgtcaaaagtagaactt

SEQ ID NO: 1356870 - DNA, 18 bp, Homo sapiens
aaatgtgaatttttattg

SEQ ID NO: 1356871 - DNA, 14 bp, Homo sapiens
aaatgttaaaagtt

SEQ ID NO: 1356872 - DNA, 19 bp, Homo sapiens
aaatgttaaaagttttata

SEQ ID NO: 1356873 - DNA, 23 bp, Homo sapiens
aaatgttaaaagttttatatgct

SEQ ID NO: 1356874 - DNA, 15 bp, Homo sapiens
aaatgttacctctga

SEQ ID NO: 1356875 - DNA, 16 bp, Homo sapiens
aaatgttattatctgg

SEQ ID NO: 1356876 - DNA, 10 bp, Homo sapiens
aaatgtttct

SEQ ID NO: 1356877 - DNA, 11 bp, Homo sapiens
aaatgtttctt

SEQ ID NO: 1356878 - DNA, 18 bp, Homo sapiens
aaatgtttcttttaaaga

SEQ ID NO: 1356879 - DNA, 10 bp, Homo sapiens
aaatgtttgg

SEQ ID NO: 1356880 - DNA, 22 bp, Homo sapiens
aaatgtttggcatgtaaatgta

SEQ ID NO: 1356881 - DNA, 17 bp, Homo sapiens
aaatgttttgtaaacat

SEQ ID NO: 1356882 - DNA, 21 bp, Homo sapiens
aaattaaggtgtttgaaaata

SEQ ID NO: 1356883 - DNA, 13 bp, Homo sapiens
aaattaattgtgt

SEQ ID NO: 1356884 - DNA, 15 bp, Homo sapiens
aaattacaattttat

SEQ ID NO: 1356885 - DNA, 22 bp, Homo sapiens
atgtttggcatgtaaatgtaaa

SEQ ID NO: 1356886 - DNA, 12 bp, Homo sapiens
atgttttaaaga

SEQ ID NO: 1356887 - DNA, 13 bp, Homo sapiens
atgttttaaagaa

SEQ ID NO: 1356888 - DNA, 22 bp, Homo sapiens
atgttttaaagaatatgacttt

SEQ ID NO: 1356889 - DNA, 22 bp, Homo sapiens
atgttttcaaaaggtattatac

SEQ ID NO: 1356890 - DNA, 16 bp, Homo sapiens
atgttttgtaaacatt

SEQ ID NO: 1356891 - DNA, 19 bp, Homo sapiens
atgttttgtaaacatttat

SEQ ID NO: 1356892 - DNA, 14 bp, Homo sapiens
atgtttttatacaa

SEQ ID NO: 1356893 - DNA, 18 bp, Homo sapiens
atgtttttatacaaaata

SEQ ID NO: 1356894 - DNA, 17 bp, Homo sapiens
attaaaactaaatttca

SEQ ID NO: 1356895 - DNA, 19 bp, Homo sapiens
attaaaggcataaatgact

SEQ ID NO: 1356896 - DNA, 12 bp, Homo sapiens
attaaatacata

SEQ ID NO: 1356897 - DNA, 13 bp, Homo sapiens
attaaatacatat

SEQ ID NO: 1356898 - DNA, 23 bp, Homo sapiens
attaaatacatatggatgttact

SEQ ID NO: 1356899 - DNA, 13 bp, Homo sapiens
attaaattaggaa

SEQ ID NO: 1356900 - DNA, 18 bp, Homo sapiens
attaaattaggaataaat

SEQ ID NO: 1356901 - DNA, 16 bp, Homo sapiens
attaaatttttttgta

SEQ ID NO: 1356902 - DNA, 17 bp, Homo sapiens
attaaccacttcagctg

SEQ ID NO: 1356903 - DNA, 18 bp, Homo sapiens
attaaccacttcagctga

SEQ ID NO: 1356904 - DNA, 17 bp, Homo sapiens
attaaccttactaatta

SEQ ID NO: 1356905 - DNA, 17 bp, Homo sapiens
attaagcaaatgttaaa

SEQ ID NO: 1356906 - DNA, 15 bp, Homo sapiens
attaaggggaagaat

SEQ ID NO: 1356907 - DNA, 15 bp, Homo sapiens
attaaggtgtttgaa

SEQ ID NO: 1356908 - DNA, 18 bp, Homo sapiens
attaaggtgtttgaaaat

SEQ ID NO: 1356909 - DNA, 16 bp, Homo sapiens
attaatatatgtatta

SEQ ID NO: 1356910 - DNA, 21 bp, Homo sapiens
attaatatatgtattatttat

SEQ ID NO: 1356911 - DNA, 22 bp, Homo sapiens
attaatatatgtattatttata

SEQ ID NO: 1356912 - DNA, 13 bp, Homo sapiens
attaatcactgtg

SEQ ID NO: 1356913 - DNA, 16 bp, Homo sapiens
attaatcactgtgtat

SEQ ID NO: 1356914 - DNA, 20 bp, Homo sapiens
attaatcactgtgtatattt

SEQ ID NO: 1356915 - DNA, 11 bp, Homo sapiens
attaatgcact

SEQ ID NO: 1356916 - DNA, 12 bp, Homo sapiens
attaatgcactt

SEQ ID NO: 1356917 - DNA, 13 bp, Homo sapiens
attaatgcacttt

SEQ ID NO: 1356918 - DNA, 14 bp, Homo sapiens
attaatgcactttc

SEQ ID NO: 1356919 - DNA, 14 bp, Homo sapiens
attaattgtgtgaa

SEQ ID NO: 1356920 - DNA, 16 bp, Homo sapiens
attaattgtgtgaact

SEQ ID NO: 1356921 - DNA, 15 bp, Homo sapiens
attacaaagttaaaa

SEQ ID NO: 1356922 - DNA, 18 bp, Homo sapiens
attacagtccaaaatact

SEQ ID NO: 1356923 - DNA, 18 bp, Homo sapiens
attaccccctccttcaga

SEQ ID NO: 1356924 - DNA, 20 bp, Homo sapiens
attaccccctccttcagaca

SEQ ID NO: 1356925 - DNA, 13 bp, Homo sapiens
attacgtgctctg

SEQ ID NO: 1356926 - DNA, 21 bp, Homo sapiens
attactgacatttcttctagt

SEQ ID NO: 1356927 - DNA, 14 bp, Homo sapiens
attactgccttgaa

SEQ ID NO: 1356928 - DNA, 20 bp, Homo sapiens
attactgtttattacttcca

SEQ ID NO: 1356929 - DNA, 15 bp, Homo sapiens
attacttccatgaat

SEQ ID NO: 1356930 - DNA, 13 bp, Homo sapiens
attagagaagaga

SEQ ID NO: 1356931 - DNA, 22 bp, Homo sapiens
attagatgttacaagtttatat

SEQ ID NO: 1356932 - DNA, 20 bp, Homo sapiens
attaggcaaggctatgtgat

SEQ ID NO: 1356933 - DNA, 21 bp, Homo sapiens
attagtaacattcatgttcta

SEQ ID NO: 1356934 - DNA, 16 bp, Homo sapiens
attagtgttatatgaa

SEQ ID NO: 1356935 - DNA, 12 bp, Homo sapiens
attagtttagaa

SEQ ID NO: 1356936 - DNA, 17 bp, Homo sapiens
attagtttagaacaggt

SEQ ID NO: 1356937 - DNA, 22 bp, Homo sapiens
attataaaggataaagaaggat

SEQ ID NO: 1356938 - DNA, 14 bp, Homo sapiens
attataatcttata

SEQ ID NO: 1356939 - DNA, 15 bp, Homo sapiens
attatataactgtat

SEQ ID NO: 1356940 - DNA, 19 bp, Homo sapiens
attatataactgtatttga

SEQ ID NO: 1356941 - DNA, 18 bp, Homo sapiens
attatatgttcagattat

SEQ ID NO: 1356942 - DNA, 17 bp, Homo sapiens
attatcaatatctaata

SEQ ID NO: 1356943 - DNA, 19 bp, Homo sapiens
attatcaatatctaatata

SEQ ID NO: 1356944 - DNA, 14 bp, Homo sapiens
attatctgggctta

SEQ ID NO: 1356945 - DNA, 15 bp, Homo sapiens
attatcttgatacat

SEQ ID NO: 1356946 - DNA, 16 bp, Homo sapiens
attatcttgatacatt

SEQ ID NO: 1356947 - DNA, 20 bp, Homo sapiens
attatgaaagcaacaaagaa

SEQ ID NO: 1356948 - DNA, 16 bp, Homo sapiens
attatgttttttaaaa

SEQ ID NO: 1356949 - DNA, 22 bp, Homo sapiens
attattagccaggtaatgtgaa

SEQ ID NO: 1356950 - DNA, 14 bp, Homo sapiens
attattgacactga

SEQ ID NO: 1356951 - DNA, 18 bp, Homo sapiens
attattgacactgaactt

SEQ ID NO: 1356952 - DNA, 19 bp, Homo sapiens
attatttaagactaaaagt

SEQ ID NO: 1356953 - DNA, 15 bp, Homo sapiens
attatttaattgtcc

SEQ ID NO: 1356954 - DNA, 13 bp, Homo sapiens
attatttattatt

SEQ ID NO: 1356955 - DNA, 21 bp, Homo sapiens
attatttgattatttaagact

SEQ ID NO: 1356956 - DNA, 22 bp, Homo sapiens
attatttgattatttaagacta

SEQ ID NO: 1356957 - DNA, 11 bp, Homo sapiens
attatttgcat

SEQ ID NO: 1356958 - DNA, 15 bp, Homo sapiens
attatttgcatgtta

SEQ ID NO: 1356959 - DNA, 19 bp, Homo sapiens
attatttgcatgttatgtt

SEQ ID NO: 1356960 - DNA, 21 bp, Homo sapiens
attatttgcatgttatgttta

SEQ ID NO: 1356961 - DNA, 13 bp, Homo sapiens
attattttaaaaa

SEQ ID NO: 1356962 - DNA, 14 bp, Homo sapiens
attatttttgtaga

SEQ ID NO: 1356963 - DNA, 20 bp, Homo sapiens
attatttttttaaaattttg

SEQ ID NO: 1356964 - DNA, 22 bp, Homo sapiens
attatttttttaaaattttgta

SEQ ID NO: 1356965 - DNA, 17 bp, Homo sapiens
attcaaactggggcctc

SEQ ID NO: 1356966 - DNA, 22 bp, Homo sapiens
attcaaactggggcctccagaa

SEQ ID NO: 1356967 - DNA, 21 bp, Homo sapiens
attcaacagcaagtgtgaata

SEQ ID NO: 1356968 - DNA, 22 bp, Homo sapiens
attcaacagcaagtgtgaatac

SEQ ID NO: 1356969 - DNA, 13 bp, Homo sapiens
attcaactttgta

SEQ ID NO: 1356970 - DNA, 14 bp, Homo sapiens
attcaactttgtaa

SEQ ID NO: 1356971 - DNA, 21 bp, Homo sapiens
attcactcccacacccaagaa

SEQ ID NO: 1356972 - DNA, 13 bp, Homo sapiens
attcactggcccc

SEQ ID NO: 1356973 - DNA, 19 bp, Homo sapiens
attcagcagcaaattttca

SEQ ID NO: 1356974 - DNA, 18 bp, Homo sapiens
attcagggtaaataggaa

SEQ ID NO: 1356975 - DNA, 11 bp, Homo sapiens
attcatttcta

SEQ ID NO: 1356976 - DNA, 12 bp, Homo sapiens
attccaataaac

SEQ ID NO: 1356977 - DNA, 19 bp, Homo sapiens
attccactacacctggctg

SEQ ID NO: 1356978 - DNA, 19 bp, Homo sapiens
attccagatctttcagaaa

SEQ ID NO: 1356979 - DNA, 20 bp, Homo sapiens
attccagatctttcagaaat

SEQ ID NO: 1356980 - DNA, 21 bp, Homo sapiens
attccagatctttcagaaata

SEQ ID NO: 1356981 - DNA, 13 bp, Homo sapiens
attccagcccctc

SEQ ID NO: 1356982 - DNA, 22 bp, Homo sapiens
attccccaccctgaaagccctg

SEQ ID NO: 1356983 - DNA, 16 bp, Homo sapiens
attcccttgttattca

SEQ ID NO: 1356984 - DNA, 14 bp, Homo sapiens
attcctttgcatat

SEQ ID NO: 1356985 - DNA, 18 bp, Homo sapiens
attcctttttatttatat

SEQ ID NO: 1356986 - DNA, 21 bp, Homo sapiens
attcctttttatttatatgta

SEQ ID NO: 1356987 - DNA, 21 bp, Homo sapiens
attcggtatccccccatcttg

SEQ ID NO: 1356988 - DNA, 22 bp, Homo sapiens
attcgttgtgttttttaagata

SEQ ID NO: 1356989 - DNA, 14 bp, Homo sapiens
attctaaatacatg

SEQ ID NO: 1356990 - DNA, 19 bp, Homo sapiens
attctaataagctagttga

SEQ ID NO: 1356991 - DNA, 21 bp, Homo sapiens
attctcccaggtaccagctgc

SEQ ID NO: 1356992 - DNA, 24 bp, Homo sapiens
attctcccaggtaccagctgcgct

SEQ ID NO: 1356993 - DNA, 17 bp, Homo sapiens
attctgagcctgatatt

SEQ ID NO: 1356994 - DNA, 21 bp, Homo sapiens
attctgattctggctttaagc

SEQ ID NO: 1356995 - DNA, 22 bp, Homo sapiens
attctgattctggctttaagcc

SEQ ID NO: 1356996 - DNA, 22 bp, Homo sapiens
attctgccgccccctcctgaac

SEQ ID NO: 1356997 - DNA, 16 bp, Homo sapiens
attctggctttaagcc

SEQ ID NO: 1356998 - DNA, 23 bp, Homo sapiens
attcttaaaaggcccatagcagc

SEQ ID NO: 1356999 - DNA, 13 bp, Homo sapiens
attcttactaaaa

SEQ ID NO: 1357000 - DNA, 22 bp, Homo sapiens
attcttactaaaaagtataaaa

SEQ ID NO: 1357001 - DNA, 20 bp, Homo sapiens
attcttgttgctgtacaaaa

SEQ ID NO: 1357002 - DNA, 21 bp, Homo sapiens
attcttgttgctgtacaaaag

SEQ ID NO: 1357003 - DNA, 15 bp, Homo sapiens
attctttcagttctt

SEQ ID NO: 1357004 - DNA, 22 bp, Homo sapiens
attgaaaatgtccaggaaagtg

SEQ ID NO: 1357005 - DNA, 12 bp, Homo sapiens
atgctccccaca

SEQ ID NO: 1357006 - DNA, 22 bp, Homo sapiens
atgctccccacagcgtccctgg

SEQ ID NO: 1357007 - DNA, 23 bp, Homo sapiens
atgctccccacagcgtccctggc

SEQ ID NO: 1357008 - DNA, 14 bp, Homo sapiens
atgctcctggccca

SEQ ID NO: 1357009 - DNA, 15 bp, Homo sapiens
atgctgaggcctggg

SEQ ID NO: 1357010 - DNA, 9 bp, Homo sapiens
atgctggga

SEQ ID NO: 1357011 - DNA, 16 bp, Homo sapiens
atgcttccttgcctga

SEQ ID NO: 1357012 - DNA, 16 bp, Homo sapiens
atgcttctcactgcca

SEQ ID NO: 1357013 - DNA, 15 bp, Homo sapiens
atgcttcttctcaaa

SEQ ID NO: 1357014 - DNA, 14 bp, Homo sapiens
atgctttatttgta

SEQ ID NO: 1357015 - DNA, 15 bp, Homo sapiens
atgctttatttgtaa

SEQ ID NO: 1357016 - DNA, 16 bp, Homo sapiens
atgctttatttgtaaa

SEQ ID NO: 1357017 - DNA, 15 bp, Homo sapiens
atgctttccaaaacc

SEQ ID NO: 1357018 - DNA, 15 bp, Homo sapiens
atgctttccaaacct

SEQ ID NO: 1357019 - DNA, 19 bp, Homo sapiens
atggaaaactgtgttgcca

SEQ ID NO: 1357020 - DNA, 16 bp, Homo sapiens
atggaaagtaactcat

SEQ ID NO: 1357021 - DNA, 16 bp, Homo sapiens
atggaaattttgctat

SEQ ID NO: 1357022 - DNA, 21 bp, Homo sapiens
atggacccaatatttaccaga

SEQ ID NO: 1357023 - DNA, 20 bp, Homo sapiens
atggactatctgtctggtgg

SEQ ID NO: 1357024 - DNA, 15 bp, Homo sapiens
atggagaagctgcag

SEQ ID NO: 1357025 - DNA, 16 bp, Homo sapiens
atggagaagctgcagg

SEQ ID NO: 1357026 - DNA, 11 bp, Homo sapiens
atggagccagc

SEQ ID NO: 1357027 - DNA, 15 bp, Homo sapiens
atggatgatttaagt

SEQ ID NO: 1357028 - DNA, 12 bp, Homo sapiens
atggatgttact

SEQ ID NO: 1357029 - DNA, 18 bp, Homo sapiens
atggatttccagccaaag

SEQ ID NO: 1357030 - DNA, 22 bp, Homo sapiens
atggcatccctttttcataaat

SEQ ID NO: 1357031 - DNA, 17 bp, Homo sapiens
atggccccagcacagct

SEQ ID NO: 1357032 - DNA, 13 bp, Homo sapiens
atggcttgtctat

SEQ ID NO: 1357033 - DNA, 17 bp, Homo sapiens
atgggaatgaggtggga

SEQ ID NO: 1357034 - DNA, 18 bp, Homo sapiens
atgggaatgaggtgggag

SEQ ID NO: 1357035 - DNA, 14 bp, Homo sapiens
atgggcccctggca

SEQ ID NO: 1357036 - DNA, 16 bp, Homo sapiens
atgggcccctggcact

SEQ ID NO: 1357037 - DNA, 22 bp, Homo sapiens
atggggaatctaagagagctgc

SEQ ID NO: 1357038 - DNA, 14 bp, Homo sapiens
atgggggtttcacc

SEQ ID NO: 1357039 - DNA, 13 bp, Homo sapiens
atggtaataagca

SEQ ID NO: 1357040 - DNA, 23 bp, Homo sapiens
atggtaatctttacctgtataca

SEQ ID NO: 1357041 - DNA, 19 bp, Homo sapiens
atggtagccagatgataaa

SEQ ID NO: 1357042 - DNA, 12 bp, Homo sapiens
atggtagtttct

SEQ ID NO: 1357043 - DNA, 15 bp, Homo sapiens
atggtagtttctgtg

SEQ ID NO: 1357044 - DNA, 16 bp, Homo sapiens
atggtatatatacata

SEQ ID NO: 1357045 - DNA, 20 bp, Homo sapiens
atggtcacgtttggtgcttc

SEQ ID NO: 1357046 - DNA, 14 bp, Homo sapiens
atggtgcctgagag

SEQ ID NO: 1357047 - DNA, 20 bp, Homo sapiens
atggtgcctgagaggcaggc

SEQ ID NO: 1357048 - DNA, 20 bp, Homo sapiens
atggttctctcaacaagaaa

SEQ ID NO: 1357049 - DNA, 23 bp, Homo sapiens
atggtttgactcatcttatatgg

SEQ ID NO: 1357050 - DNA, 15 bp, Homo sapiens
atggttttaaacttt

SEQ ID NO: 1357051 - DNA, 13 bp, Homo sapiens
atggttttaagaa

SEQ ID NO: 1357052 - DNA, 16 bp, Homo sapiens
atgtaagcatactttg

SEQ ID NO: 1357053 - DNA, 14 bp, Homo sapiens
atgtaagtgggccc

SEQ ID NO: 1357054 - DNA, 15 bp, Homo sapiens
atgtaataaacttta

SEQ ID NO: 1357055 - DNA, 16 bp, Homo sapiens
atgtacagttgaaata

SEQ ID NO: 1357056 - DNA, 14 bp, Homo sapiens
atgtactttttagt

SEQ ID NO: 1357057 - DNA, 18 bp, Homo sapiens
atgtagaggcttgtttac

SEQ ID NO: 1357058 - DNA, 23 bp, Homo sapiens
atgtagccccctggcctctgtgc

SEQ ID NO: 1357059 - DNA, 16 bp, Homo sapiens
atgtaggtaagactgt

SEQ ID NO: 1357060 - DNA, 18 bp, Homo sapiens
atgtaggtaagactgtag

SEQ ID NO: 1357061 - DNA, 19 bp, Homo sapiens
atgtagtatctatatgact

SEQ ID NO: 1357062 - DNA, 20 bp, Homo sapiens
atgtatattaaaaaagagac

SEQ ID NO: 1357063 - DNA, 21 bp, Homo sapiens
atgtatattaaaaaagagaca

SEQ ID NO: 1357064 - DNA, 15 bp, Homo sapiens
atgtattatttataa

SEQ ID NO: 1357065 - DNA, 17 bp, Homo sapiens
atgtattatttataatt

SEQ ID NO: 1357066 - DNA, 17 bp, Homo sapiens
atgtattcttttctcag

SEQ ID NO: 1357067 - DNA, 19 bp, Homo sapiens
atgtcaatttctgtgttgc

SEQ ID NO: 1357068 - DNA, 16 bp, Homo sapiens
atgtcacgaatatgga

SEQ ID NO: 1357069 - DNA, 13 bp, Homo sapiens
atgtcagcagttg

SEQ ID NO: 1357070 - DNA, 20 bp, Homo sapiens
atgtcagcagttgctggtaa

SEQ ID NO: 1357071 - DNA, 12 bp, Homo sapiens
atgtccaaagag

SEQ ID NO: 1357072 - DNA, 16 bp, Homo sapiens
atgtccaaagaggctg

SEQ ID NO: 1357073 - DNA, 19 bp, Homo sapiens
atgtccaaagaggctgccc

SEQ ID NO: 1357074 - DNA, 20 bp, Homo sapiens
atgtccaaagaggctgcccc

SEQ ID NO: 1357075 - DNA, 21 bp, Homo sapiens
atgtccaaagaggctgcccct

SEQ ID NO: 1357076 - DNA, 22 bp, Homo sapiens
atgtccagcaccttgtgcctgg

SEQ ID NO: 1357077 - DNA, 18 bp, Homo sapiens
atgtccagtaagatcact

SEQ ID NO: 1357078 - DNA, 19 bp, Homo sapiens
atgtcgtggacacacacag

SEQ ID NO: 1357079 - DNA, 20 bp, Homo sapiens
atgtcgtggacacacacaga

SEQ ID NO: 1357080 - DNA, 12 bp, Homo sapiens
atgtctgtaaat

SEQ ID NO: 1357081 - DNA, 14 bp, Homo sapiens
atgtcttttaaaat

SEQ ID NO: 1357082 - DNA, 14 bp, Homo sapiens
atgtgaattattga

SEQ ID NO: 1357083 - DNA, 16 bp, Homo sapiens
atgtgaattattgaca

SEQ ID NO: 1357084 - DNA, 19 bp, Homo sapiens
atgtgaattattgacactg

SEQ ID NO: 1357085 - DNA, 21 bp, Homo sapiens
atgtgaattattgacactgaa

SEQ ID NO: 1357086 - DNA, 10 bp, Homo sapiens
atgtgaattt

SEQ ID NO: 1357087 - DNA, 11 bp, Homo sapiens
atgtgaatttt

SEQ ID NO: 1357088 - DNA, 13 bp, Homo sapiens
atgtgaattttta

SEQ ID NO: 1357089 - DNA, 14 bp, Homo sapiens
atgtgaatttttaa

SEQ ID NO: 1357090 - DNA, 15 bp, Homo sapiens
atgtgaatttttaag

SEQ ID NO: 1357091 - DNA, 16 bp, Homo sapiens
atgtgaatttttaagc

SEQ ID NO: 1357092 - DNA, 18 bp, Homo sapiens
atgtgaatttttaagctg

SEQ ID NO: 1357093 - DNA, 17 bp, Homo sapiens
atgtgaatttttattgt

SEQ ID NO: 1357094 - DNA, 15 bp, Homo sapiens
atgtgacattaacaa

SEQ ID NO: 1357095 - DNA, 18 bp, Homo sapiens
atgtgacattaacaaata

SEQ ID NO: 1357096 - DNA, 15 bp, Homo sapiens
atgtgagaagccagc

SEQ ID NO: 1357097 - DNA, 15 bp, Homo sapiens
atgtgagagaaagtg

SEQ ID NO: 1357098 - DNA, 21 bp, Homo sapiens
atgtgatacattttttaagct

SEQ ID NO: 1357099 - DNA, 16 bp, Homo sapiens
atgtggcctttgaatt

SEQ ID NO: 1357100 - DNA, 20 bp, Homo sapiens
atgtggctggaagatcctgc

SEQ ID NO: 1357101 - DNA, 20 bp, Homo sapiens
atgtgtatgcacagtaaaaa

SEQ ID NO: 1357102 - DNA, 14 bp, Homo sapiens
atgtgtttagaatt

SEQ ID NO: 1357103 - DNA, 16 bp, Homo sapiens
atgtgtttagaattga

SEQ ID NO: 1357104 - DNA, 20 bp, Homo sapiens
atgtgtttagaattgaaggt

SEQ ID NO: 1357105 - DNA, 15 bp, Homo sapiens
atgtgttttagatgg

SEQ ID NO: 1357106 - DNA, 17 bp, Homo sapiens
atgttaaagagaatgag

SEQ ID NO: 1357107 - DNA, 20 bp, Homo sapiens
atgttaatggatttcagaag

SEQ ID NO: 1357108 - DNA, 12 bp, Homo sapiens
atgttatgttta

SEQ ID NO: 1357109 - DNA, 16 bp, Homo sapiens
atgttatgtttaataa

SEQ ID NO: 1357110 - DNA, 19 bp, Homo sapiens
atgttatgtttaataagct

SEQ ID NO: 1357111 - DNA, 13 bp, Homo sapiens
atgttattatctg

SEQ ID NO: 1357112 - DNA, 18 bp, Homo sapiens
atgttattttctgttgaa

SEQ ID NO: 1357113 - DNA, 17 bp, Homo sapiens
atgttctctcttctcca

SEQ ID NO: 1357114 - DNA, 16 bp, Homo sapiens
atgttgatttttactg

SEQ ID NO: 1357115 - DNA, 20 bp, Homo sapiens
atgttgatttttactgtgtt

SEQ ID NO: 1357116 - DNA, 17 bp, Homo sapiens
atgttgtttataataaa

SEQ ID NO: 1357117 - DNA, 14 bp, Homo sapiens
atgtttaaaacacc

SEQ ID NO: 1357118 - DNA, 16 bp, Homo sapiens
atgtttaaaacacctt

SEQ ID NO: 1357119 - DNA, 12 bp, Homo sapiens
atgtttaaaata

SEQ ID NO: 1357120 - DNA, 18 bp, Homo sapiens
atgtttaaaataaaatga

SEQ ID NO: 1357121 - DNA, 20 bp, Homo sapiens
atgtttataaatcttatgct

SEQ ID NO: 1357122 - DNA, 14 bp, Homo sapiens
atgtttcctctagt

SEQ ID NO: 1357123 - DNA, 16 bp, Homo sapiens
atgtttcttttaaaga

SEQ ID NO: 1357124 - DNA, 16 bp, Homo sapiens
atgtttcttttgtttg

SEQ ID NO: 1357125 - DNA, 21 bp, Homo sapiens
atgtttcttttgtttggtaaa

SEQ ID NO: 1357126 - DNA, 16 bp, Homo sapiens
atgtttgcacttgtga

SEQ ID NO: 1357127 - DNA, 13 bp, Homo sapiens
atctcatttaagg

SEQ ID NO: 1357128 - DNA, 17 bp, Homo sapiens
atctcatttaagggaaa

SEQ ID NO: 1357129 - DNA, 19 bp, Homo sapiens
atctcatttaagggaaaaa

SEQ ID NO: 1357130 - DNA, 23 bp, Homo sapiens
atctcatttaagggaaaaatata

SEQ ID NO: 1357131 - DNA, 18 bp, Homo sapiens
atctcctgacagaaggtg

SEQ ID NO: 1357132 - DNA, 15 bp, Homo sapiens
atctctaaagagcat

SEQ ID NO: 1357133 - DNA, 14 bp, Homo sapiens
atctctccactgtg

SEQ ID NO: 1357134 - DNA, 22 bp, Homo sapiens
atctctcctggcctatccgctg

SEQ ID NO: 1357135 - DNA, 13 bp, Homo sapiens
atctcttcattat

SEQ ID NO: 1357136 - DNA, 18 bp, Homo sapiens
atctcttgagcctgggag

SEQ ID NO: 1357137 - DNA, 21 bp, Homo sapiens
atctgaaataggaaacaagtg

SEQ ID NO: 1357138 - DNA, 21 bp, Homo sapiens
atctgaagagctattatataa

SEQ ID NO: 1357139 - DNA, 21 bp, Homo sapiens
atctgcaaaaggcctcttgta

SEQ ID NO: 1357140 - DNA, 23 bp, Homo sapiens
atctgcaccccttctctcctccc

SEQ ID NO: 1357141 - DNA, 19 bp, Homo sapiens
atctgccttaaaaccaaag

SEQ ID NO: 1357142 - DNA, 23 bp, Homo sapiens
atctgcggatctcagctttgaga

SEQ ID NO: 1357143 - DNA, 15 bp, Homo sapiens
atctgctgtatatgg

SEQ ID NO: 1357144 - DNA, 21 bp, Homo sapiens
atctggaagccaaaatgtagg

SEQ ID NO: 1357145 - DNA, 21 bp, Homo sapiens
atctggagaccagggagcctt

SEQ ID NO: 1357146 - DNA, 18 bp, Homo sapiens
atctggagttctcaaaga

SEQ ID NO: 1357147 - DNA, 21 bp, Homo sapiens
atctggttcattcttcagata

SEQ ID NO: 1357148 - DNA, 18 bp, Homo sapiens
atctgtctatattttatt

SEQ ID NO: 1357149 - DNA, 17 bp, Homo sapiens
atctgttgataaatcca

SEQ ID NO: 1357150 - DNA, 14 bp, Homo sapiens
atcttaatatattt

SEQ ID NO: 1357151 - DNA, 23 bp, Homo sapiens
atcttaatatatttctaaatgtt

SEQ ID NO: 1357152 - DNA, 15 bp, Homo sapiens
atcttacaatattga

SEQ ID NO: 1357153 - DNA, 17 bp, Homo sapiens
atcttacaatattgatt

SEQ ID NO: 1357154 - DNA, 12 bp, Homo sapiens
atcttactttgt

SEQ ID NO: 1357155 - DNA, 24 bp, Homo sapiens
atcttataaagtggaagtatgtat

SEQ ID NO: 1357156 - DNA, 16 bp, Homo sapiens
atcttataattgttct

SEQ ID NO: 1357157 - DNA, 15 bp, Homo sapiens
atcttcaaagccttc

SEQ ID NO: 1357158 - DNA, 20 bp, Homo sapiens
atcttgaatccttccattcc

SEQ ID NO: 1357159 - DNA, 23 bp, Homo sapiens
atcttgcttccctaatctatggt

SEQ ID NO: 1357160 - DNA, 20 bp, Homo sapiens
atcttggcctaaacctcagt

SEQ ID NO: 1357161 - DNA, 16 bp, Homo sapiens
atcttgggggggtggc

SEQ ID NO: 1357162 - DNA, 12 bp, Homo sapiens
atctttcagaaa

SEQ ID NO: 1357163 - DNA, 16 bp, Homo sapiens
atctttcagaaatata

SEQ ID NO: 1357164 - DNA, 17 bp, Homo sapiens
atctttcagaaatataa

SEQ ID NO: 1357165 - DNA, 15 bp, Homo sapiens
atctttgaatatgta

SEQ ID NO: 1357166 - DNA, 12 bp, Homo sapiens
atctttgatgtg

SEQ ID NO: 1357167 - DNA, 19 bp, Homo sapiens
atctttgatgtgttgttct

SEQ ID NO: 1357168 - DNA, 17 bp, Homo sapiens
atcttttgaagcataga

SEQ ID NO: 1357169 - DNA, 21 bp, Homo sapiens
atcttttttgttaactgattt

SEQ ID NO: 1357170 - DNA, 20 bp, Homo sapiens
atgaaaacagtgtgtaaaca

SEQ ID NO: 1357171 - DNA, 14 bp, Homo sapiens
atgaaaataccatt

SEQ ID NO: 1357172 - DNA, 15 bp, Homo sapiens
atgaaaattgtatta

SEQ ID NO: 1357173 - DNA, 15 bp, Homo sapiens
atgaaactaaagcaa

SEQ ID NO: 1357174 - DNA, 19 bp, Homo sapiens
atgaaactaaagcaataga

SEQ ID NO: 1357175 - DNA, 22 bp, Homo sapiens
atgaaactaaagcaatagaaac

SEQ ID NO: 1357176 - DNA, 12 bp, Homo sapiens
atgaaagaaaat

SEQ ID NO: 1357177 - DNA, 16 bp, Homo sapiens
atgaaataaaatatat

SEQ ID NO: 1357178 - DNA, 13 bp, Homo sapiens
atgaaatgtgaat

SEQ ID NO: 1357179 - DNA, 13 bp, Homo sapiens
atgaacacttata

SEQ ID NO: 1357180 - DNA, 16 bp, Homo sapiens
atgaacatacaaatgc

SEQ ID NO: 1357181 - DNA, 15 bp, Homo sapiens
atgaaccataaattc

SEQ ID NO: 1357182 - DNA, 14 bp, Homo sapiens
atgaagaatagaaa

SEQ ID NO: 1357183 - DNA, 13 bp, Homo sapiens
atgaagaatttaa

SEQ ID NO: 1357184 - DNA, 22 bp, Homo sapiens
atgaagactgttaaatgaaacc

SEQ ID NO: 1357185 - DNA, 15 bp, Homo sapiens
atgaagctacctcaa

SEQ ID NO: 1357186 - DNA, 14 bp, Homo sapiens
atgaagttgaaaat

SEQ ID NO: 1357187 - DNA, 21 bp, Homo sapiens
atgaatatctattaatatatg

SEQ ID NO: 1357188 - DNA, 15 bp, Homo sapiens
atgaatgagtctgtt

SEQ ID NO: 1357189 - DNA, 20 bp, Homo sapiens
atgaatgtatttatttggga

SEQ ID NO: 1357190 - DNA, 15 bp, Homo sapiens
atgacaataaagctt

SEQ ID NO: 1357191 - DNA, 17 bp, Homo sapiens
atgacacatttggcagt

SEQ ID NO: 1357192 - DNA, 18 bp, Homo sapiens
atgaccagatgcgtccca

SEQ ID NO: 1357193 - DNA, 21 bp, Homo sapiens
atgaccagatgcgtcccaaga

SEQ ID NO: 1357194 - DNA, 14 bp, Homo sapiens
atgactcaaagtct

SEQ ID NO: 1357195 - DNA, 16 bp, Homo sapiens
atgactcgggggtggg

SEQ ID NO: 1357196 - DNA, 14 bp, Homo sapiens
atgactgtgttgta

SEQ ID NO: 1357197 - DNA, 13 bp, Homo sapiens
atgactttttata

SEQ ID NO: 1357198 - DNA, 13 bp, Homo sapiens
atgagagcataat

SEQ ID NO: 1357199 - DNA, 11 bp, Homo sapiens
atgagcctggc

SEQ ID NO: 1357200 - DNA, 13 bp, Homo sapiens
atgagcctggcaa

SEQ ID NO: 1357201 - DNA, 15 bp, Homo sapiens
atgaggaaaattctt

SEQ ID NO: 1357202 - DNA, 22 bp, Homo sapiens
atgaggaactgtagatgatgta

SEQ ID NO: 1357203 - DNA, 13 bp, Homo sapiens
atgaggaggatgc

SEQ ID NO: 1357204 - DNA, 12 bp, Homo sapiens
atgaggagggga

SEQ ID NO: 1357205 - DNA, 13 bp, Homo sapiens
atgaggtgggagg

SEQ ID NO: 1357206 - DNA, 22 bp, Homo sapiens
atgagtagataatttcagggtg

SEQ ID NO: 1357207 - DNA, 18 bp, Homo sapiens
atgagtctgttgtgtgtc

SEQ ID NO: 1357208 - DNA, 19 bp, Homo sapiens
atgagtctgttgtgtgtca

SEQ ID NO: 1357209 - DNA, 18 bp, Homo sapiens
atgatcaccgactgaaaa

SEQ ID NO: 1357210 - DNA, 16 bp, Homo sapiens
atgatcctaggcattt

SEQ ID NO: 1357211 - DNA, 15 bp, Homo sapiens
atgatgatcctaggc

SEQ ID NO: 1357212 - DNA, 20 bp, Homo sapiens
atgatgatgtggaagaactt

SEQ ID NO: 1357213 - DNA, 18 bp, Homo sapiens
atgatgtacagattcttt

SEQ ID NO: 1357214 - DNA, 22 bp, Homo sapiens
atgatgtgcaaaaccttttact

SEQ ID NO: 1357215 - DNA, 19 bp, Homo sapiens
atgattgaattatatgttc

SEQ ID NO: 1357216 - DNA, 23 bp, Homo sapiens
atgcaaaaactctttgagagggt

SEQ ID NO: 1357217 - DNA, 14 bp, Homo sapiens
atgcaaaaggttta

SEQ ID NO: 1357218 - DNA, 16 bp, Homo sapiens
atgcaaccaagtcaca

SEQ ID NO: 1357219 - DNA, 17 bp, Homo sapiens
atgcaagcagaggacca

SEQ ID NO: 1357220 - DNA, 23 bp, Homo sapiens
atgcaataaaatttaaaaaataa

SEQ ID NO: 1357221 - DNA, 17 bp, Homo sapiens
atgcacagtaaaaatgg

SEQ ID NO: 1357222 - DNA, 21 bp, Homo sapiens
atgcacttaaagaagtatttt

SEQ ID NO: 1357223 - DNA, 14 bp, Homo sapiens
atgcagctttgcaa

SEQ ID NO: 1357224 - DNA, 15 bp, Homo sapiens
atgcagctttgcaaa

SEQ ID NO: 1357225 - DNA, 22 bp, Homo sapiens
atgcagtcttagatcatagttt

SEQ ID NO: 1357226 - DNA, 19 bp, Homo sapiens
atgcagttagctgaagaat

SEQ ID NO: 1357227 - DNA, 21 bp, Homo sapiens
atgcatataatgaataaatca

SEQ ID NO: 1357228 - DNA, 17 bp, Homo sapiens
atgcatatttgcaaagt

SEQ ID NO: 1357229 - DNA, 21 bp, Homo sapiens
atgcatatttgcaaagtgtat

SEQ ID NO: 1357230 - DNA, 19 bp, Homo sapiens
atgcatctttgatgtgttg

SEQ ID NO: 1357231 - DNA, 13 bp, Homo sapiens
atgcatgcaaatg

SEQ ID NO: 1357232 - DNA, 18 bp, Homo sapiens
atgcatgtcttttaaaat

SEQ ID NO: 1357233 - DNA, 20 bp, Homo sapiens
atgccaagagtgcacccatg

SEQ ID NO: 1357234 - DNA, 17 bp, Homo sapiens
atgccactgccttcgct

SEQ ID NO: 1357235 - DNA, 20 bp, Homo sapiens
atgccacttccttttaactg

SEQ ID NO: 1357236 - DNA, 21 bp, Homo sapiens
atgccagggccgaccagagga

SEQ ID NO: 1357237 - DNA, 18 bp, Homo sapiens
atgcccaccccctgccct

SEQ ID NO: 1357238 - DNA, 19 bp, Homo sapiens
atgcccaccccctgccctg

SEQ ID NO: 1357239 - DNA, 20 bp, Homo sapiens
atgcccaccccctgccctgc

SEQ ID NO: 1357240 - DNA, 10 bp, Homo sapiens
atgccctctc

SEQ ID NO: 1357241 - DNA, 13 bp, Homo sapiens
atgccctctcagg

SEQ ID NO: 1357242 - DNA, 22 bp, Homo sapiens
atgcgccccctccgccctgcca

SEQ ID NO: 1357243 - DNA, 23 bp, Homo sapiens
atgcgctcagggccatgctgagg

SEQ ID NO: 1357244 - DNA, 13 bp, Homo sapiens
atgcgtcccaaga

SEQ ID NO: 1357245 - DNA, 23 bp, Homo sapiens
atgctaacaaagacaaaagtctg

SEQ ID NO: 1357246 - DNA, 22 bp, Homo sapiens
atgctaatagtgatcaagaaga

SEQ ID NO: 1357247 - DNA, 14 bp, Homo sapiens
atattgtttggtaa

SEQ ID NO: 1357248 - DNA, 19 bp, Homo sapiens
atattgtttggtaaatgtt

SEQ ID NO: 1357249 - DNA, 19 bp, Homo sapiens
atattgttttacaatagtt

SEQ ID NO: 1357250 - DNA, 9 bp, Homo sapiens
atatttaat

SEQ ID NO: 1357251 - DNA, 13 bp, Homo sapiens
atatttgaatttt

SEQ ID NO: 1357252 - DNA, 15 bp, Homo sapiens
atatttgtaaagcta

SEQ ID NO: 1357253 - DNA, 19 bp, Homo sapiens
atattttaacctgcataaa

SEQ ID NO: 1357254 - DNA, 19 bp, Homo sapiens
atattttatggttatgttt

SEQ ID NO: 1357255 - DNA, 15 bp, Homo sapiens
atattttatgtgaga

SEQ ID NO: 1357256 - DNA, 13 bp, Homo sapiens
atattttctattt

SEQ ID NO: 1357257 - DNA, 14 bp, Homo sapiens
atattttctatttt

SEQ ID NO: 1357258 - DNA, 13 bp, Homo sapiens
atattttgaatca

SEQ ID NO: 1357259 - DNA, 16 bp, Homo sapiens
atatttttagactcat

SEQ ID NO: 1357260 - DNA, 17 bp, Homo sapiens
atatttttcataaacaa

SEQ ID NO: 1357261 - DNA, 18 bp, Homo sapiens
atatttttcataaacaag

SEQ ID NO: 1357262 - DNA, 13 bp, Homo sapiens
atcaaaagtgcct

SEQ ID NO: 1357263 - DNA, 14 bp, Homo sapiens
atcaaaatagtcta

SEQ ID NO: 1357264 - DNA, 19 bp, Homo sapiens
atcaaagaggttttaaaaa

SEQ ID NO: 1357265 - DNA, 20 bp, Homo sapiens
atcaaagggataaagaaaaa

SEQ ID NO: 1357266 - DNA, 22 bp, Homo sapiens
atcaaagtcattaaagacagga

SEQ ID NO: 1357267 - DNA, 20 bp, Homo sapiens
atcaaatagaaccactatga

SEQ ID NO: 1357268 - DNA, 17 bp, Homo sapiens
atcaagaagactttagg

SEQ ID NO: 1357269 - DNA, 14 bp, Homo sapiens
atcaagagccttaa

SEQ ID NO: 1357270 - DNA, 16 bp, Homo sapiens
atcaagttcttaaaat

SEQ ID NO: 1357271 - DNA, 18 bp, Homo sapiens
atcaataatatattttct

SEQ ID NO: 1357272 - DNA, 12 bp, Homo sapiens
atcaatacacta

SEQ ID NO: 1357273 - DNA, 13 bp, Homo sapiens
atcaatcaaataa

SEQ ID NO: 1357274 - DNA, 19 bp, Homo sapiens
atcaatcctgattcctctc

SEQ ID NO: 1357275 - DNA, 20 bp, Homo sapiens
atcaatcctgattcctctct

SEQ ID NO: 1357276 - DNA, 13 bp, Homo sapiens
atcacaaatgact

SEQ ID NO: 1357277 - DNA, 20 bp, Homo sapiens
atcacaaatgactttattat

SEQ ID NO: 1357278 - DNA, 14 bp, Homo sapiens
atcacatttctatg

SEQ ID NO: 1357279 - DNA, 13 bp, Homo sapiens
atcaccagacagg

SEQ ID NO: 1357280 - DNA, 15 bp, Homo sapiens
atcaccatgtaagca

SEQ ID NO: 1357281 - DNA, 15 bp, Homo sapiens
atcaccctcttcctg

SEQ ID NO: 1357282 - DNA, 16 bp, Homo sapiens
atcaccctcttcctgt

SEQ ID NO: 1357283 - DNA, 23 bp, Homo sapiens
atcactacagtattactcttaca

SEQ ID NO: 1357284 - DNA, 21 bp, Homo sapiens
atcactgccacactctccatc

SEQ ID NO: 1357285 - DNA, 22 bp, Homo sapiens
atcactgccacactctccatca

SEQ ID NO: 1357286 - DNA, 19 bp, Homo sapiens
atcactgtatcattttctt

SEQ ID NO: 1357287 - DNA, 15 bp, Homo sapiens
atcactgtttagatt

SEQ ID NO: 1357288 - DNA, 14 bp, Homo sapiens
atcacttaaaacac

SEQ ID NO: 1357289 - DNA, 19 bp, Homo sapiens
atcacttagcgaacccttt

SEQ ID NO: 1357290 - DNA, 22 bp, Homo sapiens
atcactttgagcctgggaaata

SEQ ID NO: 1357291 - DNA, 16 bp, Homo sapiens
atcagaaagctttatt

SEQ ID NO: 1357292 - DNA, 16 bp, Homo sapiens
atcagccaagttttat

SEQ ID NO: 1357293 - DNA, 11 bp, Homo sapiens
atcagcctggg

SEQ ID NO: 1357294 - DNA, 13 bp, Homo sapiens
atcaggctcccag

SEQ ID NO: 1357295 - DNA, 23 bp, Homo sapiens
atcagtaacccccttaaatttaa

SEQ ID NO: 1357296 - DNA, 21 bp, Homo sapiens
atcataggcaccttttactgt

SEQ ID NO: 1357297 - DNA, 23 bp, Homo sapiens
atcataggcaccttttactgtga

SEQ ID NO: 1357298 - DNA, 19 bp, Homo sapiens
atcatagttactgtgtaaa

SEQ ID NO: 1357299 - DNA, 19 bp, Homo sapiens
atcatagttttatttatat

SEQ ID NO: 1357300 - DNA, 19 bp, Homo sapiens
atcatctatagaaagctat

SEQ ID NO: 1357301 - DNA, 22 bp, Homo sapiens
atcatgaaacttgtttcactga

SEQ ID NO: 1357302 - DNA, 23 bp, Homo sapiens
atcatgaaacttgtttcactgaa

SEQ ID NO: 1357303 - DNA, 17 bp, Homo sapiens
atcatgtactttttagt

SEQ ID NO: 1357304 - DNA, 13 bp, Homo sapiens
atcattcagaaat

SEQ ID NO: 1357305 - DNA, 23 bp, Homo sapiens
atcattcctttttatttatatgt

SEQ ID NO: 1357306 - DNA, 14 bp, Homo sapiens
atcattcttactaa

SEQ ID NO: 1357307 - DNA, 16 bp, Homo sapiens
atcatttcaggagtta

SEQ ID NO: 1357308 - DNA, 11 bp, Homo sapiens
atcattttcat

SEQ ID NO: 1357309 - DNA, 14 bp, Homo sapiens
atcattttgaaatt

SEQ ID NO: 1357310 - DNA, 15 bp, Homo sapiens
atccaactccagcaa

SEQ ID NO: 1357311 - DNA, 15 bp, Homo sapiens
atccaagcctccaca

SEQ ID NO: 1357312 - DNA, 16 bp, Homo sapiens
atccaagcctccacag

SEQ ID NO: 1357313 - DNA, 18 bp, Homo sapiens
atccaagcctccacagcg

SEQ ID NO: 1357314 - DNA, 15 bp, Homo sapiens
atccacatgaaaata

SEQ ID NO: 1357315 - DNA, 16 bp, Homo sapiens
atccacatgaaaataa

SEQ ID NO: 1357316 - DNA, 15 bp, Homo sapiens
atccagatgtggcta

SEQ ID NO: 1357317 - DNA, 19 bp, Homo sapiens
atccagcctggggctgagg

SEQ ID NO: 1357318 - DNA, 17 bp, Homo sapiens
atccagggggcaagagg

SEQ ID NO: 1357319 - DNA, 17 bp, Homo sapiens
atccagtgacctctctc

SEQ ID NO: 1357320 - DNA, 13 bp, Homo sapiens
atccatattttat

SEQ ID NO: 1357321 - DNA, 19 bp, Homo sapiens
atccatattttattactgt

SEQ ID NO: 1357322 - DNA, 23 bp, Homo sapiens
atccatattttattactgtttat

SEQ ID NO: 1357323 - DNA, 17 bp, Homo sapiens
atccctaccgacccagg

SEQ ID NO: 1357324 - DNA, 19 bp, Homo sapiens
atccctaccgacccagggt

SEQ ID NO: 1357325 - DNA, 15 bp, Homo sapiens
atccctgtgttaatt

SEQ ID NO: 1357326 - DNA, 13 bp, Homo sapiens
atccctttattac

SEQ ID NO: 1357327 - DNA, 19 bp, Homo sapiens
atcctaatttctcctccct

SEQ ID NO: 1357328 - DNA, 14 bp, Homo sapiens
atcctcctcccacc

SEQ ID NO: 1357329 - DNA, 16 bp, Homo sapiens
atcctggcagcccaga

SEQ ID NO: 1357330 - DNA, 18 bp, Homo sapiens
atcctggcagcccagaga

SEQ ID NO: 1357331 - DNA, 19 bp, Homo sapiens
atcctggcagcccagagac

SEQ ID NO: 1357332 - DNA, 20 bp, Homo sapiens
atcctggcagcccagagact

SEQ ID NO: 1357333 - DNA, 24 bp, Homo sapiens
atcctggcagcccagagactttgt

SEQ ID NO: 1357334 - DNA, 21 bp, Homo sapiens
atcctgggggcctgggttggg

SEQ ID NO: 1357335 - DNA, 21 bp, Homo sapiens
atcctgtgactgtctcactta

SEQ ID NO: 1357336 - DNA, 14 bp, Homo sapiens
atcctgtgtagcat

SEQ ID NO: 1357337 - DNA, 15 bp, Homo sapiens
atccttaaatcttaa

SEQ ID NO: 1357338 - DNA, 13 bp, Homo sapiens
atccttagaggtc

SEQ ID NO: 1357339 - DNA, 14 bp, Homo sapiens
atccttccattcca

SEQ ID NO: 1357340 - DNA, 15 bp, Homo sapiens
atccttccattccac

SEQ ID NO: 1357341 - DNA, 20 bp, Homo sapiens
atccttccattccacacaga

SEQ ID NO: 1357342 - DNA, 21 bp, Homo sapiens
atcgacttgtttttgcacatg

SEQ ID NO: 1357343 - DNA, 21 bp, Homo sapiens
atcgagtgccgcatctcacag

SEQ ID NO: 1357344 - DNA, 18 bp, Homo sapiens
atcgcaccattctgactc

SEQ ID NO: 1357345 - DNA, 16 bp, Homo sapiens
atcgccacaaactcta

SEQ ID NO: 1357346 - DNA, 16 bp, Homo sapiens
atcgctgtgatgctgg

SEQ ID NO: 1357347 - DNA, 19 bp, Homo sapiens
atcggctgcattgaagatc

SEQ ID NO: 1357348 - DNA, 15 bp, Homo sapiens
atcgtttttgtattt

SEQ ID NO: 1357349 - DNA, 15 bp, Homo sapiens
atctaatatatatga

SEQ ID NO: 1357350 - DNA, 18 bp, Homo sapiens
atctaatatatatgaata

SEQ ID NO: 1357351 - DNA, 20 bp, Homo sapiens
atctaatatatatgaataaa

SEQ ID NO: 1357352 - DNA, 14 bp, Homo sapiens
atctacaatctctt

SEQ ID NO: 1357353 - DNA, 23 bp, Homo sapiens
atctacaatctctttttgtttgc

SEQ ID NO: 1357354 - DNA, 10 bp, Homo sapiens
atctactgca

SEQ ID NO: 1357355 - DNA, 16 bp, Homo sapiens
atctagatatcgactt

SEQ ID NO: 1357356 - DNA, 20 bp, Homo sapiens
atctaggggagccttgattc

SEQ ID NO: 1357357 - DNA, 14 bp, Homo sapiens
atctataaaataga

SEQ ID NO: 1357358 - DNA, 20 bp, Homo sapiens
atctataaaatagatataaa

SEQ ID NO: 1357359 - DNA, 17 bp, Homo sapiens
atctatagaaagctata

SEQ ID NO: 1357360 - DNA, 14 bp, Homo sapiens
atctatatatataa

SEQ ID NO: 1357361 - DNA, 14 bp, Homo sapiens
atctatctatttga

SEQ ID NO: 1357362 - DNA, 14 bp, Homo sapiens
atctattaatatat

SEQ ID NO: 1357363 - DNA, 22 bp, Homo sapiens
atctattctgagaaaacaagca

SEQ ID NO: 1357364 - DNA, 12 bp, Homo sapiens
atctatttgagg

SEQ ID NO: 1357365 - DNA, 12 bp, Homo sapiens
atctcacagcta

SEQ ID NO: 1357366 - DNA, 13 bp, Homo sapiens
atctcagctttga

SEQ ID NO: 1357367 - DNA, 22 bp, Homo sapiens
atctcagctttgagaagccttc

SEQ ID NO: 1357368 - DNA, 17 bp, Homo sapiens
atacatgccacatcaaa

SEQ ID NO: 1357369 - DNA, 19 bp, Homo sapiens
atacatgtgatacattttt

SEQ ID NO: 1357370 - DNA, 20 bp, Homo sapiens
atacattgtatatatgtgta

SEQ ID NO: 1357371 - DNA, 16 bp, Homo sapiens
atacattttttaagct

SEQ ID NO: 1357372 - DNA, 12 bp, Homo sapiens
atactgaaccac

SEQ ID NO: 1357373 - DNA, 23 bp, Homo sapiens
atactgaaccacttgtagatttg

SEQ ID NO: 1357374 - DNA, 12 bp, Homo sapiens
atactgaaggaa

SEQ ID NO: 1357375 - DNA, 14 bp, Homo sapiens
atactgaaggaaaa

SEQ ID NO: 1357376 - DNA, 13 bp, Homo sapiens
atactgatggaat

SEQ ID NO: 1357377 - DNA, 19 bp, Homo sapiens
atactgcgactttctgcct

SEQ ID NO: 1357378 - DNA, 21 bp, Homo sapiens
atactggtgcagtcattatga

SEQ ID NO: 1357379 - DNA, 19 bp, Homo sapiens
atacttacctagtgaaact

SEQ ID NO: 1357380 - DNA, 20 bp, Homo sapiens
atacttacctagtgaaactt

SEQ ID NO: 1357381 - DNA, 13 bp, Homo sapiens
atacttgaaccat

SEQ ID NO: 1357382 - DNA, 22 bp, Homo sapiens
atacttgaaccataaaatgtcc

SEQ ID NO: 1357383 - DNA, 10 bp, Homo sapiens
atactttgta

SEQ ID NO: 1357384 - DNA, 14 bp, Homo sapiens
atactttgtaaata

SEQ ID NO: 1357385 - DNA, 12 bp, Homo sapiens
atagaaagctat

SEQ ID NO: 1357386 - DNA, 12 bp, Homo sapiens
atagaaatgtct

SEQ ID NO: 1357387 - DNA, 22 bp, Homo sapiens
atagaaatgtctcaaggcagtt

SEQ ID NO: 1357388 - DNA, 14 bp, Homo sapiens
atagaaattttgta

SEQ ID NO: 1357389 - DNA, 17 bp, Homo sapiens
atagaaattttgtaaga

SEQ ID NO: 1357390 - DNA, 23 bp, Homo sapiens
atagaaattttgtaagaaggcaa

SEQ ID NO: 1357391 - DNA, 13 bp, Homo sapiens
atagacaggtcct

SEQ ID NO: 1357392 - DNA, 18 bp, Homo sapiens
atagatataaatttttaa

SEQ ID NO: 1357393 - DNA, 19 bp, Homo sapiens
atagcaacaacaattggta

SEQ ID NO: 1357394 - DNA, 17 bp, Homo sapiens
atagcagccagttcaaa

SEQ ID NO: 1357395 - DNA, 19 bp, Homo sapiens
atagcagccagttcaaaaa

SEQ ID NO: 1357396 - DNA, 16 bp, Homo sapiens
atagcatcacttaaaa

SEQ ID NO: 1357397 - DNA, 17 bp, Homo sapiens
atagcatcacttaaaac

SEQ ID NO: 1357398 - DNA, 21 bp, Homo sapiens
atagcatctggaagatcattt

SEQ ID NO: 1357399 - DNA, 13 bp, Homo sapiens
atagcatgaaata

SEQ ID NO: 1357400 - DNA, 15 bp, Homo sapiens
atagcatgaaataaa

SEQ ID NO: 1357401 - DNA, 13 bp, Homo sapiens
atagcatgtaatg

SEQ ID NO: 1357402 - DNA, 15 bp, Homo sapiens
atagctaactgtaaa

SEQ ID NO: 1357403 - DNA, 20 bp, Homo sapiens
atagctccccgcttctgcct

SEQ ID NO: 1357404 - DNA, 16 bp, Homo sapiens
ataggatttttagaat

SEQ ID NO: 1357405 - DNA, 20 bp, Homo sapiens
ataggcaccttttactgtga

SEQ ID NO: 1357406 - DNA, 19 bp, Homo sapiens
atagtcaatggcttgttca

SEQ ID NO: 1357407 - DNA, 12 bp, Homo sapiens
atagtccctgcc

SEQ ID NO: 1357408 - DNA, 18 bp, Homo sapiens
atagtctaagactatata

SEQ ID NO: 1357409 - DNA, 21 bp, Homo sapiens
atagtctaagactatatatat

SEQ ID NO: 1357410 - DNA, 23 bp, Homo sapiens
atagtctaagactatatatataa

SEQ ID NO: 1357411 - DNA, 21 bp, Homo sapiens
atagtctctttaaaaggaaag

SEQ ID NO: 1357412 - DNA, 14 bp, Homo sapiens
atagtcttttgctt

SEQ ID NO: 1357413 - DNA, 16 bp, Homo sapiens
atagtcttttgctttt

SEQ ID NO: 1357414 - DNA, 14 bp, Homo sapiens
atagtgtaacttgc

SEQ ID NO: 1357415 - DNA, 18 bp, Homo sapiens
atagttactgtgtaaact

SEQ ID NO: 1357416 - DNA, 19 bp, Homo sapiens
atagttctgagctgccagt

SEQ ID NO: 1357417 - DNA, 19 bp, Homo sapiens
atagtttattttaaaacaa

SEQ ID NO: 1357418 - DNA, 13 bp, Homo sapiens
atagtttctttat

SEQ ID NO: 1357419 - DNA, 14 bp, Homo sapiens
atagtttggcattt

SEQ ID NO: 1357420 - DNA, 24 bp, Homo sapiens
atagttttatttatatttattgac

SEQ ID NO: 1357421 - DNA, 13 bp, Homo sapiens
atataagacaaat

SEQ ID NO: 1357422 - DNA, 23 bp, Homo sapiens
atataaggaaagcaataaatgaa

SEQ ID NO: 1357423 - DNA, 19 bp, Homo sapiens
atataatgaataaatcatt

SEQ ID NO: 1357424 - DNA, 22 bp, Homo sapiens
atataatttatttccactaaaa

SEQ ID NO: 1357425 - DNA, 17 bp, Homo sapiens
atatacacgaatagaca

SEQ ID NO: 1357426 - DNA, 14 bp, Homo sapiens
atatacatatatat

SEQ ID NO: 1357427 - DNA, 16 bp, Homo sapiens
atatacatgaagaata

SEQ ID NO: 1357428 - DNA, 13 bp, Homo sapiens
atataggctattt

SEQ ID NO: 1357429 - DNA, 22 bp, Homo sapiens
atataggctattttctaaagac

SEQ ID NO: 1357430 - DNA, 17 bp, Homo sapiens
atatataaaacggtgct

SEQ ID NO: 1357431 - DNA, 13 bp, Homo sapiens
atatataaatgta

SEQ ID NO: 1357432 - DNA, 14 bp, Homo sapiens
atatataaatgtat

SEQ ID NO: 1357433 - DNA, 16 bp, Homo sapiens
atatataaatgtataa

SEQ ID NO: 1357434 - DNA, 18 bp, Homo sapiens
atatataacatatatgga

SEQ ID NO: 1357435 - DNA, 17 bp, Homo sapiens
atatataatgttgccag

SEQ ID NO: 1357436 - DNA, 20 bp, Homo sapiens
atatataggctattttctaa

SEQ ID NO: 1357437 - DNA, 16 bp, Homo sapiens
atatatataacatata

SEQ ID NO: 1357438 - DNA, 11 bp, Homo sapiens
atatatataat

SEQ ID NO: 1357439 - DNA, 14 bp, Homo sapiens
atatatatgaataa

SEQ ID NO: 1357440 - DNA, 19 bp, Homo sapiens
atatatctatctatttgag

SEQ ID NO: 1357441 - DNA, 17 bp, Homo sapiens
atatattgaacttttgt

SEQ ID NO: 1357442 - DNA, 13 bp, Homo sapiens
atatatttctatt

SEQ ID NO: 1357443 - DNA, 23 bp, Homo sapiens
atatatttctattattaattgca

SEQ ID NO: 1357444 - DNA, 15 bp, Homo sapiens
atatattttctgttt

SEQ ID NO: 1357445 - DNA, 13 bp, Homo sapiens
atatcccttccag

SEQ ID NO: 1357446 - DNA, 13 bp, Homo sapiens
atatctaatatat

SEQ ID NO: 1357447 - DNA, 17 bp, Homo sapiens
atatctaatatatatga

SEQ ID NO: 1357448 - DNA, 17 bp, Homo sapiens
atatctataaaatagat

SEQ ID NO: 1357449 - DNA, 15 bp, Homo sapiens
atatctatatatata

SEQ ID NO: 1357450 - DNA, 13 bp, Homo sapiens
atatctatctatt

SEQ ID NO: 1357451 - DNA, 17 bp, Homo sapiens
atatctatctatttgag

SEQ ID NO: 1357452 - DNA, 18 bp, Homo sapiens
atatctatctatttgagg

SEQ ID NO: 1357453 - DNA, 13 bp, Homo sapiens
atatctattaata

SEQ ID NO: 1357454 - DNA, 13 bp, Homo sapiens
atatctctatttg

SEQ ID NO: 1357455 - DNA, 16 bp, Homo sapiens
atatctctatttgaga

SEQ ID NO: 1357456 - DNA, 13 bp, Homo sapiens
atatctggcctct

SEQ ID NO: 1357457 - DNA, 19 bp, Homo sapiens
atatctggcctctgctttc

SEQ ID NO: 1357458 - DNA, 23 bp, Homo sapiens
atatcttggcctaaacctcagtt

SEQ ID NO: 1357459 - DNA, 16 bp, Homo sapiens
atatgaacatacaaat

SEQ ID NO: 1357460 - DNA, 15 bp, Homo sapiens
atatgactttttata

SEQ ID NO: 1357461 - DNA, 20 bp, Homo sapiens
atatgatttaaatcagccgt

SEQ ID NO: 1357462 - DNA, 19 bp, Homo sapiens
atatggaattttgcaaaga

SEQ ID NO: 1357463 - DNA, 14 bp, Homo sapiens
atatggtatatata

SEQ ID NO: 1357464 - DNA, 13 bp, Homo sapiens
atatgtactgttt

SEQ ID NO: 1357465 - DNA, 15 bp, Homo sapiens
atatgtagtatctat

SEQ ID NO: 1357466 - DNA, 11 bp, Homo sapiens
atatgtatgtg

SEQ ID NO: 1357467 - DNA, 15 bp, Homo sapiens
atatgtatgtgttta

SEQ ID NO: 1357468 - DNA, 18 bp, Homo sapiens
atatgtatgtgtttagaa

SEQ ID NO: 1357469 - DNA, 20 bp, Homo sapiens
atatgtatgtgtttagaatt

SEQ ID NO: 1357470 - DNA, 23 bp, Homo sapiens
atatgtatgtgtttagaattgaa

SEQ ID NO: 1357471 - DNA, 18 bp, Homo sapiens
atatgtattatttataat

SEQ ID NO: 1357472 - DNA, 23 bp, Homo sapiens
atatgtattatttataattccta

SEQ ID NO: 1357473 - DNA, 18 bp, Homo sapiens
atatgtattcttttctca

SEQ ID NO: 1357474 - DNA, 17 bp, Homo sapiens
atattaaaaaagagaca

SEQ ID NO: 1357475 - DNA, 16 bp, Homo sapiens
atattacaaaaacaaa

SEQ ID NO: 1357476 - DNA, 15 bp, Homo sapiens
atattacaatgatca

SEQ ID NO: 1357477 - DNA, 16 bp, Homo sapiens
atattacaatgatcac

SEQ ID NO: 1357478 - DNA, 12 bp, Homo sapiens
atattacattta

SEQ ID NO: 1357479 - DNA, 16 bp, Homo sapiens
atattactgacatttc

SEQ ID NO: 1357480 - DNA, 15 bp, Homo sapiens
atattagaaaggctc

SEQ ID NO: 1357481 - DNA, 18 bp, Homo sapiens
atattattataatcttat

SEQ ID NO: 1357482 - DNA, 16 bp, Homo sapiens
atattcagatgtatgt

SEQ ID NO: 1357483 - DNA, 12 bp, Homo sapiens
atattcctttgc

SEQ ID NO: 1357484 - DNA, 20 bp, Homo sapiens
atattgaacttttgtactga

SEQ ID NO: 1357485 - DNA, 12 bp, Homo sapiens
atattgaatgtt

SEQ ID NO: 1357486 - DNA, 18 bp, Homo sapiens
atattgaggccaagaata

SEQ ID NO: 1357487 - DNA, 15 bp, Homo sapiens
atattgcaaaataca

SEQ ID NO: 1357488 - DNA, 18 bp, Homo sapiens
atattgcaaaatacatga

SEQ ID NO: 1357489 - DNA, 17 bp, Homo sapiens
atattggttttatgatg

SEQ ID NO: 1357490 - DNA, 18 bp, Homo sapiens
agttgaatacttgaacca

SEQ ID NO: 1357491 - DNA, 13 bp, Homo sapiens
agttgattcagct

SEQ ID NO: 1357492 - DNA, 17 bp, Homo sapiens
agttgattcagctctgc

SEQ ID NO: 1357493 - DNA, 23 bp, Homo sapiens
agttgattcagctctgcaagaat

SEQ ID NO: 1357494 - DNA, 13 bp, Homo sapiens
agttgctattttt

SEQ ID NO: 1357495 - DNA, 15 bp, Homo sapiens
agttgctatttttgt

SEQ ID NO: 1357496 - DNA, 15 bp, Homo sapiens
agttgctggtaaaat

SEQ ID NO: 1357497 - DNA, 18 bp, Homo sapiens
agttgctggtaaaatgaa

SEQ ID NO: 1357498 - DNA, 19 bp, Homo sapiens
agttgcttgtcttctggta

SEQ ID NO: 1357499 - DNA, 12 bp, Homo sapiens
agttgtaaagta

SEQ ID NO: 1357500 - DNA, 13 bp, Homo sapiens
agttgtaaagtat

SEQ ID NO: 1357501 - DNA, 18 bp, Homo sapiens
agttgtaaagtatgtatt

SEQ ID NO: 1357502 - DNA, 16 bp, Homo sapiens
agttgtaccaagtgaa

SEQ ID NO: 1357503 - DNA, 13 bp, Homo sapiens
agttgtctaaaca

SEQ ID NO: 1357504 - DNA, 20 bp, Homo sapiens
agttgtttttgtatattggt

SEQ ID NO: 1357505 - DNA, 22 bp, Homo sapiens
agttgtttttgtatattggttt

SEQ ID NO: 1357506 - DNA, 16 bp, Homo sapiens
agtttagaacaggttt

SEQ ID NO: 1357507 - DNA, 14 bp, Homo sapiens
agtttatcattcaa

SEQ ID NO: 1357508 - DNA, 15 bp, Homo sapiens
agtttatcattcaag

SEQ ID NO: 1357509 - DNA, 17 bp, Homo sapiens
agtttatcattcaagtg

SEQ ID NO: 1357510 - DNA, 20 bp, Homo sapiens
agtttcagtattagatgcac

SEQ ID NO: 1357511 - DNA, 18 bp, Homo sapiens
agtttcagtttgttggaa

SEQ ID NO: 1357512 - DNA, 22 bp, Homo sapiens
agtttctttattttgtgtaaaa

SEQ ID NO: 1357513 - DNA, 20 bp, Homo sapiens
agtttgagatcagcctgggc

SEQ ID NO: 1357514 - DNA, 14 bp, Homo sapiens
agtttgagctgcct

SEQ ID NO: 1357515 - DNA, 16 bp, Homo sapiens
agtttgagctgccttc

SEQ ID NO: 1357516 - DNA, 22 bp, Homo sapiens
agtttgtatgccaagtgagaag

SEQ ID NO: 1357517 - DNA, 21 bp, Homo sapiens
agtttgtcgctcatgtgtgca

SEQ ID NO: 1357518 - DNA, 13 bp, Homo sapiens
agtttgttggaaa

SEQ ID NO: 1357519 - DNA, 23 bp, Homo sapiens
agttttactgtctattaatattc

SEQ ID NO: 1357520 - DNA, 14 bp, Homo sapiens
agttttatatgctt

SEQ ID NO: 1357521 - DNA, 15 bp, Homo sapiens
agttttatatgcttt

SEQ ID NO: 1357522 - DNA, 19 bp, Homo sapiens
agttttatttatatttatt

SEQ ID NO: 1357523 - DNA, 18 bp, Homo sapiens
agttttcagaaaaagaaa

SEQ ID NO: 1357524 - DNA, 18 bp, Homo sapiens
agttttgacaagctggct

SEQ ID NO: 1357525 - DNA, 16 bp, Homo sapiens
agttttgtaaaagaaa

SEQ ID NO: 1357526 - DNA, 18 bp, Homo sapiens
agtttttatgagaaactt

SEQ ID NO: 1357527 - DNA, 15 bp, Homo sapiens
agtttttcctggaat

SEQ ID NO: 1357528 - DNA, 16 bp, Homo sapiens
agtttttggttgggaa

SEQ ID NO: 1357529 - DNA, 13 bp, Homo sapiens
ataaaaaatttta

SEQ ID NO: 1357530 - DNA, 13 bp, Homo sapiens
ataaaaagaatga

SEQ ID NO: 1357531 - DNA, 19 bp, Homo sapiens
ataaaacagagtaatcttg

SEQ ID NO: 1357532 - DNA, 14 bp, Homo sapiens
ataaaactaggaat

SEQ ID NO: 1357533 - DNA, 18 bp, Homo sapiens
ataaaatacatagtgaaa

SEQ ID NO: 1357534 - DNA, 18 bp, Homo sapiens
ataaaatagtatgaaaat

SEQ ID NO: 1357535 - DNA, 17 bp, Homo sapiens
ataaaatgtaattactt

SEQ ID NO: 1357536 - DNA, 18 bp, Homo sapiens
ataaacaccactggatta

SEQ ID NO: 1357537 - DNA, 12 bp, Homo sapiens
ataaacatgaaa

SEQ ID NO: 1357538 - DNA, 16 bp, Homo sapiens
ataaactttaatataa

SEQ ID NO: 1357539 - DNA, 20 bp, Homo sapiens
ataaactttaatataaagta

SEQ ID NO: 1357540 - DNA, 18 bp, Homo sapiens
ataaagaaaaaaatacta

SEQ ID NO: 1357541 - DNA, 16 bp, Homo sapiens
ataaagcagtattttt

SEQ ID NO: 1357542 - DNA, 14 bp, Homo sapiens
ataaaggataaaga

SEQ ID NO: 1357543 - DNA, 12 bp, Homo sapiens
ataaagtttgct

SEQ ID NO: 1357544 - DNA, 15 bp, Homo sapiens
ataaataaaaatgga

SEQ ID NO: 1357545 - DNA, 20 bp, Homo sapiens
ataaataacccataattgaa

SEQ ID NO: 1357546 - DNA, 12 bp, Homo sapiens
ataaataatttt

SEQ ID NO: 1357547 - DNA, 22 bp, Homo sapiens
ataaatatggttaatttcatgt

SEQ ID NO: 1357548 - DNA, 19 bp, Homo sapiens
ataaatcattcttactaaa

SEQ ID NO: 1357549 - DNA, 20 bp, Homo sapiens
ataaatcattcttactaaaa

SEQ ID NO: 1357550 - DNA, 20 bp, Homo sapiens
ataaatccagtgacctctct

SEQ ID NO: 1357551 - DNA, 22 bp, Homo sapiens
ataaatccagtgacctctctct

SEQ ID NO: 1357552 - DNA, 15 bp, Homo sapiens
ataaattcaactttg

SEQ ID NO: 1357553 - DNA, 20 bp, Homo sapiens
ataaattcaactttgtaaaa

SEQ ID NO: 1357554 - DNA, 16 bp, Homo sapiens
ataaattctataggaa

SEQ ID NO: 1357555 - DNA, 13 bp, Homo sapiens
ataaattttgaaa

SEQ ID NO: 1357556 - DNA, 15 bp, Homo sapiens
ataaattttgaaaag

SEQ ID NO: 1357557 - DNA, 21 bp, Homo sapiens
ataaattttgaaaagtaatat

SEQ ID NO: 1357558 - DNA, 23 bp, Homo sapiens
ataacacatttttttgcatgcat

SEQ ID NO: 1357559 - DNA, 19 bp, Homo sapiens
ataacagctgcaattccct

SEQ ID NO: 1357560 - DNA, 11 bp, Homo sapiens
ataacatatat

SEQ ID NO: 1357561 - DNA, 20 bp, Homo sapiens
ataacatatatggaagagga

SEQ ID NO: 1357562 - DNA, 15 bp, Homo sapiens
ataactgtatttgaa

SEQ ID NO: 1357563 - DNA, 18 bp, Homo sapiens
ataacttttacacgacca

SEQ ID NO: 1357564 - DNA, 21 bp, Homo sapiens
ataagaaataatgctacaatt

SEQ ID NO: 1357565 - DNA, 23 bp, Homo sapiens
ataagaagaagttcatgtccaaa

SEQ ID NO: 1357566 - DNA, 17 bp, Homo sapiens
ataagatgactgtgttg

SEQ ID NO: 1357567 - DNA, 14 bp, Homo sapiens
ataagccaaaatta

SEQ ID NO: 1357568 - DNA, 19 bp, Homo sapiens
ataagctactagcaaaata

SEQ ID NO: 1357569 - DNA, 15 bp, Homo sapiens
ataagctagttgaat

SEQ ID NO: 1357570 - DNA, 17 bp, Homo sapiens
ataagctagttgaatac

SEQ ID NO: 1357571 - DNA, 23 bp, Homo sapiens
ataagctagttgaatacttgaac

SEQ ID NO: 1357572 - DNA, 15 bp, Homo sapiens
ataagtatttataat

SEQ ID NO: 1357573 - DNA, 19 bp, Homo sapiens
ataagtatttataatagca

SEQ ID NO: 1357574 - DNA, 13 bp, Homo sapiens
ataagttattgca

SEQ ID NO: 1357575 - DNA, 20 bp, Homo sapiens
ataagttattgcagtttatc

SEQ ID NO: 1357576 - DNA, 11 bp, Homo sapiens
ataataaaaat

SEQ ID NO: 1357577 - DNA, 12 bp, Homo sapiens
ataatagaaatg

SEQ ID NO: 1357578 - DNA, 15 bp, Homo sapiens
ataatagaaatgtct

SEQ ID NO: 1357579 - DNA, 11 bp, Homo sapiens
ataatataaaa

SEQ ID NO: 1357580 - DNA, 21 bp, Homo sapiens
ataatattgtttggtaaatgt

SEQ ID NO: 1357581 - DNA, 18 bp, Homo sapiens
ataatgaggagtttatga

SEQ ID NO: 1357582 - DNA, 22 bp, Homo sapiens
ataattcctatatcctgtgact

SEQ ID NO: 1357583 - DNA, 22 bp, Homo sapiens
ataattcttttttattaatcac

SEQ ID NO: 1357584 - DNA, 21 bp, Homo sapiens
ataattgtacaaaattaagca

SEQ ID NO: 1357585 - DNA, 19 bp, Homo sapiens
ataatttaaaaatatattt

SEQ ID NO: 1357586 - DNA, 14 bp, Homo sapiens
ataatttagatggt

SEQ ID NO: 1357587 - DNA, 20 bp, Homo sapiens
ataatttatttccactaaaa

SEQ ID NO: 1357588 - DNA, 14 bp, Homo sapiens
ataatttcagggtg

SEQ ID NO: 1357589 - DNA, 21 bp, Homo sapiens
ataattttaaaaaagccttcc

SEQ ID NO: 1357590 - DNA, 18 bp, Homo sapiens
atacaaacctaccaaaat

SEQ ID NO: 1357591 - DNA, 18 bp, Homo sapiens
atacaaatgcatctttga

SEQ ID NO: 1357592 - DNA, 22 bp, Homo sapiens
atacaaatgcatctttgatgtg

SEQ ID NO: 1357593 - DNA, 16 bp, Homo sapiens
atacaacttaaataat

SEQ ID NO: 1357594 - DNA, 19 bp, Homo sapiens
atacaagttcttggtccct

SEQ ID NO: 1357595 - DNA, 18 bp, Homo sapiens
atacaatgaacacttata

SEQ ID NO: 1357596 - DNA, 20 bp, Homo sapiens
atacacgaatagacatcaaa

SEQ ID NO: 1357597 - DNA, 21 bp, Homo sapiens
atacactttgttgcaagatgt

SEQ ID NO: 1357598 - DNA, 23 bp, Homo sapiens
atacactttgttgcaagatgtga

SEQ ID NO: 1357599 - DNA, 16 bp, Homo sapiens
atacagaggcaactgc

SEQ ID NO: 1357600 - DNA, 15 bp, Homo sapiens
atacagcaaaggaaa

SEQ ID NO: 1357601 - DNA, 13 bp, Homo sapiens
atacagtgcagag

SEQ ID NO: 1357602 - DNA, 17 bp, Homo sapiens
atacagtgcagagcctt

SEQ ID NO: 1357603 - DNA, 21 bp, Homo sapiens
atacagtgcagagccttctca

SEQ ID NO: 1357604 - DNA, 23 bp, Homo sapiens
atacagtgcagagccttctcaga

SEQ ID NO: 1357605 - DNA, 16 bp, Homo sapiens
atacagttttcagaaa

SEQ ID NO: 1357606 - DNA, 17 bp, Homo sapiens
atacagttttcagaaaa

SEQ ID NO: 1357607 - DNA, 14 bp, Homo sapiens
atacataaaagaaa

SEQ ID NO: 1357608 - DNA, 15 bp, Homo sapiens
atacatagtgaaaat

SEQ ID NO: 1357609 - DNA, 15 bp, Homo sapiens
atacatatggatgtt

SEQ ID NO: 1357610 - DNA, 18 bp, Homo sapiens
atacatgaagcttcatgc

SEQ ID NO: 1357611 - DNA, 17 bp, Homo sapiens
agtattctaataagcta

SEQ ID NO: 1357612 - DNA, 12 bp, Homo sapiens
agtcaacagtac

SEQ ID NO: 1357613 - DNA, 13 bp, Homo sapiens
agtcaaggcctgc

SEQ ID NO: 1357614 - DNA, 13 bp, Homo sapiens
agtcacctctgtc

SEQ ID NO: 1357615 - DNA, 21 bp, Homo sapiens
agtcactggaggttgaagcca

SEQ ID NO: 1357616 - DNA, 22 bp, Homo sapiens
agtcactggaggttgaagccaa

SEQ ID NO: 1357617 - DNA, 13 bp, Homo sapiens
agtcagagacaga

SEQ ID NO: 1357618 - DNA, 15 bp, Homo sapiens
agtcagagacagata

SEQ ID NO: 1357619 - DNA, 17 bp, Homo sapiens
agtcagagacagatacc

SEQ ID NO: 1357620 - DNA, 11 bp, Homo sapiens
agtcatgtatg

SEQ ID NO: 1357621 - DNA, 12 bp, Homo sapiens
agtcatgtatgt

SEQ ID NO: 1357622 - DNA, 13 bp, Homo sapiens
agtcatgtatgtt

SEQ ID NO: 1357623 - DNA, 23 bp, Homo sapiens
agtcattaaagacaggagacaaa

SEQ ID NO: 1357624 - DNA, 23 bp, Homo sapiens
agtcattcagcagcaaattttca

SEQ ID NO: 1357625 - DNA, 17 bp, Homo sapiens
agtccaggctgccgtgg

SEQ ID NO: 1357626 - DNA, 12 bp, Homo sapiens
agtccccacccc

SEQ ID NO: 1357627 - DNA, 17 bp, Homo sapiens
agtccccacccctgccc

SEQ ID NO: 1357628 - DNA, 21 bp, Homo sapiens
agtccctgccacgaatttctg

SEQ ID NO: 1357629 - DNA, 13 bp, Homo sapiens
agtccgtgggacg

SEQ ID NO: 1357630 - DNA, 23 bp, Homo sapiens
agtccttgatttcaaagttttgt

SEQ ID NO: 1357631 - DNA, 17 bp, Homo sapiens
agtcgtggggtgtgctg

SEQ ID NO: 1357632 - DNA, 19 bp, Homo sapiens
agtctccggcctctccagc

SEQ ID NO: 1357633 - DNA, 16 bp, Homo sapiens
agtctctaggttctga

SEQ ID NO: 1357634 - DNA, 18 bp, Homo sapiens
agtctgagggcttgtagt

SEQ ID NO: 1357635 - DNA, 13 bp, Homo sapiens
agtctgttgtgtg

SEQ ID NO: 1357636 - DNA, 16 bp, Homo sapiens
agtctgttgtgtgtca

SEQ ID NO: 1357637 - DNA, 21 bp, Homo sapiens
agtcttaaggacaaagtgcca

SEQ ID NO: 1357638 - DNA, 16 bp, Homo sapiens
agtcttactacagaaa

SEQ ID NO: 1357639 - DNA, 18 bp, Homo sapiens
agtcttactacagaaatg

SEQ ID NO: 1357640 - DNA, 13 bp, Homo sapiens
agtcttagatcat

SEQ ID NO: 1357641 - DNA, 18 bp, Homo sapiens
agtcttagatcatagttt

SEQ ID NO: 1357642 - DNA, 14 bp, Homo sapiens
agtcttttgctttt

SEQ ID NO: 1357643 - DNA, 19 bp, Homo sapiens
agtcttttgcttttggcaa

SEQ ID NO: 1357644 - DNA, 11 bp, Homo sapiens
agtgaaaaagg

SEQ ID NO: 1357645 - DNA, 17 bp, Homo sapiens
agtgaaaaaggaggaag

SEQ ID NO: 1357646 - DNA, 23 bp, Homo sapiens
agtgaaaaaggaggaagagaaaa

SEQ ID NO: 1357647 - DNA, 17 bp, Homo sapiens
agtgaaattattttgga

SEQ ID NO: 1357648 - DNA, 16 bp, Homo sapiens
agtgaacttgggccac

SEQ ID NO: 1357649 - DNA, 19 bp, Homo sapiens
agtgacagttgcagccctt

SEQ ID NO: 1357650 - DNA, 15 bp, Homo sapiens
agtgatagtcttttg

SEQ ID NO: 1357651 - DNA, 15 bp, Homo sapiens
agtgatattacattt

SEQ ID NO: 1357652 - DNA, 16 bp, Homo sapiens
agtgatcaagaagact

SEQ ID NO: 1357653 - DNA, 17 bp, Homo sapiens
agtgcatggtggccaga

SEQ ID NO: 1357654 - DNA, 19 bp, Homo sapiens
agtgcatggtggccagagg

SEQ ID NO: 1357655 - DNA, 13 bp, Homo sapiens
agtgccctccagc

SEQ ID NO: 1357656 - DNA, 17 bp, Homo sapiens
agtgccctccagccccg

SEQ ID NO: 1357657 - DNA, 16 bp, Homo sapiens
agtgccgcatctcaca

SEQ ID NO: 1357658 - DNA, 17 bp, Homo sapiens
agtgcctttgcagctca

SEQ ID NO: 1357659 - DNA, 18 bp, Homo sapiens
agtgcctttgcagctcag

SEQ ID NO: 1357660 - DNA, 23 bp, Homo sapiens
agtgctattacgaagttcaagat

SEQ ID NO: 1357661 - DNA, 20 bp, Homo sapiens
agtgctccatagtttggcat

SEQ ID NO: 1357662 - DNA, 19 bp, Homo sapiens
agtgctggagtctcctgag

SEQ ID NO: 1357663 - DNA, 22 bp, Homo sapiens
agtgcttggaacatactgttca

SEQ ID NO: 1357664 - DNA, 20 bp, Homo sapiens
agtggaagtatgtatattaa

SEQ ID NO: 1357665 - DNA, 21 bp, Homo sapiens
agtggaagtatgtatattaaa

SEQ ID NO: 1357666 - DNA, 22 bp, Homo sapiens
agtggaagtatgtatattaaaa

SEQ ID NO: 1357667 - DNA, 21 bp, Homo sapiens
agtggaccgcccttttcccct

SEQ ID NO: 1357668 - DNA, 22 bp, Homo sapiens
agtggaccgcccttttccccta

SEQ ID NO: 1357669 - DNA, 18 bp, Homo sapiens
agtggcaggggacaggag

SEQ ID NO: 1357670 - DNA, 12 bp, Homo sapiens
agtgggaagccc

SEQ ID NO: 1357671 - DNA, 21 bp, Homo sapiens
agtgggaagcccatcctgacc

SEQ ID NO: 1357672 - DNA, 22 bp, Homo sapiens
agtgggaagcccatcctgacca

SEQ ID NO: 1357673 - DNA, 16 bp, Homo sapiens
agtggggtgctgggag

SEQ ID NO: 1357674 - DNA, 13 bp, Homo sapiens
agtgggtgaataa

SEQ ID NO: 1357675 - DNA, 18 bp, Homo sapiens
agtgggtgaataatacag

SEQ ID NO: 1357676 - DNA, 19 bp, Homo sapiens
agtgggtgaataatacagt

SEQ ID NO: 1357677 - DNA, 13 bp, Homo sapiens
agtggtcctagag

SEQ ID NO: 1357678 - DNA, 17 bp, Homo sapiens
agtggttttatactgaa

SEQ ID NO: 1357679 - DNA, 18 bp, Homo sapiens
agtggttttatactgaag

SEQ ID NO: 1357680 - DNA, 18 bp, Homo sapiens
agtgtaacttgcttaaat

SEQ ID NO: 1357681 - DNA, 20 bp, Homo sapiens
agtgtaacttgcttaaattt

SEQ ID NO: 1357682 - DNA, 20 bp, Homo sapiens
agtgtacatttctataaata

SEQ ID NO: 1357683 - DNA, 16 bp, Homo sapiens
agtgtagtttacagaa

SEQ ID NO: 1357684 - DNA, 17 bp, Homo sapiens
agtgtagtttacagaaa

SEQ ID NO: 1357685 - DNA, 19 bp, Homo sapiens
agtgtagtttacagaaaaa

SEQ ID NO: 1357686 - DNA, 16 bp, Homo sapiens
agtgtataatataaaa

SEQ ID NO: 1357687 - DNA, 18 bp, Homo sapiens
agtgtatgactgcacatg

SEQ ID NO: 1357688 - DNA, 17 bp, Homo sapiens
agtgtattaggaagtgt

SEQ ID NO: 1357689 - DNA, 17 bp, Homo sapiens
agtgtctataaaagaaa

SEQ ID NO: 1357690 - DNA, 16 bp, Homo sapiens
agtgtgaatactgctt

SEQ ID NO: 1357691 - DNA, 23 bp, Homo sapiens
agtgtgtatatattttgtgtgaa

SEQ ID NO: 1357692 - DNA, 13 bp, Homo sapiens
agtgttatatgaa

SEQ ID NO: 1357693 - DNA, 21 bp, Homo sapiens
agtgttggtatattttatatt

SEQ ID NO: 1357694 - DNA, 22 bp, Homo sapiens
agttaaaattgttatcaaaata

SEQ ID NO: 1357695 - DNA, 18 bp, Homo sapiens
agttaaatgttacctctg

SEQ ID NO: 1357696 - DNA, 14 bp, Homo sapiens
agttagtttgtata

SEQ ID NO: 1357697 - DNA, 14 bp, Homo sapiens
agttataagaagaa

SEQ ID NO: 1357698 - DNA, 15 bp, Homo sapiens
agttatggtgccgaa

SEQ ID NO: 1357699 - DNA, 20 bp, Homo sapiens
agttatgtaaataattcttt

SEQ ID NO: 1357700 - DNA, 16 bp, Homo sapiens
agttattgcagtttat

SEQ ID NO: 1357701 - DNA, 19 bp, Homo sapiens
agttattgcagtttatcat

SEQ ID NO: 1357702 - DNA, 15 bp, Homo sapiens
agttcaagatcaaaa

SEQ ID NO: 1357703 - DNA, 20 bp, Homo sapiens
agttcaagatcaaaaaggct

SEQ ID NO: 1357704 - DNA, 18 bp, Homo sapiens
agttcatcgattttctat

SEQ ID NO: 1357705 - DNA, 23 bp, Homo sapiens
agttctaacagtgaagttttact

SEQ ID NO: 1357706 - DNA, 14 bp, Homo sapiens
agttctaccggctt

SEQ ID NO: 1357707 - DNA, 17 bp, Homo sapiens
agttctgagctgccagt

SEQ ID NO: 1357708 - DNA, 18 bp, Homo sapiens
agttctgagctgccagtg

SEQ ID NO: 1357709 - DNA, 14 bp, Homo sapiens
agttctgtatttga

SEQ ID NO: 1357710 - DNA, 21 bp, Homo sapiens
agttctgtatttgaaagtgcc

SEQ ID NO: 1357711 - DNA, 23 bp, Homo sapiens
agttctgtatttgaaagtgcctt

SEQ ID NO: 1357712 - DNA, 23 bp, Homo sapiens
agttcttggtccctccagaacca

SEQ ID NO: 1357713 - DNA, 15 bp, Homo sapiens
agttctttggattct

SEQ ID NO: 1357714 - DNA, 21 bp, Homo sapiens
agttctttgttcatagcccag

SEQ ID NO: 1357715 - DNA, 22 bp, Homo sapiens
agttctttgttcatagcccagt

SEQ ID NO: 1357716 - DNA, 17 bp, Homo sapiens
agttgaaaaacagctga

SEQ ID NO: 1357717 - DNA, 18 bp, Homo sapiens
agttgaaaaacagctgag

SEQ ID NO: 1357718 - DNA, 15 bp, Homo sapiens
agttgaatacttgaa

SEQ ID NO: 1357719 - DNA, 20 bp, Homo sapiens
tatcattttcttttttaacc

SEQ ID NO: 1357720 - DNA, 16 bp, Homo sapiens
tatcccaagaatgcaa

SEQ ID NO: 1357721 - DNA, 22 bp, Homo sapiens
tatccccatctccctgcctggc

SEQ ID NO: 1357722 - DNA, 19 bp, Homo sapiens
tatccccccatcttgcttc

SEQ ID NO: 1357723 - DNA, 16 bp, Homo sapiens
tatcccttccagatgg

SEQ ID NO: 1357724 - DNA, 14 bp, Homo sapiens
tatccgctgccagc

SEQ ID NO: 1357725 - DNA, 16 bp, Homo sapiens
tatcctggaacaatat

SEQ ID NO: 1357726 - DNA, 12 bp, Homo sapiens
tatcgtttttgt

SEQ ID NO: 1357727 - DNA, 22 bp, Homo sapiens
tatctataaaatagatataaat

SEQ ID NO: 1357728 - DNA, 17 bp, Homo sapiens
tatctatctatttgagg

SEQ ID NO: 1357729 - DNA, 19 bp, Homo sapiens
tatctattaatatatgtat

SEQ ID NO: 1357730 - DNA, 19 bp, Homo sapiens
tatctattctgagaaaaca

SEQ ID NO: 1357731 - DNA, 23 bp, Homo sapiens
tatctattctgagaaaacaagca

SEQ ID NO: 1357732 - DNA, 15 bp, Homo sapiens
tatctcagggcctgg

SEQ ID NO: 1357733 - DNA, 16 bp, Homo sapiens
tatctccggctcccag

SEQ ID NO: 1357734 - DNA, 19 bp, Homo sapiens
tatctccggctcccagcct

SEQ ID NO: 1357735 - DNA, 20 bp, Homo sapiens
tatctccggctcccagcctc

SEQ ID NO: 1357736 - DNA, 23 bp, Homo sapiens
tatctgggattatggttttgtga

SEQ ID NO: 1357737 - DNA, 22 bp, Homo sapiens
tatctgtttcctgacattgtct

SEQ ID NO: 1357738 - DNA, 15 bp, Homo sapiens
tatcttgatacattc

SEQ ID NO: 1357739 - DNA, 21 bp, Homo sapiens
tatgaaaacatggaacagtgt

SEQ ID NO: 1357740 - DNA, 19 bp, Homo sapiens
tatgaaagcaacaaagaaa

SEQ ID NO: 1357741 - DNA, 19 bp, Homo sapiens
tatgactttttataaaatg

SEQ ID NO: 1357742 - DNA, 22 bp, Homo sapiens
tatgactttttataaaatggct

SEQ ID NO: 1357743 - DNA, 14 bp, Homo sapiens
tatgagattggttt

SEQ ID NO: 1357744 - DNA, 13 bp, Homo sapiens
tatgaggagggga

SEQ ID NO: 1357745 - DNA, 14 bp, Homo sapiens
tatgagtagccagg

SEQ ID NO: 1357746 - DNA, 16 bp, Homo sapiens
tatgatggttttaaac

SEQ ID NO: 1357747 - DNA, 12 bp, Homo sapiens
tatgattaaaaa

SEQ ID NO: 1357748 - DNA, 21 bp, Homo sapiens
tatgattaaaaatatcaaatt

SEQ ID NO: 1357749 - DNA, 17 bp, Homo sapiens
tatgcatcatttcagga

SEQ ID NO: 1357750 - DNA, 15 bp, Homo sapiens
tatgccacttccttt

SEQ ID NO: 1357751 - DNA, 20 bp, Homo sapiens
tatgccacttccttttaact

SEQ ID NO: 1357752 - DNA, 13 bp, Homo sapiens
tatgctatttctg

SEQ ID NO: 1357753 - DNA, 15 bp, Homo sapiens
tatggaattttgcaa

SEQ ID NO: 1357754 - DNA, 17 bp, Homo sapiens
tatggactatctgtctg

SEQ ID NO: 1357755 - DNA, 18 bp, Homo sapiens
tatggatgatttaagtgt

SEQ ID NO: 1357756 - DNA, 15 bp, Homo sapiens
tatggatgttactct

SEQ ID NO: 1357757 - DNA, 22 bp, Homo sapiens
tatggcagaaaaaatgtctgta

SEQ ID NO: 1357758 - DNA, 22 bp, Homo sapiens
tatgggttagatgttgccatgt

SEQ ID NO: 1357759 - DNA, 22 bp, Homo sapiens
tatggttacttcttctcttaga

SEQ ID NO: 1357760 - DNA, 13 bp, Homo sapiens
tatggttatgttt

SEQ ID NO: 1357761 - DNA, 14 bp, Homo sapiens
tatgtaaataattc

SEQ ID NO: 1357762 - DNA, 13 bp, Homo sapiens
tatgtagaagcat

SEQ ID NO: 1357763 - DNA, 17 bp, Homo sapiens
tatgtaggtaagactgt

SEQ ID NO: 1357764 - DNA, 21 bp, Homo sapiens
tatgtaggtaagactgtagat

SEQ ID NO: 1357765 - DNA, 13 bp, Homo sapiens
tatgtatgtgttt

SEQ ID NO: 1357766 - DNA, 17 bp, Homo sapiens
tatgtatgtgtttagaa

SEQ ID NO: 1357767 - DNA, 13 bp, Homo sapiens
tatgtattattta

SEQ ID NO: 1357768 - DNA, 18 bp, Homo sapiens
tatgtgaatttttaagct

SEQ ID NO: 1357769 - DNA, 13 bp, Homo sapiens
tatgtgtttagaa

SEQ ID NO: 1357770 - DNA, 13 bp, Homo sapiens
tatgttaaagaga

SEQ ID NO: 1357771 - DNA, 20 bp, Homo sapiens
tatgttgtttataataaaaa

SEQ ID NO: 1357772 - DNA, 22 bp, Homo sapiens
tatgtttctctttgattatttg

SEQ ID NO: 1357773 - DNA, 17 bp, Homo sapiens
tatgttttttaaaatat

SEQ ID NO: 1357774 - DNA, 14 bp, Homo sapiens
tattaaaactaaat

SEQ ID NO: 1357775 - DNA, 17 bp, Homo sapiens
tattaaaactaaatttc

SEQ ID NO: 1357776 - DNA, 19 bp, Homo sapiens
tattaaaactaaatttcac

SEQ ID NO: 1357777 - DNA, 17 bp, Homo sapiens
tattaaaatatttcagg

SEQ ID NO: 1357778 - DNA, 18 bp, Homo sapiens
tattaacttaataatcaa

SEQ ID NO: 1357779 - DNA, 13 bp, Homo sapiens
tattaatcactgt

SEQ ID NO: 1357780 - DNA, 15 bp, Homo sapiens
tattaatcactgtgt

SEQ ID NO: 1357781 - DNA, 20 bp, Homo sapiens
tattaatcactgtgtatatt

SEQ ID NO: 1357782 - DNA, 23 bp, Homo sapiens
tattaatcactgtgtatatttga

SEQ ID NO: 1357783 - DNA, 13 bp, Homo sapiens
tattaatgcactt

SEQ ID NO: 1357784 - DNA, 14 bp, Homo sapiens
tattaatgcacttt

SEQ ID NO: 1357785 - DNA, 17 bp, Homo sapiens
tattaatgttttcaaaa

SEQ ID NO: 1357786 - DNA, 14 bp, Homo sapiens
tattacaaaaacaa

SEQ ID NO: 1357787 - DNA, 22 bp, Homo sapiens
tattaccccctccttcagacac

SEQ ID NO: 1357788 - DNA, 21 bp, Homo sapiens
tattacgaagttcaagatcaa

SEQ ID NO: 1357789 - DNA, 14 bp, Homo sapiens
tattacttccatga

SEQ ID NO: 1357790 - DNA, 15 bp, Homo sapiens
tattagaaaggctct

SEQ ID NO: 1357791 - DNA, 15 bp, Homo sapiens
tattaggttgtcacg

SEQ ID NO: 1357792 - DNA, 20 bp, Homo sapiens
tattataaaggataaagaag

SEQ ID NO: 1357793 - DNA, 14 bp, Homo sapiens
tattataatcttat

SEQ ID NO: 1357794 - DNA, 19 bp, Homo sapiens
tattatacaggaaagcaat

SEQ ID NO: 1357795 - DNA, 14 bp, Homo sapiens
tattatacatgtga

SEQ ID NO: 1357796 - DNA, 21 bp, Homo sapiens
tattatacatgtgatacattt

SEQ ID NO: 1357797 - DNA, 16 bp, Homo sapiens
tattatggaaaactgt

SEQ ID NO: 1357798 - DNA, 18 bp, Homo sapiens
tattatgtaggtaagact

SEQ ID NO: 1357799 - DNA, 15 bp, Homo sapiens
tattattataatctt

SEQ ID NO: 1357800 - DNA, 22 bp, Homo sapiens
tattattataatcttataattg

SEQ ID NO: 1357801 - DNA, 15 bp, Homo sapiens
tattatttataattc

SEQ ID NO: 1357802 - DNA, 15 bp, Homo sapiens
tattctaataagcta

SEQ ID NO: 1357803 - DNA, 20 bp, Homo sapiens
tattctaataagctagttga

SEQ ID NO: 1357804 - DNA, 21 bp, Homo sapiens
tattctcttaatttttcttaa

SEQ ID NO: 1357805 - DNA, 15 bp, Homo sapiens
tattctgagaaaaca

SEQ ID NO: 1357806 - DNA, 22 bp, Homo sapiens
tattcttctcttccttttatca

SEQ ID NO: 1357807 - DNA, 14 bp, Homo sapiens
tattgaatgttaaa

SEQ ID NO: 1357808 - DNA, 11 bp, Homo sapiens
tattgacactg

SEQ ID NO: 1357809 - DNA, 17 bp, Homo sapiens
tattgaggccaagaata

SEQ ID NO: 1357810 - DNA, 21 bp, Homo sapiens
tattgaggccaagaatattgc

SEQ ID NO: 1357811 - DNA, 19 bp, Homo sapiens
tattgattgggaaaacatt

SEQ ID NO: 1357812 - DNA, 20 bp, Homo sapiens
tattgattgggaaaacattt

SEQ ID NO: 1357813 - DNA, 14 bp, Homo sapiens
tattgatttaagct

SEQ ID NO: 1357814 - DNA, 12 bp, Homo sapiens
tattgcaaaata

SEQ ID NO: 1357815 - DNA, 15 bp, Homo sapiens
tattgcaaaatacat

SEQ ID NO: 1357816 - DNA, 17 bp, Homo sapiens
tattgcaaaatacatga

SEQ ID NO: 1357817 - DNA, 19 bp, Homo sapiens
tattgcaaaatacatgaag

SEQ ID NO: 1357818 - DNA, 19 bp, Homo sapiens
tattgcagtttatcattca

SEQ ID NO: 1357819 - DNA, 15 bp, Homo sapiens
tattgtatttatgtg

SEQ ID NO: 1357820 - DNA, 22 bp, Homo sapiens
tattgtcctattagtgttatat

SEQ ID NO: 1357821 - DNA, 17 bp, Homo sapiens
tattgtgctcagagaca

SEQ ID NO: 1357822 - DNA, 19 bp, Homo sapiens
tattgttgacaactgtgac

SEQ ID NO: 1357823 - DNA, 23 bp, Homo sapiens
tattgttgacaactgtgactgta

SEQ ID NO: 1357824 - DNA, 16 bp, Homo sapiens
tattgtttaaaatgta

SEQ ID NO: 1357825 - DNA, 15 bp, Homo sapiens
tgacaactgtgactg

SEQ ID NO: 1357826 - DNA, 19 bp, Homo sapiens
tgacaataaagcttgttga

SEQ ID NO: 1357827 - DNA, 24 bp, Homo sapiens
tgacaatattccagatctttcaga

SEQ ID NO: 1357828 - DNA, 16 bp, Homo sapiens
tgacaattctgttttt

SEQ ID NO: 1357829 - DNA, 19 bp, Homo sapiens
tgacacaagtggaccttag

SEQ ID NO: 1357830 - DNA, 22 bp, Homo sapiens
tgacactgaaagttttgtaaaa

SEQ ID NO: 1357831 - DNA, 15 bp, Homo sapiens
tgacagaaggtgcca

SEQ ID NO: 1357832 - DNA, 17 bp, Homo sapiens
tgacagaaggtgccact

SEQ ID NO: 1357833 - DNA, 14 bp, Homo sapiens
tgacatctggaatc

SEQ ID NO: 1357834 - DNA, 20 bp, Homo sapiens
tgacatcttgaatccttcca

SEQ ID NO: 1357835 - DNA, 16 bp, Homo sapiens
tgacatggtgcctgag

SEQ ID NO: 1357836 - DNA, 17 bp, Homo sapiens
tgacatggtgcctgaga

SEQ ID NO: 1357837 - DNA, 18 bp, Homo sapiens
tgacatggtgcctgagag

SEQ ID NO: 1357838 - DNA, 19 bp, Homo sapiens
tgaccatgctcatctgctg

SEQ ID NO: 1357839 - DNA, 14 bp, Homo sapiens
tgaccctccaaatg

SEQ ID NO: 1357840 - DNA, 15 bp, Homo sapiens
tgaccctgatgaaaa

SEQ ID NO: 1357841 - DNA, 13 bp, Homo sapiens
tgacctactctca

SEQ ID NO: 1357842 - DNA, 15 bp, Homo sapiens
tgacctgaggctgtg

SEQ ID NO: 1357843 - DNA, 21 bp, Homo sapiens
tgacgtacaagtagttctgta

SEQ ID NO: 1357844 - DNA, 22 bp, Homo sapiens
tgacgtacaagtagttctgtat

SEQ ID NO: 1357845 - DNA, 23 bp, Homo sapiens
tgactaactcaaatacacatttg

SEQ ID NO: 1357846 - DNA, 15 bp, Homo sapiens
tgactaattttacat

SEQ ID NO: 1357847 - DNA, 21 bp, Homo sapiens
tgactaattttacatgtttat

SEQ ID NO: 1357848 - DNA, 23 bp, Homo sapiens
tgactatataatttatttccact

SEQ ID NO: 1357849 - DNA, 20 bp, Homo sapiens
tgactatgcgtggctggaac

SEQ ID NO: 1357850 - DNA, 18 bp, Homo sapiens
tgactcgggggtggggaa

SEQ ID NO: 1357851 - DNA, 16 bp, Homo sapiens
tgactcggtttctcca

SEQ ID NO: 1357852 - DNA, 18 bp, Homo sapiens
tgactcggtttctccaaa

SEQ ID NO: 1357853 - DNA, 11 bp, Homo sapiens
tgactctgggt

SEQ ID NO: 1357854 - DNA, 13 bp, Homo sapiens
tgactctgggtcc

SEQ ID NO: 1357855 - DNA, 15 bp, Homo sapiens
tgactctgggtcctt

SEQ ID NO: 1357856 - DNA, 18 bp, Homo sapiens
tgactctgggtccttcct

SEQ ID NO: 1357857 - DNA, 21 bp, Homo sapiens
tgactctgggtccttcctgaa

SEQ ID NO: 1357858 - DNA, 14 bp, Homo sapiens
tgactcttgagttg

SEQ ID NO: 1357859 - DNA, 19 bp, Homo sapiens
tgactcttgagttgttttt

SEQ ID NO: 1357860 - DNA, 18 bp, Homo sapiens
tgactgaggcagtttgag

SEQ ID NO: 1357861 - DNA, 21 bp, Homo sapiens
tgactgttttctcttgagagg

SEQ ID NO: 1357862 - DNA, 19 bp, Homo sapiens
tgacttaacatagccaaaa

SEQ ID NO: 1357863 - DNA, 20 bp, Homo sapiens
tgacttagaatccctgtgtt

SEQ ID NO: 1357864 - DNA, 22 bp, Homo sapiens
tgacttagaatccctgtgttaa

SEQ ID NO: 1357865 - DNA, 23 bp, Homo sapiens
tgacttagaatccctgtgttaat

SEQ ID NO: 1357866 - DNA, 13 bp, Homo sapiens
tgacttctgcctg

SEQ ID NO: 1357867 - DNA, 16 bp, Homo sapiens
tgacttttataaagca

SEQ ID NO: 1357868 - DNA, 22 bp, Homo sapiens
tgacttttctgtccgagctttg

SEQ ID NO: 1357869 - DNA, 15 bp, Homo sapiens
tgactttttttgtat

SEQ ID NO: 1357870 - DNA, 17 bp, Homo sapiens
tgactttttttgtatgt

SEQ ID NO: 1357871 - DNA, 18 bp, Homo sapiens
tgactttttttgtatgtg

SEQ ID NO: 1357872 - DNA, 14 bp, Homo sapiens
taaaaatagaaaca

SEQ ID NO: 1357873 - DNA, 15 bp, Homo sapiens
taaaaatagaaacat

SEQ ID NO: 1357874 - DNA, 23 bp, Homo sapiens
taaaaatatcaaattaattgtgt

SEQ ID NO: 1357875 - DNA, 18 bp, Homo sapiens
taaaaatcttttgaagca

SEQ ID NO: 1357876 - DNA, 12 bp, Homo sapiens
taaaaattgtta

SEQ ID NO: 1357877 - DNA, 15 bp, Homo sapiens
taaaacatagcaaat

SEQ ID NO: 1357878 - DNA, 14 bp, Homo sapiens
taagcaaatgttaa

SEQ ID NO: 1357879 - DNA, 18 bp, Homo sapiens
taagcatactttgtaaat

SEQ ID NO: 1357880 - DNA, 22 bp, Homo sapiens
taagcgtatggctttatttttt

SEQ ID NO: 1357881 - DNA, 15 bp, Homo sapiens
taagctactagcaaa

SEQ ID NO: 1357882 - DNA, 16 bp, Homo sapiens
taagctagttgaatac

SEQ ID NO: 1357883 - DNA, 22 bp, Homo sapiens
taagctgttcctgttcagtaat

SEQ ID NO: 1357884 - DNA, 22 bp, Homo sapiens
taaggaaaactacctgtattta

SEQ ID NO: 1357885 - DNA, 15 bp, Homo sapiens
taaggacaaagtgcc

SEQ ID NO: 1357886 - DNA, 19 bp, Homo sapiens
taaggactgactgaggcag

SEQ ID NO: 1357887 - DNA, 21 bp, Homo sapiens
taaggtctttcagtacttttt

SEQ ID NO: 1357888 - DNA, 15 bp, Homo sapiens
taaggtgtttgaaaa

SEQ ID NO: 1357889 - DNA, 17 bp, Homo sapiens
taaggtgtttgaaaata

SEQ ID NO: 1357890 - DNA, 14 bp, Homo sapiens
taagtatgttattt

SEQ ID NO: 1357891 - DNA, 17 bp, Homo sapiens
taagtcatgtatgtttc

SEQ ID NO: 1357892 - DNA, 18 bp, Homo sapiens
taagtcatgtatgtttct

SEQ ID NO: 1357893 - DNA, 12 bp, Homo sapiens
taagtccagtgt

SEQ ID NO: 1357894 - DNA, 21 bp, Homo sapiens
taagtgaggaaatcaaagtgc

SEQ ID NO: 1357895 - DNA, 18 bp, Homo sapiens
taagtgatttttttgtcc

SEQ ID NO: 1357896 - DNA, 12 bp, Homo sapiens
taagttattgca

SEQ ID NO: 1357897 - DNA, 14 bp, Homo sapiens
taagttattgcagt

SEQ ID NO: 1357898 - DNA, 21 bp, Homo sapiens
taagttcttatgaggagggga

SEQ ID NO: 1357899 - DNA, 21 bp, Homo sapiens
taataaaaaggagtatacaaa

SEQ ID NO: 1357900 - DNA, 23 bp, Homo sapiens
taataaaaaggagtatacaaaca

SEQ ID NO: 1357901 - DNA, 16 bp, Homo sapiens
taataagcactgtaaa

SEQ ID NO: 1357902 - DNA, 16 bp, Homo sapiens
taataagctagttgaa

SEQ ID NO: 1357903 - DNA, 17 bp, Homo sapiens
taataagctagttgaat

SEQ ID NO: 1357904 - DNA, 20 bp, Homo sapiens
taataagctagttgaatact

SEQ ID NO: 1357905 - DNA, 21 bp, Homo sapiens
taataagctagttgaatactt

SEQ ID NO: 1357906 - DNA, 20 bp, Homo sapiens
taataatcaagagccttaaa

SEQ ID NO: 1357907 - DNA, 22 bp, Homo sapiens
taataatcaagagccttaaaac

SEQ ID NO: 1357908 - DNA, 12 bp, Homo sapiens
taataatcttgt

SEQ ID NO: 1357909 - DNA, 15 bp, Homo sapiens
taataatcttgtttc

SEQ ID NO: 1357910 - DNA, 13 bp, Homo sapiens
taatacaaggtat

SEQ ID NO: 1357911 - DNA, 20 bp, Homo sapiens
taatacaaggtataataaaa

SEQ ID NO: 1357912 - DNA, 21 bp, Homo sapiens
taatacaaggtataataaaat

SEQ ID NO: 1357913 - DNA, 20 bp, Homo sapiens
taatactgaaccacttgtag

SEQ ID NO: 1357914 - DNA, 15 bp, Homo sapiens
taatagaaatgtctc

SEQ ID NO: 1357915 - DNA, 12 bp, Homo sapiens
taatataaaaaa

SEQ ID NO: 1357916 - DNA, 21 bp, Homo sapiens
taatataaagtagtcctgtga

SEQ ID NO: 1357917 - DNA, 16 bp, Homo sapiens
taatatagctgagact

SEQ ID NO: 1357918 - DNA, 21 bp, Homo sapiens
taatatattttctgttttctt

SEQ ID NO: 1357919 - DNA, 20 bp, Homo sapiens
taatattaaggaagacaatg

SEQ ID NO: 1357920 - DNA, 14 bp, Homo sapiens
taatattgagaaag

SEQ ID NO: 1357921 - DNA, 21 bp, Homo sapiens
taatattgtttggtaaatgtt

SEQ ID NO: 1357922 - DNA, 13 bp, Homo sapiens
taatatttattaa

SEQ ID NO: 1357923 - DNA, 17 bp, Homo sapiens
taatatttattaaattt

SEQ ID NO: 1357924 - DNA, 20 bp, Homo sapiens
taatcaccatgtaagcactc

SEQ ID NO: 1357925 - DNA, 10 bp, Homo sapiens
taatcactgt

SEQ ID NO: 1357926 - DNA, 12 bp, Homo sapiens
taatcactgtgt

SEQ ID NO: 1357927 - DNA, 14 bp, Homo sapiens
taatcactgtgtat

SEQ ID NO: 1357928 - DNA, 20 bp, Homo sapiens
taatcactgtgtatatttga

SEQ ID NO: 1357929 - DNA, 21 bp, Homo sapiens
taatcactgtgtatatttgat

SEQ ID NO: 1357930 - DNA, 14 bp, Homo sapiens
taatcatttgttta

SEQ ID NO: 1357931 - DNA, 19 bp, Homo sapiens
taatcatttgtttacattt

SEQ ID NO: 1357932 - DNA, 21 bp, Homo sapiens
taatcatttgtttacatttga

SEQ ID NO: 1357933 - DNA, 17 bp, Homo sapiens
taatccctgctttttgt

SEQ ID NO: 1357934 - DNA, 21 bp, Homo sapiens
taatccctgctttttgtgttt

SEQ ID NO: 1357935 - DNA, 14 bp, Homo sapiens
taatcctttggaaa

SEQ ID NO: 1357936 - DNA, 22 bp, Homo sapiens
taatcctttgttttctgactaa

SEQ ID NO: 1357937 - DNA, 17 bp, Homo sapiens
taatcggggtataatag

SEQ ID NO: 1357938 - DNA, 17 bp, Homo sapiens
taatctagatatcgact

SEQ ID NO: 1357939 - DNA, 14 bp, Homo sapiens
taatctctaggaag

SEQ ID NO: 1357940 - DNA, 17 bp, Homo sapiens
taatctctaggaagtca

SEQ ID NO: 1357941 - DNA, 17 bp, Homo sapiens
taatcttaatctgttta

SEQ ID NO: 1357942 - DNA, 16 bp, Homo sapiens
taatcttcaaagcctt

SEQ ID NO: 1357943 - DNA, 14 bp, Homo sapiens
taatgacgaggaac

SEQ ID NO: 1357944 - DNA, 19 bp, Homo sapiens
taatgccattttaaggaaa

SEQ ID NO: 1357945 - DNA, 14 bp, Homo sapiens
taatgctacaattt

SEQ ID NO: 1357946 - DNA, 19 bp, Homo sapiens
taatggaagtgtatttatt

SEQ ID NO: 1357947 - DNA, 23 bp, Homo sapiens
taatggaagtgtatttattttac

SEQ ID NO: 1357948 - DNA, 15 bp, Homo sapiens
taatggatttcagaa

SEQ ID NO: 1357949 - DNA, 16 bp, Homo sapiens
taatggcatgtcagac

SEQ ID NO: 1357950 - DNA, 16 bp, Homo sapiens
taattaactgaaacat

SEQ ID NO: 1357951 - DNA, 21 bp, Homo sapiens
taattaggcaaggctatgtga

SEQ ID NO: 1357952 - DNA, 22 bp, Homo sapiens
taattaggcaaggctatgtgat

SEQ ID NO: 1357953 - DNA, 23 bp, Homo sapiens
taattagttcctcattagcattt

SEQ ID NO: 1357954 - DNA, 20 bp, Homo sapiens
taattcttttttattaatca

SEQ ID NO: 1357955 - DNA, 22 bp, Homo sapiens
taattgatgcaaataacacaaa

SEQ ID NO: 1357956 - DNA, 14 bp, Homo sapiens
taattgctgtgtgt

SEQ ID NO: 1357957 - DNA, 22 bp, Homo sapiens
taattgtaaagtaaaagctata

SEQ ID NO: 1357958 - DNA, 21 bp, Homo sapiens
taattgtgaaaaagttaaaca

SEQ ID NO: 1357959 - DNA, 22 bp, Homo sapiens
taattgtgtgaacttggaagca

SEQ ID NO: 1357960 - DNA, 17 bp, Homo sapiens
taattgttctcagaatc

SEQ ID NO: 1357961 - DNA, 12 bp, Homo sapiens
taattgtttaaa

SEQ ID NO: 1357962 - DNA, 20 bp, Homo sapiens
taatttatttaatatttaat

SEQ ID NO: 1357963 - DNA, 12 bp, Homo sapiens
taatttcagggt

SEQ ID NO: 1357964 - DNA, 10 bp, Homo sapiens
taatttcctt

SEQ ID NO: 1357965 - DNA, 19 bp, Homo sapiens
taatttctcctcccttcct

SEQ ID NO: 1357966 - DNA, 20 bp, Homo sapiens
taatttgatgaggtattttt

SEQ ID NO: 1357967 - DNA, 12 bp, Homo sapiens
taattttaaagt

SEQ ID NO: 1357968 - DNA, 14 bp, Homo sapiens
taattttaaagtgc

SEQ ID NO: 1357969 - DNA, 21 bp, Homo sapiens
taatttttgtattatttttgt

SEQ ID NO: 1357970 - DNA, 13 bp, Homo sapiens
taattttttttaa

SEQ ID NO: 1357971 - DNA, 13 bp, Homo sapiens
tacaaaaagaaaa

SEQ ID NO: 1357972 - DNA, 22 bp, Homo sapiens
tacaaaaataaactataaaaca

SEQ ID NO: 1357973 - DNA, 14 bp, Homo sapiens
tacaaaattaagca

SEQ ID NO: 1357974 - DNA, 16 bp, Homo sapiens
tacaaatgcatctttg

SEQ ID NO: 1357975 - DNA, 21 bp, Homo sapiens
tacaaatgcatctttgatgtg

SEQ ID NO: 1357976 - DNA, 18 bp, Homo sapiens
tacaagtagttctgtatt

SEQ ID NO: 1357977 - DNA, 18 bp, Homo sapiens
tacaagtcagctccagct

SEQ ID NO: 1357978 - DNA, 23 bp, Homo sapiens
tacaatattgattgggaaaacat

SEQ ID NO: 1357979 - DNA, 15 bp, Homo sapiens
tacaatgaacactta

SEQ ID NO: 1357980 - DNA, 13 bp, Homo sapiens
tacaattttaaga

SEQ ID NO: 1357981 - DNA, 17 bp, Homo sapiens
tacacatttgctactgt

SEQ ID NO: 1357982 - DNA, 15 bp, Homo sapiens
tacacctggctgagg

SEQ ID NO: 1357983 - DNA, 20 bp, Homo sapiens
tacaccttgccttgctgttt

SEQ ID NO: 1357984 - DNA, 21 bp, Homo sapiens
tacactgcctgccttaagtga

SEQ ID NO: 1357985 - DNA, 24 bp, Homo sapiens
tacactggcaatggtagtttctgt

SEQ ID NO: 1357986 - DNA, 14 bp, Homo sapiens
tacactttgttgca

SEQ ID NO: 1357987 - DNA, 22 bp, Homo sapiens
tacagatgaatgtatttatttg

SEQ ID NO: 1357988 - DNA, 19 bp, Homo sapiens
tacagctttgatccctgac

SEQ ID NO: 1357989 - DNA, 17 bp, Homo sapiens
tacagtagattttccaa

SEQ ID NO: 1357990 - DNA, 21 bp, Homo sapiens
tacagtagattttccaaatgt

SEQ ID NO: 1357991 - DNA, 15 bp, Homo sapiens
tacagtatctcaggg

SEQ ID NO: 1357992 - DNA, 21 bp, Homo sapiens
tacagtggttttatactgaag

SEQ ID NO: 1357993 - DNA, 17 bp, Homo sapiens
tacagttgaaaaacagc

SEQ ID NO: 1357994 - DNA, 19 bp, Homo sapiens
tacagttgaaaaacagctg

SEQ ID NO: 1357995 - DNA, 17 bp, Homo sapiens
tacagttgaaataactg

SEQ ID NO: 1357996 - DNA, 21 bp, Homo sapiens
tagccggttcctgtccctgcg

SEQ ID NO: 1357997 - DNA, 16 bp, Homo sapiens
tagcgatctctcctgg

SEQ ID NO: 1357998 - DNA, 17 bp, Homo sapiens
tagctaactgtaaatca

SEQ ID NO: 1357999 - DNA, 21 bp, Homo sapiens
tagctgaagaattgaaaagtt

SEQ ID NO: 1358000 - DNA, 13 bp, Homo sapiens
tagcttctgcttt

SEQ ID NO: 1358001 - DNA, 17 bp, Homo sapiens
tagctttagaccctggg

SEQ ID NO: 1358002 - DNA, 17 bp, Homo sapiens
gtgaacagagagaccct

SEQ ID NO: 1358003 - DNA, 14 bp, Homo sapiens
gtgaacttggaagc

SEQ ID NO: 1358004 - DNA, 19 bp, Homo sapiens
gtgaacttgggccactgtg

SEQ ID NO: 1358005 - DNA, 20 bp, Homo sapiens
gtgaagatactttgtattgt

SEQ ID NO: 1358006 - DNA, 22 bp, Homo sapiens
gtgaatactgcttgaataaaca

SEQ ID NO: 1358007 - DNA, 13 bp, Homo sapiens
gtgaatattttca

SEQ ID NO: 1358008 - DNA, 16 bp, Homo sapiens
gtgaattattgacact

SEQ ID NO: 1358009 - DNA, 19 bp, Homo sapiens
gtgaatttttattgttgta

SEQ ID NO: 1358010 - DNA, 22 bp, Homo sapiens
gtgacagttgcagcccttgtga

SEQ ID NO: 1358011 - DNA, 15 bp, Homo sapiens
gtgacatggtgcctg

SEQ ID NO: 1358012 - DNA, 22 bp, Homo sapiens
gtgacatggtgcctgagaggca

SEQ ID NO: 1358013 - DNA, 12 bp, Homo sapiens
gtgaccctccaa

SEQ ID NO: 1358014 - DNA, 21 bp, Homo sapiens
gtgagaagtgaatgctgggac

SEQ ID NO: 1358015 - DNA, 23 bp, Homo sapiens
gtgagctcttcctatccctctcc

SEQ ID NO: 1358016 - DNA, 18 bp, Homo sapiens
ggacactccagggacaca

SEQ ID NO: 1358017 - DNA, 21 bp, Homo sapiens
ggacagattgcctgtttctga

SEQ ID NO: 1358018 - DNA, 19 bp, Homo sapiens
ggacagcttgagccgggcc

SEQ ID NO: 1358019 - DNA, 22 bp, Homo sapiens
ggacatgcaataaaatttaaaa

SEQ ID NO: 1358020 - DNA, 22 bp, Homo sapiens
ggaccctgtgacatggtgcctg

SEQ ID NO: 1358021 - DNA, 19 bp, Homo sapiens
ggacctcaggtgagaagca

SEQ ID NO: 1358022 - DNA, 14 bp, Homo sapiens
ggacctgccaggca

SEQ ID NO: 1358023 - DNA, 16 bp, Homo sapiens
ggacctgccaggcagg

SEQ ID NO: 1358024 - DNA, 21 bp, Homo sapiens
ggaccttaggccttcctctct

SEQ ID NO: 1358025 - DNA, 22 bp, Homo sapiens
ggacctttccaccacagccagc

SEQ ID NO: 1358026 - DNA, 20 bp, Homo sapiens
ggacgccactcatttcatct

SEQ ID NO: 1358027 - DNA, 19 bp, Homo sapiens
ggacgctccgctgccgtgc

SEQ ID NO: 1358028 - DNA, 15 bp, Homo sapiens
ggactcagccttcag

SEQ ID NO: 1358029 - DNA, 17 bp, Homo sapiens
ggactgactgaggcagt

SEQ ID NO: 1358030 - DNA, 15 bp, Homo sapiens
ggactgagtgggaag

SEQ ID NO: 1358031 - DNA, 19 bp, Homo sapiens
ggactgctaaataaaattt

SEQ ID NO: 1358032 - DNA, 15 bp, Homo sapiens
ggactgtaagggatt

SEQ ID NO: 1358033 - DNA, 18 bp, Homo sapiens
ggactgtagggagggcgg

SEQ ID NO: 1358034 - DNA, 23 bp, Homo sapiens
ggacttctacctgccctcaaggg

SEQ ID NO: 1358035 - DNA, 14 bp, Homo sapiens
ggagaagagcgcag

SEQ ID NO: 1358036 - DNA, 18 bp, Homo sapiens
ggagaagcggctggcagc

SEQ ID NO: 1358037 - DNA, 14 bp, Homo sapiens
ggagaagctgcagg

SEQ ID NO: 1358038 - DNA, 19 bp, Homo sapiens
ggagacggtttccagggag

SEQ ID NO: 1358039 - DNA, 21 bp, Homo sapiens
ggagactttgatgtcagcagt

SEQ ID NO: 1358040 - DNA, 20 bp, Homo sapiens
ggagagcatcggcctagggc

SEQ ID NO: 1358041 - DNA, 12 bp, Homo sapiens
ggagagcctgct

SEQ ID NO: 1358042 - DNA, 13 bp, Homo sapiens
ggagagcctgctg

SEQ ID NO: 1358043 - DNA, 13 bp, Homo sapiens
ggagagggaggtc

SEQ ID NO: 1358044 - DNA, 20 bp, Homo sapiens
ggagcactgggctcccgggc

SEQ ID NO: 1358045 - DNA, 23 bp, Homo sapiens
ggagccatgcgccccctccgccc

SEQ ID NO: 1358046 - DNA, 16 bp, Homo sapiens
ggagcccagccctccc

SEQ ID NO: 1358047 - DNA, 19 bp, Homo sapiens
ggagcccagccctccccat

SEQ ID NO: 1358048 - DNA, 22 bp, Homo sapiens
ggagcgagcatgtcgtggacac

SEQ ID NO: 1358049 - DNA, 17 bp, Homo sapiens
ggagctccactctgctt

SEQ ID NO: 1358050 - DNA, 12 bp, Homo sapiens
ggaggaagagaa

SEQ ID NO: 1358051 - DNA, 13 bp, Homo sapiens
ggaggaaggcaag

SEQ ID NO: 1358052 - DNA, 15 bp, Homo sapiens
ggaggaggaaggcaa

SEQ ID NO: 1358053 - DNA, 12 bp, Homo sapiens
ggaggagggaga

SEQ ID NO: 1358054 - DNA, 15 bp, Homo sapiens
ggaggagggggccgg

SEQ ID NO: 1358055 - DNA, 14 bp, Homo sapiens
ggaggcaggcatgg

SEQ ID NO: 1358056 - DNA, 15 bp, Homo sapiens
ggaggccccaggggg

SEQ ID NO: 1358057 - DNA, 17 bp, Homo sapiens
ggaggcccgcagagcgc

SEQ ID NO: 1358058 - DNA, 13 bp, Homo sapiens
ggaggccgaggcc

SEQ ID NO: 1358059 - DNA, 18 bp, Homo sapiens
ggaggccgaggccatgtg

SEQ ID NO: 1358060 - DNA, 22 bp, Homo sapiens
ggaggctcctgcctgagcttcc

SEQ ID NO: 1358061 - DNA, 20 bp, Homo sapiens
ggagggcggcaggggcctgg

SEQ ID NO: 1358062 - DNA, 16 bp, Homo sapiens
ggaggggagactttga

SEQ ID NO: 1358063 - DNA, 14 bp, Homo sapiens
ggaggggagggtaa

SEQ ID NO: 1358064 - DNA, 14 bp, Homo sapiens
ggagggggatccga

SEQ ID NO: 1358065 - DNA, 14 bp, Homo sapiens
ggagggtgggaagg

SEQ ID NO: 1358066 - DNA, 17 bp, Homo sapiens
ggaggtcactggaaagg

SEQ ID NO: 1358067 - DNA, 15 bp, Homo sapiens
ggaggtcgaggcagg

SEQ ID NO: 1358068 - DNA, 17 bp, Homo sapiens
ggaggtgattccagtga

SEQ ID NO: 1358069 - DNA, 20 bp, Homo sapiens
ggaggtggaagaagggagaa

SEQ ID NO: 1358070 - DNA, 16 bp, Homo sapiens
ggaggttgaagccaag

SEQ ID NO: 1358071 - DNA, 20 bp, Homo sapiens
ggagtgtatgactgcacatg

SEQ ID NO: 1358072 - DNA, 18 bp, Homo sapiens
ggagtgtctggaattgtg

SEQ ID NO: 1358073 - DNA, 22 bp, Homo sapiens
ggagttctaacaaaacaagttg

SEQ ID NO: 1358074 - DNA, 19 bp, Homo sapiens
ggatagctaactgtaaatc

SEQ ID NO: 1358075 - DNA, 16 bp, Homo sapiens
ggatagttgctatttt

SEQ ID NO: 1358076 - DNA, 19 bp, Homo sapiens
ggatatataggctattttc

SEQ ID NO: 1358077 - DNA, 18 bp, Homo sapiens
ggatcaggctcccaggag

SEQ ID NO: 1358078 - DNA, 21 bp, Homo sapiens
ggatcccaagcctcctgctgc

SEQ ID NO: 1358079 - DNA, 16 bp, Homo sapiens
ggatccccgcctggcc

SEQ ID NO: 1358080 - DNA, 21 bp, Homo sapiens
ggatccccgcctggccaggag

SEQ ID NO: 1358081 - DNA, 22 bp, Homo sapiens
ggatccccgcctggccaggagc

SEQ ID NO: 1358082 - DNA, 17 bp, Homo sapiens
ggatccgactgctttgg

SEQ ID NO: 1358083 - DNA, 17 bp, Homo sapiens
ggatctcagctttgaga

SEQ ID NO: 1358084 - DNA, 22 bp, Homo sapiens
ggatctcagctttgagaagcct

SEQ ID NO: 1358085 - DNA, 17 bp, Homo sapiens
ggatgccagggccgacc

SEQ ID NO: 1358086 - DNA, 16 bp, Homo sapiens
ggatggccccagcaca

SEQ ID NO: 1358087 - DNA, 14 bp, Homo sapiens
ggatggcttgtcta

SEQ ID NO: 1358088 - DNA, 18 bp, Homo sapiens
ggattagtttagaacagg

SEQ ID NO: 1358089 - DNA, 15 bp, Homo sapiens
ggattgcctctgaaa

SEQ ID NO: 1358090 - DNA, 16 bp, Homo sapiens
ggcaagagggggtgga

SEQ ID NO: 1358091 - DNA, 13 bp, Homo sapiens
ggcaagccaggct

SEQ ID NO: 1358092 - DNA, 18 bp, Homo sapiens
ggcaaggactttgtacat

SEQ ID NO: 1358093 - DNA, 17 bp, Homo sapiens
ggcaataaattttgaaa

SEQ ID NO: 1358094 - DNA, 19 bp, Homo sapiens
ggcaataaattttgaaaag

SEQ ID NO: 1358095 - DNA, 14 bp, Homo sapiens
ggcaatattaacct

SEQ ID NO: 1358096 - DNA, 23 bp, Homo sapiens
ggcacaggaggcaggcatggccc

SEQ ID NO: 1358097 - DNA, 15 bp, Homo sapiens
ggcaccagcagcctg

SEQ ID NO: 1358098 - DNA, 15 bp, Homo sapiens
ggcaccaggaagccg

SEQ ID NO: 1358099 - DNA, 20 bp, Homo sapiens
ggcacccaccgtggaggagg

SEQ ID NO: 1358100 - DNA, 14 bp, Homo sapiens
ggcacgggtggtcc

SEQ ID NO: 1358101 - DNA, 15 bp, Homo sapiens
ggcacgggtggtccc

SEQ ID NO: 1358102 - DNA, 16 bp, Homo sapiens
ggcactggcgaggaga

SEQ ID NO: 1358103 - DNA, 14 bp, Homo sapiens
ggcacttgcctggg

SEQ ID NO: 1358104 - DNA, 19 bp, Homo sapiens
ggcagagctggctctgagc

SEQ ID NO: 1358105 - DNA, 12 bp, Homo sapiens
ggcagcctctgt

SEQ ID NO: 1358106 - DNA, 20 bp, Homo sapiens
ggcagcctctgtcaggcctt

SEQ ID NO: 1358107 - DNA, 11 bp, Homo sapiens
ggcagctgcta

SEQ ID NO: 1358108 - DNA, 22 bp, Homo sapiens
ggcagctgctatttattttcct

SEQ ID NO: 1358109 - DNA, 17 bp, Homo sapiens
ggcaggcatggccctgg

SEQ ID NO: 1358110 - DNA, 13 bp, Homo sapiens
ggcaggctcactg

SEQ ID NO: 1358111 - DNA, 17 bp, Homo sapiens
ggcaggctggccagtcc

SEQ ID NO: 1358112 - DNA, 14 bp, Homo sapiens
ggcaggctgggcca

SEQ ID NO: 1358113 - DNA, 17 bp, Homo sapiens
ggcagggagctgggccc

SEQ ID NO: 1358114 - DNA, 16 bp, Homo sapiens
ggcagggaggcagccg

SEQ ID NO: 1358115 - DNA, 20 bp, Homo sapiens
ggcaggtgctggagcactgg

SEQ ID NO: 1358116 - DNA, 15 bp, Homo sapiens
ggcatctatctgtgc

SEQ ID NO: 1358117 - DNA, 21 bp, Homo sapiens
ggcatgagactcagtgcagat

SEQ ID NO: 1358118 - DNA, 16 bp, Homo sapiens
ggcatgcggtcgggca

SEQ ID NO: 1358119 - DNA, 17 bp, Homo sapiens
ggcatgcggtcgggcag

SEQ ID NO: 1358120 - DNA, 16 bp, Homo sapiens
ggcatggccctgggcg

SEQ ID NO: 1358121 - DNA, 18 bp, Homo sapiens
ggcatggttttgtgccat

SEQ ID NO: 1358122 - DNA, 22 bp, Homo sapiens
ggccaagaatattgcaaaatac

SEQ ID NO: 1358123 - DNA, 16 bp, Homo sapiens
ggccacatggcggaga

SEQ ID NO: 1358124 - DNA, 13 bp, Homo sapiens
ggccaccaaagct

SEQ ID NO: 1358125 - DNA, 16 bp, Homo sapiens
ggccaccaaagctgcc

SEQ ID NO: 1358126 - DNA, 17 bp, Homo sapiens
ggccaccaaagctgccc

SEQ ID NO: 1358127 - DNA, 18 bp, Homo sapiens
ggccaccaaagctgccca

SEQ ID NO: 1358128 - DNA, 16 bp, Homo sapiens
ggccacctccccagca

SEQ ID NO: 1358129 - DNA, 17 bp, Homo sapiens
ggccacctccccagcat

SEQ ID NO: 1358130 - DNA, 20 bp, Homo sapiens
ggccactgtgaagagaacca

SEQ ID NO: 1358131 - DNA, 18 bp, Homo sapiens
ggccagagagcctggtgc

SEQ ID NO: 1358132 - DNA, 16 bp, Homo sapiens
ggccagaggcccccag

SEQ ID NO: 1358133 - DNA, 18 bp, Homo sapiens
ggccagaggcccccagcc

SEQ ID NO: 1358134 - DNA, 22 bp, Homo sapiens
ggccagaggcccccagcccagg

SEQ ID NO: 1358135 - DNA, 16 bp, Homo sapiens
ggccagcctccgagag

SEQ ID NO: 1358136 - DNA, 21 bp, Homo sapiens
ggccaggagcaggcacgggtg

SEQ ID NO: 1358137 - DNA, 22 bp, Homo sapiens
gctctgaccacttgaggcctga

SEQ ID NO: 1358138 - DNA, 14 bp, Homo sapiens
gctctgagcgcctc

SEQ ID NO: 1358139 - DNA, 16 bp, Homo sapiens
gctctgccgtctctgg

SEQ ID NO: 1358140 - DNA, 15 bp, Homo sapiens
gctctggaggggagg

SEQ ID NO: 1358141 - DNA, 17 bp, Homo sapiens
gctctgggatcctgggg

SEQ ID NO: 1358142 - DNA, 15 bp, Homo sapiens
gctcttcagatgcca

SEQ ID NO: 1358143 - DNA, 20 bp, Homo sapiens
gctcttcctatccctctcct

SEQ ID NO: 1358144 - DNA, 14 bp, Homo sapiens
gctgaaattctcct

SEQ ID NO: 1358145 - DNA, 15 bp, Homo sapiens
gctgaaattctcctg

SEQ ID NO: 1358146 - DNA, 16 bp, Homo sapiens
gctgaaattctcctgg

SEQ ID NO: 1358147 - DNA, 17 bp, Homo sapiens
gctgaatacagaggcaa

SEQ ID NO: 1358148 - DNA, 20 bp, Homo sapiens
gctgaatgttgggactgcta

SEQ ID NO: 1358149 - DNA, 22 bp, Homo sapiens
gctgaccatgctcatctgctgg

SEQ ID NO: 1358150 - DNA, 13 bp, Homo sapiens
gctgagcctctgc

SEQ ID NO: 1358151 - DNA, 15 bp, Homo sapiens
gctgagcctgcaggg

SEQ ID NO: 1358152 - DNA, 19 bp, Homo sapiens
gctgagcctgcagggaagc

SEQ ID NO: 1358153 - DNA, 14 bp, Homo sapiens
gctgaggcctgggc

SEQ ID NO: 1358154 - DNA, 16 bp, Homo sapiens
gctgaggcctgggccg

SEQ ID NO: 1358155 - DNA, 17 bp, Homo sapiens
gctgaggcctgggccgc

SEQ ID NO: 1358156 - DNA, 23 bp, Homo sapiens
gctgaggcctgggccgctgccac

SEQ ID NO: 1358157 - DNA, 18 bp, Homo sapiens
gctgagggtgagtgggtg

SEQ ID NO: 1358158 - DNA, 13 bp, Homo sapiens
gctgaggttcctc

SEQ ID NO: 1358159 - DNA, 16 bp, Homo sapiens
gctgaggttcctctgc

SEQ ID NO: 1358160 - DNA, 20 bp, Homo sapiens
gctgaggttcctctgcctgc

SEQ ID NO: 1358161 - DNA, 22 bp, Homo sapiens
gctgaggttcctctgcctgccc

SEQ ID NO: 1358162 - DNA, 23 bp, Homo sapiens
gctgaggttcctctgcctgcccc

SEQ ID NO: 1358163 - DNA, 17 bp, Homo sapiens
gctgagtggcaggggac

SEQ ID NO: 1358164 - DNA, 17 bp, Homo sapiens
gctgatgtcaatttctg

SEQ ID NO: 1358165 - DNA, 23 bp, Homo sapiens
gctgatgtcaatttctgtgttgc

SEQ ID NO: 1358166 - DNA, 15 bp, Homo sapiens
gctgcaattccctgg

SEQ ID NO: 1358167 - DNA, 18 bp, Homo sapiens
gctgcagagatttctcat

SEQ ID NO: 1358168 - DNA, 22 bp, Homo sapiens
gctgcagaggccagaggccccc

SEQ ID NO: 1358169 - DNA, 16 bp, Homo sapiens
gctgcagcaccgaggg

SEQ ID NO: 1358170 - DNA, 17 bp, Homo sapiens
gctgcatgccctctcag

SEQ ID NO: 1358171 - DNA, 18 bp, Homo sapiens
gctgcatgccctctcagg

SEQ ID NO: 1358172 - DNA, 19 bp, Homo sapiens
gctgcatgccctctcaggc

SEQ ID NO: 1358173 - DNA, 16 bp, Homo sapiens
gctgccagccttgagc

SEQ ID NO: 1358174 - DNA, 23 bp, Homo sapiens
gctgccagccttgagccctggct

SEQ ID NO: 1358175 - DNA, 22 bp, Homo sapiens
gctgcccactgtttctcttgag

SEQ ID NO: 1358176 - DNA, 22 bp, Homo sapiens
gctgccccatctcccctcagct

SEQ ID NO: 1358177 - DNA, 18 bp, Homo sapiens
gctgcccctctcaccaaa

SEQ ID NO: 1358178 - DNA, 13 bp, Homo sapiens
gctgcccttgggc

SEQ ID NO: 1358179 - DNA, 18 bp, Homo sapiens
gctgcccttgggccaccc

SEQ ID NO: 1358180 - DNA, 22 bp, Homo sapiens
gctgccgtggggccgccgcctc

SEQ ID NO: 1358181 - DNA, 13 bp, Homo sapiens
gctgcctctttcc

SEQ ID NO: 1358182 - DNA, 12 bp, Homo sapiens
gctgccttccct

SEQ ID NO: 1358183 - DNA, 16 bp, Homo sapiens
gctgcgcttgcttttc

SEQ ID NO: 1358184 - DNA, 13 bp, Homo sapiens
gctgctccctggc

SEQ ID NO: 1358185 - DNA, 22 bp, Homo sapiens
gctgctcttcatcccattccag

SEQ ID NO: 1358186 - DNA, 12 bp, Homo sapiens
gctgctgctgct

SEQ ID NO: 1358187 - DNA, 15 bp, Homo sapiens
gctgctggtgcacag

SEQ ID NO: 1358188 - DNA, 21 bp, Homo sapiens
gctgcttaataccaaacatgc

SEQ ID NO: 1358189 - DNA, 17 bp, Homo sapiens
gctggaagatcctgcgg

SEQ ID NO: 1358190 - DNA, 15 bp, Homo sapiens
gctggagtctcctga

SEQ ID NO: 1358191 - DNA, 14 bp, Homo sapiens
gctggccagtccag

SEQ ID NO: 1358192 - DNA, 14 bp, Homo sapiens
gctggccccagccc

SEQ ID NO: 1358193 - DNA, 16 bp, Homo sapiens
gctggccccagccctg

SEQ ID NO: 1358194 - DNA, 22 bp, Homo sapiens
gctggccccagccctgctgggg

SEQ ID NO: 1358195 - DNA, 19 bp, Homo sapiens
gctggcctctctagcacaa

SEQ ID NO: 1358196 - DNA, 21 bp, Homo sapiens
gctggcctttgtaagtgcagg

SEQ ID NO: 1358197 - DNA, 15 bp, Homo sapiens
gctggcgagagtctg

SEQ ID NO: 1358198 - DNA, 16 bp, Homo sapiens
gctggctctgagcgcc

SEQ ID NO: 1358199 - DNA, 22 bp, Homo sapiens
gctgggactcagccttcagaca

SEQ ID NO: 1358200 - DNA, 16 bp, Homo sapiens
gctgggagctccactc

SEQ ID NO: 1358201 - DNA, 21 bp, Homo sapiens
gctgggagctccactctgctt

SEQ ID NO: 1358202 - DNA, 22 bp, Homo sapiens
gctgggagctccactctgcttc

SEQ ID NO: 1358203 - DNA, 19 bp, Homo sapiens
gctgggccatgtccaaaga

SEQ ID NO: 1358204 - DNA, 22 bp, Homo sapiens
gctgggcccgacatggctccgg

SEQ ID NO: 1358205 - DNA, 12 bp, Homo sapiens
gctggggaagga

SEQ ID NO: 1358206 - DNA, 22 bp, Homo sapiens
gctggggatccccgcctggcca

SEQ ID NO: 1358207 - DNA, 14 bp, Homo sapiens
gccagagccgggca

SEQ ID NO: 1358208 - DNA, 19 bp, Homo sapiens
gccagaggaatcctggcag

SEQ ID NO: 1358209 - DNA, 19 bp, Homo sapiens
gccagaggcccccagccca

SEQ ID NO: 1358210 - DNA, 20 bp, Homo sapiens
gccagaggcccccagcccag

SEQ ID NO: 1358211 - DNA, 24 bp, Homo sapiens
gccagaggcccccagcccagggct

SEQ ID NO: 1358212 - DNA, 19 bp, Homo sapiens
gccagcagcagcaggtgat

SEQ ID NO: 1358213 - DNA, 21 bp, Homo sapiens
gccagcccggccgctccacca

SEQ ID NO: 1358214 - DNA, 22 bp, Homo sapiens
gccagcccggccgctccaccag

SEQ ID NO: 1358215 - DNA, 13 bp, Homo sapiens
gccagcctcctct

SEQ ID NO: 1358216 - DNA, 15 bp, Homo sapiens
gccagcctcctctgg

SEQ ID NO: 1358217 - DNA, 16 bp, Homo sapiens
gccagcctcctctgga

SEQ ID NO: 1358218 - DNA, 14 bp, Homo sapiens
gccagcgcctccct

SEQ ID NO: 1358219 - DNA, 16 bp, Homo sapiens
gccagcgcctccctcc

SEQ ID NO: 1358220 - DNA, 23 bp, Homo sapiens
gccagcgcctccctccaccccag

SEQ ID NO: 1358221 - DNA, 22 bp, Homo sapiens
gccagcttggggccaccaaagc

SEQ ID NO: 1358222 - DNA, 16 bp, Homo sapiens
gccaggcaggggtggg

SEQ ID NO: 1358223 - DNA, 17 bp, Homo sapiens
gccaggcaggggtgggg

SEQ ID NO: 1358224 - DNA, 13 bp, Homo sapiens
gccaggccagcct

SEQ ID NO: 1358225 - DNA, 14 bp, Homo sapiens
gccaggccagcctc

SEQ ID NO: 1358226 - DNA, 18 bp, Homo sapiens
gccaggctgcctggcctt

SEQ ID NO: 1358227 - DNA, 17 bp, Homo sapiens
gccaggggaaaatcagc

SEQ ID NO: 1358228 - DNA, 23 bp, Homo sapiens
gccaggggaaaatcagcctgctc

SEQ ID NO: 1358229 - DNA, 23 bp, Homo sapiens
gccaggttctccgttagctcctg

SEQ ID NO: 1358230 - DNA, 14 bp, Homo sapiens
gccagtatttttta

SEQ ID NO: 1358231 - DNA, 19 bp, Homo sapiens
gccagtccaccctgcctgc

SEQ ID NO: 1358232 - DNA, 13 bp, Homo sapiens
gccagtccaggct

SEQ ID NO: 1358233 - DNA, 20 bp, Homo sapiens
gccagtccaggctgccgtgg

SEQ ID NO: 1358234 - DNA, 12 bp, Homo sapiens
gccagtctgtgg

SEQ ID NO: 1358235 - DNA, 16 bp, Homo sapiens
gccatccccagggggc

SEQ ID NO: 1358236 - DNA, 14 bp, Homo sapiens
gccatctaaagtaa

SEQ ID NO: 1358237 - DNA, 13 bp, Homo sapiens
gccatgccagctg

SEQ ID NO: 1358238 - DNA, 13 bp, Homo sapiens
gccatgccagctt

SEQ ID NO: 1358239 - DNA, 18 bp, Homo sapiens
gccatgccgtctgccgga

SEQ ID NO: 1358240 - DNA, 19 bp, Homo sapiens
gccatgctgaggcctgggc

SEQ ID NO: 1358241 - DNA, 21 bp, Homo sapiens
gccatgctgaggcctgggccg

SEQ ID NO: 1358242 - DNA, 17 bp, Homo sapiens
gccatggctcagggtgg

SEQ ID NO: 1358243 - DNA, 23 bp, Homo sapiens
gccatggctcagggtggtctctt

SEQ ID NO: 1358244 - DNA, 15 bp, Homo sapiens
gccatgtccaaagag

SEQ ID NO: 1358245 - DNA, 20 bp, Homo sapiens
gccatgtgcatagtttcttt

SEQ ID NO: 1358246 - DNA, 23 bp, Homo sapiens
gccatttgcaataacagctgcaa

SEQ ID NO: 1358247 - DNA, 17 bp, Homo sapiens
gcccaagccagaggctg

SEQ ID NO: 1358248 - DNA, 21 bp, Homo sapiens
gcccaagccagaggctgggtt

SEQ ID NO: 1358249 - DNA, 17 bp, Homo sapiens
gcccaccccctgccctg

SEQ ID NO: 1358250 - DNA, 22 bp, Homo sapiens
gcccaccccctgccctgcacgt

SEQ ID NO: 1358251 - DNA, 13 bp, Homo sapiens
gcccagaatactg

SEQ ID NO: 1358252 - DNA, 15 bp, Homo sapiens
gcccaggagcctcac

SEQ ID NO: 1358253 - DNA, 18 bp, Homo sapiens
gcccaggagcctcactgg

SEQ ID NO: 1358254 - DNA, 19 bp, Homo sapiens
gcccagggcaagctccgca

SEQ ID NO: 1358255 - DNA, 15 bp, Homo sapiens
gcccagggctcctgc

SEQ ID NO: 1358256 - DNA, 17 bp, Homo sapiens
gcccagtagaccttgtt

SEQ ID NO: 1358257 - DNA, 12 bp, Homo sapiens
gcccagtgcatg

SEQ ID NO: 1358258 - DNA, 18 bp, Homo sapiens
gcccatcctgaccagctg

SEQ ID NO: 1358259 - DNA, 15 bp, Homo sapiens
gccccacatgtccag

SEQ ID NO: 1358260 - DNA, 12 bp, Homo sapiens
gccccaccctgg

SEQ ID NO: 1358261 - DNA, 14 bp, Homo sapiens
gccccaccctgggc

SEQ ID NO: 1358262 - DNA, 15 bp, Homo sapiens
gccccaccctgggcc

SEQ ID NO: 1358263 - DNA, 19 bp, Homo sapiens
gccccaccctgggccctgg

SEQ ID NO: 1358264 - DNA, 24 bp, Homo sapiens
gccccaccctgggccctgggctgg

SEQ ID NO: 1358265 - DNA, 23 bp, Homo sapiens
gccccactcccttgctggcccca

SEQ ID NO: 1358266 - DNA, 12 bp, Homo sapiens
gccccactgcca

SEQ ID NO: 1358267 - DNA, 14 bp, Homo sapiens
gccccactgccagc

SEQ ID NO: 1358268 - DNA, 19 bp, Homo sapiens
gccccagcacctcagcctg

SEQ ID NO: 1358269 - DNA, 15 bp, Homo sapiens
gccccagccctgctg

SEQ ID NO: 1358270 - DNA, 17 bp, Homo sapiens
gccccagcctgctagct

SEQ ID NO: 1358271 - DNA, 22 bp, Homo sapiens
gccccagcctgctagctagctc

SEQ ID NO: 1358272 - DNA, 16 bp, Homo sapiens
gccccaggtagaaact

SEQ ID NO: 1358273 - DNA, 19 bp, Homo sapiens
gccccatctcccctcagct

SEQ ID NO: 1358274 - DNA, 17 bp, Homo sapiens
gcccccaacctcagggc

SEQ ID NO: 1358275 - DNA, 21 bp, Homo sapiens
gcccccaccccggggaccctg

SEQ ID NO: 1358276 - DNA, 14 bp, Homo sapiens
gcccccacttgcct

SEQ ID NO: 1358277 - DNA, 18 bp, Homo sapiens
gcccccagcccagggctc

SEQ ID NO: 1358278 - DNA, 15 bp, Homo sapiens
gcccccagtccccac

SEQ ID NO: 1358279 - DNA, 18 bp, Homo sapiens
gcccccagtccccacccc

SEQ ID NO: 1358280 - DNA, 20 bp, Homo sapiens
gcccccagtccccacccctg

SEQ ID NO: 1358281 - DNA, 18 bp, Homo sapiens
gccccctccgccctgcca

SEQ ID NO: 1358282 - DNA, 15 bp, Homo sapiens
gccccctcctgaacc

SEQ ID NO: 1358283 - DNA, 13 bp, Homo sapiens
gccccctggcctc

SEQ ID NO: 1358284 - DNA, 14 bp, Homo sapiens
gccccgactccagc

SEQ ID NO: 1358285 - DNA, 20 bp, Homo sapiens
gccccgactccagccagcgc

SEQ ID NO: 1358286 - DNA, 19 bp, Homo sapiens
gccccggggtgagtccatt

SEQ ID NO: 1358287 - DNA, 15 bp, Homo sapiens
gcccctcagagactg

SEQ ID NO: 1358288 - DNA, 22 bp, Homo sapiens
gcccctcccacacccaaagctg

SEQ ID NO: 1358289 - DNA, 23 bp, Homo sapiens
gcccctcccacacccaaagctga

SEQ ID NO: 1358290 - DNA, 19 bp, Homo sapiens
gcccctctggtcgctcctg

SEQ ID NO: 1358291 - DNA, 22 bp, Homo sapiens
gcccctctggtcgctcctgccc

SEQ ID NO: 1358292 - DNA, 14 bp, Homo sapiens
gcccctcttcccca

SEQ ID NO: 1358293 - DNA, 12 bp, Homo sapiens
gcccctggcact

SEQ ID NO: 1358294 - DNA, 17 bp, Homo sapiens
gcccctggcactcttgt

SEQ ID NO: 1358295 - DNA, 15 bp, Homo sapiens
gcccctggccgcgct

SEQ ID NO: 1358296 - DNA, 21 bp, Homo sapiens
gcccctggccgcgctccgggc

SEQ ID NO: 1358297 - DNA, 22 bp, Homo sapiens
gcccgcagagcgcgcccctagc

SEQ ID NO: 1358298 - DNA, 15 bp, Homo sapiens
gcccgcgccacagga

SEQ ID NO: 1358299 - DNA, 17 bp, Homo sapiens
gcccgcgccacaggacc

SEQ ID NO: 1358300 - DNA, 23 bp, Homo sapiens
gcccgcgccacaggaccctcgcc

SEQ ID NO: 1358301 - DNA, 15 bp, Homo sapiens
gcccgtcctgcctgt

SEQ ID NO: 1358302 - DNA, 14 bp, Homo sapiens
gccctactattcag

SEQ ID NO: 1358303 - DNA, 16 bp, Homo sapiens
gccctactccctgcag

SEQ ID NO: 1358304 - DNA, 13 bp, Homo sapiens
gccctcaagggtg

SEQ ID NO: 1358305 - DNA, 18 bp, Homo sapiens
gccctccccatggagcca

SEQ ID NO: 1358306 - DNA, 22 bp, Homo sapiens
gccctctcctttgttcccggct

SEQ ID NO: 1358307 - DNA, 13 bp, Homo sapiens
gccctgccactca

SEQ ID NO: 1358308 - DNA, 17 bp, Homo sapiens
gccctggcagggggcat

SEQ ID NO: 1358309 - DNA, 20 bp, Homo sapiens
gccctggcctcccctgccac

SEQ ID NO: 1358310 - DNA, 16 bp, Homo sapiens
gccctggctgctgccc

SEQ ID NO: 1358311 - DNA, 19 bp, Homo sapiens
gccctggctgctgccccca

SEQ ID NO: 1358312 - DNA, 15 bp, Homo sapiens
gccctggctgttctg

SEQ ID NO: 1358313 - DNA, 12 bp, Homo sapiens
gccctgggctgg

SEQ ID NO: 1358314 - DNA, 13 bp, Homo sapiens
gccctgggctgga

SEQ ID NO: 1358315 - DNA, 15 bp, Homo sapiens
gccctgtgtgcaggt

SEQ ID NO: 1358316 - DNA, 14 bp, Homo sapiens
gcccttgcctcccc

SEQ ID NO: 1358317 - DNA, 16 bp, Homo sapiens
gcccttgcctccccat

SEQ ID NO: 1358318 - DNA, 19 bp, Homo sapiens
gcccttttcccctaccaat

SEQ ID NO: 1358319 - DNA, 12 bp, Homo sapiens
gccgaccagagg

SEQ ID NO: 1358320 - DNA, 21 bp, Homo sapiens
gccgagactcgactctgtgcc

SEQ ID NO: 1358321 - DNA, 21 bp, Homo sapiens
gccgatagagggacggccaag

SEQ ID NO: 1358322 - DNA, 15 bp, Homo sapiens
gccgcatctcacagc

SEQ ID NO: 1358323 - DNA, 15 bp, Homo sapiens
gccgccccctcctga

SEQ ID NO: 1358324 - DNA, 23 bp, Homo sapiens
gccgccgctaggtagagtctgag

SEQ ID NO: 1358325 - DNA, 16 bp, Homo sapiens
gccgcgcgtccagctg

SEQ ID NO: 1358326 - DNA, 17 bp, Homo sapiens
gccggatctgagggaga

SEQ ID NO: 1358327 - DNA, 16 bp, Homo sapiens
gccggcacggcccgtg

SEQ ID NO: 1358328 - DNA, 15 bp, Homo sapiens
gcagacaccttggac

SEQ ID NO: 1358329 - DNA, 17 bp, Homo sapiens
gcagacattttaaaaaa

SEQ ID NO: 1358330 - DNA, 20 bp, Homo sapiens
gcagaccacgcccgtcctgc

SEQ ID NO: 1358331 - DNA, 23 bp, Homo sapiens
gcagaccacgcccgtcctgcctg

SEQ ID NO: 1358332 - DNA, 20 bp, Homo sapiens
gcagactggggcatcctgtg

SEQ ID NO: 1358333 - DNA, 16 bp, Homo sapiens
gcagagccttctcaga

SEQ ID NO: 1358334 - DNA, 23 bp, Homo sapiens
gcagagccttctcagaagcacag

SEQ ID NO: 1358335 - DNA, 17 bp, Homo sapiens
gcagagctggctctgag

SEQ ID NO: 1358336 - DNA, 12 bp, Homo sapiens
gcagaggccaga

SEQ ID NO: 1358337 - DNA, 14 bp, Homo sapiens
gcagatgccaccct

SEQ ID NO: 1358338 - DNA, 17 bp, Homo sapiens
gcagatgccaccctagc

SEQ ID NO: 1358339 - DNA, 20 bp, Homo sapiens
gcagatgttagatatttttc

SEQ ID NO: 1358340 - DNA, 12 bp, Homo sapiens
gcagcacctcct

SEQ ID NO: 1358341 - DNA, 21 bp, Homo sapiens
gcagcaggtgattggaccagg

SEQ ID NO: 1358342 - DNA, 18 bp, Homo sapiens
gcagcccagagactttgt

SEQ ID NO: 1358343 - DNA, 12 bp, Homo sapiens
gcagcctctccc

SEQ ID NO: 1358344 - DNA, 16 bp, Homo sapiens
gcagcctctccccagg

SEQ ID NO: 1358345 - DNA, 19 bp, Homo sapiens
gcagcctctgtcaggcctt

SEQ ID NO: 1358346 - DNA, 14 bp, Homo sapiens
gcagcctggaccct

SEQ ID NO: 1358347 - DNA, 23 bp, Homo sapiens
gcagctgctatccccatctccct

SEQ ID NO: 1358348 - DNA, 13 bp, Homo sapiens
gcagcttattgtt

SEQ ID NO: 1358349 - DNA, 22 bp, Homo sapiens
gcaggacttccccggagggctg

SEQ ID NO: 1358350 - DNA, 20 bp, Homo sapiens
gcaggaggatcacttgagtc

SEQ ID NO: 1358351 - DNA, 22 bp, Homo sapiens
gcaggattgaaaatgtccagga

SEQ ID NO: 1358352 - DNA, 18 bp, Homo sapiens
gcaggcacgggtggtccc

SEQ ID NO: 1358353 - DNA, 13 bp, Homo sapiens
gcaggcatggccc

SEQ ID NO: 1358354 - DNA, 16 bp, Homo sapiens
gcaggcatggccctgg

SEQ ID NO: 1358355 - DNA, 19 bp, Homo sapiens
gcaggcatggccctgggcg

SEQ ID NO: 1358356 - DNA, 14 bp, Homo sapiens
gcaggccctggcct

SEQ ID NO: 1358357 - DNA, 14 bp, Homo sapiens
gcaggctcactgcc

SEQ ID NO: 1358358 - DNA, 22 bp, Homo sapiens
gcaggctcactgccaggccagc

SEQ ID NO: 1358359 - DNA, 12 bp, Homo sapiens
gcaggctggcca

SEQ ID NO: 1358360 - DNA, 23 bp, Homo sapiens
gcaggctttgccattgtgaacca

SEQ ID NO: 1358361 - DNA, 16 bp, Homo sapiens
gcagggagctgggccc

SEQ ID NO: 1358362 - DNA, 13 bp, Homo sapiens
gcagggaggcagc

SEQ ID NO: 1358363 - DNA, 14 bp, Homo sapiens
gcagggaggcagcc

SEQ ID NO: 1358364 - DNA, 13 bp, Homo sapiens
gcagggccatggc

SEQ ID NO: 1358365 - DNA, 18 bp, Homo sapiens
gcagggccatggctcagg

SEQ ID NO: 1358366 - DNA, 16 bp, Homo sapiens
gcaggggcctggagat

SEQ ID NO: 1358367 - DNA, 20 bp, Homo sapiens
gcaggggcctggagatcctc

SEQ ID NO: 1358368 - DNA, 17 bp, Homo sapiens
gcaggggtgggggtgga

SEQ ID NO: 1358369 - DNA, 21 bp, Homo sapiens
gcaggggtgggggtggaggct

SEQ ID NO: 1358370 - DNA, 19 bp, Homo sapiens
gcagggtcctagaaattcc

SEQ ID NO: 1358371 - DNA, 21 bp, Homo sapiens
gcaggtgattggaccaggcca

SEQ ID NO: 1358372 - DNA, 18 bp, Homo sapiens
gcaggtgctggagcactg

SEQ ID NO: 1358373 - DNA, 17 bp, Homo sapiens
gcaggtgggctggactt

SEQ ID NO: 1358374 - DNA, 17 bp, Homo sapiens
gcagttagctgaagaat

SEQ ID NO: 1358375 - DNA, 18 bp, Homo sapiens
gcagttctactcaggctg

SEQ ID NO: 1358376 - DNA, 20 bp, Homo sapiens
gcagttctactcaggctggt

SEQ ID NO: 1358377 - DNA, 22 bp, Homo sapiens
gcagttggccagagagcctggt

SEQ ID NO: 1358378 - DNA, 15 bp, Homo sapiens
gcagtttatcattca

SEQ ID NO: 1358379 - DNA, 16 bp, Homo sapiens
gcagtttatcattcaa

SEQ ID NO: 1358380 - DNA, 21 bp, Homo sapiens
gcagttttgttttaaaactgg

SEQ ID NO: 1358381 - DNA, 15 bp, Homo sapiens
gcataaaaattagcc

SEQ ID NO: 1358382 - DNA, 16 bp, Homo sapiens
gcataatttaaaaata

SEQ ID NO: 1358383 - DNA, 19 bp, Homo sapiens
gcataatttaaaaatatat

SEQ ID NO: 1358384 - DNA, 19 bp, Homo sapiens
gcatacttacctagtgaaa

SEQ ID NO: 1358385 - DNA, 16 bp, Homo sapiens
gcatactttgtaaata

SEQ ID NO: 1358386 - DNA, 22 bp, Homo sapiens
gcatagaggcttctccgccagc

SEQ ID NO: 1358387 - DNA, 15 bp, Homo sapiens
gcatagtttctttat

SEQ ID NO: 1358388 - DNA, 17 bp, Homo sapiens
gcatataatgaataaat

SEQ ID NO: 1358389 - DNA, 20 bp, Homo sapiens
gcatatgaaaggagagcatc

SEQ ID NO: 1358390 - DNA, 17 bp, Homo sapiens
gcatatgggttagatgt

SEQ ID NO: 1358391 - DNA, 16 bp, Homo sapiens
gcatattataaaggat

SEQ ID NO: 1358392 - DNA, 12 bp, Homo sapiens
gcatccctgaga

SEQ ID NO: 1358393 - DNA, 13 bp, Homo sapiens
gcatccctgagac

SEQ ID NO: 1358394 - DNA, 20 bp, Homo sapiens
gcatcgcaccattctgactc

SEQ ID NO: 1358395 - DNA, 20 bp, Homo sapiens
gcatcggcctagggccccca

SEQ ID NO: 1358396 - DNA, 14 bp, Homo sapiens
gcatctatctcatc

SEQ ID NO: 1358397 - DNA, 15 bp, Homo sapiens
gcatctatctgtgct

SEQ ID NO: 1358398 - DNA, 16 bp, Homo sapiens
gcatctatctgtgcta

SEQ ID NO: 1358399 - DNA, 21 bp, Homo sapiens
gcatctcacagctatgcaaaa

SEQ ID NO: 1358400 - DNA, 20 bp, Homo sapiens
gcatctgaaataggaaacaa

SEQ ID NO: 1358401 - DNA, 16 bp, Homo sapiens
gcatcttgcctccagg

SEQ ID NO: 1358402 - DNA, 19 bp, Homo sapiens
gcatcttgcctccaggtgc

SEQ ID NO: 1358403 - DNA, 23 bp, Homo sapiens
gcatcttgcctccaggtgcagag

SEQ ID NO: 1358404 - DNA, 22 bp, Homo sapiens
gcatcttgggggggtggccgct

SEQ ID NO: 1358405 - DNA, 17 bp, Homo sapiens
gcatctttgatgtgttg

SEQ ID NO: 1358406 - DNA, 22 bp, Homo sapiens
gcatgaaatgtgaatttttatt

SEQ ID NO: 1358407 - DNA, 15 bp, Homo sapiens
gcatgaccagatgcg

SEQ ID NO: 1358408 - DNA, 16 bp, Homo sapiens
gcatggtggccagagg

SEQ ID NO: 1358409 - DNA, 20 bp, Homo sapiens
gcatgtagaggcttgtttac

SEQ ID NO: 1358410 - DNA, 14 bp, Homo sapiens
gcatgttatgttta

SEQ ID NO: 1358411 - DNA, 16 bp, Homo sapiens
gcatgttatgtttaat

SEQ ID NO: 1358412 - DNA, 20 bp, Homo sapiens
gcatgttcacccttatagtc

SEQ ID NO: 1358413 - DNA, 14 bp, Homo sapiens
gcattcatttttat

SEQ ID NO: 1358414 - DNA, 15 bp, Homo sapiens
gcattcatttttata

SEQ ID NO: 1358415 - DNA, 18 bp, Homo sapiens
gcattcatttttatagca

SEQ ID NO: 1358416 - DNA, 23 bp, Homo sapiens
gcattcgttgtgttttttaagat

SEQ ID NO: 1358417 - DNA, 15 bp, Homo sapiens
gcattgagtattgtt

SEQ ID NO: 1358418 - DNA, 17 bp, Homo sapiens
gcatttgctgaatacag

SEQ ID NO: 1358419 - DNA, 23 bp, Homo sapiens
gcatttgctgaatacagaggcaa

SEQ ID NO: 1358420 - DNA, 13 bp, Homo sapiens
gcatttgtcaatg

SEQ ID NO: 1358421 - DNA, 21 bp, Homo sapiens
gcatttgtgctagaaattttc

SEQ ID NO: 1358422 - DNA, 13 bp, Homo sapiens
gccaagaatgtac

SEQ ID NO: 1358423 - DNA, 21 bp, Homo sapiens
gccaaggctgggggaagaagc

SEQ ID NO: 1358424 - DNA, 12 bp, Homo sapiens
gccaagggaaag

SEQ ID NO: 1358425 - DNA, 13 bp, Homo sapiens
gccaagtggggtg

SEQ ID NO: 1358426 - DNA, 16 bp, Homo sapiens
gccaatgtctcctccc

SEQ ID NO: 1358427 - DNA, 18 bp, Homo sapiens
gccacactctccatcacc

SEQ ID NO: 1358428 - DNA, 16 bp, Homo sapiens
gccacagcgccagcct

SEQ ID NO: 1358429 - DNA, 16 bp, Homo sapiens
gccaccaaagctgccc

SEQ ID NO: 1358430 - DNA, 17 bp, Homo sapiens
gccaccagctctgccgt

SEQ ID NO: 1358431 - DNA, 19 bp, Homo sapiens
gccaccagctctgccgtct

SEQ ID NO: 1358432 - DNA, 15 bp, Homo sapiens
gccacccaggaggca

SEQ ID NO: 1358433 - DNA, 16 bp, Homo sapiens
gccacccaggaggcag

SEQ ID NO: 1358434 - DNA, 22 bp, Homo sapiens
gccaccgcgggtgtgggaaagc

SEQ ID NO: 1358435 - DNA, 14 bp, Homo sapiens
gccactcactaggc

SEQ ID NO: 1358436 - DNA, 19 bp, Homo sapiens
gccactcactaggccccca

SEQ ID NO: 1358437 - DNA, 23 bp, Homo sapiens
gccactcactaggcccccacttg

SEQ ID NO: 1358438 - DNA, 13 bp, Homo sapiens
gccactcatttca

SEQ ID NO: 1358439 - DNA, 16 bp, Homo sapiens
gccactcatttcatct

SEQ ID NO: 1358440 - DNA, 20 bp, Homo sapiens
gccactcatttcatctcatt

SEQ ID NO: 1358441 - DNA, 22 bp, Homo sapiens
gccactccccggcatgagactc

SEQ ID NO: 1358442 - DNA, 21 bp, Homo sapiens
gccactccgagaggtgggcca

SEQ ID NO: 1358443 - DNA, 18 bp, Homo sapiens
gccactgtgaagagaacc

SEQ ID NO: 1358444 - DNA, 19 bp, Homo sapiens
gccactgtgaagagaacca

SEQ ID NO: 1358445 - DNA, 18 bp, Homo sapiens
gccacttccttttaactg

SEQ ID NO: 1358446 - DNA, 19 bp, Homo sapiens
gccactttacccacctaga

SEQ ID NO: 1358447 - DNA, 23 bp, Homo sapiens
gccactttacccacctagaacac

SEQ ID NO: 1358448 - DNA, 15 bp, Homo sapiens
gatggacactccagg

SEQ ID NO: 1358449 - DNA, 14 bp, Homo sapiens
gatggccccagcac

SEQ ID NO: 1358450 - DNA, 14 bp, Homo sapiens
gatggccttaattt

SEQ ID NO: 1358451 - DNA, 13 bp, Homo sapiens
gatggcttgtcta

SEQ ID NO: 1358452 - DNA, 15 bp, Homo sapiens
gatggtatcatatat

SEQ ID NO: 1358453 - DNA, 13 bp, Homo sapiens
gatggtcatccag

SEQ ID NO: 1358454 - DNA, 17 bp, Homo sapiens
gatggttttaaactttc

SEQ ID NO: 1358455 - DNA, 23 bp, Homo sapiens
gatgtctttttattaaaatattt

SEQ ID NO: 1358456 - DNA, 18 bp, Homo sapiens
gatgtgaattattgacac

SEQ ID NO: 1358457 - DNA, 20 bp, Homo sapiens
gatgtgaattattgacactg

SEQ ID NO: 1358458 - DNA, 16 bp, Homo sapiens
gatgtgcaaaaccttt

SEQ ID NO: 1358459 - DNA, 18 bp, Homo sapiens
gatgtgtggactgtggca

SEQ ID NO: 1358460 - DNA, 21 bp, Homo sapiens
gatgttacaagtttatatata

SEQ ID NO: 1358461 - DNA, 19 bp, Homo sapiens
gatgttgccatgtgtttta

SEQ ID NO: 1358462 - DNA, 23 bp, Homo sapiens
gatgtttaaaacaccttctatag

SEQ ID NO: 1358463 - DNA, 18 bp, Homo sapiens
gattaaccacttcagctg

SEQ ID NO: 1358464 - DNA, 19 bp, Homo sapiens
gattagcaagttacagtga

SEQ ID NO: 1358465 - DNA, 12 bp, Homo sapiens
gattatttgcat

SEQ ID NO: 1358466 - DNA, 15 bp, Homo sapiens
gattcagctctgcaa

SEQ ID NO: 1358467 - DNA, 13 bp, Homo sapiens
gattcaggaatgt

SEQ ID NO: 1358468 - DNA, 14 bp, Homo sapiens
gattcagtcacatg

SEQ ID NO: 1358469 - DNA, 17 bp, Homo sapiens
gattcatgatttataaa

SEQ ID NO: 1358470 - DNA, 17 bp, Homo sapiens
gattccactacacctgg

SEQ ID NO: 1358471 - DNA, 21 bp, Homo sapiens
gattccactacacctggctga

SEQ ID NO: 1358472 - DNA, 19 bp, Homo sapiens
gattcccttgttattcaac

SEQ ID NO: 1358473 - DNA, 18 bp, Homo sapiens
gattctcaaaggagcgag

SEQ ID NO: 1358474 - DNA, 20 bp, Homo sapiens
gattctggctttaagccttc

SEQ ID NO: 1358475 - DNA, 20 bp, Homo sapiens
gattcttctgtgtttataaa

SEQ ID NO: 1358476 - DNA, 18 bp, Homo sapiens
gattgctgataataaatt

SEQ ID NO: 1358477 - DNA, 18 bp, Homo sapiens
gattgcttgagctcagga

SEQ ID NO: 1358478 - DNA, 15 bp, Homo sapiens
gattggaccaggcca

SEQ ID NO: 1358479 - DNA, 12 bp, Homo sapiens
gatttaaatgcc

SEQ ID NO: 1358480 - DNA, 15 bp, Homo sapiens
gatttaaggtattta

SEQ ID NO: 1358481 - DNA, 20 bp, Homo sapiens
gatttattaacttaataatc

SEQ ID NO: 1358482 - DNA, 15 bp, Homo sapiens
gatttctcattgact

SEQ ID NO: 1358483 - DNA, 14 bp, Homo sapiens
gatttctgaggaaa

SEQ ID NO: 1358484 - DNA, 17 bp, Homo sapiens
gatttgccatagagtac

SEQ ID NO: 1358485 - DNA, 23 bp, Homo sapiens
gattttaatagggaatatatctc

SEQ ID NO: 1358486 - DNA, 15 bp, Homo sapiens
gattttcttttgcct

SEQ ID NO: 1358487 - DNA, 15 bp, Homo sapiens
gatttttagaattaa

SEQ ID NO: 1358488 - DNA, 14 bp, Homo sapiens
gcaaaaaggcagga

SEQ ID NO: 1358489 - DNA, 17 bp, Homo sapiens
gcaaaactctacttaat

SEQ ID NO: 1358490 - DNA, 17 bp, Homo sapiens
gcaaaagatgcttctca

SEQ ID NO: 1358491 - DNA, 13 bp, Homo sapiens
gcaaaaggcctct

SEQ ID NO: 1358492 - DNA, 17 bp, Homo sapiens
gcaaaaggcctcttgta

SEQ ID NO: 1358493 - DNA, 13 bp, Homo sapiens
gcaaaataaaaca

SEQ ID NO: 1358494 - DNA, 15 bp, Homo sapiens
gcaaaataaaacata

SEQ ID NO: 1358495 - DNA, 16 bp, Homo sapiens
gcaaacccattaaggg

SEQ ID NO: 1358496 - DNA, 14 bp, Homo sapiens
gcaaacgctaaaga

SEQ ID NO: 1358497 - DNA, 12 bp, Homo sapiens
gcaaagaaaatg

SEQ ID NO: 1358498 - DNA, 23 bp, Homo sapiens
gcaaaggaaactttgcagatgtg

SEQ ID NO: 1358499 - DNA, 15 bp, Homo sapiens
gcaaaggaaggtgga

SEQ ID NO: 1358500 - DNA, 15 bp, Homo sapiens
gcaaatcagaaactt

SEQ ID NO: 1358501 - DNA, 21 bp, Homo sapiens
gcaacaacaattggtaaaact

SEQ ID NO: 1358502 - DNA, 11 bp, Homo sapiens
gcaaccaggaa

SEQ ID NO: 1358503 - DNA, 15 bp, Homo sapiens
gcaaccaggaacagc

SEQ ID NO: 1358504 - DNA, 23 bp, Homo sapiens
gcaacgatcacaaatgactttat

SEQ ID NO: 1358505 - DNA, 18 bp, Homo sapiens
gcaactgcattggctttg

SEQ ID NO: 1358506 - DNA, 20 bp, Homo sapiens
gcaacttcttctccatccct

SEQ ID NO: 1358507 - DNA, 20 bp, Homo sapiens
gcaacttttgtgtaatgaaa

SEQ ID NO: 1358508 - DNA, 15 bp, Homo sapiens
gcaagatgtgaatta

SEQ ID NO: 1358509 - DNA, 15 bp, Homo sapiens
gcaagcatgcttgtg

SEQ ID NO: 1358510 - DNA, 13 bp, Homo sapiens
gcaagccaggctc

SEQ ID NO: 1358511 - DNA, 20 bp, Homo sapiens
gcaagccaggctcactcaca

SEQ ID NO: 1358512 - DNA, 19 bp, Homo sapiens
gcaaggactttgtacattt

SEQ ID NO: 1358513 - DNA, 21 bp, Homo sapiens
gcaagtgctggagtctcctga

SEQ ID NO: 1358514 - DNA, 19 bp, Homo sapiens
gcaagtgtgaatactgctt

SEQ ID NO: 1358515 - DNA, 14 bp, Homo sapiens
gcaataaaatttaa

SEQ ID NO: 1358516 - DNA, 15 bp, Homo sapiens
gcaataaaatttaaa

SEQ ID NO: 1358517 - DNA, 12 bp, Homo sapiens
gcaataaatgaa

SEQ ID NO: 1358518 - DNA, 18 bp, Homo sapiens
gcaataaattttgaaaag

SEQ ID NO: 1358519 - DNA, 13 bp, Homo sapiens
gcaataccaagta

SEQ ID NO: 1358520 - DNA, 13 bp, Homo sapiens
gcaatagaaacaa

SEQ ID NO: 1358521 - DNA, 23 bp, Homo sapiens
gcaatctcttcattattctctgc

SEQ ID NO: 1358522 - DNA, 19 bp, Homo sapiens
gcaatggtagtttctgtgg

SEQ ID NO: 1358523 - DNA, 17 bp, Homo sapiens
gcaatgtaagcatactt

SEQ ID NO: 1358524 - DNA, 14 bp, Homo sapiens
gcaatgtgataaaa

SEQ ID NO: 1358525 - DNA, 18 bp, Homo sapiens
gcaattgaattaaattag

SEQ ID NO: 1358526 - DNA, 12 bp, Homo sapiens
gcacaatttgca

SEQ ID NO: 1358527 - DNA, 14 bp, Homo sapiens
gcacaatttgcact

SEQ ID NO: 1358528 - DNA, 19 bp, Homo sapiens
gcacaatttgcactaaatc

SEQ ID NO: 1358529 - DNA, 21 bp, Homo sapiens
gcacaccaatcttactttgta

SEQ ID NO: 1358530 - DNA, 22 bp, Homo sapiens
gcacaccaatcttactttgtaa

SEQ ID NO: 1358531 - DNA, 15 bp, Homo sapiens
gcacagctcaggagg

SEQ ID NO: 1358532 - DNA, 18 bp, Homo sapiens
gcacagcttgacctgagg

SEQ ID NO: 1358533 - DNA, 15 bp, Homo sapiens
gcacaggaggcaggc

SEQ ID NO: 1358534 - DNA, 20 bp, Homo sapiens
gcacatccgcgtgtgcctgt

SEQ ID NO: 1358535 - DNA, 23 bp, Homo sapiens
gcacatccgcgtgtgcctgtgtg

SEQ ID NO: 1358536 - DNA, 13 bp, Homo sapiens
gcacatgactcgg

SEQ ID NO: 1358537 - DNA, 18 bp, Homo sapiens
gcacattgagctgtgcaa

SEQ ID NO: 1358538 - DNA, 20 bp, Homo sapiens
gcaccactgcactccagcct

SEQ ID NO: 1358539 - DNA, 21 bp, Homo sapiens
gcaccactgcactccagcctg

SEQ ID NO: 1358540 - DNA, 22 bp, Homo sapiens
gcaccactgcactccagcctgg

SEQ ID NO: 1358541 - DNA, 13 bp, Homo sapiens
gcaccagcagcct

SEQ ID NO: 1358542 - DNA, 14 bp, Homo sapiens
gcaccagcagcctg

SEQ ID NO: 1358543 - DNA, 16 bp, Homo sapiens
gcaccagcagcctgga

SEQ ID NO: 1358544 - DNA, 18 bp, Homo sapiens
gcaccaggggtttctcgc

SEQ ID NO: 1358545 - DNA, 19 bp, Homo sapiens
gcacccaccgtggaggagg

SEQ ID NO: 1358546 - DNA, 20 bp, Homo sapiens
gcacccaccgtggaggagga

SEQ ID NO: 1358547 - DNA, 12 bp, Homo sapiens
gcacccagaaca

SEQ ID NO: 1358548 - DNA, 18 bp, Homo sapiens
gcaccccttctctcctcc

SEQ ID NO: 1358549 - DNA, 20 bp, Homo sapiens
gcaccccttctctcctcccc

SEQ ID NO: 1358550 - DNA, 19 bp, Homo sapiens
gcaccctcaggcaggtggg

SEQ ID NO: 1358551 - DNA, 18 bp, Homo sapiens
gcacctcagcctgcacag

SEQ ID NO: 1358552 - DNA, 14 bp, Homo sapiens
gcacctcttccttg

SEQ ID NO: 1358553 - DNA, 15 bp, Homo sapiens
gcacctgtagtccca

SEQ ID NO: 1358554 - DNA, 16 bp, Homo sapiens
gcacctgtagtcccag

SEQ ID NO: 1358555 - DNA, 17 bp, Homo sapiens
gcactccagcctggggg

SEQ ID NO: 1358556 - DNA, 22 bp, Homo sapiens
gcactctggatgatggattcca

SEQ ID NO: 1358557 - DNA, 16 bp, Homo sapiens
gcactggcgaggagag

SEQ ID NO: 1358558 - DNA, 18 bp, Homo sapiens
gcactgggctcccgggcc

SEQ ID NO: 1358559 - DNA, 14 bp, Homo sapiens
gcactgttgagaag

SEQ ID NO: 1358560 - DNA, 18 bp, Homo sapiens
gcacttattgaatatatg

SEQ ID NO: 1358561 - DNA, 18 bp, Homo sapiens
gcacttattgaccatttt

SEQ ID NO: 1358562 - DNA, 18 bp, Homo sapiens
gcacttcatgtaaagtgt

SEQ ID NO: 1358563 - DNA, 22 bp, Homo sapiens
gcacttcgggaggtcgaggcag

SEQ ID NO: 1358564 - DNA, 13 bp, Homo sapiens
gcacttgcctggg

SEQ ID NO: 1358565 - DNA, 23 bp, Homo sapiens
gcacttgtgattatttattattt

SEQ ID NO: 1358566 - DNA, 20 bp, Homo sapiens
gcactttctatcctctgtaa

SEQ ID NO: 1358567 - DNA, 21 bp, Homo sapiens
gcagaacgaaccttggcctgg

SEQ ID NO: 1358568 - DNA, 18 bp, Homo sapiens
gcagaatgtaagtgggcc

SEQ ID NO: 1358569 - DNA, 20 bp, Homo sapiens
gaggactgtagggagggcgg

SEQ ID NO: 1358570 - DNA, 16 bp, Homo sapiens
gaggaggaaggcaaga

SEQ ID NO: 1358571 - DNA, 11 bp, Homo sapiens
gaggaggggag

SEQ ID NO: 1358572 - DNA, 13 bp, Homo sapiens
gaggaggggaggg

SEQ ID NO: 1358573 - DNA, 16 bp, Homo sapiens
gaggatctcttgagcc

SEQ ID NO: 1358574 - DNA, 19 bp, Homo sapiens
gaggatctcttgagcctgg

SEQ ID NO: 1358575 - DNA, 17 bp, Homo sapiens
gaggcaccaggaagccg

SEQ ID NO: 1358576 - DNA, 21 bp, Homo sapiens
gaggcagcgtgaaagcagatg

SEQ ID NO: 1358577 - DNA, 23 bp, Homo sapiens
gaggcagcgtgaaagcagatgag

SEQ ID NO: 1358578 - DNA, 18 bp, Homo sapiens
gaggcaggcatggccctg

SEQ ID NO: 1358579 - DNA, 19 bp, Homo sapiens
gaggcaggcatggccctgg

SEQ ID NO: 1358580 - DNA, 16 bp, Homo sapiens
gaggcagggaggcagc

SEQ ID NO: 1358581 - DNA, 19 bp, Homo sapiens
gaggcatcctacccttttc

SEQ ID NO: 1358582 - DNA, 21 bp, Homo sapiens
gaggccagaggcccccagccc

SEQ ID NO: 1358583 - DNA, 14 bp, Homo sapiens
gaggccccaggggg

SEQ ID NO: 1358584 - DNA, 14 bp, Homo sapiens
gaggcccccagccc

SEQ ID NO: 1358585 - DNA, 19 bp, Homo sapiens
gaggcccccagcccagggc

SEQ ID NO: 1358586 - DNA, 21 bp, Homo sapiens
gaggcccccagcccagggctc

SEQ ID NO: 1358587 - DNA, 16 bp, Homo sapiens
gaggcctgggccgctg

SEQ ID NO: 1358588 - DNA, 20 bp, Homo sapiens
gaggcggagcttgcagtgag

SEQ ID NO: 1358589 - DNA, 18 bp, Homo sapiens
gaggctgcccctctcacc

SEQ ID NO: 1358590 - DNA, 19 bp, Homo sapiens
gaggcttctccgccagcct

SEQ ID NO: 1358591 - DNA, 20 bp, Homo sapiens
gaggcttctccgccagcctc

SEQ ID NO: 1358592 - DNA, 23 bp, Homo sapiens
gaggcttctccgccagcctcctc

SEQ ID NO: 1358593 - DNA, 23 bp, Homo sapiens
gaggcttgtttacctttctctct

SEQ ID NO: 1358594 - DNA, 19 bp, Homo sapiens
gagggaagggtttctctat

SEQ ID NO: 1358595 - DNA, 13 bp, Homo sapiens
gagggagagagag

SEQ ID NO: 1358596 - DNA, 16 bp, Homo sapiens
gagggagagagagaga

SEQ ID NO: 1358597 - DNA, 16 bp, Homo sapiens
gagggaggccccaggg

SEQ ID NO: 1358598 - DNA, 12 bp, Homo sapiens
gagggaggggaa

SEQ ID NO: 1358599 - DNA, 21 bp, Homo sapiens
gagggattctggttccagggt

SEQ ID NO: 1358600 - DNA, 17 bp, Homo sapiens
gagggcagactggggca

SEQ ID NO: 1358601 - DNA, 20 bp, Homo sapiens
gaggggagactttgatgtca

SEQ ID NO: 1358602 - DNA, 11 bp, Homo sapiens
gaggggagggg

SEQ ID NO: 1358603 - DNA, 22 bp, Homo sapiens
gaggggccggccctgtgtgcag

SEQ ID NO: 1358604 - DNA, 17 bp, Homo sapiens
gagggggcttgaagcca

SEQ ID NO: 1358605 - DNA, 20 bp, Homo sapiens
gaggggtccctagcagccca

SEQ ID NO: 1358606 - DNA, 15 bp, Homo sapiens
gagggtaaataaacc

SEQ ID NO: 1358607 - DNA, 21 bp, Homo sapiens
gagggtaggagggtgggaagg

SEQ ID NO: 1358608 - DNA, 12 bp, Homo sapiens
gagggtggaata

SEQ ID NO: 1358609 - DNA, 16 bp, Homo sapiens
gaggtcactggaaagg

SEQ ID NO: 1358610 - DNA, 21 bp, Homo sapiens
gaggtcactggaaaggggaga

SEQ ID NO: 1358611 - DNA, 16 bp, Homo sapiens
gaggtcctctggagcc

SEQ ID NO: 1358612 - DNA, 20 bp, Homo sapiens
gaggtcctctggagccctaa

SEQ ID NO: 1358613 - DNA, 21 bp, Homo sapiens
gaggtcggtaggttcagccaa

SEQ ID NO: 1358614 - DNA, 22 bp, Homo sapiens
gaggtcggtaggttcagccaag

SEQ ID NO: 1358615 - DNA, 13 bp, Homo sapiens
gaggtggaagaag

SEQ ID NO: 1358616 - DNA, 19 bp, Homo sapiens
gaggtggaagaagggagaa

SEQ ID NO: 1358617 - DNA, 16 bp, Homo sapiens
gaggtgtggagccgag

SEQ ID NO: 1358618 - DNA, 16 bp, Homo sapiens
gaggttcctctgcctg

SEQ ID NO: 1358619 - DNA, 15 bp, Homo sapiens
gaggttgcagtgagc

SEQ ID NO: 1358620 - DNA, 15 bp, Homo sapiens
gagtagaaaatgtga

SEQ ID NO: 1358621 - DNA, 16 bp, Homo sapiens
gagtagaaaatgtgac

SEQ ID NO: 1358622 - DNA, 21 bp, Homo sapiens
gagtcaaggcctgctccctgt

SEQ ID NO: 1358623 - DNA, 22 bp, Homo sapiens
gagtccactttgtttcgtgggg

SEQ ID NO: 1358624 - DNA, 16 bp, Homo sapiens
gagtccattctcccag

SEQ ID NO: 1358625 - DNA, 20 bp, Homo sapiens
gagtccattctcccaggtac

SEQ ID NO: 1358626 - DNA, 17 bp, Homo sapiens
gagtcgtggggtgtgct

SEQ ID NO: 1358627 - DNA, 19 bp, Homo sapiens
gagtcgtggggtgtgctgg

SEQ ID NO: 1358628 - DNA, 20 bp, Homo sapiens
gagtcgtggggtgtgctggg

SEQ ID NO: 1358629 - DNA, 21 bp, Homo sapiens
gagtcgtggggtgtgctggga

SEQ ID NO: 1358630 - DNA, 12 bp, Homo sapiens
gagtctgaggcc

SEQ ID NO: 1358631 - DNA, 23 bp, Homo sapiens
gagtctgaggccgttgctgactt

SEQ ID NO: 1358632 - DNA, 17 bp, Homo sapiens
gagtctggccctagact

SEQ ID NO: 1358633 - DNA, 18 bp, Homo sapiens
gagtctggccctagactc

SEQ ID NO: 1358634 - DNA, 19 bp, Homo sapiens
gagtgaaccccacgccctg

SEQ ID NO: 1358635 - DNA, 19 bp, Homo sapiens
gagtgctgaaggaatggaa

SEQ ID NO: 1358636 - DNA, 11 bp, Homo sapiens
gagtgggaagc

SEQ ID NO: 1358637 - DNA, 12 bp, Homo sapiens
gagtgggaagcc

SEQ ID NO: 1358638 - DNA, 15 bp, Homo sapiens
gagtgtagactgtgg

SEQ ID NO: 1358639 - DNA, 18 bp, Homo sapiens
gagtgtctggaattgtgg

SEQ ID NO: 1358640 - DNA, 16 bp, Homo sapiens
gagttgattcagctct

SEQ ID NO: 1358641 - DNA, 16 bp, Homo sapiens
gagttgtttttgtata

SEQ ID NO: 1358642 - DNA, 17 bp, Homo sapiens
gagtttgagctgccttc

SEQ ID NO: 1358643 - DNA, 18 bp, Homo sapiens
gagtttgtcgctcatgtg

SEQ ID NO: 1358644 - DNA, 16 bp, Homo sapiens
gataactttacagaaa

SEQ ID NO: 1358645 - DNA, 20 bp, Homo sapiens
gatactgcgactttctgcct

SEQ ID NO: 1358646 - DNA, 19 bp, Homo sapiens
gatactttgtattgtccta

SEQ ID NO: 1358647 - DNA, 23 bp, Homo sapiens
gatactttgtattgtcctattag

SEQ ID NO: 1358648 - DNA, 14 bp, Homo sapiens
gatagtaagcatag

SEQ ID NO: 1358649 - DNA, 18 bp, Homo sapiens
gatataaatttttaagag

SEQ ID NO: 1358650 - DNA, 17 bp, Homo sapiens
gatattcagatgtatgt

SEQ ID NO: 1358651 - DNA, 20 bp, Homo sapiens
gatattccccccacttaaga

SEQ ID NO: 1358652 - DNA, 20 bp, Homo sapiens
gatattgaggccaagaatat

SEQ ID NO: 1358653 - DNA, 23 bp, Homo sapiens
gatattgaggccaagaatattgc

SEQ ID NO: 1358654 - DNA, 14 bp, Homo sapiens
gatcaaaaaggctt

SEQ ID NO: 1358655 - DNA, 12 bp, Homo sapiens
gatcacaaatga

SEQ ID NO: 1358656 - DNA, 15 bp, Homo sapiens
gatcactgccacact

SEQ ID NO: 1358657 - DNA, 16 bp, Homo sapiens
gatcactgccacactc

SEQ ID NO: 1358658 - DNA, 16 bp, Homo sapiens
gatcatagttttattt

SEQ ID NO: 1358659 - DNA, 18 bp, Homo sapiens
gatcatagttttatttat

SEQ ID NO: 1358660 - DNA, 13 bp, Homo sapiens
gatcatgtacttt

SEQ ID NO: 1358661 - DNA, 11 bp, Homo sapiens
gatccaaagac

SEQ ID NO: 1358662 - DNA, 17 bp, Homo sapiens
gatccacccaaccctat

SEQ ID NO: 1358663 - DNA, 17 bp, Homo sapiens
gatcccgttttccccat

SEQ ID NO: 1358664 - DNA, 17 bp, Homo sapiens
gatccgactgctttgga

SEQ ID NO: 1358665 - DNA, 16 bp, Homo sapiens
gatcgagaccatcctg

SEQ ID NO: 1358666 - DNA, 22 bp, Homo sapiens
gatcggccatcaagggaagaac

SEQ ID NO: 1358667 - DNA, 18 bp, Homo sapiens
gatctaccagcataaata

SEQ ID NO: 1358668 - DNA, 21 bp, Homo sapiens
gatctcagctttgagaagcct

SEQ ID NO: 1358669 - DNA, 19 bp, Homo sapiens
gatctcttgagcctgggag

SEQ ID NO: 1358670 - DNA, 13 bp, Homo sapiens
gatctgagggaga

SEQ ID NO: 1358671 - DNA, 21 bp, Homo sapiens
gatctgcccatcgtgaagaag

SEQ ID NO: 1358672 - DNA, 21 bp, Homo sapiens
gatctgcggatctcagctttg

SEQ ID NO: 1358673 - DNA, 17 bp, Homo sapiens
gatctgctgcagagcag

SEQ ID NO: 1358674 - DNA, 15 bp, Homo sapiens
gatctttcagaaata

SEQ ID NO: 1358675 - DNA, 18 bp, Homo sapiens
gatctttcagaaatataa

SEQ ID NO: 1358676 - DNA, 19 bp, Homo sapiens
gatgaaactaaagcaatag

SEQ ID NO: 1358677 - DNA, 14 bp, Homo sapiens
gatgaacatctaac

SEQ ID NO: 1358678 - DNA, 21 bp, Homo sapiens
gatgacgtacaagtagttctg

SEQ ID NO: 1358679 - DNA, 16 bp, Homo sapiens
gatgagatttttaaaa

SEQ ID NO: 1358680 - DNA, 16 bp, Homo sapiens
gatgaggtattttttc

SEQ ID NO: 1358681 - DNA, 13 bp, Homo sapiens
gatgatcctaggc

SEQ ID NO: 1358682 - DNA, 16 bp, Homo sapiens
gatgcaccaccaagcc

SEQ ID NO: 1358683 - DNA, 12 bp, Homo sapiens
gatgcaggctcc

SEQ ID NO: 1358684 - DNA, 16 bp, Homo sapiens
gatgcaggctcccctg

SEQ ID NO: 1358685 - DNA, 22 bp, Homo sapiens
gatgcatgtcttttaaaatgca

SEQ ID NO: 1358686 - DNA, 23 bp, Homo sapiens
gatgccacttctaagaaaagcct

SEQ ID NO: 1358687 - DNA, 22 bp, Homo sapiens
gatgcggccattcaaggggagc

SEQ ID NO: 1358688 - DNA, 23 bp, Homo sapiens
gatgctttgtttctttcatatga

SEQ ID NO: 1358689 - DNA, 15 bp, Homo sapiens
cttggttgtctggca

SEQ ID NO: 1358690 - DNA, 15 bp, Homo sapiens
cttgtaaagactggt

SEQ ID NO: 1358691 - DNA, 23 bp, Homo sapiens
cttgtaaagactggttttctgcc

SEQ ID NO: 1358692 - DNA, 22 bp, Homo sapiens
cttgtagcgactaaactagatt

SEQ ID NO: 1358693 - DNA, 14 bp, Homo sapiens
cttgtataaattat

SEQ ID NO: 1358694 - DNA, 18 bp, Homo sapiens
cttgtcctagcttgggag

SEQ ID NO: 1358695 - DNA, 15 bp, Homo sapiens
cttgtcctcagccag

SEQ ID NO: 1358696 - DNA, 16 bp, Homo sapiens
cttgtcctcagccagt

SEQ ID NO: 1358697 - DNA, 23 bp, Homo sapiens
cttgtcttctggtactttctgtt

SEQ ID NO: 1358698 - DNA, 18 bp, Homo sapiens
cttgtgaaaatgtgttct

SEQ ID NO: 1358699 - DNA, 21 bp, Homo sapiens
cttgtgatttctttaaaagaa

SEQ ID NO: 1358700 - DNA, 16 bp, Homo sapiens
cttgtggcagcaacgg

SEQ ID NO: 1358701 - DNA, 24 bp, Homo sapiens
cttgtgggtccatgctaacaaaga

SEQ ID NO: 1358702 - DNA, 16 bp, Homo sapiens
cttgttcatcatccag

SEQ ID NO: 1358703 - DNA, 15 bp, Homo sapiens
cttgtttacctttct

SEQ ID NO: 1358704 - DNA, 15 bp, Homo sapiens
cttgtttcactgaaa

SEQ ID NO: 1358705 - DNA, 21 bp, Homo sapiens
cttgttttggatggcttgtct

SEQ ID NO: 1358706 - DNA, 12 bp, Homo sapiens
cttgtttttgca

SEQ ID NO: 1358707 - DNA, 20 bp, Homo sapiens
ctttaaaaagggaagaaact

SEQ ID NO: 1358708 - DNA, 18 bp, Homo sapiens
ctttaaaaggaaagaaaa

SEQ ID NO: 1358709 - DNA, 14 bp, Homo sapiens
ctttaaaagtgatc

SEQ ID NO: 1358710 - DNA, 23 bp, Homo sapiens
ctttaagacatactccttccatc

SEQ ID NO: 1358711 - DNA, 17 bp, Homo sapiens
ctttaagccttcaaaac

SEQ ID NO: 1358712 - DNA, 19 bp, Homo sapiens
ctttacccacctagaacac

SEQ ID NO: 1358713 - DNA, 17 bp, Homo sapiens
ctttaccttttcagggc

SEQ ID NO: 1358714 - DNA, 17 bp, Homo sapiens
ctttagacttgaaaaga

SEQ ID NO: 1358715 - DNA, 13 bp, Homo sapiens
ctttagtttttgg

SEQ ID NO: 1358716 - DNA, 14 bp, Homo sapiens
ctttatgtgaattt

SEQ ID NO: 1358717 - DNA, 20 bp, Homo sapiens
ctttatgtttttgaggcttt

SEQ ID NO: 1358718 - DNA, 15 bp, Homo sapiens
ctttattaatgtttt

SEQ ID NO: 1358719 - DNA, 19 bp, Homo sapiens
ctttattaatgttttcaaa

SEQ ID NO: 1358720 - DNA, 20 bp, Homo sapiens
ctttattaccccctccttca

SEQ ID NO: 1358721 - DNA, 12 bp, Homo sapiens
ctttattattta

SEQ ID NO: 1358722 - DNA, 14 bp, Homo sapiens
ctttatttgtaaat

SEQ ID NO: 1358723 - DNA, 15 bp, Homo sapiens
ctttatttgtaaatt

SEQ ID NO: 1358724 - DNA, 13 bp, Homo sapiens
ctttattttgtgt

SEQ ID NO: 1358725 - DNA, 16 bp, Homo sapiens
ctttattttgtgtaaa

SEQ ID NO: 1358726 - DNA, 20 bp, Homo sapiens
ctttatttttttgaactctt

SEQ ID NO: 1358727 - DNA, 23 bp, Homo sapiens
ctttcaagcagtcgtgcctgtgt

SEQ ID NO: 1358728 - DNA, 11 bp, Homo sapiens
ctttcagaaag

SEQ ID NO: 1358729 - DNA, 15 bp, Homo sapiens
ctttcagaaatataa

SEQ ID NO: 1358730 - DNA, 22 bp, Homo sapiens
ctttcagaaatataacacattt

SEQ ID NO: 1358731 - DNA, 14 bp, Homo sapiens
ctttcagtactttt

SEQ ID NO: 1358732 - DNA, 15 bp, Homo sapiens
ctttcagtacttttt

SEQ ID NO: 1358733 - DNA, 18 bp, Homo sapiens
ctttccaaaccttatctc

SEQ ID NO: 1358734 - DNA, 19 bp, Homo sapiens
ctttccaaatgcccagctt

SEQ ID NO: 1358735 - DNA, 22 bp, Homo sapiens
ctttccaaatgcccagcttaaa

SEQ ID NO: 1358736 - DNA, 15 bp, Homo sapiens
ctttccaccacagcc

SEQ ID NO: 1358737 - DNA, 22 bp, Homo sapiens
ctttccaggctatgtataaaat

SEQ ID NO: 1358738 - DNA, 23 bp, Homo sapiens
ctttccaggctatgtataaaata

SEQ ID NO: 1358739 - DNA, 17 bp, Homo sapiens
ctttcccccttctctta

SEQ ID NO: 1358740 - DNA, 11 bp, Homo sapiens
ctttccctcac

SEQ ID NO: 1358741 - DNA, 16 bp, Homo sapiens
ctttccctcaccccct

SEQ ID NO: 1358742 - DNA, 18 bp, Homo sapiens
ctttccctcaccccctcc

SEQ ID NO: 1358743 - DNA, 21 bp, Homo sapiens
ctttccttttcgcctttcctc

SEQ ID NO: 1358744 - DNA, 18 bp, Homo sapiens
ctttctcaaagaaatatt

SEQ ID NO: 1358745 - DNA, 12 bp, Homo sapiens
ctttctgcctgg

SEQ ID NO: 1358746 - DNA, 15 bp, Homo sapiens
ctttgagaagccttc

SEQ ID NO: 1358747 - DNA, 19 bp, Homo sapiens
ctttgagcctgggaaataa

SEQ ID NO: 1358748 - DNA, 11 bp, Homo sapiens
ctttgatgtca

SEQ ID NO: 1358749 - DNA, 22 bp, Homo sapiens
ctttgatgtcagcagttgctgg

SEQ ID NO: 1358750 - DNA, 22 bp, Homo sapiens
ctttgattatttgcatgttatg

SEQ ID NO: 1358751 - DNA, 24 bp, Homo sapiens
ctttgattatttgcatgttatgtt

SEQ ID NO: 1358752 - DNA, 13 bp, Homo sapiens
ctttgcatattat

SEQ ID NO: 1358753 - DNA, 15 bp, Homo sapiens
ctttgcatattataa

SEQ ID NO: 1358754 - DNA, 19 bp, Homo sapiens
ctttgccagtcattcagca

SEQ ID NO: 1358755 - DNA, 14 bp, Homo sapiens
ctttggaggtgctg

SEQ ID NO: 1358756 - DNA, 21 bp, Homo sapiens
ctttggattctaaatacatgc

SEQ ID NO: 1358757 - DNA, 20 bp, Homo sapiens
ctttgggaggccgaggcggg

SEQ ID NO: 1358758 - DNA, 16 bp, Homo sapiens
ctttggtactaataat

SEQ ID NO: 1358759 - DNA, 15 bp, Homo sapiens
ctttgtaaattctga

SEQ ID NO: 1358760 - DNA, 13 bp, Homo sapiens
ctttgtagatcct

SEQ ID NO: 1358761 - DNA, 13 bp, Homo sapiens
ctttgtatattac

SEQ ID NO: 1358762 - DNA, 14 bp, Homo sapiens
ctttgtatattaca

SEQ ID NO: 1358763 - DNA, 22 bp, Homo sapiens
ctttgtattgtcctattagtgt

SEQ ID NO: 1358764 - DNA, 18 bp, Homo sapiens
ctttgtattttgattatt

SEQ ID NO: 1358765 - DNA, 16 bp, Homo sapiens
ctttgtcaaaaggaag

SEQ ID NO: 1358766 - DNA, 14 bp, Homo sapiens
ctttgttcccggct

SEQ ID NO: 1358767 - DNA, 17 bp, Homo sapiens
ctttgtttcgtggggag

SEQ ID NO: 1358768 - DNA, 21 bp, Homo sapiens
ctttgtttgttgtcagctgaa

SEQ ID NO: 1358769 - DNA, 19 bp, Homo sapiens
cttttaaaatgcaatgtaa

SEQ ID NO: 1358770 - DNA, 20 bp, Homo sapiens
cttttaactttataaatcca

SEQ ID NO: 1358771 - DNA, 19 bp, Homo sapiens
cttttaattgtttcagaat

SEQ ID NO: 1358772 - DNA, 15 bp, Homo sapiens
cttttactggttgca

SEQ ID NO: 1358773 - DNA, 18 bp, Homo sapiens
cttttactggttgcatgg

SEQ ID NO: 1358774 - DNA, 13 bp, Homo sapiens
cttttataaagca

SEQ ID NO: 1358775 - DNA, 14 bp, Homo sapiens
cttttataaagcat

SEQ ID NO: 1358776 - DNA, 23 bp, Homo sapiens
cttttatctattctgagaaaaca

SEQ ID NO: 1358777 - DNA, 18 bp, Homo sapiens
cttttatgcaaaaggttt

SEQ ID NO: 1358778 - DNA, 21 bp, Homo sapiens
cttttattttacacagaaaca

SEQ ID NO: 1358779 - DNA, 19 bp, Homo sapiens
cttttccactccattgtcg

SEQ ID NO: 1358780 - DNA, 13 bp, Homo sapiens
cttttccctgctt

SEQ ID NO: 1358781 - DNA, 14 bp, Homo sapiens
cttttccctgcttc

SEQ ID NO: 1358782 - DNA, 15 bp, Homo sapiens
cttttccctgcttcc

SEQ ID NO: 1358783 - DNA, 20 bp, Homo sapiens
cttttccctgcttccaggaa

SEQ ID NO: 1358784 - DNA, 13 bp, Homo sapiens
cttttccttggca

SEQ ID NO: 1358785 - DNA, 14 bp, Homo sapiens
cttggagggaagcc

SEQ ID NO: 1358786 - DNA, 22 bp, Homo sapiens
cttggatatataggctattttc

SEQ ID NO: 1358787 - DNA, 13 bp, Homo sapiens
cttggattaaata

SEQ ID NO: 1358788 - DNA, 15 bp, Homo sapiens
cttggattaaataca

SEQ ID NO: 1358789 - DNA, 20 bp, Homo sapiens
cttggcaataaattttgaaa

SEQ ID NO: 1358790 - DNA, 18 bp, Homo sapiens
cttggcacttattgaata

SEQ ID NO: 1358791 - DNA, 14 bp, Homo sapiens
cttggcattccgca

SEQ ID NO: 1358792 - DNA, 19 bp, Homo sapiens
cttggcctaaacctcagtt

SEQ ID NO: 1358793 - DNA, 13 bp, Homo sapiens
cttggcctgctgt

SEQ ID NO: 1358794 - DNA, 15 bp, Homo sapiens
cttggcctgctgtga

SEQ ID NO: 1358795 - DNA, 15 bp, Homo sapiens
cttgggaggcttccc

SEQ ID NO: 1358796 - DNA, 18 bp, Homo sapiens
cttgggcagagctggctc

SEQ ID NO: 1358797 - DNA, 13 bp, Homo sapiens
cttgggccacccc

SEQ ID NO: 1358798 - DNA, 21 bp, Homo sapiens
cttggggccaccaaagctgcc

SEQ ID NO: 1358799 - DNA, 22 bp, Homo sapiens
cttggggccaccaaagctgccc

SEQ ID NO: 1358800 - DNA, 16 bp, Homo sapiens
cttggggcccagtgca

SEQ ID NO: 1358801 - DNA, 17 bp, Homo sapiens
cttggggcccagtgcat

SEQ ID NO: 1358802 - DNA, 18 bp, Homo sapiens
cttggggctcacacacct

SEQ ID NO: 1358803 - DNA, 22 bp, Homo sapiens
cttggggggctgaggtgggagg

SEQ ID NO: 1358804 - DNA, 23 bp, Homo sapiens
cttggggggctgaggtgggagga

SEQ ID NO: 1358805 - DNA, 16 bp, Homo sapiens
cttggtgtaatttgaa

SEQ ID NO: 1358806 - DNA, 17 bp, Homo sapiens
ctcaaaaaaagaaaaag

SEQ ID NO: 1358807 - DNA, 18 bp, Homo sapiens
ctcaaaataaagaagtat

SEQ ID NO: 1358808 - DNA, 13 bp, Homo sapiens
ctcaaattttttg

SEQ ID NO: 1358809 - DNA, 21 bp, Homo sapiens
ctcaaattttttgactttttt

SEQ ID NO: 1358810 - DNA, 12 bp, Homo sapiens
ctcaacaagaaa

SEQ ID NO: 1358811 - DNA, 21 bp, Homo sapiens
ctcaacacctctgcacaagct

SEQ ID NO: 1358812 - DNA, 13 bp, Homo sapiens
ctcaacctcttct

SEQ ID NO: 1358813 - DNA, 18 bp, Homo sapiens
ctcaacctcttctggctc

SEQ ID NO: 1358814 - DNA, 17 bp, Homo sapiens
ctcaactgggtccagaa

SEQ ID NO: 1358815 - DNA, 18 bp, Homo sapiens
ctcaagaggaatgaaaaa

SEQ ID NO: 1358816 - DNA, 19 bp, Homo sapiens
ctctttgattatttgcatg

SEQ ID NO: 1358817 - DNA, 20 bp, Homo sapiens
ctctttgattatttgcatgt

SEQ ID NO: 1358818 - DNA, 18 bp, Homo sapiens
ctctttggacactcacac

SEQ ID NO: 1358819 - DNA, 23 bp, Homo sapiens
ctcttttccactccattgtcgta

SEQ ID NO: 1358820 - DNA, 20 bp, Homo sapiens
ctgaaaatattgttttacaa

SEQ ID NO: 1358821 - DNA, 20 bp, Homo sapiens
ctgaaactatattttgtcat

SEQ ID NO: 1358822 - DNA, 18 bp, Homo sapiens
ctgaaagccctgagcttt

SEQ ID NO: 1358823 - DNA, 19 bp, Homo sapiens
ctgaaagccctgagctttc

SEQ ID NO: 1358824 - DNA, 15 bp, Homo sapiens
ctgaaagttttgtaa

SEQ ID NO: 1358825 - DNA, 17 bp, Homo sapiens
ctgaaagttttgtaaaa

SEQ ID NO: 1358826 - DNA, 18 bp, Homo sapiens
ctgaaataggaaacaagt

SEQ ID NO: 1358827 - DNA, 14 bp, Homo sapiens
ctgaaattctcctg

SEQ ID NO: 1358828 - DNA, 17 bp, Homo sapiens
ctgaaattctcctggag

SEQ ID NO: 1358829 - DNA, 20 bp, Homo sapiens
ctgaaattctcctggaggtc

SEQ ID NO: 1358830 - DNA, 19 bp, Homo sapiens
ctgaacacttttgttgtaa

SEQ ID NO: 1358831 - DNA, 14 bp, Homo sapiens
ctgaaccacttgta

SEQ ID NO: 1358832 - DNA, 18 bp, Homo sapiens
ctgaaccacttgtagatt

SEQ ID NO: 1358833 - DNA, 22 bp, Homo sapiens
ctgaaccacttgtagatttgat

SEQ ID NO: 1358834 - DNA, 20 bp, Homo sapiens
ctgaagcagcctctccccag

SEQ ID NO: 1358835 - DNA, 14 bp, Homo sapiens
ctgaaggaaaaaca

SEQ ID NO: 1358836 - DNA, 17 bp, Homo sapiens
ctgaaggaaaaacacaa

SEQ ID NO: 1358837 - DNA, 15 bp, Homo sapiens
ctgaatgttgggact

SEQ ID NO: 1358838 - DNA, 19 bp, Homo sapiens
ctgaatgttgggactgcta

SEQ ID NO: 1358839 - DNA, 19 bp, Homo sapiens
ctgaatttttttgtaataa

SEQ ID NO: 1358840 - DNA, 23 bp, Homo sapiens
ctgaatttttttgtaataagcaa

SEQ ID NO: 1358841 - DNA, 22 bp, Homo sapiens
ctgacaaggcacttcatgtaaa

SEQ ID NO: 1358842 - DNA, 23 bp, Homo sapiens
ctgacaaggcacttcatgtaaag

SEQ ID NO: 1358843 - DNA, 16 bp, Homo sapiens
ctgacatatctacact

SEQ ID NO: 1358844 - DNA, 21 bp, Homo sapiens
ctgacatcttgaatccttcca

SEQ ID NO: 1358845 - DNA, 22 bp, Homo sapiens
ctgacatcttgaatccttccat

SEQ ID NO: 1358846 - DNA, 14 bp, Homo sapiens
ctgacatttcttct

SEQ ID NO: 1358847 - DNA, 18 bp, Homo sapiens
ctgaccacttgaggcctg

SEQ ID NO: 1358848 - DNA, 19 bp, Homo sapiens
ctgaccacttgaggcctga

SEQ ID NO: 1358849 - DNA, 16 bp, Homo sapiens
ctgacccattgctgtt

SEQ ID NO: 1358850 - DNA, 18 bp, Homo sapiens
ctgactcggtttctccaa

SEQ ID NO: 1358851 - DNA, 11 bp, Homo sapiens
ctgactgaggc

SEQ ID NO: 1358852 - DNA, 12 bp, Homo sapiens
ctgacttagaat

SEQ ID NO: 1358853 - DNA, 16 bp, Homo sapiens
ctgacttctgcctgga

SEQ ID NO: 1358854 - DNA, 19 bp, Homo sapiens
ctgacttctgcctggagac

SEQ ID NO: 1358855 - DNA, 15 bp, Homo sapiens
ctgagactgtgctgt

SEQ ID NO: 1358856 - DNA, 12 bp, Homo sapiens
ctgagaggcagg

SEQ ID NO: 1358857 - DNA, 22 bp, Homo sapiens
ctgagccagtgctttaatggca

SEQ ID NO: 1358858 - DNA, 21 bp, Homo sapiens
ctgagccctactccctgcaga

SEQ ID NO: 1358859 - DNA, 18 bp, Homo sapiens
ctgagccggccccaggct

SEQ ID NO: 1358860 - DNA, 14 bp, Homo sapiens
ctgagcctctgctc

SEQ ID NO: 1358861 - DNA, 15 bp, Homo sapiens
ctgagcctgcaggga

SEQ ID NO: 1358862 - DNA, 13 bp, Homo sapiens
ctgagctgccagt

SEQ ID NO: 1358863 - DNA, 14 bp, Homo sapiens
ctgagctttctgct

SEQ ID NO: 1358864 - DNA, 16 bp, Homo sapiens
ctgaggatgaccagaa

SEQ ID NO: 1358865 - DNA, 17 bp, Homo sapiens
ctgaggcagtttgagga

SEQ ID NO: 1358866 - DNA, 19 bp, Homo sapiens
ctgaggcctgggccgctgc

SEQ ID NO: 1358867 - DNA, 12 bp, Homo sapiens
ctgaggctgagg

SEQ ID NO: 1358868 - DNA, 23 bp, Homo sapiens
ctgagggaaatgttttgtaaaca

SEQ ID NO: 1358869 - DNA, 20 bp, Homo sapiens
ctgagggcagactggggcat

SEQ ID NO: 1358870 - DNA, 14 bp, Homo sapiens
ctgagggcttgtag

SEQ ID NO: 1358871 - DNA, 20 bp, Homo sapiens
ctgagggcttgtagttcttt

SEQ ID NO: 1358872 - DNA, 13 bp, Homo sapiens
ctgagggggagcc

SEQ ID NO: 1358873 - DNA, 14 bp, Homo sapiens
ctgaggttcctctg

SEQ ID NO: 1358874 - DNA, 20 bp, Homo sapiens
ctgaggttcctctgcctgcc

SEQ ID NO: 1358875 - DNA, 16 bp, Homo sapiens
ctgagtggcaggggac

SEQ ID NO: 1358876 - DNA, 18 bp, Homo sapiens
ctgagtggcaggggacag

SEQ ID NO: 1358877 - DNA, 12 bp, Homo sapiens
ctgatctgccca

SEQ ID NO: 1358878 - DNA, 17 bp, Homo sapiens
ctgatctgcccatcgtg

SEQ ID NO: 1358879 - DNA, 19 bp, Homo sapiens
ctgatctgcggatctcagc

SEQ ID NO: 1358880 - DNA, 18 bp, Homo sapiens
ctgatctttgtatattac

SEQ ID NO: 1358881 - DNA, 11 bp, Homo sapiens
ctgatgacaat

SEQ ID NO: 1358882 - DNA, 18 bp, Homo sapiens
ctgatgacaataaagctt

SEQ ID NO: 1358883 - DNA, 20 bp, Homo sapiens
ctgatgacaataaagcttgt

SEQ ID NO: 1358884 - DNA, 17 bp, Homo sapiens
ctgatgagatttttaaa

SEQ ID NO: 1358885 - DNA, 14 bp, Homo sapiens
ctgatggccttaat

SEQ ID NO: 1358886 - DNA, 19 bp, Homo sapiens
ctgatggccttaatttcct

SEQ ID NO: 1358887 - DNA, 22 bp, Homo sapiens
ctgatgggaaaactgccaatat

SEQ ID NO: 1358888 - DNA, 21 bp, Homo sapiens
ctgatggtgtggcctgtggct

SEQ ID NO: 1358889 - DNA, 22 bp, Homo sapiens
ctgatgtcaatttctgtgttgc

SEQ ID NO: 1358890 - DNA, 21 bp, Homo sapiens
ctgattaagttgtctaaacaa

SEQ ID NO: 1358891 - DNA, 14 bp, Homo sapiens
ctgattctggcttt

SEQ ID NO: 1358892 - DNA, 21 bp, Homo sapiens
ctgatttctagaacccgtgac

SEQ ID NO: 1358893 - DNA, 21 bp, Homo sapiens
ctgcaaaaggcctcttgtaaa

SEQ ID NO: 1358894 - DNA, 12 bp, Homo sapiens
ctgcaatatttg

SEQ ID NO: 1358895 - DNA, 14 bp, Homo sapiens
ctgcaattccctgg

SEQ ID NO: 1358896 - DNA, 15 bp, Homo sapiens
ctgcacaagctgcac

SEQ ID NO: 1358897 - DNA, 18 bp, Homo sapiens
ctgcacaagctgcaccct

SEQ ID NO: 1358898 - DNA, 19 bp, Homo sapiens
ctgcaccccttctctcctc

SEQ ID NO: 1358899 - DNA, 20 bp, Homo sapiens
ctgcactccagcctggggga

SEQ ID NO: 1358900 - DNA, 19 bp, Homo sapiens
ctgcactcttaagcttccg

SEQ ID NO: 1358901 - DNA, 21 bp, Homo sapiens
ctgcagagcagtaagggaaca

SEQ ID NO: 1358902 - DNA, 21 bp, Homo sapiens
ctgcagatgccaccctagcca

SEQ ID NO: 1358903 - DNA, 18 bp, Homo sapiens
ctgcagcaccgaggggcc

SEQ ID NO: 1358904 - DNA, 12 bp, Homo sapiens
ctgcagctttgt

SEQ ID NO: 1358905 - DNA, 18 bp, Homo sapiens
ctgcaggaaatagtcact

SEQ ID NO: 1358906 - DNA, 19 bp, Homo sapiens
ctgcaggacttgagaagac

SEQ ID NO: 1358907 - DNA, 13 bp, Homo sapiens
ctgcaggccctgg

SEQ ID NO: 1358908 - DNA, 14 bp, Homo sapiens
ctgcaggccctggc

SEQ ID NO: 1358909 - DNA, 17 bp, Homo sapiens
ctgcaggccctggcctc

SEQ ID NO: 1358910 - DNA, 19 bp, Homo sapiens
ctgcaggccctggcctccc

SEQ ID NO: 1358911 - DNA, 15 bp, Homo sapiens
ctgcaggctttgcca

SEQ ID NO: 1358912 - DNA, 11 bp, Homo sapiens
ctgcagggcca

SEQ ID NO: 1358913 - DNA, 21 bp, Homo sapiens
ctgcagggccatggctcaggg

SEQ ID NO: 1358914 - DNA, 23 bp, Homo sapiens
ctgcagtcctactcaagcgggtg

SEQ ID NO: 1358915 - DNA, 15 bp, Homo sapiens
ctgcatgccctctca

SEQ ID NO: 1358916 - DNA, 16 bp, Homo sapiens
ctgcatgccctctcag

SEQ ID NO: 1358917 - DNA, 17 bp, Homo sapiens
ctgcatgccctctcagg

SEQ ID NO: 1358918 - DNA, 18 bp, Homo sapiens
ctgcatgccctctcaggc

SEQ ID NO: 1358919 - DNA, 23 bp, Homo sapiens
ctgcattcatttttatagcaaca

SEQ ID NO: 1358920 - DNA, 19 bp, Homo sapiens
ctgcatttcctcgcagcct

SEQ ID NO: 1358921 - DNA, 11 bp, Homo sapiens
ctgccagcagc

SEQ ID NO: 1358922 - DNA, 20 bp, Homo sapiens
ctgccagccttgagccctgg

SEQ ID NO: 1358923 - DNA, 22 bp, Homo sapiens
ctgccaggccagcctccgagag

SEQ ID NO: 1358924 - DNA, 20 bp, Homo sapiens
ctgccatctagccagcccct

SEQ ID NO: 1358925 - DNA, 17 bp, Homo sapiens
ctgccatgccagcttat

SEQ ID NO: 1358926 - DNA, 19 bp, Homo sapiens
ctgccatgccagcttatct

SEQ ID NO: 1358927 - DNA, 23 bp, Homo sapiens
ctgccatggctaggtagaagtga

SEQ ID NO: 1358928 - DNA, 15 bp, Homo sapiens
ctgcccacctgccgg

SEQ ID NO: 1358929 - DNA, 21 bp, Homo sapiens
ctgcccatcgtgaagaagcct

SEQ ID NO: 1358930 - DNA, 13 bp, Homo sapiens
ctgccccatctcc

SEQ ID NO: 1358931 - DNA, 21 bp, Homo sapiens
ctgccccatctcccctcagct

SEQ ID NO: 1358932 - DNA, 14 bp, Homo sapiens
ctgccccgccccca

SEQ ID NO: 1358933 - DNA, 16 bp, Homo sapiens
ctgccccgcccccagt

SEQ ID NO: 1358934 - DNA, 15 bp, Homo sapiens
ctgcccctcagagac

SEQ ID NO: 1358935 - DNA, 12 bp, Homo sapiens
ctaagtcagtac

SEQ ID NO: 1358936 - DNA, 15 bp, Homo sapiens
ctaagtcagtaccca

SEQ ID NO: 1358937 - DNA, 15 bp, Homo sapiens
ctaagtcatgtatgt

SEQ ID NO: 1358938 - DNA, 18 bp, Homo sapiens
ctaagtcatgtatgtttc

SEQ ID NO: 1358939 - DNA, 15 bp, Homo sapiens
ctaataatcttgttt

SEQ ID NO: 1358940 - DNA, 19 bp, Homo sapiens
ctaataatcttgtttctga

SEQ ID NO: 1358941 - DNA, 18 bp, Homo sapiens
ctaatagtgatcaagaag

SEQ ID NO: 1358942 - DNA, 23 bp, Homo sapiens
ctaatagtgatcaagaagacttt

SEQ ID NO: 1358943 - DNA, 18 bp, Homo sapiens
ctaatcaccatgtaagca

SEQ ID NO: 1358944 - DNA, 20 bp, Homo sapiens
ctaatctatggtcgggagac

SEQ ID NO: 1358945 - DNA, 18 bp, Homo sapiens
ctaattaaccttactaat

SEQ ID NO: 1358946 - DNA, 21 bp, Homo sapiens
ctaattatactactttgttag

SEQ ID NO: 1358947 - DNA, 14 bp, Homo sapiens
ctaattatttaatt

SEQ ID NO: 1358948 - DNA, 14 bp, Homo sapiens
ctaattctaatgtg

SEQ ID NO: 1358949 - DNA, 15 bp, Homo sapiens
ctaattggtactttt

SEQ ID NO: 1358950 - DNA, 14 bp, Homo sapiens
cctctgtgccttct

SEQ ID NO: 1358951 - DNA, 21 bp, Homo sapiens
cctctgtgccttcttttgatt

SEQ ID NO: 1358952 - DNA, 16 bp, Homo sapiens
cctctgtgctgtgtgt

SEQ ID NO: 1358953 - DNA, 15 bp, Homo sapiens
cctcttctggctcaa

SEQ ID NO: 1358954 - DNA, 15 bp, Homo sapiens
cctgaaccgcacagc

SEQ ID NO: 1358955 - DNA, 18 bp, Homo sapiens
cctgaaccgcacagctca

SEQ ID NO: 1358956 - DNA, 20 bp, Homo sapiens
cctgaaccgcacagctcagg

SEQ ID NO: 1358957 - DNA, 16 bp, Homo sapiens
cctgacagaaggtgcc

SEQ ID NO: 1358958 - DNA, 23 bp, Homo sapiens
cctgacagagggatggaggaaga

SEQ ID NO: 1358959 - DNA, 20 bp, Homo sapiens
cctgaccagctgctccgagg

SEQ ID NO: 1358960 - DNA, 21 bp, Homo sapiens
cctgaccagctgctccgagga

SEQ ID NO: 1358961 - DNA, 20 bp, Homo sapiens
cctgacccattgctgttgtc

SEQ ID NO: 1358962 - DNA, 13 bp, Homo sapiens
cctgagaggcagg

SEQ ID NO: 1358963 - DNA, 14 bp, Homo sapiens
cctgagaggcaggc

SEQ ID NO: 1358964 - DNA, 22 bp, Homo sapiens
cctgagccctactccctgcaga

SEQ ID NO: 1358965 - DNA, 16 bp, Homo sapiens
cctgagctttctgcta

SEQ ID NO: 1358966 - DNA, 17 bp, Homo sapiens
cctgagtctgggcagct

SEQ ID NO: 1358967 - DNA, 13 bp, Homo sapiens
cctgattcctctc

SEQ ID NO: 1358968 - DNA, 13 bp, Homo sapiens
cctgcaatatttg

SEQ ID NO: 1358969 - DNA, 18 bp, Homo sapiens
cctgcacgtcatgggagg

SEQ ID NO: 1358970 - DNA, 13 bp, Homo sapiens
cctgcagatgcca

SEQ ID NO: 1358971 - DNA, 13 bp, Homo sapiens
cctgccaccaggc

SEQ ID NO: 1358972 - DNA, 14 bp, Homo sapiens
cctgccaccaggcc

SEQ ID NO: 1358973 - DNA, 13 bp, Homo sapiens
cctgccactcact

SEQ ID NO: 1358974 - DNA, 15 bp, Homo sapiens
cctgccaggcagggg

SEQ ID NO: 1358975 - DNA, 12 bp, Homo sapiens
cctgccaggcat

SEQ ID NO: 1358976 - DNA, 15 bp, Homo sapiens
cctgccaggcatggt

SEQ ID NO: 1358977 - DNA, 18 bp, Homo sapiens
cctgcccagccccctggt

SEQ ID NO: 1358978 - DNA, 20 bp, Homo sapiens
cctgccccgcccccagtccc

SEQ ID NO: 1358979 - DNA, 14 bp, Homo sapiens
cctgccctcaaggg

SEQ ID NO: 1358980 - DNA, 18 bp, Homo sapiens
ccggtaactgtcctgtcc

SEQ ID NO: 1358981 - DNA, 19 bp, Homo sapiens
ccggtaactgtcctgtcct

SEQ ID NO: 1358982 - DNA, 21 bp, Homo sapiens
ccggtccagctggcctggaca

SEQ ID NO: 1358983 - DNA, 20 bp, Homo sapiens
ccgtatctccggctcccagc

SEQ ID NO: 1358984 - DNA, 22 bp, Homo sapiens
ccgtatctccggctcccagcct

SEQ ID NO: 1358985 - DNA, 13 bp, Homo sapiens
ccgtcaccaccac

SEQ ID NO: 1358986 - DNA, 15 bp, Homo sapiens
ccgtcaccaccaccc

SEQ ID NO: 1358987 - DNA, 17 bp, Homo sapiens
ccgtcaccaccacccct

SEQ ID NO: 1358988 - DNA, 20 bp, Homo sapiens
ccgtcaccaccacccctacc

SEQ ID NO: 1358989 - DNA, 15 bp, Homo sapiens
ccgtcctgcctgtgg

SEQ ID NO: 1358990 - DNA, 23 bp, Homo sapiens
ccgtggaggaggaaggcaagagg

SEQ ID NO: 1358991 - DNA, 13 bp, Homo sapiens
ccgtggggcaggg

SEQ ID NO: 1358992 - DNA, 23 bp, Homo sapiens
ccgtggggcagggagctgggccc

SEQ ID NO: 1358993 - DNA, 18 bp, Homo sapiens
ccgttccaccccaagaga

SEQ ID NO: 1358994 - DNA, 20 bp, Homo sapiens
ccgttccaccccaagagaac

SEQ ID NO: 1358995 - DNA, 22 bp, Homo sapiens
ccgttccaccccaagagaactc

SEQ ID NO: 1358996 - DNA, 15 bp, Homo sapiens
ccgttgctgacttag

SEQ ID NO: 1358997 - DNA, 12 bp, Homo sapiens
ccgttttcccca

SEQ ID NO: 1358998 - DNA, 22 bp, Homo sapiens
cctaaagaaaaatatcttggcc

SEQ ID NO: 1358999 - DNA, 14 bp, Homo sapiens
cctaaccccttcca

SEQ ID NO: 1359000 - DNA, 20 bp, Homo sapiens
cctaatctatggtcgggaga

SEQ ID NO: 1359001 - DNA, 14 bp, Homo sapiens
cctaatttctcctc

SEQ ID NO: 1359002 - DNA, 15 bp, Homo sapiens
cctaatttctcctcc

SEQ ID NO: 1359003 - DNA, 17 bp, Homo sapiens
cctaatttctcctccct

SEQ ID NO: 1359004 - DNA, 20 bp, Homo sapiens
cctaatttctcctcccttcc

SEQ ID NO: 1359005 - DNA, 23 bp, Homo sapiens
cctaatttctcctcccttccttt

SEQ ID NO: 1359006 - DNA, 21 bp, Homo sapiens
cctacagctttgatccctgac

SEQ ID NO: 1359007 - DNA, 21 bp, Homo sapiens
cctacagttgaaaaacagctg

SEQ ID NO: 1359008 - DNA, 16 bp, Homo sapiens
cctaccaatattaggt

SEQ ID NO: 1359009 - DNA, 21 bp, Homo sapiens
cctagaaattccccaccctga

SEQ ID NO: 1359010 - DNA, 23 bp, Homo sapiens
cctagactcggggtgcttccttg

SEQ ID NO: 1359011 - DNA, 20 bp, Homo sapiens
cctagaggccctttgctgtc

SEQ ID NO: 1359012 - DNA, 17 bp, Homo sapiens
cctagcactttgggagg

SEQ ID NO: 1359013 - DNA, 22 bp, Homo sapiens
agaccctgggtgggctctgtgc

SEQ ID NO: 1359014 - DNA, 23 bp, Homo sapiens
agactagcaatctcttcattatt

SEQ ID NO: 1359015 - DNA, 19 bp, Homo sapiens
agactatatatataaatgt

SEQ ID NO: 1359016 - DNA, 21 bp, Homo sapiens
agactatttttagattttctt

SEQ ID NO: 1359017 - DNA, 18 bp, Homo sapiens
agactcagtgcagatgga

SEQ ID NO: 1359018 - DNA, 22 bp, Homo sapiens
agactcggggtgcttccttgta

SEQ ID NO: 1359019 - DNA, 18 bp, Homo sapiens
agactggcttttattaat

SEQ ID NO: 1359020 - DNA, 22 bp, Homo sapiens
agactggcttttattaatgcac

SEQ ID NO: 1359021 - DNA, 14 bp, Homo sapiens
agactggttttctg

SEQ ID NO: 1359022 - DNA, 15 bp, Homo sapiens
agactggttttctgc

SEQ ID NO: 1359023 - DNA, 16 bp, Homo sapiens
agactggttttctgcc

SEQ ID NO: 1359024 - DNA, 17 bp, Homo sapiens
agacttgaaaagagaca

SEQ ID NO: 1359025 - DNA, 20 bp, Homo sapiens
agacttgaaaagagacaggc

SEQ ID NO: 1359026 - DNA, 21 bp, Homo sapiens
agacttgtatagcatgaaata

SEQ ID NO: 1359027 - DNA, 13 bp, Homo sapiens
agactttgatgtc

SEQ ID NO: 1359028 - DNA, 17 bp, Homo sapiens
agactttgatgtcagca

SEQ ID NO: 1359029 - DNA, 14 bp, Homo sapiens
agagaacaggacta

SEQ ID NO: 1359030 - DNA, 22 bp, Homo sapiens
agagaactcgcgctcagtaaac

SEQ ID NO: 1359031 - DNA, 15 bp, Homo sapiens
agagaagcaagtaaa

SEQ ID NO: 1359032 - DNA, 21 bp, Homo sapiens
agagacagctacacagagctt

SEQ ID NO: 1359033 - DNA, 22 bp, Homo sapiens
agagacaggcaggtgatctgct

SEQ ID NO: 1359034 - DNA, 14 bp, Homo sapiens
agagactgaaatta

SEQ ID NO: 1359035 - DNA, 15 bp, Homo sapiens
agagagagaggacag

SEQ ID NO: 1359036 - DNA, 13 bp, Homo sapiens
agagaggacagct

SEQ ID NO: 1359037 - DNA, 13 bp, Homo sapiens
agagatttctcat

SEQ ID NO: 1359038 - DNA, 17 bp, Homo sapiens
agagcagtggtaagaat

SEQ ID NO: 1359039 - DNA, 18 bp, Homo sapiens
agagcataatttaaaaat

SEQ ID NO: 1359040 - DNA, 20 bp, Homo sapiens
agagcataatttaaaaatat

SEQ ID NO: 1359041 - DNA, 21 bp, Homo sapiens
agagcataatttaaaaatata

SEQ ID NO: 1359042 - DNA, 23 bp, Homo sapiens
agagcataatttaaaaatatatt

SEQ ID NO: 1359043 - DNA, 19 bp, Homo sapiens
agagccatacataaaagaa

SEQ ID NO: 1359044 - DNA, 14 bp, Homo sapiens
agagcccttgcctc

SEQ ID NO: 1359045 - DNA, 19 bp, Homo sapiens
agagcccttgcctccccat

SEQ ID NO: 1359046 - DNA, 22 bp, Homo sapiens
agagccgggcacattgagctgt

SEQ ID NO: 1359047 - DNA, 11 bp, Homo sapiens
agagcctgctg

SEQ ID NO: 1359048 - DNA, 12 bp, Homo sapiens
agagcctgctgg

SEQ ID NO: 1359049 - DNA, 16 bp, Homo sapiens
agagcctggtgctgct

SEQ ID NO: 1359050 - DNA, 15 bp, Homo sapiens
agagccttctcagaa

SEQ ID NO: 1359051 - DNA, 17 bp, Homo sapiens
agagctatcaggagaaa

SEQ ID NO: 1359052 - DNA, 22 bp, Homo sapiens
agagctctctctacagagagga

SEQ ID NO: 1359053 - DNA, 16 bp, Homo sapiens
agagctgccatcgctg

SEQ ID NO: 1359054 - DNA, 15 bp, Homo sapiens
agagctggctctgag

SEQ ID NO: 1359055 - DNA, 15 bp, Homo sapiens
agaggaatcctggca

SEQ ID NO: 1359056 - DNA, 21 bp, Homo sapiens
agaggaatcctggcagcccag

SEQ ID NO: 1359057 - DNA, 13 bp, Homo sapiens
agaggaatgaaaa

SEQ ID NO: 1359058 - DNA, 17 bp, Homo sapiens
agaggaatgaaaaaagc

SEQ ID NO: 1359059 - DNA, 22 bp, Homo sapiens
agaggactgtagggagggcggc

SEQ ID NO: 1359060 - DNA, 11 bp, Homo sapiens
agaggagcctt

SEQ ID NO: 1359061 - DNA, 13 bp, Homo sapiens
agaggcaccagga

SEQ ID NO: 1359062 - DNA, 20 bp, Homo sapiens
agaggcccagatattagaaa

SEQ ID NO: 1359063 - DNA, 21 bp, Homo sapiens
agaggcccccagcccagggct

SEQ ID NO: 1359064 - DNA, 17 bp, Homo sapiens
agaggccctttgctgtc

SEQ ID NO: 1359065 - DNA, 17 bp, Homo sapiens
agaggctagcttctgct

SEQ ID NO: 1359066 - DNA, 18 bp, Homo sapiens
agaggctgcccctctcac

SEQ ID NO: 1359067 - DNA, 20 bp, Homo sapiens
agaggctgcccctctcacca

SEQ ID NO: 1359068 - DNA, 16 bp, Homo sapiens
agaggcttctccgcca

SEQ ID NO: 1359069 - DNA, 21 bp, Homo sapiens
agaggcttctccgccagcctc

SEQ ID NO: 1359070 - DNA, 21 bp, Homo sapiens
agagggacggccaagaatgta

SEQ ID NO: 1359071 - DNA, 22 bp, Homo sapiens
agagggacggccaagaatgtac

SEQ ID NO: 1359072 - DNA, 12 bp, Homo sapiens
agagggagagag

SEQ ID NO: 1359073 - DNA, 21 bp, Homo sapiens
agaggtgggccagtctgtgga

SEQ ID NO: 1359074 - DNA, 24 bp, Homo sapiens
agaggtgggccagtctgtggatca

SEQ ID NO: 1359075 - DNA, 15 bp, Homo sapiens
agagtacactgcctg

SEQ ID NO: 1359076 - DNA, 15 bp, Homo sapiens
agagtcaaggcctgc

SEQ ID NO: 1359077 - DNA, 18 bp, Homo sapiens
agagtcagccaggaccat

SEQ ID NO: 1359078 - DNA, 21 bp, Homo sapiens
agagtctgagggcttgtagtt

SEQ ID NO: 1359079 - DNA, 15 bp, Homo sapiens
agagtctggccctag

SEQ ID NO: 1359080 - DNA, 20 bp, Homo sapiens
agagtgtagtttacagaaaa

SEQ ID NO: 1359081 - DNA, 22 bp, Homo sapiens
agagttgggtgtctccttaagc

SEQ ID NO: 1359082 - DNA, 20 bp, Homo sapiens
agagtttcagtttgttggaa

SEQ ID NO: 1359083 - DNA, 18 bp, Homo sapiens
agataatattaaggaaga

SEQ ID NO: 1359084 - DNA, 17 bp, Homo sapiens
agataatattgtttggt

SEQ ID NO: 1359085 - DNA, 16 bp, Homo sapiens
agataatttcagggtg

SEQ ID NO: 1359086 - DNA, 19 bp, Homo sapiens
agataccttatcttacaat

SEQ ID NO: 1359087 - DNA, 15 bp, Homo sapiens
agatagacaggtcct

SEQ ID NO: 1359088 - DNA, 16 bp, Homo sapiens
agatatcgacttgttt

SEQ ID NO: 1359089 - DNA, 16 bp, Homo sapiens
agatatttttcataaa

SEQ ID NO: 1359090 - DNA, 15 bp, Homo sapiens
agatcaaaaaggctt

SEQ ID NO: 1359091 - DNA, 20 bp, Homo sapiens
agatcaaaaaggcttataaa

SEQ ID NO: 1359092 - DNA, 22 bp, Homo sapiens
cccccacttgcctcttccttga

SEQ ID NO: 1359093 - DNA, 19 bp, Homo sapiens
cccccagccatgccagctg

SEQ ID NO: 1359094 - DNA, 20 bp, Homo sapiens
cccccagccatgccagctgg

SEQ ID NO: 1359095 - DNA, 23 bp, Homo sapiens
cccccagccatgccagctggcct

SEQ ID NO: 1359096 - DNA, 21 bp, Homo sapiens
cccccagcccagggctcctgc

SEQ ID NO: 1359097 - DNA, 19 bp, Homo sapiens
ccccctccgccctgccact

SEQ ID NO: 1359098 - DNA, 14 bp, Homo sapiens
ccccctgccctgca

SEQ ID NO: 1359099 - DNA, 14 bp, Homo sapiens
ccccgcagacacct

SEQ ID NO: 1359100 - DNA, 13 bp, Homo sapiens
ccccgcctggcca

SEQ ID NO: 1359101 - DNA, 14 bp, Homo sapiens
ccccgcctggccag

SEQ ID NO: 1359102 - DNA, 23 bp, Homo sapiens
ccccggcatgagactcagtgcag

SEQ ID NO: 1359103 - DNA, 21 bp, Homo sapiens
cccctagccggttcctgtccc

SEQ ID NO: 1359104 - DNA, 15 bp, Homo sapiens
cccctcaacacctct

SEQ ID NO: 1359105 - DNA, 15 bp, Homo sapiens
cccctcagctcggct

SEQ ID NO: 1359106 - DNA, 18 bp, Homo sapiens
cccctcagctcggctcag

SEQ ID NO: 1359107 - DNA, 17 bp, Homo sapiens
cccctcccacccccagc

SEQ ID NO: 1359108 - DNA, 19 bp, Homo sapiens
cccctcctagtttgggagg

SEQ ID NO: 1359109 - DNA, 20 bp, Homo sapiens
cccctcctgaaccgcacagc

SEQ ID NO: 1359110 - DNA, 18 bp, Homo sapiens
cccctcgcaactgtccac

SEQ ID NO: 1359111 - DNA, 12 bp, Homo sapiens
cccctctcacca

SEQ ID NO: 1359112 - DNA, 17 bp, Homo sapiens
cccctctgcacccagaa

SEQ ID NO: 1359113 - DNA, 20 bp, Homo sapiens
cccctctggtcgctcctgcc

SEQ ID NO: 1359114 - DNA, 20 bp, Homo sapiens
cccctgccaccaggccacct

SEQ ID NO: 1359115 - DNA, 16 bp, Homo sapiens
cccctgcttcagtccc

SEQ ID NO: 1359116 - DNA, 16 bp, Homo sapiens
cccctgggcttggcct

SEQ ID NO: 1359117 - DNA, 20 bp, Homo sapiens
cccctgggcttggcctgctg

SEQ ID NO: 1359118 - DNA, 23 bp, Homo sapiens
cccctgtctccttattcggcagc

SEQ ID NO: 1359119 - DNA, 15 bp, Homo sapiens
cccgcagacaccttg

SEQ ID NO: 1359120 - DNA, 16 bp, Homo sapiens
cccgcagacaccttgg

SEQ ID NO: 1359121 - DNA, 16 bp, Homo sapiens
cccgcagccctggcag

SEQ ID NO: 1359122 - DNA, 16 bp, Homo sapiens
cccgccgatagaggga

SEQ ID NO: 1359123 - DNA, 15 bp, Homo sapiens
cccgcctggccagga

SEQ ID NO: 1359124 - DNA, 17 bp, Homo sapiens
cccgcctggccaggagc

SEQ ID NO: 1359125 - DNA, 14 bp, Homo sapiens
cccggagctggagg

SEQ ID NO: 1359126 - DNA, 21 bp, Homo sapiens
cccggaggccgaggccatgtg

SEQ ID NO: 1359127 - DNA, 23 bp, Homo sapiens
cccggcatgagactcagtgcaga

SEQ ID NO: 1359128 - DNA, 15 bp, Homo sapiens
cccggggaccctgtg

SEQ ID NO: 1359129 - DNA, 17 bp, Homo sapiens
cccggggaccctgtgac

SEQ ID NO: 1359130 - DNA, 19 bp, Homo sapiens
ttttagtatttatttatgt

SEQ ID NO: 1359131 - DNA, 12 bp, Homo sapiens
ttttataaagca

SEQ ID NO: 1359132 - DNA, 14 bp, Homo sapiens
ttttatatttcctt

SEQ ID NO: 1359133 - DNA, 21 bp, Homo sapiens
ttttatatttcctttatgtga

SEQ ID NO: 1359134 - DNA, 23 bp, Homo sapiens
ttttatcgtttttgtattttcat

SEQ ID NO: 1359135 - DNA, 20 bp, Homo sapiens
ttttatgatgacgtacaagt

SEQ ID NO: 1359136 - DNA, 19 bp, Homo sapiens
ttttattaaaatatttcag

SEQ ID NO: 1359137 - DNA, 12 bp, Homo sapiens
ttttattaatca

SEQ ID NO: 1359138 - DNA, 21 bp, Homo sapiens
ttttattaatcactgtgtata

SEQ ID NO: 1359139 - DNA, 23 bp, Homo sapiens
ttttattaatcactgtgtatatt

SEQ ID NO: 1359140 - DNA, 11 bp, Homo sapiens
ttttattaatg

SEQ ID NO: 1359141 - DNA, 10 bp, Homo sapiens
ttttattgtt

SEQ ID NO: 1359142 - DNA, 17 bp, Homo sapiens
ttttatttagggaacat

SEQ ID NO: 1359143 - DNA, 21 bp, Homo sapiens
ttttatttctactgtcaaatg

SEQ ID NO: 1359144 - DNA, 14 bp, Homo sapiens
ttttcaaaagaaag

SEQ ID NO: 1359145 - DNA, 20 bp, Homo sapiens
ttttcaaaatccaaaaagaa

SEQ ID NO: 1359146 - DNA, 23 bp, Homo sapiens
ttttcaatatattgaacttttgt

SEQ ID NO: 1359147 - DNA, 14 bp, Homo sapiens
ttttcacttatgaa

SEQ ID NO: 1359148 - DNA, 17 bp, Homo sapiens
ttttcctaaagagagta

SEQ ID NO: 1359149 - DNA, 15 bp, Homo sapiens
ttttctaagagaagt

SEQ ID NO: 1359150 - DNA, 12 bp, Homo sapiens
ttttctgcttta

SEQ ID NO: 1359151 - DNA, 13 bp, Homo sapiens
ttttgacactgaa

SEQ ID NO: 1359152 - DNA, 12 bp, Homo sapiens
ttttgattatgt

SEQ ID NO: 1359153 - DNA, 22 bp, Homo sapiens
ttttgattattttttttttctt

SEQ ID NO: 1359154 - DNA, 21 bp, Homo sapiens
ttttgcaaccaggaacagcaa

SEQ ID NO: 1359155 - DNA, 17 bp, Homo sapiens
ttttggacttcaaagca

SEQ ID NO: 1359156 - DNA, 19 bp, Homo sapiens
ttttggcaaaactctactt

SEQ ID NO: 1359157 - DNA, 22 bp, Homo sapiens
ttttggcaatgactcaaagtct

SEQ ID NO: 1359158 - DNA, 16 bp, Homo sapiens
ttttggggagccagaa

SEQ ID NO: 1359159 - DNA, 14 bp, Homo sapiens
ttttgtaaagtttc

SEQ ID NO: 1359160 - DNA, 15 bp, Homo sapiens
ttttgtactgaattt

SEQ ID NO: 1359161 - DNA, 14 bp, Homo sapiens
ttttgtatattggt

SEQ ID NO: 1359162 - DNA, 14 bp, Homo sapiens
ttttgtatgttaaa

SEQ ID NO: 1359163 - DNA, 14 bp, Homo sapiens
ttttgtgtgaaatt

SEQ ID NO: 1359164 - DNA, 18 bp, Homo sapiens
ttttgtttggagacgttt

SEQ ID NO: 1359165 - DNA, 18 bp, Homo sapiens
ttttgtttttctgcttta

SEQ ID NO: 1359166 - DNA, 16 bp, Homo sapiens
tttttaaatattttct

SEQ ID NO: 1359167 - DNA, 15 bp, Homo sapiens
tttttaagatagtgt

SEQ ID NO: 1359168 - DNA, 16 bp, Homo sapiens
tttttaagcttcagtt

SEQ ID NO: 1359169 - DNA, 13 bp, Homo sapiens
tttttaattgtat

SEQ ID NO: 1359170 - DNA, 11 bp, Homo sapiens
tttttactgtg

SEQ ID NO: 1359171 - DNA, 22 bp, Homo sapiens
tttttagaataagaatttgcat

SEQ ID NO: 1359172 - DNA, 23 bp, Homo sapiens
tttttagaataagaatttgcata

SEQ ID NO: 1359173 - DNA, 21 bp, Homo sapiens
tttttatatcatgcaaaatat

SEQ ID NO: 1359174 - DNA, 15 bp, Homo sapiens
tttttattaatcact

SEQ ID NO: 1359175 - DNA, 13 bp, Homo sapiens
tttttatttaaat

SEQ ID NO: 1359176 - DNA, 21 bp, Homo sapiens
tttttatttatatgtatgtgt

SEQ ID NO: 1359177 - DNA, 16 bp, Homo sapiens
tttttatttctactgt

SEQ ID NO: 1359178 - DNA, 19 bp, Homo sapiens
tttttcaagttgtaaataa

SEQ ID NO: 1359179 - DNA, 21 bp, Homo sapiens
tttttcaagttgtaaataatt

SEQ ID NO: 1359180 - DNA, 20 bp, Homo sapiens
tttttcaatatattgaactt

SEQ ID NO: 1359181 - DNA, 19 bp, Homo sapiens
tttttcactctaagtcatg

SEQ ID NO: 1359182 - DNA, 13 bp, Homo sapiens
tttttctgcttta

SEQ ID NO: 1359183 - DNA, 20 bp, Homo sapiens
tttttctgctttagacttga

SEQ ID NO: 1359184 - DNA, 13 bp, Homo sapiens
tttttgacactga

SEQ ID NO: 1359185 - DNA, 15 bp, Homo sapiens
tttttgacactgaaa

SEQ ID NO: 1359186 - DNA, 22 bp, Homo sapiens
tttttgacactgaaagttttgt

SEQ ID NO: 1359187 - DNA, 22 bp, Homo sapiens
tttttgtaataagcaatcaagg

SEQ ID NO: 1359188 - DNA, 16 bp, Homo sapiens
tttttgttattaaaca

SEQ ID NO: 1359189 - DNA, 14 bp, Homo sapiens
tttttgtttttctg

SEQ ID NO: 1359190 - DNA, 12 bp, Homo sapiens
ttttttaaagaa

SEQ ID NO: 1359191 - DNA, 12 bp, Homo sapiens
ttttttaagctt

SEQ ID NO: 1359192 - DNA, 11 bp, Homo sapiens
ttttttattat

SEQ ID NO: 1359193 - DNA, 17 bp, Homo sapiens
ttttttatttctactgt

SEQ ID NO: 1359194 - DNA, 13 bp, Homo sapiens
ttttttgtaataa

SEQ ID NO: 1359195 - DNA, 14 bp, Homo sapiens
tttttttgttatta

SEQ ID NO: 1359196 - DNA, 21 bp, Homo sapiens
tttcccatttgtgccagagga

SEQ ID NO: 1359197 - DNA, 11 bp, Homo sapiens
tttcctcagtg

SEQ ID NO: 1359198 - DNA, 17 bp, Homo sapiens
tttcctctctatatttc

SEQ ID NO: 1359199 - DNA, 15 bp, Homo sapiens
tttcctttatgtgaa

SEQ ID NO: 1359200 - DNA, 16 bp, Homo sapiens
tttcgaagtcattaaa

SEQ ID NO: 1359201 - DNA, 13 bp, Homo sapiens
tttcgtggggagg

SEQ ID NO: 1359202 - DNA, 11 bp, Homo sapiens
tttctaagaga

SEQ ID NO: 1359203 - DNA, 13 bp, Homo sapiens
tttctaagagaag

SEQ ID NO: 1359204 - DNA, 19 bp, Homo sapiens
tttctacagtggttttata

SEQ ID NO: 1359205 - DNA, 19 bp, Homo sapiens
tttctagaattatttttca

SEQ ID NO: 1359206 - DNA, 15 bp, Homo sapiens
tttctctgaaagtgt

SEQ ID NO: 1359207 - DNA, 22 bp, Homo sapiens
tttctctgcatttaaaaaaatc

SEQ ID NO: 1359208 - DNA, 15 bp, Homo sapiens
tttctctgtactttt

SEQ ID NO: 1359209 - DNA, 15 bp, Homo sapiens
tttctcttgagctgg

SEQ ID NO: 1359210 - DNA, 18 bp, Homo sapiens
tttctcttgagctggcct

SEQ ID NO: 1359211 - DNA, 15 bp, Homo sapiens
tttctctttgattat

SEQ ID NO: 1359212 - DNA, 17 bp, Homo sapiens
tttctgatttgctgctc

SEQ ID NO: 1359213 - DNA, 14 bp, Homo sapiens
tttctgccctggct

SEQ ID NO: 1359214 - DNA, 14 bp, Homo sapiens
tttctgcctggagt

SEQ ID NO: 1359215 - DNA, 22 bp, Homo sapiens
tttctgcctggagtgtatgact

SEQ ID NO: 1359216 - DNA, 19 bp, Homo sapiens
tttctgctttagacttgaa

SEQ ID NO: 1359217 - DNA, 12 bp, Homo sapiens
tttctggcaccg

SEQ ID NO: 1359218 - DNA, 14 bp, Homo sapiens
tttctggggcctag

SEQ ID NO: 1359219 - DNA, 17 bp, Homo sapiens
tttctggtggtctgttg

SEQ ID NO: 1359220 - DNA, 15 bp, Homo sapiens
tttctgtgtgtcagt

SEQ ID NO: 1359221 - DNA, 22 bp, Homo sapiens
tttctgtgtgtcagttttcata

SEQ ID NO: 1359222 - DNA, 12 bp, Homo sapiens
tttctgttttct

SEQ ID NO: 1359223 - DNA, 13 bp, Homo sapiens
tttcttatgtgac

SEQ ID NO: 1359224 - DNA, 16 bp, Homo sapiens
tttcttatgtgacatt

SEQ ID NO: 1359225 - DNA, 15 bp, Homo sapiens
tttcttctctgtgag

SEQ ID NO: 1359226 - DNA, 18 bp, Homo sapiens
tttctttaggagatttat

SEQ ID NO: 1359227 - DNA, 14 bp, Homo sapiens
tttctttttttcct

SEQ ID NO: 1359228 - DNA, 13 bp, Homo sapiens
tttgaaaaatata

SEQ ID NO: 1359229 - DNA, 12 bp, Homo sapiens
tttgaaaagtaa

SEQ ID NO: 1359230 - DNA, 18 bp, Homo sapiens
tttgaaaatagtttattt

SEQ ID NO: 1359231 - DNA, 14 bp, Homo sapiens
tttgaaagtgcctt

SEQ ID NO: 1359232 - DNA, 18 bp, Homo sapiens
tttgaaagtgcctttgca

SEQ ID NO: 1359233 - DNA, 21 bp, Homo sapiens
tttgaaagtgcctttgcagct

SEQ ID NO: 1359234 - DNA, 22 bp, Homo sapiens
tttgaaattgttccttggagaa

SEQ ID NO: 1359235 - DNA, 13 bp, Homo sapiens
tttgaataaatgt

SEQ ID NO: 1359236 - DNA, 14 bp, Homo sapiens
tttgaatatgtagt

SEQ ID NO: 1359237 - DNA, 22 bp, Homo sapiens
tttgaattatccacatgaaaat

SEQ ID NO: 1359238 - DNA, 17 bp, Homo sapiens
tttgaattttaaatcta

SEQ ID NO: 1359239 - DNA, 17 bp, Homo sapiens
tttgacactgaaagttt

SEQ ID NO: 1359240 - DNA, 19 bp, Homo sapiens
tttgacactgaaagttttg

SEQ ID NO: 1359241 - DNA, 16 bp, Homo sapiens
tttgactaattttaca

SEQ ID NO: 1359242 - DNA, 13 bp, Homo sapiens
tttgagacaggag

SEQ ID NO: 1359243 - DNA, 12 bp, Homo sapiens
tttgagctgcct

SEQ ID NO: 1359244 - DNA, 22 bp, Homo sapiens
tttgaggattagtttagaacag

SEQ ID NO: 1359245 - DNA, 21 bp, Homo sapiens
tttgatacagttttcagaaaa

SEQ ID NO: 1359246 - DNA, 16 bp, Homo sapiens
tttgatgcatgtcttt

SEQ ID NO: 1359247 - DNA, 16 bp, Homo sapiens
tttgatgtcagcagtt

SEQ ID NO: 1359248 - DNA, 20 bp, Homo sapiens
tttgatgtcagcagttgctg

SEQ ID NO: 1359249 - DNA, 21 bp, Homo sapiens
tttgatgtcagcagttgctgg

SEQ ID NO: 1359250 - DNA, 20 bp, Homo sapiens
tttgattatttgcatgttat

SEQ ID NO: 1359251 - DNA, 22 bp, Homo sapiens
tttgattatttgcatgttatgt

SEQ ID NO: 1359252 - DNA, 14 bp, Homo sapiens
tttgcaagtgctgg

SEQ ID NO: 1359253 - DNA, 15 bp, Homo sapiens
tttgcaataacagct

SEQ ID NO: 1359254 - DNA, 19 bp, Homo sapiens
tttgcaataacagctgcaa

SEQ ID NO: 1359255 - DNA, 20 bp, Homo sapiens
tttgcatgcatgcaaatgag

SEQ ID NO: 1359256 - DNA, 15 bp, Homo sapiens
tttgcatgttatgtt

SEQ ID NO: 1359257 - DNA, 17 bp, Homo sapiens
tttgcatgttatgttta

SEQ ID NO: 1359258 - DNA, 18 bp, Homo sapiens
tttgcatgttatgtttaa

SEQ ID NO: 1359259 - DNA, 17 bp, Homo sapiens
tttgccattgtgaacca

SEQ ID NO: 1359260 - DNA, 21 bp, Homo sapiens
tttgctactgttgtaagaatt

SEQ ID NO: 1359261 - DNA, 21 bp, Homo sapiens
tttgctcttcagatgccactt

SEQ ID NO: 1359262 - DNA, 13 bp, Homo sapiens
tttgctgctcttc

SEQ ID NO: 1359263 - DNA, 12 bp, Homo sapiens
tttgcttagaaa

SEQ ID NO: 1359264 - DNA, 15 bp, Homo sapiens
tttggattctaaata

SEQ ID NO: 1359265 - DNA, 18 bp, Homo sapiens
tttggattctaaatacat

SEQ ID NO: 1359266 - DNA, 19 bp, Homo sapiens
tttggattctaaatacatg

SEQ ID NO: 1359267 - DNA, 20 bp, Homo sapiens
tttggctgaaattctcctgg

SEQ ID NO: 1359268 - DNA, 15 bp, Homo sapiens
tttgggagtttttat

SEQ ID NO: 1359269 - DNA, 16 bp, Homo sapiens
tttggggtctttgtgg

SEQ ID NO: 1359270 - DNA, 13 bp, Homo sapiens
tttggtaaatgtt

SEQ ID NO: 1359271 - DNA, 14 bp, Homo sapiens
tttgtaaaaatctt

SEQ ID NO: 1359272 - DNA, 14 bp, Homo sapiens
tttgtaaacattta

SEQ ID NO: 1359273 - DNA, 18 bp, Homo sapiens
tttgtaaattatttatgt

SEQ ID NO: 1359274 - DNA, 16 bp, Homo sapiens
tttgtaaatttagtgt

SEQ ID NO: 1359275 - DNA, 20 bp, Homo sapiens
tttgtacgacgtcagatgtt

SEQ ID NO: 1359276 - DNA, 19 bp, Homo sapiens
tttgtatagttatgtaaat

SEQ ID NO: 1359277 - DNA, 15 bp, Homo sapiens
tttgtatgaaaacat

SEQ ID NO: 1359278 - DNA, 16 bp, Homo sapiens
tttgtatgttaaagag

SEQ ID NO: 1359279 - DNA, 13 bp, Homo sapiens
tttgtattgtcct

SEQ ID NO: 1359280 - DNA, 22 bp, Homo sapiens
tttgtattgtcctattagtgtt

SEQ ID NO: 1359281 - DNA, 15 bp, Homo sapiens
tttgtattttcatga

SEQ ID NO: 1359282 - DNA, 21 bp, Homo sapiens
tttgtattttcatgaaaatac

SEQ ID NO: 1359283 - DNA, 11 bp, Homo sapiens
tttgtcaatga

SEQ ID NO: 1359284 - DNA, 13 bp, Homo sapiens
tttgtcttaaaaa

SEQ ID NO: 1359285 - DNA, 14 bp, Homo sapiens
tttgtgctagaaat

SEQ ID NO: 1359286 - DNA, 21 bp, Homo sapiens
tttgtgctagaaattttcaag

SEQ ID NO: 1359287 - DNA, 16 bp, Homo sapiens
tttgtgtaatgaaaat

SEQ ID NO: 1359288 - DNA, 17 bp, Homo sapiens
tttgtgtgttgtctctt

SEQ ID NO: 1359289 - DNA, 22 bp, Homo sapiens
tttgttaaaattatcaatatct

SEQ ID NO: 1359290 - DNA, 15 bp, Homo sapiens
tttgttgtaaaacaa

SEQ ID NO: 1359291 - DNA, 16 bp, Homo sapiens
tttgttgtcagctgaa

SEQ ID NO: 1359292 - DNA, 15 bp, Homo sapiens
tttgttttttaaaaa

SEQ ID NO: 1359293 - DNA, 18 bp, Homo sapiens
ttttaaaaaatattttct

SEQ ID NO: 1359294 - DNA, 17 bp, Homo sapiens
ttttaaaactggacctg

SEQ ID NO: 1359295 - DNA, 20 bp, Homo sapiens
ttttaaaactggacctgtat

SEQ ID NO: 1359296 - DNA, 14 bp, Homo sapiens
ttttaaaatagaaa

SEQ ID NO: 1359297 - DNA, 16 bp, Homo sapiens
ttttaaaatagaaatt

SEQ ID NO: 1359298 - DNA, 21 bp, Homo sapiens
ttttaaaatagaaattttgta

SEQ ID NO: 1359299 - DNA, 20 bp, Homo sapiens
ttttaaaatctgagggaaat

SEQ ID NO: 1359300 - DNA, 16 bp, Homo sapiens
ttttaaaatgcaatgt

SEQ ID NO: 1359301 - DNA, 13 bp, Homo sapiens
ttttaaagtgcaa

SEQ ID NO: 1359302 - DNA, 14 bp, Homo sapiens
ttttaaatctaaat

SEQ ID NO: 1359303 - DNA, 22 bp, Homo sapiens
ttttaaccggtaagagtttcag

SEQ ID NO: 1359304 - DNA, 16 bp, Homo sapiens
ttttaaggactgactg

SEQ ID NO: 1359305 - DNA, 22 bp, Homo sapiens
ttttaaggactgactgaggcag

SEQ ID NO: 1359306 - DNA, 13 bp, Homo sapiens
ttttaaggtcttt

SEQ ID NO: 1359307 - DNA, 17 bp, Homo sapiens
ttttaaggtctttcagt

SEQ ID NO: 1359308 - DNA, 17 bp, Homo sapiens
gaaaaatataaaattat

SEQ ID NO: 1359309 - DNA, 20 bp, Homo sapiens
gaaaacaatggagtattctc

SEQ ID NO: 1359310 - DNA, 17 bp, Homo sapiens
gaaaagagacaggcagg

SEQ ID NO: 1359311 - DNA, 21 bp, Homo sapiens
gaaaagatggtatcatatatt

SEQ ID NO: 1359312 - DNA, 14 bp, Homo sapiens
gaaaagtaatattt

SEQ ID NO: 1359313 - DNA, 16 bp, Homo sapiens
gaaaagtaatatttat

SEQ ID NO: 1359314 - DNA, 17 bp, Homo sapiens
gaaaagtaatatttatt

SEQ ID NO: 1359315 - DNA, 19 bp, Homo sapiens
gaaaagtaatatttattaa

SEQ ID NO: 1359316 - DNA, 13 bp, Homo sapiens
gaaaataaagcta

SEQ ID NO: 1359317 - DNA, 19 bp, Homo sapiens
gaaaatacaacttaaataa

SEQ ID NO: 1359318 - DNA, 14 bp, Homo sapiens
gaaaatagtttatt

SEQ ID NO: 1359319 - DNA, 19 bp, Homo sapiens
gaaaatagtttattttaaa

SEQ ID NO: 1359320 - DNA, 23 bp, Homo sapiens
gaaaatagtttattttaaaacaa

SEQ ID NO: 1359321 - DNA, 15 bp, Homo sapiens
gaaaatattgtttta

SEQ ID NO: 1359322 - DNA, 14 bp, Homo sapiens
gaaaatcagcctgc

SEQ ID NO: 1359323 - DNA, 14 bp, Homo sapiens
gaaaatgaaatgca

SEQ ID NO: 1359324 - DNA, 17 bp, Homo sapiens
gaaaatgaaatgcatat

SEQ ID NO: 1359325 - DNA, 18 bp, Homo sapiens
gaaaatgtgaccctccaa

SEQ ID NO: 1359326 - DNA, 20 bp, Homo sapiens
gaaaatgtgaccctccaaat

SEQ ID NO: 1359327 - DNA, 14 bp, Homo sapiens
gaaaattgtttagt

SEQ ID NO: 1359328 - DNA, 16 bp, Homo sapiens
gaaacactgccttttt

SEQ ID NO: 1359329 - DNA, 16 bp, Homo sapiens
gaaacctgggattcag

SEQ ID NO: 1359330 - DNA, 22 bp, Homo sapiens
gaaactaaagcaatagaaacaa

SEQ ID NO: 1359331 - DNA, 15 bp, Homo sapiens
gaaactagtgtacat

SEQ ID NO: 1359332 - DNA, 19 bp, Homo sapiens
gaaacttaaatgttattat

SEQ ID NO: 1359333 - DNA, 21 bp, Homo sapiens
gaaacttaaatgttattatct

SEQ ID NO: 1359334 - DNA, 12 bp, Homo sapiens
gaaacttggctc

SEQ ID NO: 1359335 - DNA, 14 bp, Homo sapiens
gaaagacactgcct

SEQ ID NO: 1359336 - DNA, 15 bp, Homo sapiens
gaaagacactgcctg

SEQ ID NO: 1359337 - DNA, 18 bp, Homo sapiens
gaaagacactgcctgggc

SEQ ID NO: 1359338 - DNA, 20 bp, Homo sapiens
gaaagacactgcctgggctg

SEQ ID NO: 1359339 - DNA, 13 bp, Homo sapiens
gaaagaggaagca

SEQ ID NO: 1359340 - DNA, 16 bp, Homo sapiens
gaaagaggcaccagga

SEQ ID NO: 1359341 - DNA, 20 bp, Homo sapiens
gaaagaggcaccaggaagcc

SEQ ID NO: 1359342 - DNA, 21 bp, Homo sapiens
gaaagaggcaccaggaagccg

SEQ ID NO: 1359343 - DNA, 17 bp, Homo sapiens
gaaagcaacaaagaaat

SEQ ID NO: 1359344 - DNA, 14 bp, Homo sapiens
gaaagcaataaatg

SEQ ID NO: 1359345 - DNA, 22 bp, Homo sapiens
gaaagcagagttttcattaaat

SEQ ID NO: 1359346 - DNA, 23 bp, Homo sapiens
gaaagctttgaatactaaattat

SEQ ID NO: 1359347 - DNA, 18 bp, Homo sapiens
gaaaggggagagcctgct

SEQ ID NO: 1359348 - DNA, 21 bp, Homo sapiens
gaaaggggagagcctgctggc

SEQ ID NO: 1359349 - DNA, 17 bp, Homo sapiens
gaaaggggtcggctgac

SEQ ID NO: 1359350 - DNA, 20 bp, Homo sapiens
gaaagtgcatttttgtaaat

SEQ ID NO: 1359351 - DNA, 15 bp, Homo sapiens
gaaagtgcctttgca

SEQ ID NO: 1359352 - DNA, 22 bp, Homo sapiens
gaaagtgggcttaatggagttc

SEQ ID NO: 1359353 - DNA, 19 bp, Homo sapiens
gaaagtgtataataagaaa

SEQ ID NO: 1359354 - DNA, 20 bp, Homo sapiens
gaaagtttcgttatattaaa

SEQ ID NO: 1359355 - DNA, 17 bp, Homo sapiens
gaaagttttgtaaaaga

SEQ ID NO: 1359356 - DNA, 18 bp, Homo sapiens
gaaagtttttttttatta

SEQ ID NO: 1359357 - DNA, 19 bp, Homo sapiens
gaaataaaccaaaggaaaa

SEQ ID NO: 1359358 - DNA, 14 bp, Homo sapiens
gaaataatgctaca

SEQ ID NO: 1359359 - DNA, 18 bp, Homo sapiens
gaaatataacacattttt

SEQ ID NO: 1359360 - DNA, 19 bp, Homo sapiens
gaaatatatacaaaaagaa

SEQ ID NO: 1359361 - DNA, 14 bp, Homo sapiens
gaaatcaaagtgct

SEQ ID NO: 1359362 - DNA, 14 bp, Homo sapiens
gaaatcagccaagt

SEQ ID NO: 1359363 - DNA, 17 bp, Homo sapiens
gaaatcatgtccataca

SEQ ID NO: 1359364 - DNA, 11 bp, Homo sapiens
gaaatgatgtt

SEQ ID NO: 1359365 - DNA, 15 bp, Homo sapiens
gaaatggaaagcaga

SEQ ID NO: 1359366 - DNA, 16 bp, Homo sapiens
gaaatggaaagcagag

SEQ ID NO: 1359367 - DNA, 18 bp, Homo sapiens
gaaatgtaggtcctcaga

SEQ ID NO: 1359368 - DNA, 19 bp, Homo sapiens
gaaatgtgaatttttattg

SEQ ID NO: 1359369 - DNA, 14 bp, Homo sapiens
gaaattctcctgga

SEQ ID NO: 1359370 - DNA, 15 bp, Homo sapiens
gaaattctcctggag

SEQ ID NO: 1359371 - DNA, 17 bp, Homo sapiens
gaaattctcctggaggt

SEQ ID NO: 1359372 - DNA, 13 bp, Homo sapiens
gaaattgtatatt

SEQ ID NO: 1359373 - DNA, 15 bp, Homo sapiens
gaaattttgtaagaa

SEQ ID NO: 1359374 - DNA, 18 bp, Homo sapiens
gaacaagcttcagtaagt

SEQ ID NO: 1359375 - DNA, 16 bp, Homo sapiens
gaacaatattttatgg

SEQ ID NO: 1359376 - DNA, 19 bp, Homo sapiens
gaacactaactcaccagcc

SEQ ID NO: 1359377 - DNA, 20 bp, Homo sapiens
gaacagagagacccttgtgg

SEQ ID NO: 1359378 - DNA, 13 bp, Homo sapiens
gaacatacaaatg

SEQ ID NO: 1359379 - DNA, 22 bp, Homo sapiens
gaacatacaaatgcatctttga

SEQ ID NO: 1359380 - DNA, 16 bp, Homo sapiens
gaacatactgttcact

SEQ ID NO: 1359381 - DNA, 17 bp, Homo sapiens
gaacatccaaccttccc

SEQ ID NO: 1359382 - DNA, 19 bp, Homo sapiens
gaacatctaacccactaga

SEQ ID NO: 1359383 - DNA, 14 bp, Homo sapiens
gaacatgaatcaaa

SEQ ID NO: 1359384 - DNA, 13 bp, Homo sapiens
gaacatgccccct

SEQ ID NO: 1359385 - DNA, 18 bp, Homo sapiens
gaacatggtttgactcat

SEQ ID NO: 1359386 - DNA, 19 bp, Homo sapiens
gaaccataaaatgtccagt

SEQ ID NO: 1359387 - DNA, 18 bp, Homo sapiens
gaaccatggtgaagtgct

SEQ ID NO: 1359388 - DNA, 20 bp, Homo sapiens
gaacccgggagcggaggttg

SEQ ID NO: 1359389 - DNA, 18 bp, Homo sapiens
gaacccttttaaagttga

SEQ ID NO: 1359390 - DNA, 15 bp, Homo sapiens
gaaccgcacagctca

SEQ ID NO: 1359391 - DNA, 22 bp, Homo sapiens
gaacctccccagcctgcgcctg

SEQ ID NO: 1359392 - DNA, 16 bp, Homo sapiens
gaaccttggcctgggc

SEQ ID NO: 1359393 - DNA, 19 bp, Homo sapiens
gaacgttttttcctcagtg

SEQ ID NO: 1359394 - DNA, 14 bp, Homo sapiens
gaactccaggccct

SEQ ID NO: 1359395 - DNA, 17 bp, Homo sapiens
gaactcgcgctcagtaa

SEQ ID NO: 1359396 - DNA, 19 bp, Homo sapiens
gaactcgcgctcagtaaac

SEQ ID NO: 1359397 - DNA, 17 bp, Homo sapiens
gaactcttctcattact

SEQ ID NO: 1359398 - DNA, 17 bp, Homo sapiens
gaactgcaggccctggc

SEQ ID NO: 1359399 - DNA, 15 bp, Homo sapiens
tgcaagatgtgaatt

SEQ ID NO: 1359400 - DNA, 15 bp, Homo sapiens
tgcaagcagaggacc

SEQ ID NO: 1359401 - DNA, 17 bp, Homo sapiens
tgcaagcagaggaccag

SEQ ID NO: 1359402 - DNA, 22 bp, Homo sapiens
tgcaagcagaggaccagggcct

SEQ ID NO: 1359403 - DNA, 12 bp, Homo sapiens
tgcaagtgctgg

SEQ ID NO: 1359404 - DNA, 24 bp, Homo sapiens
tgcaataaaaatgatactgatggt

SEQ ID NO: 1359405 - DNA, 16 bp, Homo sapiens
tgcaataaaatttaaa

SEQ ID NO: 1359406 - DNA, 15 bp, Homo sapiens
tgcaataacagctgc

SEQ ID NO: 1359407 - DNA, 16 bp, Homo sapiens
tgcaataacagctgca

SEQ ID NO: 1359408 - DNA, 15 bp, Homo sapiens
tgcacaagctgcacc

SEQ ID NO: 1359409 - DNA, 18 bp, Homo sapiens
tgcacatgtttcctctag

SEQ ID NO: 1359410 - DNA, 15 bp, Homo sapiens
tgcaccaccaagcca

SEQ ID NO: 1359411 - DNA, 18 bp, Homo sapiens
tgcaccaccaagccaagg

SEQ ID NO: 1359412 - DNA, 14 bp, Homo sapiens
tgcaccactgcact

SEQ ID NO: 1359413 - DNA, 15 bp, Homo sapiens
tgcaccactgcactc

SEQ ID NO: 1359414 - DNA, 17 bp, Homo sapiens
tgcacccacccaggagt

SEQ ID NO: 1359415 - DNA, 13 bp, Homo sapiens
tgcacccagaaca

SEQ ID NO: 1359416 - DNA, 23 bp, Homo sapiens
tgcacggtttcgaagtcattaaa

SEQ ID NO: 1359417 - DNA, 15 bp, Homo sapiens
tgcactccagcctgg

SEQ ID NO: 1359418 - DNA, 16 bp, Homo sapiens
tgcactccagcctggg

SEQ ID NO: 1359419 - DNA, 12 bp, Homo sapiens
tgcactcctcag

SEQ ID NO: 1359420 - DNA, 12 bp, Homo sapiens
tgcactgtttaa

SEQ ID NO: 1359421 - DNA, 20 bp, Homo sapiens
tgcacttaagttagcctcca

SEQ ID NO: 1359422 - DNA, 15 bp, Homo sapiens
tgcacttacttgctt

SEQ ID NO: 1359423 - DNA, 17 bp, Homo sapiens
tgcacttgtgattattt

SEQ ID NO: 1359424 - DNA, 15 bp, Homo sapiens
tgcagaactgtagct

SEQ ID NO: 1359425 - DNA, 19 bp, Homo sapiens
tgcagaatgtaagtgggcc

SEQ ID NO: 1359426 - DNA, 21 bp, Homo sapiens
tgcagaatgtaagtgggccca

SEQ ID NO: 1359427 - DNA, 20 bp, Homo sapiens
tgcagagatttctcattgac

SEQ ID NO: 1359428 - DNA, 17 bp, Homo sapiens
tgcagagcagtaaggga

SEQ ID NO: 1359429 - DNA, 19 bp, Homo sapiens
tgcagagccttctcagaag

SEQ ID NO: 1359430 - DNA, 22 bp, Homo sapiens
tgcagagccttctcagaagcac

SEQ ID NO: 1359431 - DNA, 17 bp, Homo sapiens
tgcagaggtaccctggg

SEQ ID NO: 1359432 - DNA, 17 bp, Homo sapiens
tgcagatgttagatatt

SEQ ID NO: 1359433 - DNA, 21 bp, Homo sapiens
tgcagcaccgaggggcctttg

SEQ ID NO: 1359434 - DNA, 14 bp, Homo sapiens
tgcagctttgcaaa

SEQ ID NO: 1359435 - DNA, 18 bp, Homo sapiens
tgcaggacctcaggtgag

SEQ ID NO: 1359436 - DNA, 13 bp, Homo sapiens
tgcaggacttgag

SEQ ID NO: 1359437 - DNA, 12 bp, Homo sapiens
tgcaggccctgg

SEQ ID NO: 1359438 - DNA, 14 bp, Homo sapiens
tgcagtcactggag

SEQ ID NO: 1359439 - DNA, 22 bp, Homo sapiens
tgcagtcttagatcatagtttt

SEQ ID NO: 1359440 - DNA, 14 bp, Homo sapiens
tgcagtgagccgag

SEQ ID NO: 1359441 - DNA, 10 bp, Homo sapiens
tgcagtttat

SEQ ID NO: 1359442 - DNA, 22 bp, Homo sapiens
tgcatactttgtattttgatta

SEQ ID NO: 1359443 - DNA, 15 bp, Homo sapiens
tgcatagtttcttta

SEQ ID NO: 1359444 - DNA, 13 bp, Homo sapiens
tgcatattataaa

SEQ ID NO: 1359445 - DNA, 20 bp, Homo sapiens
tgcatattataaaggataaa

SEQ ID NO: 1359446 - DNA, 21 bp, Homo sapiens
tgcatccagcctggggctgag

SEQ ID NO: 1359447 - DNA, 14 bp, Homo sapiens
tgcatccctgagac

SEQ ID NO: 1359448 - DNA, 15 bp, Homo sapiens
tgcatcgtttcatct

SEQ ID NO: 1359449 - DNA, 17 bp, Homo sapiens
tgcatcgtttcatcttc

SEQ ID NO: 1359450 - DNA, 18 bp, Homo sapiens
tgcatgcatgcaaatgag

SEQ ID NO: 1359451 - DNA, 15 bp, Homo sapiens
tgcatggaaatcagc

SEQ ID NO: 1359452 - DNA, 21 bp, Homo sapiens
tgcatgtagaggcttgtttac

SEQ ID NO: 1359453 - DNA, 14 bp, Homo sapiens
tgcatgtcttttaa

SEQ ID NO: 1359454 - DNA, 13 bp, Homo sapiens
tgcatgttatgtt

SEQ ID NO: 1359455 - DNA, 22 bp, Homo sapiens
tgcatgttatgtttaataagct

SEQ ID NO: 1359456 - DNA, 15 bp, Homo sapiens
tgcattcatttttat

SEQ ID NO: 1359457 - DNA, 21 bp, Homo sapiens
tgcatttagggagtattctaa

SEQ ID NO: 1359458 - DNA, 22 bp, Homo sapiens
tgcatttttgtaaatgtgtaca

SEQ ID NO: 1359459 - DNA, 19 bp, Homo sapiens
tgccaaaattcatttctaa

SEQ ID NO: 1359460 - DNA, 13 bp, Homo sapiens
tgccaagctccaa

SEQ ID NO: 1359461 - DNA, 23 bp, Homo sapiens
tgccaagtcatagccataaatga

SEQ ID NO: 1359462 - DNA, 22 bp, Homo sapiens
tgccacatcaaacctttgagta

SEQ ID NO: 1359463 - DNA, 12 bp, Homo sapiens
ttgttttacaat

SEQ ID NO: 1359464 - DNA, 16 bp, Homo sapiens
ttgttttctgactaat

SEQ ID NO: 1359465 - DNA, 14 bp, Homo sapiens
tttaaaaaaaaagt

SEQ ID NO: 1359466 - DNA, 17 bp, Homo sapiens
tttaaaaaatattttct

SEQ ID NO: 1359467 - DNA, 23 bp, Homo sapiens
tttaaaacacatgtttttataca

SEQ ID NO: 1359468 - DNA, 15 bp, Homo sapiens
tttaaaataaaatga

SEQ ID NO: 1359469 - DNA, 22 bp, Homo sapiens
tttaaaataaaatgaaaattgt

SEQ ID NO: 1359470 - DNA, 13 bp, Homo sapiens
tttaaaatagaaa

SEQ ID NO: 1359471 - DNA, 23 bp, Homo sapiens
tttaaaatagaaattttgtaaga

SEQ ID NO: 1359472 - DNA, 16 bp, Homo sapiens
tttaaaatatttatct

SEQ ID NO: 1359473 - DNA, 21 bp, Homo sapiens
tttaaaatctgagggaaatgt

SEQ ID NO: 1359474 - DNA, 12 bp, Homo sapiens
tttaaaatgtaa

SEQ ID NO: 1359475 - DNA, 21 bp, Homo sapiens
tttaaaatgtaatttaaatga

SEQ ID NO: 1359476 - DNA, 22 bp, Homo sapiens
tttaaaatgtaatttaaatgaa

SEQ ID NO: 1359477 - DNA, 15 bp, Homo sapiens
tttaaatattttcta

SEQ ID NO: 1359478 - DNA, 22 bp, Homo sapiens
tttaaatctaaatctatttatt

SEQ ID NO: 1359479 - DNA, 21 bp, Homo sapiens
tttaacagaaattgtatattg

SEQ ID NO: 1359480 - DNA, 16 bp, Homo sapiens
tttaaccttgtataaa

SEQ ID NO: 1359481 - DNA, 14 bp, Homo sapiens
tttaagatagtgta

SEQ ID NO: 1359482 - DNA, 20 bp, Homo sapiens
tttaagctgcaaatctgatg

SEQ ID NO: 1359483 - DNA, 22 bp, Homo sapiens
tttaagctgtggtcaaggctac

SEQ ID NO: 1359484 - DNA, 21 bp, Homo sapiens
tttaagcttcagttgcttgtc

SEQ ID NO: 1359485 - DNA, 17 bp, Homo sapiens
tttaagtgtctcactaa

SEQ ID NO: 1359486 - DNA, 22 bp, Homo sapiens
tttaatattgagaaagaaacta

SEQ ID NO: 1359487 - DNA, 23 bp, Homo sapiens
tttaatcatagttactgtgtaaa

SEQ ID NO: 1359488 - DNA, 12 bp, Homo sapiens
tttaatccagtt

SEQ ID NO: 1359489 - DNA, 15 bp, Homo sapiens
tttaatgctatttga

SEQ ID NO: 1359490 - DNA, 12 bp, Homo sapiens
tttaattgtaaa

SEQ ID NO: 1359491 - DNA, 15 bp, Homo sapiens
tttaattgtaaagta

SEQ ID NO: 1359492 - DNA, 21 bp, Homo sapiens
tttaattgtaaagtaaaagct

SEQ ID NO: 1359493 - DNA, 17 bp, Homo sapiens
tttaattgtatttttgt

SEQ ID NO: 1359494 - DNA, 13 bp, Homo sapiens
tttaattgtttaa

SEQ ID NO: 1359495 - DNA, 17 bp, Homo sapiens
tttacaatagttctgtg

SEQ ID NO: 1359496 - DNA, 12 bp, Homo sapiens
tttacacagaaa

SEQ ID NO: 1359497 - DNA, 13 bp, Homo sapiens
tttacagaaaaag

SEQ ID NO: 1359498 - DNA, 21 bp, Homo sapiens
tttacagctcattaaactttt

SEQ ID NO: 1359499 - DNA, 22 bp, Homo sapiens
tttacagtatctacttgcatgt

SEQ ID NO: 1359500 - DNA, 19 bp, Homo sapiens
tttacatataaaatgtaat

SEQ ID NO: 1359501 - DNA, 22 bp, Homo sapiens
tttactgcctgaataaagagcc

SEQ ID NO: 1359502 - DNA, 23 bp, Homo sapiens
tttactgtctattaatattcagg

SEQ ID NO: 1359503 - DNA, 15 bp, Homo sapiens
tttacttgttttgga

SEQ ID NO: 1359504 - DNA, 15 bp, Homo sapiens
tttagaataagaatt

SEQ ID NO: 1359505 - DNA, 19 bp, Homo sapiens
tttagaataagaatttgca

SEQ ID NO: 1359506 - DNA, 20 bp, Homo sapiens
tttagaataagaatttgcat

SEQ ID NO: 1359507 - DNA, 22 bp, Homo sapiens
tttagactcatcaatcaaataa

SEQ ID NO: 1359508 - DNA, 23 bp, Homo sapiens
tttagacttgaaaagagacaggc

SEQ ID NO: 1359509 - DNA, 15 bp, Homo sapiens
tttagggagtattct

SEQ ID NO: 1359510 - DNA, 13 bp, Homo sapiens
tttagtaatttct

SEQ ID NO: 1359511 - DNA, 18 bp, Homo sapiens
tttagtgtttttttattt

SEQ ID NO: 1359512 - DNA, 20 bp, Homo sapiens
tttagtgtttttttatttct

SEQ ID NO: 1359513 - DNA, 16 bp, Homo sapiens
tttataaaatggctgt

SEQ ID NO: 1359514 - DNA, 17 bp, Homo sapiens
tttataattgtacaaaa

SEQ ID NO: 1359515 - DNA, 12 bp, Homo sapiens
tttatacaaaat

SEQ ID NO: 1359516 - DNA, 16 bp, Homo sapiens
tttatactgaaggaaa

SEQ ID NO: 1359517 - DNA, 15 bp, Homo sapiens
tttatatcatgcaaa

SEQ ID NO: 1359518 - DNA, 12 bp, Homo sapiens
tttatatgcttt

SEQ ID NO: 1359519 - DNA, 15 bp, Homo sapiens
tttatatttccttta

SEQ ID NO: 1359520 - DNA, 18 bp, Homo sapiens
tttatccagaaaactgtg

SEQ ID NO: 1359521 - DNA, 14 bp, Homo sapiens
tttatcgtttttgt

SEQ ID NO: 1359522 - DNA, 13 bp, Homo sapiens
tttatctgattaa

SEQ ID NO: 1359523 - DNA, 14 bp, Homo sapiens
tttatctgtttcct

SEQ ID NO: 1359524 - DNA, 14 bp, Homo sapiens
tttatgagaaactt

SEQ ID NO: 1359525 - DNA, 18 bp, Homo sapiens
tttatgggcccctggcac

SEQ ID NO: 1359526 - DNA, 21 bp, Homo sapiens
tttatggttacttcttctctt

SEQ ID NO: 1359527 - DNA, 15 bp, Homo sapiens
tttatggttatgttt

SEQ ID NO: 1359528 - DNA, 19 bp, Homo sapiens
tttatggttatgtttttct

SEQ ID NO: 1359529 - DNA, 13 bp, Homo sapiens
tttatgtgaattt

SEQ ID NO: 1359530 - DNA, 15 bp, Homo sapiens
tttatgtgaattttt

SEQ ID NO: 1359531 - DNA, 18 bp, Homo sapiens
tttattaaaatatttcag

SEQ ID NO: 1359532 - DNA, 19 bp, Homo sapiens
tttattaaaatatttcagg

SEQ ID NO: 1359533 - DNA, 21 bp, Homo sapiens
tttattaaaatatttcaggtt

SEQ ID NO: 1359534 - DNA, 23 bp, Homo sapiens
tttattaaatttttttgtatgaa

SEQ ID NO: 1359535 - DNA, 13 bp, Homo sapiens
tttattaatcact

SEQ ID NO: 1359536 - DNA, 15 bp, Homo sapiens
tttattaatcactgt

SEQ ID NO: 1359537 - DNA, 12 bp, Homo sapiens
tttattaatgtt

SEQ ID NO: 1359538 - DNA, 18 bp, Homo sapiens
tttattaatgttttcaaa

SEQ ID NO: 1359539 - DNA, 23 bp, Homo sapiens
tttattaccccctccttcagaca

SEQ ID NO: 1359540 - DNA, 20 bp, Homo sapiens
tttattacttccatgaattt

SEQ ID NO: 1359541 - DNA, 23 bp, Homo sapiens
tttattgccttttaatttttaat

SEQ ID NO: 1359542 - DNA, 19 bp, Homo sapiens
tttatttaaattacaattt

SEQ ID NO: 1359543 - DNA, 19 bp, Homo sapiens
tttatttagttccttgagt

SEQ ID NO: 1359544 - DNA, 15 bp, Homo sapiens
tttatttatatgtat

SEQ ID NO: 1359545 - DNA, 14 bp, Homo sapiens
tttatttatgtact

SEQ ID NO: 1359546 - DNA, 16 bp, Homo sapiens
tttatttctactgtca

SEQ ID NO: 1359547 - DNA, 20 bp, Homo sapiens
tttatttgaacaatgaagtt

SEQ ID NO: 1359548 - DNA, 18 bp, Homo sapiens
tttattttacacagaaac

SEQ ID NO: 1359549 - DNA, 15 bp, Homo sapiens
tttattttcctaaag

SEQ ID NO: 1359550 - DNA, 13 bp, Homo sapiens
tttattttgtgta

SEQ ID NO: 1359551 - DNA, 13 bp, Homo sapiens
tttcaaaagaaag

SEQ ID NO: 1359552 - DNA, 19 bp, Homo sapiens
tttcaaaatccaaaaagaa

SEQ ID NO: 1359553 - DNA, 22 bp, Homo sapiens
tttcaaacaatcaagttgactc

SEQ ID NO: 1359554 - DNA, 21 bp, Homo sapiens
tttcaaagttttgttgtactt

SEQ ID NO: 1359555 - DNA, 21 bp, Homo sapiens
tttcaagagtctaatagtctt

SEQ ID NO: 1359556 - DNA, 22 bp, Homo sapiens
tttcaagcagtcgtgcctgtgt

SEQ ID NO: 1359557 - DNA, 23 bp, Homo sapiens
tttcaagcagtcgtgcctgtgtc

SEQ ID NO: 1359558 - DNA, 16 bp, Homo sapiens
tttcacattcttggct

SEQ ID NO: 1359559 - DNA, 14 bp, Homo sapiens
tttcacggaaactc

SEQ ID NO: 1359560 - DNA, 18 bp, Homo sapiens
tttcacggaaactcccga

SEQ ID NO: 1359561 - DNA, 22 bp, Homo sapiens
tttcagaaatataacacatttt

SEQ ID NO: 1359562 - DNA, 16 bp, Homo sapiens
tttcagaagttagttt

SEQ ID NO: 1359563 - DNA, 23 bp, Homo sapiens
tttcagaagttagtttgtatata

SEQ ID NO: 1359564 - DNA, 18 bp, Homo sapiens
tttcagggctggctcctg

SEQ ID NO: 1359565 - DNA, 19 bp, Homo sapiens
tttcagtacttttttaaat

SEQ ID NO: 1359566 - DNA, 14 bp, Homo sapiens
tttcagtttgttgg

SEQ ID NO: 1359567 - DNA, 17 bp, Homo sapiens
tttcataaacaagttcg

SEQ ID NO: 1359568 - DNA, 22 bp, Homo sapiens
tttcatctcatttaagggaaaa

SEQ ID NO: 1359569 - DNA, 17 bp, Homo sapiens
aaatgtataaatataca

SEQ ID NO: 1359570 - DNA, 19 bp, Homo sapiens
aaatgtataaatatacagt

SEQ ID NO: 1359571 - DNA, 22 bp, Homo sapiens
aaatgtccagtaagatcactgt

SEQ ID NO: 1359572 - DNA, 18 bp, Homo sapiens
aaatgtctgtaataatag

SEQ ID NO: 1359573 - DNA, 20 bp, Homo sapiens
aaatgtgaatttttattgtt

SEQ ID NO: 1359574 - DNA, 21 bp, Homo sapiens
aaatgtgaatttttattgttg

SEQ ID NO: 1359575 - DNA, 16 bp, Homo sapiens
aaatgttaaaagtttt

SEQ ID NO: 1359576 - DNA, 18 bp, Homo sapiens
aaatgttaaaagttttat

SEQ ID NO: 1359577 - DNA, 15 bp, Homo sapiens
aaatgtttcttttaa

SEQ ID NO: 1359578 - DNA, 13 bp, Homo sapiens
aaattaagcaaat

SEQ ID NO: 1359579 - DNA, 16 bp, Homo sapiens
aaattaagcaaatgtt

SEQ ID NO: 1359580 - DNA, 17 bp, Homo sapiens
aaattaagcaaatgtta

SEQ ID NO: 1359581 - DNA, 12 bp, Homo sapiens
aaattaaggtgt

SEQ ID NO: 1359582 - DNA, 23 bp, Homo sapiens
aaattaaggtgtttgaaaatagt

SEQ ID NO: 1359583 - DNA, 16 bp, Homo sapiens
aaattaatcatagtca

SEQ ID NO: 1359584 - DNA, 15 bp, Homo sapiens
aaattaattgtgtga

SEQ ID NO: 1359585 - DNA, 16 bp, Homo sapiens
aaattaattgtgtgaa

SEQ ID NO: 1359586 - DNA, 14 bp, Homo sapiens
aaattacaatttta

SEQ ID NO: 1359587 - DNA, 15 bp, Homo sapiens
aaattagccgggcgt

SEQ ID NO: 1359588 - DNA, 15 bp, Homo sapiens
aaattaggaataaat

SEQ ID NO: 1359589 - DNA, 21 bp, Homo sapiens
aaattatcttgatacattcaa

SEQ ID NO: 1359590 - DNA, 19 bp, Homo sapiens
aaattctataggaacatat

SEQ ID NO: 1359591 - DNA, 23 bp, Homo sapiens
aaattctataggaacatatgaaa

SEQ ID NO: 1359592 - DNA, 12 bp, Homo sapiens
aaattctccact

SEQ ID NO: 1359593 - DNA, 20 bp, Homo sapiens
aaattctgatttcttttcac

SEQ ID NO: 1359594 - DNA, 12 bp, Homo sapiens
aaattgcatact

SEQ ID NO: 1359595 - DNA, 14 bp, Homo sapiens
aaattgcatacttt

SEQ ID NO: 1359596 - DNA, 18 bp, Homo sapiens
aaattgctttgtattgta

SEQ ID NO: 1359597 - DNA, 16 bp, Homo sapiens
aaattgttatcaaaat

SEQ ID NO: 1359598 - DNA, 11 bp, Homo sapiens
aaatttcttat

SEQ ID NO: 1359599 - DNA, 17 bp, Homo sapiens
aaatttcttatgtgaca

SEQ ID NO: 1359600 - DNA, 17 bp, Homo sapiens
aaatttgactaatttta

SEQ ID NO: 1359601 - DNA, 18 bp, Homo sapiens
aaatttgactaattttac

SEQ ID NO: 1359602 - DNA, 15 bp, Homo sapiens
aaattttaaaaatct

SEQ ID NO: 1359603 - DNA, 21 bp, Homo sapiens
aaattttacaagggcataaag

SEQ ID NO: 1359604 - DNA, 13 bp, Homo sapiens
aaattttcagcat

SEQ ID NO: 1359605 - DNA, 21 bp, Homo sapiens
aaattttgaaaagtaatattt

SEQ ID NO: 1359606 - DNA, 21 bp, Homo sapiens
aaattttgctatcaacaataa

SEQ ID NO: 1359607 - DNA, 12 bp, Homo sapiens
aaattttgtaag

SEQ ID NO: 1359608 - DNA, 14 bp, Homo sapiens
aaattttgtaagaa

SEQ ID NO: 1359609 - DNA, 12 bp, Homo sapiens
aaattttttgac

SEQ ID NO: 1359610 - DNA, 20 bp, Homo sapiens
aaatttttttgtatgaaaac

SEQ ID NO: 1359611 - DNA, 19 bp, Homo sapiens
aaatttttttttaaagcag

SEQ ID NO: 1359612 - DNA, 11 bp, Homo sapiens
aacaaaatttg

SEQ ID NO: 1359613 - DNA, 24 bp, Homo sapiens
aacaaaatttgactaattttacat

SEQ ID NO: 1359614 - DNA, 22 bp, Homo sapiens
aacaagaccaccacttcgaaac

SEQ ID NO: 1359615 - DNA, 12 bp, Homo sapiens
aacaagcttcag

SEQ ID NO: 1359616 - DNA, 21 bp, Homo sapiens
aacaagttgagctatgactta

SEQ ID NO: 1359617 - DNA, 22 bp, Homo sapiens
aacaagttgagctatgacttaa

SEQ ID NO: 1359618 - DNA, 14 bp, Homo sapiens
aacaataaaatttt

SEQ ID NO: 1359619 - DNA, 23 bp, Homo sapiens
aacaataggatgggcttctgtgc

SEQ ID NO: 1359620 - DNA, 15 bp, Homo sapiens
aacaatggagtattc

SEQ ID NO: 1359621 - DNA, 17 bp, Homo sapiens
aacaattggtaaaactc

SEQ ID NO: 1359622 - DNA, 19 bp, Homo sapiens
aacactaactcaccagccc

SEQ ID NO: 1359623 - DNA, 23 bp, Homo sapiens
aacactagggccttggaaattcc

SEQ ID NO: 1359624 - DNA, 15 bp, Homo sapiens
aacactgccttttta

SEQ ID NO: 1359625 - DNA, 19 bp, Homo sapiens
aacagaaattgtatattgt

SEQ ID NO: 1359626 - DNA, 21 bp, Homo sapiens
aacagaaattgtatattgtaa

SEQ ID NO: 1359627 - DNA, 16 bp, Homo sapiens
aacagagtaatcttgt

SEQ ID NO: 1359628 - DNA, 20 bp, Homo sapiens
aacagcaaatgcaaaaactc

SEQ ID NO: 1359629 - DNA, 15 bp, Homo sapiens
aacaggcctctccat

SEQ ID NO: 1359630 - DNA, 20 bp, Homo sapiens
aacagtgtggcctcttctga

SEQ ID NO: 1359631 - DNA, 13 bp, Homo sapiens
aacagttgtattt

SEQ ID NO: 1359632 - DNA, 17 bp, Homo sapiens
aacagttttgtgtaact

SEQ ID NO: 1359633 - DNA, 13 bp, Homo sapiens
aacataacataaa

SEQ ID NO: 1359634 - DNA, 15 bp, Homo sapiens
aacatacaaatgcat

SEQ ID NO: 1359635 - DNA, 20 bp, Homo sapiens
aacatacaaatgcatctttg

SEQ ID NO: 1359636 - DNA, 22 bp, Homo sapiens
aacatacaaatgcatctttgat

SEQ ID NO: 1359637 - DNA, 17 bp, Homo sapiens
aacatcattccttttta

SEQ ID NO: 1359638 - DNA, 21 bp, Homo sapiens
aacatcattcctttttattta

SEQ ID NO: 1359639 - DNA, 18 bp, Homo sapiens
aacatctttaaggggagg

SEQ ID NO: 1359640 - DNA, 22 bp, Homo sapiens
aacatgccccctgcagacacgt

SEQ ID NO: 1359641 - DNA, 16 bp, Homo sapiens
aacattgaagtaatga

SEQ ID NO: 1359642 - DNA, 19 bp, Homo sapiens
aacattgaagtaatgaatt

SEQ ID NO: 1359643 - DNA, 21 bp, Homo sapiens
aaccaaatgtttattttctac

SEQ ID NO: 1359644 - DNA, 22 bp, Homo sapiens
aaccacattgaagaatgttaga

SEQ ID NO: 1359645 - DNA, 16 bp, Homo sapiens
aaccaccaaaaacaaa

SEQ ID NO: 1359646 - DNA, 22 bp, Homo sapiens
aaccacggaggatgatgccagt

SEQ ID NO: 1359647 - DNA, 12 bp, Homo sapiens
aaccactagaaa

SEQ ID NO: 1359648 - DNA, 21 bp, Homo sapiens
aaccactgtgcgtcttggtgt

SEQ ID NO: 1359649 - DNA, 12 bp, Homo sapiens
aaccacttgtag

SEQ ID NO: 1359650 - DNA, 18 bp, Homo sapiens
aaccacttgtagatttga

SEQ ID NO: 1359651 - DNA, 20 bp, Homo sapiens
aaccacttgtagatttgatt

SEQ ID NO: 1359652 - DNA, 22 bp, Homo sapiens
aaccacttgtagatttgatttt

SEQ ID NO: 1359653 - DNA, 15 bp, Homo sapiens
aaccagacctggaag

SEQ ID NO: 1359654 - DNA, 15 bp, Homo sapiens
aaccagagtgctgaa

SEQ ID NO: 1359655 - DNA, 16 bp, Homo sapiens
aaccaggcacctcttc

SEQ ID NO: 1359656 - DNA, 19 bp, Homo sapiens
aaccatcttgtgtctttgg

SEQ ID NO: 1359657 - DNA, 22 bp, Homo sapiens
aaccatgtagcagtgagtcata

SEQ ID NO: 1359658 - DNA, 17 bp, Homo sapiens
aaccatgtcatttcaga

SEQ ID NO: 1359659 - DNA, 16 bp, Homo sapiens
aacccagtttcccgtc

SEQ ID NO: 1359660 - DNA, 19 bp, Homo sapiens
aaccctatctcctgacaga

SEQ ID NO: 1359661 - DNA, 22 bp, Homo sapiens
aaccctatctcctgacagaagg

SEQ ID NO: 1359662 - DNA, 18 bp, Homo sapiens
aaccctttatttgaacaa

SEQ ID NO: 1359663 - DNA, 19 bp, Homo sapiens
aaccgagtagaaaatgtga

SEQ ID NO: 1359664 - DNA, 23 bp, Homo sapiens
aaccgagtagaaaatgtgaccct

SEQ ID NO: 1359665 - DNA, 13 bp, Homo sapiens
aaccgcacagctc

SEQ ID NO: 1359666 - DNA, 14 bp, Homo sapiens
aaccgcacagctca

SEQ ID NO: 1359667 - DNA, 17 bp, Homo sapiens
aacctcagggctcccag

SEQ ID NO: 1359668 - DNA, 18 bp, Homo sapiens
aacctctcacttcaccct

SEQ ID NO: 1359669 - DNA, 20 bp, Homo sapiens
aacctgggattcaggaatgt

SEQ ID NO: 1359670 - DNA, 17 bp, Homo sapiens
aaccttggcctgggccg

SEQ ID NO: 1359671 - DNA, 16 bp, Homo sapiens
aaccttgtataaatta

SEQ ID NO: 1359672 - DNA, 19 bp, Homo sapiens
aaccttgtataaattattc

SEQ ID NO: 1359673 - DNA, 15 bp, Homo sapiens
aacctttccctcacc

SEQ ID NO: 1359674 - DNA, 19 bp, Homo sapiens
aacctttccctcaccccct

SEQ ID NO: 1359675 - DNA, 18 bp, Homo sapiens
aacgcctcccctgcccca

SEQ ID NO: 1359676 - DNA, 21 bp, Homo sapiens
aacgctaaagagcccttgcct

SEQ ID NO: 1359677 - DNA, 19 bp, Homo sapiens
aactaaagcaatagaaaca

SEQ ID NO: 1359678 - DNA, 15 bp, Homo sapiens
aactacctgtattta

SEQ ID NO: 1359679 - DNA, 23 bp, Homo sapiens
aactagtggggtttcctggcact

SEQ ID NO: 1359680 - DNA, 17 bp, Homo sapiens
aactatattttgtcata

SEQ ID NO: 1359681 - DNA, 20 bp, Homo sapiens
aactcaatgctttatttgta

SEQ ID NO: 1359682 - DNA, 21 bp, Homo sapiens
aactcaatgctttatttgtaa

SEQ ID NO: 1359683 - DNA, 17 bp, Homo sapiens
aactccacatctgcctt

SEQ ID NO: 1359684 - DNA, 18 bp, Homo sapiens
aactccacatctgcctta

SEQ ID NO: 1359685 - DNA, 15 bp, Homo sapiens
aactctggcttttgg

SEQ ID NO: 1359686 - DNA, 13 bp, Homo sapiens
aactcttctcatt

SEQ ID NO: 1359687 - DNA, 17 bp, Homo sapiens
aactcttctcattactt

SEQ ID NO: 1359688 - DNA, 18 bp, Homo sapiens
aactgcaggccctggcct

SEQ ID NO: 1359689 - DNA, 19 bp, Homo sapiens
aatactatttaagatgtga

SEQ ID NO: 1359690 - DNA, 20 bp, Homo sapiens
aatactctaccctcttagaa

SEQ ID NO: 1359691 - DNA, 14 bp, Homo sapiens
aatactctttattt

SEQ ID NO: 1359692 - DNA, 13 bp, Homo sapiens
aatactgaaccac

SEQ ID NO: 1359693 - DNA, 14 bp, Homo sapiens
aatacttccagaag

SEQ ID NO: 1359694 - DNA, 14 bp, Homo sapiens
aatacttgaaccat

SEQ ID NO: 1359695 - DNA, 19 bp, Homo sapiens
aatacttgaaccataaaat

SEQ ID NO: 1359696 - DNA, 12 bp, Homo sapiens
aatagaaacaag

SEQ ID NO: 1359697 - DNA, 15 bp, Homo sapiens
aatagaaattttgta

SEQ ID NO: 1359698 - DNA, 21 bp, Homo sapiens
aatagactgtaacttccaaat

SEQ ID NO: 1359699 - DNA, 21 bp, Homo sapiens
aatagattttataagatgact

SEQ ID NO: 1359700 - DNA, 15 bp, Homo sapiens
aatagcaacttttgt

SEQ ID NO: 1359701 - DNA, 20 bp, Homo sapiens
aataggaatcattcagaaat

SEQ ID NO: 1359702 - DNA, 16 bp, Homo sapiens
aataggatttttagaa

SEQ ID NO: 1359703 - DNA, 13 bp, Homo sapiens
aatagtaatgttt

SEQ ID NO: 1359704 - DNA, 13 bp, Homo sapiens
aatagtagatgtg

SEQ ID NO: 1359705 - DNA, 22 bp, Homo sapiens
aatagtagatgtggcctttgaa

SEQ ID NO: 1359706 - DNA, 17 bp, Homo sapiens
aatagtttattttaaaa

SEQ ID NO: 1359707 - DNA, 15 bp, Homo sapiens
aatataaaattatga

SEQ ID NO: 1359708 - DNA, 23 bp, Homo sapiens
aatataaacaaagattcatgatt

SEQ ID NO: 1359709 - DNA, 18 bp, Homo sapiens
aatataaggaaagcaata

SEQ ID NO: 1359710 - DNA, 19 bp, Homo sapiens
aatataaggaaagcaataa

SEQ ID NO: 1359711 - DNA, 23 bp, Homo sapiens
aatatacatgaagaatagaaaca

SEQ ID NO: 1359712 - DNA, 20 bp, Homo sapiens
aatatatatctatctatttg

SEQ ID NO: 1359713 - DNA, 14 bp, Homo sapiens
aatatatttttaga

SEQ ID NO: 1359714 - DNA, 20 bp, Homo sapiens
aatatctaatatatatgaat

SEQ ID NO: 1359715 - DNA, 22 bp, Homo sapiens
aatatctaatatatatgaataa

SEQ ID NO: 1359716 - DNA, 16 bp, Homo sapiens
aatatctattaatata

SEQ ID NO: 1359717 - DNA, 20 bp, Homo sapiens
aatatgactttttataaaat

SEQ ID NO: 1359718 - DNA, 16 bp, Homo sapiens
aatatgtagtatctat

SEQ ID NO: 1359719 - DNA, 19 bp, Homo sapiens
aatatgtggaagcaaccaa

SEQ ID NO: 1359720 - DNA, 22 bp, Homo sapiens
aatattccagatctttcagaaa

SEQ ID NO: 1359721 - DNA, 23 bp, Homo sapiens
aatattccagatctttcagaaat

SEQ ID NO: 1359722 - DNA, 21 bp, Homo sapiens
aatattcctttgcatattata

SEQ ID NO: 1359723 - DNA, 20 bp, Homo sapiens
aatattgattgggaaaacat

SEQ ID NO: 1359724 - DNA, 22 bp, Homo sapiens
aatattgattgggaaaacattt

SEQ ID NO: 1359725 - DNA, 17 bp, Homo sapiens
aatattgcaaaatacat

SEQ ID NO: 1359726 - DNA, 20 bp, Homo sapiens
aatattgcaaaatacatgaa

SEQ ID NO: 1359727 - DNA, 20 bp, Homo sapiens
aatattgttgacaactgtga

SEQ ID NO: 1359728 - DNA, 21 bp, Homo sapiens
aatattgtttggtaaatgttt

SEQ ID NO: 1359729 - DNA, 21 bp, Homo sapiens
aatatttaacattatttatat

SEQ ID NO: 1359730 - DNA, 19 bp, Homo sapiens
aatattttctctgtacttt

SEQ ID NO: 1359731 - DNA, 23 bp, Homo sapiens
aatattttctctgtacttttcat

SEQ ID NO: 1359732 - DNA, 15 bp, Homo sapiens
aatattttgaatcaa

SEQ ID NO: 1359733 - DNA, 22 bp, Homo sapiens
aatattttgaatcaataatata

SEQ ID NO: 1359734 - DNA, 15 bp, Homo sapiens
aatatttttatatca

SEQ ID NO: 1359735 - DNA, 23 bp, Homo sapiens
aatatttttatatcatgcaaaat

SEQ ID NO: 1359736 - DNA, 19 bp, Homo sapiens
aatatttttatatttcctt

SEQ ID NO: 1359737 - DNA, 19 bp, Homo sapiens
aatcaaataagtatttata

SEQ ID NO: 1359738 - DNA, 22 bp, Homo sapiens
aatcaagagccttaaaacatca

SEQ ID NO: 1359739 - DNA, 17 bp, Homo sapiens
aatcaaggttataattt

SEQ ID NO: 1359740 - DNA, 18 bp, Homo sapiens
aatcaaggttataatttt

SEQ ID NO: 1359741 - DNA, 19 bp, Homo sapiens
aatcaccatgtaagcactc

SEQ ID NO: 1359742 - DNA, 18 bp, Homo sapiens
aatcactgtgtatatttg

SEQ ID NO: 1359743 - DNA, 22 bp, Homo sapiens
aatcactgtgtatatttgattt

SEQ ID NO: 1359744 - DNA, 23 bp, Homo sapiens
aatcactgtgtatatttgattta

SEQ ID NO: 1359745 - DNA, 14 bp, Homo sapiens
aatcagcatttagt

SEQ ID NO: 1359746 - DNA, 15 bp, Homo sapiens
aatcagccaagtttt

SEQ ID NO: 1359747 - DNA, 13 bp, Homo sapiens
aatcagcctgctc

SEQ ID NO: 1359748 - DNA, 22 bp, Homo sapiens
aatcagtcatgtgtaatatgca

SEQ ID NO: 1359749 - DNA, 22 bp, Homo sapiens
aatcatgtccatacactttgtt

SEQ ID NO: 1359750 - DNA, 23 bp, Homo sapiens
aatcatgttgatcatgtactttt

SEQ ID NO: 1359751 - DNA, 14 bp, Homo sapiens
aatcattcagaaat

SEQ ID NO: 1359752 - DNA, 23 bp, Homo sapiens
aatcattcagaaatgttgagtct

SEQ ID NO: 1359753 - DNA, 17 bp, Homo sapiens
aatcattcttactaaaa

SEQ ID NO: 1359754 - DNA, 22 bp, Homo sapiens
aatcatttgtttacatttgatg

SEQ ID NO: 1359755 - DNA, 17 bp, Homo sapiens
aatccaagcctccacag

SEQ ID NO: 1359756 - DNA, 19 bp, Homo sapiens
aatccagttataagaagaa

SEQ ID NO: 1359757 - DNA, 17 bp, Homo sapiens
aatcccctaaaataaca

SEQ ID NO: 1359758 - DNA, 13 bp, Homo sapiens
aatccctgctttt

SEQ ID NO: 1359759 - DNA, 22 bp, Homo sapiens
aatccctgctttttgtgttttt

SEQ ID NO: 1359760 - DNA, 18 bp, Homo sapiens
aatccctgtgttaattta

SEQ ID NO: 1359761 - DNA, 20 bp, Homo sapiens
aatccctgtgttaatttaag

SEQ ID NO: 1359762 - DNA, 22 bp, Homo sapiens
aatcccttaacagttgtattta

SEQ ID NO: 1359763 - DNA, 19 bp, Homo sapiens
aatccctttattaccccct

SEQ ID NO: 1359764 - DNA, 16 bp, Homo sapiens
aatcctaatttctcct

SEQ ID NO: 1359765 - DNA, 19 bp, Homo sapiens
aatcctaatttctcctccc

SEQ ID NO: 1359766 - DNA, 21 bp, Homo sapiens
aatcctaatttctcctccctt

SEQ ID NO: 1359767 - DNA, 19 bp, Homo sapiens
aatcctgattcctctctaa

SEQ ID NO: 1359768 - DNA, 13 bp, Homo sapiens
aatcctggcagcc

SEQ ID NO: 1359769 - DNA, 14 bp, Homo sapiens
aatcctttggaaaa

SEQ ID NO: 1359770 - DNA, 16 bp, Homo sapiens
aatctaaatctattta

SEQ ID NO: 1359771 - DNA, 16 bp, Homo sapiens
aatctatttattaata

SEQ ID NO: 1359772 - DNA, 18 bp, Homo sapiens
aatctatttattaatatt

SEQ ID NO: 1359773 - DNA, 20 bp, Homo sapiens
aatctatttattaatattta

SEQ ID NO: 1359774 - DNA, 18 bp, Homo sapiens
aatctcttcattattctc

SEQ ID NO: 1359775 - DNA, 21 bp, Homo sapiens
aatctcttcattattctctgc

SEQ ID NO: 1359776 - DNA, 18 bp, Homo sapiens
aatctctttttgtttgcc

SEQ ID NO: 1359777 - DNA, 22 bp, Homo sapiens
aatctgagggaaatgttttgta

SEQ ID NO: 1359778 - DNA, 16 bp, Homo sapiens
aatctgatggccttaa

SEQ ID NO: 1359779 - DNA, 17 bp, Homo sapiens
aatctgatggccttaat

SEQ ID NO: 1359780 - DNA, 15 bp, Homo sapiens
aatctggagaccagg

SEQ ID NO: 1359781 - DNA, 13 bp, Homo sapiens
aatcttactttgt

SEQ ID NO: 1359782 - DNA, 16 bp, Homo sapiens
aatcttactttgtaaa

SEQ ID NO: 1359783 - DNA, 17 bp, Homo sapiens
aatcttactttgtaaat

SEQ ID NO: 1359784 - DNA, 14 bp, Homo sapiens
aatcttataattgt

SEQ ID NO: 1359785 - DNA, 17 bp, Homo sapiens
aatcttataattgttct

SEQ ID NO: 1359786 - DNA, 17 bp, Homo sapiens
aatcttcaaagccttct

SEQ ID NO: 1359787 - DNA, 17 bp, Homo sapiens
aatcttcccatgcattc

SEQ ID NO: 1359788 - DNA, 22 bp, Homo sapiens
aatctttgtttcaggttcagta

SEQ ID NO: 1359789 - DNA, 13 bp, Homo sapiens
aatcttttgaagc

SEQ ID NO: 1359790 - DNA, 14 bp, Homo sapiens
aatgaaaaaagctt

SEQ ID NO: 1359791 - DNA, 21 bp, Homo sapiens
aatgaaaaatagtgtctttgt

SEQ ID NO: 1359792 - DNA, 13 bp, Homo sapiens
aatgaaaatgaat

SEQ ID NO: 1359793 - DNA, 16 bp, Homo sapiens
aatgaaaatgaatatc

SEQ ID NO: 1359794 - DNA, 19 bp, Homo sapiens
aatgaaagaaaattgagtt

SEQ ID NO: 1359795 - DNA, 19 bp, Homo sapiens
aatgaaatattgtttccaa

SEQ ID NO: 1359796 - DNA, 18 bp, Homo sapiens
aatgaaccataaattcaa

SEQ ID NO: 1359797 - DNA, 18 bp, Homo sapiens
aatgaagaatttaaagaa

SEQ ID NO: 1359798 - DNA, 16 bp, Homo sapiens
aatgactcaaagtctg

SEQ ID NO: 1359799 - DNA, 11 bp, Homo sapiens
aatgactttat

SEQ ID NO: 1359800 - DNA, 14 bp, Homo sapiens
aatgactttattat

SEQ ID NO: 1359801 - DNA, 15 bp, Homo sapiens
aactgccaagaaatt

SEQ ID NO: 1359802 - DNA, 20 bp, Homo sapiens
aactgctgactgttttctct

SEQ ID NO: 1359803 - DNA, 17 bp, Homo sapiens
aactggacctgtatatt

SEQ ID NO: 1359804 - DNA, 23 bp, Homo sapiens
aactgggatgaaactaaagcaat

SEQ ID NO: 1359805 - DNA, 18 bp, Homo sapiens
aactggggttgagggcca

SEQ ID NO: 1359806 - DNA, 12 bp, Homo sapiens
aactgtaaatca

SEQ ID NO: 1359807 - DNA, 17 bp, Homo sapiens
aactgtagaaatgatga

SEQ ID NO: 1359808 - DNA, 13 bp, Homo sapiens
aactgtcctgtcc

SEQ ID NO: 1359809 - DNA, 22 bp, Homo sapiens
aactgtctctcttctcagagtg

SEQ ID NO: 1359810 - DNA, 14 bp, Homo sapiens
aactgtgtactgtt

SEQ ID NO: 1359811 - DNA, 15 bp, Homo sapiens
aacttaaatgttatt

SEQ ID NO: 1359812 - DNA, 13 bp, Homo sapiens
aacttaataatca

SEQ ID NO: 1359813 - DNA, 17 bp, Homo sapiens
aacttaataatcaagag

SEQ ID NO: 1359814 - DNA, 20 bp, Homo sapiens
aacttaataatcaagagcct

SEQ ID NO: 1359815 - DNA, 19 bp, Homo sapiens
aacttattttaaatatgcc

SEQ ID NO: 1359816 - DNA, 19 bp, Homo sapiens
aacttctgcaacaagcatg

SEQ ID NO: 1359817 - DNA, 20 bp, Homo sapiens
aacttctgcaacaagcatgc

SEQ ID NO: 1359818 - DNA, 18 bp, Homo sapiens
aacttgcttaaatttctt

SEQ ID NO: 1359819 - DNA, 21 bp, Homo sapiens
aacttgcttaaatttcttatg

SEQ ID NO: 1359820 - DNA, 23 bp, Homo sapiens
aacttggctcgaatctctgtgcc

SEQ ID NO: 1359821 - DNA, 19 bp, Homo sapiens
aactttataaatccagtga

SEQ ID NO: 1359822 - DNA, 16 bp, Homo sapiens
aactttgggaaaacat

SEQ ID NO: 1359823 - DNA, 15 bp, Homo sapiens
aactttgtatagtta

SEQ ID NO: 1359824 - DNA, 22 bp, Homo sapiens
aactttgtatagttatgtaaat

SEQ ID NO: 1359825 - DNA, 14 bp, Homo sapiens
aacttttgtaaata

SEQ ID NO: 1359826 - DNA, 19 bp, Homo sapiens
aacttttgtactgaatttt

SEQ ID NO: 1359827 - DNA, 20 bp, Homo sapiens
aacttttgtactgaattttt

SEQ ID NO: 1359828 - DNA, 13 bp, Homo sapiens
aagaaaaaaatgt

SEQ ID NO: 1359829 - DNA, 20 bp, Homo sapiens
aagaaaaaaatgtcaaaagt

SEQ ID NO: 1359830 - DNA, 19 bp, Homo sapiens
aagaaaaaatattttccct

SEQ ID NO: 1359831 - DNA, 13 bp, Homo sapiens
aagaaaaagaaaa

SEQ ID NO: 1359832 - DNA, 18 bp, Homo sapiens
aagaaaaagaaaaagaaa

SEQ ID NO: 1359833 - DNA, 13 bp, Homo sapiens
aagaaaacatctt

SEQ ID NO: 1359834 - DNA, 16 bp, Homo sapiens
aagaaagtcagccata

SEQ ID NO: 1359835 - DNA, 21 bp, Homo sapiens
aagaacgttttttcctcagtg

SEQ ID NO: 1359836 - DNA, 18 bp, Homo sapiens
aagaactgcaggccctgg

SEQ ID NO: 1359837 - DNA, 13 bp, Homo sapiens
aagaagacttttt

SEQ ID NO: 1359838 - DNA, 15 bp, Homo sapiens
aagaagagctatcag

SEQ ID NO: 1359839 - DNA, 22 bp, Homo sapiens
aagaagatgctccagcaacaca

SEQ ID NO: 1359840 - DNA, 15 bp, Homo sapiens
aagaagctctctcct

SEQ ID NO: 1359841 - DNA, 15 bp, Homo sapiens
aagaaggcaatatta

SEQ ID NO: 1359842 - DNA, 14 bp, Homo sapiens
aagaagggagaaga

SEQ ID NO: 1359843 - DNA, 15 bp, Homo sapiens
aagaagggagaagaa

SEQ ID NO: 1359844 - DNA, 23 bp, Homo sapiens
aagaagtcttctctgcctgtaag

SEQ ID NO: 1359845 - DNA, 13 bp, Homo sapiens
aagaatagaaaca

SEQ ID NO: 1359846 - DNA, 14 bp, Homo sapiens
aagaatatgacttt

SEQ ID NO: 1359847 - DNA, 17 bp, Homo sapiens
aagaatgaaagctgttc

SEQ ID NO: 1359848 - DNA, 18 bp, Homo sapiens
aagaatgactatataatt

SEQ ID NO: 1359849 - DNA, 21 bp, Homo sapiens
aagaatgttagagtaatgaaa

SEQ ID NO: 1359850 - DNA, 20 bp, Homo sapiens
aagaattctgattgatttga

SEQ ID NO: 1359851 - DNA, 15 bp, Homo sapiens
aagaattgaaaagtt

SEQ ID NO: 1359852 - DNA, 13 bp, Homo sapiens
aagaatttaaaga

SEQ ID NO: 1359853 - DNA, 12 bp, Homo sapiens
aagaatttgcat

SEQ ID NO: 1359854 - DNA, 13 bp, Homo sapiens
aagaatttgcata

SEQ ID NO: 1359855 - DNA, 22 bp, Homo sapiens
aagacaaaagtctgtctttcct

SEQ ID NO: 1359856 - DNA, 19 bp, Homo sapiens
aagacaatgtgaaaagaaa

SEQ ID NO: 1359857 - DNA, 13 bp, Homo sapiens
aagacactgcctg

SEQ ID NO: 1359858 - DNA, 14 bp, Homo sapiens
aagacactgcctgg

SEQ ID NO: 1359859 - DNA, 17 bp, Homo sapiens
aagacactgcctgggct

SEQ ID NO: 1359860 - DNA, 14 bp, Homo sapiens
aagacaggagacaa

SEQ ID NO: 1359861 - DNA, 18 bp, Homo sapiens
aagacaggagacaaaaga

SEQ ID NO: 1359862 - DNA, 20 bp, Homo sapiens
aagacagtgtatgtagaagc

SEQ ID NO: 1359863 - DNA, 16 bp, Homo sapiens
aagacctcacctagaa

SEQ ID NO: 1359864 - DNA, 22 bp, Homo sapiens
aagactggcttttattaatgca

SEQ ID NO: 1359865 - DNA, 23 bp, Homo sapiens
aagactggcttttattaatgcac

SEQ ID NO: 1359866 - DNA, 15 bp, Homo sapiens
aagactggttttctg

SEQ ID NO: 1359867 - DNA, 17 bp, Homo sapiens
aagactgtagatatgta

SEQ ID NO: 1359868 - DNA, 11 bp, Homo sapiens
aagagaactcg

SEQ ID NO: 1359869 - DNA, 21 bp, Homo sapiens
aagagaagttgtaaagtatgt

SEQ ID NO: 1359870 - DNA, 13 bp, Homo sapiens
aagagacactcca

SEQ ID NO: 1359871 - DNA, 17 bp, Homo sapiens
aagagagaacaggacta

SEQ ID NO: 1359872 - DNA, 13 bp, Homo sapiens
aagagctattgcc

SEQ ID NO: 1359873 - DNA, 17 bp, Homo sapiens
aagaggctgcccctctc

SEQ ID NO: 1359874 - DNA, 21 bp, Homo sapiens
aagaggctgcccctctcacca

SEQ ID NO: 1359875 - DNA, 22 bp, Homo sapiens
aagaggctgcccctctcaccaa

SEQ ID NO: 1359876 - DNA, 13 bp, Homo sapiens
aagagggggtgga

SEQ ID NO: 1359877 - DNA, 16 bp, Homo sapiens
aagagggggtggaggg

SEQ ID NO: 1359878 - DNA, 23 bp, Homo sapiens
aagagtgatagtcttttgctttt

SEQ ID NO: 1359879 - DNA, 20 bp, Homo sapiens
aagagttcccttgaaacttt

SEQ ID NO: 1359880 - DNA, 12 bp, Homo sapiens
aagatactttgt

SEQ ID NO: 1359881 - DNA, 21 bp, Homo sapiens
aagatagtgtaacttgcttaa

SEQ ID NO: 1359882 - DNA, 20 bp, Homo sapiens
aagatcactgtttagatttg

SEQ ID NO: 1359883 - DNA, 16 bp, Homo sapiens
aagatgcttctcactg

SEQ ID NO: 1359884 - DNA, 13 bp, Homo sapiens
aagatgtgaatta

SEQ ID NO: 1359885 - DNA, 20 bp, Homo sapiens
aagatgtgaattattgacac

SEQ ID NO: 1359886 - DNA, 16 bp, Homo sapiens
aagatgttgattttta

SEQ ID NO: 1359887 - DNA, 14 bp, Homo sapiens
aagattgatatcta

SEQ ID NO: 1359888 - DNA, 20 bp, Homo sapiens
aagcaagtaaaaaggctaaa

SEQ ID NO: 1359889 - DNA, 23 bp, Homo sapiens
aagcactcctgcttaatcttcaa

SEQ ID NO: 1359890 - DNA, 19 bp, Homo sapiens
aagcactctggatgatgga

SEQ ID NO: 1359891 - DNA, 22 bp, Homo sapiens
aagcagcctctccccaggtcca

SEQ ID NO: 1359892 - DNA, 18 bp, Homo sapiens
aagcagtatttttcttga

SEQ ID NO: 1359893 - DNA, 21 bp, Homo sapiens
aagcatatgggttagatgttg

SEQ ID NO: 1359894 - DNA, 13 bp, Homo sapiens
aagcatgaaatgt

SEQ ID NO: 1359895 - DNA, 19 bp, Homo sapiens
aagcatttttcaatatatt

SEQ ID NO: 1359896 - DNA, 22 bp, Homo sapiens
aagccaaaattaaggtgtttga

SEQ ID NO: 1359897 - DNA, 13 bp, Homo sapiens
aagccaaagaaaa

SEQ ID NO: 1359898 - DNA, 16 bp, Homo sapiens
aagccaagggaaaggg

SEQ ID NO: 1359899 - DNA, 15 bp, Homo sapiens
aagccagaggctggg

SEQ ID NO: 1359900 - DNA, 16 bp, Homo sapiens
aagccagaggctgggt

SEQ ID NO: 1359901 - DNA, 18 bp, Homo sapiens
aagccaggctcactcaca

SEQ ID NO: 1359902 - DNA, 15 bp, Homo sapiens
aagcccatcctgacc

SEQ ID NO: 1359903 - DNA, 13 bp, Homo sapiens
aagccccacatgt

SEQ ID NO: 1359904 - DNA, 21 bp, Homo sapiens
aagccggggaagagatccaaa

SEQ ID NO: 1359905 - DNA, 22 bp, Homo sapiens
aagcctaatcacagtttttcct

SEQ ID NO: 1359906 - DNA, 22 bp, Homo sapiens
aagcctcaaagagagaaagttt

SEQ ID NO: 1359907 - DNA, 12 bp, Homo sapiens
aagcctccacag

SEQ ID NO: 1359908 - DNA, 16 bp, Homo sapiens
aagcctcccacgactg

SEQ ID NO: 1359909 - DNA, 15 bp, Homo sapiens
aagcctcctccagcc

SEQ ID NO: 1359910 - DNA, 19 bp, Homo sapiens
aagcctcctccagccgcca

SEQ ID NO: 1359911 - DNA, 13 bp, Homo sapiens
aagccttcaaaac

SEQ ID NO: 1359912 - DNA, 19 bp, Homo sapiens
aagccttcagctccaggga

SEQ ID NO: 1359913 - DNA, 13 bp, Homo sapiens
aagcgtatggctt

SEQ ID NO: 1359914 - DNA, 23 bp, Homo sapiens
aagctaatgacgaggaaccgaaa

SEQ ID NO: 1359915 - DNA, 15 bp, Homo sapiens
aagctagtcaacagt

SEQ ID NO: 1359916 - DNA, 13 bp, Homo sapiens
aagctataaagca

SEQ ID NO: 1359917 - DNA, 17 bp, Homo sapiens
aagctatttatgggccc

SEQ ID NO: 1359918 - DNA, 15 bp, Homo sapiens
aagctccgcaggact

SEQ ID NO: 1359919 - DNA, 17 bp, Homo sapiens
aagctcctatctgtttt

SEQ ID NO: 1359920 - DNA, 21 bp, Homo sapiens
aagctgcaccctcaggcaggt

SEQ ID NO: 1359921 - DNA, 22 bp, Homo sapiens
aagctgcaccctcaggcaggtg

SEQ ID NO: 1359922 - DNA, 17 bp, Homo sapiens
acttgacttttaaggct

SEQ ID NO: 1359923 - DNA, 13 bp, Homo sapiens
acttgcctcttcc

SEQ ID NO: 1359924 - DNA, 17 bp, Homo sapiens
acttgcctcttccttga

SEQ ID NO: 1359925 - DNA, 13 bp, Homo sapiens
acttgcctgggtc

SEQ ID NO: 1359926 - DNA, 21 bp, Homo sapiens
acttgctttaccttttcaggg

SEQ ID NO: 1359927 - DNA, 19 bp, Homo sapiens
acttggctcgaatctctgt

SEQ ID NO: 1359928 - DNA, 16 bp, Homo sapiens
acttggtttttaaaaa

SEQ ID NO: 1359929 - DNA, 20 bp, Homo sapiens
acttgtgattatttattatt

SEQ ID NO: 1359930 - DNA, 17 bp, Homo sapiens
acttgtgttttaaaata

SEQ ID NO: 1359931 - DNA, 15 bp, Homo sapiens
acttgttgcctataa

SEQ ID NO: 1359932 - DNA, 20 bp, Homo sapiens
acttgttttggatggcttgt

SEQ ID NO: 1359933 - DNA, 12 bp, Homo sapiens
actttaaaagtg

SEQ ID NO: 1359934 - DNA, 18 bp, Homo sapiens
actttacagaaatggact

SEQ ID NO: 1359935 - DNA, 17 bp, Homo sapiens
actttacccacctagaa

SEQ ID NO: 1359936 - DNA, 19 bp, Homo sapiens
actttactgcctgaataaa

SEQ ID NO: 1359937 - DNA, 19 bp, Homo sapiens
actttagggggtgggattc

SEQ ID NO: 1359938 - DNA, 13 bp, Homo sapiens
actttataaatcc

SEQ ID NO: 1359939 - DNA, 17 bp, Homo sapiens
actttctatcctctgta

SEQ ID NO: 1359940 - DNA, 19 bp, Homo sapiens
actttctattttaatcttg

SEQ ID NO: 1359941 - DNA, 18 bp, Homo sapiens
actttgagcctgggaaat

SEQ ID NO: 1359942 - DNA, 11 bp, Homo sapiens
actttgatgtc

SEQ ID NO: 1359943 - DNA, 16 bp, Homo sapiens
actttgatgtcagcag

SEQ ID NO: 1359944 - DNA, 19 bp, Homo sapiens
actttgggaaaacatgtta

SEQ ID NO: 1359945 - DNA, 21 bp, Homo sapiens
actttgggaggccgaggcggg

SEQ ID NO: 1359946 - DNA, 17 bp, Homo sapiens
actttgtaaaaatcttt

SEQ ID NO: 1359947 - DNA, 14 bp, Homo sapiens
actttgtaaattct

SEQ ID NO: 1359948 - DNA, 23 bp, Homo sapiens
actttgtaaattctgatttcttt

SEQ ID NO: 1359949 - DNA, 14 bp, Homo sapiens
actttgtattttga

SEQ ID NO: 1359950 - DNA, 15 bp, Homo sapiens
actttgttgcaagat

SEQ ID NO: 1359951 - DNA, 17 bp, Homo sapiens
actttgttgcaagatgt

SEQ ID NO: 1359952 - DNA, 20 bp, Homo sapiens
actttgttgcaagatgtgaa

SEQ ID NO: 1359953 - DNA, 22 bp, Homo sapiens
acttttattttacacagaaaca

SEQ ID NO: 1359954 - DNA, 18 bp, Homo sapiens
acttttcattctctttta

SEQ ID NO: 1359955 - DNA, 23 bp, Homo sapiens
acttttctagaattatttttcac

SEQ ID NO: 1359956 - DNA, 18 bp, Homo sapiens
acttttgtgtaatgaaaa

SEQ ID NO: 1359957 - DNA, 19 bp, Homo sapiens
acttttgtgtaatgaaaat

SEQ ID NO: 1359958 - DNA, 15 bp, Homo sapiens
actttttagtaattt

SEQ ID NO: 1359959 - DNA, 16 bp, Homo sapiens
agaaaaaaatactatt

SEQ ID NO: 1359960 - DNA, 13 bp, Homo sapiens
agaaaaaaatgtc

SEQ ID NO: 1359961 - DNA, 20 bp, Homo sapiens
agaaaaaaatgtcaaaagta

SEQ ID NO: 1359962 - DNA, 17 bp, Homo sapiens
agaaaaaatattttccc

SEQ ID NO: 1359963 - DNA, 22 bp, Homo sapiens
agaaaacaagcaagttctgaga

SEQ ID NO: 1359964 - DNA, 13 bp, Homo sapiens
agaaaagatgaaa

SEQ ID NO: 1359965 - DNA, 17 bp, Homo sapiens
agaaaatgaaatgcata

SEQ ID NO: 1359966 - DNA, 19 bp, Homo sapiens
agaaaatgtgaccctccaa

SEQ ID NO: 1359967 - DNA, 22 bp, Homo sapiens
agaaaattgagttgcacttatt

SEQ ID NO: 1359968 - DNA, 12 bp, Homo sapiens
agaaacactgcc

SEQ ID NO: 1359969 - DNA, 13 bp, Homo sapiens
agaaacactgcct

SEQ ID NO: 1359970 - DNA, 15 bp, Homo sapiens
agaaacactgccttt

SEQ ID NO: 1359971 - DNA, 20 bp, Homo sapiens
agaaacttatttctcatatc

SEQ ID NO: 1359972 - DNA, 22 bp, Homo sapiens
agaaacttttatctattctgag

SEQ ID NO: 1359973 - DNA, 23 bp, Homo sapiens
agaaacttttatctattctgaga

SEQ ID NO: 1359974 - DNA, 23 bp, Homo sapiens
agaaaggtgagtttgagctgcct

SEQ ID NO: 1359975 - DNA, 19 bp, Homo sapiens
agaaagtggtcttaagaaa

SEQ ID NO: 1359976 - DNA, 21 bp, Homo sapiens
agaaagtggtcttaagaaatg

SEQ ID NO: 1359977 - DNA, 21 bp, Homo sapiens
agaaataaagtttgcttagaa

SEQ ID NO: 1359978 - DNA, 22 bp, Homo sapiens
agaaataatgctacaattttaa

SEQ ID NO: 1359979 - DNA, 17 bp, Homo sapiens
agaaatattaagcatgt

SEQ ID NO: 1359980 - DNA, 16 bp, Homo sapiens
agaaatgaaaacagtg

SEQ ID NO: 1359981 - DNA, 22 bp, Homo sapiens
agaaatgttgagtctgtactaa

SEQ ID NO: 1359982 - DNA, 16 bp, Homo sapiens
agaaattgtatattgt

SEQ ID NO: 1359983 - DNA, 20 bp, Homo sapiens
agaaattgtatattgtaatt

SEQ ID NO: 1359984 - DNA, 21 bp, Homo sapiens
agaaattgtatattgtaattt

SEQ ID NO: 1359985 - DNA, 13 bp, Homo sapiens
agaaattttgtaa

SEQ ID NO: 1359986 - DNA, 14 bp, Homo sapiens
agaaattttgtaag

SEQ ID NO: 1359987 - DNA, 12 bp, Homo sapiens
agaacaggacta

SEQ ID NO: 1359988 - DNA, 17 bp, Homo sapiens
agaacaggtttttttgt

SEQ ID NO: 1359989 - DNA, 18 bp, Homo sapiens
agaacaggtttttttgtt

SEQ ID NO: 1359990 - DNA, 21 bp, Homo sapiens
agaacaggtttttttgtttgt

SEQ ID NO: 1359991 - DNA, 14 bp, Homo sapiens
agaacatgaatcaa

SEQ ID NO: 1359992 - DNA, 17 bp, Homo sapiens
agaacatgaatcaaaag

SEQ ID NO: 1359993 - DNA, 16 bp, Homo sapiens
agaaccaaatctggaa

SEQ ID NO: 1359994 - DNA, 17 bp, Homo sapiens
agaactccaggccctcc

SEQ ID NO: 1359995 - DNA, 15 bp, Homo sapiens
agaactttgtatagt

SEQ ID NO: 1359996 - DNA, 15 bp, Homo sapiens
agaagacaaactgct

SEQ ID NO: 1359997 - DNA, 16 bp, Homo sapiens
agaagcacagaatatt

SEQ ID NO: 1359998 - DNA, 16 bp, Homo sapiens
agaagcagaggaagga

SEQ ID NO: 1359999 - DNA, 15 bp, Homo sapiens
agaagcagtggcctt

SEQ ID NO: 1360000 - DNA, 15 bp, Homo sapiens
agaagccaagggaaa

SEQ ID NO: 1360001 - DNA, 16 bp, Homo sapiens
agaagccaagggaaag

SEQ ID NO: 1360002 - DNA, 22 bp, Homo sapiens
agaagccaagggaaaggggtgc

SEQ ID NO: 1360003 - DNA, 19 bp, Homo sapiens
agaagcctgtaacactcct

SEQ ID NO: 1360004 - DNA, 18 bp, Homo sapiens
agaagccttcagctccag

SEQ ID NO: 1360005 - DNA, 15 bp, Homo sapiens
agaagcggctggcag

SEQ ID NO: 1360006 - DNA, 16 bp, Homo sapiens
agaagcggctggcagc

SEQ ID NO: 1360007 - DNA, 21 bp, Homo sapiens
agaagctgccaggtgagaaac

SEQ ID NO: 1360008 - DNA, 22 bp, Homo sapiens
agaagctgccaggtgagaaact

SEQ ID NO: 1360009 - DNA, 18 bp, Homo sapiens
agaaggtttattgttaat

SEQ ID NO: 1360010 - DNA, 21 bp, Homo sapiens
agaagtaagaggctacctctt

SEQ ID NO: 1360011 - DNA, 21 bp, Homo sapiens
agaagtactgcccttttgtgt

SEQ ID NO: 1360012 - DNA, 14 bp, Homo sapiens
agaagtatttttag

SEQ ID NO: 1360013 - DNA, 16 bp, Homo sapiens
agaagtgaatgctggg

SEQ ID NO: 1360014 - DNA, 21 bp, Homo sapiens
agaagtgaatgctgggactca

SEQ ID NO: 1360015 - DNA, 22 bp, Homo sapiens
agaagtttggctgctgtcataa

SEQ ID NO: 1360016 - DNA, 17 bp, Homo sapiens
agaataagaatttgcat

SEQ ID NO: 1360017 - DNA, 18 bp, Homo sapiens
agaataagaatttgcata

SEQ ID NO: 1360018 - DNA, 12 bp, Homo sapiens
agaataagttat

SEQ ID NO: 1360019 - DNA, 16 bp, Homo sapiens
agaataagttattgca

SEQ ID NO: 1360020 - DNA, 17 bp, Homo sapiens
agaataagttattgcag

SEQ ID NO: 1360021 - DNA, 16 bp, Homo sapiens
agaataccacatcaaa

SEQ ID NO: 1360022 - DNA, 17 bp, Homo sapiens
agaataccacatcaaat

SEQ ID NO: 1360023 - DNA, 21 bp, Homo sapiens
agaatactgatggaatttttt

SEQ ID NO: 1360024 - DNA, 12 bp, Homo sapiens
agaatagaaaca

SEQ ID NO: 1360025 - DNA, 22 bp, Homo sapiens
agaatatcctttaaaatttaaa

SEQ ID NO: 1360026 - DNA, 16 bp, Homo sapiens
agaatatgacttttta

SEQ ID NO: 1360027 - DNA, 15 bp, Homo sapiens
agaatattgcaaaat

SEQ ID NO: 1360028 - DNA, 23 bp, Homo sapiens
agaatatttttatatttccttta

SEQ ID NO: 1360029 - DNA, 19 bp, Homo sapiens
agaatccctgtgttaattt

SEQ ID NO: 1360030 - DNA, 20 bp, Homo sapiens
agaatcccttaacagttgta

SEQ ID NO: 1360031 - DNA, 22 bp, Homo sapiens
agaatcccttaacagttgtatt

SEQ ID NO: 1360032 - DNA, 21 bp, Homo sapiens
agaatgaaagctgttccttgg

SEQ ID NO: 1360033 - DNA, 20 bp, Homo sapiens
agaatgcaaccaagtcacac

SEQ ID NO: 1360034 - DNA, 19 bp, Homo sapiens
agaatggtgtgaacccggg

SEQ ID NO: 1360035 - DNA, 20 bp, Homo sapiens
agaatggtgtgaacccggga

SEQ ID NO: 1360036 - DNA, 15 bp, Homo sapiens
agaatgttagagtaa

SEQ ID NO: 1360037 - DNA, 16 bp, Homo sapiens
agaatgttagagtaat

SEQ ID NO: 1360038 - DNA, 20 bp, Homo sapiens
agaattataattagttcctc

SEQ ID NO: 1360039 - DNA, 20 bp, Homo sapiens
agaattcaaactggggcctc

SEQ ID NO: 1360040 - DNA, 17 bp, Homo sapiens
agaattgaaaagttttt

SEQ ID NO: 1360041 - DNA, 12 bp, Homo sapiens
agaattgaaggt

SEQ ID NO: 1360042 - DNA, 12 bp, Homo sapiens
actcatttcatc

SEQ ID NO: 1360043 - DNA, 15 bp, Homo sapiens
actcatttcatctca

SEQ ID NO: 1360044 - DNA, 15 bp, Homo sapiens
actccacatctgcct

SEQ ID NO: 1360045 - DNA, 16 bp, Homo sapiens
actccacatctgcctt

SEQ ID NO: 1360046 - DNA, 23 bp, Homo sapiens
actccagccagcgcctccctcca

SEQ ID NO: 1360047 - DNA, 24 bp, Homo sapiens
actccagggacacacagcctagca

SEQ ID NO: 1360048 - DNA, 12 bp, Homo sapiens
actccattgtcg

SEQ ID NO: 1360049 - DNA, 14 bp, Homo sapiens
actcccccaggtgg

SEQ ID NO: 1360050 - DNA, 16 bp, Homo sapiens
actcccttgctggccc

SEQ ID NO: 1360051 - DNA, 18 bp, Homo sapiens
actcccttgctggcccca

SEQ ID NO: 1360052 - DNA, 23 bp, Homo sapiens
actccgagaggtgggccagtctg

SEQ ID NO: 1360053 - DNA, 20 bp, Homo sapiens
actcctctgcgtctatcctg

SEQ ID NO: 1360054 - DNA, 22 bp, Homo sapiens
actccttatttggcgtgacccg

SEQ ID NO: 1360055 - DNA, 14 bp, Homo sapiens
actcgagtctgagg

SEQ ID NO: 1360056 - DNA, 15 bp, Homo sapiens
actcgcgctcagtaa

SEQ ID NO: 1360057 - DNA, 20 bp, Homo sapiens
actcggggtgcttccttgta

SEQ ID NO: 1360058 - DNA, 20 bp, Homo sapiens
actcgggtttctctgtggct

SEQ ID NO: 1360059 - DNA, 21 bp, Homo sapiens
actctaccctcttagaaaaac

SEQ ID NO: 1360060 - DNA, 16 bp, Homo sapiens
actctcatcactacag

SEQ ID NO: 1360061 - DNA, 12 bp, Homo sapiens
actctgcttctc

SEQ ID NO: 1360062 - DNA, 16 bp, Homo sapiens
actctgcttctctgac

SEQ ID NO: 1360063 - DNA, 17 bp, Homo sapiens
actctgcttctctgact

SEQ ID NO: 1360064 - DNA, 18 bp, Homo sapiens
actctgcttctctgactt

SEQ ID NO: 1360065 - DNA, 21 bp, Homo sapiens
actctgcttctctgacttctg

SEQ ID NO: 1360066 - DNA, 16 bp, Homo sapiens
actctgggtccttcct

SEQ ID NO: 1360067 - DNA, 18 bp, Homo sapiens
actcttaaaacccaagtg

SEQ ID NO: 1360068 - DNA, 17 bp, Homo sapiens
actcttctcattacttg

SEQ ID NO: 1360069 - DNA, 20 bp, Homo sapiens
actgaaggaaaaacacaagc

SEQ ID NO: 1360070 - DNA, 22 bp, Homo sapiens
actgaaggaaaaacacaagcaa

SEQ ID NO: 1360071 - DNA, 20 bp, Homo sapiens
actgaatttttttgtaataa

SEQ ID NO: 1360072 - DNA, 15 bp, Homo sapiens
actgaccttgtaaaa

SEQ ID NO: 1360073 - DNA, 20 bp, Homo sapiens
actgaccttgtaaaagacag

SEQ ID NO: 1360074 - DNA, 21 bp, Homo sapiens
actgactgaggcagtttgagg

SEQ ID NO: 1360075 - DNA, 22 bp, Homo sapiens
actgactgtcgggctttaaaaa

SEQ ID NO: 1360076 - DNA, 15 bp, Homo sapiens
actgaggatattcag

SEQ ID NO: 1360077 - DNA, 23 bp, Homo sapiens
actgaggatattcagatgtatgt

SEQ ID NO: 1360078 - DNA, 16 bp, Homo sapiens
actgagtgggaagccc

SEQ ID NO: 1360079 - DNA, 22 bp, Homo sapiens
actgatggaatttttttgtacg

SEQ ID NO: 1360080 - DNA, 22 bp, Homo sapiens
actgatttgcaataaaaatgat

SEQ ID NO: 1360081 - DNA, 14 bp, Homo sapiens
actgcactccagcc

SEQ ID NO: 1360082 - DNA, 19 bp, Homo sapiens
actgcactccagcctgggg

SEQ ID NO: 1360083 - DNA, 12 bp, Homo sapiens
actgcaggccct

SEQ ID NO: 1360084 - DNA, 16 bp, Homo sapiens
actgcaggccctggcc

SEQ ID NO: 1360085 - DNA, 17 bp, Homo sapiens
actgcaggccctggcct

SEQ ID NO: 1360086 - DNA, 17 bp, Homo sapiens
actgcaggtcaagttgt

SEQ ID NO: 1360087 - DNA, 16 bp, Homo sapiens
actgcatttagggagt

SEQ ID NO: 1360088 - DNA, 12 bp, Homo sapiens
actgccagcagc

SEQ ID NO: 1360089 - DNA, 18 bp, Homo sapiens
actgccagcagcagcagg

SEQ ID NO: 1360090 - DNA, 16 bp, Homo sapiens
actgccaggccagcct

SEQ ID NO: 1360091 - DNA, 17 bp, Homo sapiens
actgccaggccagcctc

SEQ ID NO: 1360092 - DNA, 14 bp, Homo sapiens
actgcctgaataaa

SEQ ID NO: 1360093 - DNA, 15 bp, Homo sapiens
actgcctgccttaag

SEQ ID NO: 1360094 - DNA, 21 bp, Homo sapiens
actgccttcgcttcttgcctc

SEQ ID NO: 1360095 - DNA, 18 bp, Homo sapiens
actgcgactttctgcctg

SEQ ID NO: 1360096 - DNA, 21 bp, Homo sapiens
actgcgactttctgcctggag

SEQ ID NO: 1360097 - DNA, 14 bp, Homo sapiens
actgctaaataaaa

SEQ ID NO: 1360098 - DNA, 16 bp, Homo sapiens
actgctaaataaaatt

SEQ ID NO: 1360099 - DNA, 19 bp, Homo sapiens
actgctaaataaaatttgt

SEQ ID NO: 1360100 - DNA, 21 bp, Homo sapiens
actgcttcccttactttgctg

SEQ ID NO: 1360101 - DNA, 15 bp, Homo sapiens
actggaaaggggaga

SEQ ID NO: 1360102 - DNA, 21 bp, Homo sapiens
actggaaaggggagagcctgc

SEQ ID NO: 1360103 - DNA, 13 bp, Homo sapiens
actggaacccttt

SEQ ID NO: 1360104 - DNA, 14 bp, Homo sapiens
actggaaccctttt

SEQ ID NO: 1360105 - DNA, 16 bp, Homo sapiens
actggaacccttttaa

SEQ ID NO: 1360106 - DNA, 15 bp, Homo sapiens
actggagctcatctg

SEQ ID NO: 1360107 - DNA, 18 bp, Homo sapiens
actggcttttattaatgc

SEQ ID NO: 1360108 - DNA, 12 bp, Homo sapiens
actgggccctga

SEQ ID NO: 1360109 - DNA, 14 bp, Homo sapiens
actgggccctgagt

SEQ ID NO: 1360110 - DNA, 15 bp, Homo sapiens
actgggtaggaaaga

SEQ ID NO: 1360111 - DNA, 15 bp, Homo sapiens
actggtaggaccaag

SEQ ID NO: 1360112 - DNA, 17 bp, Homo sapiens
actggttgcatggaaat

SEQ ID NO: 1360113 - DNA, 19 bp, Homo sapiens
actggttgcatggaaatca

SEQ ID NO: 1360114 - DNA, 20 bp, Homo sapiens
actggtttatccacccacaa

SEQ ID NO: 1360115 - DNA, 17 bp, Homo sapiens
actgtaaacttctgcaa

SEQ ID NO: 1360116 - DNA, 16 bp, Homo sapiens
actgtacccaaatgga

SEQ ID NO: 1360117 - DNA, 20 bp, Homo sapiens
actgtagatatgtattcttt

SEQ ID NO: 1360118 - DNA, 16 bp, Homo sapiens
actgtatcattttctt

SEQ ID NO: 1360119 - DNA, 12 bp, Homo sapiens
actgtatttgaa

SEQ ID NO: 1360120 - DNA, 15 bp, Homo sapiens
actgtcaaatgatgt

SEQ ID NO: 1360121 - DNA, 20 bp, Homo sapiens
actgtcaaatgatgtgcaaa

SEQ ID NO: 1360122 - DNA, 15 bp, Homo sapiens
actgtcactcattgc

SEQ ID NO: 1360123 - DNA, 24 bp, Homo sapiens
actgtcactcattgctgagcctct

SEQ ID NO: 1360124 - DNA, 17 bp, Homo sapiens
actgtcctgtcctgctc

SEQ ID NO: 1360125 - DNA, 17 bp, Homo sapiens
actgtctattaatattc

SEQ ID NO: 1360126 - DNA, 14 bp, Homo sapiens
actgtgtaaactca

SEQ ID NO: 1360127 - DNA, 17 bp, Homo sapiens
actgtgtatatttgatt

SEQ ID NO: 1360128 - DNA, 18 bp, Homo sapiens
actgtgtatatttgattt

SEQ ID NO: 1360129 - DNA, 16 bp, Homo sapiens
actgttactgggccct

SEQ ID NO: 1360130 - DNA, 18 bp, Homo sapiens
actgttactgggccctga

SEQ ID NO: 1360131 - DNA, 16 bp, Homo sapiens
actgttcactcactct

SEQ ID NO: 1360132 - DNA, 15 bp, Homo sapiens
actgttctttccagg

SEQ ID NO: 1360133 - DNA, 21 bp, Homo sapiens
actgttgtaagaattctgatt

SEQ ID NO: 1360134 - DNA, 22 bp, Homo sapiens
actgtttaatcatagttactgt

SEQ ID NO: 1360135 - DNA, 13 bp, Homo sapiens
actgtttagattt

SEQ ID NO: 1360136 - DNA, 14 bp, Homo sapiens
actgtttattactt

SEQ ID NO: 1360137 - DNA, 19 bp, Homo sapiens
actgtttctcttgagctgg

SEQ ID NO: 1360138 - DNA, 21 bp, Homo sapiens
actgtttctcttgagctggcc

SEQ ID NO: 1360139 - DNA, 21 bp, Homo sapiens
actgtttgaaaacttcagaag

SEQ ID NO: 1360140 - DNA, 14 bp, Homo sapiens
actgttttatctgg

SEQ ID NO: 1360141 - DNA, 14 bp, Homo sapiens
acttaaaacacgtt

SEQ ID NO: 1360142 - DNA, 18 bp, Homo sapiens
acttaaaacacgttttaa

SEQ ID NO: 1360143 - DNA, 22 bp, Homo sapiens
acttaaagaagtatttttagaa

SEQ ID NO: 1360144 - DNA, 15 bp, Homo sapiens
acttaaatgttatta

SEQ ID NO: 1360145 - DNA, 13 bp, Homo sapiens
acttacttgctta

SEQ ID NO: 1360146 - DNA, 15 bp, Homo sapiens
acttacttgcttatt

SEQ ID NO: 1360147 - DNA, 20 bp, Homo sapiens
acttagaatccctgtgttaa

SEQ ID NO: 1360148 - DNA, 16 bp, Homo sapiens
acttagggcaccaggg

SEQ ID NO: 1360149 - DNA, 23 bp, Homo sapiens
acttagggcaccaggggtttctc

SEQ ID NO: 1360150 - DNA, 13 bp, Homo sapiens
acttattgaatat

SEQ ID NO: 1360151 - DNA, 12 bp, Homo sapiens
acttcatgtaaa

SEQ ID NO: 1360152 - DNA, 13 bp, Homo sapiens
acttcatgtaaag

SEQ ID NO: 1360153 - DNA, 14 bp, Homo sapiens
acttccatgaattt

SEQ ID NO: 1360154 - DNA, 22 bp, Homo sapiens
acttccttgagacacggagccc

SEQ ID NO: 1360155 - DNA, 17 bp, Homo sapiens
acttctacctgccctca

SEQ ID NO: 1360156 - DNA, 13 bp, Homo sapiens
acttctgcctgga

SEQ ID NO: 1360157 - DNA, 16 bp, Homo sapiens
acttcttctcttagat

SEQ ID NO: 1360158 - DNA, 18 bp, Homo sapiens
acttcttctcttagattc

SEQ ID NO: 1360159 - DNA, 22 bp, Homo sapiens
acttcttttttcaaaagaaagt

SEQ ID NO: 1360160 - DNA, 23 bp, Homo sapiens
acttcttttttcaaaagaaagtc

SEQ ID NO: 1360161 - DNA, 20 bp, Homo sapiens
acttgaaaagagacaggcag

SEQ ID NO: 1360162 - DNA, 19 bp, Homo sapiens
acttgaaccataaaatgtc

SEQ ID NO: 1360163 - DNA, 19 bp, Homo sapiens
aaggacaaagtgccaaaga

SEQ ID NO: 1360164 - DNA, 18 bp, Homo sapiens
aaggaccttaagacagag

SEQ ID NO: 1360165 - DNA, 11 bp, Homo sapiens
aaggagagcta

SEQ ID NO: 1360166 - DNA, 13 bp, Homo sapiens
aaggataaagaag

SEQ ID NO: 1360167 - DNA, 15 bp, Homo sapiens
aaggatagtaagcat

SEQ ID NO: 1360168 - DNA, 21 bp, Homo sapiens
aaggcaagagggggtggaggg

SEQ ID NO: 1360169 - DNA, 23 bp, Homo sapiens
aaggcaagccaggctcactcaca

SEQ ID NO: 1360170 - DNA, 18 bp, Homo sapiens
aaggcacttcatgtaaag

SEQ ID NO: 1360171 - DNA, 20 bp, Homo sapiens
aaggcagattttacagagcg

SEQ ID NO: 1360172 - DNA, 17 bp, Homo sapiens
aaggcatctatctgtgc

SEQ ID NO: 1360173 - DNA, 18 bp, Homo sapiens
aaggcatctatctgtgct

SEQ ID NO: 1360174 - DNA, 21 bp, Homo sapiens
aaggcctcttgtaaagactgg

SEQ ID NO: 1360175 - DNA, 17 bp, Homo sapiens
aaggcgctgagactgtg

SEQ ID NO: 1360176 - DNA, 15 bp, Homo sapiens
aaggctatgtgatta

SEQ ID NO: 1360177 - DNA, 14 bp, Homo sapiens
aaggctgggggaag

SEQ ID NO: 1360178 - DNA, 22 bp, Homo sapiens
aaggctgggggaagaagctctc

SEQ ID NO: 1360179 - DNA, 17 bp, Homo sapiens
aaggctgtgctgccctg

SEQ ID NO: 1360180 - DNA, 16 bp, Homo sapiens
aaggcttgaagctgtg

SEQ ID NO: 1360181 - DNA, 16 bp, Homo sapiens
aagggaagatttatgt

SEQ ID NO: 1360182 - DNA, 16 bp, Homo sapiens
aagggagaagaaaggt

SEQ ID NO: 1360183 - DNA, 23 bp, Homo sapiens
aagggatgcaggctcccctgagg

SEQ ID NO: 1360184 - DNA, 15 bp, Homo sapiens
aaggggagagcctgc

SEQ ID NO: 1360185 - DNA, 18 bp, Homo sapiens
aaggggagagcctgctgg

SEQ ID NO: 1360186 - DNA, 15 bp, Homo sapiens
aaggtataataaaat

SEQ ID NO: 1360187 - DNA, 19 bp, Homo sapiens
aaggtatttaaagtatttt

SEQ ID NO: 1360188 - DNA, 22 bp, Homo sapiens
aaggtggattttgtttaaaaaa

SEQ ID NO: 1360189 - DNA, 11 bp, Homo sapiens
aaggtgggagg

SEQ ID NO: 1360190 - DNA, 13 bp, Homo sapiens
aaggtgtttgaaa

SEQ ID NO: 1360191 - DNA, 20 bp, Homo sapiens
aaggtgtttgaaaatagttt

SEQ ID NO: 1360192 - DNA, 15 bp, Homo sapiens
aaggttataattttt

SEQ ID NO: 1360193 - DNA, 14 bp, Homo sapiens
aaggtttttgatag

SEQ ID NO: 1360194 - DNA, 12 bp, Homo sapiens
aagtaactcatt

SEQ ID NO: 1360195 - DNA, 18 bp, Homo sapiens
aagtaagaaagtgaagca

SEQ ID NO: 1360196 - DNA, 21 bp, Homo sapiens
aagtaagaaagtgaagcaaat

SEQ ID NO: 1360197 - DNA, 14 bp, Homo sapiens
aagtaatatttatt

SEQ ID NO: 1360198 - DNA, 22 bp, Homo sapiens
aagtaatatttattaaattttt

SEQ ID NO: 1360199 - DNA, 15 bp, Homo sapiens
aagtaatcatctaag

SEQ ID NO: 1360200 - DNA, 15 bp, Homo sapiens
aagtagaactttgta

SEQ ID NO: 1360201 - DNA, 16 bp, Homo sapiens
aagtagaactttgtat

SEQ ID NO: 1360202 - DNA, 20 bp, Homo sapiens
aagtagttctgtatttgaaa

SEQ ID NO: 1360203 - DNA, 21 bp, Homo sapiens
aagtagttctgtatttgaaag

SEQ ID NO: 1360204 - DNA, 14 bp, Homo sapiens
aagtatgtattatt

SEQ ID NO: 1360205 - DNA, 21 bp, Homo sapiens
aagtatgtattatttacattt

SEQ ID NO: 1360206 - DNA, 14 bp, Homo sapiens
aagtattttttcaa

SEQ ID NO: 1360207 - DNA, 14 bp, Homo sapiens
aagtcagagacaga

SEQ ID NO: 1360208 - DNA, 17 bp, Homo sapiens
aagtcatagccataaat

SEQ ID NO: 1360209 - DNA, 13 bp, Homo sapiens
aagtcatgtatgt

SEQ ID NO: 1360210 - DNA, 16 bp, Homo sapiens
aagtcatgtatgtttc

SEQ ID NO: 1360211 - DNA, 19 bp, Homo sapiens
aagtcatgtatgtttctct

SEQ ID NO: 1360212 - DNA, 13 bp, Homo sapiens
aagtcattaaact

SEQ ID NO: 1360213 - DNA, 16 bp, Homo sapiens
aagtcattaaactggt

SEQ ID NO: 1360214 - DNA, 15 bp, Homo sapiens
aagtctgtctttcct

SEQ ID NO: 1360215 - DNA, 22 bp, Homo sapiens
aagtcttaaggacaaagtgcca

SEQ ID NO: 1360216 - DNA, 14 bp, Homo sapiens
aagtgaaaatggtc

SEQ ID NO: 1360217 - DNA, 14 bp, Homo sapiens
aagtgaagtgatac

SEQ ID NO: 1360218 - DNA, 21 bp, Homo sapiens
aagtgatcaaactacatattg

SEQ ID NO: 1360219 - DNA, 17 bp, Homo sapiens
aagtgatttttttgtcc

SEQ ID NO: 1360220 - DNA, 16 bp, Homo sapiens
aagtgcatttttgtaa

SEQ ID NO: 1360221 - DNA, 21 bp, Homo sapiens
aagtgcctcaagaggaatgaa

SEQ ID NO: 1360222 - DNA, 22 bp, Homo sapiens
aagtgcggggtaggggaagaag

SEQ ID NO: 1360223 - DNA, 18 bp, Homo sapiens
aagtgctattacgaagtt

SEQ ID NO: 1360224 - DNA, 21 bp, Homo sapiens
aagtggaaaaatagcctgcct

SEQ ID NO: 1360225 - DNA, 20 bp, Homo sapiens
aagtggcgtgggagccagcc

SEQ ID NO: 1360226 - DNA, 11 bp, Homo sapiens
aagtgggccca

SEQ ID NO: 1360227 - DNA, 13 bp, Homo sapiens
aagtgggcccacc

SEQ ID NO: 1360228 - DNA, 19 bp, Homo sapiens
aagtgggcccacccggtgg

SEQ ID NO: 1360229 - DNA, 22 bp, Homo sapiens
aagtggtcctagaggccctttg

SEQ ID NO: 1360230 - DNA, 14 bp, Homo sapiens
aagtgtccttcttg

SEQ ID NO: 1360231 - DNA, 15 bp, Homo sapiens
aagtgtgaatactgc

SEQ ID NO: 1360232 - DNA, 13 bp, Homo sapiens
aagtgtggtagag

SEQ ID NO: 1360233 - DNA, 19 bp, Homo sapiens
aagtgtttatgttgtttat

SEQ ID NO: 1360234 - DNA, 23 bp, Homo sapiens
aagttagtttgtatatattatta

SEQ ID NO: 1360235 - DNA, 14 bp, Homo sapiens
aagttatctttgaa

SEQ ID NO: 1360236 - DNA, 15 bp, Homo sapiens
aagttatctttgaat

SEQ ID NO: 1360237 - DNA, 13 bp, Homo sapiens
aagtttgcttaga

SEQ ID NO: 1360238 - DNA, 20 bp, Homo sapiens
aagttttgacaagctggctt

SEQ ID NO: 1360239 - DNA, 13 bp, Homo sapiens
aagttttgtaaaa

SEQ ID NO: 1360240 - DNA, 16 bp, Homo sapiens
aagttttgtaaaagaa

SEQ ID NO: 1360241 - DNA, 19 bp, Homo sapiens
aagttttgtaaaagaaatc

SEQ ID NO: 1360242 - DNA, 14 bp, Homo sapiens
aataaaaaaagaaa

SEQ ID NO: 1360243 - DNA, 14 bp, Homo sapiens
aataaaaatatatt

SEQ ID NO: 1360244 - DNA, 15 bp, Homo sapiens
aataaaaatatattt

SEQ ID NO: 1360245 - DNA, 13 bp, Homo sapiens
aataaaaatggat

SEQ ID NO: 1360246 - DNA, 15 bp, Homo sapiens
aataaaacatagcaa

SEQ ID NO: 1360247 - DNA, 21 bp, Homo sapiens
aataaaaccgaaggtgaaaaa

SEQ ID NO: 1360248 - DNA, 15 bp, Homo sapiens
aataaaatatatctt

SEQ ID NO: 1360249 - DNA, 12 bp, Homo sapiens
aataaaatttgt

SEQ ID NO: 1360250 - DNA, 12 bp, Homo sapiens
aataaagcttgt

SEQ ID NO: 1360251 - DNA, 15 bp, Homo sapiens
aataaatatatacat

SEQ ID NO: 1360252 - DNA, 15 bp, Homo sapiens
aataaatgccctctt

SEQ ID NO: 1360253 - DNA, 16 bp, Homo sapiens
aataaatgccctcttc

SEQ ID NO: 1360254 - DNA, 11 bp, Homo sapiens
aataaatgtgt

SEQ ID NO: 1360255 - DNA, 12 bp, Homo sapiens
aataaatgtgtt

SEQ ID NO: 1360256 - DNA, 13 bp, Homo sapiens
aataaattttgaa

SEQ ID NO: 1360257 - DNA, 18 bp, Homo sapiens
aataaattttgaaaagta

SEQ ID NO: 1360258 - DNA, 16 bp, Homo sapiens
aataactgtgtactgt

SEQ ID NO: 1360259 - DNA, 16 bp, Homo sapiens
aataagtatttataat

SEQ ID NO: 1360260 - DNA, 22 bp, Homo sapiens
aataagtgtgtggtagaaacaa

SEQ ID NO: 1360261 - DNA, 23 bp, Homo sapiens
aataagtgtgtggtagaaacaaa

SEQ ID NO: 1360262 - DNA, 11 bp, Homo sapiens
aataagttatt

SEQ ID NO: 1360263 - DNA, 13 bp, Homo sapiens
aataagttattgc

SEQ ID NO: 1360264 - DNA, 14 bp, Homo sapiens
aataatagactgta

SEQ ID NO: 1360265 - DNA, 17 bp, Homo sapiens
aataatatattttctgt

SEQ ID NO: 1360266 - DNA, 19 bp, Homo sapiens
aataatatattttctgttt

SEQ ID NO: 1360267 - DNA, 20 bp, Homo sapiens
aataattcttttttattaat

SEQ ID NO: 1360268 - DNA, 21 bp, Homo sapiens
aataattcttttttattaatc

SEQ ID NO: 1360269 - DNA, 18 bp, Homo sapiens
aataattttcattttgca

SEQ ID NO: 1360270 - DNA, 20 bp, Homo sapiens
aatacaaaaattagccgggc

SEQ ID NO: 1360271 - DNA, 13 bp, Homo sapiens
aatacaaggtata

SEQ ID NO: 1360272 - DNA, 18 bp, Homo sapiens
aatgcatatttgcaaagt

SEQ ID NO: 1360273 - DNA, 14 bp, Homo sapiens
aatgcatctttgat

SEQ ID NO: 1360274 - DNA, 19 bp, Homo sapiens
aatgcatctttgatgtgtt

SEQ ID NO: 1360275 - DNA, 11 bp, Homo sapiens
aatgccctctt

SEQ ID NO: 1360276 - DNA, 16 bp, Homo sapiens
aatgctacaattttaa

SEQ ID NO: 1360277 - DNA, 20 bp, Homo sapiens
aatgctccccacagcgtccc

SEQ ID NO: 1360278 - DNA, 18 bp, Homo sapiens
aatgctttatttgtaaat

SEQ ID NO: 1360279 - DNA, 22 bp, Homo sapiens
aatgctttatttgtaaatttag

SEQ ID NO: 1360280 - DNA, 19 bp, Homo sapiens
aatggaaagtaactcattt

SEQ ID NO: 1360281 - DNA, 16 bp, Homo sapiens
aatggaaattttgcta

SEQ ID NO: 1360282 - DNA, 18 bp, Homo sapiens
aatggaataaaaggcttg

SEQ ID NO: 1360283 - DNA, 22 bp, Homo sapiens
aatggcctcatgtggctggaag

SEQ ID NO: 1360284 - DNA, 17 bp, Homo sapiens
aatggctgtaatcattt

SEQ ID NO: 1360285 - DNA, 19 bp, Homo sapiens
aatgggctctccggggcca

SEQ ID NO: 1360286 - DNA, 15 bp, Homo sapiens
aatgggttacttgat

SEQ ID NO: 1360287 - DNA, 14 bp, Homo sapiens
aatggtaataagca

SEQ ID NO: 1360288 - DNA, 13 bp, Homo sapiens
aatgtaatttaaa

SEQ ID NO: 1360289 - DNA, 17 bp, Homo sapiens
aatgtacagttgaaata

SEQ ID NO: 1360290 - DNA, 18 bp, Homo sapiens
aatgtacgtccagcctgc

SEQ ID NO: 1360291 - DNA, 23 bp, Homo sapiens
aatgtagcgactgtcaacagcgt

SEQ ID NO: 1360292 - DNA, 16 bp, Homo sapiens
aatgtaggcttagttt

SEQ ID NO: 1360293 - DNA, 18 bp, Homo sapiens
aatgtaggtcctcagaaa

SEQ ID NO: 1360294 - DNA, 19 bp, Homo sapiens
aatgtcaaaagtagaactt

SEQ ID NO: 1360295 - DNA, 22 bp, Homo sapiens
aatgtctagttgtaacaccatg

SEQ ID NO: 1360296 - DNA, 20 bp, Homo sapiens
aatgtctcaaggcagttaat

SEQ ID NO: 1360297 - DNA, 16 bp, Homo sapiens
aatgtctgtaataata

SEQ ID NO: 1360298 - DNA, 17 bp, Homo sapiens
aatgtctgtaataatag

SEQ ID NO: 1360299 - DNA, 15 bp, Homo sapiens
aatgtgaaaagaaaa

SEQ ID NO: 1360300 - DNA, 18 bp, Homo sapiens
aatgttaaagggatattt

SEQ ID NO: 1360301 - DNA, 16 bp, Homo sapiens
aatgttacctctgaat

SEQ ID NO: 1360302 - DNA, 18 bp, Homo sapiens
aatgttcacaatatattt

SEQ ID NO: 1360303 - DNA, 22 bp, Homo sapiens
aatgttgggactgctaaataaa

SEQ ID NO: 1360304 - DNA, 17 bp, Homo sapiens
aatgtttcttttgtttg

SEQ ID NO: 1360305 - DNA, 20 bp, Homo sapiens
aatgtttggcatgtaaatgt

SEQ ID NO: 1360306 - DNA, 16 bp, Homo sapiens
aatgttttgtaaacat

SEQ ID NO: 1360307 - DNA, 23 bp, Homo sapiens
aattaagcaaatgttaaaagttt

SEQ ID NO: 1360308 - DNA, 20 bp, Homo sapiens
aattaaggtgtttgaaaata

SEQ ID NO: 1360309 - DNA, 13 bp, Homo sapiens
aattaattgtgtg

SEQ ID NO: 1360310 - DNA, 14 bp, Homo sapiens
aattacgtgctctg

SEQ ID NO: 1360311 - DNA, 20 bp, Homo sapiens
aattaggaataaataaaaat

SEQ ID NO: 1360312 - DNA, 14 bp, Homo sapiens
aattatactacttt

SEQ ID NO: 1360313 - DNA, 17 bp, Homo sapiens
aattatgagattggttt

SEQ ID NO: 1360314 - DNA, 14 bp, Homo sapiens
aattattgacactg

SEQ ID NO: 1360315 - DNA, 17 bp, Homo sapiens
aattattgacactgaac

SEQ ID NO: 1360316 - DNA, 12 bp, Homo sapiens
aattctcctgga

SEQ ID NO: 1360317 - DNA, 15 bp, Homo sapiens
aattctgatttcttt

SEQ ID NO: 1360318 - DNA, 22 bp, Homo sapiens
aattctgatttcttttcaccat

SEQ ID NO: 1360319 - DNA, 21 bp, Homo sapiens
aattctgtttttaatgctatt

SEQ ID NO: 1360320 - DNA, 11 bp, Homo sapiens
aattcttaaaa

SEQ ID NO: 1360321 - DNA, 13 bp, Homo sapiens
aattcttttttat

SEQ ID NO: 1360322 - DNA, 14 bp, Homo sapiens
aattcttttttatt

SEQ ID NO: 1360323 - DNA, 16 bp, Homo sapiens
aattcttttttattaa

SEQ ID NO: 1360324 - DNA, 18 bp, Homo sapiens
aattgaaggtttttgata

SEQ ID NO: 1360325 - DNA, 21 bp, Homo sapiens
aattgaaggtttttgatagca

SEQ ID NO: 1360326 - DNA, 17 bp, Homo sapiens
aattgaagtgtataata

SEQ ID NO: 1360327 - DNA, 21 bp, Homo sapiens
aattgaagtgtataatataaa

SEQ ID NO: 1360328 - DNA, 22 bp, Homo sapiens
aattgaagtgtataatataaaa

SEQ ID NO: 1360329 - DNA, 23 bp, Homo sapiens
aattggacagattgcctgtttct

SEQ ID NO: 1360330 - DNA, 14 bp, Homo sapiens
aattgtatttttgt

SEQ ID NO: 1360331 - DNA, 19 bp, Homo sapiens
aattgtatttttgttgttg

SEQ ID NO: 1360332 - DNA, 19 bp, Homo sapiens
aattgtggctatcctgatt

SEQ ID NO: 1360333 - DNA, 18 bp, Homo sapiens
aattgtgtgaacttggaa

SEQ ID NO: 1360334 - DNA, 23 bp, Homo sapiens
aattgttccttggagaaatgaaa

SEQ ID NO: 1360335 - DNA, 13 bp, Homo sapiens
aattgttctcaga

SEQ ID NO: 1360336 - DNA, 14 bp, Homo sapiens
aattgtttcagaat

SEQ ID NO: 1360337 - DNA, 14 bp, Homo sapiens
aatttaaaaaataa

SEQ ID NO: 1360338 - DNA, 14 bp, Homo sapiens
aatttaaaaatata

SEQ ID NO: 1360339 - DNA, 20 bp, Homo sapiens
aatttaagttttgacaagct

SEQ ID NO: 1360340 - DNA, 14 bp, Homo sapiens
aatttatttccact

SEQ ID NO: 1360341 - DNA, 20 bp, Homo sapiens
aatttatttccactaaaaat

SEQ ID NO: 1360342 - DNA, 16 bp, Homo sapiens
aatttcagggtgcagc

SEQ ID NO: 1360343 - DNA, 18 bp, Homo sapiens
aatttcatgtaaaacaga

SEQ ID NO: 1360344 - DNA, 20 bp, Homo sapiens
aatttcctttttgacactga

SEQ ID NO: 1360345 - DNA, 12 bp, Homo sapiens
aatttctgtgcc

SEQ ID NO: 1360346 - DNA, 19 bp, Homo sapiens
aatttctgtgccctcctga

SEQ ID NO: 1360347 - DNA, 14 bp, Homo sapiens
aatttcttatgtga

SEQ ID NO: 1360348 - DNA, 20 bp, Homo sapiens
aatttcttatgtgacattaa

SEQ ID NO: 1360349 - DNA, 14 bp, Homo sapiens
aatttgaagtaatg

SEQ ID NO: 1360350 - DNA, 12 bp, Homo sapiens
aatttgttgcat

SEQ ID NO: 1360351 - DNA, 16 bp, Homo sapiens
aattttaaagtgcaaa

SEQ ID NO: 1360352 - DNA, 23 bp, Homo sapiens
aattttacaagggcataaagtaa

SEQ ID NO: 1360353 - DNA, 19 bp, Homo sapiens
aattttatctgtttcctga

SEQ ID NO: 1360354 - DNA, 22 bp, Homo sapiens
aattttcaactgtcttcctcaa

SEQ ID NO: 1360355 - DNA, 15 bp, Homo sapiens
aattttcaagtaatt

SEQ ID NO: 1360356 - DNA, 12 bp, Homo sapiens
aattttcagcat

SEQ ID NO: 1360357 - DNA, 13 bp, Homo sapiens
aattttgaaaagt

SEQ ID NO: 1360358 - DNA, 20 bp, Homo sapiens
aattttgaaaagtaatattt

SEQ ID NO: 1360359 - DNA, 23 bp, Homo sapiens
aattttgataaaaatttagaaca

SEQ ID NO: 1360360 - DNA, 13 bp, Homo sapiens
aattttgtaagaa

SEQ ID NO: 1360361 - DNA, 13 bp, Homo sapiens
aattttgtacaaa

SEQ ID NO: 1360362 - DNA, 16 bp, Homo sapiens
aattttgtatgttaaa

SEQ ID NO: 1360363 - DNA, 12 bp, Homo sapiens
aatttttaaaaa

SEQ ID NO: 1360364 - DNA, 13 bp, Homo sapiens
aatttttattgtt

SEQ ID NO: 1360365 - DNA, 12 bp, Homo sapiens
aatttttgtatt

SEQ ID NO: 1360366 - DNA, 13 bp, Homo sapiens
aattttttgactt

SEQ ID NO: 1360367 - DNA, 17 bp, Homo sapiens
aatttttttgtatgaaa

SEQ ID NO: 1360368 - DNA, 18 bp, Homo sapiens
aatttttttgtatgaaaa

SEQ ID NO: 1360369 - DNA, 19 bp, Homo sapiens
aatttttttgtatgaaaac

SEQ ID NO: 1360370 - DNA, 15 bp, Homo sapiens
aattttttttagtat

SEQ ID NO: 1360371 - DNA, 20 bp, Homo sapiens
aattttttttagtatttatt

SEQ ID NO: 1360372 - DNA, 20 bp, Homo sapiens
acaaaaaccaaatgtttatt

SEQ ID NO: 1360373 - DNA, 13 bp, Homo sapiens
acaaaagagcagt

SEQ ID NO: 1360374 - DNA, 21 bp, Homo sapiens
acaaaagtctgtctttcctga

SEQ ID NO: 1360375 - DNA, 13 bp, Homo sapiens
acaaaatttgact

SEQ ID NO: 1360376 - DNA, 22 bp, Homo sapiens
acaaacatctaataagtatata

SEQ ID NO: 1360377 - DNA, 22 bp, Homo sapiens
acaaactgcttcccttactttg

SEQ ID NO: 1360378 - DNA, 23 bp, Homo sapiens
acaaagtgccaaagaaagtggtc

SEQ ID NO: 1360379 - DNA, 14 bp, Homo sapiens
acaaataatttaga

SEQ ID NO: 1360380 - DNA, 12 bp, Homo sapiens
acaaatgacttt

SEQ ID NO: 1360381 - DNA, 13 bp, Homo sapiens
acaaatgacttta

SEQ ID NO: 1360382 - DNA, 15 bp, Homo sapiens
acaaatgcatctttg

SEQ ID NO: 1360383 - DNA, 20 bp, Homo sapiens
acaaatgcatctttgatgtg

SEQ ID NO: 1360384 - DNA, 14 bp, Homo sapiens
acaaattatttttg

SEQ ID NO: 1360385 - DNA, 14 bp, Homo sapiens
acaactgtgactgt

SEQ ID NO: 1360386 - DNA, 14 bp, Homo sapiens
acaacttaaataat

SEQ ID NO: 1360387 - DNA, 19 bp, Homo sapiens
acaagaacacacacatata

SEQ ID NO: 1360388 - DNA, 22 bp, Homo sapiens
acaagattttttaattgtttaa

SEQ ID NO: 1360389 - DNA, 19 bp, Homo sapiens
acaagcatgcagctttgca

SEQ ID NO: 1360390 - DNA, 14 bp, Homo sapiens
acctgcataaaaag

SEQ ID NO: 1360391 - DNA, 18 bp, Homo sapiens
acctgccaggcaggggtg

SEQ ID NO: 1360392 - DNA, 14 bp, Homo sapiens
acctgccctcaagg

SEQ ID NO: 1360393 - DNA, 15 bp, Homo sapiens
acctgccctcaaggg

SEQ ID NO: 1360394 - DNA, 17 bp, Homo sapiens
acctgccctcaagggtg

SEQ ID NO: 1360395 - DNA, 21 bp, Homo sapiens
acctggcatcgcaccattctg

SEQ ID NO: 1360396 - DNA, 20 bp, Homo sapiens
acctggccgcggagcctgca

SEQ ID NO: 1360397 - DNA, 20 bp, Homo sapiens
acctggggctgctgtgaagc

SEQ ID NO: 1360398 - DNA, 21 bp, Homo sapiens
acctgggtaactagggaagat

SEQ ID NO: 1360399 - DNA, 13 bp, Homo sapiens
accttaggccttc

SEQ ID NO: 1360400 - DNA, 20 bp, Homo sapiens
accttaggccttcctctctc

SEQ ID NO: 1360401 - DNA, 14 bp, Homo sapiens
accttcccaaacgc

SEQ ID NO: 1360402 - DNA, 21 bp, Homo sapiens
accttcccaaacgcctcccct

SEQ ID NO: 1360403 - DNA, 17 bp, Homo sapiens
accttctatagcatcac

SEQ ID NO: 1360404 - DNA, 16 bp, Homo sapiens
accttcttctcctaca

SEQ ID NO: 1360405 - DNA, 18 bp, Homo sapiens
accttggacatcctcctc

SEQ ID NO: 1360406 - DNA, 13 bp, Homo sapiens
accttggcctggg

SEQ ID NO: 1360407 - DNA, 15 bp, Homo sapiens
accttggcctgggcc

SEQ ID NO: 1360408 - DNA, 16 bp, Homo sapiens
accttggcctgggccg

SEQ ID NO: 1360409 - DNA, 12 bp, Homo sapiens
accttgtaaaag

SEQ ID NO: 1360410 - DNA, 13 bp, Homo sapiens
accttgtaaaaga

SEQ ID NO: 1360411 - DNA, 17 bp, Homo sapiens
accttgttacttctgag

SEQ ID NO: 1360412 - DNA, 14 bp, Homo sapiens
acctttcaaagctt

SEQ ID NO: 1360413 - DNA, 14 bp, Homo sapiens
acctttccctcacc

SEQ ID NO: 1360414 - DNA, 17 bp, Homo sapiens
acctttccctcaccccc

SEQ ID NO: 1360415 - DNA, 11 bp, Homo sapiens
accttttactg

SEQ ID NO: 1360416 - DNA, 14 bp, Homo sapiens
accttttactgtga

SEQ ID NO: 1360417 - DNA, 15 bp, Homo sapiens
accttttcagggctg

SEQ ID NO: 1360418 - DNA, 17 bp, Homo sapiens
acgaaatatcaaagtca

SEQ ID NO: 1360419 - DNA, 20 bp, Homo sapiens
acgacacgggtggggaaagg

SEQ ID NO: 1360420 - DNA, 16 bp, Homo sapiens
acgatcacaaatgact

SEQ ID NO: 1360421 - DNA, 18 bp, Homo sapiens
acgatcacaaatgacttt

SEQ ID NO: 1360422 - DNA, 12 bp, Homo sapiens
acgatttaaggt

SEQ ID NO: 1360423 - DNA, 12 bp, Homo sapiens
acgccactcatt

SEQ ID NO: 1360424 - DNA, 16 bp, Homo sapiens
acgccactcatttcat

SEQ ID NO: 1360425 - DNA, 20 bp, Homo sapiens
acgcccacccaaccccaagc

SEQ ID NO: 1360426 - DNA, 15 bp, Homo sapiens
acgcctcttgaccag

SEQ ID NO: 1360427 - DNA, 18 bp, Homo sapiens
acgctaaagagcccttgc

SEQ ID NO: 1360428 - DNA, 19 bp, Homo sapiens
acggacactcaaaagctgg

SEQ ID NO: 1360429 - DNA, 15 bp, Homo sapiens
acggagcccagccct

SEQ ID NO: 1360430 - DNA, 23 bp, Homo sapiens
acggaggcaaagctggctcacct

SEQ ID NO: 1360431 - DNA, 21 bp, Homo sapiens
acggaggcctgcgaccctggg

SEQ ID NO: 1360432 - DNA, 18 bp, Homo sapiens
acggcaggctcactgcca

SEQ ID NO: 1360433 - DNA, 16 bp, Homo sapiens
acggccaagaatgtac

SEQ ID NO: 1360434 - DNA, 23 bp, Homo sapiens
acgggacatcacagggtgggcct

SEQ ID NO: 1360435 - DNA, 15 bp, Homo sapiens
acggtgcccaagcca

SEQ ID NO: 1360436 - DNA, 18 bp, Homo sapiens
acggtgctgtgagggagg

SEQ ID NO: 1360437 - DNA, 16 bp, Homo sapiens
acgtacaagtagttct

SEQ ID NO: 1360438 - DNA, 13 bp, Homo sapiens
acgtacatgttta

SEQ ID NO: 1360439 - DNA, 18 bp, Homo sapiens
acgtcagacttggctcag

SEQ ID NO: 1360440 - DNA, 20 bp, Homo sapiens
acgtcagatgtttaaaacac

SEQ ID NO: 1360441 - DNA, 21 bp, Homo sapiens
acgtgaccggacttttctgca

SEQ ID NO: 1360442 - DNA, 20 bp, Homo sapiens
acgtgatcctctcacctcag

SEQ ID NO: 1360443 - DNA, 18 bp, Homo sapiens
acgttggagaagcccgtg

SEQ ID NO: 1360444 - DNA, 11 bp, Homo sapiens
acgtttataaa

SEQ ID NO: 1360445 - DNA, 14 bp, Homo sapiens
acgtttataaacag

SEQ ID NO: 1360446 - DNA, 19 bp, Homo sapiens
acgtttataaacagaaatg

SEQ ID NO: 1360447 - DNA, 20 bp, Homo sapiens
acgtttctttaaccttgtat

SEQ ID NO: 1360448 - DNA, 12 bp, Homo sapiens
acgttttaagga

SEQ ID NO: 1360449 - DNA, 18 bp, Homo sapiens
acgttttaaggactgact

SEQ ID NO: 1360450 - DNA, 19 bp, Homo sapiens
acgttttaaggactgactg

SEQ ID NO: 1360451 - DNA, 20 bp, Homo sapiens
actaaaaagtataaaatagt

SEQ ID NO: 1360452 - DNA, 15 bp, Homo sapiens
actaaagcaatagaa

SEQ ID NO: 1360453 - DNA, 19 bp, Homo sapiens
actaaagcaatagaaacaa

SEQ ID NO: 1360454 - DNA, 12 bp, Homo sapiens
actaaagcatga

SEQ ID NO: 1360455 - DNA, 15 bp, Homo sapiens
actaaagcatgaaat

SEQ ID NO: 1360456 - DNA, 20 bp, Homo sapiens
actaaagcatgaaatgtgaa

SEQ ID NO: 1360457 - DNA, 22 bp, Homo sapiens
actaacgaaatatcaaagtcat

SEQ ID NO: 1360458 - DNA, 15 bp, Homo sapiens
actaactcaaataca

SEQ ID NO: 1360459 - DNA, 22 bp, Homo sapiens
actaactcaaatacacatttgc

SEQ ID NO: 1360460 - DNA, 16 bp, Homo sapiens
actaagagaagttgta

SEQ ID NO: 1360461 - DNA, 19 bp, Homo sapiens
actaatattttatgtgaga

SEQ ID NO: 1360462 - DNA, 21 bp, Homo sapiens
actaattatactactttgtta

SEQ ID NO: 1360463 - DNA, 15 bp, Homo sapiens
actaattttacatgt

SEQ ID NO: 1360464 - DNA, 13 bp, Homo sapiens
actacaagtcagc

SEQ ID NO: 1360465 - DNA, 19 bp, Homo sapiens
actacccatagacatgaaa

SEQ ID NO: 1360466 - DNA, 14 bp, Homo sapiens
actactagattgac

SEQ ID NO: 1360467 - DNA, 23 bp, Homo sapiens
actacttcttttttcaaaagaaa

SEQ ID NO: 1360468 - DNA, 21 bp, Homo sapiens
actagaggaaaccagtttggt

SEQ ID NO: 1360469 - DNA, 13 bp, Homo sapiens
actagattgacta

SEQ ID NO: 1360470 - DNA, 18 bp, Homo sapiens
actagcaaaataaaacat

SEQ ID NO: 1360471 - DNA, 19 bp, Homo sapiens
actagcaaaataaaacata

SEQ ID NO: 1360472 - DNA, 17 bp, Homo sapiens
actagggaagataatat

SEQ ID NO: 1360473 - DNA, 20 bp, Homo sapiens
actagtggggtttcctggca

SEQ ID NO: 1360474 - DNA, 14 bp, Homo sapiens
actataaaacaaaa

SEQ ID NO: 1360475 - DNA, 20 bp, Homo sapiens
actatagcttgcagaactgt

SEQ ID NO: 1360476 - DNA, 15 bp, Homo sapiens
actatattttgtcat

SEQ ID NO: 1360477 - DNA, 16 bp, Homo sapiens
actatattttgtcata

SEQ ID NO: 1360478 - DNA, 23 bp, Homo sapiens
actatgcgtggctggaaccacat

SEQ ID NO: 1360479 - DNA, 22 bp, Homo sapiens
actatggtagccagatgataaa

SEQ ID NO: 1360480 - DNA, 18 bp, Homo sapiens
actatttaagatgtgaaa

SEQ ID NO: 1360481 - DNA, 18 bp, Homo sapiens
actcaaaagctgggcagg

SEQ ID NO: 1360482 - DNA, 17 bp, Homo sapiens
actcaaactcttaaaac

SEQ ID NO: 1360483 - DNA, 15 bp, Homo sapiens
actcaaatacacatt

SEQ ID NO: 1360484 - DNA, 16 bp, Homo sapiens
actcaaatacacattt

SEQ ID NO: 1360485 - DNA, 18 bp, Homo sapiens
actcaagcgggtggctct

SEQ ID NO: 1360486 - DNA, 15 bp, Homo sapiens
actcaatgctttatt

SEQ ID NO: 1360487 - DNA, 18 bp, Homo sapiens
actcaatgctttatttgt

SEQ ID NO: 1360488 - DNA, 22 bp, Homo sapiens
actcaatgctttatttgtaaat

SEQ ID NO: 1360489 - DNA, 18 bp, Homo sapiens
actcacagagtcaaggcc

SEQ ID NO: 1360490 - DNA, 19 bp, Homo sapiens
actcacagagtcaaggcct

SEQ ID NO: 1360491 - DNA, 14 bp, Homo sapiens
actcaccagcccca

SEQ ID NO: 1360492 - DNA, 20 bp, Homo sapiens
actcaccagccccactgcca

SEQ ID NO: 1360493 - DNA, 21 bp, Homo sapiens
actcaccagccccactgccag

SEQ ID NO: 1360494 - DNA, 22 bp, Homo sapiens
actcaccagccccactgccagc

SEQ ID NO: 1360495 - DNA, 23 bp, Homo sapiens
actcaccagccccactgccagca

SEQ ID NO: 1360496 - DNA, 14 bp, Homo sapiens
actcactaggcccc

SEQ ID NO: 1360497 - DNA, 17 bp, Homo sapiens
actcactaggcccccac

SEQ ID NO: 1360498 - DNA, 13 bp, Homo sapiens
actcactctaaag

SEQ ID NO: 1360499 - DNA, 22 bp, Homo sapiens
actcactggggcctacagcttt

SEQ ID NO: 1360500 - DNA, 22 bp, Homo sapiens
actcagagaaaaatgctcccca

SEQ ID NO: 1360501 - DNA, 13 bp, Homo sapiens
actcaggtgggcc

SEQ ID NO: 1360502 - DNA, 12 bp, Homo sapiens
actcagtgcaga

SEQ ID NO: 1360503 - DNA, 17 bp, Homo sapiens
actcatctgaaatgtta

SEQ ID NO: 1360504 - DNA, 19 bp, Homo sapiens
actcatctgaaatgttaca

SEQ ID NO: 1360505 - DNA, 19 bp, Homo sapiens
actcatctggagttctcaa

SEQ ID NO: 1360506 - DNA, 19 bp, Homo sapiens
actcatcttatatgggaaa

SEQ ID NO: 1360507 - DNA, 18 bp, Homo sapiens
actcattgctgagcctct

SEQ ID NO: 1360508 - DNA, 21 bp, Homo sapiens
actcattgctgagcctctgct

SEQ ID NO: 1360509 - DNA, 22 bp, Homo sapiens
actcattgctgagcctctgctc

SEQ ID NO: 1360510 - DNA, 23 bp, Homo sapiens
actcattgctgagcctctgctcc

SEQ ID NO: 1360511 - DNA, 17 bp, Homo sapiens
agtttgaggattagttt

SEQ ID NO: 1360512 - DNA, 13 bp, Homo sapiens
agtttgcttagaa

SEQ ID NO: 1360513 - DNA, 17 bp, Homo sapiens
agtttgtcgctcatgtg

SEQ ID NO: 1360514 - DNA, 19 bp, Homo sapiens
agtttgtcgctcatgtgtg

SEQ ID NO: 1360515 - DNA, 14 bp, Homo sapiens
agtttgtgtgttgt

SEQ ID NO: 1360516 - DNA, 14 bp, Homo sapiens
agttttatttatat

SEQ ID NO: 1360517 - DNA, 19 bp, Homo sapiens
agttttcagaaaaagaaat

SEQ ID NO: 1360518 - DNA, 14 bp, Homo sapiens
agttttgacaagct

SEQ ID NO: 1360519 - DNA, 15 bp, Homo sapiens
agttttgacaagctg

SEQ ID NO: 1360520 - DNA, 13 bp, Homo sapiens
agttttgttgtac

SEQ ID NO: 1360521 - DNA, 23 bp, Homo sapiens
agttttgttgtacttaaatggta

SEQ ID NO: 1360522 - DNA, 17 bp, Homo sapiens
agtttttacaagatgta

SEQ ID NO: 1360523 - DNA, 12 bp, Homo sapiens
agtttttttgct

SEQ ID NO: 1360524 - DNA, 12 bp, Homo sapiens
ataaaaatatat

SEQ ID NO: 1360525 - DNA, 13 bp, Homo sapiens
ataaaaatatatt

SEQ ID NO: 1360526 - DNA, 12 bp, Homo sapiens
ataaaaatggat

SEQ ID NO: 1360527 - DNA, 14 bp, Homo sapiens
ataaaaatgtcttg

SEQ ID NO: 1360528 - DNA, 17 bp, Homo sapiens
ataaaatacatagtgaa

SEQ ID NO: 1360529 - DNA, 22 bp, Homo sapiens
ataaaatagatataaattttta

SEQ ID NO: 1360530 - DNA, 15 bp, Homo sapiens
ataaaatataaacaa

SEQ ID NO: 1360531 - DNA, 14 bp, Homo sapiens
ataaaatcctgtgc

SEQ ID NO: 1360532 - DNA, 13 bp, Homo sapiens
ataaaatgaaaat

SEQ ID NO: 1360533 - DNA, 12 bp, Homo sapiens
ataaaatttaaa

SEQ ID NO: 1360534 - DNA, 22 bp, Homo sapiens
ataaacagtggaatataaggaa

SEQ ID NO: 1360535 - DNA, 15 bp, Homo sapiens
ataaaccactgtgcg

SEQ ID NO: 1360536 - DNA, 20 bp, Homo sapiens
ataaagagagaacaggacta

SEQ ID NO: 1360537 - DNA, 16 bp, Homo sapiens
ataaagtaaatacatg

SEQ ID NO: 1360538 - DNA, 22 bp, Homo sapiens
ataaagtggaagtatgtatatt

SEQ ID NO: 1360539 - DNA, 19 bp, Homo sapiens
ataaagtttgcttagaaaa

SEQ ID NO: 1360540 - DNA, 19 bp, Homo sapiens
ataaataactcaatggaaa

SEQ ID NO: 1360541 - DNA, 13 bp, Homo sapiens
ataaatccagtga

SEQ ID NO: 1360542 - DNA, 14 bp, Homo sapiens
ataaatccagtgac

SEQ ID NO: 1360543 - DNA, 23 bp, Homo sapiens
ataaatccagtgacctctctctc

SEQ ID NO: 1360544 - DNA, 19 bp, Homo sapiens
ataaatgtataaatataca

SEQ ID NO: 1360545 - DNA, 16 bp, Homo sapiens
ataaattttgaaaagt

SEQ ID NO: 1360546 - DNA, 22 bp, Homo sapiens
ataaattttgaaaagtaatatt

SEQ ID NO: 1360547 - DNA, 12 bp, Homo sapiens
ataacacatttt

SEQ ID NO: 1360548 - DNA, 22 bp, Homo sapiens
ataacagctgcaattccctgga

SEQ ID NO: 1360549 - DNA, 17 bp, Homo sapiens
ataacatccagagcttt

SEQ ID NO: 1360550 - DNA, 15 bp, Homo sapiens
ataactcaatggaaa

SEQ ID NO: 1360551 - DNA, 16 bp, Homo sapiens
ataactgtgtactgtt

SEQ ID NO: 1360552 - DNA, 22 bp, Homo sapiens
ataagaaataatgctacaattt

SEQ ID NO: 1360553 - DNA, 12 bp, Homo sapiens
ataagaatttgc

SEQ ID NO: 1360554 - DNA, 14 bp, Homo sapiens
ataagatgactgtg

SEQ ID NO: 1360555 - DNA, 17 bp, Homo sapiens
ataagctactagcaaaa

SEQ ID NO: 1360556 - DNA, 21 bp, Homo sapiens
ataagctagttgaatacttga

SEQ ID NO: 1360557 - DNA, 22 bp, Homo sapiens
ataagctagttgaatacttgaa

SEQ ID NO: 1360558 - DNA, 22 bp, Homo sapiens
ataagcttccattttaatttta

SEQ ID NO: 1360559 - DNA, 18 bp, Homo sapiens
ataaggaaagcaataaat

SEQ ID NO: 1360560 - DNA, 12 bp, Homo sapiens
ataaggaaattt

SEQ ID NO: 1360561 - DNA, 15 bp, Homo sapiens
ataagtgaagtgata

SEQ ID NO: 1360562 - DNA, 21 bp, Homo sapiens
ataagttattgcagtttatca

SEQ ID NO: 1360563 - DNA, 17 bp, Homo sapiens
ataataaaaaaagaaag

SEQ ID NO: 1360564 - DNA, 13 bp, Homo sapiens
ataataaaaatat

SEQ ID NO: 1360565 - DNA, 15 bp, Homo sapiens
ataataaaaatatat

SEQ ID NO: 1360566 - DNA, 19 bp, Homo sapiens
ataataaaaatatattttc

SEQ ID NO: 1360567 - DNA, 13 bp, Homo sapiens
ataataaaattat

SEQ ID NO: 1360568 - DNA, 13 bp, Homo sapiens
ataataaatatat

SEQ ID NO: 1360569 - DNA, 19 bp, Homo sapiens
ataatacagtatctcaggg

SEQ ID NO: 1360570 - DNA, 14 bp, Homo sapiens
atagcaaatgacat

SEQ ID NO: 1360571 - DNA, 17 bp, Homo sapiens
atagcaacaacaattgg

SEQ ID NO: 1360572 - DNA, 22 bp, Homo sapiens
atagcaacttttgtgtaatgaa

SEQ ID NO: 1360573 - DNA, 15 bp, Homo sapiens
atagcatcacttaaa

SEQ ID NO: 1360574 - DNA, 20 bp, Homo sapiens
atagcatcacttaaaacacg

SEQ ID NO: 1360575 - DNA, 16 bp, Homo sapiens
atagcatgaaataaaa

SEQ ID NO: 1360576 - DNA, 19 bp, Homo sapiens
atagcctatggcagaaaaa

SEQ ID NO: 1360577 - DNA, 11 bp, Homo sapiens
atagcctggac

SEQ ID NO: 1360578 - DNA, 14 bp, Homo sapiens
atagctaactgtaa

SEQ ID NO: 1360579 - DNA, 16 bp, Homo sapiens
atagctaactgtaaat

SEQ ID NO: 1360580 - DNA, 23 bp, Homo sapiens
atagctccccgcttctgcctgca

SEQ ID NO: 1360581 - DNA, 16 bp, Homo sapiens
ataggaacatatgaaa

SEQ ID NO: 1360582 - DNA, 18 bp, Homo sapiens
ataggaacatatgaaaat

SEQ ID NO: 1360583 - DNA, 21 bp, Homo sapiens
ataggaatcattcagaaatgt

SEQ ID NO: 1360584 - DNA, 20 bp, Homo sapiens
ataggacctttccaccacag

SEQ ID NO: 1360585 - DNA, 21 bp, Homo sapiens
ataggagtggtgatttgaaaa

SEQ ID NO: 1360586 - DNA, 20 bp, Homo sapiens
ataggctattttctaaagac

SEQ ID NO: 1360587 - DNA, 17 bp, Homo sapiens
atagggaatatatctct

SEQ ID NO: 1360588 - DNA, 13 bp, Homo sapiens
atagtaagattga

SEQ ID NO: 1360589 - DNA, 18 bp, Homo sapiens
atagtactctttgtagca

SEQ ID NO: 1360590 - DNA, 23 bp, Homo sapiens
atagtatccatattttattactg

SEQ ID NO: 1360591 - DNA, 15 bp, Homo sapiens
atagtgatcaagaag

SEQ ID NO: 1360592 - DNA, 20 bp, Homo sapiens
atagtgatcaagaagacttt

SEQ ID NO: 1360593 - DNA, 23 bp, Homo sapiens
atagtgtaacttgcttaaatttc

SEQ ID NO: 1360594 - DNA, 12 bp, Homo sapiens
atagtgtctttg

SEQ ID NO: 1360595 - DNA, 21 bp, Homo sapiens
atagttaaatgttacctctga

SEQ ID NO: 1360596 - DNA, 15 bp, Homo sapiens
atagttatgtaaata

SEQ ID NO: 1360597 - DNA, 18 bp, Homo sapiens
atagtttggcatttgcac

SEQ ID NO: 1360598 - DNA, 16 bp, Homo sapiens
atagttttatttatat

SEQ ID NO: 1360599 - DNA, 18 bp, Homo sapiens
atagttttatttatattt

SEQ ID NO: 1360600 - DNA, 12 bp, Homo sapiens
atataacacatt

SEQ ID NO: 1360601 - DNA, 15 bp, Homo sapiens
atataacacattttt

SEQ ID NO: 1360602 - DNA, 13 bp, Homo sapiens
atataacatatat

SEQ ID NO: 1360603 - DNA, 15 bp, Homo sapiens
atatacaaaaagaaa

SEQ ID NO: 1360604 - DNA, 13 bp, Homo sapiens
atatacacgaata

SEQ ID NO: 1360605 - DNA, 20 bp, Homo sapiens
atatacacgaatagacatca

SEQ ID NO: 1360606 - DNA, 19 bp, Homo sapiens
atatacatgaagaatagaa

SEQ ID NO: 1360607 - DNA, 15 bp, Homo sapiens
atatatataaatgta

SEQ ID NO: 1360608 - DNA, 15 bp, Homo sapiens
atatatatgaataaa

SEQ ID NO: 1360609 - DNA, 16 bp, Homo sapiens
atatatctatctattt

SEQ ID NO: 1360610 - DNA, 18 bp, Homo sapiens
atatatctatctatttga

SEQ ID NO: 1360611 - DNA, 20 bp, Homo sapiens
atatatctatctatttgagg

SEQ ID NO: 1360612 - DNA, 19 bp, Homo sapiens
atatatcttataaagtgga

SEQ ID NO: 1360613 - DNA, 15 bp, Homo sapiens
atatatggaagagga

SEQ ID NO: 1360614 - DNA, 19 bp, Homo sapiens
atatatgtattatttataa

SEQ ID NO: 1360615 - DNA, 20 bp, Homo sapiens
atatatgtattatttataat

SEQ ID NO: 1360616 - DNA, 18 bp, Homo sapiens
atatattattataatctt

SEQ ID NO: 1360617 - DNA, 18 bp, Homo sapiens
atatattctttcaaagga

SEQ ID NO: 1360618 - DNA, 15 bp, Homo sapiens
atatattgaactttt

SEQ ID NO: 1360619 - DNA, 22 bp, Homo sapiens
atatattgaacttttgtactga

SEQ ID NO: 1360620 - DNA, 17 bp, Homo sapiens
atatatttctattatta

SEQ ID NO: 1360621 - DNA, 16 bp, Homo sapiens
atatattttgtgtgaa

SEQ ID NO: 1360622 - DNA, 13 bp, Homo sapiens
atatcaaattaat

SEQ ID NO: 1360623 - DNA, 20 bp, Homo sapiens
atatcaaattaattgtgtga

SEQ ID NO: 1360624 - DNA, 12 bp, Homo sapiens
atggagtattct

SEQ ID NO: 1360625 - DNA, 17 bp, Homo sapiens
atggatttcagaagcct

SEQ ID NO: 1360626 - DNA, 22 bp, Homo sapiens
atggatttggcactagccaaag

SEQ ID NO: 1360627 - DNA, 21 bp, Homo sapiens
atggcagaaaaaatgtctgta

SEQ ID NO: 1360628 - DNA, 17 bp, Homo sapiens
atggcatccctttttca

SEQ ID NO: 1360629 - DNA, 19 bp, Homo sapiens
atggcctcatgtggctgga

SEQ ID NO: 1360630 - DNA, 20 bp, Homo sapiens
atggcgccaccagctctgcc

SEQ ID NO: 1360631 - DNA, 13 bp, Homo sapiens
atggctcagggtg

SEQ ID NO: 1360632 - DNA, 22 bp, Homo sapiens
atggctgtgttggtgtggccca

SEQ ID NO: 1360633 - DNA, 20 bp, Homo sapiens
atggcttgtctatactcctt

SEQ ID NO: 1360634 - DNA, 23 bp, Homo sapiens
atggctttatttttttgaactct

SEQ ID NO: 1360635 - DNA, 20 bp, Homo sapiens
atgggagggggcttgaagcc

SEQ ID NO: 1360636 - DNA, 23 bp, Homo sapiens
atgggagggggcttgaagccaaa

SEQ ID NO: 1360637 - DNA, 12 bp, Homo sapiens
atgggcccctgg

SEQ ID NO: 1360638 - DNA, 22 bp, Homo sapiens
atgggcttttggggagccagaa

SEQ ID NO: 1360639 - DNA, 20 bp, Homo sapiens
atggtaataagcactgtaaa

SEQ ID NO: 1360640 - DNA, 20 bp, Homo sapiens
atggtaatctttacctgtat

SEQ ID NO: 1360641 - DNA, 19 bp, Homo sapiens
atggtagtttctgtggttg

SEQ ID NO: 1360642 - DNA, 21 bp, Homo sapiens
atggtatatttggtactgtat

SEQ ID NO: 1360643 - DNA, 21 bp, Homo sapiens
atggtcacgtttggtgcttct

SEQ ID NO: 1360644 - DNA, 23 bp, Homo sapiens
atggtcgagaaagaggcaccagg

SEQ ID NO: 1360645 - DNA, 19 bp, Homo sapiens
atggtgaaaccccgtctct

SEQ ID NO: 1360646 - DNA, 19 bp, Homo sapiens
atggtgatgcagtcttaga

SEQ ID NO: 1360647 - DNA, 15 bp, Homo sapiens
atggtgcctgagagg

SEQ ID NO: 1360648 - DNA, 23 bp, Homo sapiens
atggtgcctgagaggcaggcata

SEQ ID NO: 1360649 - DNA, 22 bp, Homo sapiens
atggtgtagccctcccactttg

SEQ ID NO: 1360650 - DNA, 16 bp, Homo sapiens
atggttatgtttttct

SEQ ID NO: 1360651 - DNA, 14 bp, Homo sapiens
atggttcttcacct

SEQ ID NO: 1360652 - DNA, 15 bp, Homo sapiens
atggtttcttgcaag

SEQ ID NO: 1360653 - DNA, 14 bp, Homo sapiens
atggttttaaactt

SEQ ID NO: 1360654 - DNA, 17 bp, Homo sapiens
atgtaaaacagaaaaaa

SEQ ID NO: 1360655 - DNA, 15 bp, Homo sapiens
atgtaaatgtaaact

SEQ ID NO: 1360656 - DNA, 15 bp, Homo sapiens
atgtaagcatacttt

SEQ ID NO: 1360657 - DNA, 19 bp, Homo sapiens
atgtaagcatactttgtaa

SEQ ID NO: 1360658 - DNA, 15 bp, Homo sapiens
atgtaagtgggccca

SEQ ID NO: 1360659 - DNA, 14 bp, Homo sapiens
atgtaataaacttt

SEQ ID NO: 1360660 - DNA, 15 bp, Homo sapiens
atgtaatttaaatga

SEQ ID NO: 1360661 - DNA, 18 bp, Homo sapiens
atgtacgtccagcctgcc

SEQ ID NO: 1360662 - DNA, 21 bp, Homo sapiens
atgtagccccctggcctctgt

SEQ ID NO: 1360663 - DNA, 20 bp, Homo sapiens
atgtaggtaagactgtagat

SEQ ID NO: 1360664 - DNA, 14 bp, Homo sapiens
atgtagtatctata

SEQ ID NO: 1360665 - DNA, 14 bp, Homo sapiens
attccagcccctct

SEQ ID NO: 1360666 - DNA, 17 bp, Homo sapiens
attccagcccctctggt

SEQ ID NO: 1360667 - DNA, 19 bp, Homo sapiens
attcccttgttattcaaca

SEQ ID NO: 1360668 - DNA, 14 bp, Homo sapiens
attccgcatcccta

SEQ ID NO: 1360669 - DNA, 18 bp, Homo sapiens
attcctaaagaaaaatat

SEQ ID NO: 1360670 - DNA, 19 bp, Homo sapiens
attcctatatcctgtgact

SEQ ID NO: 1360671 - DNA, 20 bp, Homo sapiens
attcctatatcctgtgactg

SEQ ID NO: 1360672 - DNA, 15 bp, Homo sapiens
attcctttttattta

SEQ ID NO: 1360673 - DNA, 16 bp, Homo sapiens
attcgtacataatact

SEQ ID NO: 1360674 - DNA, 18 bp, Homo sapiens
attcgtacataatactga

SEQ ID NO: 1360675 - DNA, 23 bp, Homo sapiens
attcgtacataatactgaaccac

SEQ ID NO: 1360676 - DNA, 19 bp, Homo sapiens
attcgttgtgttttttaag

SEQ ID NO: 1360677 - DNA, 16 bp, Homo sapiens
attctaataagctagt

SEQ ID NO: 1360678 - DNA, 16 bp, Homo sapiens
attctagttttgtcaa

SEQ ID NO: 1360679 - DNA, 14 bp, Homo sapiens
attctataaaactc

SEQ ID NO: 1360680 - DNA, 24 bp, Homo sapiens
attctataaaactctgcatgtaga

SEQ ID NO: 1360681 - DNA, 20 bp, Homo sapiens
attctcccaggtaccagctg

SEQ ID NO: 1360682 - DNA, 18 bp, Homo sapiens
attctgactcggtttctc

SEQ ID NO: 1360683 - DNA, 20 bp, Homo sapiens
attctgactcggtttctcca

SEQ ID NO: 1360684 - DNA, 14 bp, Homo sapiens
attctggctttaag

SEQ ID NO: 1360685 - DNA, 19 bp, Homo sapiens
attctggttccagggtccc

SEQ ID NO: 1360686 - DNA, 23 bp, Homo sapiens
attctggttccagggtccctctg

SEQ ID NO: 1360687 - DNA, 17 bp, Homo sapiens
attcttactaaaaagta

SEQ ID NO: 1360688 - DNA, 21 bp, Homo sapiens
attcttctcttccttttatca

SEQ ID NO: 1360689 - DNA, 19 bp, Homo sapiens
attcttgttgctgtacaaa

SEQ ID NO: 1360690 - DNA, 21 bp, Homo sapiens
attcttttttattaatcactg

SEQ ID NO: 1360691 - DNA, 16 bp, Homo sapiens
attgaaaagtttttgt

SEQ ID NO: 1360692 - DNA, 23 bp, Homo sapiens
attgaaaagtttttgtttggaga

SEQ ID NO: 1360693 - DNA, 20 bp, Homo sapiens
attgaacttttgtactgaat

SEQ ID NO: 1360694 - DNA, 10 bp, Homo sapiens
attgaagaat

SEQ ID NO: 1360695 - DNA, 22 bp, Homo sapiens
attgaagctcgtgacaagtgcc

SEQ ID NO: 1360696 - DNA, 13 bp, Homo sapiens
attgaaggttttt

SEQ ID NO: 1360697 - DNA, 17 bp, Homo sapiens
attgaaggtttttgata

SEQ ID NO: 1360698 - DNA, 19 bp, Homo sapiens
attgaaggtttttgatagc

SEQ ID NO: 1360699 - DNA, 20 bp, Homo sapiens
attgaaggtttttgatagca

SEQ ID NO: 1360700 - DNA, 14 bp, Homo sapiens
attgaagtaatgaa

SEQ ID NO: 1360701 - DNA, 15 bp, Homo sapiens
attgaagtaatgaat

SEQ ID NO: 1360702 - DNA, 16 bp, Homo sapiens
attgaagtaatgaatt

SEQ ID NO: 1360703 - DNA, 16 bp, Homo sapiens
attgactctgggtcct

SEQ ID NO: 1360704 - DNA, 20 bp, Homo sapiens
attgactctgggtccttcct

SEQ ID NO: 1360705 - DNA, 14 bp, Homo sapiens
attgactcttgagt

SEQ ID NO: 1360706 - DNA, 22 bp, Homo sapiens
attgaggccaagaatattgcaa

SEQ ID NO: 1360707 - DNA, 13 bp, Homo sapiens
attgagtattgtt

SEQ ID NO: 1360708 - DNA, 20 bp, Homo sapiens
attgagtattgtttaaaatg

SEQ ID NO: 1360709 - DNA, 21 bp, Homo sapiens
attgagtattgtttaaaatgt

SEQ ID NO: 1360710 - DNA, 23 bp, Homo sapiens
attgagtattgtttaaaatgtaa

SEQ ID NO: 1360711 - DNA, 13 bp, Homo sapiens
attgattgggaaa

SEQ ID NO: 1360712 - DNA, 19 bp, Homo sapiens
attgattgggaaaacattt

SEQ ID NO: 1360713 - DNA, 21 bp, Homo sapiens
attgattgggaaaacatttgc

SEQ ID NO: 1360714 - DNA, 14 bp, Homo sapiens
attgcaaaatacat

SEQ ID NO: 1360715 - DNA, 19 bp, Homo sapiens
attgcagtttatcattcaa

SEQ ID NO: 1360716 - DNA, 15 bp, Homo sapiens
attgcatcactgtat

SEQ ID NO: 1360717 - DNA, 21 bp, Homo sapiens
attgccagctgacatcttgaa

SEQ ID NO: 1360718 - DNA, 12 bp, Homo sapiens
attgccatgtgg

SEQ ID NO: 1360719 - DNA, 13 bp, Homo sapiens
attgcctctgaaa

SEQ ID NO: 1360720 - DNA, 18 bp, Homo sapiens
attgcctctgaaaagtgt

SEQ ID NO: 1360721 - DNA, 15 bp, Homo sapiens
attgcctgtttctga

SEQ ID NO: 1360722 - DNA, 17 bp, Homo sapiens
attgccttttaattttt

SEQ ID NO: 1360723 - DNA, 19 bp, Homo sapiens
attgctgtgtgtcccaggc

SEQ ID NO: 1360724 - DNA, 13 bp, Homo sapiens
attggcaaaacta

SEQ ID NO: 1360725 - DNA, 21 bp, Homo sapiens
attggtaaaactcactgtgat

SEQ ID NO: 1360726 - DNA, 17 bp, Homo sapiens
attgtaagcgtatggct

SEQ ID NO: 1360727 - DNA, 18 bp, Homo sapiens
attgtacaaaattaagca

SEQ ID NO: 1360728 - DNA, 22 bp, Homo sapiens
attgtacaaaattaagcaaatg

SEQ ID NO: 1360729 - DNA, 19 bp, Homo sapiens
attgtacatagcatgttta

SEQ ID NO: 1360730 - DNA, 17 bp, Homo sapiens
attgtatattacaatga

SEQ ID NO: 1360731 - DNA, 18 bp, Homo sapiens
attgtatattacaatgat

SEQ ID NO: 1360732 - DNA, 15 bp, Homo sapiens
attgtatattgtaat

SEQ ID NO: 1360733 - DNA, 23 bp, Homo sapiens
attgtccagtttgtcttggatat

SEQ ID NO: 1360734 - DNA, 14 bp, Homo sapiens
attgtcctattagt

SEQ ID NO: 1360735 - DNA, 20 bp, Homo sapiens
attgtcctattagtgttata

SEQ ID NO: 1360736 - DNA, 15 bp, Homo sapiens
attgtctcccttcca

SEQ ID NO: 1360737 - DNA, 23 bp, Homo sapiens
attgtctcctatatatttctatt

SEQ ID NO: 1360738 - DNA, 15 bp, Homo sapiens
attgtgctcagagac

SEQ ID NO: 1360739 - DNA, 15 bp, Homo sapiens
attgtgcttcacagt

SEQ ID NO: 1360740 - DNA, 24 bp, Homo sapiens
attgtgcttcacagtagagccagc

SEQ ID NO: 1360741 - DNA, 20 bp, Homo sapiens
attgtggtcacaacttgatg

SEQ ID NO: 1360742 - DNA, 21 bp, Homo sapiens
attgttccttggagaaatgaa

SEQ ID NO: 1360743 - DNA, 17 bp, Homo sapiens
attgttctcagaatccc

SEQ ID NO: 1360744 - DNA, 18 bp, Homo sapiens
attgttgacaactgtgac

SEQ ID NO: 1360745 - DNA, 17 bp, Homo sapiens
acattgttaagaaaaat

SEQ ID NO: 1360746 - DNA, 20 bp, Homo sapiens
acatttagctgtgctcagaa

SEQ ID NO: 1360747 - DNA, 18 bp, Homo sapiens
acatttatttatccagaa

SEQ ID NO: 1360748 - DNA, 22 bp, Homo sapiens
acatttattttttttaaagaaa

SEQ ID NO: 1360749 - DNA, 23 bp, Homo sapiens
acatttattttttttaaagaaaa

SEQ ID NO: 1360750 - DNA, 22 bp, Homo sapiens
acatttgatgcatgtcttttaa

SEQ ID NO: 1360751 - DNA, 15 bp, Homo sapiens
acatttgctgccatt

SEQ ID NO: 1360752 - DNA, 23 bp, Homo sapiens
acatttttttgcatgcatgcaaa

SEQ ID NO: 1360753 - DNA, 14 bp, Homo sapiens
accaaagctgccca

SEQ ID NO: 1360754 - DNA, 21 bp, Homo sapiens
accaatcttactttgtaaatt

SEQ ID NO: 1360755 - DNA, 23 bp, Homo sapiens
accacagcaacgatcacaaatga

SEQ ID NO: 1360756 - DNA, 12 bp, Homo sapiens
accaccacccct

SEQ ID NO: 1360757 - DNA, 18 bp, Homo sapiens
accaccccggccccctgc

SEQ ID NO: 1360758 - DNA, 13 bp, Homo sapiens
accaccctgagcc

SEQ ID NO: 1360759 - DNA, 22 bp, Homo sapiens
accacgcctcttgaccaggctg

SEQ ID NO: 1360760 - DNA, 17 bp, Homo sapiens
accactcgtgcatccct

SEQ ID NO: 1360761 - DNA, 17 bp, Homo sapiens
accactgcactccagcc

SEQ ID NO: 1360762 - DNA, 17 bp, Homo sapiens
accagcagcctggaccc

SEQ ID NO: 1360763 - DNA, 18 bp, Homo sapiens
accagcatcacctgcctg

SEQ ID NO: 1360764 - DNA, 19 bp, Homo sapiens
accagcccatcgccacaaa

SEQ ID NO: 1360765 - DNA, 16 bp, Homo sapiens
accagccccactgcca

SEQ ID NO: 1360766 - DNA, 17 bp, Homo sapiens
accagccccactgccag

SEQ ID NO: 1360767 - DNA, 21 bp, Homo sapiens
accagccccactgccagcagc

SEQ ID NO: 1360768 - DNA, 22 bp, Homo sapiens
accagccccactgccagcagca

SEQ ID NO: 1360769 - DNA, 22 bp, Homo sapiens
accagcgtgtgactactccccc

SEQ ID NO: 1360770 - DNA, 14 bp, Homo sapiens
accaggccacctcc

SEQ ID NO: 1360771 - DNA, 17 bp, Homo sapiens
accaggccacctcccca

SEQ ID NO: 1360772 - DNA, 15 bp, Homo sapiens
accaggccattctgc

SEQ ID NO: 1360773 - DNA, 21 bp, Homo sapiens
accagggccttttctggcacc

SEQ ID NO: 1360774 - DNA, 22 bp, Homo sapiens
accatattgtgcttcacagtag

SEQ ID NO: 1360775 - DNA, 22 bp, Homo sapiens
accatgattaaccacttcagct

SEQ ID NO: 1360776 - DNA, 19 bp, Homo sapiens
accatgctcatctgctggt

SEQ ID NO: 1360777 - DNA, 20 bp, Homo sapiens
accatgctcatctgctggtc

SEQ ID NO: 1360778 - DNA, 18 bp, Homo sapiens
accatgtaagcactctgg

SEQ ID NO: 1360779 - DNA, 12 bp, Homo sapiens
accatgtcattt

SEQ ID NO: 1360780 - DNA, 15 bp, Homo sapiens
accatgtcatttcag

SEQ ID NO: 1360781 - DNA, 14 bp, Homo sapiens
accatgtggccaca

SEQ ID NO: 1360782 - DNA, 23 bp, Homo sapiens
accattgagaccgtgaagatact

SEQ ID NO: 1360783 - DNA, 17 bp, Homo sapiens
acccaaagctgagcctg

SEQ ID NO: 1360784 - DNA, 18 bp, Homo sapiens
acccaaagctgagcctgc

SEQ ID NO: 1360785 - DNA, 22 bp, Homo sapiens
acccaaagctgagcctgcaggg

SEQ ID NO: 1360786 - DNA, 22 bp, Homo sapiens
acccaaccctatctcctgacag

SEQ ID NO: 1360787 - DNA, 22 bp, Homo sapiens
acccaccgtggaggaggaaggc

SEQ ID NO: 1360788 - DNA, 14 bp, Homo sapiens
acccaggaggcagg

SEQ ID NO: 1360789 - DNA, 23 bp, Homo sapiens
acccaggaggcagggaggcagcc

SEQ ID NO: 1360790 - DNA, 9 bp, Homo sapiens
acccagtgc

SEQ ID NO: 1360791 - DNA, 12 bp, Homo sapiens
acccagtgcaga

SEQ ID NO: 1360792 - DNA, 21 bp, Homo sapiens
acccattaaggggaagaatga

SEQ ID NO: 1360793 - DNA, 17 bp, Homo sapiens
acccattgctgttgtcc

SEQ ID NO: 1360794 - DNA, 19 bp, Homo sapiens
accccaaacagtgactgta

SEQ ID NO: 1360795 - DNA, 18 bp, Homo sapiens
accccaagagaactcgcg

SEQ ID NO: 1360796 - DNA, 18 bp, Homo sapiens
accccaagccagcccggc

SEQ ID NO: 1360797 - DNA, 11 bp, Homo sapiens
accccaggacg

SEQ ID NO: 1360798 - DNA, 11 bp, Homo sapiens
acccccagccc

SEQ ID NO: 1360799 - DNA, 20 bp, Homo sapiens
acccccagccccgactccag

SEQ ID NO: 1360800 - DNA, 21 bp, Homo sapiens
acccccagccccgactccagc

SEQ ID NO: 1360801 - DNA, 23 bp, Homo sapiens
acccccagccccgactccagcca

SEQ ID NO: 1360802 - DNA, 17 bp, Homo sapiens
accccctcccaccccca

SEQ ID NO: 1360803 - DNA, 16 bp, Homo sapiens
accccctccttcagac

SEQ ID NO: 1360804 - DNA, 13 bp, Homo sapiens
accccctgccctg

SEQ ID NO: 1360805 - DNA, 14 bp, Homo sapiens
accccctgccctgc

SEQ ID NO: 1360806 - DNA, 17 bp, Homo sapiens
acccccttaaatttaat

SEQ ID NO: 1360807 - DNA, 17 bp, Homo sapiens
accccgcagacaccttg

SEQ ID NO: 1360808 - DNA, 18 bp, Homo sapiens
accccgcagacaccttgg

SEQ ID NO: 1360809 - DNA, 20 bp, Homo sapiens
accccgcagacaccttggac

SEQ ID NO: 1360810 - DNA, 15 bp, Homo sapiens
accccggggaccctg

SEQ ID NO: 1360811 - DNA, 16 bp, Homo sapiens
accccggggaccctgt

SEQ ID NO: 1360812 - DNA, 18 bp, Homo sapiens
accccggggaccctgtga

SEQ ID NO: 1360813 - DNA, 21 bp, Homo sapiens
accccggtggcggccccagca

SEQ ID NO: 1360814 - DNA, 20 bp, Homo sapiens
acccctcacaggagcttact

SEQ ID NO: 1360815 - DNA, 20 bp, Homo sapiens
acccctgcccccagccccgg

SEQ ID NO: 1360816 - DNA, 16 bp, Homo sapiens
accccttccagatcac

SEQ ID NO: 1360817 - DNA, 20 bp, Homo sapiens
accccttccagatcactgcc

SEQ ID NO: 1360818 - DNA, 15 bp, Homo sapiens
accccttctctcctc

SEQ ID NO: 1360819 - DNA, 17 bp, Homo sapiens
accccttctctcctccc

SEQ ID NO: 1360820 - DNA, 15 bp, Homo sapiens
acccggggcccaggg

SEQ ID NO: 1360821 - DNA, 14 bp, Homo sapiens
accctatctcctga

SEQ ID NO: 1360822 - DNA, 15 bp, Homo sapiens
accctatctcctgac

SEQ ID NO: 1360823 - DNA, 13 bp, Homo sapiens
accctattgctgc

SEQ ID NO: 1360824 - DNA, 14 bp, Homo sapiens
accctattgctgct

SEQ ID NO: 1360825 - DNA, 13 bp, Homo sapiens
accctcagagcct

SEQ ID NO: 1360826 - DNA, 14 bp, Homo sapiens
accctcaggcaggt

SEQ ID NO: 1360827 - DNA, 16 bp, Homo sapiens
accctcaggcaggtgg

SEQ ID NO: 1360828 - DNA, 11 bp, Homo sapiens
accctccaaat

SEQ ID NO: 1360829 - DNA, 16 bp, Homo sapiens
accctgaaagccctga

SEQ ID NO: 1360830 - DNA, 18 bp, Homo sapiens
accctgaaagccctgagc

SEQ ID NO: 1360831 - DNA, 18 bp, Homo sapiens
accctgccgtcaccacca

SEQ ID NO: 1360832 - DNA, 22 bp, Homo sapiens
accctgccgtcaccaccacccc

SEQ ID NO: 1360833 - DNA, 18 bp, Homo sapiens
accctgggccctgggctg

SEQ ID NO: 1360834 - DNA, 16 bp, Homo sapiens
accctgggggcacagg

SEQ ID NO: 1360835 - DNA, 18 bp, Homo sapiens
accctgggggcacaggag

SEQ ID NO: 1360836 - DNA, 22 bp, Homo sapiens
accctgggggcacaggaggcag

SEQ ID NO: 1360837 - DNA, 14 bp, Homo sapiens
acccttataaaatc

SEQ ID NO: 1360838 - DNA, 15 bp, Homo sapiens
acccttataaaatcc

SEQ ID NO: 1360839 - DNA, 17 bp, Homo sapiens
accctttgggggttgaa

SEQ ID NO: 1360840 - DNA, 23 bp, Homo sapiens
accctttggtttttttcttctgt

SEQ ID NO: 1360841 - DNA, 15 bp, Homo sapiens
accgaggggcctttg

SEQ ID NO: 1360842 - DNA, 12 bp, Homo sapiens
accgcacagctc

SEQ ID NO: 1360843 - DNA, 15 bp, Homo sapiens
accgcccctggccgc

SEQ ID NO: 1360844 - DNA, 20 bp, Homo sapiens
accgcctccccacctccagg

SEQ ID NO: 1360845 - DNA, 24 bp, Homo sapiens
accggagtgtctggaattgtggct

SEQ ID NO: 1360846 - DNA, 15 bp, Homo sapiens
accggtccagctggc

SEQ ID NO: 1360847 - DNA, 18 bp, Homo sapiens
accgtgaagatactttgt

SEQ ID NO: 1360848 - DNA, 19 bp, Homo sapiens
accgtgaagatactttgta

SEQ ID NO: 1360849 - DNA, 15 bp, Homo sapiens
acctaaatggcctca

SEQ ID NO: 1360850 - DNA, 13 bp, Homo sapiens
acctagtgaaact

SEQ ID NO: 1360851 - DNA, 19 bp, Homo sapiens
acctagtgaaacttttcta

SEQ ID NO: 1360852 - DNA, 20 bp, Homo sapiens
acctcagcctgcacagtgtc

SEQ ID NO: 1360853 - DNA, 15 bp, Homo sapiens
acctcagggctccca

SEQ ID NO: 1360854 - DNA, 17 bp, Homo sapiens
acctcagggctcccagg

SEQ ID NO: 1360855 - DNA, 13 bp, Homo sapiens
acctcatgcccac

SEQ ID NO: 1360856 - DNA, 16 bp, Homo sapiens
acctcatgcccacccc

SEQ ID NO: 1360857 - DNA, 16 bp, Homo sapiens
acctccaaccctgccg

SEQ ID NO: 1360858 - DNA, 14 bp, Homo sapiens
agccccagcctgct

SEQ ID NO: 1360859 - DNA, 10 bp, Homo sapiens
agccccaggg

SEQ ID NO: 1360860 - DNA, 16 bp, Homo sapiens
agccccaggggacaag

SEQ ID NO: 1360861 - DNA, 16 bp, Homo sapiens
agccccatctagggga

SEQ ID NO: 1360862 - DNA, 14 bp, Homo sapiens
agccccctggcctc

SEQ ID NO: 1360863 - DNA, 16 bp, Homo sapiens
agccccctggcctctg

SEQ ID NO: 1360864 - DNA, 17 bp, Homo sapiens
agccccctggcctctgt

SEQ ID NO: 1360865 - DNA, 15 bp, Homo sapiens
agccccgactccagc

SEQ ID NO: 1360866 - DNA, 18 bp, Homo sapiens
agccccgactccagccag

SEQ ID NO: 1360867 - DNA, 20 bp, Homo sapiens
agccccgactccagccagcg

SEQ ID NO: 1360868 - DNA, 16 bp, Homo sapiens
agcccctctggtcgct

SEQ ID NO: 1360869 - DNA, 12 bp, Homo sapiens
agcccctcttcc

SEQ ID NO: 1360870 - DNA, 21 bp, Homo sapiens
agccctaaccccttccagatc

SEQ ID NO: 1360871 - DNA, 17 bp, Homo sapiens
agccctactccctgcag

SEQ ID NO: 1360872 - DNA, 24 bp, Homo sapiens
agccctactccctgcagatgccac

SEQ ID NO: 1360873 - DNA, 12 bp, Homo sapiens
agccctccccat

SEQ ID NO: 1360874 - DNA, 20 bp, Homo sapiens
agccctccccatggagccag

SEQ ID NO: 1360875 - DNA, 21 bp, Homo sapiens
agccctccccatggagccagc

SEQ ID NO: 1360876 - DNA, 23 bp, Homo sapiens
agcccttgcctccccatttccca

SEQ ID NO: 1360877 - DNA, 19 bp, Homo sapiens
agccgagattgcaccactg

SEQ ID NO: 1360878 - DNA, 20 bp, Homo sapiens
agccgagattgcaccactgc

SEQ ID NO: 1360879 - DNA, 14 bp, Homo sapiens
agccgggcccctgg

SEQ ID NO: 1360880 - DNA, 18 bp, Homo sapiens
agccgggcccctgggctt

SEQ ID NO: 1360881 - DNA, 14 bp, Homo sapiens
agccggttcctgtc

SEQ ID NO: 1360882 - DNA, 12 bp, Homo sapiens
agccgtcctggc

SEQ ID NO: 1360883 - DNA, 13 bp, Homo sapiens
agccgtcctggcg

SEQ ID NO: 1360884 - DNA, 13 bp, Homo sapiens
agcctactctcct

SEQ ID NO: 1360885 - DNA, 14 bp, Homo sapiens
agcctcagactgga

SEQ ID NO: 1360886 - DNA, 22 bp, Homo sapiens
agcctcagccccctgcttcagt

SEQ ID NO: 1360887 - DNA, 19 bp, Homo sapiens
agcctcagcgcggccctcc

SEQ ID NO: 1360888 - DNA, 22 bp, Homo sapiens
agcctcagcgcggccctcccga

SEQ ID NO: 1360889 - DNA, 22 bp, Homo sapiens
agcctccacagcgagggcagct

SEQ ID NO: 1360890 - DNA, 23 bp, Homo sapiens
agcctccacagcgagggcagctg

SEQ ID NO: 1360891 - DNA, 22 bp, Homo sapiens
agcctcccacgactgcccggca

SEQ ID NO: 1360892 - DNA, 14 bp, Homo sapiens
agcctcctccagcc

SEQ ID NO: 1360893 - DNA, 12 bp, Homo sapiens
agcctcctctgg

SEQ ID NO: 1360894 - DNA, 14 bp, Homo sapiens
agcctcctctggac

SEQ ID NO: 1360895 - DNA, 18 bp, Homo sapiens
agcctctcagtgccctcc

SEQ ID NO: 1360896 - DNA, 15 bp, Homo sapiens
agcctctgctcccca

SEQ ID NO: 1360897 - DNA, 17 bp, Homo sapiens
agcctctgtcaggcctt

SEQ ID NO: 1360898 - DNA, 16 bp, Homo sapiens
agcctctttttgatac

SEQ ID NO: 1360899 - DNA, 16 bp, Homo sapiens
agcctgatattgatat

SEQ ID NO: 1360900 - DNA, 18 bp, Homo sapiens
agcctgatgagattttta

SEQ ID NO: 1360901 - DNA, 19 bp, Homo sapiens
agcctgcagggaagcccca

SEQ ID NO: 1360902 - DNA, 19 bp, Homo sapiens
agcctgcctcttctctact

SEQ ID NO: 1360903 - DNA, 20 bp, Homo sapiens
agcctgcgcctgctgcatgc

SEQ ID NO: 1360904 - DNA, 13 bp, Homo sapiens
agcctgctagcta

SEQ ID NO: 1360905 - DNA, 17 bp, Homo sapiens
agcctgctagctagctc

SEQ ID NO: 1360906 - DNA, 14 bp, Homo sapiens
agcctggaccctgt

SEQ ID NO: 1360907 - DNA, 21 bp, Homo sapiens
agcctgggaaataagccccct

SEQ ID NO: 1360908 - DNA, 18 bp, Homo sapiens
agcctgggcaatgtgata

SEQ ID NO: 1360909 - DNA, 14 bp, Homo sapiens
agcctggtgctgct

SEQ ID NO: 1360910 - DNA, 19 bp, Homo sapiens
agcctgtaacactcctctg

SEQ ID NO: 1360911 - DNA, 21 bp, Homo sapiens
agccttgattcccttgttatt

SEQ ID NO: 1360912 - DNA, 18 bp, Homo sapiens
agcctttggttctggcca

SEQ ID NO: 1360913 - DNA, 20 bp, Homo sapiens
agcctttttaaaacacatgt

SEQ ID NO: 1360914 - DNA, 17 bp, Homo sapiens
agcgactccgttggcca

SEQ ID NO: 1360915 - DNA, 19 bp, Homo sapiens
agcgactccgttggccact

SEQ ID NO: 1360916 - DNA, 20 bp, Homo sapiens
agcgactccgttggccactc

SEQ ID NO: 1360917 - DNA, 16 bp, Homo sapiens
agcgatctctccactg

SEQ ID NO: 1360918 - DNA, 13 bp, Homo sapiens
agcgccagcctca

SEQ ID NO: 1360919 - DNA, 19 bp, Homo sapiens
agcgccagcctcagactgg

SEQ ID NO: 1360920 - DNA, 12 bp, Homo sapiens
agcgcctccctc

SEQ ID NO: 1360921 - DNA, 14 bp, Homo sapiens
agcgcctccctcca

SEQ ID NO: 1360922 - DNA, 18 bp, Homo sapiens
agcgcctccctccacccc

SEQ ID NO: 1360923 - DNA, 21 bp, Homo sapiens
agcgcctccctccaccccagg

SEQ ID NO: 1360924 - DNA, 15 bp, Homo sapiens
agcgcgcccctagcc

SEQ ID NO: 1360925 - DNA, 13 bp, Homo sapiens
agcggctggcagc

SEQ ID NO: 1360926 - DNA, 15 bp, Homo sapiens
agctaactgtaaatc

SEQ ID NO: 1360927 - DNA, 16 bp, Homo sapiens
agctaactgtaaatca

SEQ ID NO: 1360928 - DNA, 16 bp, Homo sapiens
agctagctcaactagt

SEQ ID NO: 1360929 - DNA, 14 bp, Homo sapiens
agctagtcaacagt

SEQ ID NO: 1360930 - DNA, 15 bp, Homo sapiens
agctagttgaatact

SEQ ID NO: 1360931 - DNA, 22 bp, Homo sapiens
agctataaagcagtatttttct

SEQ ID NO: 1360932 - DNA, 12 bp, Homo sapiens
agctatgactta

SEQ ID NO: 1360933 - DNA, 17 bp, Homo sapiens
agctattgccaaccagt

SEQ ID NO: 1360934 - DNA, 15 bp, Homo sapiens
agctcaggaggcgcc

SEQ ID NO: 1360935 - DNA, 20 bp, Homo sapiens
agggagacggtttccaggga

SEQ ID NO: 1360936 - DNA, 17 bp, Homo sapiens
agggaggggccggccct

SEQ ID NO: 1360937 - DNA, 18 bp, Homo sapiens
agggaggggccggccctg

SEQ ID NO: 1360938 - DNA, 20 bp, Homo sapiens
agggaggtcactggaaaggg

SEQ ID NO: 1360939 - DNA, 20 bp, Homo sapiens
agggagttactgaagtctta

SEQ ID NO: 1360940 - DNA, 18 bp, Homo sapiens
agggatgcaggctcccct

SEQ ID NO: 1360941 - DNA, 16 bp, Homo sapiens
agggcaaggggttccc

SEQ ID NO: 1360942 - DNA, 14 bp, Homo sapiens
agggcaccaggggt

SEQ ID NO: 1360943 - DNA, 19 bp, Homo sapiens
agggccatgctgaggcctg

SEQ ID NO: 1360944 - DNA, 20 bp, Homo sapiens
agggccatgctgaggcctgg

SEQ ID NO: 1360945 - DNA, 21 bp, Homo sapiens
agggccatgctgaggcctggg

SEQ ID NO: 1360946 - DNA, 23 bp, Homo sapiens
agggccatgctgaggcctgggcc

SEQ ID NO: 1360947 - DNA, 19 bp, Homo sapiens
agggccgactaagagaagt

SEQ ID NO: 1360948 - DNA, 19 bp, Homo sapiens
agggccttttctggcaccg

SEQ ID NO: 1360949 - DNA, 11 bp, Homo sapiens
agggctcctgc

SEQ ID NO: 1360950 - DNA, 11 bp, Homo sapiens
agggctgcagt

SEQ ID NO: 1360951 - DNA, 23 bp, Homo sapiens
agggctgctgggggcaactggcc

SEQ ID NO: 1360952 - DNA, 16 bp, Homo sapiens
agggctggctcctgat

SEQ ID NO: 1360953 - DNA, 15 bp, Homo sapiens
agggcttgtagttct

SEQ ID NO: 1360954 - DNA, 15 bp, Homo sapiens
aggggaagaatgaaa

SEQ ID NO: 1360955 - DNA, 17 bp, Homo sapiens
aggggaaggagaagtaa

SEQ ID NO: 1360956 - DNA, 13 bp, Homo sapiens
aggggagactttg

SEQ ID NO: 1360957 - DNA, 16 bp, Homo sapiens
aggggagttgtgtctg

SEQ ID NO: 1360958 - DNA, 13 bp, Homo sapiens
aggggccggccct

SEQ ID NO: 1360959 - DNA, 17 bp, Homo sapiens
aggggccggccctgtgt

SEQ ID NO: 1360960 - DNA, 18 bp, Homo sapiens
aggggcctggagatcctc

SEQ ID NO: 1360961 - DNA, 15 bp, Homo sapiens
aggggctgcttcctc

SEQ ID NO: 1360962 - DNA, 16 bp, Homo sapiens
agggggcaagaggaat

SEQ ID NO: 1360963 - DNA, 18 bp, Homo sapiens
agggggcttgaagccaaa

SEQ ID NO: 1360964 - DNA, 14 bp, Homo sapiens
aggggtccctagca

SEQ ID NO: 1360965 - DNA, 23 bp, Homo sapiens
aggggtccctagcagcccaccct

SEQ ID NO: 1360966 - DNA, 21 bp, Homo sapiens
aggggtcggctgaccatgctc

SEQ ID NO: 1360967 - DNA, 14 bp, Homo sapiens
aggggtctccctgg

SEQ ID NO: 1360968 - DNA, 17 bp, Homo sapiens
aggggtctccctggctc

SEQ ID NO: 1360969 - DNA, 19 bp, Homo sapiens
aggggtctccctggctccc

SEQ ID NO: 1360970 - DNA, 19 bp, Homo sapiens
aggggtgggggtggaggct

SEQ ID NO: 1360971 - DNA, 22 bp, Homo sapiens
aggggtgtcttgggcagagctg

SEQ ID NO: 1360972 - DNA, 24 bp, Homo sapiens
aggggtgtcttgggcagagctggc

SEQ ID NO: 1360973 - DNA, 18 bp, Homo sapiens
aggggtgtggcagtggtt

SEQ ID NO: 1360974 - DNA, 23 bp, Homo sapiens
aggggttcccttgagggctgcag

SEQ ID NO: 1360975 - DNA, 14 bp, Homo sapiens
aggggttcctcaaa

SEQ ID NO: 1360976 - DNA, 19 bp, Homo sapiens
agggtccaaccagacctgg

SEQ ID NO: 1360977 - DNA, 15 bp, Homo sapiens
agggtccctctgtgt

SEQ ID NO: 1360978 - DNA, 18 bp, Homo sapiens
agggtccctctgtgtatt

SEQ ID NO: 1360979 - DNA, 22 bp, Homo sapiens
agggtcggaacccaagcttaga

SEQ ID NO: 1360980 - DNA, 18 bp, Homo sapiens
agggtgggggagggaggt

SEQ ID NO: 1360981 - DNA, 23 bp, Homo sapiens
agggtggtctcttcttggggccc

SEQ ID NO: 1360982 - DNA, 22 bp, Homo sapiens
agggtgtccggtccctgtccca

SEQ ID NO: 1360983 - DNA, 14 bp, Homo sapiens
agggtttctctatt

SEQ ID NO: 1360984 - DNA, 15 bp, Homo sapiens
aggtataataaaatt

SEQ ID NO: 1360985 - DNA, 15 bp, Homo sapiens
aggtatctagagctt

SEQ ID NO: 1360986 - DNA, 20 bp, Homo sapiens
aggtcactggaaaggggaga

SEQ ID NO: 1360987 - DNA, 21 bp, Homo sapiens
aggtcactggaaaggggagag

SEQ ID NO: 1360988 - DNA, 16 bp, Homo sapiens
aggtcactgtttcctg

SEQ ID NO: 1360989 - DNA, 13 bp, Homo sapiens
aggtccagctctg

SEQ ID NO: 1360990 - DNA, 14 bp, Homo sapiens
aggtccagctctgg

SEQ ID NO: 1360991 - DNA, 15 bp, Homo sapiens
aggtccagctctgga

SEQ ID NO: 1360992 - DNA, 18 bp, Homo sapiens
aggtccagctctggaggg

SEQ ID NO: 1360993 - DNA, 15 bp, Homo sapiens
aggtcctctggagcc

SEQ ID NO: 1360994 - DNA, 21 bp, Homo sapiens
aggtgcccagaataagttatt

SEQ ID NO: 1360995 - DNA, 20 bp, Homo sapiens
aggtggaggctgcagtgagc

SEQ ID NO: 1360996 - DNA, 15 bp, Homo sapiens
aggtggatggcccca

SEQ ID NO: 1360997 - DNA, 23 bp, Homo sapiens
aggtggatggccccagcacagct

SEQ ID NO: 1360998 - DNA, 19 bp, Homo sapiens
aggtggattttgtttaaaa

SEQ ID NO: 1360999 - DNA, 23 bp, Homo sapiens
aggtggattttgtttaaaaaatc

SEQ ID NO: 1361000 - DNA, 17 bp, Homo sapiens
aggtggtagatattgag

SEQ ID NO: 1361001 - DNA, 21 bp, Homo sapiens
aggtggtggtagagaagcaag

SEQ ID NO: 1361002 - DNA, 14 bp, Homo sapiens
aggtgtttgaaaat

SEQ ID NO: 1361003 - DNA, 17 bp, Homo sapiens
aggtgtttgaaaatagt

SEQ ID NO: 1361004 - DNA, 16 bp, Homo sapiens
aggttccgatgttatt

SEQ ID NO: 1361005 - DNA, 15 bp, Homo sapiens
aggttcctctgcctg

SEQ ID NO: 1361006 - DNA, 17 bp, Homo sapiens
aggttcctctgcctgcc

SEQ ID NO: 1361007 - DNA, 19 bp, Homo sapiens
aggttcctctgcctgcccc

SEQ ID NO: 1361008 - DNA, 20 bp, Homo sapiens
aggttctccgttagctcctg

SEQ ID NO: 1361009 - DNA, 21 bp, Homo sapiens
aggttctccgttagctcctgt

SEQ ID NO: 1361010 - DNA, 22 bp, Homo sapiens
aggttctccgttagctcctgtg

SEQ ID NO: 1361011 - DNA, 12 bp, Homo sapiens
aggttgaagcca

SEQ ID NO: 1361012 - DNA, 13 bp, Homo sapiens
aggttgaagccaa

SEQ ID NO: 1361013 - DNA, 23 bp, Homo sapiens
aggttgaagccaagtggggtgct

SEQ ID NO: 1361014 - DNA, 14 bp, Homo sapiens
aggttggtgggggc

SEQ ID NO: 1361015 - DNA, 23 bp, Homo sapiens
aggtttttgatagcattgtaagc

SEQ ID NO: 1361016 - DNA, 14 bp, Homo sapiens
agtaaaaaggctaa

SEQ ID NO: 1361017 - DNA, 21 bp, Homo sapiens
agtaaacgggaacatgccccc

SEQ ID NO: 1361018 - DNA, 23 bp, Homo sapiens
agtaaacgggaacatgccccctg

SEQ ID NO: 1361019 - DNA, 23 bp, Homo sapiens
agtaactgtcaggctgaaaacaa

SEQ ID NO: 1361020 - DNA, 20 bp, Homo sapiens
agtaagaaagtgaagcaaat

SEQ ID NO: 1361021 - DNA, 21 bp, Homo sapiens
agtaagaataccacatcaaat

SEQ ID NO: 1361022 - DNA, 14 bp, Homo sapiens
agtaagatatctca

SEQ ID NO: 1361023 - DNA, 22 bp, Homo sapiens
agtaagattgatatctataaaa

SEQ ID NO: 1361024 - DNA, 12 bp, Homo sapiens
agtaatcatcta

SEQ ID NO: 1361025 - DNA, 12 bp, Homo sapiens
agtaatgaattt

SEQ ID NO: 1361026 - DNA, 15 bp, Homo sapiens
agtaattgtgaaaaa

SEQ ID NO: 1361027 - DNA, 17 bp, Homo sapiens
agtacactgcctgcctt

SEQ ID NO: 1361028 - DNA, 19 bp, Homo sapiens
agtacactgcctgccttaa

SEQ ID NO: 1361029 - DNA, 16 bp, Homo sapiens
agtacttttttaaata

SEQ ID NO: 1361030 - DNA, 22 bp, Homo sapiens
agtagaaaatgtgaccctccaa

SEQ ID NO: 1361031 - DNA, 16 bp, Homo sapiens
agtagaactttgtata

SEQ ID NO: 1361032 - DNA, 18 bp, Homo sapiens
agtagaactttgtatagt

SEQ ID NO: 1361033 - DNA, 21 bp, Homo sapiens
agtagaactttgtatagttat

SEQ ID NO: 1361034 - DNA, 13 bp, Homo sapiens
agtagagccagct

SEQ ID NO: 1361035 - DNA, 16 bp, Homo sapiens
agtagatccatttcca

SEQ ID NO: 1361036 - DNA, 23 bp, Homo sapiens
agtagatccatttccattgctta

SEQ ID NO: 1361037 - DNA, 14 bp, Homo sapiens
agtagtcctgtgaa

SEQ ID NO: 1361038 - DNA, 13 bp, Homo sapiens
agtagttctgtat

SEQ ID NO: 1361039 - DNA, 14 bp, Homo sapiens
agtagttctgtatt

SEQ ID NO: 1361040 - DNA, 15 bp, Homo sapiens
agtagttctgtattt

SEQ ID NO: 1361041 - DNA, 22 bp, Homo sapiens
agtataaaatagtatgaaaatg

SEQ ID NO: 1361042 - DNA, 12 bp, Homo sapiens
agtatcccacat

SEQ ID NO: 1361043 - DNA, 23 bp, Homo sapiens
agtatgtatattaaaaaagagac

SEQ ID NO: 1361044 - DNA, 21 bp, Homo sapiens
agtattaatatctgaggatga

SEQ ID NO: 1361045 - DNA, 12 bp, Homo sapiens
agtattcttctc

SEQ ID NO: 1361046 - DNA, 14 bp, Homo sapiens
agtattcttctctt

SEQ ID NO: 1361047 - DNA, 12 bp, Homo sapiens
agtattgtttaa

SEQ ID NO: 1361048 - DNA, 16 bp, Homo sapiens
agtatttatttatgta

SEQ ID NO: 1361049 - DNA, 23 bp, Homo sapiens
agtattttcttctctgtgagaag

SEQ ID NO: 1361050 - DNA, 14 bp, Homo sapiens
agtattttttcaag

SEQ ID NO: 1361051 - DNA, 19 bp, Homo sapiens
agtattttttcaagttgta

SEQ ID NO: 1361052 - DNA, 15 bp, Homo sapiens
agtcaaggcctgctc

SEQ ID NO: 1361053 - DNA, 14 bp, Homo sapiens
agtcaccagagact

SEQ ID NO: 1361054 - DNA, 19 bp, Homo sapiens
agtcagtaggactccttat

SEQ ID NO: 1361055 - DNA, 18 bp, Homo sapiens
agcttggattaaatacat

SEQ ID NO: 1361056 - DNA, 21 bp, Homo sapiens
agcttggggccaccaaagctg

SEQ ID NO: 1361057 - DNA, 23 bp, Homo sapiens
agcttggggccaccaaagctgcc

SEQ ID NO: 1361058 - DNA, 18 bp, Homo sapiens
agcttggttctgtgaaca

SEQ ID NO: 1361059 - DNA, 21 bp, Homo sapiens
agctttgtttgttgtcagctg

SEQ ID NO: 1361060 - DNA, 20 bp, Homo sapiens
aggaaaatgtctgtaataat

SEQ ID NO: 1361061 - DNA, 23 bp, Homo sapiens
aggaaaatgtctgtaataataga

SEQ ID NO: 1361062 - DNA, 19 bp, Homo sapiens
aggaaacaaccatgtcatt

SEQ ID NO: 1361063 - DNA, 13 bp, Homo sapiens
aggaaacaagtga

SEQ ID NO: 1361064 - DNA, 23 bp, Homo sapiens
aggaaaccgagtagaaaatgtga

SEQ ID NO: 1361065 - DNA, 19 bp, Homo sapiens
aggaaagcaataaatgaat

SEQ ID NO: 1361066 - DNA, 22 bp, Homo sapiens
aggaaagcaataaatgaatggg

SEQ ID NO: 1361067 - DNA, 13 bp, Homo sapiens
aggaaatcaaagt

SEQ ID NO: 1361068 - DNA, 16 bp, Homo sapiens
aggaacatatgaaaat

SEQ ID NO: 1361069 - DNA, 16 bp, Homo sapiens
aggaacattgtgtcta

SEQ ID NO: 1361070 - DNA, 16 bp, Homo sapiens
aggaagaacgtttttt

SEQ ID NO: 1361071 - DNA, 19 bp, Homo sapiens
aggaagaactgaaaggctt

SEQ ID NO: 1361072 - DNA, 19 bp, Homo sapiens
aggaagcaaatagaagaga

SEQ ID NO: 1361073 - DNA, 19 bp, Homo sapiens
aggaagccggggaagagat

SEQ ID NO: 1361074 - DNA, 16 bp, Homo sapiens
aggaatgtgtggcctg

SEQ ID NO: 1361075 - DNA, 16 bp, Homo sapiens
aggacaatactggggt

SEQ ID NO: 1361076 - DNA, 13 bp, Homo sapiens
aggacatgcaata

SEQ ID NO: 1361077 - DNA, 13 bp, Homo sapiens
aggaccagggcct

SEQ ID NO: 1361078 - DNA, 15 bp, Homo sapiens
aggaccagggccttt

SEQ ID NO: 1361079 - DNA, 20 bp, Homo sapiens
aggaccagggccttttctgg

SEQ ID NO: 1361080 - DNA, 13 bp, Homo sapiens
aggacctcaggtg

SEQ ID NO: 1361081 - DNA, 21 bp, Homo sapiens
aggacctttccaccacagcca

SEQ ID NO: 1361082 - DNA, 16 bp, Homo sapiens
aggacgccactcattt

SEQ ID NO: 1361083 - DNA, 17 bp, Homo sapiens
aggacgccactcatttc

SEQ ID NO: 1361084 - DNA, 18 bp, Homo sapiens
aggacgccactcatttca

SEQ ID NO: 1361085 - DNA, 18 bp, Homo sapiens
aggactgactgaggcagt

SEQ ID NO: 1361086 - DNA, 19 bp, Homo sapiens
aggagaaccaaatctggaa

SEQ ID NO: 1361087 - DNA, 17 bp, Homo sapiens
aggagaagctgcatcca

SEQ ID NO: 1361088 - DNA, 13 bp, Homo sapiens
aggagacaaaaga

SEQ ID NO: 1361089 - DNA, 15 bp, Homo sapiens
aggagaggagagggg

SEQ ID NO: 1361090 - DNA, 20 bp, Homo sapiens
aggagagggcgctcctctct

SEQ ID NO: 1361091 - DNA, 16 bp, Homo sapiens
aggagaggggcacagg

SEQ ID NO: 1361092 - DNA, 23 bp, Homo sapiens
aggagatcgagaccatcctggct

SEQ ID NO: 1361093 - DNA, 22 bp, Homo sapiens
aggagctgccttggctcagaca

SEQ ID NO: 1361094 - DNA, 23 bp, Homo sapiens
aggagctgccttggctcagacat

SEQ ID NO: 1361095 - DNA, 20 bp, Homo sapiens
aggaggcgcccttggcttct

SEQ ID NO: 1361096 - DNA, 12 bp, Homo sapiens
aggagggagagg

SEQ ID NO: 1361097 - DNA, 15 bp, Homo sapiens
aggagggagagggag

SEQ ID NO: 1361098 - DNA, 14 bp, Homo sapiens
aggatctctaaaga

SEQ ID NO: 1361099 - DNA, 17 bp, Homo sapiens
aggatctcttgagcctg

SEQ ID NO: 1361100 - DNA, 22 bp, Homo sapiens
aggatctcttgagcctgggagg

SEQ ID NO: 1361101 - DNA, 24 bp, Homo sapiens
aggatgatgccagttacttgcttt

SEQ ID NO: 1361102 - DNA, 16 bp, Homo sapiens
aggattagtttagaac

SEQ ID NO: 1361103 - DNA, 17 bp, Homo sapiens
aggattagtttagaaca

SEQ ID NO: 1361104 - DNA, 23 bp, Homo sapiens
aggattttaacttaactgaaatg

SEQ ID NO: 1361105 - DNA, 19 bp, Homo sapiens
aggcaactgcattggcttt

SEQ ID NO: 1361106 - DNA, 21 bp, Homo sapiens
aggcaagagggggtggagggg

SEQ ID NO: 1361107 - DNA, 12 bp, Homo sapiens
aggcaccaggaa

SEQ ID NO: 1361108 - DNA, 14 bp, Homo sapiens
aggcaccaggaagc

SEQ ID NO: 1361109 - DNA, 22 bp, Homo sapiens
aggcagattttacagagcgcac

SEQ ID NO: 1361110 - DNA, 20 bp, Homo sapiens
aggcagcctctgtcaggcct

SEQ ID NO: 1361111 - DNA, 16 bp, Homo sapiens
aggcaggggtgggggt

SEQ ID NO: 1361112 - DNA, 23 bp, Homo sapiens
aggcaggggtgggggtggaggct

SEQ ID NO: 1361113 - DNA, 23 bp, Homo sapiens
aggcaggtgatctgctgcagagc

SEQ ID NO: 1361114 - DNA, 20 bp, Homo sapiens
aggcagtttgaggattagtt

SEQ ID NO: 1361115 - DNA, 15 bp, Homo sapiens
aggcatagaggcttc

SEQ ID NO: 1361116 - DNA, 14 bp, Homo sapiens
aggcatctgagggg

SEQ ID NO: 1361117 - DNA, 13 bp, Homo sapiens
aggcatggccctg

SEQ ID NO: 1361118 - DNA, 15 bp, Homo sapiens
aggcatggtggccca

SEQ ID NO: 1361119 - DNA, 20 bp, Homo sapiens
aggcatttgctgaatacaga

SEQ ID NO: 1361120 - DNA, 19 bp, Homo sapiens
aggccaagaatattgcaaa

SEQ ID NO: 1361121 - DNA, 18 bp, Homo sapiens
aggccaaggtgggaggat

SEQ ID NO: 1361122 - DNA, 15 bp, Homo sapiens
aggccacctccccag

SEQ ID NO: 1361123 - DNA, 17 bp, Homo sapiens
aggccacctccccagca

SEQ ID NO: 1361124 - DNA, 14 bp, Homo sapiens
aggccagcctccga

SEQ ID NO: 1361125 - DNA, 18 bp, Homo sapiens
aggccagcctccgagagg

SEQ ID NO: 1361126 - DNA, 13 bp, Homo sapiens
aggcccatagcag

SEQ ID NO: 1361127 - DNA, 17 bp, Homo sapiens
agtcatgtatgtttctc

SEQ ID NO: 1361128 - DNA, 14 bp, Homo sapiens
agtcattaaagaca

SEQ ID NO: 1361129 - DNA, 22 bp, Homo sapiens
agtcattcagcagcaaattttc

SEQ ID NO: 1361130 - DNA, 14 bp, Homo sapiens
agtccaggctgccg

SEQ ID NO: 1361131 - DNA, 18 bp, Homo sapiens
agtccaggctgccgtggg

SEQ ID NO: 1361132 - DNA, 19 bp, Homo sapiens
agtccattctcccaggtac

SEQ ID NO: 1361133 - DNA, 20 bp, Homo sapiens
agtcccagctacttgggagg

SEQ ID NO: 1361134 - DNA, 13 bp, Homo sapiens
agtccccacccct

SEQ ID NO: 1361135 - DNA, 15 bp, Homo sapiens
agtccccacccctgc

SEQ ID NO: 1361136 - DNA, 23 bp, Homo sapiens
agtccgtgggacgggatggttct

SEQ ID NO: 1361137 - DNA, 18 bp, Homo sapiens
agtcctgtgaatgccact

SEQ ID NO: 1361138 - DNA, 13 bp, Homo sapiens
agtcgtgcctgtg

SEQ ID NO: 1361139 - DNA, 18 bp, Homo sapiens
agtctacccgacataagt

SEQ ID NO: 1361140 - DNA, 18 bp, Homo sapiens
agtctgaggccgttgctg

SEQ ID NO: 1361141 - DNA, 17 bp, Homo sapiens
agtctgagggcttgtag

SEQ ID NO: 1361142 - DNA, 21 bp, Homo sapiens
agtctgagggcttgtagttct

SEQ ID NO: 1361143 - DNA, 22 bp, Homo sapiens
agtctggccctagactcggggt

SEQ ID NO: 1361144 - DNA, 17 bp, Homo sapiens
agtctgtactaaacagt

SEQ ID NO: 1361145 - DNA, 22 bp, Homo sapiens
agtctgtactaaacagtaagat

SEQ ID NO: 1361146 - DNA, 17 bp, Homo sapiens
agtctgtggatcagaga

SEQ ID NO: 1361147 - DNA, 19 bp, Homo sapiens
agtcttactacagaaatga

SEQ ID NO: 1361148 - DNA, 20 bp, Homo sapiens
agtcttagatcatagtttta

SEQ ID NO: 1361149 - DNA, 14 bp, Homo sapiens
agtctttaataaat

SEQ ID NO: 1361150 - DNA, 16 bp, Homo sapiens
agtcttttttttcctg

SEQ ID NO: 1361151 - DNA, 15 bp, Homo sapiens
agtgaaacttttcta

SEQ ID NO: 1361152 - DNA, 14 bp, Homo sapiens
agtgaatgctggga

SEQ ID NO: 1361153 - DNA, 16 bp, Homo sapiens
agtgaatttgcactgt

SEQ ID NO: 1361154 - DNA, 24 bp, Homo sapiens
agtgacaaataaattaggaccaag

SEQ ID NO: 1361155 - DNA, 17 bp, Homo sapiens
agtgagaccctgtctca

SEQ ID NO: 1361156 - DNA, 14 bp, Homo sapiens
agtgaggaaatcaa

SEQ ID NO: 1361157 - DNA, 20 bp, Homo sapiens
agtgatactatccagttact

SEQ ID NO: 1361158 - DNA, 21 bp, Homo sapiens
agtgatagtcttttgcttttg

SEQ ID NO: 1361159 - DNA, 21 bp, Homo sapiens
agtgatgctgtgctatgaatt

SEQ ID NO: 1361160 - DNA, 22 bp, Homo sapiens
agtgcagaatgtaagtgggccc

SEQ ID NO: 1361161 - DNA, 19 bp, Homo sapiens
agtgcagagccttctcaga

SEQ ID NO: 1361162 - DNA, 21 bp, Homo sapiens
agtgcagagccttctcagaag

SEQ ID NO: 1361163 - DNA, 21 bp, Homo sapiens
agtgcatttgtgctagaaatt

SEQ ID NO: 1361164 - DNA, 14 bp, Homo sapiens
agtgcatttttgta

SEQ ID NO: 1361165 - DNA, 20 bp, Homo sapiens
agtgcatttttgtaaatgtg

SEQ ID NO: 1361166 - DNA, 12 bp, Homo sapiens
agtgccaaagaa

SEQ ID NO: 1361167 - DNA, 12 bp, Homo sapiens
agtgccctccag

SEQ ID NO: 1361168 - DNA, 15 bp, Homo sapiens
agtgccctccagccc

SEQ ID NO: 1361169 - DNA, 18 bp, Homo sapiens
agtgccctccagccccgc

SEQ ID NO: 1361170 - DNA, 18 bp, Homo sapiens
agtgccgcatctcacagc

SEQ ID NO: 1361171 - DNA, 21 bp, Homo sapiens
agtgcctttgcagctcagaac

SEQ ID NO: 1361172 - DNA, 22 bp, Homo sapiens
agtgctggagtctcctgaggac

SEQ ID NO: 1361173 - DNA, 13 bp, Homo sapiens
agtgcttggaaca

SEQ ID NO: 1361174 - DNA, 13 bp, Homo sapiens
agtgctttaatgg

SEQ ID NO: 1361175 - DNA, 19 bp, Homo sapiens
agtgcttttaagtgaaaat

SEQ ID NO: 1361176 - DNA, 23 bp, Homo sapiens
agtgcttttaagtgaaaatggtc

SEQ ID NO: 1361177 - DNA, 19 bp, Homo sapiens
agtggaaaaatagcctgcc

SEQ ID NO: 1361178 - DNA, 15 bp, Homo sapiens
agtggaaatgttcta

SEQ ID NO: 1361179 - DNA, 19 bp, Homo sapiens
agtggaccttaggccttcc

SEQ ID NO: 1361180 - DNA, 20 bp, Homo sapiens
agtggaccttaggccttcct

SEQ ID NO: 1361181 - DNA, 18 bp, Homo sapiens
agtggcaccgcctcccca

SEQ ID NO: 1361182 - DNA, 18 bp, Homo sapiens
agtggccaagaagcagtg

SEQ ID NO: 1361183 - DNA, 18 bp, Homo sapiens
agtgggcccacccggtgg

SEQ ID NO: 1361184 - DNA, 14 bp, Homo sapiens
agtggggtgctggg

SEQ ID NO: 1361185 - DNA, 21 bp, Homo sapiens
agtggggtgctgggaggaggg

SEQ ID NO: 1361186 - DNA, 14 bp, Homo sapiens
agtggtgggggaag

SEQ ID NO: 1361187 - DNA, 18 bp, Homo sapiens
agtggttgaatatgatta

SEQ ID NO: 1361188 - DNA, 21 bp, Homo sapiens
agtgtaaaatattttgaatca

SEQ ID NO: 1361189 - DNA, 16 bp, Homo sapiens
agtgtaacttgcttaa

SEQ ID NO: 1361190 - DNA, 23 bp, Homo sapiens
tgccaggacatgcaataaaattt

SEQ ID NO: 1361191 - DNA, 17 bp, Homo sapiens
tgccaggcaggggtggg

SEQ ID NO: 1361192 - DNA, 15 bp, Homo sapiens
tgccaggccagcctc

SEQ ID NO: 1361193 - DNA, 18 bp, Homo sapiens
tgccagttacttgcttta

SEQ ID NO: 1361194 - DNA, 14 bp, Homo sapiens
tgccatagagtaca

SEQ ID NO: 1361195 - DNA, 15 bp, Homo sapiens
tgccatagagtacac

SEQ ID NO: 1361196 - DNA, 12 bp, Homo sapiens
tgccatctgtag

SEQ ID NO: 1361197 - DNA, 15 bp, Homo sapiens
tgccatgtgcacctt

SEQ ID NO: 1361198 - DNA, 16 bp, Homo sapiens
tgccattttaaggaaa

SEQ ID NO: 1361199 - DNA, 16 bp, Homo sapiens
tgcccaagccagaggc

SEQ ID NO: 1361200 - DNA, 15 bp, Homo sapiens
tgcccaccccctgcc

SEQ ID NO: 1361201 - DNA, 18 bp, Homo sapiens
tgcccaccccctgccctg

SEQ ID NO: 1361202 - DNA, 19 bp, Homo sapiens
tgcccaccccctgccctgc

SEQ ID NO: 1361203 - DNA, 16 bp, Homo sapiens
tgcccacctgccggcc

SEQ ID NO: 1361204 - DNA, 19 bp, Homo sapiens
tgcccacggagtcgtgggg

SEQ ID NO: 1361205 - DNA, 19 bp, Homo sapiens
tgcccagaatactgatgga

SEQ ID NO: 1361206 - DNA, 20 bp, Homo sapiens
tgcccatcgtgaagaagcct

SEQ ID NO: 1361207 - DNA, 23 bp, Homo sapiens
tgcccatcgtgaagaagcctgta

SEQ ID NO: 1361208 - DNA, 19 bp, Homo sapiens
tgccccatctcccctcagc

SEQ ID NO: 1361209 - DNA, 22 bp, Homo sapiens
tgcccccaccccggggaccctg

SEQ ID NO: 1361210 - DNA, 23 bp, Homo sapiens
tgcccccaccccggggaccctgt

SEQ ID NO: 1361211 - DNA, 14 bp, Homo sapiens
tgccccctgcagac

SEQ ID NO: 1361212 - DNA, 22 bp, Homo sapiens
tgccccgcccccagtccccacc

SEQ ID NO: 1361213 - DNA, 14 bp, Homo sapiens
tgcccctcccccag

SEQ ID NO: 1361214 - DNA, 16 bp, Homo sapiens
tgcccctcccccagcc

SEQ ID NO: 1361215 - DNA, 14 bp, Homo sapiens
tgcccctctcacca

SEQ ID NO: 1361216 - DNA, 15 bp, Homo sapiens
tgcccctctcaccaa

SEQ ID NO: 1361217 - DNA, 14 bp, Homo sapiens
tgcccgttcttgaa

SEQ ID NO: 1361218 - DNA, 14 bp, Homo sapiens
tgccctctcaggcc

SEQ ID NO: 1361219 - DNA, 20 bp, Homo sapiens
tgccctcttctcgtgcctcc

SEQ ID NO: 1361220 - DNA, 11 bp, Homo sapiens
tgccctggctg

SEQ ID NO: 1361221 - DNA, 18 bp, Homo sapiens
tgccctggctgctgcccc

SEQ ID NO: 1361222 - DNA, 13 bp, Homo sapiens
tgcccttgggcca

SEQ ID NO: 1361223 - DNA, 17 bp, Homo sapiens
tgccgccccctcctgaa

SEQ ID NO: 1361224 - DNA, 20 bp, Homo sapiens
tgccgcctgcactcctcagg

SEQ ID NO: 1361225 - DNA, 13 bp, Homo sapiens
tgccgtctctgga

SEQ ID NO: 1361226 - DNA, 18 bp, Homo sapiens
tgcctcaagaggaatgaa

SEQ ID NO: 1361227 - DNA, 15 bp, Homo sapiens
tgcctcactaatttt

SEQ ID NO: 1361228 - DNA, 18 bp, Homo sapiens
tgcctcactaatttttgt

SEQ ID NO: 1361229 - DNA, 17 bp, Homo sapiens
tgcctccaggtgcagag

SEQ ID NO: 1361230 - DNA, 21 bp, Homo sapiens
tgcctccaggtgcagaggtac

SEQ ID NO: 1361231 - DNA, 17 bp, Homo sapiens
tgcctccccatttccca

SEQ ID NO: 1361232 - DNA, 12 bp, Homo sapiens
tgcctctgtgct

SEQ ID NO: 1361233 - DNA, 13 bp, Homo sapiens
tgcctctgtgctg

SEQ ID NO: 1361234 - DNA, 14 bp, Homo sapiens
tgcctctgtgctgt

SEQ ID NO: 1361235 - DNA, 16 bp, Homo sapiens
tgcctctgtgctgtgt

SEQ ID NO: 1361236 - DNA, 17 bp, Homo sapiens
tgcctctgtgctgtgtg

SEQ ID NO: 1361237 - DNA, 21 bp, Homo sapiens
tgcctctgtgctgtgtgtgac

SEQ ID NO: 1361238 - DNA, 21 bp, Homo sapiens
tgcctcttctctactctaggg

SEQ ID NO: 1361239 - DNA, 12 bp, Homo sapiens
tgcctgaataaa

SEQ ID NO: 1361240 - DNA, 17 bp, Homo sapiens
tgcctgaataaagagcc

SEQ ID NO: 1361241 - DNA, 13 bp, Homo sapiens
tgcctgagaggca

SEQ ID NO: 1361242 - DNA, 14 bp, Homo sapiens
tgcctgagaggcag

SEQ ID NO: 1361243 - DNA, 15 bp, Homo sapiens
tgcctgagaggcagg

SEQ ID NO: 1361244 - DNA, 17 bp, Homo sapiens
tgcctgagaggcaggca

SEQ ID NO: 1361245 - DNA, 19 bp, Homo sapiens
tgcctgagaggcaggcata

SEQ ID NO: 1361246 - DNA, 12 bp, Homo sapiens
tgcctgcagggc

SEQ ID NO: 1361247 - DNA, 14 bp, Homo sapiens
tgcctgcagggcca

SEQ ID NO: 1361248 - DNA, 23 bp, Homo sapiens
tgcctggagtgtatgactgcaca

SEQ ID NO: 1361249 - DNA, 22 bp, Homo sapiens
tgcctggccttgtcctcagcca

SEQ ID NO: 1361250 - DNA, 19 bp, Homo sapiens
tgcctggggtgttagtggc

SEQ ID NO: 1361251 - DNA, 20 bp, Homo sapiens
tgcctggtgcttccaaatat

SEQ ID NO: 1361252 - DNA, 15 bp, Homo sapiens
tgcctgtaacttgag

SEQ ID NO: 1361253 - DNA, 11 bp, Homo sapiens
tgcctgtggcg

SEQ ID NO: 1361254 - DNA, 19 bp, Homo sapiens
tgcctgtgtccatgcgctc

SEQ ID NO: 1361255 - DNA, 21 bp, Homo sapiens
tgcctgtgtccatgcgctcag

SEQ ID NO: 1361256 - DNA, 16 bp, Homo sapiens
tgcctgtttctgattt

SEQ ID NO: 1361257 - DNA, 16 bp, Homo sapiens
tgccttaaaaccaaag

SEQ ID NO: 1361258 - DNA, 20 bp, Homo sapiens
tgccttaaaaccaaagaggg

SEQ ID NO: 1361259 - DNA, 22 bp, Homo sapiens
tgccttaaaaccaaagagggct

SEQ ID NO: 1361260 - DNA, 17 bp, Homo sapiens
tgccttcgcttcttgcc

SEQ ID NO: 1361261 - DNA, 22 bp, Homo sapiens
tgccttgctgtttgtcctgaga

SEQ ID NO: 1361262 - DNA, 13 bp, Homo sapiens
tgccttggctcag

SEQ ID NO: 1361263 - DNA, 16 bp, Homo sapiens
tgccttggctcagaca

SEQ ID NO: 1361264 - DNA, 13 bp, Homo sapiens
tgcgaccctgggg

SEQ ID NO: 1361265 - DNA, 15 bp, Homo sapiens
tgcgaccctgggggc

SEQ ID NO: 1361266 - DNA, 20 bp, Homo sapiens
tgcgcatcttgcctccaggt

SEQ ID NO: 1361267 - DNA, 23 bp, Homo sapiens
tgcgccccctccgccctgccact

SEQ ID NO: 1361268 - DNA, 13 bp, Homo sapiens
tgcgctcagggcc

SEQ ID NO: 1361269 - DNA, 22 bp, Homo sapiens
tgcgctcagggccatgctgagg

SEQ ID NO: 1361270 - DNA, 14 bp, Homo sapiens
tgcgcttgcttttc

SEQ ID NO: 1361271 - DNA, 19 bp, Homo sapiens
ttctttttttcctttttaa

SEQ ID NO: 1361272 - DNA, 20 bp, Homo sapiens
ttctttttttttaagttctt

SEQ ID NO: 1361273 - DNA, 21 bp, Homo sapiens
ttcttttttttttttttgaga

SEQ ID NO: 1361274 - DNA, 13 bp, Homo sapiens
ttgaaaaatataa

SEQ ID NO: 1361275 - DNA, 18 bp, Homo sapiens
ttgaaaacttcagaagca

SEQ ID NO: 1361276 - DNA, 16 bp, Homo sapiens
ttgaaccataaaatgt

SEQ ID NO: 1361277 - DNA, 21 bp, Homo sapiens
ttgaaccataaaatgtccagt

SEQ ID NO: 1361278 - DNA, 16 bp, Homo sapiens
ttgaactcttctcatt

SEQ ID NO: 1361279 - DNA, 20 bp, Homo sapiens
ttgaactcttctcattactt

SEQ ID NO: 1361280 - DNA, 14 bp, Homo sapiens
ttgaagccaaagaa

SEQ ID NO: 1361281 - DNA, 16 bp, Homo sapiens
ttgaagtaatgaattt

SEQ ID NO: 1361282 - DNA, 16 bp, Homo sapiens
ttgaagtgtataatat

SEQ ID NO: 1361283 - DNA, 21 bp, Homo sapiens
ttgaagtgtataatataaaaa

SEQ ID NO: 1361284 - DNA, 21 bp, Homo sapiens
ttgaataaacaccactggatt

SEQ ID NO: 1361285 - DNA, 10 bp, Homo sapiens
ttgaatcaat

SEQ ID NO: 1361286 - DNA, 14 bp, Homo sapiens
ttgaatcaataata

SEQ ID NO: 1361287 - DNA, 22 bp, Homo sapiens
ttgaatcaataatatattttct

SEQ ID NO: 1361288 - DNA, 23 bp, Homo sapiens
ttgaatcaataatatattttctg

SEQ ID NO: 1361289 - DNA, 15 bp, Homo sapiens
ttgaattttaaatct

SEQ ID NO: 1361290 - DNA, 14 bp, Homo sapiens
ttgacaactgtgac

SEQ ID NO: 1361291 - DNA, 16 bp, Homo sapiens
ttgacaactgtgactg

SEQ ID NO: 1361292 - DNA, 14 bp, Homo sapiens
ttgacaagctggct

SEQ ID NO: 1361293 - DNA, 22 bp, Homo sapiens
ttgacactgaaagttttgtaaa

SEQ ID NO: 1361294 - DNA, 22 bp, Homo sapiens
ttgacactgaacttaataactg

SEQ ID NO: 1361295 - DNA, 22 bp, Homo sapiens
ttgactaactcaaatacacatt

SEQ ID NO: 1361296 - DNA, 14 bp, Homo sapiens
ttgactaattttac

SEQ ID NO: 1361297 - DNA, 12 bp, Homo sapiens
ttgactctgggt

SEQ ID NO: 1361298 - DNA, 19 bp, Homo sapiens
ttgactctgggtccttcct

SEQ ID NO: 1361299 - DNA, 19 bp, Homo sapiens
ttgagaagccttcagctcc

SEQ ID NO: 1361300 - DNA, 22 bp, Homo sapiens
ttgagacacggagcccagccct

SEQ ID NO: 1361301 - DNA, 22 bp, Homo sapiens
ttgagaccgtgaagatactttg

SEQ ID NO: 1361302 - DNA, 15 bp, Homo sapiens
ttgagatcagcctgg

SEQ ID NO: 1361303 - DNA, 19 bp, Homo sapiens
ttgagccgggcccctgggc

SEQ ID NO: 1361304 - DNA, 20 bp, Homo sapiens
ttgagccgggcccctgggct

SEQ ID NO: 1361305 - DNA, 11 bp, Homo sapiens
ttgagcctggg

SEQ ID NO: 1361306 - DNA, 14 bp, Homo sapiens
ttgagctgccttcc

SEQ ID NO: 1361307 - DNA, 17 bp, Homo sapiens
ttgaggattagtttaga

SEQ ID NO: 1361308 - DNA, 18 bp, Homo sapiens
ttgaggattagtttagaa

SEQ ID NO: 1361309 - DNA, 20 bp, Homo sapiens
ttgaggccaagaatattgca

SEQ ID NO: 1361310 - DNA, 15 bp, Homo sapiens
ttgagtattgtttaa

SEQ ID NO: 1361311 - DNA, 20 bp, Homo sapiens
ttgagttgattcagctctgc

SEQ ID NO: 1361312 - DNA, 18 bp, Homo sapiens
ttgagttgtttttgtata

SEQ ID NO: 1361313 - DNA, 19 bp, Homo sapiens
ttgagttgtttttgtatat

SEQ ID NO: 1361314 - DNA, 19 bp, Homo sapiens
ttgatacagttttcagaaa

SEQ ID NO: 1361315 - DNA, 19 bp, Homo sapiens
ttgatagggaactggggaa

SEQ ID NO: 1361316 - DNA, 17 bp, Homo sapiens
ttgatcatgtacttttt

SEQ ID NO: 1361317 - DNA, 20 bp, Homo sapiens
ttgatgaaacgtcatgtgtt

SEQ ID NO: 1361318 - DNA, 14 bp, Homo sapiens
ttgtgtgaaattgc

SEQ ID NO: 1361319 - DNA, 16 bp, Homo sapiens
ttgtgtgaacttggaa

SEQ ID NO: 1361320 - DNA, 18 bp, Homo sapiens
ttgtgtgtttatttcact

SEQ ID NO: 1361321 - DNA, 16 bp, Homo sapiens
ttgtgttttttaagat

SEQ ID NO: 1361322 - DNA, 17 bp, Homo sapiens
ttgtgttttttaagata

SEQ ID NO: 1361323 - DNA, 21 bp, Homo sapiens
ttgtgttttttaagatagtgt

SEQ ID NO: 1361324 - DNA, 13 bp, Homo sapiens
ttgttaatacaag

SEQ ID NO: 1361325 - DNA, 14 bp, Homo sapiens
ttgttatcaaaata

SEQ ID NO: 1361326 - DNA, 23 bp, Homo sapiens
ttgttctcagaatcccttaacag

SEQ ID NO: 1361327 - DNA, 14 bp, Homo sapiens
ttgttgtacttaaa

SEQ ID NO: 1361328 - DNA, 16 bp, Homo sapiens
ttgtttcgtggggagg

SEQ ID NO: 1361329 - DNA, 19 bp, Homo sapiens
ttgtttggtaaatgtttct

SEQ ID NO: 1361330 - DNA, 13 bp, Homo sapiens
ttgttttaaaact

SEQ ID NO: 1361331 - DNA, 14 bp, Homo sapiens
ttgttttaaaactg

SEQ ID NO: 1361332 - DNA, 18 bp, Homo sapiens
ttgttttctgactaatta

SEQ ID NO: 1361333 - DNA, 17 bp, Homo sapiens
ttgttttggatggcttg

SEQ ID NO: 1361334 - DNA, 13 bp, Homo sapiens
ttgtttttgtata

SEQ ID NO: 1361335 - DNA, 17 bp, Homo sapiens
tttaaaaagggaagaaa

SEQ ID NO: 1361336 - DNA, 13 bp, Homo sapiens
tttaaaaatagaa

SEQ ID NO: 1361337 - DNA, 16 bp, Homo sapiens
tttaaaaatagaaaca

SEQ ID NO: 1361338 - DNA, 15 bp, Homo sapiens
tttaaaaattgttat

SEQ ID NO: 1361339 - DNA, 13 bp, Homo sapiens
tttaaaagaatga

SEQ ID NO: 1361340 - DNA, 17 bp, Homo sapiens
tttaaaaggaaagaaaa

SEQ ID NO: 1361341 - DNA, 18 bp, Homo sapiens
tttaaaatgtaatttaaa

SEQ ID NO: 1361342 - DNA, 10 bp, Homo sapiens
tttaaaattt

SEQ ID NO: 1361343 - DNA, 17 bp, Homo sapiens
tttaaaattttgtatgt

SEQ ID NO: 1361344 - DNA, 15 bp, Homo sapiens
tttaaactgtcgtgt

SEQ ID NO: 1361345 - DNA, 18 bp, Homo sapiens
tttaaagaaaaaaatgtc

SEQ ID NO: 1361346 - DNA, 18 bp, Homo sapiens
tttaaagaaaagatgaaa

SEQ ID NO: 1361347 - DNA, 15 bp, Homo sapiens
tttaaagtattttct

SEQ ID NO: 1361348 - DNA, 14 bp, Homo sapiens
tttaaagtgcaaaa

SEQ ID NO: 1361349 - DNA, 14 bp, Homo sapiens
tttaaatattttct

SEQ ID NO: 1361350 - DNA, 17 bp, Homo sapiens
tttaaatattttctatt

SEQ ID NO: 1361351 - DNA, 19 bp, Homo sapiens
tttaaatattttctatttt

SEQ ID NO: 1361352 - DNA, 19 bp, Homo sapiens
tttaaatctaaatctattt

SEQ ID NO: 1361353 - DNA, 12 bp, Homo sapiens
tttaaatgccat

SEQ ID NO: 1361354 - DNA, 12 bp, Homo sapiens
tttaacagaaat

SEQ ID NO: 1361355 - DNA, 14 bp, Homo sapiens
tttaacagaaattg

SEQ ID NO: 1361356 - DNA, 19 bp, Homo sapiens
tttaacagaaattgtatat

SEQ ID NO: 1361357 - DNA, 12 bp, Homo sapiens
tttaagatgtga

SEQ ID NO: 1361358 - DNA, 14 bp, Homo sapiens
tttaagatgtgaaa

SEQ ID NO: 1361359 - DNA, 17 bp, Homo sapiens
tttaagggaaagaaaat

SEQ ID NO: 1361360 - DNA, 15 bp, Homo sapiens
tttaagtgaaaatgg

SEQ ID NO: 1361361 - DNA, 13 bp, Homo sapiens
tttaagttttgac

SEQ ID NO: 1361362 - DNA, 18 bp, Homo sapiens
tttaagttttgacaagct

SEQ ID NO: 1361363 - DNA, 20 bp, Homo sapiens
tttaataagctactagcaaa

SEQ ID NO: 1361364 - DNA, 16 bp, Homo sapiens
tttaatctactgcatt

SEQ ID NO: 1361365 - DNA, 17 bp, Homo sapiens
tttaatctactgcattt

SEQ ID NO: 1361366 - DNA, 18 bp, Homo sapiens
tttaatctactgcattta

SEQ ID NO: 1361367 - DNA, 13 bp, Homo sapiens
tttaattgtattt

SEQ ID NO: 1361368 - DNA, 20 bp, Homo sapiens
tttaattgtccagtttgtct

SEQ ID NO: 1361369 - DNA, 15 bp, Homo sapiens
tttaattgtttaaaa

SEQ ID NO: 1361370 - DNA, 14 bp, Homo sapiens
tttaattttcactt

SEQ ID NO: 1361371 - DNA, 17 bp, Homo sapiens
tttaattttttttagta

SEQ ID NO: 1361372 - DNA, 14 bp, Homo sapiens
tttacacagaaaca

SEQ ID NO: 1361373 - DNA, 20 bp, Homo sapiens
tttacacagaaacactgcct

SEQ ID NO: 1361374 - DNA, 13 bp, Homo sapiens
tttacagaaatgg

SEQ ID NO: 1361375 - DNA, 23 bp, Homo sapiens
tttacagctttcatgattagcaa

SEQ ID NO: 1361376 - DNA, 18 bp, Homo sapiens
tttaccttttatgcaaaa

SEQ ID NO: 1361377 - DNA, 21 bp, Homo sapiens
tttactcatcctccaggaact

SEQ ID NO: 1361378 - DNA, 16 bp, Homo sapiens
tttactgcagctttgt

SEQ ID NO: 1361379 - DNA, 15 bp, Homo sapiens
tttactgtgatgttt

SEQ ID NO: 1361380 - DNA, 11 bp, Homo sapiens
tttacttaaac

SEQ ID NO: 1361381 - DNA, 16 bp, Homo sapiens
tttagaacagcattgt

SEQ ID NO: 1361382 - DNA, 15 bp, Homo sapiens
tttagaacaggtttt

SEQ ID NO: 1361383 - DNA, 21 bp, Homo sapiens
tttagaataagaatttgcata

SEQ ID NO: 1361384 - DNA, 11 bp, Homo sapiens
tttagaattga

SEQ ID NO: 1361385 - DNA, 13 bp, Homo sapiens
tttagaattgaag

SEQ ID NO: 1361386 - DNA, 17 bp, Homo sapiens
tttagaattgaaggttt

SEQ ID NO: 1361387 - DNA, 19 bp, Homo sapiens
tttagaccctattgctgct

SEQ ID NO: 1361388 - DNA, 22 bp, Homo sapiens
tttagaccctattgctgcttga

SEQ ID NO: 1361389 - DNA, 12 bp, Homo sapiens
tttagacttgaa

SEQ ID NO: 1361390 - DNA, 19 bp, Homo sapiens
tttagacttgaaaagagac

SEQ ID NO: 1361391 - DNA, 21 bp, Homo sapiens
tttagtgtttttttatttcta

SEQ ID NO: 1361392 - DNA, 16 bp, Homo sapiens
tttataaacagaaatg

SEQ ID NO: 1361393 - DNA, 14 bp, Homo sapiens
tttataataaaaat

SEQ ID NO: 1361394 - DNA, 15 bp, Homo sapiens
tttataattgtacaa

SEQ ID NO: 1361395 - DNA, 13 bp, Homo sapiens
tttatacaaaata

SEQ ID NO: 1361396 - DNA, 14 bp, Homo sapiens
tctggttccagggt

SEQ ID NO: 1361397 - DNA, 12 bp, Homo sapiens
tctgtaaatatg

SEQ ID NO: 1361398 - DNA, 13 bp, Homo sapiens
tctgtaataatag

SEQ ID NO: 1361399 - DNA, 19 bp, Homo sapiens
tctgtaataatagactgta

SEQ ID NO: 1361400 - DNA, 22 bp, Homo sapiens
tctgtactaaacagtaagatat

SEQ ID NO: 1361401 - DNA, 22 bp, Homo sapiens
tctgtatttgaaagtgcctttg

SEQ ID NO: 1361402 - DNA, 19 bp, Homo sapiens
tctgtccgagctttgaaaa

SEQ ID NO: 1361403 - DNA, 21 bp, Homo sapiens
tctgtctttcctgaaccatgt

SEQ ID NO: 1361404 - DNA, 17 bp, Homo sapiens
tctgtgaacagagagac

SEQ ID NO: 1361405 - DNA, 17 bp, Homo sapiens
tctgtgatgagctgatc

SEQ ID NO: 1361406 - DNA, 20 bp, Homo sapiens
tctgtgggctacatgctggg

SEQ ID NO: 1361407 - DNA, 23 bp, Homo sapiens
tctgtgggctacatgctggggtc

SEQ ID NO: 1361408 - DNA, 16 bp, Homo sapiens
tctgtggttcctctgc

SEQ ID NO: 1361409 - DNA, 20 bp, Homo sapiens
tctgtgtgtgtgtgtgtgcg

SEQ ID NO: 1361410 - DNA, 16 bp, Homo sapiens
tctgtgttgccaagct

SEQ ID NO: 1361411 - DNA, 21 bp, Homo sapiens
tctgttatgggcttttgggga

SEQ ID NO: 1361412 - DNA, 16 bp, Homo sapiens
tctgtttcctgacatt

SEQ ID NO: 1361413 - DNA, 13 bp, Homo sapiens
tcttaaaaagtgg

SEQ ID NO: 1361414 - DNA, 13 bp, Homo sapiens
tcttaatgttcct

SEQ ID NO: 1361415 - DNA, 20 bp, Homo sapiens
tcttaatgttcctcaaagct

SEQ ID NO: 1361416 - DNA, 11 bp, Homo sapiens
tcttactttgt

SEQ ID NO: 1361417 - DNA, 13 bp, Homo sapiens
tcttactttgtaa

SEQ ID NO: 1361418 - DNA, 20 bp, Homo sapiens
tcttactttgtaaattctga

SEQ ID NO: 1361419 - DNA, 22 bp, Homo sapiens
tcttactttgtaaattctgatt

SEQ ID NO: 1361420 - DNA, 17 bp, Homo sapiens
tcttagatcatagtttt

SEQ ID NO: 1361421 - DNA, 14 bp, Homo sapiens
tcttagttatatag

SEQ ID NO: 1361422 - DNA, 16 bp, Homo sapiens
tcttatgtgacattaa

SEQ ID NO: 1361423 - DNA, 21 bp, Homo sapiens
tcttatgtgacattaacaaat

SEQ ID NO: 1361424 - DNA, 12 bp, Homo sapiens
tcttcaaccagt

SEQ ID NO: 1361425 - DNA, 15 bp, Homo sapiens
tcttcagtaagccgt

SEQ ID NO: 1361426 - DNA, 16 bp, Homo sapiens
tcttcagtaagccgtg

SEQ ID NO: 1361427 - DNA, 23 bp, Homo sapiens
tcttcatatcatcacaacattat

SEQ ID NO: 1361428 - DNA, 13 bp, Homo sapiens
tcttcccatgcat

SEQ ID NO: 1361429 - DNA, 13 bp, Homo sapiens
tcttcctgtgatc

SEQ ID NO: 1361430 - DNA, 21 bp, Homo sapiens
tcttccttgaagaactgcagg

SEQ ID NO: 1361431 - DNA, 15 bp, Homo sapiens
tcttctcattacttg

SEQ ID NO: 1361432 - DNA, 20 bp, Homo sapiens
tcttctgagcttacgtagtt

SEQ ID NO: 1361433 - DNA, 13 bp, Homo sapiens
tcttctggctcaa

SEQ ID NO: 1361434 - DNA, 21 bp, Homo sapiens
tcttctggctcaaaaagagaa

SEQ ID NO: 1361435 - DNA, 20 bp, Homo sapiens
tcttctggggcaggctgggc

SEQ ID NO: 1361436 - DNA, 21 bp, Homo sapiens
tcttctggggcaggctgggcc

SEQ ID NO: 1361437 - DNA, 21 bp, Homo sapiens
tcttctgtgtttataaaatat

SEQ ID NO: 1361438 - DNA, 21 bp, Homo sapiens
tcttgagctggcctctctagc

SEQ ID NO: 1361439 - DNA, 21 bp, Homo sapiens
tcttgagttgtttttgtatat

SEQ ID NO: 1361440 - DNA, 20 bp, Homo sapiens
tcttgagtttgtcgctcatg

SEQ ID NO: 1361441 - DNA, 14 bp, Homo sapiens
tcttgatacattca

SEQ ID NO: 1361442 - DNA, 14 bp, Homo sapiens
tcttgcccatcctg

SEQ ID NO: 1361443 - DNA, 13 bp, Homo sapiens
tcttgcctctgtg

SEQ ID NO: 1361444 - DNA, 18 bp, Homo sapiens
tcttgcttccctaatcta

SEQ ID NO: 1361445 - DNA, 17 bp, Homo sapiens
tcttggcaataaatttt

SEQ ID NO: 1361446 - DNA, 22 bp, Homo sapiens
tcttggcaataaattttgaaaa

SEQ ID NO: 1361447 - DNA, 21 bp, Homo sapiens
tcttggcttaatcattttcat

SEQ ID NO: 1361448 - DNA, 20 bp, Homo sapiens
tcttgggcagagctggctct

SEQ ID NO: 1361449 - DNA, 21 bp, Homo sapiens
tcttgggcagagctggctctg

SEQ ID NO: 1361450 - DNA, 13 bp, Homo sapiens
tcttggggcccag

SEQ ID NO: 1361451 - DNA, 17 bp, Homo sapiens
tcttggggcccagtgca

SEQ ID NO: 1361452 - DNA, 14 bp, Homo sapiens
tcttgtaaagactg

SEQ ID NO: 1361453 - DNA, 17 bp, Homo sapiens
tcttgtaaagactggtt

SEQ ID NO: 1361454 - DNA, 15 bp, Homo sapiens
tcttgtgtctttgga

SEQ ID NO: 1361455 - DNA, 15 bp, Homo sapiens
tctttaaactgtcgt

SEQ ID NO: 1361456 - DNA, 16 bp, Homo sapiens
tctttaaccttgtata

SEQ ID NO: 1361457 - DNA, 16 bp, Homo sapiens
tctttaggagatttat

SEQ ID NO: 1361458 - DNA, 12 bp, Homo sapiens
tctttagttttt

SEQ ID NO: 1361459 - DNA, 14 bp, Homo sapiens
tctttgatgtgttg

SEQ ID NO: 1361460 - DNA, 16 bp, Homo sapiens
tctttgatgtgttgtt

SEQ ID NO: 1361461 - DNA, 18 bp, Homo sapiens
tctttgattatttgcatg

SEQ ID NO: 1361462 - DNA, 19 bp, Homo sapiens
tctttgattatttgcatgt

SEQ ID NO: 1361463 - DNA, 13 bp, Homo sapiens
tctttgcaactgt

SEQ ID NO: 1361464 - DNA, 21 bp, Homo sapiens
tcttttaatgaggaccaatgt

SEQ ID NO: 1361465 - DNA, 20 bp, Homo sapiens
tcttttaattgtttcagaat

SEQ ID NO: 1361466 - DNA, 14 bp, Homo sapiens
tcttttgaagcata

SEQ ID NO: 1361467 - DNA, 22 bp, Homo sapiens
tcttttggtaaagactggcttt

SEQ ID NO: 1361468 - DNA, 15 bp, Homo sapiens
tctttttgttgtaaa

SEQ ID NO: 1361469 - DNA, 15 bp, Homo sapiens
tctttttttttaagt

SEQ ID NO: 1361470 - DNA, 20 bp, Homo sapiens
tctttttttttaagttctta

SEQ ID NO: 1361471 - DNA, 20 bp, Homo sapiens
tgaaaaatataaaattatga

SEQ ID NO: 1361472 - DNA, 19 bp, Homo sapiens
tgaaaacagtgtgtaaaca

SEQ ID NO: 1361473 - DNA, 15 bp, Homo sapiens
tgaaaagaaaaatga

SEQ ID NO: 1361474 - DNA, 16 bp, Homo sapiens
tgaaaagagacaggca

SEQ ID NO: 1361475 - DNA, 16 bp, Homo sapiens
tgaaaagcagacattt

SEQ ID NO: 1361476 - DNA, 19 bp, Homo sapiens
tgaaaagtaatatttatta

SEQ ID NO: 1361477 - DNA, 20 bp, Homo sapiens
tgaaaagtaatatttattaa

SEQ ID NO: 1361478 - DNA, 20 bp, Homo sapiens
tgaaaatattgttttacaat

SEQ ID NO: 1361479 - DNA, 21 bp, Homo sapiens
tgaaaattacagtccaaaata

SEQ ID NO: 1361480 - DNA, 17 bp, Homo sapiens
tgaaaattggacagatt

SEQ ID NO: 1361481 - DNA, 17 bp, Homo sapiens
tgaaacctttttttatc

SEQ ID NO: 1361482 - DNA, 14 bp, Homo sapiens
tgaaactaaagcaa

SEQ ID NO: 1361483 - DNA, 22 bp, Homo sapiens
tgaaactaaagcaatagaaaca

SEQ ID NO: 1361484 - DNA, 19 bp, Homo sapiens
tgaaactatattttgtcat

SEQ ID NO: 1361485 - DNA, 20 bp, Homo sapiens
tgaaacttgtttcactgaaa

SEQ ID NO: 1361486 - DNA, 15 bp, Homo sapiens
tgaaactttgggaaa

SEQ ID NO: 1361487 - DNA, 19 bp, Homo sapiens
tgaaactttgggaaaacat

SEQ ID NO: 1361488 - DNA, 22 bp, Homo sapiens
tgaaactttgggaaaacatgtt

SEQ ID NO: 1361489 - DNA, 15 bp, Homo sapiens
tgaaacttttctaga

SEQ ID NO: 1361490 - DNA, 16 bp, Homo sapiens
tgctgggattacagac

SEQ ID NO: 1361491 - DNA, 18 bp, Homo sapiens
tgctgggcggctgtgctt

SEQ ID NO: 1361492 - DNA, 17 bp, Homo sapiens
tgctgggcttgtctgta

SEQ ID NO: 1361493 - DNA, 16 bp, Homo sapiens
tgctggtaaaatgaag

SEQ ID NO: 1361494 - DNA, 13 bp, Homo sapiens
tgctgtgtatatg

SEQ ID NO: 1361495 - DNA, 19 bp, Homo sapiens
tgctgtgtatatggtatat

SEQ ID NO: 1361496 - DNA, 15 bp, Homo sapiens
tgctgttccttactt

SEQ ID NO: 1361497 - DNA, 12 bp, Homo sapiens
tgctgttgctta

SEQ ID NO: 1361498 - DNA, 14 bp, Homo sapiens
tgctgttgttctcg

SEQ ID NO: 1361499 - DNA, 14 bp, Homo sapiens
tgcttaaaccactt

SEQ ID NO: 1361500 - DNA, 14 bp, Homo sapiens
tgcttaatcttcaa

SEQ ID NO: 1361501 - DNA, 15 bp, Homo sapiens
tgcttaatcttcaaa

SEQ ID NO: 1361502 - DNA, 21 bp, Homo sapiens
tgcttcacagtagagccagct

SEQ ID NO: 1361503 - DNA, 15 bp, Homo sapiens
tgcttccctaatcta

SEQ ID NO: 1361504 - DNA, 15 bp, Homo sapiens
tgcttcctcccaaca

SEQ ID NO: 1361505 - DNA, 23 bp, Homo sapiens
tgcttcctcccaacaagcagctg

SEQ ID NO: 1361506 - DNA, 14 bp, Homo sapiens
tgcttcctcctgga

SEQ ID NO: 1361507 - DNA, 21 bp, Homo sapiens
tgcttctcagatttctgagga

SEQ ID NO: 1361508 - DNA, 21 bp, Homo sapiens
tgcttctctgacttctgcctg

SEQ ID NO: 1361509 - DNA, 13 bp, Homo sapiens
tgcttctgccacc

SEQ ID NO: 1361510 - DNA, 15 bp, Homo sapiens
tgcttgaataaacac

SEQ ID NO: 1361511 - DNA, 15 bp, Homo sapiens
tgcttgagctcagga

SEQ ID NO: 1361512 - DNA, 20 bp, Homo sapiens
tgcttgcctgcagggccatg

SEQ ID NO: 1361513 - DNA, 17 bp, Homo sapiens
tgcttggaacatactgt

SEQ ID NO: 1361514 - DNA, 16 bp, Homo sapiens
tgcttgtgaaaatgtg

SEQ ID NO: 1361515 - DNA, 14 bp, Homo sapiens
tgctttagacttga

SEQ ID NO: 1361516 - DNA, 16 bp, Homo sapiens
tgctttagacttgaaa

SEQ ID NO: 1361517 - DNA, 18 bp, Homo sapiens
tgctttagacttgaaaag

SEQ ID NO: 1361518 - DNA, 21 bp, Homo sapiens
tgctttagacttgaaaagaga

SEQ ID NO: 1361519 - DNA, 23 bp, Homo sapiens
tgctttattaatgttttcaaaag

SEQ ID NO: 1361520 - DNA, 20 bp, Homo sapiens
tgctttccaaaccttatctc

SEQ ID NO: 1361521 - DNA, 15 bp, Homo sapiens
tgctttctcctttaa

SEQ ID NO: 1361522 - DNA, 20 bp, Homo sapiens
tgctttctcctttaattgta

SEQ ID NO: 1361523 - DNA, 22 bp, Homo sapiens
tgctttctcctttaattgtaaa

SEQ ID NO: 1361524 - DNA, 12 bp, Homo sapiens
tgctttgtattg

SEQ ID NO: 1361525 - DNA, 21 bp, Homo sapiens
tgcttttggcaaaactctact

SEQ ID NO: 1361526 - DNA, 16 bp, Homo sapiens
tgctttttgtgttttt

SEQ ID NO: 1361527 - DNA, 17 bp, Homo sapiens
tgcttttttgttttggc

SEQ ID NO: 1361528 - DNA, 14 bp, Homo sapiens
tggaaaggggagag

SEQ ID NO: 1361529 - DNA, 15 bp, Homo sapiens
tggaaaggggagagc

SEQ ID NO: 1361530 - DNA, 17 bp, Homo sapiens
tggaaaggggagagcct

SEQ ID NO: 1361531 - DNA, 19 bp, Homo sapiens
tggaaaggggagagcctgc

SEQ ID NO: 1361532 - DNA, 21 bp, Homo sapiens
tggaaaggggagagcctgctg

SEQ ID NO: 1361533 - DNA, 16 bp, Homo sapiens
tggaaatcagccaagt

SEQ ID NO: 1361534 - DNA, 13 bp, Homo sapiens
tggaaattcctgt

SEQ ID NO: 1361535 - DNA, 14 bp, Homo sapiens
tggaaattcctgta

SEQ ID NO: 1361536 - DNA, 18 bp, Homo sapiens
tggaacaatattttatgg

SEQ ID NO: 1361537 - DNA, 16 bp, Homo sapiens
tggaagaacaggcctc

SEQ ID NO: 1361538 - DNA, 15 bp, Homo sapiens
tggaagaagggagaa

SEQ ID NO: 1361539 - DNA, 21 bp, Homo sapiens
tggaagaagggagaagaaagg

SEQ ID NO: 1361540 - DNA, 15 bp, Homo sapiens
tggaagaggaaaagg

SEQ ID NO: 1361541 - DNA, 21 bp, Homo sapiens
tggaagcacaccaatcttact

SEQ ID NO: 1361542 - DNA, 23 bp, Homo sapiens
tggaagcacaccaatcttacttt

SEQ ID NO: 1361543 - DNA, 19 bp, Homo sapiens
tggaaggcaagccaggctc

SEQ ID NO: 1361544 - DNA, 16 bp, Homo sapiens
tggaagtgtatttatt

SEQ ID NO: 1361545 - DNA, 18 bp, Homo sapiens
tggaataaaaggcttgaa

SEQ ID NO: 1361546 - DNA, 22 bp, Homo sapiens
tggaataaaaggcttgaagctg

SEQ ID NO: 1361547 - DNA, 21 bp, Homo sapiens
tggaatataaggaaagcaata

SEQ ID NO: 1361548 - DNA, 17 bp, Homo sapiens
tggaatctggagaccag

SEQ ID NO: 1361549 - DNA, 14 bp, Homo sapiens
tggaattgtggcta

SEQ ID NO: 1361550 - DNA, 22 bp, Homo sapiens
tggaattttgcaaagatttaat

SEQ ID NO: 1361551 - DNA, 23 bp, Homo sapiens
tggaattttgcaaagatttaatc

SEQ ID NO: 1361552 - DNA, 20 bp, Homo sapiens
tggacacacacagactattt

SEQ ID NO: 1361553 - DNA, 19 bp, Homo sapiens
tggaccgcccttttcccct

SEQ ID NO: 1361554 - DNA, 17 bp, Homo sapiens
tggacctaaatggcctc

SEQ ID NO: 1361555 - DNA, 15 bp, Homo sapiens
tggaccttaggcctt

SEQ ID NO: 1361556 - DNA, 17 bp, Homo sapiens
tggaccttaggccttcc

SEQ ID NO: 1361557 - DNA, 20 bp, Homo sapiens
tggacggcaggctcactgcc

SEQ ID NO: 1361558 - DNA, 17 bp, Homo sapiens
tggactgagtgggaagc

SEQ ID NO: 1361559 - DNA, 21 bp, Homo sapiens
tggactgtggcacttgcctgg

SEQ ID NO: 1361560 - DNA, 14 bp, Homo sapiens
tggacttcaaagca

SEQ ID NO: 1361561 - DNA, 19 bp, Homo sapiens
tggacttcaaagcaagctg

SEQ ID NO: 1361562 - DNA, 18 bp, Homo sapiens
tggacttctacctgccct

SEQ ID NO: 1361563 - DNA, 15 bp, Homo sapiens
tggagaactctggct

SEQ ID NO: 1361564 - DNA, 13 bp, Homo sapiens
tggagaagcggct

SEQ ID NO: 1361565 - DNA, 15 bp, Homo sapiens
tggagaagctgcagg

SEQ ID NO: 1361566 - DNA, 18 bp, Homo sapiens
tggagatcctcctgcaga

SEQ ID NO: 1361567 - DNA, 14 bp, Homo sapiens
tgggccgctgccac

SEQ ID NO: 1361568 - DNA, 14 bp, Homo sapiens
tgggcggctgtgct

SEQ ID NO: 1361569 - DNA, 14 bp, Homo sapiens
tgggctctccgggg

SEQ ID NO: 1361570 - DNA, 18 bp, Homo sapiens
tgggctggaatcaggaat

SEQ ID NO: 1361571 - DNA, 22 bp, Homo sapiens
tgggcttgaccaggcttggcct

SEQ ID NO: 1361572 - DNA, 19 bp, Homo sapiens
tggggaaagacactgcctg

SEQ ID NO: 1361573 - DNA, 21 bp, Homo sapiens
tggggaaagacactgcctggg

SEQ ID NO: 1361574 - DNA, 22 bp, Homo sapiens
tggggaaaggggtcggctgacc

SEQ ID NO: 1361575 - DNA, 22 bp, Homo sapiens
tggggatccccgcctggccagg

SEQ ID NO: 1361576 - DNA, 14 bp, Homo sapiens
tggggcaggctggg

SEQ ID NO: 1361577 - DNA, 21 bp, Homo sapiens
tggggcagggagctgggcccg

SEQ ID NO: 1361578 - DNA, 13 bp, Homo sapiens
tggggcccagtgc

SEQ ID NO: 1361579 - DNA, 17 bp, Homo sapiens
tggggctcacacacctg

SEQ ID NO: 1361580 - DNA, 20 bp, Homo sapiens
tgggggacagaaagagactc

SEQ ID NO: 1361581 - DNA, 20 bp, Homo sapiens
tgggggaggggagactttga

SEQ ID NO: 1361582 - DNA, 18 bp, Homo sapiens
tgggggtggaggcttcct

SEQ ID NO: 1361583 - DNA, 19 bp, Homo sapiens
tgggggtggaggcttcctg

SEQ ID NO: 1361584 - DNA, 13 bp, Homo sapiens
tggggtgctggga

SEQ ID NO: 1361585 - DNA, 18 bp, Homo sapiens
tggggtgctgggaggagg

SEQ ID NO: 1361586 - DNA, 21 bp, Homo sapiens
tggggtgggggggggtcctaa

SEQ ID NO: 1361587 - DNA, 13 bp, Homo sapiens
tggggtgtgctgg

SEQ ID NO: 1361588 - DNA, 15 bp, Homo sapiens
tggggtgtgctggga

SEQ ID NO: 1361589 - DNA, 13 bp, Homo sapiens
tggggtttcctgg

SEQ ID NO: 1361590 - DNA, 15 bp, Homo sapiens
tggggtttcctggca

SEQ ID NO: 1361591 - DNA, 16 bp, Homo sapiens
tgggtgggctctgtgc

SEQ ID NO: 1361592 - DNA, 20 bp, Homo sapiens
tggtaaaactcactgtgatc

SEQ ID NO: 1361593 - DNA, 18 bp, Homo sapiens
tggtaaaatgaagaattt

SEQ ID NO: 1361594 - DNA, 23 bp, Homo sapiens
tggtaatctttacctgtatacag

SEQ ID NO: 1361595 - DNA, 12 bp, Homo sapiens
tggtagaaacaa

SEQ ID NO: 1361596 - DNA, 13 bp, Homo sapiens
tggtatatataca

SEQ ID NO: 1361597 - DNA, 16 bp, Homo sapiens
tggtatcttaaagtgt

SEQ ID NO: 1361598 - DNA, 19 bp, Homo sapiens
tggtccccaacaatgtgag

SEQ ID NO: 1361599 - DNA, 23 bp, Homo sapiens
tggtcgagaaagaggcaccagga

SEQ ID NO: 1361600 - DNA, 10 bp, Homo sapiens
tggtctttga

SEQ ID NO: 1361601 - DNA, 14 bp, Homo sapiens
tggtgaactatatt

SEQ ID NO: 1361602 - DNA, 14 bp, Homo sapiens
tggtgatgcagtct

SEQ ID NO: 1361603 - DNA, 21 bp, Homo sapiens
tggtgatttgaaaaatataaa

SEQ ID NO: 1361604 - DNA, 22 bp, Homo sapiens
tggtgatttgaaaaatataaaa

SEQ ID NO: 1361605 - DNA, 16 bp, Homo sapiens
tggtgccatccccagg

SEQ ID NO: 1361606 - DNA, 15 bp, Homo sapiens
tggtgtaatttgaag

SEQ ID NO: 1361607 - DNA, 21 bp, Homo sapiens
tggtgtagccctcccactttg

SEQ ID NO: 1361608 - DNA, 18 bp, Homo sapiens
tggttacttcttctctta

SEQ ID NO: 1361609 - DNA, 18 bp, Homo sapiens
tggttatacaagttcttg

SEQ ID NO: 1361610 - DNA, 19 bp, Homo sapiens
tggttatgtttttctgtgt

SEQ ID NO: 1361611 - DNA, 12 bp, Homo sapiens
tggttccagggt

SEQ ID NO: 1361612 - DNA, 22 bp, Homo sapiens
tggttccagggtccctctgtgt

SEQ ID NO: 1361613 - DNA, 13 bp, Homo sapiens
tggttcctctgct

SEQ ID NO: 1361614 - DNA, 14 bp, Homo sapiens
tgtctcttgagttt

SEQ ID NO: 1361615 - DNA, 15 bp, Homo sapiens
tgtctggaattgtgg

SEQ ID NO: 1361616 - DNA, 14 bp, Homo sapiens
tgtctggcaaggac

SEQ ID NO: 1361617 - DNA, 13 bp, Homo sapiens
tgtctggtggccc

SEQ ID NO: 1361618 - DNA, 17 bp, Homo sapiens
tgtctgtaaatatgttt

SEQ ID NO: 1361619 - DNA, 14 bp, Homo sapiens
tgtctgtctggcac

SEQ ID NO: 1361620 - DNA, 14 bp, Homo sapiens
tgtctgtgaacaga

SEQ ID NO: 1361621 - DNA, 21 bp, Homo sapiens
tgtcttgggcagagctggctc

SEQ ID NO: 1361622 - DNA, 13 bp, Homo sapiens
tgtctttcctgaa

SEQ ID NO: 1361623 - DNA, 16 bp, Homo sapiens
tgtcttttaaaatgca

SEQ ID NO: 1361624 - DNA, 20 bp, Homo sapiens
tgtcttttaaaatgcaatgt

SEQ ID NO: 1361625 - DNA, 21 bp, Homo sapiens
tgtgaaaagaaaaatgagcct

SEQ ID NO: 1361626 - DNA, 13 bp, Homo sapiens
tgtgaaattgcat

SEQ ID NO: 1361627 - DNA, 23 bp, Homo sapiens
tgtgaacaagcttcagtaagtta

SEQ ID NO: 1361628 - DNA, 14 bp, Homo sapiens
tgtgaatactgctt

SEQ ID NO: 1361629 - DNA, 18 bp, Homo sapiens
tgtgaatactgcttgaat

SEQ ID NO: 1361630 - DNA, 17 bp, Homo sapiens
tgtgaatgccactgcct

SEQ ID NO: 1361631 - DNA, 17 bp, Homo sapiens
tgtgaattattgacact

SEQ ID NO: 1361632 - DNA, 19 bp, Homo sapiens
tgtgaattattgacactga

SEQ ID NO: 1361633 - DNA, 14 bp, Homo sapiens
tgtgaatttttaag

SEQ ID NO: 1361634 - DNA, 19 bp, Homo sapiens
tgtgaatttttaagctgca

SEQ ID NO: 1361635 - DNA, 15 bp, Homo sapiens
tgtgaatttttattg

SEQ ID NO: 1361636 - DNA, 20 bp, Homo sapiens
tgtgaatttttattgttgta

SEQ ID NO: 1361637 - DNA, 16 bp, Homo sapiens
tgtgacatggtgcctg

SEQ ID NO: 1361638 - DNA, 20 bp, Homo sapiens
tgtgacatggtgcctgagag

SEQ ID NO: 1361639 - DNA, 13 bp, Homo sapiens
tgtgaccctccaa

SEQ ID NO: 1361640 - DNA, 17 bp, Homo sapiens
tgtgaccctccaaatgg

SEQ ID NO: 1361641 - DNA, 18 bp, Homo sapiens
tgtgagaaacatctcaat

SEQ ID NO: 1361642 - DNA, 19 bp, Homo sapiens
tgtgagaaggtttattgtt

SEQ ID NO: 1361643 - DNA, 22 bp, Homo sapiens
tgtgagaagtgaatgctgggac

SEQ ID NO: 1361644 - DNA, 13 bp, Homo sapiens
tgtgagagaaagt

SEQ ID NO: 1361645 - DNA, 14 bp, Homo sapiens
tgtgagggagggga

SEQ ID NO: 1361646 - DNA, 21 bp, Homo sapiens
tgtgatacattttttaagctt

SEQ ID NO: 1361647 - DNA, 13 bp, Homo sapiens
tgtgatgagctga

SEQ ID NO: 1361648 - DNA, 22 bp, Homo sapiens
tgtgattccactacacctggct

SEQ ID NO: 1361649 - DNA, 22 bp, Homo sapiens
tgtgatttctttaaaagaatga

SEQ ID NO: 1361650 - DNA, 18 bp, Homo sapiens
tgtgcaacagggtatgga

SEQ ID NO: 1361651 - DNA, 19 bp, Homo sapiens
tgtgcaacgccgtgggctg

SEQ ID NO: 1361652 - DNA, 10 bp, Homo sapiens
tgtgcacatc

SEQ ID NO: 1361653 - DNA, 17 bp, Homo sapiens
tgtgcagtcactggagg

SEQ ID NO: 1361654 - DNA, 18 bp, Homo sapiens
tgtgcagtcactggaggt

SEQ ID NO: 1361655 - DNA, 14 bp, Homo sapiens
tgtgcatagtttct

SEQ ID NO: 1361656 - DNA, 12 bp, Homo sapiens
tgtgccatctgt

SEQ ID NO: 1361657 - DNA, 17 bp, Homo sapiens
tgtgcccagaatactga

SEQ ID NO: 1361658 - DNA, 12 bp, Homo sapiens
tgtgcctggggt

SEQ ID NO: 1361659 - DNA, 15 bp, Homo sapiens
tgtgcgctctgtgga

SEQ ID NO: 1361660 - DNA, 17 bp, Homo sapiens
tgtgctagaaattttca

SEQ ID NO: 1361661 - DNA, 20 bp, Homo sapiens
tgtgctagaaattttcaaga

SEQ ID NO: 1361662 - DNA, 12 bp, Homo sapiens
tgtgctgccctg

SEQ ID NO: 1361663 - DNA, 16 bp, Homo sapiens
tgtgctgccctgaaga

SEQ ID NO: 1361664 - DNA, 12 bp, Homo sapiens
tgtgctgggagc

SEQ ID NO: 1361665 - DNA, 17 bp, Homo sapiens
tgtgctgggagctccac

SEQ ID NO: 1361666 - DNA, 15 bp, Homo sapiens
tgtgctgtgtgtgac

SEQ ID NO: 1361667 - DNA, 22 bp, Homo sapiens
tgtgcttcacagtagagccagc

SEQ ID NO: 1361668 - DNA, 21 bp, Homo sapiens
tgtggagaagcggctggcagc

SEQ ID NO: 1361669 - DNA, 16 bp, Homo sapiens
tgtggagccgaggcct

SEQ ID NO: 1361670 - DNA, 14 bp, Homo sapiens
tgtggatgataaaa

SEQ ID NO: 1361671 - DNA, 17 bp, Homo sapiens
tgtggcaatctgtgggc

SEQ ID NO: 1361672 - DNA, 19 bp, Homo sapiens
tgtggcacttgcctgggtc

SEQ ID NO: 1361673 - DNA, 13 bp, Homo sapiens
tgtggccccaccc

SEQ ID NO: 1361674 - DNA, 16 bp, Homo sapiens
tgtggcctcttctgag

SEQ ID NO: 1361675 - DNA, 18 bp, Homo sapiens
tgtggcgccgtctccagg

SEQ ID NO: 1361676 - DNA, 16 bp, Homo sapiens
tgtggctagtgacaaa

SEQ ID NO: 1361677 - DNA, 21 bp, Homo sapiens
tgtgtaaaaaaaccaccaaaa

SEQ ID NO: 1361678 - DNA, 14 bp, Homo sapiens
tgtgtaaacaaaat

SEQ ID NO: 1361679 - DNA, 22 bp, Homo sapiens
tgtgtaaacaaaatgaagctgc

SEQ ID NO: 1361680 - DNA, 20 bp, Homo sapiens
ttatctattctgagaaaaca

SEQ ID NO: 1361681 - DNA, 12 bp, Homo sapiens
ttatctgtttcc

SEQ ID NO: 1361682 - DNA, 22 bp, Homo sapiens
ttatctgtttcctgacattgtc

SEQ ID NO: 1361683 - DNA, 22 bp, Homo sapiens
ttatgatgacgtacaagtagtt

SEQ ID NO: 1361684 - DNA, 15 bp, Homo sapiens
ttatgattgttatgt

SEQ ID NO: 1361685 - DNA, 22 bp, Homo sapiens
ttatgccacttccttttaactg

SEQ ID NO: 1361686 - DNA, 17 bp, Homo sapiens
ttatgctctcactgttt

SEQ ID NO: 1361687 - DNA, 15 bp, Homo sapiens
ttatgtaaataattc

SEQ ID NO: 1361688 - DNA, 17 bp, Homo sapiens
ttatgtgaatttttaag

SEQ ID NO: 1361689 - DNA, 19 bp, Homo sapiens
ttatgtgaatttttaagct

SEQ ID NO: 1361690 - DNA, 20 bp, Homo sapiens
ttatgtgaatttttaagctg

SEQ ID NO: 1361691 - DNA, 22 bp, Homo sapiens
ttatgttttttaaaatatttat

SEQ ID NO: 1361692 - DNA, 16 bp, Homo sapiens
ttattaaacaaataat

SEQ ID NO: 1361693 - DNA, 20 bp, Homo sapiens
ttattaaatttttttgtatg

SEQ ID NO: 1361694 - DNA, 17 bp, Homo sapiens
ttattaatgcactttct

SEQ ID NO: 1361695 - DNA, 18 bp, Homo sapiens
ttattaatgcactttcta

SEQ ID NO: 1361696 - DNA, 16 bp, Homo sapiens
ttattaatgttttcaa

SEQ ID NO: 1361697 - DNA, 13 bp, Homo sapiens
ttattacatgtaa

SEQ ID NO: 1361698 - DNA, 18 bp, Homo sapiens
ttattacatgtaatttga

SEQ ID NO: 1361699 - DNA, 16 bp, Homo sapiens
ttattacttccatgaa

SEQ ID NO: 1361700 - DNA, 21 bp, Homo sapiens
ttattataatcttataattgt

SEQ ID NO: 1361701 - DNA, 12 bp, Homo sapiens
ttattatttatt

SEQ ID NO: 1361702 - DNA, 22 bp, Homo sapiens
ttattcaacagcaagtgtgaat

SEQ ID NO: 1361703 - DNA, 20 bp, Homo sapiens
ttattgactcttgagttgtt

SEQ ID NO: 1361704 - DNA, 14 bp, Homo sapiens
ttattgcagtttat

SEQ ID NO: 1361705 - DNA, 16 bp, Homo sapiens
ttattgcagtttatca

SEQ ID NO: 1361706 - DNA, 15 bp, Homo sapiens
ttatttacatttaat

SEQ ID NO: 1361707 - DNA, 17 bp, Homo sapiens
ttatttatatttattga

SEQ ID NO: 1361708 - DNA, 13 bp, Homo sapiens
ttatttatgtact

SEQ ID NO: 1361709 - DNA, 23 bp, Homo sapiens
ttatttcaaaatatacattcaaa

SEQ ID NO: 1361710 - DNA, 15 bp, Homo sapiens
ttatttccactaaaa

SEQ ID NO: 1361711 - DNA, 15 bp, Homo sapiens
ttatttgtaaattta

SEQ ID NO: 1361712 - DNA, 21 bp, Homo sapiens
ttattttgagatgtaaaaaga

SEQ ID NO: 1361713 - DNA, 16 bp, Homo sapiens
ttatttttataattgt

SEQ ID NO: 1361714 - DNA, 16 bp, Homo sapiens
ttatttttttaaaatt

SEQ ID NO: 1361715 - DNA, 17 bp, Homo sapiens
ttatttttttaaaattt

SEQ ID NO: 1361716 - DNA, 12 bp, Homo sapiens
ttcaaaagaaag

SEQ ID NO: 1361717 - DNA, 13 bp, Homo sapiens
ttcaaaagaaagt

SEQ ID NO: 1361718 - DNA, 20 bp, Homo sapiens
ttcaaaaggtattatacatg

SEQ ID NO: 1361719 - DNA, 15 bp, Homo sapiens
ttcaaaatccaaaaa

SEQ ID NO: 1361720 - DNA, 20 bp, Homo sapiens
ttcaaagttttgttgtactt

SEQ ID NO: 1361721 - DNA, 21 bp, Homo sapiens
ttcaaagttttgttgtactta

SEQ ID NO: 1361722 - DNA, 23 bp, Homo sapiens
ttcaagcagtcgtgcctgtgtcc

SEQ ID NO: 1361723 - DNA, 17 bp, Homo sapiens
ttcaatatattgaactt

SEQ ID NO: 1361724 - DNA, 20 bp, Homo sapiens
ttcacagtagagccagcttg

SEQ ID NO: 1361725 - DNA, 22 bp, Homo sapiens
ttcacccttatagtctaagact

SEQ ID NO: 1361726 - DNA, 13 bp, Homo sapiens
ttcacggaagagc

SEQ ID NO: 1361727 - DNA, 16 bp, Homo sapiens
ttcactcactctaaag

SEQ ID NO: 1361728 - DNA, 19 bp, Homo sapiens
ttcactctaagtcatgtat

SEQ ID NO: 1361729 - DNA, 22 bp, Homo sapiens
ttcacttatgaatgatttgcat

SEQ ID NO: 1361730 - DNA, 21 bp, Homo sapiens
ttcacttgatgatacaatgaa

SEQ ID NO: 1361731 - DNA, 15 bp, Homo sapiens
ttcagaaaaagaaat

SEQ ID NO: 1361732 - DNA, 12 bp, Homo sapiens
ttcagaaatgtt

SEQ ID NO: 1361733 - DNA, 20 bp, Homo sapiens
ttcagacatctgaggtttta

SEQ ID NO: 1361734 - DNA, 17 bp, Homo sapiens
ttcagcagcaaattttc

SEQ ID NO: 1361735 - DNA, 10 bp, Homo sapiens
ttcagccaag

SEQ ID NO: 1361736 - DNA, 17 bp, Homo sapiens
ttcagctgacttttctg

SEQ ID NO: 1361737 - DNA, 17 bp, Homo sapiens
ttcaggaagggatgcag

SEQ ID NO: 1361738 - DNA, 19 bp, Homo sapiens
ttcaggaatgtgtggcctg

SEQ ID NO: 1361739 - DNA, 21 bp, Homo sapiens
ttcaggagaacctaacatgct

SEQ ID NO: 1361740 - DNA, 20 bp, Homo sapiens
ttcagggctggctcctgatc

SEQ ID NO: 1361741 - DNA, 14 bp, Homo sapiens
ttcagggtaaatag

SEQ ID NO: 1361742 - DNA, 14 bp, Homo sapiens
ttcagtaagccgtg

SEQ ID NO: 1361743 - DNA, 18 bp, Homo sapiens
ttcagttgcttgtcttct

SEQ ID NO: 1361744 - DNA, 11 bp, Homo sapiens
ttcataaacaa

SEQ ID NO: 1361745 - DNA, 22 bp, Homo sapiens
ttccttgagacacggagcccag

SEQ ID NO: 1361746 - DNA, 12 bp, Homo sapiens
ttccttttatca

SEQ ID NO: 1361747 - DNA, 15 bp, Homo sapiens
ttccttttccctgct

SEQ ID NO: 1361748 - DNA, 17 bp, Homo sapiens
ttcctttttgacactga

SEQ ID NO: 1361749 - DNA, 16 bp, Homo sapiens
ttccttttttcaaaat

SEQ ID NO: 1361750 - DNA, 13 bp, Homo sapiens
ttcgaagtcatta

SEQ ID NO: 1361751 - DNA, 14 bp, Homo sapiens
ttcgagaccagcct

SEQ ID NO: 1361752 - DNA, 13 bp, Homo sapiens
ttcgcctttcctc

SEQ ID NO: 1361753 - DNA, 13 bp, Homo sapiens
ttcgtggggaggt

SEQ ID NO: 1361754 - DNA, 12 bp, Homo sapiens
ttctaagagaag

SEQ ID NO: 1361755 - DNA, 23 bp, Homo sapiens
ttctaataagctagttgaatact

SEQ ID NO: 1361756 - DNA, 19 bp, Homo sapiens
ttctaccaaggtcttctta

SEQ ID NO: 1361757 - DNA, 18 bp, Homo sapiens
ttctagaattatttttca

SEQ ID NO: 1361758 - DNA, 20 bp, Homo sapiens
ttctatagcatcacttaaaa

SEQ ID NO: 1361759 - DNA, 14 bp, Homo sapiens
ttctatcctctgta

SEQ ID NO: 1361760 - DNA, 22 bp, Homo sapiens
ttctatgtgacaattttgtaca

SEQ ID NO: 1361761 - DNA, 19 bp, Homo sapiens
ttctattatttttataatt

SEQ ID NO: 1361762 - DNA, 18 bp, Homo sapiens
ttctcaaaggagcgagca

SEQ ID NO: 1361763 - DNA, 18 bp, Homo sapiens
ttctcaatgaaaaatagt

SEQ ID NO: 1361764 - DNA, 16 bp, Homo sapiens
ttctcagatttctgag

SEQ ID NO: 1361765 - DNA, 14 bp, Homo sapiens
ttctccactgtgca

SEQ ID NO: 1361766 - DNA, 18 bp, Homo sapiens
ttctccactgtgcacacc

SEQ ID NO: 1361767 - DNA, 16 bp, Homo sapiens
ttctccgccagcctcc

SEQ ID NO: 1361768 - DNA, 21 bp, Homo sapiens
ttctccgccagcctcctctgg

SEQ ID NO: 1361769 - DNA, 18 bp, Homo sapiens
ttctccgttagctcctgt

SEQ ID NO: 1361770 - DNA, 12 bp, Homo sapiens
ttctctcctccc

SEQ ID NO: 1361771 - DNA, 15 bp, Homo sapiens
ttctctcctccccaa

SEQ ID NO: 1361772 - DNA, 13 bp, Homo sapiens
ttctctctctaag

SEQ ID NO: 1361773 - DNA, 12 bp, Homo sapiens
ttctctgacttc

SEQ ID NO: 1361774 - DNA, 18 bp, Homo sapiens
ttctcttagcaactcaga

SEQ ID NO: 1361775 - DNA, 20 bp, Homo sapiens
ttctcttccttttatcagta

SEQ ID NO: 1361776 - DNA, 15 bp, Homo sapiens
ttctcttgagctggc

SEQ ID NO: 1361777 - DNA, 22 bp, Homo sapiens
ttctcttgagctggcctctcta

SEQ ID NO: 1361778 - DNA, 20 bp, Homo sapiens
ttctctttgattatttgcat

SEQ ID NO: 1361779 - DNA, 19 bp, Homo sapiens
ttctgactcggtttctcca

SEQ ID NO: 1361780 - DNA, 12 bp, Homo sapiens
ttctgagaaaac

SEQ ID NO: 1361781 - DNA, 23 bp, Homo sapiens
ttctgattctggctttaagcctt

SEQ ID NO: 1361782 - DNA, 19 bp, Homo sapiens
ttctgccatctagccagcc

SEQ ID NO: 1361783 - DNA, 19 bp, Homo sapiens
ttctgccctggctgctgcc

SEQ ID NO: 1361784 - DNA, 21 bp, Homo sapiens
ttctgccgccccctcctgaac

SEQ ID NO: 1361785 - DNA, 22 bp, Homo sapiens
ttctgccgccccctcctgaacc

SEQ ID NO: 1361786 - DNA, 14 bp, Homo sapiens
ttctgcctggagac

SEQ ID NO: 1361787 - DNA, 19 bp, Homo sapiens
ttctggacccttataaaat

SEQ ID NO: 1361788 - DNA, 21 bp, Homo sapiens
ttctggggaaagacactgcct

SEQ ID NO: 1361789 - DNA, 19 bp, Homo sapiens
ttctggggcaggctgggcc

SEQ ID NO: 1361790 - DNA, 11 bp, Homo sapiens
ttctggtaatc

SEQ ID NO: 1361791 - DNA, 15 bp, Homo sapiens
ttctggtactttctg

SEQ ID NO: 1361792 - DNA, 17 bp, Homo sapiens
ttctggtactttctgtt

SEQ ID NO: 1361793 - DNA, 18 bp, Homo sapiens
ttctgtattttgtttttg

SEQ ID NO: 1361794 - DNA, 22 bp, Homo sapiens
ttctgtatttttttttctaaga

SEQ ID NO: 1361795 - DNA, 18 bp, Homo sapiens
ttctgtgatgagctgatc

SEQ ID NO: 1361796 - DNA, 19 bp, Homo sapiens
ttctgtgcccagaatactg

SEQ ID NO: 1361797 - DNA, 17 bp, Homo sapiens
ttctgtggttcctctgc

SEQ ID NO: 1361798 - DNA, 18 bp, Homo sapiens
ttctgtgtgtcagttttc

SEQ ID NO: 1361799 - DNA, 15 bp, Homo sapiens
ttcttactaaaaagt

SEQ ID NO: 1361800 - DNA, 14 bp, Homo sapiens
ttcttatgaggagg

SEQ ID NO: 1361801 - DNA, 22 bp, Homo sapiens
ttcttccttaattcactcccac

SEQ ID NO: 1361802 - DNA, 15 bp, Homo sapiens
ttcttgcaagcatgc

SEQ ID NO: 1361803 - DNA, 15 bp, Homo sapiens
ttcttgcctctgtgc

SEQ ID NO: 1361804 - DNA, 22 bp, Homo sapiens
ttcttggcttaatcattttcat

SEQ ID NO: 1361805 - DNA, 18 bp, Homo sapiens
ttcttggggcccagtgca

SEQ ID NO: 1361806 - DNA, 19 bp, Homo sapiens
ttcttggggcccagtgcat

SEQ ID NO: 1361807 - DNA, 17 bp, Homo sapiens
ttctttaaaagaatgac

SEQ ID NO: 1361808 - DNA, 19 bp, Homo sapiens
ttctttaaaagaatgacta

SEQ ID NO: 1361809 - DNA, 13 bp, Homo sapiens
ttctttaaactgt

SEQ ID NO: 1361810 - DNA, 19 bp, Homo sapiens
ttctttaaccttgtataaa

SEQ ID NO: 1361811 - DNA, 14 bp, Homo sapiens
ttcttttctcagtg

SEQ ID NO: 1361812 - DNA, 16 bp, Homo sapiens
ttcttttttattaatc

SEQ ID NO: 1361813 - DNA, 20 bp, Homo sapiens
ttcttttttattaatcactg

SEQ ID NO: 1361814 - DNA, 20 bp, Homo sapiens
gaacttttgtactgaatttt

SEQ ID NO: 1361815 - DNA, 13 bp, Homo sapiens
gaagaagatgctc

SEQ ID NO: 1361816 - DNA, 12 bp, Homo sapiens
gaagaagcctgt

SEQ ID NO: 1361817 - DNA, 17 bp, Homo sapiens
gaagaattgaaaagttt

SEQ ID NO: 1361818 - DNA, 22 bp, Homo sapiens
gaagaattgaaaagtttttgtt

SEQ ID NO: 1361819 - DNA, 12 bp, Homo sapiens
gaagaatttaaa

SEQ ID NO: 1361820 - DNA, 13 bp, Homo sapiens
gaagaatttaaag

SEQ ID NO: 1361821 - DNA, 23 bp, Homo sapiens
gaagacaatgtgaaaagaaaaat

SEQ ID NO: 1361822 - DNA, 17 bp, Homo sapiens
gaagaccctcttgccca

SEQ ID NO: 1361823 - DNA, 19 bp, Homo sapiens
gaagacctcacctagaaat

SEQ ID NO: 1361824 - DNA, 17 bp, Homo sapiens
gaagaggaaaaggctgg

SEQ ID NO: 1361825 - DNA, 22 bp, Homo sapiens
gaagatcctgcgggtggggctt

SEQ ID NO: 1361826 - DNA, 22 bp, Homo sapiens
gaagatgctccagcaacacagc

SEQ ID NO: 1361827 - DNA, 21 bp, Homo sapiens
gaagcactacaccttgccttg

SEQ ID NO: 1361828 - DNA, 12 bp, Homo sapiens
gaagcagcctct

SEQ ID NO: 1361829 - DNA, 22 bp, Homo sapiens
gaagcagcctctccccaggtcc

SEQ ID NO: 1361830 - DNA, 12 bp, Homo sapiens
gaagccaaagaa

SEQ ID NO: 1361831 - DNA, 14 bp, Homo sapiens
gaagccaaagaaaa

SEQ ID NO: 1361832 - DNA, 15 bp, Homo sapiens
gaagccttcagctcc

SEQ ID NO: 1361833 - DNA, 17 bp, Homo sapiens
gaaggagaagtaagagg

SEQ ID NO: 1361834 - DNA, 21 bp, Homo sapiens
gaaggatgatgtctttttatt

SEQ ID NO: 1361835 - DNA, 14 bp, Homo sapiens
gaaggcaagagggg

SEQ ID NO: 1361836 - DNA, 16 bp, Homo sapiens
gaaggcaagagggggt

SEQ ID NO: 1361837 - DNA, 14 bp, Homo sapiens
gaaggcaagccagg

SEQ ID NO: 1361838 - DNA, 14 bp, Homo sapiens
gaaggtttttgata

SEQ ID NO: 1361839 - DNA, 17 bp, Homo sapiens
gaagtatttttagaata

SEQ ID NO: 1361840 - DNA, 16 bp, Homo sapiens
gaagtcaatatgtgga

SEQ ID NO: 1361841 - DNA, 22 bp, Homo sapiens
gaagtgatactatccagttact

SEQ ID NO: 1361842 - DNA, 20 bp, Homo sapiens
gaagtgctggcaaccactaa

SEQ ID NO: 1361843 - DNA, 13 bp, Homo sapiens
gaagtgcttggaa

SEQ ID NO: 1361844 - DNA, 15 bp, Homo sapiens
gaagtgtatttattt

SEQ ID NO: 1361845 - DNA, 14 bp, Homo sapiens
gaagtttggctgct

SEQ ID NO: 1361846 - DNA, 21 bp, Homo sapiens
gaataaaaggcttgaagctgt

SEQ ID NO: 1361847 - DNA, 14 bp, Homo sapiens
gaataaacaccact

SEQ ID NO: 1361848 - DNA, 12 bp, Homo sapiens
gaataaatgtgt

SEQ ID NO: 1361849 - DNA, 12 bp, Homo sapiens
gaataagttatt

SEQ ID NO: 1361850 - DNA, 19 bp, Homo sapiens
gaataccacatcaaataag

SEQ ID NO: 1361851 - DNA, 13 bp, Homo sapiens
gaatactgcttga

SEQ ID NO: 1361852 - DNA, 14 bp, Homo sapiens
gaatagacatcaaa

SEQ ID NO: 1361853 - DNA, 16 bp, Homo sapiens
gaatagacatcaaact

SEQ ID NO: 1361854 - DNA, 17 bp, Homo sapiens
gaatatctattaatata

SEQ ID NO: 1361855 - DNA, 11 bp, Homo sapiens
gaatcaataat

SEQ ID NO: 1361856 - DNA, 21 bp, Homo sapiens
gaatcaggaatattttccaaa

SEQ ID NO: 1361857 - DNA, 19 bp, Homo sapiens
gaatcccttaacagttgta

SEQ ID NO: 1361858 - DNA, 21 bp, Homo sapiens
gaatcccttaacagttgtatt

SEQ ID NO: 1361859 - DNA, 12 bp, Homo sapiens
gaatcctggcag

SEQ ID NO: 1361860 - DNA, 17 bp, Homo sapiens
gaatcctggcagcccag

SEQ ID NO: 1361861 - DNA, 14 bp, Homo sapiens
gaatctctgtgcct

SEQ ID NO: 1361862 - DNA, 22 bp, Homo sapiens
gaatctggagaccagggagcct

SEQ ID NO: 1361863 - DNA, 15 bp, Homo sapiens
gaatgaaagctgttc

SEQ ID NO: 1361864 - DNA, 14 bp, Homo sapiens
gaatgaggaaaatt

SEQ ID NO: 1361865 - DNA, 14 bp, Homo sapiens
gaatgaggtgggag

SEQ ID NO: 1361866 - DNA, 19 bp, Homo sapiens
gaatgcaaccaagtcacac

SEQ ID NO: 1361867 - DNA, 13 bp, Homo sapiens
gaatggtggtgga

SEQ ID NO: 1361868 - DNA, 16 bp, Homo sapiens
gaatgtatttatttgg

SEQ ID NO: 1361869 - DNA, 23 bp, Homo sapiens
gaatgtatttatttgggagaccg

SEQ ID NO: 1361870 - DNA, 12 bp, Homo sapiens
gaatgtgtcagg

SEQ ID NO: 1361871 - DNA, 13 bp, Homo sapiens
gaatgttaaaggg

SEQ ID NO: 1361872 - DNA, 21 bp, Homo sapiens
gaattatgctttgtagagttt

SEQ ID NO: 1361873 - DNA, 16 bp, Homo sapiens
gaattcaaactggggc

SEQ ID NO: 1361874 - DNA, 22 bp, Homo sapiens
gaattcaaactggggcctccag

SEQ ID NO: 1361875 - DNA, 14 bp, Homo sapiens
gaattgaaaagttt

SEQ ID NO: 1361876 - DNA, 17 bp, Homo sapiens
gaattgaaaagtttttg

SEQ ID NO: 1361877 - DNA, 20 bp, Homo sapiens
gaattgtggctatcctgatt

SEQ ID NO: 1361878 - DNA, 22 bp, Homo sapiens
gaatttaaagaaaaaaatgtca

SEQ ID NO: 1361879 - DNA, 16 bp, Homo sapiens
gaatttacttccttgc

SEQ ID NO: 1361880 - DNA, 21 bp, Homo sapiens
gaattttgcaaagatttaatc

SEQ ID NO: 1361881 - DNA, 12 bp, Homo sapiens
gaatttttaagc

SEQ ID NO: 1361882 - DNA, 13 bp, Homo sapiens
gaatttttattgt

SEQ ID NO: 1361883 - DNA, 13 bp, Homo sapiens
gaatttttttgta

SEQ ID NO: 1361884 - DNA, 14 bp, Homo sapiens
gaatttttttgtaa

SEQ ID NO: 1361885 - DNA, 22 bp, Homo sapiens
gacaaatattcctttgcatatt

SEQ ID NO: 1361886 - DNA, 14 bp, Homo sapiens
gacaacatgtttaa

SEQ ID NO: 1361887 - DNA, 20 bp, Homo sapiens
gacaacatgtttaataaata

SEQ ID NO: 1361888 - DNA, 14 bp, Homo sapiens
gacaagctggctta

SEQ ID NO: 1361889 - DNA, 16 bp, Homo sapiens
gacaataaaccctcag

SEQ ID NO: 1361890 - DNA, 18 bp, Homo sapiens
gacaatgttgtagtgtcc

SEQ ID NO: 1361891 - DNA, 19 bp, Homo sapiens
gacaatgttgtagtgtccc

SEQ ID NO: 1361892 - DNA, 13 bp, Homo sapiens
gacaattctgttt

SEQ ID NO: 1361893 - DNA, 14 bp, Homo sapiens
gacacacagcctag

SEQ ID NO: 1361894 - DNA, 13 bp, Homo sapiens
gacaccctcaacc

SEQ ID NO: 1361895 - DNA, 15 bp, Homo sapiens
gacacggagcccagc

SEQ ID NO: 1361896 - DNA, 16 bp, Homo sapiens
gacagagaggactgta

SEQ ID NO: 1361897 - DNA, 19 bp, Homo sapiens
gacagagaggactgtaggg

SEQ ID NO: 1361898 - DNA, 23 bp, Homo sapiens
gacagatacctccaaccctgccg

SEQ ID NO: 1361899 - DNA, 17 bp, Homo sapiens
gacagccaaaggctggc

SEQ ID NO: 1361900 - DNA, 15 bp, Homo sapiens
gacagcttttctcaa

SEQ ID NO: 1361901 - DNA, 22 bp, Homo sapiens
gacaggaaccttaagtaatcat

SEQ ID NO: 1361902 - DNA, 16 bp, Homo sapiens
gacagtatcccacatc

SEQ ID NO: 1361903 - DNA, 21 bp, Homo sapiens
gacagtatcccacatccaact

SEQ ID NO: 1361904 - DNA, 14 bp, Homo sapiens
gacatatctacact

SEQ ID NO: 1361905 - DNA, 19 bp, Homo sapiens
gacatcaaactcaatgctt

SEQ ID NO: 1361906 - DNA, 19 bp, Homo sapiens
gacatggctccggcctctg

SEQ ID NO: 1361907 - DNA, 20 bp, Homo sapiens
gacatggctccggcctctgc

SEQ ID NO: 1361908 - DNA, 17 bp, Homo sapiens
gacatggtgcctgagag

SEQ ID NO: 1361909 - DNA, 18 bp, Homo sapiens
gacatggtgcctgagagg

SEQ ID NO: 1361910 - DNA, 21 bp, Homo sapiens
gacattgtctcctatatattt

SEQ ID NO: 1361911 - DNA, 20 bp, Homo sapiens
gacattttaaaaaatggtca

SEQ ID NO: 1361912 - DNA, 18 bp, Homo sapiens
gaccacaaaacttttcta

SEQ ID NO: 1361913 - DNA, 15 bp, Homo sapiens
gaccaccctgagccg

SEQ ID NO: 1361914 - DNA, 21 bp, Homo sapiens
gaccagaggagcctttttaaa

SEQ ID NO: 1361915 - DNA, 19 bp, Homo sapiens
gaccagctgctccgaggac

SEQ ID NO: 1361916 - DNA, 20 bp, Homo sapiens
gaccagctgctccgaggacc

SEQ ID NO: 1361917 - DNA, 14 bp, Homo sapiens
gaccagggagcctt

SEQ ID NO: 1361918 - DNA, 15 bp, Homo sapiens
gaccagggagccttt

SEQ ID NO: 1361919 - DNA, 11 bp, Homo sapiens
gaccagggcct

SEQ ID NO: 1361920 - DNA, 13 bp, Homo sapiens
gaccatcctggct

SEQ ID NO: 1361921 - DNA, 22 bp, Homo sapiens
gaccatgctcatctgctggtcc

SEQ ID NO: 1361922 - DNA, 15 bp, Homo sapiens
gacccaggaaaggca

SEQ ID NO: 1361923 - DNA, 10 bp, Homo sapiens
gacccagtgc

SEQ ID NO: 1361924 - DNA, 15 bp, Homo sapiens
gacccattgctgttg

SEQ ID NO: 1361925 - DNA, 19 bp, Homo sapiens
gaccccggcttcctttccc

SEQ ID NO: 1361926 - DNA, 22 bp, Homo sapiens
gaccctcttgcccatcctgact

SEQ ID NO: 1361927 - DNA, 21 bp, Homo sapiens
gaccctgggggcacaggaggc

SEQ ID NO: 1361928 - DNA, 19 bp, Homo sapiens
gaccctgggtgggctctgt

SEQ ID NO: 1361929 - DNA, 22 bp, Homo sapiens
gaccctgggtgggctctgtgca

SEQ ID NO: 1361930 - DNA, 22 bp, Homo sapiens
gaccctggttattgatgtggcc

SEQ ID NO: 1361931 - DNA, 12 bp, Homo sapiens
gaccctgtctca

SEQ ID NO: 1361932 - DNA, 12 bp, Homo sapiens
gaccctttgggg

SEQ ID NO: 1361933 - DNA, 17 bp, Homo sapiens
gaccggacttttctgca

SEQ ID NO: 1361934 - DNA, 19 bp, Homo sapiens
gaccggcggaccccagcca

SEQ ID NO: 1361935 - DNA, 20 bp, Homo sapiens
tcacttttggcaatgactca

SEQ ID NO: 1361936 - DNA, 18 bp, Homo sapiens
tccaggcctgcctcccac

SEQ ID NO: 1361937 - DNA, 20 bp, Homo sapiens
tcctatatatttctattatt

SEQ ID NO: 1361938 - DNA, 13 bp, Homo sapiens
tcctattagtgtt

SEQ ID NO: 1361939 - DNA, 15 bp, Homo sapiens
tcctcacctcatgcc

SEQ ID NO: 1361940 - DNA, 21 bp, Homo sapiens
tcctcacctcatgcccacccc

SEQ ID NO: 1361941 - DNA, 22 bp, Homo sapiens
tcctcatggcagcctactctcc

SEQ ID NO: 1361942 - DNA, 18 bp, Homo sapiens
tcctcattagcattttgc

SEQ ID NO: 1361943 - DNA, 21 bp, Homo sapiens
tcctcccacccggctgcagag

SEQ ID NO: 1361944 - DNA, 19 bp, Homo sapiens
tcctcccaggaagcccagg

SEQ ID NO: 1361945 - DNA, 18 bp, Homo sapiens
tcctcccttccttttccc

SEQ ID NO: 1361946 - DNA, 21 bp, Homo sapiens
tcctcccttccttttccctgc

SEQ ID NO: 1361947 - DNA, 22 bp, Homo sapiens
tcctcccttccttttccctgct

SEQ ID NO: 1361948 - DNA, 12 bp, Homo sapiens
tcctcctgcaga

SEQ ID NO: 1361949 - DNA, 15 bp, Homo sapiens
tcctcggtactccca

SEQ ID NO: 1361950 - DNA, 17 bp, Homo sapiens
tcctcggtactcccata

SEQ ID NO: 1361951 - DNA, 14 bp, Homo sapiens
tcctctagaagcca

SEQ ID NO: 1361952 - DNA, 17 bp, Homo sapiens
tcctctagaagccaagg

SEQ ID NO: 1361953 - DNA, 17 bp, Homo sapiens
tcctctcacctcagcct

SEQ ID NO: 1361954 - DNA, 18 bp, Homo sapiens
tcctctctaagtgggcat

SEQ ID NO: 1361955 - DNA, 12 bp, Homo sapiens
tcctctgcctgc

SEQ ID NO: 1361956 - DNA, 18 bp, Homo sapiens
tcctctggacggcaggct

SEQ ID NO: 1361957 - DNA, 20 bp, Homo sapiens
tcctctggacggcaggctca

SEQ ID NO: 1361958 - DNA, 24 bp, Homo sapiens
tcctctggacggcaggctcactgc

SEQ ID NO: 1361959 - DNA, 20 bp, Homo sapiens
tcctcttgtgatttctttaa

SEQ ID NO: 1361960 - DNA, 16 bp, Homo sapiens
tcctgaaactatattt

SEQ ID NO: 1361961 - DNA, 14 bp, Homo sapiens
tcctgaaccatgtg

SEQ ID NO: 1361962 - DNA, 22 bp, Homo sapiens
tcctgaaccatgtggataactt

SEQ ID NO: 1361963 - DNA, 17 bp, Homo sapiens
tcctgaaccgcacagct

SEQ ID NO: 1361964 - DNA, 14 bp, Homo sapiens
tcctgacagaaggt

SEQ ID NO: 1361965 - DNA, 16 bp, Homo sapiens
tcctgacagaaggtgc

SEQ ID NO: 1361966 - DNA, 17 bp, Homo sapiens
tcctgacagaaggtgcc

SEQ ID NO: 1361967 - DNA, 15 bp, Homo sapiens
tcctgacattgtctc

SEQ ID NO: 1361968 - DNA, 16 bp, Homo sapiens
tcctgacccattgctg

SEQ ID NO: 1361969 - DNA, 20 bp, Homo sapiens
tcctgactgaaagtaggggg

SEQ ID NO: 1361970 - DNA, 14 bp, Homo sapiens
tcctgactggtgct

SEQ ID NO: 1361971 - DNA, 15 bp, Homo sapiens
tcctgactggtgctg

SEQ ID NO: 1361972 - DNA, 20 bp, Homo sapiens
tcctgatccactttggggga

SEQ ID NO: 1361973 - DNA, 23 bp, Homo sapiens
tcctgatttctagaacccgtgac

SEQ ID NO: 1361974 - DNA, 13 bp, Homo sapiens
tcctgcctgtggc

SEQ ID NO: 1361975 - DNA, 13 bp, Homo sapiens
tcctgcgggtggg

SEQ ID NO: 1361976 - DNA, 13 bp, Homo sapiens
tcctgcgtcctcc

SEQ ID NO: 1361977 - DNA, 16 bp, Homo sapiens
tcctgcgtcctcctca

SEQ ID NO: 1361978 - DNA, 16 bp, Homo sapiens
tcctggaacaatattt

SEQ ID NO: 1361979 - DNA, 21 bp, Homo sapiens
tcctggaacaatattttatgg

SEQ ID NO: 1361980 - DNA, 17 bp, Homo sapiens
tcctggaattgccagct

SEQ ID NO: 1361981 - DNA, 11 bp, Homo sapiens
tcctggcagcc

SEQ ID NO: 1361982 - DNA, 17 bp, Homo sapiens
tcctggcagcccagaga

SEQ ID NO: 1361983 - DNA, 19 bp, Homo sapiens
tcctggcagcccagagact

SEQ ID NO: 1361984 - DNA, 14 bp, Homo sapiens
tcctggcctatccg

SEQ ID NO: 1361985 - DNA, 13 bp, Homo sapiens
tcctgtcctgctc

SEQ ID NO: 1361986 - DNA, 22 bp, Homo sapiens
tcctgtgaatgccactgccttc

SEQ ID NO: 1361987 - DNA, 17 bp, Homo sapiens
tccttaagctgcagaga

SEQ ID NO: 1361988 - DNA, 13 bp, Homo sapiens
tccttcagacacc

SEQ ID NO: 1361989 - DNA, 18 bp, Homo sapiens
tccttccagtataaccag

SEQ ID NO: 1361990 - DNA, 23 bp, Homo sapiens
tccttgaagaactgcaggccctg

SEQ ID NO: 1361991 - DNA, 21 bp, Homo sapiens
tccttgagacacggagcccag

SEQ ID NO: 1361992 - DNA, 19 bp, Homo sapiens
tccttggagaaatgaaaac

SEQ ID NO: 1361993 - DNA, 20 bp, Homo sapiens
tccttgtagcgactaaacta

SEQ ID NO: 1361994 - DNA, 13 bp, Homo sapiens
tcctttatgtgaa

SEQ ID NO: 1361995 - DNA, 15 bp, Homo sapiens
tcctttatgtgaatt

SEQ ID NO: 1361996 - DNA, 13 bp, Homo sapiens
tcctttcccaagc

SEQ ID NO: 1361997 - DNA, 21 bp, Homo sapiens
tcctttcccaagccttcgggc

SEQ ID NO: 1361998 - DNA, 15 bp, Homo sapiens
tcctttgttcccggc

SEQ ID NO: 1361999 - DNA, 13 bp, Homo sapiens
tcctttttattta

SEQ ID NO: 1362000 - DNA, 12 bp, Homo sapiens
tcgaagtcatta

SEQ ID NO: 1362001 - DNA, 16 bp, Homo sapiens
tcgaagtcattaaact

SEQ ID NO: 1362002 - DNA, 17 bp, Homo sapiens
tcgaagtcattaaactg

SEQ ID NO: 1362003 - DNA, 23 bp, Homo sapiens
tcgaattttgtctttaaaattca

SEQ ID NO: 1362004 - DNA, 20 bp, Homo sapiens
tcgagaaagaggcaccagga

SEQ ID NO: 1362005 - DNA, 21 bp, Homo sapiens
tcgagaaagaggcaccaggaa

SEQ ID NO: 1362006 - DNA, 15 bp, Homo sapiens
tcgagaccatcctgg

SEQ ID NO: 1362007 - DNA, 16 bp, Homo sapiens
tcgagaccatcctggc

SEQ ID NO: 1362008 - DNA, 19 bp, Homo sapiens
tcgagaccatcctggctaa

SEQ ID NO: 1362009 - DNA, 13 bp, Homo sapiens
tcgagtctgaggc

SEQ ID NO: 1362010 - DNA, 14 bp, Homo sapiens
tcgagtctgaggcc

SEQ ID NO: 1362011 - DNA, 23 bp, Homo sapiens
tcgatactgcgactttctgcctg

SEQ ID NO: 1362012 - DNA, 16 bp, Homo sapiens
tcgcaccattctgact

SEQ ID NO: 1362013 - DNA, 17 bp, Homo sapiens
tcgcaccattctgactc

SEQ ID NO: 1362014 - DNA, 15 bp, Homo sapiens
tcgcatttgtcaatg

SEQ ID NO: 1362015 - DNA, 21 bp, Homo sapiens
tcgcctttcctctctatattt

SEQ ID NO: 1362016 - DNA, 16 bp, Homo sapiens
tcgcttcttgcctctg

SEQ ID NO: 1362017 - DNA, 20 bp, Homo sapiens
tcggaacccaagcttagaac

SEQ ID NO: 1362018 - DNA, 21 bp, Homo sapiens
tcgggagacagcatcagggtt

SEQ ID NO: 1362019 - DNA, 17 bp, Homo sapiens
tcgggaggtcgaggcag

SEQ ID NO: 1362020 - DNA, 21 bp, Homo sapiens
tcgggaggtcgaggcaggagg

SEQ ID NO: 1362021 - DNA, 19 bp, Homo sapiens
tcgggcaggggctggaggg

SEQ ID NO: 1362022 - DNA, 13 bp, Homo sapiens
tcggtttctccaa

SEQ ID NO: 1362023 - DNA, 14 bp, Homo sapiens
tcgtacataatact

SEQ ID NO: 1362024 - DNA, 15 bp, Homo sapiens
tcgtgaagaagcctg

SEQ ID NO: 1362025 - DNA, 17 bp, Homo sapiens
tcgtggacacacacaga

SEQ ID NO: 1362026 - DNA, 18 bp, Homo sapiens
tcgtggacacacacagac

SEQ ID NO: 1362027 - DNA, 12 bp, Homo sapiens
tcgtggctgtca

SEQ ID NO: 1362028 - DNA, 13 bp, Homo sapiens
tcgtggctgtcaa

SEQ ID NO: 1362029 - DNA, 12 bp, Homo sapiens
tcgtggggaggt

SEQ ID NO: 1362030 - DNA, 21 bp, Homo sapiens
tcgttctgtactgttactggg

SEQ ID NO: 1362031 - DNA, 20 bp, Homo sapiens
tcgtttttgtattttcatga

SEQ ID NO: 1362032 - DNA, 14 bp, Homo sapiens
tctaaagagcatct

SEQ ID NO: 1362033 - DNA, 16 bp, Homo sapiens
tctaaatctatttatt

SEQ ID NO: 1362034 - DNA, 21 bp, Homo sapiens
tctaaatctatttattaatat

SEQ ID NO: 1362035 - DNA, 23 bp, Homo sapiens
tctaagactatatatataaatgt

SEQ ID NO: 1362036 - DNA, 16 bp, Homo sapiens
tctaagtcatgtatgt

SEQ ID NO: 1362037 - DNA, 21 bp, Homo sapiens
tctaagtgggcattgccatgt

SEQ ID NO: 1362038 - DNA, 23 bp, Homo sapiens
tctaattaaccttactaattata

SEQ ID NO: 1362039 - DNA, 16 bp, Homo sapiens
tctaattgctgtgtgt

SEQ ID NO: 1362040 - DNA, 14 bp, Homo sapiens
tctacaatctcttt

SEQ ID NO: 1362041 - DNA, 13 bp, Homo sapiens
tctacagtggttt

SEQ ID NO: 1362042 - DNA, 21 bp, Homo sapiens
tctacatgaggaactgtagat

SEQ ID NO: 1362043 - DNA, 18 bp, Homo sapiens
tctacctgccctcaaggg

SEQ ID NO: 1362044 - DNA, 13 bp, Homo sapiens
tctacgtttcttt

SEQ ID NO: 1362045 - DNA, 14 bp, Homo sapiens
tctacgtttcttta

SEQ ID NO: 1362046 - DNA, 18 bp, Homo sapiens
tctactctagggaaaaac

SEQ ID NO: 1362047 - DNA, 24 bp, Homo sapiens
tctactgcatttagggagtattct

SEQ ID NO: 1362048 - DNA, 23 bp, Homo sapiens
tctactgtcaaatgatgtgcaaa

SEQ ID NO: 1362049 - DNA, 21 bp, Homo sapiens
tctacttaatccaatgggttt

SEQ ID NO: 1362050 - DNA, 14 bp, Homo sapiens
tctagaaacaaaca

SEQ ID NO: 1362051 - DNA, 14 bp, Homo sapiens
tctaggatagctaa

SEQ ID NO: 1362052 - DNA, 23 bp, Homo sapiens
tctaggatagctaactgtaaatc

SEQ ID NO: 1362053 - DNA, 12 bp, Homo sapiens
tctagggaaaaa

SEQ ID NO: 1362054 - DNA, 14 bp, Homo sapiens
tctagtcttggcca

SEQ ID NO: 1362055 - DNA, 16 bp, Homo sapiens
tctataaaactctgca

SEQ ID NO: 1362056 - DNA, 16 bp, Homo sapiens
tctataaaagaaacac

SEQ ID NO: 1362057 - DNA, 14 bp, Homo sapiens
tctataaaatagat

SEQ ID NO: 1362058 - DNA, 15 bp, Homo sapiens
tctatagcatcactt

SEQ ID NO: 1362059 - DNA, 14 bp, Homo sapiens
tctatctatttgag

SEQ ID NO: 1362060 - DNA, 17 bp, Homo sapiens
tctatgctttccaaacc

SEQ ID NO: 1362061 - DNA, 18 bp, Homo sapiens
tctatgctttccaaacct

SEQ ID NO: 1362062 - DNA, 13 bp, Homo sapiens
tctattaatatat

SEQ ID NO: 1362063 - DNA, 16 bp, Homo sapiens
tctattaatatatgta

SEQ ID NO: 1362064 - DNA, 21 bp, Homo sapiens
tctattaatatatgtattatt

SEQ ID NO: 1362065 - DNA, 22 bp, Homo sapiens
tctattaatatatgtattattt

SEQ ID NO: 1362066 - DNA, 14 bp, Homo sapiens
tctattccaataaa

SEQ ID NO: 1362067 - DNA, 15 bp, Homo sapiens
tctattccaataaac

SEQ ID NO: 1362068 - DNA, 18 bp, Homo sapiens
tctattctgagaaaacaa

SEQ ID NO: 1362069 - DNA, 15 bp, Homo sapiens
tctatttatgtttgc

SEQ ID NO: 1362070 - DNA, 16 bp, Homo sapiens
tctcaaaggagcgagc

SEQ ID NO: 1362071 - DNA, 20 bp, Homo sapiens
tctcacactggttctcaatg

SEQ ID NO: 1362072 - DNA, 22 bp, Homo sapiens
tctcacactggttctcaatgaa

SEQ ID NO: 1362073 - DNA, 22 bp, Homo sapiens
tctcacagctatgcaaaaagct

SEQ ID NO: 1362074 - DNA, 18 bp, Homo sapiens
tctcactaaagcatgaaa

SEQ ID NO: 1362075 - DNA, 20 bp, Homo sapiens
tctcactgccatgccagctt

SEQ ID NO: 1362076 - DNA, 15 bp, Homo sapiens
tctcagaagcacaga

SEQ ID NO: 1362077 - DNA, 12 bp, Homo sapiens
tctcagaatccc

SEQ ID NO: 1362078 - DNA, 21 bp, Homo sapiens
tctcagaatcccttaacagtt

SEQ ID NO: 1362079 - DNA, 14 bp, Homo sapiens
tctcagatttctga

SEQ ID NO: 1362080 - DNA, 18 bp, Homo sapiens
tctcagatttctgaggaa

SEQ ID NO: 1362081 - DNA, 20 bp, Homo sapiens
tctcaggccggcagccccag

SEQ ID NO: 1362082 - DNA, 13 bp, Homo sapiens
tctcagggcctgg

SEQ ID NO: 1362083 - DNA, 19 bp, Homo sapiens
tctcagggcctggtcgttt

SEQ ID NO: 1362084 - DNA, 14 bp, Homo sapiens
tctcagtgttggta

SEQ ID NO: 1362085 - DNA, 23 bp, Homo sapiens
tctccaaactgaagcagcctctc

SEQ ID NO: 1362086 - DNA, 10 bp, Homo sapiens
tctccactgt

SEQ ID NO: 1362087 - DNA, 23 bp, Homo sapiens
tctccaggggctgcttcctcctg

SEQ ID NO: 1362088 - DNA, 18 bp, Homo sapiens
tctcccaaaaaactactt

SEQ ID NO: 1362089 - DNA, 17 bp, Homo sapiens
tctcccaggtaccagct

SEQ ID NO: 1362090 - DNA, 18 bp, Homo sapiens
tctcccaggtaccagctg

SEQ ID NO: 1362091 - DNA, 19 bp, Homo sapiens
tctcccaggtaccagctgc

SEQ ID NO: 1362092 - DNA, 13 bp, Homo sapiens
tctcccctcagct

SEQ ID NO: 1362093 - DNA, 15 bp, Homo sapiens
tctccctgcctggcc

SEQ ID NO: 1362094 - DNA, 16 bp, Homo sapiens
tctccctgcctggccc

SEQ ID NO: 1362095 - DNA, 13 bp, Homo sapiens
tctccctggctcc

SEQ ID NO: 1362096 - DNA, 14 bp, Homo sapiens
tctccgccagcctc

SEQ ID NO: 1362097 - DNA, 18 bp, Homo sapiens
tctccgccagcctcctct

SEQ ID NO: 1362098 - DNA, 17 bp, Homo sapiens
tctccgttagctcctgt

SEQ ID NO: 1362099 - DNA, 20 bp, Homo sapiens
tctccgttagctcctgtggc

SEQ ID NO: 1362100 - DNA, 19 bp, Homo sapiens
tctcctatatatttctatt

SEQ ID NO: 1362101 - DNA, 22 bp, Homo sapiens
tctcctatatatttctattatt

SEQ ID NO: 1362102 - DNA, 23 bp, Homo sapiens
tctcctatatatttctattatta

SEQ ID NO: 1362103 - DNA, 15 bp, Homo sapiens
tctcctgacagaagg

SEQ ID NO: 1362104 - DNA, 14 bp, Homo sapiens
tctcctgagctagg

SEQ ID NO: 1362105 - DNA, 11 bp, Homo sapiens
tctcctggagg

SEQ ID NO: 1362106 - DNA, 22 bp, Homo sapiens
tctccttccagtataaccagct

SEQ ID NO: 1362107 - DNA, 16 bp, Homo sapiens
tctccttgagtgtatg

SEQ ID NO: 1362108 - DNA, 23 bp, Homo sapiens
tctcggatagttgctatttttgt

SEQ ID NO: 1362109 - DNA, 17 bp, Homo sapiens
tctctaaggtttacaat

SEQ ID NO: 1362110 - DNA, 13 bp, Homo sapiens
tctctaggaagtc

SEQ ID NO: 1362111 - DNA, 13 bp, Homo sapiens
tctctccactgtg

SEQ ID NO: 1362112 - DNA, 13 bp, Homo sapiens
tctctccagatgt

SEQ ID NO: 1362113 - DNA, 13 bp, Homo sapiens
tctctcctcccca

SEQ ID NO: 1362114 - DNA, 14 bp, Homo sapiens
tctctctctaaggt

SEQ ID NO: 1362115 - DNA, 16 bp, Homo sapiens
tctctcttctcagagt

SEQ ID NO: 1362116 - DNA, 14 bp, Homo sapiens
tctctgaaagtgtg

SEQ ID NO: 1362117 - DNA, 15 bp, Homo sapiens
tctctgaatgcccca

SEQ ID NO: 1362118 - DNA, 14 bp, Homo sapiens
tctctgacttctgc

SEQ ID NO: 1362119 - DNA, 16 bp, Homo sapiens
tctctgacttctgcct

SEQ ID NO: 1362120 - DNA, 18 bp, Homo sapiens
tctctgccatatcagtga

SEQ ID NO: 1362121 - DNA, 13 bp, Homo sapiens
tctctgtgagaag

SEQ ID NO: 1362122 - DNA, 12 bp, Homo sapiens
tctctgtgcctt

SEQ ID NO: 1362123 - DNA, 19 bp, Homo sapiens
tctcttcattattctctgc

SEQ ID NO: 1362124 - DNA, 14 bp, Homo sapiens
tctcttctcagagt

SEQ ID NO: 1362125 - DNA, 15 bp, Homo sapiens
tctcttgagcctggg

SEQ ID NO: 1362126 - DNA, 15 bp, Homo sapiens
tctcttgagctggcc

SEQ ID NO: 1362127 - DNA, 18 bp, Homo sapiens
tctctttaaaaggaaaga

SEQ ID NO: 1362128 - DNA, 21 bp, Homo sapiens
tctctttaaaaggaaagaaaa

SEQ ID NO: 1362129 - DNA, 18 bp, Homo sapiens
tctctttgattatttgca

SEQ ID NO: 1362130 - DNA, 20 bp, Homo sapiens
tctgaaataggaaacaagtg

SEQ ID NO: 1362131 - DNA, 15 bp, Homo sapiens
tctgaaatgttacaa

SEQ ID NO: 1362132 - DNA, 21 bp, Homo sapiens
tctgaatttacttccttgcat

SEQ ID NO: 1362133 - DNA, 19 bp, Homo sapiens
tctgaccacttgaggcctg

SEQ ID NO: 1362134 - DNA, 16 bp, Homo sapiens
tctgactcggtttctc

SEQ ID NO: 1362135 - DNA, 19 bp, Homo sapiens
tctgactcggtttctccaa

SEQ ID NO: 1362136 - DNA, 14 bp, Homo sapiens
tctgacttctgcct

SEQ ID NO: 1362137 - DNA, 12 bp, Homo sapiens
tctgagaaaaca

SEQ ID NO: 1362138 - DNA, 20 bp, Homo sapiens
tctgagccagtgctttaatg

SEQ ID NO: 1362139 - DNA, 15 bp, Homo sapiens
tctgagcctgatatt

SEQ ID NO: 1362140 - DNA, 14 bp, Homo sapiens
tctgagcgcctcca

SEQ ID NO: 1362141 - DNA, 19 bp, Homo sapiens
tctgagcttacgtagttct

SEQ ID NO: 1362142 - DNA, 20 bp, Homo sapiens
tctgagggcttgtagttctt

SEQ ID NO: 1362143 - DNA, 15 bp, Homo sapiens
tctgatggccttaat

SEQ ID NO: 1362144 - DNA, 23 bp, Homo sapiens
tctgatggccttaatttcctttt

SEQ ID NO: 1362145 - DNA, 20 bp, Homo sapiens
tctgatttcttttcaccatt

SEQ ID NO: 1362146 - DNA, 19 bp, Homo sapiens
tctgatttgctgctcttca

SEQ ID NO: 1362147 - DNA, 14 bp, Homo sapiens
tctgcaacaagcat

SEQ ID NO: 1362148 - DNA, 16 bp, Homo sapiens
tctgcaacaagcatgc

SEQ ID NO: 1362149 - DNA, 17 bp, Homo sapiens
tctgcaacaagcatgca

SEQ ID NO: 1362150 - DNA, 20 bp, Homo sapiens
tctgcaagaattgaagcagg

SEQ ID NO: 1362151 - DNA, 14 bp, Homo sapiens
tctgcacaagctgc

SEQ ID NO: 1362152 - DNA, 15 bp, Homo sapiens
tctgcacccagaaca

SEQ ID NO: 1362153 - DNA, 19 bp, Homo sapiens
tctgcaccccttctctcct

SEQ ID NO: 1362154 - DNA, 17 bp, Homo sapiens
tctgccaccctgctgag

SEQ ID NO: 1362155 - DNA, 18 bp, Homo sapiens
tctgccatctagccagcc

SEQ ID NO: 1362156 - DNA, 21 bp, Homo sapiens
tctgccctggctgctgccccc

SEQ ID NO: 1362157 - DNA, 18 bp, Homo sapiens
tctgccgccccctcctga

SEQ ID NO: 1362158 - DNA, 21 bp, Homo sapiens
tctgccggtgctcggagaaga

SEQ ID NO: 1362159 - DNA, 23 bp, Homo sapiens
tctgcctggagacttagggcacc

SEQ ID NO: 1362160 - DNA, 19 bp, Homo sapiens
tctgcggatctcagctttg

SEQ ID NO: 1362161 - DNA, 15 bp, Homo sapiens
tctgctgcagagcag

SEQ ID NO: 1362162 - DNA, 14 bp, Homo sapiens
tctgcttctctgac

SEQ ID NO: 1362163 - DNA, 19 bp, Homo sapiens
tctgcttctctgacttctg

SEQ ID NO: 1362164 - DNA, 12 bp, Homo sapiens
tctgctttagac

SEQ ID NO: 1362165 - DNA, 19 bp, Homo sapiens
tctgctttagacttgaaaa

SEQ ID NO: 1362166 - DNA, 20 bp, Homo sapiens
tctggaatatgcaacattgt

SEQ ID NO: 1362167 - DNA, 19 bp, Homo sapiens
tctggaatctggagaccag

SEQ ID NO: 1362168 - DNA, 23 bp, Homo sapiens
tctggacggcaggctcactgcca

SEQ ID NO: 1362169 - DNA, 21 bp, Homo sapiens
tctggagccctaaccccttcc

SEQ ID NO: 1362170 - DNA, 14 bp, Homo sapiens
tctggaggggaggg

SEQ ID NO: 1362171 - DNA, 21 bp, Homo sapiens
tctggaggggagggggatccg

SEQ ID NO: 1362172 - DNA, 12 bp, Homo sapiens
tctggcaaggac

SEQ ID NO: 1362173 - DNA, 18 bp, Homo sapiens
tctggcaaggactttgta

SEQ ID NO: 1362174 - DNA, 21 bp, Homo sapiens
tctggggaaagacactgcctg

SEQ ID NO: 1362175 - DNA, 23 bp, Homo sapiens
tctggggaaagacactgcctggg

SEQ ID NO: 1362176 - DNA, 18 bp, Homo sapiens
tctggggcaggctgggcc

SEQ ID NO: 1362177 - DNA, 21 bp, Homo sapiens
tctggggcaggctgggccatg

SEQ ID NO: 1362178 - DNA, 20 bp, Homo sapiens
tctggtcaagggctgtcatt

SEQ ID NO: 1362179 - DNA, 22 bp, Homo sapiens
taaaaatctaagcagcttattg

SEQ ID NO: 1362180 - DNA, 15 bp, Homo sapiens
taaaaatctcttttc

SEQ ID NO: 1362181 - DNA, 22 bp, Homo sapiens
taaaaatggaaactatattgac

SEQ ID NO: 1362182 - DNA, 14 bp, Homo sapiens
taaaacaaaatttg

SEQ ID NO: 1362183 - DNA, 13 bp, Homo sapiens
taaaacatagcaa

SEQ ID NO: 1362184 - DNA, 14 bp, Homo sapiens
taaaacatagcaaa

SEQ ID NO: 1362185 - DNA, 16 bp, Homo sapiens
taaaacatcattcctt

SEQ ID NO: 1362186 - DNA, 17 bp, Homo sapiens
taaaacatcattccttt

SEQ ID NO: 1362187 - DNA, 20 bp, Homo sapiens
taaaacatcattccttttta

SEQ ID NO: 1362188 - DNA, 21 bp, Homo sapiens
taaaaccgaaggtgaaaaaaa

SEQ ID NO: 1362189 - DNA, 23 bp, Homo sapiens
taaaacggtgctgtgagggaggg

SEQ ID NO: 1362190 - DNA, 15 bp, Homo sapiens
taaaagaatgactat

SEQ ID NO: 1362191 - DNA, 18 bp, Homo sapiens
taaaagacagtgtatgta

SEQ ID NO: 1362192 - DNA, 15 bp, Homo sapiens
taaaaggaaagaaaa

SEQ ID NO: 1362193 - DNA, 21 bp, Homo sapiens
taaaaggaaagaaaacatctt

SEQ ID NO: 1362194 - DNA, 17 bp, Homo sapiens
taaaagttttatatgct

SEQ ID NO: 1362195 - DNA, 14 bp, Homo sapiens
taaaataaaatgaa

SEQ ID NO: 1362196 - DNA, 16 bp, Homo sapiens
taaaataaaatgaaaa

SEQ ID NO: 1362197 - DNA, 20 bp, Homo sapiens
taaaataaaatgaaaattgt

SEQ ID NO: 1362198 - DNA, 18 bp, Homo sapiens
taaaataattatataact

SEQ ID NO: 1362199 - DNA, 22 bp, Homo sapiens
taaaatagaaattttgtaagaa

SEQ ID NO: 1362200 - DNA, 17 bp, Homo sapiens
taaaatagagtgtagtt

SEQ ID NO: 1362201 - DNA, 18 bp, Homo sapiens
taaaatagatataaattt

SEQ ID NO: 1362202 - DNA, 18 bp, Homo sapiens
taaaatagtctctttaaa

SEQ ID NO: 1362203 - DNA, 15 bp, Homo sapiens
taaaatatttatctg

SEQ ID NO: 1362204 - DNA, 20 bp, Homo sapiens
taaaatctgagggaaatgtt

SEQ ID NO: 1362205 - DNA, 15 bp, Homo sapiens
taaaatgtaatttaa

SEQ ID NO: 1362206 - DNA, 16 bp, Homo sapiens
taaaatgtaatttaaa

SEQ ID NO: 1362207 - DNA, 22 bp, Homo sapiens
taaaatgtccagtaagatcact

SEQ ID NO: 1362208 - DNA, 22 bp, Homo sapiens
taaaattatcaatatctaatat

SEQ ID NO: 1362209 - DNA, 12 bp, Homo sapiens
taaaattgttat

SEQ ID NO: 1362210 - DNA, 15 bp, Homo sapiens
taaaattgttatcaa

SEQ ID NO: 1362211 - DNA, 16 bp, Homo sapiens
taaaattttgtatgtt

SEQ ID NO: 1362212 - DNA, 19 bp, Homo sapiens
taaaattttgtatgttaaa

SEQ ID NO: 1362213 - DNA, 16 bp, Homo sapiens
taaacaaagattcatg

SEQ ID NO: 1362214 - DNA, 22 bp, Homo sapiens
taaacaagttcgagtcaaagtt

SEQ ID NO: 1362215 - DNA, 16 bp, Homo sapiens
taaacactcaccttct

SEQ ID NO: 1362216 - DNA, 12 bp, Homo sapiens
taaacagaaatg

SEQ ID NO: 1362217 - DNA, 14 bp, Homo sapiens
taaacagaaatgga

SEQ ID NO: 1362218 - DNA, 15 bp, Homo sapiens
taaacctcagttatt

SEQ ID NO: 1362219 - DNA, 14 bp, Homo sapiens
taaactataaaaca

SEQ ID NO: 1362220 - DNA, 23 bp, Homo sapiens
taaactcagcatcaaaatatttc

SEQ ID NO: 1362221 - DNA, 17 bp, Homo sapiens
taaactgtcgtgtcata

SEQ ID NO: 1362222 - DNA, 22 bp, Homo sapiens
taaacttctgcaacaagcatgc

SEQ ID NO: 1362223 - DNA, 17 bp, Homo sapiens
taaagaaaaaaatgtca

SEQ ID NO: 1362224 - DNA, 20 bp, Homo sapiens
taaagaaaaaaatgtcaaaa

SEQ ID NO: 1362225 - DNA, 15 bp, Homo sapiens
taaagaaaagatgaa

SEQ ID NO: 1362226 - DNA, 22 bp, Homo sapiens
taaagaagtatttttagaataa

SEQ ID NO: 1362227 - DNA, 16 bp, Homo sapiens
taaagaatatgacttt

SEQ ID NO: 1362228 - DNA, 15 bp, Homo sapiens
taaagacacctggtt

SEQ ID NO: 1362229 - DNA, 15 bp, Homo sapiens
taaagacagaggcag

SEQ ID NO: 1362230 - DNA, 23 bp, Homo sapiens
taaagacaggagacaaaagagca

SEQ ID NO: 1362231 - DNA, 20 bp, Homo sapiens
taaagactggcttttattaa

SEQ ID NO: 1362232 - DNA, 13 bp, Homo sapiens
taaagactggttt

SEQ ID NO: 1362233 - DNA, 19 bp, Homo sapiens
taaagagagaacaggacta

SEQ ID NO: 1362234 - DNA, 19 bp, Homo sapiens
taaagagcccttgcctccc

SEQ ID NO: 1362235 - DNA, 13 bp, Homo sapiens
taaagcaatagaa

SEQ ID NO: 1362236 - DNA, 15 bp, Homo sapiens
taaagcaatagaaac

SEQ ID NO: 1362237 - DNA, 18 bp, Homo sapiens
taaagcatgaaatgtgaa

SEQ ID NO: 1362238 - DNA, 19 bp, Homo sapiens
taaagcatgaaatgtgaat

SEQ ID NO: 1362239 - DNA, 22 bp, Homo sapiens
taaagggatatttttttctatt

SEQ ID NO: 1362240 - DNA, 13 bp, Homo sapiens
taaaggtggattt

SEQ ID NO: 1362241 - DNA, 20 bp, Homo sapiens
taaaggtggtgaggcaataa

SEQ ID NO: 1362242 - DNA, 21 bp, Homo sapiens
taaaggtggtgaggcaataaa

SEQ ID NO: 1362243 - DNA, 17 bp, Homo sapiens
taaagtagtcctgtgaa

SEQ ID NO: 1362244 - DNA, 19 bp, Homo sapiens
taaagtatgtattatttac

SEQ ID NO: 1362245 - DNA, 13 bp, Homo sapiens
taaagtattcttc

SEQ ID NO: 1362246 - DNA, 17 bp, Homo sapiens
taaagtgtgtttctatg

SEQ ID NO: 1362247 - DNA, 19 bp, Homo sapiens
taaataaaaactaattaag

SEQ ID NO: 1362248 - DNA, 20 bp, Homo sapiens
taaataaaatttgttgcata

SEQ ID NO: 1362249 - DNA, 13 bp, Homo sapiens
taaataattcttt

SEQ ID NO: 1362250 - DNA, 23 bp, Homo sapiens
taaataattcttttttattaatc

SEQ ID NO: 1362251 - DNA, 21 bp, Homo sapiens
taaataggaatcattcagaaa

SEQ ID NO: 1362252 - DNA, 12 bp, Homo sapiens
taaataggattt

SEQ ID NO: 1362253 - DNA, 17 bp, Homo sapiens
taaatatcttctgattt

SEQ ID NO: 1362254 - DNA, 18 bp, Homo sapiens
taaatatcttctgatttg

SEQ ID NO: 1362255 - DNA, 17 bp, Homo sapiens
taaatatttatttatgt

SEQ ID NO: 1362256 - DNA, 17 bp, Homo sapiens
taaatattttctatttt

SEQ ID NO: 1362257 - DNA, 17 bp, Homo sapiens
taaatcattcttactaa

SEQ ID NO: 1362258 - DNA, 14 bp, Homo sapiens
taaatcctgaagag

SEQ ID NO: 1362259 - DNA, 16 bp, Homo sapiens
taaatcctgaagagca

SEQ ID NO: 1362260 - DNA, 18 bp, Homo sapiens
taaatcctgaagagcatt

SEQ ID NO: 1362261 - DNA, 16 bp, Homo sapiens
taaatcttaatgttcc

SEQ ID NO: 1362262 - DNA, 22 bp, Homo sapiens
taaatgccctcttctcgtgcct

SEQ ID NO: 1362263 - DNA, 16 bp, Homo sapiens
taaatggcctcatgtg

SEQ ID NO: 1362264 - DNA, 18 bp, Homo sapiens
taaatggtaataagcact

SEQ ID NO: 1362265 - DNA, 14 bp, Homo sapiens
taaatgtaaactca

SEQ ID NO: 1362266 - DNA, 19 bp, Homo sapiens
taaatgtataaatatacag

SEQ ID NO: 1362267 - DNA, 23 bp, Homo sapiens
taaatgttaatggatttcagaag

SEQ ID NO: 1362268 - DNA, 16 bp, Homo sapiens
taaatgttacctctga

SEQ ID NO: 1362269 - DNA, 17 bp, Homo sapiens
taaattacaattttatc

SEQ ID NO: 1362270 - DNA, 21 bp, Homo sapiens
taaattaggaataaataaaaa

SEQ ID NO: 1362271 - DNA, 19 bp, Homo sapiens
taaattatagtgtagaaaa

SEQ ID NO: 1362272 - DNA, 20 bp, Homo sapiens
taaattatttgattatttaa

SEQ ID NO: 1362273 - DNA, 17 bp, Homo sapiens
taaattctgagcctgat

SEQ ID NO: 1362274 - DNA, 14 bp, Homo sapiens
taaattctgatttc

SEQ ID NO: 1362275 - DNA, 15 bp, Homo sapiens
taaattctgatttct

SEQ ID NO: 1362276 - DNA, 20 bp, Homo sapiens
taaattctgatttcttttca

SEQ ID NO: 1362277 - DNA, 12 bp, Homo sapiens
taaattgcatca

SEQ ID NO: 1362278 - DNA, 16 bp, Homo sapiens
taaattgcatcactgt

SEQ ID NO: 1362279 - DNA, 18 bp, Homo sapiens
taaattgcatcactgtat

SEQ ID NO: 1362280 - DNA, 19 bp, Homo sapiens
taaattgcatcactgtatc

SEQ ID NO: 1362281 - DNA, 17 bp, Homo sapiens
taaatttaataccagat

SEQ ID NO: 1362282 - DNA, 22 bp, Homo sapiens
taaattttgaaaagtaatattt

SEQ ID NO: 1362283 - DNA, 17 bp, Homo sapiens
taaattttgtatgaaaa

SEQ ID NO: 1362284 - DNA, 18 bp, Homo sapiens
taaatttttttgtatgaa

SEQ ID NO: 1362285 - DNA, 21 bp, Homo sapiens
taacaaataaaaaagctcttt

SEQ ID NO: 1362286 - DNA, 20 bp, Homo sapiens
taacacatttttttgcatgc

SEQ ID NO: 1362287 - DNA, 14 bp, Homo sapiens
taacagaaattgta

SEQ ID NO: 1362288 - DNA, 22 bp, Homo sapiens
taacagaaattgtatattgtaa

SEQ ID NO: 1362289 - DNA, 14 bp, Homo sapiens
taacattatttata

SEQ ID NO: 1362290 - DNA, 15 bp, Homo sapiens
taacattatttatat

SEQ ID NO: 1362291 - DNA, 16 bp, Homo sapiens
taacctcgccctctcc

SEQ ID NO: 1362292 - DNA, 19 bp, Homo sapiens
taaccttactaattatact

SEQ ID NO: 1362293 - DNA, 15 bp, Homo sapiens
taactcaaatacaca

SEQ ID NO: 1362294 - DNA, 18 bp, Homo sapiens
taactcaaatacacattt

SEQ ID NO: 1362295 - DNA, 12 bp, Homo sapiens
taactcatttgt

SEQ ID NO: 1362296 - DNA, 14 bp, Homo sapiens
taactgtaaatcat

SEQ ID NO: 1362297 - DNA, 22 bp, Homo sapiens
taactgtatttgaaataagaat

SEQ ID NO: 1362298 - DNA, 14 bp, Homo sapiens
taactgtcctgtcc

SEQ ID NO: 1362299 - DNA, 13 bp, Homo sapiens
tagattttccaaa

SEQ ID NO: 1362300 - DNA, 21 bp, Homo sapiens
tagcaaaataaaacatagcaa

SEQ ID NO: 1362301 - DNA, 18 bp, Homo sapiens
tagcaacaacaattggta

SEQ ID NO: 1362302 - DNA, 14 bp, Homo sapiens
tagcagcacctcct

SEQ ID NO: 1362303 - DNA, 16 bp, Homo sapiens
tagcagccagttcaaa

SEQ ID NO: 1362304 - DNA, 17 bp, Homo sapiens
tagcatcacttaaaaca

SEQ ID NO: 1362305 - DNA, 18 bp, Homo sapiens
tagcatcacttaaaacac

SEQ ID NO: 1362306 - DNA, 22 bp, Homo sapiens
tagcattgtaagcgtatggctt

SEQ ID NO: 1362307 - DNA, 15 bp, Homo sapiens
tagccaaaatgtgag

SEQ ID NO: 1362308 - DNA, 16 bp, Homo sapiens
tagccaaaatgtgagt

SEQ ID NO: 1362309 - DNA, 23 bp, Homo sapiens
tagccaaaatgtgagtggttgaa

SEQ ID NO: 1362310 - DNA, 13 bp, Homo sapiens
tatccccatctcc

SEQ ID NO: 1362311 - DNA, 20 bp, Homo sapiens
tatccccatctccctgcctg

SEQ ID NO: 1362312 - DNA, 21 bp, Homo sapiens
tatccccatctccctgcctgg

SEQ ID NO: 1362313 - DNA, 15 bp, Homo sapiens
tatccccccatcttg

SEQ ID NO: 1362314 - DNA, 17 bp, Homo sapiens
tatccccccatcttgct

SEQ ID NO: 1362315 - DNA, 17 bp, Homo sapiens
tatcctgtgactgtctc

SEQ ID NO: 1362316 - DNA, 17 bp, Homo sapiens
tatctaatatatatgaa

SEQ ID NO: 1362317 - DNA, 13 bp, Homo sapiens
tatctataaaata

SEQ ID NO: 1362318 - DNA, 16 bp, Homo sapiens
tatctatctatttgag

SEQ ID NO: 1362319 - DNA, 16 bp, Homo sapiens
tatctattctgagaaa

SEQ ID NO: 1362320 - DNA, 14 bp, Homo sapiens
tatctccggctccc

SEQ ID NO: 1362321 - DNA, 18 bp, Homo sapiens
tatctccggctcccagcc

SEQ ID NO: 1362322 - DNA, 11 bp, Homo sapiens
tatctcctgac

SEQ ID NO: 1362323 - DNA, 13 bp, Homo sapiens
tatctcctgacag

SEQ ID NO: 1362324 - DNA, 16 bp, Homo sapiens
tatctctatttgagaa

SEQ ID NO: 1362325 - DNA, 14 bp, Homo sapiens
tatcttctgatttg

SEQ ID NO: 1362326 - DNA, 18 bp, Homo sapiens
tatcttgatacattcaaa

SEQ ID NO: 1362327 - DNA, 19 bp, Homo sapiens
tatcttgatacattcaaat

SEQ ID NO: 1362328 - DNA, 11 bp, Homo sapiens
tatcttggcct

SEQ ID NO: 1362329 - DNA, 18 bp, Homo sapiens
tatgaaaacatggaacag

SEQ ID NO: 1362330 - DNA, 17 bp, Homo sapiens
tatgaacatacaaatgc

SEQ ID NO: 1362331 - DNA, 21 bp, Homo sapiens
tatgaagctacctcaaacttc

SEQ ID NO: 1362332 - DNA, 13 bp, Homo sapiens
tatgactttttat

SEQ ID NO: 1362333 - DNA, 15 bp, Homo sapiens
tatgagaggcaatga

SEQ ID NO: 1362334 - DNA, 20 bp, Homo sapiens
tatgagattggttttcctgt

SEQ ID NO: 1362335 - DNA, 21 bp, Homo sapiens
tatgatgacgtacaagtagtt

SEQ ID NO: 1362336 - DNA, 17 bp, Homo sapiens
tatgattaaaaatatca

SEQ ID NO: 1362337 - DNA, 18 bp, Homo sapiens
tatgcatcatttcaggag

SEQ ID NO: 1362338 - DNA, 14 bp, Homo sapiens
tatgccacttcctt

SEQ ID NO: 1362339 - DNA, 14 bp, Homo sapiens
tatgctatttctgt

SEQ ID NO: 1362340 - DNA, 21 bp, Homo sapiens
tatgctttccaaaccttatct

SEQ ID NO: 1362341 - DNA, 13 bp, Homo sapiens
tatggactatctg

SEQ ID NO: 1362342 - DNA, 15 bp, Homo sapiens
tatgggcccctggca

SEQ ID NO: 1362343 - DNA, 17 bp, Homo sapiens
tatggtatatatacata

SEQ ID NO: 1362344 - DNA, 20 bp, Homo sapiens
tatggttacttcttctctta

SEQ ID NO: 1362345 - DNA, 14 bp, Homo sapiens
tatggttatgtttt

SEQ ID NO: 1362346 - DNA, 15 bp, Homo sapiens
tatgtaaataattct

SEQ ID NO: 1362347 - DNA, 17 bp, Homo sapiens
tatgtaaataattcttt

SEQ ID NO: 1362348 - DNA, 17 bp, Homo sapiens
tatgtaatctctaggaa

SEQ ID NO: 1362349 - DNA, 21 bp, Homo sapiens
tatgtacttttattttacaca

SEQ ID NO: 1362350 - DNA, 15 bp, Homo sapiens
tatgtatgtgtttag

SEQ ID NO: 1362351 - DNA, 16 bp, Homo sapiens
tatgtatgtgtttaga

SEQ ID NO: 1362352 - DNA, 22 bp, Homo sapiens
tatgtatgtgtttagaattgaa

SEQ ID NO: 1362353 - DNA, 15 bp, Homo sapiens
tatgtcagtactatt

SEQ ID NO: 1362354 - DNA, 18 bp, Homo sapiens
tatgtgggatattgaatg

SEQ ID NO: 1362355 - DNA, 20 bp, Homo sapiens
tatgtgtatgcacagtaaaa

SEQ ID NO: 1362356 - DNA, 14 bp, Homo sapiens
tatgttaaagagaa

SEQ ID NO: 1362357 - DNA, 16 bp, Homo sapiens
tatgttcagattattg

SEQ ID NO: 1362358 - DNA, 18 bp, Homo sapiens
tatgttgtttataataaa

SEQ ID NO: 1362359 - DNA, 13 bp, Homo sapiens
tatgtttaaaata

SEQ ID NO: 1362360 - DNA, 23 bp, Homo sapiens
tatgtttctctttgattatttgc

SEQ ID NO: 1362361 - DNA, 17 bp, Homo sapiens
tattaaaaaagagacat

SEQ ID NO: 1362362 - DNA, 23 bp, Homo sapiens
tattaaaaaagagacatccaaat

SEQ ID NO: 1362363 - DNA, 16 bp, Homo sapiens
tattaaaatatttcag

SEQ ID NO: 1362364 - DNA, 23 bp, Homo sapiens
tattaaaggaagcactctgtata

SEQ ID NO: 1362365 - DNA, 21 bp, Homo sapiens
tattaaatttttttgtatgaa

SEQ ID NO: 1362366 - DNA, 23 bp, Homo sapiens
tattaaatttttttgtatgaaaa

SEQ ID NO: 1362367 - DNA, 14 bp, Homo sapiens
tattaatatatgta

SEQ ID NO: 1362368 - DNA, 14 bp, Homo sapiens
tattaatcactgtg

SEQ ID NO: 1362369 - DNA, 16 bp, Homo sapiens
tattaatcactgtgta

SEQ ID NO: 1362370 - DNA, 22 bp, Homo sapiens
tattaatcactgtgtatatttg

SEQ ID NO: 1362371 - DNA, 12 bp, Homo sapiens
tattaatgcact

SEQ ID NO: 1362372 - DNA, 16 bp, Homo sapiens
tattacaaaaacaaaa

SEQ ID NO: 1362373 - DNA, 18 bp, Homo sapiens
tattacttccatgaattt

SEQ ID NO: 1362374 - DNA, 19 bp, Homo sapiens
tattacttccatgaatttt

SEQ ID NO: 1362375 - DNA, 12 bp, Homo sapiens
tattagagaaga

SEQ ID NO: 1362376 - DNA, 16 bp, Homo sapiens
tattagtgttatatga

SEQ ID NO: 1362377 - DNA, 23 bp, Homo sapiens
tattagtgttatatgaacataca

SEQ ID NO: 1362378 - DNA, 18 bp, Homo sapiens
tattataaaggataaaga

SEQ ID NO: 1362379 - DNA, 14 bp, Homo sapiens
tattatctgggctt

SEQ ID NO: 1362380 - DNA, 20 bp, Homo sapiens
tattatttttataattgtac

SEQ ID NO: 1362381 - DNA, 20 bp, Homo sapiens
tattatttttttaaaatttt

SEQ ID NO: 1362382 - DNA, 16 bp, Homo sapiens
tattcaattcttttaa

SEQ ID NO: 1362383 - DNA, 15 bp, Homo sapiens
tattcagggtaaata

SEQ ID NO: 1362384 - DNA, 16 bp, Homo sapiens
tattcagggtaaatag

SEQ ID NO: 1362385 - DNA, 13 bp, Homo sapiens
tattctaataagc

SEQ ID NO: 1362386 - DNA, 17 bp, Homo sapiens
tattctaataagctagt

SEQ ID NO: 1362387 - DNA, 19 bp, Homo sapiens
tattgaacttttgtactga

SEQ ID NO: 1362388 - DNA, 21 bp, Homo sapiens
tattgacaaccgagaaggttt

SEQ ID NO: 1362389 - DNA, 14 bp, Homo sapiens
tattgacactgaac

SEQ ID NO: 1362390 - DNA, 18 bp, Homo sapiens
tattgaggccaagaatat

SEQ ID NO: 1362391 - DNA, 19 bp, Homo sapiens
tattgaggccaagaatatt

SEQ ID NO: 1362392 - DNA, 15 bp, Homo sapiens
tattgattgggaaaa

SEQ ID NO: 1362393 - DNA, 16 bp, Homo sapiens
tattgcaaaatacatg

SEQ ID NO: 1362394 - DNA, 18 bp, Homo sapiens
tattgcaaaatacatgaa

SEQ ID NO: 1362395 - DNA, 23 bp, Homo sapiens
tattggggccatgagtaaaatag

SEQ ID NO: 1362396 - DNA, 16 bp, Homo sapiens
tattgtatattacaat

SEQ ID NO: 1362397 - DNA, 17 bp, Homo sapiens
tattgtcctattagtgt

SEQ ID NO: 1362398 - DNA, 20 bp, Homo sapiens
tattgttgacaactgtgact

SEQ ID NO: 1362399 - DNA, 15 bp, Homo sapiens
tattgtttctgcatt

SEQ ID NO: 1362400 - DNA, 15 bp, Homo sapiens
tattgtttggtaaat

SEQ ID NO: 1362401 - DNA, 16 bp, Homo sapiens
tattgtttggtaaatg

SEQ ID NO: 1362402 - DNA, 17 bp, Homo sapiens
tattgttttacaatagt

SEQ ID NO: 1362403 - DNA, 20 bp, Homo sapiens
tattgttttacaatagttct

SEQ ID NO: 1362404 - DNA, 22 bp, Homo sapiens
tattgttttacaatagttctgt

SEQ ID NO: 1362405 - DNA, 18 bp, Homo sapiens
tatttaaaaatagaaaca

SEQ ID NO: 1362406 - DNA, 14 bp, Homo sapiens
tatttaacagaaat

SEQ ID NO: 1362407 - DNA, 19 bp, Homo sapiens
tatttaacagaaattgtat

SEQ ID NO: 1362408 - DNA, 14 bp, Homo sapiens
tatttaagactaaa

SEQ ID NO: 1362409 - DNA, 18 bp, Homo sapiens
tatttaagatgtgaaaat

SEQ ID NO: 1362410 - DNA, 14 bp, Homo sapiens
tatttaatatttaa

SEQ ID NO: 1362411 - DNA, 17 bp, Homo sapiens
tatttaatggaagtgta

SEQ ID NO: 1362412 - DNA, 13 bp, Homo sapiens
tatttagacaaga

SEQ ID NO: 1362413 - DNA, 22 bp, Homo sapiens
tatttataatagcaacttttgt

SEQ ID NO: 1362414 - DNA, 16 bp, Homo sapiens
tatttatatgtatgtg

SEQ ID NO: 1362415 - DNA, 17 bp, Homo sapiens
tatttatatttattgac

SEQ ID NO: 1362416 - DNA, 15 bp, Homo sapiens
tatttattaaatttt

SEQ ID NO: 1362417 - DNA, 24 bp, Homo sapiens
tatttattaaatttttttgtatga

SEQ ID NO: 1362418 - DNA, 19 bp, Homo sapiens
tatttattaatatttaaca

SEQ ID NO: 1362419 - DNA, 11 bp, Homo sapiens
tatttatttat

SEQ ID NO: 1362420 - DNA, 13 bp, Homo sapiens
tatttatttatgt

SEQ ID NO: 1362421 - DNA, 16 bp, Homo sapiens
tatttattttcctaaa

SEQ ID NO: 1362422 - DNA, 22 bp, Homo sapiens
tatttattttttttaattgtat

SEQ ID NO: 1362423 - DNA, 15 bp, Homo sapiens
tatttctgtatataa

SEQ ID NO: 1362424 - DNA, 20 bp, Homo sapiens
tatttgaacaatgaagttga

SEQ ID NO: 1362425 - DNA, 16 bp, Homo sapiens
tatttgatttattaac

SEQ ID NO: 1362426 - DNA, 18 bp, Homo sapiens
tattttaagactgatttt

SEQ ID NO: 1362427 - DNA, 16 bp, Homo sapiens
tattttataatgtcca

SEQ ID NO: 1362428 - DNA, 23 bp, Homo sapiens
tattttatggttatgtttttctg

SEQ ID NO: 1362429 - DNA, 13 bp, Homo sapiens
tattttattactg

SEQ ID NO: 1362430 - DNA, 14 bp, Homo sapiens
tattttattactgt

SEQ ID NO: 1362431 - DNA, 17 bp, Homo sapiens
tattttatttagacaag

SEQ ID NO: 1362432 - DNA, 14 bp, Homo sapiens
tattttctacagtg

SEQ ID NO: 1362433 - DNA, 19 bp, Homo sapiens
tattttctattttaagact

SEQ ID NO: 1362434 - DNA, 13 bp, Homo sapiens
tattttgaatcaa

SEQ ID NO: 1362435 - DNA, 16 bp, Homo sapiens
tattttgtcatatcaa

SEQ ID NO: 1362436 - DNA, 14 bp, Homo sapiens
tattttgtgtgaaa

SEQ ID NO: 1362437 - DNA, 17 bp, Homo sapiens
tattttgtgtgaaattg

SEQ ID NO: 1362438 - DNA, 14 bp, Homo sapiens
tatttttagaataa

SEQ ID NO: 1362439 - DNA, 16 bp, Homo sapiens
tatttttcataaacaa

SEQ ID NO: 1362440 - DNA, 18 bp, Homo sapiens
tatttttcataaacaagt

SEQ ID NO: 1362441 - DNA, 17 bp, Homo sapiens
tattttttttaaagaaa

SEQ ID NO: 1362442 - DNA, 19 bp, Homo sapiens
tattttttttaattgtatt

SEQ ID NO: 1362443 - DNA, 16 bp, Homo sapiens
tattttttttttcttc

SEQ ID NO: 1362444 - DNA, 17 bp, Homo sapiens
tcaaaaaggcttataaa

SEQ ID NO: 1362445 - DNA, 17 bp, Homo sapiens
tcaaaagtagaactttg

SEQ ID NO: 1362446 - DNA, 16 bp, Homo sapiens
tcaaactggggcctcc

SEQ ID NO: 1362447 - DNA, 22 bp, Homo sapiens
tcaaactggggcctccagaact

SEQ ID NO: 1362448 - DNA, 23 bp, Homo sapiens
tcaaactggggcctccagaactc

SEQ ID NO: 1362449 - DNA, 14 bp, Homo sapiens
tcaaactgtagaaa

SEQ ID NO: 1362450 - DNA, 15 bp, Homo sapiens
tcaaagaacaaacat

SEQ ID NO: 1362451 - DNA, 19 bp, Homo sapiens
tcaaagcactgttgagaag

SEQ ID NO: 1362452 - DNA, 23 bp, Homo sapiens
tcaaataaagagagaacaggact

SEQ ID NO: 1362453 - DNA, 17 bp, Homo sapiens
tcaaatgatgtgcaaaa

SEQ ID NO: 1362454 - DNA, 16 bp, Homo sapiens
tcaaattttttgactt

SEQ ID NO: 1362455 - DNA, 15 bp, Homo sapiens
tcaacaagaaataat

SEQ ID NO: 1362456 - DNA, 18 bp, Homo sapiens
tcaacaagaaataataga

SEQ ID NO: 1362457 - DNA, 22 bp, Homo sapiens
tcaacagcaagtgtgaatactg

SEQ ID NO: 1362458 - DNA, 12 bp, Homo sapiens
tcaaccacaaaa

SEQ ID NO: 1362459 - DNA, 14 bp, Homo sapiens
tcaaccacaaaact

SEQ ID NO: 1362460 - DNA, 16 bp, Homo sapiens
tcaactgggtccagaa

SEQ ID NO: 1362461 - DNA, 17 bp, Homo sapiens
tcaactgggtccagaag

SEQ ID NO: 1362462 - DNA, 16 bp, Homo sapiens
tcaactgtcttcctca

SEQ ID NO: 1362463 - DNA, 14 bp, Homo sapiens
tcaactttgtaaaa

SEQ ID NO: 1362464 - DNA, 15 bp, Homo sapiens
tcaagagccttaaaa

SEQ ID NO: 1362465 - DNA, 17 bp, Homo sapiens
tcaagagccttaaaaca

SEQ ID NO: 1362466 - DNA, 21 bp, Homo sapiens
tcaagagccttaaaacatcat

SEQ ID NO: 1362467 - DNA, 23 bp, Homo sapiens
tcaagatcaaaaaggcttataaa

SEQ ID NO: 1362468 - DNA, 16 bp, Homo sapiens
tcaagcagtcgtgcct

SEQ ID NO: 1362469 - DNA, 19 bp, Homo sapiens
tcaagcagtcgtgcctgtg

SEQ ID NO: 1362470 - DNA, 23 bp, Homo sapiens
tcaagcagtcgtgcctgtgtcca

SEQ ID NO: 1362471 - DNA, 19 bp, Homo sapiens
tcaaggtcactgtttcctg

SEQ ID NO: 1362472 - DNA, 15 bp, Homo sapiens
tcaagtaattgtgaa

SEQ ID NO: 1362473 - DNA, 15 bp, Homo sapiens
tcaataatatatttt

SEQ ID NO: 1362474 - DNA, 20 bp, Homo sapiens
tcaataatatattttctgtt

SEQ ID NO: 1362475 - DNA, 16 bp, Homo sapiens
tcaatatattgaactt

SEQ ID NO: 1362476 - DNA, 22 bp, Homo sapiens
tcaatatattgaacttttgtac

SEQ ID NO: 1362477 - DNA, 21 bp, Homo sapiens
tcaatatctaatatatatgaa

SEQ ID NO: 1362478 - DNA, 13 bp, Homo sapiens
tcaatgagagcat

SEQ ID NO: 1362479 - DNA, 14 bp, Homo sapiens
tcaatgagagcata

SEQ ID NO: 1362480 - DNA, 17 bp, Homo sapiens
tcaatgctttatttgta

SEQ ID NO: 1362481 - DNA, 23 bp, Homo sapiens
tcaattaaaatagtctctttaaa

SEQ ID NO: 1362482 - DNA, 14 bp, Homo sapiens
tcaattgtcacttt

SEQ ID NO: 1362483 - DNA, 15 bp, Homo sapiens
tcaatttctgtgttg

SEQ ID NO: 1362484 - DNA, 11 bp, Homo sapiens
tcacaaatgac

SEQ ID NO: 1362485 - DNA, 14 bp, Homo sapiens
tcacaaatgacttt

SEQ ID NO: 1362486 - DNA, 20 bp, Homo sapiens
tcacaaatgactttattatt

SEQ ID NO: 1362487 - DNA, 12 bp, Homo sapiens
tcacaagaacac

SEQ ID NO: 1362488 - DNA, 20 bp, Homo sapiens
tcacaagaacacacacatat

SEQ ID NO: 1362489 - DNA, 12 bp, Homo sapiens
tcacacacctgt

SEQ ID NO: 1362490 - DNA, 17 bp, Homo sapiens
tcacactggttctcaat

SEQ ID NO: 1362491 - DNA, 20 bp, Homo sapiens
tcacagctatgcaaaaagct

SEQ ID NO: 1362492 - DNA, 14 bp, Homo sapiens
tcacagtagagcca

SEQ ID NO: 1362493 - DNA, 20 bp, Homo sapiens
tcacagtagagccagcttgg

SEQ ID NO: 1362494 - DNA, 21 bp, Homo sapiens
tcacagtagagccagcttggg

SEQ ID NO: 1362495 - DNA, 16 bp, Homo sapiens
tcacagtgcttttaag

SEQ ID NO: 1362496 - DNA, 18 bp, Homo sapiens
tcacagtgcttttaagtg

SEQ ID NO: 1362497 - DNA, 19 bp, Homo sapiens
tcacagtttttcctggaat

SEQ ID NO: 1362498 - DNA, 20 bp, Homo sapiens
tcacattggagtcactgcca

SEQ ID NO: 1362499 - DNA, 10 bp, Homo sapiens
tcaccaccac

SEQ ID NO: 1362500 - DNA, 13 bp, Homo sapiens
tcaccaccacccc

SEQ ID NO: 1362501 - DNA, 15 bp, Homo sapiens
tcaccagagacttta

SEQ ID NO: 1362502 - DNA, 19 bp, Homo sapiens
tcaccagagactttagggg

SEQ ID NO: 1362503 - DNA, 15 bp, Homo sapiens
tcaccagccccactg

SEQ ID NO: 1362504 - DNA, 19 bp, Homo sapiens
tcaccagccccactgccag

SEQ ID NO: 1362505 - DNA, 20 bp, Homo sapiens
tcaccatcaatcctgattcc

SEQ ID NO: 1362506 - DNA, 21 bp, Homo sapiens
tcaccattcgtacataatact

SEQ ID NO: 1362507 - DNA, 19 bp, Homo sapiens
tcacccatgcaagcagagg

SEQ ID NO: 1362508 - DNA, 15 bp, Homo sapiens
tcaccccctcccacc

SEQ ID NO: 1362509 - DNA, 17 bp, Homo sapiens
tcaccccctcccacccc

SEQ ID NO: 1362510 - DNA, 22 bp, Homo sapiens
tcacccttatagtctaagacta

SEQ ID NO: 1362511 - DNA, 15 bp, Homo sapiens
tcacctagaaattga

SEQ ID NO: 1362512 - DNA, 20 bp, Homo sapiens
tcacgcctgtaatcctagca

SEQ ID NO: 1362513 - DNA, 17 bp, Homo sapiens
tcacggaagagccttgc

SEQ ID NO: 1362514 - DNA, 22 bp, Homo sapiens
tcactaaagcatgaaatgtgaa

SEQ ID NO: 1362515 - DNA, 23 bp, Homo sapiens
tcactaattggtacttttaaaaa

SEQ ID NO: 1362516 - DNA, 18 bp, Homo sapiens
tcactacaagtcagctcc

SEQ ID NO: 1362517 - DNA, 19 bp, Homo sapiens
tcactacaagtcagctcca

SEQ ID NO: 1362518 - DNA, 23 bp, Homo sapiens
tcactaggcccccacttgcctct

SEQ ID NO: 1362519 - DNA, 16 bp, Homo sapiens
tcactcacagagtcaa

SEQ ID NO: 1362520 - DNA, 22 bp, Homo sapiens
tcactcacagagtcaaggcctg

SEQ ID NO: 1362521 - DNA, 13 bp, Homo sapiens
tcactcattgctg

SEQ ID NO: 1362522 - DNA, 19 bp, Homo sapiens
tcactcattgctgagcctc

SEQ ID NO: 1362523 - DNA, 20 bp, Homo sapiens
tcactcattgctgagcctct

SEQ ID NO: 1362524 - DNA, 14 bp, Homo sapiens
tcactccagcctgg

SEQ ID NO: 1362525 - DNA, 16 bp, Homo sapiens
tcactctaagtcatgt

SEQ ID NO: 1362526 - DNA, 15 bp, Homo sapiens
tcactgccacactct

SEQ ID NO: 1362527 - DNA, 19 bp, Homo sapiens
tcactgccaggccagcctc

SEQ ID NO: 1362528 - DNA, 18 bp, Homo sapiens
tcactgccatgccagctt

SEQ ID NO: 1362529 - DNA, 18 bp, Homo sapiens
tcactgcgaagaccctct

SEQ ID NO: 1362530 - DNA, 17 bp, Homo sapiens
tcactggggcctacagc

SEQ ID NO: 1362531 - DNA, 12 bp, Homo sapiens
tcactgtgtata

SEQ ID NO: 1362532 - DNA, 17 bp, Homo sapiens
tcactgtgtatatttga

SEQ ID NO: 1362533 - DNA, 18 bp, Homo sapiens
tcactgtgtatatttgat

SEQ ID NO: 1362534 - DNA, 13 bp, Homo sapiens
tcactgtttagat

SEQ ID NO: 1362535 - DNA, 17 bp, Homo sapiens
tcactgtttagatttgc

SEQ ID NO: 1362536 - DNA, 15 bp, Homo sapiens
tcacttaaaacacgt

SEQ ID NO: 1362537 - DNA, 10 bp, Homo sapiens
tcacttgagt

SEQ ID NO: 1362538 - DNA, 13 bp, Homo sapiens
tcacttgtgtttt

SEQ ID NO: 1362539 - DNA, 14 bp, Homo sapiens
attgtttaaaatgt

SEQ ID NO: 1362540 - DNA, 15 bp, Homo sapiens
attgtttaaaatgta

SEQ ID NO: 1362541 - DNA, 16 bp, Homo sapiens
attgtttctctgaaag

SEQ ID NO: 1362542 - DNA, 19 bp, Homo sapiens
atttaaagaaaaaaatgtc

SEQ ID NO: 1362543 - DNA, 16 bp, Homo sapiens
atttaacagaaattgt

SEQ ID NO: 1362544 - DNA, 13 bp, Homo sapiens
atttaagggaaaa

SEQ ID NO: 1362545 - DNA, 16 bp, Homo sapiens
atttaagggaaagaaa

SEQ ID NO: 1362546 - DNA, 12 bp, Homo sapiens
atttaaggtatt

SEQ ID NO: 1362547 - DNA, 20 bp, Homo sapiens
atttaagttttgacaagctg

SEQ ID NO: 1362548 - DNA, 18 bp, Homo sapiens
atttacaagggaagattt

SEQ ID NO: 1362549 - DNA, 21 bp, Homo sapiens
atttacaagggaagatttatg

SEQ ID NO: 1362550 - DNA, 15 bp, Homo sapiens
atttacatttaatag

SEQ ID NO: 1362551 - DNA, 15 bp, Homo sapiens
atttactacagtagt

SEQ ID NO: 1362552 - DNA, 16 bp, Homo sapiens
atttactctaaaaact

SEQ ID NO: 1362553 - DNA, 20 bp, Homo sapiens
atttagggagtattctaata

SEQ ID NO: 1362554 - DNA, 23 bp, Homo sapiens
atttagtgtttttttatttctac

SEQ ID NO: 1362555 - DNA, 14 bp, Homo sapiens
atttataattccta

SEQ ID NO: 1362556 - DNA, 16 bp, Homo sapiens
atttatatttattgac

SEQ ID NO: 1362557 - DNA, 22 bp, Homo sapiens
atttatccagaaaactgtgatt

SEQ ID NO: 1362558 - DNA, 15 bp, Homo sapiens
atttatgggcccctg

SEQ ID NO: 1362559 - DNA, 13 bp, Homo sapiens
atttatgtttgca

SEQ ID NO: 1362560 - DNA, 19 bp, Homo sapiens
atttattatttatttatta

SEQ ID NO: 1362561 - DNA, 15 bp, Homo sapiens
atttatttaatattt

SEQ ID NO: 1362562 - DNA, 13 bp, Homo sapiens
atttatttacaga

SEQ ID NO: 1362563 - DNA, 13 bp, Homo sapiens
atttatttattat

SEQ ID NO: 1362564 - DNA, 22 bp, Homo sapiens
atttattttttttaattgtatt

SEQ ID NO: 1362565 - DNA, 22 bp, Homo sapiens
atctgatggccttaatttcctt

SEQ ID NO: 1362566 - DNA, 20 bp, Homo sapiens
atctgcaccccttctctcct

SEQ ID NO: 1362567 - DNA, 21 bp, Homo sapiens
atctgcaccccttctctcctc

SEQ ID NO: 1362568 - DNA, 17 bp, Homo sapiens
atctgccagacttaaaa

SEQ ID NO: 1362569 - DNA, 18 bp, Homo sapiens
atctgccccacagtctcc

SEQ ID NO: 1362570 - DNA, 14 bp, Homo sapiens
atctgtctggtggc

SEQ ID NO: 1362571 - DNA, 16 bp, Homo sapiens
atctgtctggtggccc

SEQ ID NO: 1362572 - DNA, 22 bp, Homo sapiens
atcttaatctgtttatttacaa

SEQ ID NO: 1362573 - DNA, 14 bp, Homo sapiens
atcttactttgtaa

SEQ ID NO: 1362574 - DNA, 16 bp, Homo sapiens
atcttactttgtaaat

SEQ ID NO: 1362575 - DNA, 17 bp, Homo sapiens
atcttactttgtaaatt

SEQ ID NO: 1362576 - DNA, 15 bp, Homo sapiens
atcttatatgggaaa

SEQ ID NO: 1362577 - DNA, 18 bp, Homo sapiens
atcttcaaagccttctcc

SEQ ID NO: 1362578 - DNA, 14 bp, Homo sapiens
atcttcccatgcat

SEQ ID NO: 1362579 - DNA, 20 bp, Homo sapiens
atcttgatacattcaaattt

SEQ ID NO: 1362580 - DNA, 14 bp, Homo sapiens
atcttgcctccagg

SEQ ID NO: 1362581 - DNA, 15 bp, Homo sapiens
atcttgcctccaggt

SEQ ID NO: 1362582 - DNA, 17 bp, Homo sapiens
atcttgctactaccgtt

SEQ ID NO: 1362583 - DNA, 15 bp, Homo sapiens
atcttgtttctgaaa

SEQ ID NO: 1362584 - DNA, 16 bp, Homo sapiens
atctttgatgtgttgt

SEQ ID NO: 1362585 - DNA, 17 bp, Homo sapiens
atctttgatgtgttgtt

SEQ ID NO: 1362586 - DNA, 19 bp, Homo sapiens
atgaaaaatagtgtctttg

SEQ ID NO: 1362587 - DNA, 20 bp, Homo sapiens
atgaaaaatagtgtctttgt

SEQ ID NO: 1362588 - DNA, 18 bp, Homo sapiens
atgaaaacagtgtgtaaa

SEQ ID NO: 1362589 - DNA, 17 bp, Homo sapiens
atgaaaacatggaacag

SEQ ID NO: 1362590 - DNA, 17 bp, Homo sapiens
atgaaaagattcttctg

SEQ ID NO: 1362591 - DNA, 24 bp, Homo sapiens
atgaaaataccatttagtaagaat

SEQ ID NO: 1362592 - DNA, 12 bp, Homo sapiens
atgaaaatggaa

SEQ ID NO: 1362593 - DNA, 21 bp, Homo sapiens
atgaaactaaagcaatagaaa

SEQ ID NO: 1362594 - DNA, 16 bp, Homo sapiens
atgaaagctgttcctt

SEQ ID NO: 1362595 - DNA, 18 bp, Homo sapiens
atgaaagctgttccttgg

SEQ ID NO: 1362596 - DNA, 15 bp, Homo sapiens
atgaaaggagagcat

SEQ ID NO: 1362597 - DNA, 21 bp, Homo sapiens
atgaaaggcaggcctatttca

SEQ ID NO: 1362598 - DNA, 12 bp, Homo sapiens
atgaaatgtgaa

SEQ ID NO: 1362599 - DNA, 23 bp, Homo sapiens
atgaaatgtgaatttttattgtt

SEQ ID NO: 1362600 - DNA, 14 bp, Homo sapiens
atgaacactcccca

SEQ ID NO: 1362601 - DNA, 16 bp, Homo sapiens
atgaagaatttaaaga

SEQ ID NO: 1362602 - DNA, 20 bp, Homo sapiens
atgaagcctccttagaaaaa

SEQ ID NO: 1362603 - DNA, 14 bp, Homo sapiens
atgaagctacctca

SEQ ID NO: 1362604 - DNA, 17 bp, Homo sapiens
atgaatatctattaata

SEQ ID NO: 1362605 - DNA, 22 bp, Homo sapiens
atgaatatctattaatatatgt

SEQ ID NO: 1362606 - DNA, 21 bp, Homo sapiens
atgaatcaaaagtgcctcaag

SEQ ID NO: 1362607 - DNA, 21 bp, Homo sapiens
atgaatgggctgagctgcctg

SEQ ID NO: 1362608 - DNA, 17 bp, Homo sapiens
atgaattttaaaatctg

SEQ ID NO: 1362609 - DNA, 14 bp, Homo sapiens
atgacaaaaaatgt

SEQ ID NO: 1362610 - DNA, 17 bp, Homo sapiens
atgacaaaaaatgtttt

SEQ ID NO: 1362611 - DNA, 18 bp, Homo sapiens
cagtaacccccttaaatt

SEQ ID NO: 1362612 - DNA, 20 bp, Homo sapiens
cagtaagatatctcaatgaa

SEQ ID NO: 1362613 - DNA, 14 bp, Homo sapiens
cagtaagtcttttt

SEQ ID NO: 1362614 - DNA, 14 bp, Homo sapiens
cagtacccaccacc

SEQ ID NO: 1362615 - DNA, 15 bp, Homo sapiens
cagtagaactgtctg

SEQ ID NO: 1362616 - DNA, 20 bp, Homo sapiens
cagtagaccttgttacttct

SEQ ID NO: 1362617 - DNA, 15 bp, Homo sapiens
cagtagagccagctt

SEQ ID NO: 1362618 - DNA, 17 bp, Homo sapiens
cagtaggactccttatt

SEQ ID NO: 1362619 - DNA, 22 bp, Homo sapiens
cagtaggtgcccagaataagtt

SEQ ID NO: 1362620 - DNA, 12 bp, Homo sapiens
cagtatcccaca

SEQ ID NO: 1362621 - DNA, 13 bp, Homo sapiens
cagtatcccacat

SEQ ID NO: 1362622 - DNA, 14 bp, Homo sapiens
cagtatcccacatc

SEQ ID NO: 1362623 - DNA, 15 bp, Homo sapiens
cagtatctcagggcc

SEQ ID NO: 1362624 - DNA, 19 bp, Homo sapiens
cagtatgtgggatattgaa

SEQ ID NO: 1362625 - DNA, 23 bp, Homo sapiens
cagtcactggaggttgaagccaa

SEQ ID NO: 1362626 - DNA, 23 bp, Homo sapiens
cagtcattatgagaggcaatgat

SEQ ID NO: 1362627 - DNA, 12 bp, Homo sapiens
cagtccccaccc

SEQ ID NO: 1362628 - DNA, 13 bp, Homo sapiens
cagtccccacccc

SEQ ID NO: 1362629 - DNA, 16 bp, Homo sapiens
cagtccccacccctgc

SEQ ID NO: 1362630 - DNA, 17 bp, Homo sapiens
cagtccccacccctgcc

SEQ ID NO: 1362631 - DNA, 18 bp, Homo sapiens
cagtccccacccctgccc

SEQ ID NO: 1362632 - DNA, 19 bp, Homo sapiens
cagtccccacccctgcccc

SEQ ID NO: 1362633 - DNA, 21 bp, Homo sapiens
cagtctccggcctctccagcc

SEQ ID NO: 1362634 - DNA, 22 bp, Homo sapiens
cagtcttagatcatagttttat

SEQ ID NO: 1362635 - DNA, 18 bp, Homo sapiens
cagtgacctctctctctg

SEQ ID NO: 1362636 - DNA, 13 bp, Homo sapiens
cagtgcaaatgca

SEQ ID NO: 1362637 - DNA, 15 bp, Homo sapiens
cagtgcagaatgtaa

SEQ ID NO: 1362638 - DNA, 16 bp, Homo sapiens
cagtgcagagccttct

SEQ ID NO: 1362639 - DNA, 14 bp, Homo sapiens
cagtgcagatggag

SEQ ID NO: 1362640 - DNA, 14 bp, Homo sapiens
cagtgcatggtggc

SEQ ID NO: 1362641 - DNA, 14 bp, Homo sapiens
cagtgccctccagc

SEQ ID NO: 1362642 - DNA, 16 bp, Homo sapiens
cagtgccctccagccc

SEQ ID NO: 1362643 - DNA, 18 bp, Homo sapiens
cagtgccctccagccccg

SEQ ID NO: 1362644 - DNA, 18 bp, Homo sapiens
cagtgccgagaaggaagc

SEQ ID NO: 1362645 - DNA, 16 bp, Homo sapiens
cagtgctttaatggca

SEQ ID NO: 1362646 - DNA, 23 bp, Homo sapiens
cagtggaatataaggaaagcaat

SEQ ID NO: 1362647 - DNA, 20 bp, Homo sapiens
cagtggttttatactgaagg

SEQ ID NO: 1362648 - DNA, 14 bp, Homo sapiens
cagtgtatgtagaa

SEQ ID NO: 1362649 - DNA, 17 bp, Homo sapiens
cagtgtgggcttgacca

SEQ ID NO: 1362650 - DNA, 13 bp, Homo sapiens
cagtgtgtaaaca

SEQ ID NO: 1362651 - DNA, 16 bp, Homo sapiens
cagtgttggtatattt

SEQ ID NO: 1362652 - DNA, 16 bp, Homo sapiens
cagttcctcccaggaa

SEQ ID NO: 1362653 - DNA, 18 bp, Homo sapiens
cagttgaaaaacagctga

SEQ ID NO: 1362654 - DNA, 19 bp, Homo sapiens
cagttgaaaaacagctgag

SEQ ID NO: 1362655 - DNA, 20 bp, Homo sapiens
cagttgcagcccttgtgatg

SEQ ID NO: 1362656 - DNA, 14 bp, Homo sapiens
cagttgctggtaaa

SEQ ID NO: 1362657 - DNA, 18 bp, Homo sapiens
cagttgtatttaacagaa

SEQ ID NO: 1362658 - DNA, 14 bp, Homo sapiens
cagtttatcattca

SEQ ID NO: 1362659 - DNA, 15 bp, Homo sapiens
cagtttatcattcaa

SEQ ID NO: 1362660 - DNA, 18 bp, Homo sapiens
cagtttatcattcaagtg

SEQ ID NO: 1362661 - DNA, 16 bp, Homo sapiens
cagtttgtcttggata

SEQ ID NO: 1362662 - DNA, 13 bp, Homo sapiens
cagttttcagaaa

SEQ ID NO: 1362663 - DNA, 20 bp, Homo sapiens
cagttttgacctaacatacc

SEQ ID NO: 1362664 - DNA, 14 bp, Homo sapiens
cataaagtaaatac

SEQ ID NO: 1362665 - DNA, 22 bp, Homo sapiens
cataaagtaaatacatgcatat

SEQ ID NO: 1362666 - DNA, 16 bp, Homo sapiens
cataaattcaactttg

SEQ ID NO: 1362667 - DNA, 14 bp, Homo sapiens
cataacatccagag

SEQ ID NO: 1362668 - DNA, 17 bp, Homo sapiens
cataagcttccatttta

SEQ ID NO: 1362669 - DNA, 15 bp, Homo sapiens
cataatactgaacca

SEQ ID NO: 1362670 - DNA, 13 bp, Homo sapiens
cataatttaaaaa

SEQ ID NO: 1362671 - DNA, 19 bp, Homo sapiens
catacaaatgcatctttga

SEQ ID NO: 1362672 - DNA, 20 bp, Homo sapiens
catacaaatgcatctttgat

SEQ ID NO: 1362673 - DNA, 22 bp, Homo sapiens
catacttacctagtgaaacttt

SEQ ID NO: 1362674 - DNA, 22 bp, Homo sapiens
catactttgtaaataggatttt

SEQ ID NO: 1362675 - DNA, 20 bp, Homo sapiens
catagaggcttctccgccag

SEQ ID NO: 1362676 - DNA, 17 bp, Homo sapiens
catagagtacactgcct

SEQ ID NO: 1362677 - DNA, 19 bp, Homo sapiens
catagagtacactgcctgc

SEQ ID NO: 1362678 - DNA, 16 bp, Homo sapiens
catagccaaaatgtga

SEQ ID NO: 1362679 - DNA, 20 bp, Homo sapiens
cataggcaccttttactgtg

SEQ ID NO: 1362680 - DNA, 14 bp, Homo sapiens
catagtaagattga

SEQ ID NO: 1362681 - DNA, 19 bp, Homo sapiens
catagtatccatattttat

SEQ ID NO: 1362682 - DNA, 13 bp, Homo sapiens
catagttactgtg

SEQ ID NO: 1362683 - DNA, 16 bp, Homo sapiens
catagttactgtgtaa

SEQ ID NO: 1362684 - DNA, 19 bp, Homo sapiens
catagttactgtgtaaact

SEQ ID NO: 1362685 - DNA, 20 bp, Homo sapiens
catagttctgagctgccagt

SEQ ID NO: 1362686 - DNA, 15 bp, Homo sapiens
catagtttctttatt

SEQ ID NO: 1362687 - DNA, 23 bp, Homo sapiens
catagtttctttattttgtgtaa

SEQ ID NO: 1362688 - DNA, 15 bp, Homo sapiens
catagttttatttat

SEQ ID NO: 1362689 - DNA, 20 bp, Homo sapiens
catataagacaaatattcct

SEQ ID NO: 1362690 - DNA, 16 bp, Homo sapiens
catataatgaataaat

SEQ ID NO: 1362691 - DNA, 11 bp, Homo sapiens
catatatatat

SEQ ID NO: 1362692 - DNA, 14 bp, Homo sapiens
catatcccttccag

SEQ ID NO: 1362693 - DNA, 15 bp, Homo sapiens
catatggatgttact

SEQ ID NO: 1362694 - DNA, 18 bp, Homo sapiens
catatgggttagatgttg

SEQ ID NO: 1362695 - DNA, 22 bp, Homo sapiens
catattataaaggataaagaag

SEQ ID NO: 1362696 - DNA, 16 bp, Homo sapiens
catatttgaagggtct

SEQ ID NO: 1362697 - DNA, 21 bp, Homo sapiens
catcaaaatatttcagtgaat

SEQ ID NO: 1362698 - DNA, 17 bp, Homo sapiens
catcaaacctttgagta

SEQ ID NO: 1362699 - DNA, 19 bp, Homo sapiens
catcaatcaaataagtatt

SEQ ID NO: 1362700 - DNA, 21 bp, Homo sapiens
catcaatcctgattcctctct

SEQ ID NO: 1362701 - DNA, 12 bp, Homo sapiens
catcactgtatc

SEQ ID NO: 1362702 - DNA, 13 bp, Homo sapiens
catcacttaaaac

SEQ ID NO: 1362703 - DNA, 15 bp, Homo sapiens
catcacttaaaacac

SEQ ID NO: 1362704 - DNA, 15 bp, Homo sapiens
catcagaaagcttta

SEQ ID NO: 1362705 - DNA, 16 bp, Homo sapiens
catctgcaccccttct

SEQ ID NO: 1362706 - DNA, 19 bp, Homo sapiens
catctgctggtccgtggga

SEQ ID NO: 1362707 - DNA, 21 bp, Homo sapiens
catcttaggttggcaaaaagg

SEQ ID NO: 1362708 - DNA, 13 bp, Homo sapiens
catcttgaatcct

SEQ ID NO: 1362709 - DNA, 16 bp, Homo sapiens
catcttgcctccaggt

SEQ ID NO: 1362710 - DNA, 14 bp, Homo sapiens
catcttgcttccct

SEQ ID NO: 1362711 - DNA, 13 bp, Homo sapiens
catctttgatgtg

SEQ ID NO: 1362712 - DNA, 15 bp, Homo sapiens
catctttgatgtgtt

SEQ ID NO: 1362713 - DNA, 14 bp, Homo sapiens
catgaaataaaata

SEQ ID NO: 1362714 - DNA, 18 bp, Homo sapiens
catgaaataaaatatatc

SEQ ID NO: 1362715 - DNA, 16 bp, Homo sapiens
catgaaatgtgaattt

SEQ ID NO: 1362716 - DNA, 15 bp, Homo sapiens
catgaagaatagaaa

SEQ ID NO: 1362717 - DNA, 17 bp, Homo sapiens
catgaatctttgtttca

SEQ ID NO: 1362718 - DNA, 17 bp, Homo sapiens
catgactcgggggtggg

SEQ ID NO: 1362719 - DNA, 18 bp, Homo sapiens
catgagactcagtgcaga

SEQ ID NO: 1362720 - DNA, 12 bp, Homo sapiens
catgaggagggt

SEQ ID NO: 1362721 - DNA, 13 bp, Homo sapiens
catgaggagggtg

SEQ ID NO: 1362722 - DNA, 22 bp, Homo sapiens
catgcaaatgagctctgaaatc

SEQ ID NO: 1362723 - DNA, 14 bp, Homo sapiens
catgcaagcagagg

SEQ ID NO: 1362724 - DNA, 18 bp, Homo sapiens
catgcaataaaatttaaa

SEQ ID NO: 1362725 - DNA, 12 bp, Homo sapiens
catgcatataat

SEQ ID NO: 1362726 - DNA, 14 bp, Homo sapiens
catgcatataatga

SEQ ID NO: 1362727 - DNA, 22 bp, Homo sapiens
catgcatataatgaataaatca

SEQ ID NO: 1362728 - DNA, 14 bp, Homo sapiens
catgcatgcaaatg

SEQ ID NO: 1362729 - DNA, 19 bp, Homo sapiens
catgcatgcaaatgagctc

SEQ ID NO: 1362730 - DNA, 13 bp, Homo sapiens
catgcccaccccc

SEQ ID NO: 1362731 - DNA, 16 bp, Homo sapiens
catgcccaccccctgc

SEQ ID NO: 1362732 - DNA, 17 bp, Homo sapiens
catgcccaccccctgcc

SEQ ID NO: 1362733 - DNA, 20 bp, Homo sapiens
catgcccaccccctgccctg

SEQ ID NO: 1362734 - DNA, 21 bp, Homo sapiens
catgcccaccccctgccctgc

SEQ ID NO: 1362735 - DNA, 14 bp, Homo sapiens
catgccctctcagg

SEQ ID NO: 1362736 - DNA, 18 bp, Homo sapiens
catgcctcactaattttt

SEQ ID NO: 1362737 - DNA, 23 bp, Homo sapiens
catgcgccccctccgccctgcca

SEQ ID NO: 1362738 - DNA, 14 bp, Homo sapiens
catgcgctcagggc

SEQ ID NO: 1362739 - DNA, 15 bp, Homo sapiens
catgcgctcagggcc

SEQ ID NO: 1362740 - DNA, 23 bp, Homo sapiens
catgcgctcagggccatgctgag

SEQ ID NO: 1362741 - DNA, 13 bp, Homo sapiens
catgcggtcgggc

SEQ ID NO: 1362742 - DNA, 14 bp, Homo sapiens
catgctcctggccc

SEQ ID NO: 1362743 - DNA, 20 bp, Homo sapiens
catgctcctggcccactgca

SEQ ID NO: 1362744 - DNA, 15 bp, Homo sapiens
catggaaatcagcca

SEQ ID NO: 1362745 - DNA, 17 bp, Homo sapiens
catggcatccctttttc

SEQ ID NO: 1362746 - DNA, 23 bp, Homo sapiens
catggcatccctttttcataaat

SEQ ID NO: 1362747 - DNA, 12 bp, Homo sapiens
catggccctggg

SEQ ID NO: 1362748 - DNA, 16 bp, Homo sapiens
catggctcagggtggt

SEQ ID NO: 1362749 - DNA, 17 bp, Homo sapiens
catggctccggcctctg

SEQ ID NO: 1362750 - DNA, 15 bp, Homo sapiens
catggctgctgttgc

SEQ ID NO: 1362751 - DNA, 12 bp, Homo sapiens
catggctgtgtt

SEQ ID NO: 1362752 - DNA, 22 bp, Homo sapiens
catgggagggggcttgaagcca

SEQ ID NO: 1362753 - DNA, 23 bp, Homo sapiens
catggggagggattctggttcca

SEQ ID NO: 1362754 - DNA, 13 bp, Homo sapiens
catggtgcctgag

SEQ ID NO: 1362755 - DNA, 14 bp, Homo sapiens
catggtgcctgaga

SEQ ID NO: 1362756 - DNA, 15 bp, Homo sapiens
catggtgcctgagag

SEQ ID NO: 1362757 - DNA, 17 bp, Homo sapiens
catggtgcctgagaggc

SEQ ID NO: 1362758 - DNA, 17 bp, Homo sapiens
catgtaaaacagaaaaa

SEQ ID NO: 1362759 - DNA, 15 bp, Homo sapiens
catgtaaatgtaaac

SEQ ID NO: 1362760 - DNA, 16 bp, Homo sapiens
catgtaaatgtaaact

SEQ ID NO: 1362761 - DNA, 18 bp, Homo sapiens
catgtaaatgtaaactca

SEQ ID NO: 1362762 - DNA, 16 bp, Homo sapiens
catgtaaattttgtat

SEQ ID NO: 1362763 - DNA, 21 bp, Homo sapiens
catgtaatggtatcttaaagt

SEQ ID NO: 1362764 - DNA, 15 bp, Homo sapiens
catgtagcagtgagt

SEQ ID NO: 1362765 - DNA, 17 bp, Homo sapiens
catgtagccccctggcc

SEQ ID NO: 1362766 - DNA, 20 bp, Homo sapiens
catgtagccccctggcctct

SEQ ID NO: 1362767 - DNA, 21 bp, Homo sapiens
catgtagccccctggcctctg

SEQ ID NO: 1362768 - DNA, 13 bp, Homo sapiens
catgtcaaacatg

SEQ ID NO: 1362769 - DNA, 14 bp, Homo sapiens
catgtccaaagagg

SEQ ID NO: 1362770 - DNA, 21 bp, Homo sapiens
catgtccaaagaggctgcccc

SEQ ID NO: 1362771 - DNA, 18 bp, Homo sapiens
catgtgagctcttcctat

SEQ ID NO: 1362772 - DNA, 20 bp, Homo sapiens
catgtgatggacactccagg

SEQ ID NO: 1362773 - DNA, 15 bp, Homo sapiens
catgtgcatagtttc

SEQ ID NO: 1362774 - DNA, 18 bp, Homo sapiens
catgtgtgcaacagggta

SEQ ID NO: 1362775 - DNA, 12 bp, Homo sapiens
catgttatgttt

SEQ ID NO: 1362776 - DNA, 13 bp, Homo sapiens
catgttatgttta

SEQ ID NO: 1362777 - DNA, 19 bp, Homo sapiens
catgttgggaaacttggct

SEQ ID NO: 1362778 - DNA, 21 bp, Homo sapiens
catgttgggaaacttggctcg

SEQ ID NO: 1362779 - DNA, 13 bp, Homo sapiens
catgtttataaat

SEQ ID NO: 1362780 - DNA, 18 bp, Homo sapiens
catgtttgcctagacagc

SEQ ID NO: 1362781 - DNA, 13 bp, Homo sapiens
cattaacaaataa

SEQ ID NO: 1362782 - DNA, 16 bp, Homo sapiens
cattaacaaataaaaa

SEQ ID NO: 1362783 - DNA, 21 bp, Homo sapiens
cattaaggggaagaatgaaag

SEQ ID NO: 1362784 - DNA, 23 bp, Homo sapiens
cattaaggggaagaatgaaagct

SEQ ID NO: 1362785 - DNA, 18 bp, Homo sapiens
cattagccagatttgtct

SEQ ID NO: 1362786 - DNA, 16 bp, Homo sapiens
cattatgagaggcaat

SEQ ID NO: 1362787 - DNA, 16 bp, Homo sapiens
cattatgccacttcct

SEQ ID NO: 1362788 - DNA, 24 bp, Homo sapiens
cattattctctgctatatataaaa

SEQ ID NO: 1362789 - DNA, 14 bp, Homo sapiens
cattcagaaatgtt

SEQ ID NO: 1362790 - DNA, 19 bp, Homo sapiens
cattcagcagcaaattttc

SEQ ID NO: 1362791 - DNA, 21 bp, Homo sapiens
cattcgttgtgttttttaaga

SEQ ID NO: 1362792 - DNA, 21 bp, Homo sapiens
cattctgactcggtttctcca

SEQ ID NO: 1362793 - DNA, 23 bp, Homo sapiens
cattctgactcggtttctccaaa

SEQ ID NO: 1362794 - DNA, 23 bp, Homo sapiens
cattctgccgccccctcctgaac

SEQ ID NO: 1362795 - DNA, 22 bp, Homo sapiens
cattcttactaaaaagtataaa

SEQ ID NO: 1362796 - DNA, 15 bp, Homo sapiens
cattgagtattgttt

SEQ ID NO: 1362797 - DNA, 16 bp, Homo sapiens
cattgctgagcctctg

SEQ ID NO: 1362798 - DNA, 17 bp, Homo sapiens
cattgctgagcctctgc

SEQ ID NO: 1362799 - DNA, 18 bp, Homo sapiens
cattgctgagcctctgct

SEQ ID NO: 1362800 - DNA, 21 bp, Homo sapiens
cattgctgttgtccaactatt

SEQ ID NO: 1362801 - DNA, 22 bp, Homo sapiens
cattgctgttgtccaactattt

SEQ ID NO: 1362802 - DNA, 17 bp, Homo sapiens
catttaagggaaaaata

SEQ ID NO: 1362803 - DNA, 17 bp, Homo sapiens
catttagggagtattct

SEQ ID NO: 1362804 - DNA, 21 bp, Homo sapiens
catttattttttttaaagaaa

SEQ ID NO: 1362805 - DNA, 15 bp, Homo sapiens
catttcatctcattt

SEQ ID NO: 1362806 - DNA, 17 bp, Homo sapiens
catttcccatctgcacc

SEQ ID NO: 1362807 - DNA, 18 bp, Homo sapiens
catttcctcgcagcctct

SEQ ID NO: 1362808 - DNA, 16 bp, Homo sapiens
catttgatgcatgtct

SEQ ID NO: 1362809 - DNA, 17 bp, Homo sapiens
catttgatgcatgtctt

SEQ ID NO: 1362810 - DNA, 19 bp, Homo sapiens
catttgatgcatgtctttt

SEQ ID NO: 1362811 - DNA, 17 bp, Homo sapiens
catttgccaattttcct

SEQ ID NO: 1362812 - DNA, 15 bp, Homo sapiens
catttgctactgttg

SEQ ID NO: 1362813 - DNA, 19 bp, Homo sapiens
catttgctcttcagatgcc

SEQ ID NO: 1362814 - DNA, 13 bp, Homo sapiens
catttgctgaata

SEQ ID NO: 1362815 - DNA, 17 bp, Homo sapiens
catttggggtaatactt

SEQ ID NO: 1362816 - DNA, 15 bp, Homo sapiens
catttgtgccagagg

SEQ ID NO: 1362817 - DNA, 16 bp, Homo sapiens
catttgtgccagagga

SEQ ID NO: 1362818 - DNA, 15 bp, Homo sapiens
cattttaattttaaa

SEQ ID NO: 1362819 - DNA, 14 bp, Homo sapiens
cattttcattccta

SEQ ID NO: 1362820 - DNA, 20 bp, Homo sapiens
cattttgaaattgttccttg

SEQ ID NO: 1362821 - DNA, 18 bp, Homo sapiens
cattttgctaaatgtgaa

SEQ ID NO: 1362822 - DNA, 14 bp, Homo sapiens
catttttttgcatg

SEQ ID NO: 1362823 - DNA, 12 bp, Homo sapiens
ccaaaaaactac

SEQ ID NO: 1362824 - DNA, 13 bp, Homo sapiens
ccaaagaggctgc

SEQ ID NO: 1362825 - DNA, 19 bp, Homo sapiens
ccaaagatagacaggtcct

SEQ ID NO: 1362826 - DNA, 17 bp, Homo sapiens
ccactttgctgttcctt

SEQ ID NO: 1362827 - DNA, 22 bp, Homo sapiens
ccactttgtttcgtggggaggt

SEQ ID NO: 1362828 - DNA, 18 bp, Homo sapiens
ccagaaatggtgagatgt

SEQ ID NO: 1362829 - DNA, 19 bp, Homo sapiens
ccagaactcactggggcct

SEQ ID NO: 1362830 - DNA, 22 bp, Homo sapiens
ccagaataagttattgcagttt

SEQ ID NO: 1362831 - DNA, 23 bp, Homo sapiens
ccagaataagttattgcagttta

SEQ ID NO: 1362832 - DNA, 19 bp, Homo sapiens
ccagaggaatcctggcagc

SEQ ID NO: 1362833 - DNA, 16 bp, Homo sapiens
ccagaggagccttttt

SEQ ID NO: 1362834 - DNA, 14 bp, Homo sapiens
ccagaggcccccag

SEQ ID NO: 1362835 - DNA, 15 bp, Homo sapiens
ccagaggcccccagc

SEQ ID NO: 1362836 - DNA, 18 bp, Homo sapiens
ccagaggcccccagccca

SEQ ID NO: 1362837 - DNA, 21 bp, Homo sapiens
ccagaggcccccagcccaggg

SEQ ID NO: 1362838 - DNA, 22 bp, Homo sapiens
ccagaggcccccagcccagggc

SEQ ID NO: 1362839 - DNA, 16 bp, Homo sapiens
ccagaggctgggttca

SEQ ID NO: 1362840 - DNA, 18 bp, Homo sapiens
ccagagtgctgaaggaat

SEQ ID NO: 1362841 - DNA, 18 bp, Homo sapiens
ccagatcactgccacact

SEQ ID NO: 1362842 - DNA, 13 bp, Homo sapiens
ccagatgtggcta

SEQ ID NO: 1362843 - DNA, 15 bp, Homo sapiens
ccagattaaacttca

SEQ ID NO: 1362844 - DNA, 15 bp, Homo sapiens
ccagcaccttgtgcc

SEQ ID NO: 1362845 - DNA, 18 bp, Homo sapiens
ccagcaccttgtgcctgg

SEQ ID NO: 1362846 - DNA, 20 bp, Homo sapiens
ccagcaccttgtgcctgggg

SEQ ID NO: 1362847 - DNA, 14 bp, Homo sapiens
ccagcagcagcagg

SEQ ID NO: 1362848 - DNA, 14 bp, Homo sapiens
ccagcagcctggac

SEQ ID NO: 1362849 - DNA, 14 bp, Homo sapiens
ccagcatcacctgc

SEQ ID NO: 1362850 - DNA, 15 bp, Homo sapiens
ccagcatcacctgcc

SEQ ID NO: 1362851 - DNA, 17 bp, Homo sapiens
ccagcatcacctgcctg

SEQ ID NO: 1362852 - DNA, 18 bp, Homo sapiens
ccagcatcacctgcctgt

SEQ ID NO: 1362853 - DNA, 16 bp, Homo sapiens
ccagcattccagcccc

SEQ ID NO: 1362854 - DNA, 22 bp, Homo sapiens
ccagcattccagcccctctggt

SEQ ID NO: 1362855 - DNA, 16 bp, Homo sapiens
ccagcatttagctggc

SEQ ID NO: 1362856 - DNA, 18 bp, Homo sapiens
ccagcatttagctggcca

SEQ ID NO: 1362857 - DNA, 14 bp, Homo sapiens
ccagccagcgcctc

SEQ ID NO: 1362858 - DNA, 15 bp, Homo sapiens
ccagccagcgcctcc

SEQ ID NO: 1362859 - DNA, 16 bp, Homo sapiens
ccagccagcgcctccc

SEQ ID NO: 1362860 - DNA, 22 bp, Homo sapiens
ccaggtgcagaggtaccctggg

SEQ ID NO: 1362861 - DNA, 22 bp, Homo sapiens
ccaggttctccgttagctcctg

SEQ ID NO: 1362862 - DNA, 24 bp, Homo sapiens
ccaggttctccgttagctcctgtg

SEQ ID NO: 1362863 - DNA, 13 bp, Homo sapiens
ccaggtttaagct

SEQ ID NO: 1362864 - DNA, 12 bp, Homo sapiens
ccagtaagatca

SEQ ID NO: 1362865 - DNA, 14 bp, Homo sapiens
ccagtaagatcact

SEQ ID NO: 1362866 - DNA, 15 bp, Homo sapiens
ccagtaagatcactg

SEQ ID NO: 1362867 - DNA, 17 bp, Homo sapiens
ccagtccaccctgcctg

SEQ ID NO: 1362868 - DNA, 19 bp, Homo sapiens
ccagtccaggctgccgtgg

SEQ ID NO: 1362869 - DNA, 18 bp, Homo sapiens
ccagtccccacccctgcc

SEQ ID NO: 1362870 - DNA, 13 bp, Homo sapiens
ccagtgacctctc

SEQ ID NO: 1362871 - DNA, 15 bp, Homo sapiens
ccagtgcagaatgta

SEQ ID NO: 1362872 - DNA, 16 bp, Homo sapiens
ccagtgcagaatgtaa

SEQ ID NO: 1362873 - DNA, 21 bp, Homo sapiens
ccagtgtctataaaagaaaca

SEQ ID NO: 1362874 - DNA, 13 bp, Homo sapiens
ccagtgtgggctt

SEQ ID NO: 1362875 - DNA, 18 bp, Homo sapiens
ccagtgtgggcttgacca

SEQ ID NO: 1362876 - DNA, 20 bp, Homo sapiens
ccagtgtgggcttgaccagg

SEQ ID NO: 1362877 - DNA, 20 bp, Homo sapiens
ccatacactttgttgcaaga

SEQ ID NO: 1362878 - DNA, 14 bp, Homo sapiens
ccatagtccctgcc

SEQ ID NO: 1362879 - DNA, 20 bp, Homo sapiens
ccatattttattactgttta

SEQ ID NO: 1362880 - DNA, 20 bp, Homo sapiens
ccatcagggttctcttagca

SEQ ID NO: 1362881 - DNA, 22 bp, Homo sapiens
ccatcccctgtagagtgggagc

SEQ ID NO: 1362882 - DNA, 12 bp, Homo sapiens
ccatcctggcta

SEQ ID NO: 1362883 - DNA, 17 bp, Homo sapiens
ccatcctgtattcttca

SEQ ID NO: 1362884 - DNA, 21 bp, Homo sapiens
ccatctagactagcaatctct

SEQ ID NO: 1362885 - DNA, 14 bp, Homo sapiens
ccatctcccctcag

SEQ ID NO: 1362886 - DNA, 17 bp, Homo sapiens
ccatctccctgcctggc

SEQ ID NO: 1362887 - DNA, 12 bp, Homo sapiens
ccatctgcaccc

SEQ ID NO: 1362888 - DNA, 20 bp, Homo sapiens
ccatcttgcttccctaatct

SEQ ID NO: 1362889 - DNA, 15 bp, Homo sapiens
ccatgccagctggcc

SEQ ID NO: 1362890 - DNA, 22 bp, Homo sapiens
ccatgcgccccctccgccctgc

SEQ ID NO: 1362891 - DNA, 22 bp, Homo sapiens
ccatgcgctcagggccatgctg

SEQ ID NO: 1362892 - DNA, 20 bp, Homo sapiens
ccatgctcatctgctggtcc

SEQ ID NO: 1362893 - DNA, 15 bp, Homo sapiens
ccatgctgaggcctg

SEQ ID NO: 1362894 - DNA, 16 bp, Homo sapiens
ccatgctgaggcctgg

SEQ ID NO: 1362895 - DNA, 22 bp, Homo sapiens
ccatggagccagctccctctat

SEQ ID NO: 1362896 - DNA, 16 bp, Homo sapiens
ccatggctcagggtgg

SEQ ID NO: 1362897 - DNA, 20 bp, Homo sapiens
ccatggggagggattctggt

SEQ ID NO: 1362898 - DNA, 20 bp, Homo sapiens
ccatggtgatggtgtagccc

SEQ ID NO: 1362899 - DNA, 14 bp, Homo sapiens
ccgttagctcctgt

SEQ ID NO: 1362900 - DNA, 15 bp, Homo sapiens
ccgttagctcctgtg

SEQ ID NO: 1362901 - DNA, 21 bp, Homo sapiens
ccgttccaccccaagagaact

SEQ ID NO: 1362902 - DNA, 14 bp, Homo sapiens
ccgttgctgactta

SEQ ID NO: 1362903 - DNA, 17 bp, Homo sapiens
ccgttgctgacttagaa

SEQ ID NO: 1362904 - DNA, 23 bp, Homo sapiens
cctaaaataacagtatgtgggat

SEQ ID NO: 1362905 - DNA, 13 bp, Homo sapiens
cctaaacctcagt

SEQ ID NO: 1362906 - DNA, 21 bp, Homo sapiens
cctaagatctcggtttgccaa

SEQ ID NO: 1362907 - DNA, 15 bp, Homo sapiens
cctaatggtgatgca

SEQ ID NO: 1362908 - DNA, 18 bp, Homo sapiens
cctaatttctcctccctt

SEQ ID NO: 1362909 - DNA, 20 bp, Homo sapiens
cctacagctttgatccctga

SEQ ID NO: 1362910 - DNA, 17 bp, Homo sapiens
cctacatatcccttcca

SEQ ID NO: 1362911 - DNA, 16 bp, Homo sapiens
cctaccgacccagggt

SEQ ID NO: 1362912 - DNA, 16 bp, Homo sapiens
cctactagtcaccaga

SEQ ID NO: 1362913 - DNA, 13 bp, Homo sapiens
cctactccctgca

SEQ ID NO: 1362914 - DNA, 15 bp, Homo sapiens
cctactccctgcaga

SEQ ID NO: 1362915 - DNA, 20 bp, Homo sapiens
cctactccctgcagatgcca

SEQ ID NO: 1362916 - DNA, 18 bp, Homo sapiens
cctactcggctctgcagt

SEQ ID NO: 1362917 - DNA, 21 bp, Homo sapiens
cctactctccttgagtgtatg

SEQ ID NO: 1362918 - DNA, 21 bp, Homo sapiens
cctagactcggggtgcttcct

SEQ ID NO: 1362919 - DNA, 17 bp, Homo sapiens
cctagcagcccaccctg

SEQ ID NO: 1362920 - DNA, 22 bp, Homo sapiens
cctagccggttcctgtccctgc

SEQ ID NO: 1362921 - DNA, 23 bp, Homo sapiens
cctagccggttcctgtccctgcg

SEQ ID NO: 1362922 - DNA, 19 bp, Homo sapiens
cctagcgatctctcctggc

SEQ ID NO: 1362923 - DNA, 21 bp, Homo sapiens
cctagcgatctctcctggcct

SEQ ID NO: 1362924 - DNA, 15 bp, Homo sapiens
cctagctaattattt

SEQ ID NO: 1362925 - DNA, 20 bp, Homo sapiens
cctagctcctccccttcctc

SEQ ID NO: 1362926 - DNA, 20 bp, Homo sapiens
cctagctttagaccctgggt

SEQ ID NO: 1362927 - DNA, 12 bp, Homo sapiens
cctagggccccc

SEQ ID NO: 1362928 - DNA, 14 bp, Homo sapiens
cctaggtctccagt

SEQ ID NO: 1362929 - DNA, 19 bp, Homo sapiens
cctagtgaaacttttctag

SEQ ID NO: 1362930 - DNA, 17 bp, Homo sapiens
cctagtttgtgagaaac

SEQ ID NO: 1362931 - DNA, 16 bp, Homo sapiens
cctatatcctgtgact

SEQ ID NO: 1362932 - DNA, 17 bp, Homo sapiens
cctattagagaagagat

SEQ ID NO: 1362933 - DNA, 15 bp, Homo sapiens
cctattagtgttata

SEQ ID NO: 1362934 - DNA, 24 bp, Homo sapiens
cctcaaagcttggattaaatacat

SEQ ID NO: 1362935 - DNA, 17 bp, Homo sapiens
cctcaacctcttctggc

SEQ ID NO: 1362936 - DNA, 21 bp, Homo sapiens
cctcaccccctcccaccccca

SEQ ID NO: 1362937 - DNA, 14 bp, Homo sapiens
cctcacctcatgcc

SEQ ID NO: 1362938 - DNA, 16 bp, Homo sapiens
cctcacctcatgccca

SEQ ID NO: 1362939 - DNA, 19 bp, Homo sapiens
cctcacctcatgcccaccc

SEQ ID NO: 1362940 - DNA, 14 bp, Homo sapiens
cctcactaattttt

SEQ ID NO: 1362941 - DNA, 22 bp, Homo sapiens
cctcactcgggtttctctgtgg

SEQ ID NO: 1362942 - DNA, 14 bp, Homo sapiens
cctcagcctgcaca

SEQ ID NO: 1362943 - DNA, 13 bp, Homo sapiens
cctcagctcggct

SEQ ID NO: 1362944 - DNA, 17 bp, Homo sapiens
cctcagctcggctcagc

SEQ ID NO: 1362945 - DNA, 19 bp, Homo sapiens
cctcagctcggctcagctc

SEQ ID NO: 1362946 - DNA, 11 bp, Homo sapiens
cctcaggcagg

SEQ ID NO: 1362947 - DNA, 12 bp, Homo sapiens
cctcaggcaggt

SEQ ID NO: 1362948 - DNA, 18 bp, Homo sapiens
cctcagggctcccagggg

SEQ ID NO: 1362949 - DNA, 18 bp, Homo sapiens
cctcaggtgagaagcaga

SEQ ID NO: 1362950 - DNA, 20 bp, Homo sapiens
cctcatgcccaccccctgcc

SEQ ID NO: 1362951 - DNA, 19 bp, Homo sapiens
cctccaaatggagaagctg

SEQ ID NO: 1362952 - DNA, 21 bp, Homo sapiens
cctccaaatggagaagctgca

SEQ ID NO: 1362953 - DNA, 11 bp, Homo sapiens
cctccaagcct

SEQ ID NO: 1362954 - DNA, 14 bp, Homo sapiens
cctccacagcgagg

SEQ ID NO: 1362955 - DNA, 22 bp, Homo sapiens
cctccacagcgagggcagctgc

SEQ ID NO: 1362956 - DNA, 23 bp, Homo sapiens
cctggcatcgcaccattctgact

SEQ ID NO: 1362957 - DNA, 13 bp, Homo sapiens
cctggccaggagc

SEQ ID NO: 1362958 - DNA, 16 bp, Homo sapiens
cctggcccccaacctc

SEQ ID NO: 1362959 - DNA, 20 bp, Homo sapiens
cctggcctcccctgccacca

SEQ ID NO: 1362960 - DNA, 22 bp, Homo sapiens
cctggccttgtcctcagccagt

SEQ ID NO: 1362961 - DNA, 22 bp, Homo sapiens
cctggcgcaggtgggctggact

SEQ ID NO: 1362962 - DNA, 14 bp, Homo sapiens
cctggctccctcct

SEQ ID NO: 1362963 - DNA, 15 bp, Homo sapiens
cctggctccctcctc

SEQ ID NO: 1362964 - DNA, 21 bp, Homo sapiens
cctggctgaggttcctctgcc

SEQ ID NO: 1362965 - DNA, 22 bp, Homo sapiens
cctggctgaggttcctctgcct

SEQ ID NO: 1362966 - DNA, 13 bp, Homo sapiens
cctggctgccggc

SEQ ID NO: 1362967 - DNA, 15 bp, Homo sapiens
cctggctgctgcccc

SEQ ID NO: 1362968 - DNA, 17 bp, Homo sapiens
cctggctgctgccccca

SEQ ID NO: 1362969 - DNA, 21 bp, Homo sapiens
cctggctgctgcccccacccc

SEQ ID NO: 1362970 - DNA, 22 bp, Homo sapiens
cctggctgctgcccccaccccg

SEQ ID NO: 1362971 - DNA, 17 bp, Homo sapiens
cctgggccgctgccacg

SEQ ID NO: 1362972 - DNA, 14 bp, Homo sapiens
cctgggctggaatc

SEQ ID NO: 1362973 - DNA, 14 bp, Homo sapiens
cctgggcttggcct

SEQ ID NO: 1362974 - DNA, 15 bp, Homo sapiens
cctgggcttggcctg

SEQ ID NO: 1362975 - DNA, 21 bp, Homo sapiens
cctgggcttggcctgctgtga

SEQ ID NO: 1362976 - DNA, 15 bp, Homo sapiens
cctgggggcacagga

SEQ ID NO: 1362977 - DNA, 23 bp, Homo sapiens
cctgggggcacaggaggcaggca

SEQ ID NO: 1362978 - DNA, 15 bp, Homo sapiens
cctgggtgggctctg

SEQ ID NO: 1362979 - DNA, 16 bp, Homo sapiens
cctgggtgggctctgt

SEQ ID NO: 1362980 - DNA, 21 bp, Homo sapiens
cctgggtgtccccgctgctgt

SEQ ID NO: 1362981 - DNA, 20 bp, Homo sapiens
cctggtctttgagctcccac

SEQ ID NO: 1362982 - DNA, 16 bp, Homo sapiens
cctggttgtgtgtccc

SEQ ID NO: 1362983 - DNA, 20 bp, Homo sapiens
cctgtaatcctagcactttg

SEQ ID NO: 1362984 - DNA, 14 bp, Homo sapiens
cctgtacagtagat

SEQ ID NO: 1362985 - DNA, 16 bp, Homo sapiens
cctgtagagtgggagc

SEQ ID NO: 1362986 - DNA, 23 bp, Homo sapiens
cctgtagggtccaaccagacctg

SEQ ID NO: 1362987 - DNA, 15 bp, Homo sapiens
cctgtatacagtgca

SEQ ID NO: 1362988 - DNA, 21 bp, Homo sapiens
cctgtatacagtgcagagcct

SEQ ID NO: 1362989 - DNA, 18 bp, Homo sapiens
cctgtatttaaaaataga

SEQ ID NO: 1362990 - DNA, 23 bp, Homo sapiens
cctgtatttaaaaatagaaacat

SEQ ID NO: 1362991 - DNA, 12 bp, Homo sapiens
cctgtccccgca

SEQ ID NO: 1362992 - DNA, 13 bp, Homo sapiens
cctgtccctgcgc

SEQ ID NO: 1362993 - DNA, 15 bp, Homo sapiens
cctgtcccttgacct

SEQ ID NO: 1362994 - DNA, 19 bp, Homo sapiens
cctgtgaatgccactgcct

SEQ ID NO: 1362995 - DNA, 22 bp, Homo sapiens
cctgtgaatgccactgccttcg

SEQ ID NO: 1362996 - DNA, 20 bp, Homo sapiens
cctgtgatccacccaaccct

SEQ ID NO: 1362997 - DNA, 15 bp, Homo sapiens
cctgtggcataaatt

SEQ ID NO: 1362998 - DNA, 15 bp, Homo sapiens
cctgtggccccaccc

SEQ ID NO: 1362999 - DNA, 22 bp, Homo sapiens
cctgtggcgccgtctccagggg

SEQ ID NO: 1363000 - DNA, 13 bp, Homo sapiens
cctgtggctgtcg

SEQ ID NO: 1363001 - DNA, 19 bp, Homo sapiens
cctgtgtccatgcgctcag

SEQ ID NO: 1363002 - DNA, 12 bp, Homo sapiens
cctgtgtgcagg

SEQ ID NO: 1363003 - DNA, 23 bp, Homo sapiens
cctgtgttaatttaagttttgac

SEQ ID NO: 1363004 - DNA, 19 bp, Homo sapiens
ccttaagtgaggaaatcaa

SEQ ID NO: 1363005 - DNA, 22 bp, Homo sapiens
ccttaatttcctttttgacact

SEQ ID NO: 1363006 - DNA, 13 bp, Homo sapiens
ccttactggctta

SEQ ID NO: 1363007 - DNA, 21 bp, Homo sapiens
ccttactttactgcctgaata

SEQ ID NO: 1363008 - DNA, 23 bp, Homo sapiens
ccttaggccttcctctctccaga

SEQ ID NO: 1363009 - DNA, 17 bp, Homo sapiens
ccttatagtctaagact

SEQ ID NO: 1363010 - DNA, 11 bp, Homo sapiens
ccttcagacac

SEQ ID NO: 1363011 - DNA, 20 bp, Homo sapiens
ccttcagacaccctcaacct

SEQ ID NO: 1363012 - DNA, 13 bp, Homo sapiens
ccttccagatcac

SEQ ID NO: 1363013 - DNA, 20 bp, Homo sapiens
ccttccagatcactgccaca

SEQ ID NO: 1363014 - DNA, 15 bp, Homo sapiens
ccttccagatggtca

SEQ ID NO: 1363015 - DNA, 13 bp, Homo sapiens
ccttccattccac

SEQ ID NO: 1363016 - DNA, 18 bp, Homo sapiens
ccttccgcagtgtggcca

SEQ ID NO: 1363017 - DNA, 23 bp, Homo sapiens
ccttccttttccctgcttccagg

SEQ ID NO: 1363018 - DNA, 18 bp, Homo sapiens
ccttcgcttcttgcctct

SEQ ID NO: 1363019 - DNA, 19 bp, Homo sapiens
ccttcgcttcttgcctctg

SEQ ID NO: 1363020 - DNA, 21 bp, Homo sapiens
ccttcgcttcttgcctctgtg

SEQ ID NO: 1363021 - DNA, 23 bp, Homo sapiens
ccttcgcttcttgcctctgtgct

SEQ ID NO: 1363022 - DNA, 18 bp, Homo sapiens
ccttcgggcgtctgtgtg

SEQ ID NO: 1363023 - DNA, 16 bp, Homo sapiens
ccttcgtctttcccat

SEQ ID NO: 1363024 - DNA, 17 bp, Homo sapiens
ccttcgtctttcccatg

SEQ ID NO: 1363025 - DNA, 22 bp, Homo sapiens
ccttctagtcttggccagccaa

SEQ ID NO: 1363026 - DNA, 18 bp, Homo sapiens
ccttgaagaactgcaggc

SEQ ID NO: 1363027 - DNA, 23 bp, Homo sapiens
ccttgaagaactgcaggccctgg

SEQ ID NO: 1363028 - DNA, 13 bp, Homo sapiens
ccttgagccctgg

SEQ ID NO: 1363029 - DNA, 16 bp, Homo sapiens
ccttgagccctggctg

SEQ ID NO: 1363030 - DNA, 22 bp, Homo sapiens
ccttgagccctggctgttctgt

SEQ ID NO: 1363031 - DNA, 17 bp, Homo sapiens
ccttgcctccccatttc

SEQ ID NO: 1363032 - DNA, 23 bp, Homo sapiens
ccttgcctccccatttcccatct

SEQ ID NO: 1363033 - DNA, 13 bp, Homo sapiens
ccttgctggcccc

SEQ ID NO: 1363034 - DNA, 14 bp, Homo sapiens
ccttgctggcccca

SEQ ID NO: 1363035 - DNA, 16 bp, Homo sapiens
ccttgctggccccagc

SEQ ID NO: 1363036 - DNA, 20 bp, Homo sapiens
ccttgctggccccagccctg

SEQ ID NO: 1363037 - DNA, 19 bp, Homo sapiens
ccttgctgtttgtcctgag

SEQ ID NO: 1363038 - DNA, 12 bp, Homo sapiens
ccttggctcaga

SEQ ID NO: 1363039 - DNA, 17 bp, Homo sapiens
ccttggcttctgtgatg

SEQ ID NO: 1363040 - DNA, 17 bp, Homo sapiens
ccttggtgcctcttgta

SEQ ID NO: 1363041 - DNA, 15 bp, Homo sapiens
ccttgttacttctga

SEQ ID NO: 1363042 - DNA, 16 bp, Homo sapiens
ccttgttacttctgag

SEQ ID NO: 1363043 - DNA, 18 bp, Homo sapiens
ccttgttacttctgaggt

SEQ ID NO: 1363044 - DNA, 18 bp, Homo sapiens
cctttaattgtaaagtaa

SEQ ID NO: 1363045 - DNA, 13 bp, Homo sapiens
cctttatgtgaat

SEQ ID NO: 1363046 - DNA, 13 bp, Homo sapiens
cctttcaaagctt

SEQ ID NO: 1363047 - DNA, 21 bp, Homo sapiens
cctttccctcaccccctccca

SEQ ID NO: 1363048 - DNA, 15 bp, Homo sapiens
cctttctctctctaa

SEQ ID NO: 1363049 - DNA, 15 bp, Homo sapiens
cctttgcagctcaga

SEQ ID NO: 1363050 - DNA, 11 bp, Homo sapiens
cctttggcttc

SEQ ID NO: 1363051 - DNA, 16 bp, Homo sapiens
cctttgtaagtgcagg

SEQ ID NO: 1363052 - DNA, 15 bp, Homo sapiens
cctttgttctggggg

SEQ ID NO: 1363053 - DNA, 19 bp, Homo sapiens
ccttttactggttgcatgg

SEQ ID NO: 1363054 - DNA, 12 bp, Homo sapiens
ccttttactgtg

SEQ ID NO: 1363055 - DNA, 17 bp, Homo sapiens
cctttttaaaacacatg

SEQ ID NO: 1363056 - DNA, 13 bp, Homo sapiens
cctttttgacact

SEQ ID NO: 1363057 - DNA, 14 bp, Homo sapiens
ccttttttcttttt

SEQ ID NO: 1363058 - DNA, 19 bp, Homo sapiens
cgaacatccaaccttccca

SEQ ID NO: 1363059 - DNA, 14 bp, Homo sapiens
cgaagaagatgctc

SEQ ID NO: 1363060 - DNA, 18 bp, Homo sapiens
cgaagaccctcttgccca

SEQ ID NO: 1363061 - DNA, 23 bp, Homo sapiens
cgaagaccctcttgcccatcctg

SEQ ID NO: 1363062 - DNA, 17 bp, Homo sapiens
cgaagttcaagatcaaa

SEQ ID NO: 1363063 - DNA, 18 bp, Homo sapiens
cgaagttcaagatcaaaa

SEQ ID NO: 1363064 - DNA, 14 bp, Homo sapiens
cgaatagacatcaa

SEQ ID NO: 1363065 - DNA, 17 bp, Homo sapiens
cgaatttttcagatgat

SEQ ID NO: 1363066 - DNA, 18 bp, Homo sapiens
cgacacggtctcggatca

SEQ ID NO: 1363067 - DNA, 12 bp, Homo sapiens
cgactccagcca

SEQ ID NO: 1363068 - DNA, 15 bp, Homo sapiens
cgactccagccagcg

SEQ ID NO: 1363069 - DNA, 19 bp, Homo sapiens
cgacttgtttttgcacatg

SEQ ID NO: 1363070 - DNA, 13 bp, Homo sapiens
cgactttctgcct

SEQ ID NO: 1363071 - DNA, 17 bp, Homo sapiens
cgagaaagaggcaccag

SEQ ID NO: 1363072 - DNA, 16 bp, Homo sapiens
cgagaccatcctggct

SEQ ID NO: 1363073 - DNA, 14 bp, Homo sapiens
cgagagggagagag

SEQ ID NO: 1363074 - DNA, 22 bp, Homo sapiens
cgagaggtgggccagtctgtgg

SEQ ID NO: 1363075 - DNA, 14 bp, Homo sapiens
cgagagtctggccc

SEQ ID NO: 1363076 - DNA, 17 bp, Homo sapiens
cgagagtctggccctag

SEQ ID NO: 1363077 - DNA, 17 bp, Homo sapiens
cccaggggtctccctgg

SEQ ID NO: 1363078 - DNA, 18 bp, Homo sapiens
cccaggggtctccctggc

SEQ ID NO: 1363079 - DNA, 21 bp, Homo sapiens
cccaggggtctccctggctcc

SEQ ID NO: 1363080 - DNA, 22 bp, Homo sapiens
cccaggggtctccctggctccc

SEQ ID NO: 1363081 - DNA, 23 bp, Homo sapiens
cccaggggtctccctggctccct

SEQ ID NO: 1363082 - DNA, 14 bp, Homo sapiens
cccagggttcccgc

SEQ ID NO: 1363083 - DNA, 16 bp, Homo sapiens
cccaggtaccagctgc

SEQ ID NO: 1363084 - DNA, 15 bp, Homo sapiens
cccagtccccacccc

SEQ ID NO: 1363085 - DNA, 18 bp, Homo sapiens
cccagtccccacccctgc

SEQ ID NO: 1363086 - DNA, 20 bp, Homo sapiens
cccagtccccacccctgccc

SEQ ID NO: 1363087 - DNA, 23 bp, Homo sapiens
cccagtccccacccctgccccca

SEQ ID NO: 1363088 - DNA, 15 bp, Homo sapiens
cccagtgcagaatgt

SEQ ID NO: 1363089 - DNA, 20 bp, Homo sapiens
cccagtgcatggtggccaga

SEQ ID NO: 1363090 - DNA, 15 bp, Homo sapiens
cccagtgccgagaag

SEQ ID NO: 1363091 - DNA, 14 bp, Homo sapiens
cccagttagctctc

SEQ ID NO: 1363092 - DNA, 20 bp, Homo sapiens
cccatagcagccagttcaaa

SEQ ID NO: 1363093 - DNA, 15 bp, Homo sapiens
cccatctccctgcct

SEQ ID NO: 1363094 - DNA, 17 bp, Homo sapiens
cccatctccctgcctgg

SEQ ID NO: 1363095 - DNA, 18 bp, Homo sapiens
cccatctccctgcctggc

SEQ ID NO: 1363096 - DNA, 13 bp, Homo sapiens
cccatctgcaccc

SEQ ID NO: 1363097 - DNA, 18 bp, Homo sapiens
cccatctgccccacagtc

SEQ ID NO: 1363098 - DNA, 12 bp, Homo sapiens
cccatcttgctt

SEQ ID NO: 1363099 - DNA, 21 bp, Homo sapiens
cccatgcaagcagaggaccag

SEQ ID NO: 1363100 - DNA, 20 bp, Homo sapiens
cccatgcttacgtgatcctc

SEQ ID NO: 1363101 - DNA, 22 bp, Homo sapiens
cccatgtagccccctggcctct

SEQ ID NO: 1363102 - DNA, 14 bp, Homo sapiens
cccatttcccatct

SEQ ID NO: 1363103 - DNA, 15 bp, Homo sapiens
cccatttcccatctg

SEQ ID NO: 1363104 - DNA, 16 bp, Homo sapiens
cccatttcccatctgc

SEQ ID NO: 1363105 - DNA, 17 bp, Homo sapiens
cccatttcccatctgca

SEQ ID NO: 1363106 - DNA, 19 bp, Homo sapiens
cccatttcccatctgcacc

SEQ ID NO: 1363107 - DNA, 18 bp, Homo sapiens
cccatttgtgccagagga

SEQ ID NO: 1363108 - DNA, 21 bp, Homo sapiens
ccccaacctcagggctcccag

SEQ ID NO: 1363109 - DNA, 22 bp, Homo sapiens
ccccaacctcagggctcccagg

SEQ ID NO: 1363110 - DNA, 17 bp, Homo sapiens
ccccacagcgtccctgg

SEQ ID NO: 1363111 - DNA, 13 bp, Homo sapiens
ccccacccctgcc

SEQ ID NO: 1363112 - DNA, 14 bp, Homo sapiens
ccccacccctgccc

SEQ ID NO: 1363113 - DNA, 16 bp, Homo sapiens
ccccactgccagcagc

SEQ ID NO: 1363114 - DNA, 19 bp, Homo sapiens
ccccactgccagcagcagc

SEQ ID NO: 1363115 - DNA, 22 bp, Homo sapiens
ccccactgccagcagcagcagg

SEQ ID NO: 1363116 - DNA, 14 bp, Homo sapiens
ccccacttgcctct

SEQ ID NO: 1363117 - DNA, 16 bp, Homo sapiens
ccccacttgcctcttc

SEQ ID NO: 1363118 - DNA, 19 bp, Homo sapiens
ccccagcattccagcccct

SEQ ID NO: 1363119 - DNA, 23 bp, Homo sapiens
ccccagccatgccagctggcctt

SEQ ID NO: 1363120 - DNA, 14 bp, Homo sapiens
ccccagcccagggc

SEQ ID NO: 1363121 - DNA, 15 bp, Homo sapiens
cgaggacccaggaaa

SEQ ID NO: 1363122 - DNA, 22 bp, Homo sapiens
cgaggggcctttgttctggggg

SEQ ID NO: 1363123 - DNA, 18 bp, Homo sapiens
cgaggggtgtcttgggca

SEQ ID NO: 1363124 - DNA, 14 bp, Homo sapiens
cgaggtcaggagat

SEQ ID NO: 1363125 - DNA, 22 bp, Homo sapiens
cgagtagaaaatgtgaccctcc

SEQ ID NO: 1363126 - DNA, 22 bp, Homo sapiens
cgatactgcgactttctgcctg

SEQ ID NO: 1363127 - DNA, 18 bp, Homo sapiens
cgatcacaaatgacttta

SEQ ID NO: 1363128 - DNA, 16 bp, Homo sapiens
cgatctctcctggcct

SEQ ID NO: 1363129 - DNA, 17 bp, Homo sapiens
cgatctctcctggccta

SEQ ID NO: 1363130 - DNA, 21 bp, Homo sapiens
cgcaccggagtgtctggaatt

SEQ ID NO: 1363131 - DNA, 19 bp, Homo sapiens
cgcagaacgaaccttggcc

SEQ ID NO: 1363132 - DNA, 23 bp, Homo sapiens
cgcagaacgaaccttggcctggg

SEQ ID NO: 1363133 - DNA, 17 bp, Homo sapiens
cgcagacaccttggaca

SEQ ID NO: 1363134 - DNA, 16 bp, Homo sapiens
cgcagccctggcaggg

SEQ ID NO: 1363135 - DNA, 13 bp, Homo sapiens
cgcatctcacagc

SEQ ID NO: 1363136 - DNA, 16 bp, Homo sapiens
cgcatcttgcctccag

SEQ ID NO: 1363137 - DNA, 16 bp, Homo sapiens
cgccaaggctggggga

SEQ ID NO: 1363138 - DNA, 12 bp, Homo sapiens
cgccacaggacc

SEQ ID NO: 1363139 - DNA, 13 bp, Homo sapiens
cgccacaggaccc

SEQ ID NO: 1363140 - DNA, 15 bp, Homo sapiens
cgccagcctcctctg

SEQ ID NO: 1363141 - DNA, 17 bp, Homo sapiens
cgccagcctcctctgga

SEQ ID NO: 1363142 - DNA, 21 bp, Homo sapiens
cgccagcctcctctggacggc

SEQ ID NO: 1363143 - DNA, 20 bp, Homo sapiens
cgcccaggctggagtgcagt

SEQ ID NO: 1363144 - DNA, 17 bp, Homo sapiens
cgccccctccgccctgc

SEQ ID NO: 1363145 - DNA, 19 bp, Homo sapiens
cgccccctccgccctgcca

SEQ ID NO: 1363146 - DNA, 11 bp, Homo sapiens
cgccctgccac

SEQ ID NO: 1363147 - DNA, 12 bp, Homo sapiens
cgccctgccact

SEQ ID NO: 1363148 - DNA, 20 bp, Homo sapiens
cgcccttggcttctgtgatg

SEQ ID NO: 1363149 - DNA, 12 bp, Homo sapiens
cgccgcctcttt

SEQ ID NO: 1363150 - DNA, 16 bp, Homo sapiens
cgcctccatccaaggc

SEQ ID NO: 1363151 - DNA, 17 bp, Homo sapiens
cgcctcttgaccaggct

SEQ ID NO: 1363152 - DNA, 15 bp, Homo sapiens
cgcctggccaggagc

SEQ ID NO: 1363153 - DNA, 18 bp, Homo sapiens
cgcctggccaggagcagg

SEQ ID NO: 1363154 - DNA, 21 bp, Homo sapiens
cgctaaagagcccttgcctcc

SEQ ID NO: 1363155 - DNA, 19 bp, Homo sapiens
cgctcagggccatgctgag

SEQ ID NO: 1363156 - DNA, 22 bp, Homo sapiens
cgctcagggccatgctgaggcc

SEQ ID NO: 1363157 - DNA, 23 bp, Homo sapiens
cgctccgggctttcacggaaact

SEQ ID NO: 1363158 - DNA, 21 bp, Homo sapiens
cgctctgtggatgccagggcc

SEQ ID NO: 1363159 - DNA, 16 bp, Homo sapiens
cgctgagactgtgctg

SEQ ID NO: 1363160 - DNA, 13 bp, Homo sapiens
cgctgagtggcag

SEQ ID NO: 1363161 - DNA, 16 bp, Homo sapiens
cgcttcttgcctctgt

SEQ ID NO: 1363162 - DNA, 18 bp, Homo sapiens
cgcttgcttttctgtatt

SEQ ID NO: 1363163 - DNA, 11 bp, Homo sapiens
cgcttttcctt

SEQ ID NO: 1363164 - DNA, 22 bp, Homo sapiens
cgcttttccttggcattccgca

SEQ ID NO: 1363165 - DNA, 13 bp, Homo sapiens
cggaagagccttg

SEQ ID NO: 1363166 - DNA, 14 bp, Homo sapiens
cggacttttctgca

SEQ ID NO: 1363167 - DNA, 16 bp, Homo sapiens
cggagaagagcgcagt

SEQ ID NO: 1363168 - DNA, 16 bp, Homo sapiens
cggaggcaaagctggc

SEQ ID NO: 1363169 - DNA, 18 bp, Homo sapiens
cggaggcctgcgaccctg

SEQ ID NO: 1363170 - DNA, 22 bp, Homo sapiens
cggaggttgcagtgagctgaga

SEQ ID NO: 1363171 - DNA, 22 bp, Homo sapiens
cggagtcgtggggtgtgctggg

SEQ ID NO: 1363172 - DNA, 15 bp, Homo sapiens
ctatatcctgtgact

SEQ ID NO: 1363173 - DNA, 16 bp, Homo sapiens
ctatattttgtcatat

SEQ ID NO: 1363174 - DNA, 21 bp, Homo sapiens
ctatattttgtcatatcaaat

SEQ ID NO: 1363175 - DNA, 19 bp, Homo sapiens
ctatcaacaataaaatttt

SEQ ID NO: 1363176 - DNA, 21 bp, Homo sapiens
ctatccccatctccctgcctg

SEQ ID NO: 1363177 - DNA, 17 bp, Homo sapiens
ctatccgctgccagcct

SEQ ID NO: 1363178 - DNA, 22 bp, Homo sapiens
ctatccgctgccagccttgagc

SEQ ID NO: 1363179 - DNA, 12 bp, Homo sapiens
ctatcctctgta

SEQ ID NO: 1363180 - DNA, 18 bp, Homo sapiens
ctatctagttctaacagt

SEQ ID NO: 1363181 - DNA, 11 bp, Homo sapiens
ctatctgtctg

SEQ ID NO: 1363182 - DNA, 14 bp, Homo sapiens
ctatgcaaaaagct

SEQ ID NO: 1363183 - DNA, 14 bp, Homo sapiens
ctatggcagaaaaa

SEQ ID NO: 1363184 - DNA, 16 bp, Homo sapiens
ctatggcagaaaaaat

SEQ ID NO: 1363185 - DNA, 17 bp, Homo sapiens
ctatggtcgggagacag

SEQ ID NO: 1363186 - DNA, 17 bp, Homo sapiens
ctatgtataaaatacat

SEQ ID NO: 1363187 - DNA, 11 bp, Homo sapiens
ctattaatata

SEQ ID NO: 1363188 - DNA, 23 bp, Homo sapiens
ctattacgaagttcaagatcaaa

SEQ ID NO: 1363189 - DNA, 18 bp, Homo sapiens
ctattagtgttatatgaa

SEQ ID NO: 1363190 - DNA, 19 bp, Homo sapiens
ctattagtgttatatgaac

SEQ ID NO: 1363191 - DNA, 16 bp, Homo sapiens
ctattatggaaaactg

SEQ ID NO: 1363192 - DNA, 17 bp, Homo sapiens
ctattatggaaaactgt

SEQ ID NO: 1363193 - DNA, 18 bp, Homo sapiens
ctattatggaaaactgtg

SEQ ID NO: 1363194 - DNA, 22 bp, Homo sapiens
ctattctataaaactctgcatg

SEQ ID NO: 1363195 - DNA, 17 bp, Homo sapiens
ctattgatttaagcttt

SEQ ID NO: 1363196 - DNA, 15 bp, Homo sapiens
ctatttaagatgtga

SEQ ID NO: 1363197 - DNA, 13 bp, Homo sapiens
ctatttattaata

SEQ ID NO: 1363198 - DNA, 16 bp, Homo sapiens
ctatttattttcctaa

SEQ ID NO: 1363199 - DNA, 14 bp, Homo sapiens
ctatttgaacaagt

SEQ ID NO: 1363200 - DNA, 18 bp, Homo sapiens
ctcaaaaaaagaaaaaga

SEQ ID NO: 1363201 - DNA, 23 bp, Homo sapiens
ctcaaagaaatctactatatccc

SEQ ID NO: 1363202 - DNA, 23 bp, Homo sapiens
ctcaaagcttggattaaatacat

SEQ ID NO: 1363203 - DNA, 12 bp, Homo sapiens
ctcaacctcttc

SEQ ID NO: 1363204 - DNA, 20 bp, Homo sapiens
ctcaacctcttctggctcaa

SEQ ID NO: 1363205 - DNA, 15 bp, Homo sapiens
ctcaagaaattccca

SEQ ID NO: 1363206 - DNA, 14 bp, Homo sapiens
ctcaatcctaattt

SEQ ID NO: 1363207 - DNA, 20 bp, Homo sapiens
ctcaatcctaatttctcctc

SEQ ID NO: 1363208 - DNA, 19 bp, Homo sapiens
ctcaatgaaccataaattc

SEQ ID NO: 1363209 - DNA, 15 bp, Homo sapiens
ctcaatgctttattt

SEQ ID NO: 1363210 - DNA, 17 bp, Homo sapiens
ctcaatgctttatttgt

SEQ ID NO: 1363211 - DNA, 21 bp, Homo sapiens
ctcacactggttctcaatgaa

SEQ ID NO: 1363212 - DNA, 12 bp, Homo sapiens
ctcacagagtca

SEQ ID NO: 1363213 - DNA, 13 bp, Homo sapiens
ctcacagagtcaa

SEQ ID NO: 1363214 - DNA, 16 bp, Homo sapiens
ctcaccagccccactg

SEQ ID NO: 1363215 - DNA, 19 bp, Homo sapiens
ctcaccagccccactgcca

SEQ ID NO: 1363216 - DNA, 22 bp, Homo sapiens
ctcaccagccccactgccagca

SEQ ID NO: 1363217 - DNA, 23 bp, Homo sapiens
ctcaccagccccactgccagcag

SEQ ID NO: 1363218 - DNA, 14 bp, Homo sapiens
ctcaccgcccatca

SEQ ID NO: 1363219 - DNA, 19 bp, Homo sapiens
ctcactaaagcatgaaatg

SEQ ID NO: 1363220 - DNA, 17 bp, Homo sapiens
ctcactaatttttgtat

SEQ ID NO: 1363221 - DNA, 23 bp, Homo sapiens
ctcactaggcccccacttgcctc

SEQ ID NO: 1363222 - DNA, 11 bp, Homo sapiens
ctcactgccag

SEQ ID NO: 1363223 - DNA, 12 bp, Homo sapiens
ctcactgccagg

SEQ ID NO: 1363224 - DNA, 14 bp, Homo sapiens
ctcactgccaggcc

SEQ ID NO: 1363225 - DNA, 13 bp, Homo sapiens
ctcactggggcct

SEQ ID NO: 1363226 - DNA, 16 bp, Homo sapiens
ctcactggggcctaca

SEQ ID NO: 1363227 - DNA, 19 bp, Homo sapiens
ctcagacatgttttccgtg

SEQ ID NO: 1363228 - DNA, 20 bp, Homo sapiens
ctcagacatgttttccgtga

SEQ ID NO: 1363229 - DNA, 15 bp, Homo sapiens
ctcagagctctctct

SEQ ID NO: 1363230 - DNA, 16 bp, Homo sapiens
ctcagagtggtggggg

SEQ ID NO: 1363231 - DNA, 19 bp, Homo sapiens
ctcagcaaaagatgcttct

SEQ ID NO: 1363232 - DNA, 20 bp, Homo sapiens
ctcagcaaaagatgcttctc

SEQ ID NO: 1363233 - DNA, 21 bp, Homo sapiens
ctcagcaaaagatgcttctca

SEQ ID NO: 1363234 - DNA, 18 bp, Homo sapiens
ctcagcctcccaagtaac

SEQ ID NO: 1363235 - DNA, 11 bp, Homo sapiens
ctcagcctgca

SEQ ID NO: 1363236 - DNA, 13 bp, Homo sapiens
ctcagcctgcaca

SEQ ID NO: 1363237 - DNA, 19 bp, Homo sapiens
ctcagccttcagacagaga

SEQ ID NO: 1363238 - DNA, 16 bp, Homo sapiens
ctcagcgcggccctcc

SEQ ID NO: 1363239 - DNA, 15 bp, Homo sapiens
ctcagctcggggagc

SEQ ID NO: 1363240 - DNA, 12 bp, Homo sapiens
ctcagctttgag

SEQ ID NO: 1363241 - DNA, 23 bp, Homo sapiens
ctcaggagtttgagaccaacctg

SEQ ID NO: 1363242 - DNA, 20 bp, Homo sapiens
ctcaggccggcagccccagc

SEQ ID NO: 1363243 - DNA, 22 bp, Homo sapiens
ctcaggccggcagccccagcct

SEQ ID NO: 1363244 - DNA, 23 bp, Homo sapiens
ctcaggccggcagccccagcctg

SEQ ID NO: 1363245 - DNA, 19 bp, Homo sapiens
ctcagggccatgctgaggc

SEQ ID NO: 1363246 - DNA, 20 bp, Homo sapiens
ctcagggccatgctgaggcc

SEQ ID NO: 1363247 - DNA, 15 bp, Homo sapiens
ctcagggcctggtcg

SEQ ID NO: 1363248 - DNA, 15 bp, Homo sapiens
ctcagggtggtctct

SEQ ID NO: 1363249 - DNA, 16 bp, Homo sapiens
ctcaggtgagaagcag

SEQ ID NO: 1363250 - DNA, 20 bp, Homo sapiens
ctcagtaaacgggaacatgc

SEQ ID NO: 1363251 - DNA, 10 bp, Homo sapiens
ctcagtgcag

SEQ ID NO: 1363252 - DNA, 22 bp, Homo sapiens
ctcagtgggttaacatcagttt

SEQ ID NO: 1363253 - DNA, 19 bp, Homo sapiens
ctcatctgaaatgttacaa

SEQ ID NO: 1363254 - DNA, 16 bp, Homo sapiens
ctcatctgctggtccg

SEQ ID NO: 1363255 - DNA, 20 bp, Homo sapiens
ctcatctgctggtccgtggg

SEQ ID NO: 1363256 - DNA, 21 bp, Homo sapiens
ctcatctggagttctcaaaga

SEQ ID NO: 1363257 - DNA, 21 bp, Homo sapiens
ctcatgcccaccccctgccct

SEQ ID NO: 1363258 - DNA, 16 bp, Homo sapiens
ctcatgtgtgcaacag

SEQ ID NO: 1363259 - DNA, 16 bp, Homo sapiens
ctcattgctgagcctc

SEQ ID NO: 1363260 - DNA, 18 bp, Homo sapiens
ctcattgctgagcctctg

SEQ ID NO: 1363261 - DNA, 15 bp, Homo sapiens
ctcatttcatctcat

SEQ ID NO: 1363262 - DNA, 17 bp, Homo sapiens
ctcatttgttaaaatta

SEQ ID NO: 1363263 - DNA, 18 bp, Homo sapiens
ctccaaactgaagcagcc

SEQ ID NO: 1363264 - DNA, 22 bp, Homo sapiens
ctccaaactgaagcagcctctc

SEQ ID NO: 1363265 - DNA, 20 bp, Homo sapiens
ctccaaatggagaagctgca

SEQ ID NO: 1363266 - DNA, 21 bp, Homo sapiens
ctccaaatggagaagctgcag

SEQ ID NO: 1363267 - DNA, 16 bp, Homo sapiens
ctccacatctgcctta

SEQ ID NO: 1363268 - DNA, 14 bp, Homo sapiens
ctccaccccaggac

SEQ ID NO: 1363269 - DNA, 22 bp, Homo sapiens
ctccaccccaggacgccactca

SEQ ID NO: 1363270 - DNA, 16 bp, Homo sapiens
ctccactgtgcacacc

SEQ ID NO: 1363271 - DNA, 16 bp, Homo sapiens
ctccagcaacacagcc

SEQ ID NO: 1363272 - DNA, 16 bp, Homo sapiens
ctccagcctgggggac

SEQ ID NO: 1363273 - DNA, 13 bp, Homo sapiens
ctccagctgttca

SEQ ID NO: 1363274 - DNA, 18 bp, Homo sapiens
ctccagctgttcagctgg

SEQ ID NO: 1363275 - DNA, 13 bp, Homo sapiens
ctccaggccctcc

SEQ ID NO: 1363276 - DNA, 14 bp, Homo sapiens
ctccaggcctgcct

SEQ ID NO: 1363277 - DNA, 15 bp, Homo sapiens
ctccaggcctgcctc

SEQ ID NO: 1363278 - DNA, 22 bp, Homo sapiens
ctccagggacacacagcctagc

SEQ ID NO: 1363279 - DNA, 14 bp, Homo sapiens
ctccaggggctgct

SEQ ID NO: 1363280 - DNA, 23 bp, Homo sapiens
ctccaggggctgcttcctcctgg

SEQ ID NO: 1363281 - DNA, 16 bp, Homo sapiens
ctccaggtgcagaggt

SEQ ID NO: 1363282 - DNA, 13 bp, Homo sapiens
ctccatccaaggc

SEQ ID NO: 1363283 - DNA, 18 bp, Homo sapiens
ctccatccaaggccaggt

SEQ ID NO: 1363284 - DNA, 13 bp, Homo sapiens
ctccatccctcta

SEQ ID NO: 1363285 - DNA, 15 bp, Homo sapiens
ctccatttgctcttc

SEQ ID NO: 1363286 - DNA, 18 bp, Homo sapiens
ctcccacacccaaagctg

SEQ ID NO: 1363287 - DNA, 13 bp, Homo sapiens
ctcccacccccag

SEQ ID NO: 1363288 - DNA, 16 bp, Homo sapiens
ctcccacccccagccc

SEQ ID NO: 1363289 - DNA, 17 bp, Homo sapiens
ctcccacccggctgcag

SEQ ID NO: 1363290 - DNA, 16 bp, Homo sapiens
ctcccacttctgccag

SEQ ID NO: 1363291 - DNA, 17 bp, Homo sapiens
ctcccacttctgccaga

SEQ ID NO: 1363292 - DNA, 21 bp, Homo sapiens
ctcccaggaagcccaggagcc

SEQ ID NO: 1363293 - DNA, 16 bp, Homo sapiens
ctcccaggggtctccc

SEQ ID NO: 1363294 - DNA, 22 bp, Homo sapiens
ctcccaggggtctccctggctc

SEQ ID NO: 1363295 - DNA, 17 bp, Homo sapiens
ctcccaggtaccagctg

SEQ ID NO: 1363296 - DNA, 18 bp, Homo sapiens
ctcccaggtaccagctgc

SEQ ID NO: 1363297 - DNA, 21 bp, Homo sapiens
ctccccaaatcaatacactag

SEQ ID NO: 1363298 - DNA, 15 bp, Homo sapiens
ctccccacctccagg

SEQ ID NO: 1363299 - DNA, 19 bp, Homo sapiens
ctccccagcattccagccc

SEQ ID NO: 1363300 - DNA, 17 bp, Homo sapiens
ctccccaggtccagctc

SEQ ID NO: 1363301 - DNA, 20 bp, Homo sapiens
ctccccaggtccagctctgg

SEQ ID NO: 1363302 - DNA, 19 bp, Homo sapiens
ctccccatttcccatctgc

SEQ ID NO: 1363303 - DNA, 22 bp, Homo sapiens
ctcccccagccatgccagctgg

SEQ ID NO: 1363304 - DNA, 22 bp, Homo sapiens
ctcccccagttcctcccaggaa

SEQ ID NO: 1363305 - DNA, 15 bp, Homo sapiens
ctcccccggctctac

SEQ ID NO: 1363306 - DNA, 23 bp, Homo sapiens
ctccccggcatgagactcagtgc

SEQ ID NO: 1363307 - DNA, 14 bp, Homo sapiens
ctccctagctcctc

SEQ ID NO: 1363308 - DNA, 16 bp, Homo sapiens
ctccctccaccccagg

SEQ ID NO: 1363309 - DNA, 12 bp, Homo sapiens
ctccctcccaca

SEQ ID NO: 1363310 - DNA, 23 bp, Homo sapiens
ctccctctgcccctcccccagcc

SEQ ID NO: 1363311 - DNA, 13 bp, Homo sapiens
ctccctgcctggc

SEQ ID NO: 1363312 - DNA, 12 bp, Homo sapiens
ctccctggctcc

SEQ ID NO: 1363313 - DNA, 20 bp, Homo sapiens
ctcccttccttttccctgct

SEQ ID NO: 1363314 - DNA, 15 bp, Homo sapiens
ctcccttgctggccc

SEQ ID NO: 1363315 - DNA, 23 bp, Homo sapiens
ctcccttgctggccccagccctg

SEQ ID NO: 1363316 - DNA, 17 bp, Homo sapiens
ctccctttcttccctac

SEQ ID NO: 1363317 - DNA, 17 bp, Homo sapiens
ctccgagaggtgggcca

SEQ ID NO: 1363318 - DNA, 22 bp, Homo sapiens
ctccgagaggtgggccagtctg

SEQ ID NO: 1363319 - DNA, 13 bp, Homo sapiens
ctccgcaggactt

SEQ ID NO: 1363320 - DNA, 13 bp, Homo sapiens
ctccgccagcctc

SEQ ID NO: 1363321 - DNA, 17 bp, Homo sapiens
ctccgccctgccactca

SEQ ID NO: 1363322 - DNA, 17 bp, Homo sapiens
ctccggctcccagcctc

SEQ ID NO: 1363323 - DNA, 15 bp, Homo sapiens
ctccgttagctcctg

SEQ ID NO: 1363324 - DNA, 16 bp, Homo sapiens
ctccgttagctcctgt

SEQ ID NO: 1363325 - DNA, 17 bp, Homo sapiens
ctccgttagctcctgtg

SEQ ID NO: 1363326 - DNA, 21 bp, Homo sapiens
ctccgttagctcctgtggccc

SEQ ID NO: 1363327 - DNA, 20 bp, Homo sapiens
ctcctaactgccagccccct

SEQ ID NO: 1363328 - DNA, 20 bp, Homo sapiens
ctcctacatatcccttccag

SEQ ID NO: 1363329 - DNA, 16 bp, Homo sapiens
ctcctcacctcatgcc

SEQ ID NO: 1363330 - DNA, 21 bp, Homo sapiens
ctcctccaggcctgcctccca

SEQ ID NO: 1363331 - DNA, 14 bp, Homo sapiens
ctcctccccaaatc

SEQ ID NO: 1363332 - DNA, 17 bp, Homo sapiens
ctcctccccaaatcaat

SEQ ID NO: 1363333 - DNA, 17 bp, Homo sapiens
ctcctccccttcctctt

SEQ ID NO: 1363334 - DNA, 17 bp, Homo sapiens
ctcctcggttcaaggtc

SEQ ID NO: 1363335 - DNA, 21 bp, Homo sapiens
ctcctctggacggcaggctca

SEQ ID NO: 1363336 - DNA, 23 bp, Homo sapiens
ctcctgaaccgcacagctcagga

SEQ ID NO: 1363337 - DNA, 18 bp, Homo sapiens
ctcctgacccattgctgt

SEQ ID NO: 1363338 - DNA, 16 bp, Homo sapiens
ctcctgactggtgctg

SEQ ID NO: 1363339 - DNA, 14 bp, Homo sapiens
ctcctgcagaccac

SEQ ID NO: 1363340 - DNA, 19 bp, Homo sapiens
ctcctgcttaatcttcaaa

SEQ ID NO: 1363341 - DNA, 16 bp, Homo sapiens
ctcctggcccactgca

SEQ ID NO: 1363342 - DNA, 13 bp, Homo sapiens
ctccttagaaaaa

SEQ ID NO: 1363343 - DNA, 14 bp, Homo sapiens
ctccttcagacacc

SEQ ID NO: 1363344 - DNA, 19 bp, Homo sapiens
ctccttcagacaccctcaa

SEQ ID NO: 1363345 - DNA, 13 bp, Homo sapiens
ctcctttaattgt

SEQ ID NO: 1363346 - DNA, 16 bp, Homo sapiens
ctcctttgttcccggc

SEQ ID NO: 1363347 - DNA, 16 bp, Homo sapiens
ctcgaatctctgtgcc

SEQ ID NO: 1363348 - DNA, 17 bp, Homo sapiens
ctcgaatctctgtgcct

SEQ ID NO: 1363349 - DNA, 14 bp, Homo sapiens
ctcgactctgtgcc

SEQ ID NO: 1363350 - DNA, 12 bp, Homo sapiens
ctcgagtctgag

SEQ ID NO: 1363351 - DNA, 21 bp, Homo sapiens
ctcgcatttgtcaatgacagt

SEQ ID NO: 1363352 - DNA, 17 bp, Homo sapiens
ctcgccggatctgaggg

SEQ ID NO: 1363353 - DNA, 18 bp, Homo sapiens
ctcgccggatctgaggga

SEQ ID NO: 1363354 - DNA, 22 bp, Homo sapiens
ctcgctgagggcagactggggc

SEQ ID NO: 1363355 - DNA, 13 bp, Homo sapiens
ctcggctcagctc

SEQ ID NO: 1363356 - DNA, 17 bp, Homo sapiens
ctcgggtttctctgtgg

SEQ ID NO: 1363357 - DNA, 11 bp, Homo sapiens
ctcggtgcctt

SEQ ID NO: 1363358 - DNA, 14 bp, Homo sapiens
ctcggtgggagcca

SEQ ID NO: 1363359 - DNA, 16 bp, Homo sapiens
ctcggtgtggagaagc

SEQ ID NO: 1363360 - DNA, 16 bp, Homo sapiens
ctcgtgcatccctgag

SEQ ID NO: 1363361 - DNA, 14 bp, Homo sapiens
ctctaacctcgccc

SEQ ID NO: 1363362 - DNA, 19 bp, Homo sapiens
ctctaacctcgccctctcc

SEQ ID NO: 1363363 - DNA, 20 bp, Homo sapiens
ctctaagtgggcattgccat

SEQ ID NO: 1363364 - DNA, 18 bp, Homo sapiens
ctctacttaatccaatgg

SEQ ID NO: 1363365 - DNA, 22 bp, Homo sapiens
ctctagaagccaagggaaaggg

SEQ ID NO: 1363366 - DNA, 23 bp, Homo sapiens
ctctagggaaaaaccagcgtgtg

SEQ ID NO: 1363367 - DNA, 13 bp, Homo sapiens
ctctagttctttg

SEQ ID NO: 1363368 - DNA, 14 bp, Homo sapiens
ctctattaaaatgc

SEQ ID NO: 1363369 - DNA, 16 bp, Homo sapiens
ctctatttatgtttgc

SEQ ID NO: 1363370 - DNA, 14 bp, Homo sapiens
ctctatttgagaat

SEQ ID NO: 1363371 - DNA, 14 bp, Homo sapiens
ctctcaagtaatat

SEQ ID NO: 1363372 - DNA, 21 bp, Homo sapiens
ctctcaggccggcagccccag

SEQ ID NO: 1363373 - DNA, 20 bp, Homo sapiens
ctctccagatgtttccagac

SEQ ID NO: 1363374 - DNA, 16 bp, Homo sapiens
ctctccggggccattt

SEQ ID NO: 1363375 - DNA, 11 bp, Homo sapiens
ctctcctcccc

SEQ ID NO: 1363376 - DNA, 15 bp, Homo sapiens
ctctcctccccaaat

SEQ ID NO: 1363377 - DNA, 22 bp, Homo sapiens
ctctctagcacaatttgcacta

SEQ ID NO: 1363378 - DNA, 14 bp, Homo sapiens
ctctctccagatgt

SEQ ID NO: 1363379 - DNA, 19 bp, Homo sapiens
ctctcttctcagagtggtg

SEQ ID NO: 1363380 - DNA, 13 bp, Homo sapiens
ctctgacttctgc

SEQ ID NO: 1363381 - DNA, 14 bp, Homo sapiens
ctctgacttctgcc

SEQ ID NO: 1363382 - DNA, 17 bp, Homo sapiens
ctctgacttctgcctgg

SEQ ID NO: 1363383 - DNA, 13 bp, Homo sapiens
ctctgagcgcctc

SEQ ID NO: 1363384 - DNA, 22 bp, Homo sapiens
ctctgatctccataaacatgaa

SEQ ID NO: 1363385 - DNA, 22 bp, Homo sapiens
ctctgatggttcttcacctcct

SEQ ID NO: 1363386 - DNA, 20 bp, Homo sapiens
ctctgcacaagctgcaccct

SEQ ID NO: 1363387 - DNA, 21 bp, Homo sapiens
ctctgcacaagctgcaccctc

SEQ ID NO: 1363388 - DNA, 16 bp, Homo sapiens
ctctgcacccagaaca

SEQ ID NO: 1363389 - DNA, 20 bp, Homo sapiens
ctctgcagtcctactcaagc

SEQ ID NO: 1363390 - DNA, 15 bp, Homo sapiens
ctctgccgtctctgg

SEQ ID NO: 1363391 - DNA, 17 bp, Homo sapiens
ctctgccgtctctggag

SEQ ID NO: 1363392 - DNA, 13 bp, Homo sapiens
ctctgcctgcccc

SEQ ID NO: 1363393 - DNA, 22 bp, Homo sapiens
ctctgcctttgcaccacgggac

SEQ ID NO: 1363394 - DNA, 21 bp, Homo sapiens
ctctgctcaccgcccatcagg

SEQ ID NO: 1363395 - DNA, 18 bp, Homo sapiens
ctctggacggcaggctca

SEQ ID NO: 1363396 - DNA, 16 bp, Homo sapiens
ctctggaggggagggg

SEQ ID NO: 1363397 - DNA, 21 bp, Homo sapiens
ctctggatgatggattccaca

SEQ ID NO: 1363398 - DNA, 15 bp, Homo sapiens
ctctggcttttggaa

SEQ ID NO: 1363399 - DNA, 18 bp, Homo sapiens
ctctgggtccttcctgaa

SEQ ID NO: 1363400 - DNA, 12 bp, Homo sapiens
ctctgtactttt

SEQ ID NO: 1363401 - DNA, 22 bp, Homo sapiens
ctctgtacttttcattctcttt

SEQ ID NO: 1363402 - DNA, 19 bp, Homo sapiens
ctctgtgagaaggtttatt

SEQ ID NO: 1363403 - DNA, 21 bp, Homo sapiens
ctctgtgagaaggtttattgt

SEQ ID NO: 1363404 - DNA, 16 bp, Homo sapiens
ctctgtgccttctttt

SEQ ID NO: 1363405 - DNA, 13 bp, Homo sapiens
ctctgtgctgtgt

SEQ ID NO: 1363406 - DNA, 13 bp, Homo sapiens
ctcttaaaaccca

SEQ ID NO: 1363407 - DNA, 18 bp, Homo sapiens
ctcttagattcttaattc

SEQ ID NO: 1363408 - DNA, 18 bp, Homo sapiens
ctcttcattattctctgc

SEQ ID NO: 1363409 - DNA, 14 bp, Homo sapiens
ctcttccccccaaa

SEQ ID NO: 1363410 - DNA, 13 bp, Homo sapiens
ctcttcctgtgat

SEQ ID NO: 1363411 - DNA, 14 bp, Homo sapiens
ctcttgaccaggct

SEQ ID NO: 1363412 - DNA, 15 bp, Homo sapiens
ctcttgaccaggctg

SEQ ID NO: 1363413 - DNA, 15 bp, Homo sapiens
ctcttgagctggcct

SEQ ID NO: 1363414 - DNA, 14 bp, Homo sapiens
cgtctatcctgtgt

SEQ ID NO: 1363415 - DNA, 11 bp, Homo sapiens
cgtctgtgtgc

SEQ ID NO: 1363416 - DNA, 15 bp, Homo sapiens
cgtgaaaacggagct

SEQ ID NO: 1363417 - DNA, 23 bp, Homo sapiens
cgtgaaagtgcatttttgtaaat

SEQ ID NO: 1363418 - DNA, 18 bp, Homo sapiens
cgtgacccgacctggccg

SEQ ID NO: 1363419 - DNA, 14 bp, Homo sapiens
cgtgcctgtgtcca

SEQ ID NO: 1363420 - DNA, 15 bp, Homo sapiens
cgtggactgagtggg

SEQ ID NO: 1363421 - DNA, 21 bp, Homo sapiens
cgtggactgagtgggaagccc

SEQ ID NO: 1363422 - DNA, 20 bp, Homo sapiens
cgtgggacggtgcccaagcc

SEQ ID NO: 1363423 - DNA, 20 bp, Homo sapiens
cgtgggctcccgtgttttgt

SEQ ID NO: 1363424 - DNA, 22 bp, Homo sapiens
cgtggggcagggagctgggccc

SEQ ID NO: 1363425 - DNA, 15 bp, Homo sapiens
cgtggggtgtgctgg

SEQ ID NO: 1363426 - DNA, 17 bp, Homo sapiens
cgtggggtgtgctggga

SEQ ID NO: 1363427 - DNA, 18 bp, Homo sapiens
cgtggggtgtgctgggag

SEQ ID NO: 1363428 - DNA, 19 bp, Homo sapiens
cgtgggtcctgaggcctgc

SEQ ID NO: 1363429 - DNA, 15 bp, Homo sapiens
cgttagctcctgtgg

SEQ ID NO: 1363430 - DNA, 16 bp, Homo sapiens
cgttagctcctgtggc

SEQ ID NO: 1363431 - DNA, 21 bp, Homo sapiens
cgttccaccccaagagaactc

SEQ ID NO: 1363432 - DNA, 20 bp, Homo sapiens
cgttctgtactgttactggg

SEQ ID NO: 1363433 - DNA, 23 bp, Homo sapiens
cgttctgtactgttactgggccc

SEQ ID NO: 1363434 - DNA, 16 bp, Homo sapiens
cgttggagaagcccgt

SEQ ID NO: 1363435 - DNA, 18 bp, Homo sapiens
cgtttggtgcttctcaga

SEQ ID NO: 1363436 - DNA, 17 bp, Homo sapiens
ctaaaaagtataaaata

SEQ ID NO: 1363437 - DNA, 17 bp, Homo sapiens
ctaaacctcagttatta

SEQ ID NO: 1363438 - DNA, 23 bp, Homo sapiens
ctaaagaaaaatatcttggccta

SEQ ID NO: 1363439 - DNA, 15 bp, Homo sapiens
ctaaagagcccttgc

SEQ ID NO: 1363440 - DNA, 18 bp, Homo sapiens
ctaaagagcccttgcctc

SEQ ID NO: 1363441 - DNA, 23 bp, Homo sapiens
ctaaagagcccttgcctccccat

SEQ ID NO: 1363442 - DNA, 15 bp, Homo sapiens
ctaaagcaatagaaa

SEQ ID NO: 1363443 - DNA, 16 bp, Homo sapiens
ctaaagcaatagaaac

SEQ ID NO: 1363444 - DNA, 20 bp, Homo sapiens
ctaaagtgtattttcagagc

SEQ ID NO: 1363445 - DNA, 14 bp, Homo sapiens
ctaaatcagagaca

SEQ ID NO: 1363446 - DNA, 16 bp, Homo sapiens
ctaaatggcctcatgt

SEQ ID NO: 1363447 - DNA, 19 bp, Homo sapiens
ctaaatggcctcatgtggc

SEQ ID NO: 1363448 - DNA, 21 bp, Homo sapiens
ctaaatgtttggcatgtaaat

SEQ ID NO: 1363449 - DNA, 13 bp, Homo sapiens
ctaaatttcacta

SEQ ID NO: 1363450 - DNA, 20 bp, Homo sapiens
ctaacagtgaagttttactg

SEQ ID NO: 1363451 - DNA, 22 bp, Homo sapiens
ctaacatggtgaaaccccgtct

SEQ ID NO: 1363452 - DNA, 13 bp, Homo sapiens
ctaaccccttcca

SEQ ID NO: 1363453 - DNA, 13 bp, Homo sapiens
ctaacctcgccct

SEQ ID NO: 1363454 - DNA, 16 bp, Homo sapiens
ctaactcaaatacaca

SEQ ID NO: 1363455 - DNA, 20 bp, Homo sapiens
ctaactcaaatacacatttg

SEQ ID NO: 1363456 - DNA, 14 bp, Homo sapiens
ctaactgtaaatca

SEQ ID NO: 1363457 - DNA, 15 bp, Homo sapiens
ctaactgtaaatcat

SEQ ID NO: 1363458 - DNA, 22 bp, Homo sapiens
ctaagaaaagcctaatcacagt

SEQ ID NO: 1363459 - DNA, 13 bp, Homo sapiens
ctaagactatata

SEQ ID NO: 1363460 - DNA, 14 bp, Homo sapiens
cttaaatttcttat

SEQ ID NO: 1363461 - DNA, 17 bp, Homo sapiens
cttaagaaatgtataaa

SEQ ID NO: 1363462 - DNA, 19 bp, Homo sapiens
cttaagtaatcatctaagt

SEQ ID NO: 1363463 - DNA, 19 bp, Homo sapiens
cttaagtgaggaaatcaaa

SEQ ID NO: 1363464 - DNA, 20 bp, Homo sapiens
cttaagttagcctccaccac

SEQ ID NO: 1363465 - DNA, 21 bp, Homo sapiens
cttaatttcctttttgacact

SEQ ID NO: 1363466 - DNA, 23 bp, Homo sapiens
cttaatttcctttttgacactga

SEQ ID NO: 1363467 - DNA, 20 bp, Homo sapiens
cttacaatattgattgggaa

SEQ ID NO: 1363468 - DNA, 21 bp, Homo sapiens
cttacctagtgaaacttttct

SEQ ID NO: 1363469 - DNA, 15 bp, Homo sapiens
cttactaaaaagtat

SEQ ID NO: 1363470 - DNA, 18 bp, Homo sapiens
cttactaaaaagtataaa

SEQ ID NO: 1363471 - DNA, 15 bp, Homo sapiens
cttactacagaaatg

SEQ ID NO: 1363472 - DNA, 13 bp, Homo sapiens
cttactttgctga

SEQ ID NO: 1363473 - DNA, 15 bp, Homo sapiens
cttactttgtaaatt

SEQ ID NO: 1363474 - DNA, 20 bp, Homo sapiens
cttactttgtaaattctgat

SEQ ID NO: 1363475 - DNA, 21 bp, Homo sapiens
cttactttgtaaattctgatt

SEQ ID NO: 1363476 - DNA, 20 bp, Homo sapiens
cttagaaaaaccaccaccat

SEQ ID NO: 1363477 - DNA, 18 bp, Homo sapiens
cttagatcatagttttat

SEQ ID NO: 1363478 - DNA, 22 bp, Homo sapiens
cttagatcatagttttatttat

SEQ ID NO: 1363479 - DNA, 16 bp, Homo sapiens
cttagattcttaattc

SEQ ID NO: 1363480 - DNA, 15 bp, Homo sapiens
cttaggccttcctct

SEQ ID NO: 1363481 - DNA, 17 bp, Homo sapiens
cttaggccttcctctct

SEQ ID NO: 1363482 - DNA, 23 bp, Homo sapiens
cttaggccttcctctctccagat

SEQ ID NO: 1363483 - DNA, 12 bp, Homo sapiens
cttataaaacag

SEQ ID NO: 1363484 - DNA, 14 bp, Homo sapiens
cttataaaacagag

SEQ ID NO: 1363485 - DNA, 19 bp, Homo sapiens
cttataaaatcctgtgcaa

SEQ ID NO: 1363486 - DNA, 20 bp, Homo sapiens
cttataaagtggaagtatgt

SEQ ID NO: 1363487 - DNA, 24 bp, Homo sapiens
cttataaagtggaagtatgtatat

SEQ ID NO: 1363488 - DNA, 19 bp, Homo sapiens
cttataagtgaagtgatac

SEQ ID NO: 1363489 - DNA, 20 bp, Homo sapiens
cttataagtgaagtgatact

SEQ ID NO: 1363490 - DNA, 21 bp, Homo sapiens
cttatgattaaacttccttct

SEQ ID NO: 1363491 - DNA, 13 bp, Homo sapiens
cttatgtgacatt

SEQ ID NO: 1363492 - DNA, 22 bp, Homo sapiens
cttattgacaaccgagaaggtt

SEQ ID NO: 1363493 - DNA, 18 bp, Homo sapiens
cttatttggcgtgacccg

SEQ ID NO: 1363494 - DNA, 15 bp, Homo sapiens
cttcaaagccttctc

SEQ ID NO: 1363495 - DNA, 15 bp, Homo sapiens
cttcacagtagagcc

SEQ ID NO: 1363496 - DNA, 17 bp, Homo sapiens
cttcacagtagagccag

SEQ ID NO: 1363497 - DNA, 21 bp, Homo sapiens
cttcacagtagagccagcttg

SEQ ID NO: 1363498 - DNA, 19 bp, Homo sapiens
cttcagacagagaggactg

SEQ ID NO: 1363499 - DNA, 23 bp, Homo sapiens
cttcagctccagggaatccaagc

SEQ ID NO: 1363500 - DNA, 19 bp, Homo sapiens
cttcagctgacttttctgt

SEQ ID NO: 1363501 - DNA, 16 bp, Homo sapiens
cttcagggctgctggg

SEQ ID NO: 1363502 - DNA, 16 bp, Homo sapiens
cttcagtaagccgtga

SEQ ID NO: 1363503 - DNA, 23 bp, Homo sapiens
cttcagtaagccgtgattttcat

SEQ ID NO: 1363504 - DNA, 17 bp, Homo sapiens
cttcagtcccttcccca

SEQ ID NO: 1363505 - DNA, 15 bp, Homo sapiens
cttcagttgcttgtc

SEQ ID NO: 1363506 - DNA, 18 bp, Homo sapiens
cttcatgcacttaaagaa

SEQ ID NO: 1363507 - DNA, 14 bp, Homo sapiens
cttcattattttaa

SEQ ID NO: 1363508 - DNA, 15 bp, Homo sapiens
cttccaaataaataa

SEQ ID NO: 1363509 - DNA, 17 bp, Homo sapiens
cttccagatcactgcca

SEQ ID NO: 1363510 - DNA, 20 bp, Homo sapiens
cttccagatcactgccacac

SEQ ID NO: 1363511 - DNA, 19 bp, Homo sapiens
cttccagatggtcatccag

SEQ ID NO: 1363512 - DNA, 21 bp, Homo sapiens
cttccagcatttagctggcca

SEQ ID NO: 1363513 - DNA, 22 bp, Homo sapiens
cttccaggaaactccacatctg

SEQ ID NO: 1363514 - DNA, 13 bp, Homo sapiens
cttccatgaattt

SEQ ID NO: 1363515 - DNA, 12 bp, Homo sapiens
cttccattccac

SEQ ID NO: 1363516 - DNA, 19 bp, Homo sapiens
cttccccatgcttccttgc

SEQ ID NO: 1363517 - DNA, 18 bp, Homo sapiens
cttccccggagggctgcg

SEQ ID NO: 1363518 - DNA, 17 bp, Homo sapiens
cttccctacagttgaaa

SEQ ID NO: 1363519 - DNA, 17 bp, Homo sapiens
cttccgcagtgtggcca

SEQ ID NO: 1363520 - DNA, 18 bp, Homo sapiens
cttcctctagaagccaag

SEQ ID NO: 1363521 - DNA, 15 bp, Homo sapiens
cttcctctctccaga

SEQ ID NO: 1363522 - DNA, 19 bp, Homo sapiens
cttccttaattcactccca

SEQ ID NO: 1363523 - DNA, 21 bp, Homo sapiens
cttccttgaagaactgcaggc

SEQ ID NO: 1363524 - DNA, 14 bp, Homo sapiens
cttccttttccctg

SEQ ID NO: 1363525 - DNA, 16 bp, Homo sapiens
cttccttttccctgct

SEQ ID NO: 1363526 - DNA, 20 bp, Homo sapiens
cttcgggaggtcgaggcagg

SEQ ID NO: 1363527 - DNA, 18 bp, Homo sapiens
cttcgggcgtctgtgtgc

SEQ ID NO: 1363528 - DNA, 15 bp, Homo sapiens
cttctagagttttat

SEQ ID NO: 1363529 - DNA, 16 bp, Homo sapiens
cttctagtcttggcca

SEQ ID NO: 1363530 - DNA, 16 bp, Homo sapiens
cttctcactgccatgc

SEQ ID NO: 1363531 - DNA, 21 bp, Homo sapiens
cttctcactgccatgccagct

SEQ ID NO: 1363532 - DNA, 16 bp, Homo sapiens
cttctcagaagcacag

SEQ ID NO: 1363533 - DNA, 19 bp, Homo sapiens
cttctcagatttctgagga

SEQ ID NO: 1363534 - DNA, 16 bp, Homo sapiens
cttctccctagctcct

SEQ ID NO: 1363535 - DNA, 15 bp, Homo sapiens
cttctccgccagcct

SEQ ID NO: 1363536 - DNA, 19 bp, Homo sapiens
cttctccgccagcctcctc

SEQ ID NO: 1363537 - DNA, 13 bp, Homo sapiens
cttctctcctccc

SEQ ID NO: 1363538 - DNA, 20 bp, Homo sapiens
cttctctgacttctgcctgg

SEQ ID NO: 1363539 - DNA, 18 bp, Homo sapiens
cttctctgtgagaaggtt

SEQ ID NO: 1363540 - DNA, 12 bp, Homo sapiens
cttctgcctgca

SEQ ID NO: 1363541 - DNA, 13 bp, Homo sapiens
cttctgcctggag

SEQ ID NO: 1363542 - DNA, 16 bp, Homo sapiens
cttctgcctggagact

SEQ ID NO: 1363543 - DNA, 14 bp, Homo sapiens
cttctgcttttctg

SEQ ID NO: 1363544 - DNA, 19 bp, Homo sapiens
cttctgcttttctgccctg

SEQ ID NO: 1363545 - DNA, 15 bp, Homo sapiens
cttctggggcaggct

SEQ ID NO: 1363546 - DNA, 16 bp, Homo sapiens
cttctggggcaggctg

SEQ ID NO: 1363547 - DNA, 19 bp, Homo sapiens
cttctggggcaggctgggc

SEQ ID NO: 1363548 - DNA, 22 bp, Homo sapiens
cttctggggcaggctgggccat

SEQ ID NO: 1363549 - DNA, 23 bp, Homo sapiens
cttctgtgcccagaatactgatg

SEQ ID NO: 1363550 - DNA, 19 bp, Homo sapiens
cttcttaaagtattcttct

SEQ ID NO: 1363551 - DNA, 13 bp, Homo sapiens
cttcttgcctctg

SEQ ID NO: 1363552 - DNA, 16 bp, Homo sapiens
cttcttgcctctgtgc

SEQ ID NO: 1363553 - DNA, 11 bp, Homo sapiens
cttcttgggat

SEQ ID NO: 1363554 - DNA, 21 bp, Homo sapiens
cttcttggggcccagtgcatg

SEQ ID NO: 1363555 - DNA, 23 bp, Homo sapiens
cttcttggggcccagtgcatggt

SEQ ID NO: 1363556 - DNA, 12 bp, Homo sapiens
cttctttaaaca

SEQ ID NO: 1363557 - DNA, 17 bp, Homo sapiens
cttctttaattgatcta

SEQ ID NO: 1363558 - DNA, 15 bp, Homo sapiens
cttgaaaagagacag

SEQ ID NO: 1363559 - DNA, 18 bp, Homo sapiens
cttgaaactttgggaaaa

SEQ ID NO: 1363560 - DNA, 20 bp, Homo sapiens
cttgaatccttccattccac

SEQ ID NO: 1363561 - DNA, 12 bp, Homo sapiens
cttgagccctgg

SEQ ID NO: 1363562 - DNA, 13 bp, Homo sapiens
cttgagccctggc

SEQ ID NO: 1363563 - DNA, 15 bp, Homo sapiens
cttgagcctgggagg

SEQ ID NO: 1363564 - DNA, 13 bp, Homo sapiens
cttgagctggcct

SEQ ID NO: 1363565 - DNA, 14 bp, Homo sapiens
cttgagggctgcag

SEQ ID NO: 1363566 - DNA, 23 bp, Homo sapiens
cttgagggctgcagttctactca

SEQ ID NO: 1363567 - DNA, 18 bp, Homo sapiens
cttgcaagcatgcttgtg

SEQ ID NO: 1363568 - DNA, 20 bp, Homo sapiens
cttgccagagccgggcacat

SEQ ID NO: 1363569 - DNA, 12 bp, Homo sapiens
cttgcccatcct

SEQ ID NO: 1363570 - DNA, 15 bp, Homo sapiens
cttgcctccaggtgc

SEQ ID NO: 1363571 - DNA, 16 bp, Homo sapiens
cttgcctccaggtgca

SEQ ID NO: 1363572 - DNA, 14 bp, Homo sapiens
cttgcctccccatt

SEQ ID NO: 1363573 - DNA, 13 bp, Homo sapiens
cttgcctctgtgc

SEQ ID NO: 1363574 - DNA, 16 bp, Homo sapiens
cttgcctcttccttga

SEQ ID NO: 1363575 - DNA, 12 bp, Homo sapiens
cttgctggcccc

SEQ ID NO: 1363576 - DNA, 15 bp, Homo sapiens
cttgctggccccagc

SEQ ID NO: 1363577 - DNA, 16 bp, Homo sapiens
cttgctggccccagcc

SEQ ID NO: 1363578 - DNA, 21 bp, Homo sapiens
cttgctggccccagccctgct

SEQ ID NO: 1363579 - DNA, 22 bp, Homo sapiens
cttgctggccccagccctgctg

SEQ ID NO: 1363580 - DNA, 19 bp, Homo sapiens
cttgctgtttgtcctgaga

SEQ ID NO: 1363581 - DNA, 15 bp, Homo sapiens
cttgcttatttgaca

SEQ ID NO: 1363582 - DNA, 17 bp, Homo sapiens
cttgcttccctaatcta

SEQ ID NO: 1363583 - DNA, 12 bp, Homo sapiens
cttgcttgcctg

SEQ ID NO: 1363584 - DNA, 17 bp, Homo sapiens
cttgcttgcctgcaggg

SEQ ID NO: 1363585 - DNA, 17 bp, Homo sapiens
cttgcttttctgtattt

SEQ ID NO: 1363586 - DNA, 21 bp, Homo sapiens
cttggacatcctcctcccacc

SEQ ID NO: 1363587 - DNA, 12 bp, Homo sapiens
cttggcctgctg

SEQ ID NO: 1363588 - DNA, 16 bp, Homo sapiens
cttggcctgctgtgat

SEQ ID NO: 1363589 - DNA, 14 bp, Homo sapiens
cttggcctgggccg

SEQ ID NO: 1363590 - DNA, 14 bp, Homo sapiens
cttggctcagacat

SEQ ID NO: 1363591 - DNA, 16 bp, Homo sapiens
cttggctcagacatgt

SEQ ID NO: 1363592 - DNA, 19 bp, Homo sapiens
cttggctcgaatctctgtg

SEQ ID NO: 1363593 - DNA, 21 bp, Homo sapiens
cttggctcgaatctctgtgcc

SEQ ID NO: 1363594 - DNA, 22 bp, Homo sapiens
cttggctcgaatctctgtgcct

SEQ ID NO: 1363595 - DNA, 14 bp, Homo sapiens
cttggcttaatcat

SEQ ID NO: 1363596 - DNA, 16 bp, Homo sapiens
cttgggaggcttcccc

SEQ ID NO: 1363597 - DNA, 13 bp, Homo sapiens
cttgggcagagct

SEQ ID NO: 1363598 - DNA, 14 bp, Homo sapiens
cttgggcagagctg

SEQ ID NO: 1363599 - DNA, 17 bp, Homo sapiens
cttgggccacccctcct

SEQ ID NO: 1363600 - DNA, 20 bp, Homo sapiens
cttgggccactgtgaagaga

SEQ ID NO: 1363601 - DNA, 21 bp, Homo sapiens
cttgggctatttggactcagg

SEQ ID NO: 1363602 - DNA, 23 bp, Homo sapiens
cttggggccaccaaagctgccca

SEQ ID NO: 1363603 - DNA, 12 bp, Homo sapiens
cttggggcccag

SEQ ID NO: 1363604 - DNA, 15 bp, Homo sapiens
cttggggcccagtgc

SEQ ID NO: 1363605 - DNA, 16 bp, Homo sapiens
cttggggggctgaggt

SEQ ID NO: 1363606 - DNA, 16 bp, Homo sapiens
cttgggggggtggccg

SEQ ID NO: 1363607 - DNA, 20 bp, Homo sapiens
cttggggttttcagtatgaa

SEQ ID NO: 1363608 - DNA, 12 bp, Homo sapiens
cttggtgtaatt

SEQ ID NO: 1363609 - DNA, 12 bp, Homo sapiens
cttgtaaagact

SEQ ID NO: 1363610 - DNA, 20 bp, Homo sapiens
cttgtagttctttaaactgt

SEQ ID NO: 1363611 - DNA, 13 bp, Homo sapiens
cttgtgaaaatgt

SEQ ID NO: 1363612 - DNA, 23 bp, Homo sapiens
cttgtgatccactcgcctcagcc

SEQ ID NO: 1363613 - DNA, 15 bp, Homo sapiens
cttgtgattatttat

SEQ ID NO: 1363614 - DNA, 16 bp, Homo sapiens
cttgtgatttctttaa

SEQ ID NO: 1363615 - DNA, 23 bp, Homo sapiens
cttgtgatttctttaaaagaatg

SEQ ID NO: 1363616 - DNA, 14 bp, Homo sapiens
cttgtgcctggggt

SEQ ID NO: 1363617 - DNA, 14 bp, Homo sapiens
cttgtgggtccatg

SEQ ID NO: 1363618 - DNA, 22 bp, Homo sapiens
cttgtgtctttggaggtgctgc

SEQ ID NO: 1363619 - DNA, 15 bp, Homo sapiens
cttgttacttctgag

SEQ ID NO: 1363620 - DNA, 20 bp, Homo sapiens
cttgttgctcaaaaaatgag

SEQ ID NO: 1363621 - DNA, 16 bp, Homo sapiens
cttgtttttgcacatg

SEQ ID NO: 1363622 - DNA, 16 bp, Homo sapiens
ctttaaaaggaaagaa

SEQ ID NO: 1363623 - DNA, 18 bp, Homo sapiens
ctttaaccttgtataaat

SEQ ID NO: 1363624 - DNA, 14 bp, Homo sapiens
ctttaagacatact

SEQ ID NO: 1363625 - DNA, 20 bp, Homo sapiens
ctttaagccttcaaaactat

SEQ ID NO: 1363626 - DNA, 20 bp, Homo sapiens
ctttaaggggaggaaccaga

SEQ ID NO: 1363627 - DNA, 17 bp, Homo sapiens
ctttacccacctagaac

SEQ ID NO: 1363628 - DNA, 18 bp, Homo sapiens
ctttacccacctagaaca

SEQ ID NO: 1363629 - DNA, 23 bp, Homo sapiens
ctttactgcctgaataaagagcc

SEQ ID NO: 1363630 - DNA, 16 bp, Homo sapiens
ctttagaccctgggtg

SEQ ID NO: 1363631 - DNA, 23 bp, Homo sapiens
ctttagaccctgggtgggctctg

SEQ ID NO: 1363632 - DNA, 12 bp, Homo sapiens
ctttagacttga

SEQ ID NO: 1363633 - DNA, 14 bp, Homo sapiens
ctttagacttgaaa

SEQ ID NO: 1363634 - DNA, 15 bp, Homo sapiens
ctttagacttgaaaa

SEQ ID NO: 1363635 - DNA, 23 bp, Homo sapiens
ctttagtttttggttgggaatga

SEQ ID NO: 1363636 - DNA, 13 bp, Homo sapiens
ctttataaatcca

SEQ ID NO: 1363637 - DNA, 18 bp, Homo sapiens
ctttataaatccagtgac

SEQ ID NO: 1363638 - DNA, 17 bp, Homo sapiens
ctttatgtgaattttta

SEQ ID NO: 1363639 - DNA, 20 bp, Homo sapiens
ctttatttgaacaatgaagt

SEQ ID NO: 1363640 - DNA, 17 bp, Homo sapiens
ctttattttgagatgta

SEQ ID NO: 1363641 - DNA, 22 bp, Homo sapiens
ctttattttgagatgtaaaaag

SEQ ID NO: 1363642 - DNA, 18 bp, Homo sapiens
ctttattttgtgtaaaaa

SEQ ID NO: 1363643 - DNA, 12 bp, Homo sapiens
ctttcaaagctt

SEQ ID NO: 1363644 - DNA, 20 bp, Homo sapiens
ctttcaagcagtcgtgcctg

SEQ ID NO: 1363645 - DNA, 19 bp, Homo sapiens
ctttcaattgtcacttttt

SEQ ID NO: 1363646 - DNA, 23 bp, Homo sapiens
ctttcagaaatataacacatttt

SEQ ID NO: 1363647 - DNA, 22 bp, Homo sapiens
ctttccaaaccttatctccaca

SEQ ID NO: 1363648 - DNA, 18 bp, Homo sapiens
ctttccaaatgcccagct

SEQ ID NO: 1363649 - DNA, 15 bp, Homo sapiens
ctttcccaagccttc

SEQ ID NO: 1363650 - DNA, 16 bp, Homo sapiens
ctttcccatggggagg

SEQ ID NO: 1363651 - DNA, 19 bp, Homo sapiens
ctttccctcaccccctccc

SEQ ID NO: 1363652 - DNA, 20 bp, Homo sapiens
ctttctcaaagaaatattaa

SEQ ID NO: 1363653 - DNA, 21 bp, Homo sapiens
ctttctgccatctagccagcc

SEQ ID NO: 1363654 - DNA, 17 bp, Homo sapiens
ctttgagaagccttcag

SEQ ID NO: 1363655 - DNA, 12 bp, Homo sapiens
ctttgatgtgtt

SEQ ID NO: 1363656 - DNA, 15 bp, Homo sapiens
ctttgatgtgttgtt

SEQ ID NO: 1363657 - DNA, 18 bp, Homo sapiens
ctttgatgtgttgttctt

SEQ ID NO: 1363658 - DNA, 16 bp, Homo sapiens
ctttgattatttgcat

SEQ ID NO: 1363659 - DNA, 17 bp, Homo sapiens
ctttgattatttgcatg

SEQ ID NO: 1363660 - DNA, 18 bp, Homo sapiens
ctttgattatttgcatgt

SEQ ID NO: 1363661 - DNA, 21 bp, Homo sapiens
ctttgattatttgcatgttat

SEQ ID NO: 1363662 - DNA, 14 bp, Homo sapiens
ctttgctgtcccat

SEQ ID NO: 1363663 - DNA, 22 bp, Homo sapiens
ctttgctgtcccatagtccctg

SEQ ID NO: 1363664 - DNA, 23 bp, Homo sapiens
ctttgctgtcccatagtccctgc

SEQ ID NO: 1363665 - DNA, 21 bp, Homo sapiens
ctttggacctaaatggcctca

SEQ ID NO: 1363666 - DNA, 18 bp, Homo sapiens
ctttggattctaaataca

SEQ ID NO: 1363667 - DNA, 20 bp, Homo sapiens
ctttggattctaaatacatg

SEQ ID NO: 1363668 - DNA, 13 bp, Homo sapiens
ctttgtaaaaatc

SEQ ID NO: 1363669 - DNA, 16 bp, Homo sapiens
ctttgtaaattctgat

SEQ ID NO: 1363670 - DNA, 17 bp, Homo sapiens
ctttgtaaattctgatt

SEQ ID NO: 1363671 - DNA, 15 bp, Homo sapiens
ctttgtatagttatg

SEQ ID NO: 1363672 - DNA, 21 bp, Homo sapiens
ctttgtatagttatgtaaata

SEQ ID NO: 1363673 - DNA, 12 bp, Homo sapiens
ctttgtattgtc

SEQ ID NO: 1363674 - DNA, 17 bp, Homo sapiens
ctttgtattttgattat

SEQ ID NO: 1363675 - DNA, 18 bp, Homo sapiens
ctttgttgcaagatgtga

SEQ ID NO: 1363676 - DNA, 21 bp, Homo sapiens
ctttgttgcaagatgtgaatt

SEQ ID NO: 1363677 - DNA, 20 bp, Homo sapiens
ctttgtttgttgtcagctga

SEQ ID NO: 1363678 - DNA, 16 bp, Homo sapiens
gaccgggccctgggtt

SEQ ID NO: 1363679 - DNA, 13 bp, Homo sapiens
gacctactctcat

SEQ ID NO: 1363680 - DNA, 18 bp, Homo sapiens
gacctcaggtgagaagca

SEQ ID NO: 1363681 - DNA, 18 bp, Homo sapiens
gacctggcactggatgca

SEQ ID NO: 1363682 - DNA, 13 bp, Homo sapiens
gaccttaggcctt

SEQ ID NO: 1363683 - DNA, 18 bp, Homo sapiens
gaccttaggccttcctct

SEQ ID NO: 1363684 - DNA, 17 bp, Homo sapiens
gaccttgttacttctga

SEQ ID NO: 1363685 - DNA, 13 bp, Homo sapiens
gacctttccacca

SEQ ID NO: 1363686 - DNA, 17 bp, Homo sapiens
gacctttccaccacagc

SEQ ID NO: 1363687 - DNA, 21 bp, Homo sapiens
gacctttccaccacagccagc

SEQ ID NO: 1363688 - DNA, 23 bp, Homo sapiens
gacctttccaccacagccagcac

SEQ ID NO: 1363689 - DNA, 15 bp, Homo sapiens
gacgagttgatttcc

SEQ ID NO: 1363690 - DNA, 11 bp, Homo sapiens
gacggcaggct

SEQ ID NO: 1363691 - DNA, 16 bp, Homo sapiens
gacggtgcccaagcca

SEQ ID NO: 1363692 - DNA, 18 bp, Homo sapiens
gacggtttccagggaggg

SEQ ID NO: 1363693 - DNA, 23 bp, Homo sapiens
gacgtttataaacagaaatggaa

SEQ ID NO: 1363694 - DNA, 15 bp, Homo sapiens
gactaattttacatg

SEQ ID NO: 1363695 - DNA, 23 bp, Homo sapiens
gactaattttacatgtttataaa

SEQ ID NO: 1363696 - DNA, 17 bp, Homo sapiens
gactagcaatctcttca

SEQ ID NO: 1363697 - DNA, 16 bp, Homo sapiens
gactatataatttatt

SEQ ID NO: 1363698 - DNA, 20 bp, Homo sapiens
gactatgcgtggctggaacc

SEQ ID NO: 1363699 - DNA, 18 bp, Homo sapiens
gactcagagctctctcta

SEQ ID NO: 1363700 - DNA, 12 bp, Homo sapiens
gactcagccttc

SEQ ID NO: 1363701 - DNA, 16 bp, Homo sapiens
gactcaggtgggccct

SEQ ID NO: 1363702 - DNA, 9 bp, Homo sapiens
gactccagc

SEQ ID NO: 1363703 - DNA, 10 bp, Homo sapiens
gactccagcc

SEQ ID NO: 1363704 - DNA, 13 bp, Homo sapiens
gactccagccagc

SEQ ID NO: 1363705 - DNA, 22 bp, Homo sapiens
gactccagccagcgcctccctc

SEQ ID NO: 1363706 - DNA, 13 bp, Homo sapiens
gactcgactctgt

SEQ ID NO: 1363707 - DNA, 19 bp, Homo sapiens
gactcggggtgcttccttg

SEQ ID NO: 1363708 - DNA, 13 bp, Homo sapiens
gactcggtttctc

SEQ ID NO: 1363709 - DNA, 19 bp, Homo sapiens
gactcggtttctccaaact

SEQ ID NO: 1363710 - DNA, 19 bp, Homo sapiens
gactctgggtccttcctga

SEQ ID NO: 1363711 - DNA, 14 bp, Homo sapiens
gactcttgggaggg

SEQ ID NO: 1363712 - DNA, 15 bp, Homo sapiens
gactgagtgggaagc

SEQ ID NO: 1363713 - DNA, 13 bp, Homo sapiens
gactgattttaat

SEQ ID NO: 1363714 - DNA, 15 bp, Homo sapiens
gactgcccggcaggg

SEQ ID NO: 1363715 - DNA, 17 bp, Homo sapiens
gactgctaaataaaatt

SEQ ID NO: 1363716 - DNA, 18 bp, Homo sapiens
gactgctaaataaaattt

SEQ ID NO: 1363717 - DNA, 21 bp, Homo sapiens
gactgctacctttcaaagctt

SEQ ID NO: 1363718 - DNA, 20 bp, Homo sapiens
gactggcttttattaatgca

SEQ ID NO: 1363719 - DNA, 23 bp, Homo sapiens
gactggcttttattaatgcactt

SEQ ID NO: 1363720 - DNA, 14 bp, Homo sapiens
gactggttttctgc

SEQ ID NO: 1363721 - DNA, 20 bp, Homo sapiens
gacttagaatccctgtgtta

SEQ ID NO: 1363722 - DNA, 23 bp, Homo sapiens
gacttagaatccctgtgttaatt

SEQ ID NO: 1363723 - DNA, 17 bp, Homo sapiens
gacttagggcaccaggg

SEQ ID NO: 1363724 - DNA, 17 bp, Homo sapiens
gacttcaaagcaagctg

SEQ ID NO: 1363725 - DNA, 20 bp, Homo sapiens
gacttccccggagggctgcg

SEQ ID NO: 1363726 - DNA, 14 bp, Homo sapiens
gacttccttgagac

SEQ ID NO: 1363727 - DNA, 15 bp, Homo sapiens
gacttctacctgccc

SEQ ID NO: 1363728 - DNA, 13 bp, Homo sapiens
gacttctgcctgg

SEQ ID NO: 1363729 - DNA, 14 bp, Homo sapiens
gacttctgcctgga

SEQ ID NO: 1363730 - DNA, 23 bp, Homo sapiens
gacttgtatagcatgaaataaaa

SEQ ID NO: 1363731 - DNA, 18 bp, Homo sapiens
gactttgatgtcagcagt

SEQ ID NO: 1363732 - DNA, 21 bp, Homo sapiens
gacttttctgtccgagctttg

SEQ ID NO: 1363733 - DNA, 13 bp, Homo sapiens
gactttttataaa

SEQ ID NO: 1363734 - DNA, 16 bp, Homo sapiens
gactttttataaaatg

SEQ ID NO: 1363735 - DNA, 13 bp, Homo sapiens
gactttttttgta

SEQ ID NO: 1363736 - DNA, 24 bp, Homo sapiens
gagaaacttaaatgttattatctg

SEQ ID NO: 1363737 - DNA, 15 bp, Homo sapiens
gagaaagaatttagt

SEQ ID NO: 1363738 - DNA, 18 bp, Homo sapiens
gagaaagtgtgagcaaac

SEQ ID NO: 1363739 - DNA, 12 bp, Homo sapiens
gagaacaggact

SEQ ID NO: 1363740 - DNA, 17 bp, Homo sapiens
gagaaccaaatctggaa

SEQ ID NO: 1363741 - DNA, 18 bp, Homo sapiens
gagaaccaaatctggaag

SEQ ID NO: 1363742 - DNA, 20 bp, Homo sapiens
gagaactcgcgctcagtaaa

SEQ ID NO: 1363743 - DNA, 22 bp, Homo sapiens
gagaactcgcgctcagtaaacg

SEQ ID NO: 1363744 - DNA, 20 bp, Homo sapiens
gagaagaaaggtgagtttga

SEQ ID NO: 1363745 - DNA, 15 bp, Homo sapiens
gagaagcccgtgtga

SEQ ID NO: 1363746 - DNA, 16 bp, Homo sapiens
gagaagcccgtgtgag

SEQ ID NO: 1363747 - DNA, 12 bp, Homo sapiens
gagaagctgcag

SEQ ID NO: 1363748 - DNA, 15 bp, Homo sapiens
gagaaggtttattgt

SEQ ID NO: 1363749 - DNA, 17 bp, Homo sapiens
gagaaggtttattgtta

SEQ ID NO: 1363750 - DNA, 20 bp, Homo sapiens
gagaatggcgtgaacccggg

SEQ ID NO: 1363751 - DNA, 20 bp, Homo sapiens
gagaatggtgtgaacccggg

SEQ ID NO: 1363752 - DNA, 21 bp, Homo sapiens
gagaatggtgtgaacccggga

SEQ ID NO: 1363753 - DNA, 14 bp, Homo sapiens
gagaattgggggct

SEQ ID NO: 1363754 - DNA, 18 bp, Homo sapiens
gagacaaaatatttccca

SEQ ID NO: 1363755 - DNA, 16 bp, Homo sapiens
gagacacggagcccag

SEQ ID NO: 1363756 - DNA, 16 bp, Homo sapiens
gagacactgttgataa

SEQ ID NO: 1363757 - DNA, 20 bp, Homo sapiens
gagacagatacctccaaccc

SEQ ID NO: 1363758 - DNA, 23 bp, Homo sapiens
gagacagatacctccaaccctgc

SEQ ID NO: 1363759 - DNA, 15 bp, Homo sapiens
gagaccatcctggct

SEQ ID NO: 1363760 - DNA, 16 bp, Homo sapiens
gagaccatcctggcta

SEQ ID NO: 1363761 - DNA, 18 bp, Homo sapiens
gagaccgggccctgggtt

SEQ ID NO: 1363762 - DNA, 19 bp, Homo sapiens
gagacctggcactggatgc

SEQ ID NO: 1363763 - DNA, 23 bp, Homo sapiens
gagacgtttataaacagaaatgg

SEQ ID NO: 1363764 - DNA, 16 bp, Homo sapiens
gagactcagtgcagat

SEQ ID NO: 1363765 - DNA, 23 bp, Homo sapiens
gagactcagtgcagatggagaga

SEQ ID NO: 1363766 - DNA, 18 bp, Homo sapiens
gagacttagggcaccagg

SEQ ID NO: 1363767 - DNA, 11 bp, Homo sapiens
gagactttgat

SEQ ID NO: 1363768 - DNA, 14 bp, Homo sapiens
gagagagagagagg

SEQ ID NO: 1363769 - DNA, 13 bp, Homo sapiens
gagagagaggaca

SEQ ID NO: 1363770 - DNA, 16 bp, Homo sapiens
gagagcataatttaaa

SEQ ID NO: 1363771 - DNA, 15 bp, Homo sapiens
gagagcatcggccta

SEQ ID NO: 1363772 - DNA, 12 bp, Homo sapiens
gagagcctgctg

SEQ ID NO: 1363773 - DNA, 14 bp, Homo sapiens
gagagcctgctggc

SEQ ID NO: 1363774 - DNA, 19 bp, Homo sapiens
gagagcctggtgctgctgc

SEQ ID NO: 1363775 - DNA, 15 bp, Homo sapiens
gagaggacagcttga

SEQ ID NO: 1363776 - DNA, 20 bp, Homo sapiens
gagaggactgtagggagggc

SEQ ID NO: 1363777 - DNA, 21 bp, Homo sapiens
gagaggcaggcatagaggctt

SEQ ID NO: 1363778 - DNA, 14 bp, Homo sapiens
gagagggagagaga

SEQ ID NO: 1363779 - DNA, 14 bp, Homo sapiens
gagaggtgggccag

SEQ ID NO: 1363780 - DNA, 22 bp, Homo sapiens
gagagtatttttatacaaacct

SEQ ID NO: 1363781 - DNA, 18 bp, Homo sapiens
gagataattactgccttg

SEQ ID NO: 1363782 - DNA, 17 bp, Homo sapiens
gagatcgagaccatcct

SEQ ID NO: 1363783 - DNA, 21 bp, Homo sapiens
gagatcgagaccatcctggct

SEQ ID NO: 1363784 - DNA, 21 bp, Homo sapiens
gagatgcaccaccaagccaag

SEQ ID NO: 1363785 - DNA, 16 bp, Homo sapiens
gagatgtgtggactgt

SEQ ID NO: 1363786 - DNA, 20 bp, Homo sapiens
gagatgtgtggactgtggca

SEQ ID NO: 1363787 - DNA, 24 bp, Homo sapiens
gagcagagacatgactcagcctgt

SEQ ID NO: 1363788 - DNA, 22 bp, Homo sapiens
gagcaggcacgggtggtccccg

SEQ ID NO: 1363789 - DNA, 17 bp, Homo sapiens
gagcataatttaaaaat

SEQ ID NO: 1363790 - DNA, 20 bp, Homo sapiens
gagcataatttaaaaatata

SEQ ID NO: 1363791 - DNA, 15 bp, Homo sapiens
gagcccagccctccc

SEQ ID NO: 1363792 - DNA, 16 bp, Homo sapiens
gagccctaaccccttc

SEQ ID NO: 1363793 - DNA, 18 bp, Homo sapiens
gagccctaaccccttcca

SEQ ID NO: 1363794 - DNA, 22 bp, Homo sapiens
gagcccttgcctccccatttcc

SEQ ID NO: 1363795 - DNA, 15 bp, Homo sapiens
gatatctataaaata

SEQ ID NO: 1363796 - DNA, 17 bp, Homo sapiens
gatatctataaaataga

SEQ ID NO: 1363797 - DNA, 20 bp, Homo sapiens
gatatgtattcttttctcag

SEQ ID NO: 1363798 - DNA, 16 bp, Homo sapiens
gatattgaatgttaaa

SEQ ID NO: 1363799 - DNA, 18 bp, Homo sapiens
gatattgaggccaagaat

SEQ ID NO: 1363800 - DNA, 17 bp, Homo sapiens
gatatttttcataaaca

SEQ ID NO: 1363801 - DNA, 22 bp, Homo sapiens
gatatttttcataaacaagttc

SEQ ID NO: 1363802 - DNA, 19 bp, Homo sapiens
gatcaatatttttatatca

SEQ ID NO: 1363803 - DNA, 22 bp, Homo sapiens
gcgctcagggccatgctgaggc

SEQ ID NO: 1363804 - DNA, 12 bp, Homo sapiens
gcgctcagtaaa

SEQ ID NO: 1363805 - DNA, 14 bp, Homo sapiens
gcgctccgggcttt

SEQ ID NO: 1363806 - DNA, 16 bp, Homo sapiens
gcgctctctttgcaac

SEQ ID NO: 1363807 - DNA, 23 bp, Homo sapiens
gcgctctgtggatgccagggccg

SEQ ID NO: 1363808 - DNA, 19 bp, Homo sapiens
gcgctgcccacctgccggc

SEQ ID NO: 1363809 - DNA, 23 bp, Homo sapiens
gcgctgccccatctcccctcagc

SEQ ID NO: 1363810 - DNA, 13 bp, Homo sapiens
gcgcttgctggcc

SEQ ID NO: 1363811 - DNA, 16 bp, Homo sapiens
gcggagcttgcagtga

SEQ ID NO: 1363812 - DNA, 18 bp, Homo sapiens
gcggattaatttgcatct

SEQ ID NO: 1363813 - DNA, 20 bp, Homo sapiens
gcggattaatttgcatctga

SEQ ID NO: 1363814 - DNA, 12 bp, Homo sapiens
gcggctgtgctt

SEQ ID NO: 1363815 - DNA, 16 bp, Homo sapiens
gcgggacagagtagcc

SEQ ID NO: 1363816 - DNA, 21 bp, Homo sapiens
gcgggagccatgcgccccctc

SEQ ID NO: 1363817 - DNA, 18 bp, Homo sapiens
gcggtggctcacgcctgt

SEQ ID NO: 1363818 - DNA, 17 bp, Homo sapiens
gcgtcagctgctccctg

SEQ ID NO: 1363819 - DNA, 20 bp, Homo sapiens
gcgtcctcctcacctcatgc

SEQ ID NO: 1363820 - DNA, 17 bp, Homo sapiens
gcgtgccgtggcaccag

SEQ ID NO: 1363821 - DNA, 21 bp, Homo sapiens
gcgtgcgcatcttgcctccag

SEQ ID NO: 1363822 - DNA, 22 bp, Homo sapiens
gcgtgcgcatcttgcctccagg

SEQ ID NO: 1363823 - DNA, 16 bp, Homo sapiens
gcgtggagggaggccc

SEQ ID NO: 1363824 - DNA, 21 bp, Homo sapiens
gctaaataaaatttgttgcat

SEQ ID NO: 1363825 - DNA, 16 bp, Homo sapiens
gctaactgtaaatcat

SEQ ID NO: 1363826 - DNA, 16 bp, Homo sapiens
gctacatgctggggtc

SEQ ID NO: 1363827 - DNA, 17 bp, Homo sapiens
gctacctttcaaagctt

SEQ ID NO: 1363828 - DNA, 16 bp, Homo sapiens
gctacttgggaggctg

SEQ ID NO: 1363829 - DNA, 14 bp, Homo sapiens
gctagctagctcaa

SEQ ID NO: 1363830 - DNA, 13 bp, Homo sapiens
gctaggaagagtc

SEQ ID NO: 1363831 - DNA, 13 bp, Homo sapiens
gctagtcaacagt

SEQ ID NO: 1363832 - DNA, 19 bp, Homo sapiens
gctataaagcagtattttt

SEQ ID NO: 1363833 - DNA, 21 bp, Homo sapiens
gctataaagcagtatttttct

SEQ ID NO: 1363834 - DNA, 14 bp, Homo sapiens
gctatatataaaac

SEQ ID NO: 1363835 - DNA, 16 bp, Homo sapiens
gctatgtataaaatac

SEQ ID NO: 1363836 - DNA, 15 bp, Homo sapiens
gctatgtcagtacta

SEQ ID NO: 1363837 - DNA, 18 bp, Homo sapiens
gctatttatgggcccctg

SEQ ID NO: 1363838 - DNA, 19 bp, Homo sapiens
gctatttatgggcccctgg

SEQ ID NO: 1363839 - DNA, 16 bp, Homo sapiens
gctatttattttccta

SEQ ID NO: 1363840 - DNA, 15 bp, Homo sapiens
gctcaaaaaatgagc

SEQ ID NO: 1363841 - DNA, 14 bp, Homo sapiens
gctcaaagaaatct

SEQ ID NO: 1363842 - DNA, 16 bp, Homo sapiens
gctcaccgcccatcag

SEQ ID NO: 1363843 - DNA, 15 bp, Homo sapiens
gctcactgccaggcc

SEQ ID NO: 1363844 - DNA, 22 bp, Homo sapiens
gctcactgccaggccagcctcc

SEQ ID NO: 1363845 - DNA, 15 bp, Homo sapiens
gctcagaaccacagc

SEQ ID NO: 1363846 - DNA, 20 bp, Homo sapiens
gctcagcaaaagatgcttct

SEQ ID NO: 1363847 - DNA, 13 bp, Homo sapiens
gctcaggagtttg

SEQ ID NO: 1363848 - DNA, 22 bp, Homo sapiens
gctcagtaaacgggaacatgcc

SEQ ID NO: 1363849 - DNA, 19 bp, Homo sapiens
gctcagtgtttttgtgaat

SEQ ID NO: 1363850 - DNA, 21 bp, Homo sapiens
gctcatctgctggtccgtggg

SEQ ID NO: 1363851 - DNA, 22 bp, Homo sapiens
gctcatgtgtgcaacagggtat

SEQ ID NO: 1363852 - DNA, 14 bp, Homo sapiens
gctcattaaacttt

SEQ ID NO: 1363853 - DNA, 16 bp, Homo sapiens
gctcattatgccactt

SEQ ID NO: 1363854 - DNA, 21 bp, Homo sapiens
gctccagctgttcagctggtt

SEQ ID NO: 1363855 - DNA, 17 bp, Homo sapiens
gctcccacttctgccag

SEQ ID NO: 1363856 - DNA, 13 bp, Homo sapiens
gctcccaggagcc

SEQ ID NO: 1363857 - DNA, 21 bp, Homo sapiens
gctcccaggggtctccctggc

SEQ ID NO: 1363858 - DNA, 19 bp, Homo sapiens
gctccccacagcgtccctg

SEQ ID NO: 1363859 - DNA, 22 bp, Homo sapiens
gctccccacagcgtccctggcg

SEQ ID NO: 1363860 - DNA, 16 bp, Homo sapiens
gctccctcctccaggc

SEQ ID NO: 1363861 - DNA, 17 bp, Homo sapiens
gctccctgtagggtcca

SEQ ID NO: 1363862 - DNA, 23 bp, Homo sapiens
gctccctgtagggtccaaccaga

SEQ ID NO: 1363863 - DNA, 13 bp, Homo sapiens
gctccgcaggact

SEQ ID NO: 1363864 - DNA, 15 bp, Homo sapiens
gctccgctgccgtgc

SEQ ID NO: 1363865 - DNA, 21 bp, Homo sapiens
gctccggcctctgcctttgca

SEQ ID NO: 1363866 - DNA, 12 bp, Homo sapiens
gctcctgcactt

SEQ ID NO: 1363867 - DNA, 20 bp, Homo sapiens
gctcctgcacttacttgctt

SEQ ID NO: 1363868 - DNA, 14 bp, Homo sapiens
gctcctggcccact

SEQ ID NO: 1363869 - DNA, 19 bp, Homo sapiens
gctcctggcccactgcatc

SEQ ID NO: 1363870 - DNA, 21 bp, Homo sapiens
gctcctgtggccccaccctgg

SEQ ID NO: 1363871 - DNA, 17 bp, Homo sapiens
gctcggtacccggggcc

SEQ ID NO: 1363872 - DNA, 24 bp, Homo sapiens
gctcggtacccggggcccagggca

SEQ ID NO: 1363873 - DNA, 14 bp, Homo sapiens
gctctaaaaggtaa

SEQ ID NO: 1363874 - DNA, 13 bp, Homo sapiens
gctctacgggggc

SEQ ID NO: 1363875 - DNA, 14 bp, Homo sapiens
gctctctttgcaac

SEQ ID NO: 1363876 - DNA, 21 bp, Homo sapiens
gctctgaccacttgaggcctg

SEQ ID NO: 1363877 - DNA, 18 bp, Homo sapiens
gctctgccgtctctggag

SEQ ID NO: 1363878 - DNA, 13 bp, Homo sapiens
gctctggagggga

SEQ ID NO: 1363879 - DNA, 19 bp, Homo sapiens
gctctgtgcagtcactgga

SEQ ID NO: 1363880 - DNA, 24 bp, Homo sapiens
gctctgtggatgccagggccgacc

SEQ ID NO: 1363881 - DNA, 12 bp, Homo sapiens
gctcttcttaaa

SEQ ID NO: 1363882 - DNA, 17 bp, Homo sapiens
gctgaaattctcctgga

SEQ ID NO: 1363883 - DNA, 18 bp, Homo sapiens
gctgaaattctcctggag

SEQ ID NO: 1363884 - DNA, 17 bp, Homo sapiens
gctgaatgttgggactg

SEQ ID NO: 1363885 - DNA, 23 bp, Homo sapiens
gctgaatgttgggactgctaaat

SEQ ID NO: 1363886 - DNA, 23 bp, Homo sapiens
gctgacatcttgaatccttccat

SEQ ID NO: 1363887 - DNA, 22 bp, Homo sapiens
gctgactgttttctcttgagag

SEQ ID NO: 1363888 - DNA, 15 bp, Homo sapiens
gctgagactgtgctg

SEQ ID NO: 1363889 - DNA, 19 bp, Homo sapiens
gctgagcctctgctcccca

SEQ ID NO: 1363890 - DNA, 16 bp, Homo sapiens
gctgagcctgcaggga

SEQ ID NO: 1363891 - DNA, 13 bp, Homo sapiens
gctgaggcctggg

SEQ ID NO: 1363892 - DNA, 20 bp, Homo sapiens
gctgaggcctgggccgctgc

SEQ ID NO: 1363893 - DNA, 18 bp, Homo sapiens
gctgaggttcctctgcct

SEQ ID NO: 1363894 - DNA, 23 bp, Homo sapiens
gctgagtgggggatcacagcctc

SEQ ID NO: 1363895 - DNA, 22 bp, Homo sapiens
gctgatggtgtggcctgtggct

SEQ ID NO: 1363896 - DNA, 17 bp, Homo sapiens
gtaacattcatgttcta

SEQ ID NO: 1363897 - DNA, 13 bp, Homo sapiens
gtaactgtcctgt

SEQ ID NO: 1363898 - DNA, 16 bp, Homo sapiens
gtaactgtcctgtcct

SEQ ID NO: 1363899 - DNA, 19 bp, Homo sapiens
gtaacttccaaataaataa

SEQ ID NO: 1363900 - DNA, 21 bp, Homo sapiens
gtaacttgcttaaatttctta

SEQ ID NO: 1363901 - DNA, 19 bp, Homo sapiens
gtaacttttgtaaatacac

SEQ ID NO: 1363902 - DNA, 13 bp, Homo sapiens
gtaagaaggcaat

SEQ ID NO: 1363903 - DNA, 18 bp, Homo sapiens
gtaagatcactgtttaga

SEQ ID NO: 1363904 - DNA, 16 bp, Homo sapiens
gtaagtgggcccaccc

SEQ ID NO: 1363905 - DNA, 16 bp, Homo sapiens
gtaataatagactgta

SEQ ID NO: 1363906 - DNA, 16 bp, Homo sapiens
gtaatatttattaaat

SEQ ID NO: 1363907 - DNA, 23 bp, Homo sapiens
gtaatcctagcactttgggaggc

SEQ ID NO: 1363908 - DNA, 20 bp, Homo sapiens
gtaatctttacctgtataca

SEQ ID NO: 1363909 - DNA, 13 bp, Homo sapiens
gtaattgtgaaaa

SEQ ID NO: 1363910 - DNA, 14 bp, Homo sapiens
gtaattgtgaaaaa

SEQ ID NO: 1363911 - DNA, 21 bp, Homo sapiens
gtaatttaaaataattatata

SEQ ID NO: 1363912 - DNA, 19 bp, Homo sapiens
gtaatttaaatgaaagaaa

SEQ ID NO: 1363913 - DNA, 21 bp, Homo sapiens
gtaatttaaatgaaagaaaat

SEQ ID NO: 1363914 - DNA, 23 bp, Homo sapiens
gtaatttaaatgaaagaaaattg

SEQ ID NO: 1363915 - DNA, 12 bp, Homo sapiens
gtacaaaattaa

SEQ ID NO: 1363916 - DNA, 13 bp, Homo sapiens
gtacaagtagttc

SEQ ID NO: 1363917 - DNA, 17 bp, Homo sapiens
gtacactgcctgcctta

SEQ ID NO: 1363918 - DNA, 19 bp, Homo sapiens
gtacataatactgaaccac

SEQ ID NO: 1363919 - DNA, 17 bp, Homo sapiens
gtacatacgatttaagg

SEQ ID NO: 1363920 - DNA, 22 bp, Homo sapiens
gtacatttgggagtttttatga

SEQ ID NO: 1363921 - DNA, 13 bp, Homo sapiens
gtaccaagtgaaa

SEQ ID NO: 1363922 - DNA, 18 bp, Homo sapiens
gtacccggggcccagggc

SEQ ID NO: 1363923 - DNA, 13 bp, Homo sapiens
gtaccctgggtgt

SEQ ID NO: 1363924 - DNA, 18 bp, Homo sapiens
gtactgaatttttttgta

SEQ ID NO: 1363925 - DNA, 20 bp, Homo sapiens
gtactgaatttttttgtaat

SEQ ID NO: 1363926 - DNA, 16 bp, Homo sapiens
gtacttttcattctct

SEQ ID NO: 1363927 - DNA, 17 bp, Homo sapiens
gtacttttcattctctt

SEQ ID NO: 1363928 - DNA, 20 bp, Homo sapiens
gtacttttcattctctttta

SEQ ID NO: 1363929 - DNA, 22 bp, Homo sapiens
gtacttttcattctcttttaat

SEQ ID NO: 1363930 - DNA, 23 bp, Homo sapiens
gtactttttagtaatttcttttt

SEQ ID NO: 1363931 - DNA, 18 bp, Homo sapiens
gtagaaaagaactggaaa

SEQ ID NO: 1363932 - DNA, 13 bp, Homo sapiens
gtagaactttgta

SEQ ID NO: 1363933 - DNA, 15 bp, Homo sapiens
gtagaggcttgttta

SEQ ID NO: 1363934 - DNA, 12 bp, Homo sapiens
gtagagtctgag

SEQ ID NO: 1363935 - DNA, 19 bp, Homo sapiens
gtagagttgatcaaaatca

SEQ ID NO: 1363936 - DNA, 16 bp, Homo sapiens
gtagataatttcaggg

SEQ ID NO: 1363937 - DNA, 22 bp, Homo sapiens
gtagatccatttccattgctta

SEQ ID NO: 1363938 - DNA, 13 bp, Homo sapiens
gtagcacttactg

SEQ ID NO: 1363939 - DNA, 16 bp, Homo sapiens
gtaggaaagaggaagc

SEQ ID NO: 1363940 - DNA, 22 bp, Homo sapiens
gtaggagctgccttggctcaga

SEQ ID NO: 1363941 - DNA, 12 bp, Homo sapiens
gtagtccccaac

SEQ ID NO: 1363942 - DNA, 12 bp, Homo sapiens
gtagtcctgtga

SEQ ID NO: 1363943 - DNA, 14 bp, Homo sapiens
gtagttctgtattt

SEQ ID NO: 1363944 - DNA, 17 bp, Homo sapiens
gtagttctgtatttgaa

SEQ ID NO: 1363945 - DNA, 16 bp, Homo sapiens
gcacagtgtcccccag

SEQ ID NO: 1363946 - DNA, 17 bp, Homo sapiens
gcaccaccaagccaagg

SEQ ID NO: 1363947 - DNA, 18 bp, Homo sapiens
gcaccaccaagccaaggg

SEQ ID NO: 1363948 - DNA, 18 bp, Homo sapiens
gcaccaggcgctgcccac

SEQ ID NO: 1363949 - DNA, 16 bp, Homo sapiens
gcaccaggggtttctc

SEQ ID NO: 1363950 - DNA, 15 bp, Homo sapiens
gcaccattctgactc

SEQ ID NO: 1363951 - DNA, 11 bp, Homo sapiens
gcacccagaac

SEQ ID NO: 1363952 - DNA, 14 bp, Homo sapiens
gcacccagaacagt

SEQ ID NO: 1363953 - DNA, 12 bp, Homo sapiens
gcaccccttctc

SEQ ID NO: 1363954 - DNA, 17 bp, Homo sapiens
gcaccccttctctcctc

SEQ ID NO: 1363955 - DNA, 19 bp, Homo sapiens
gcaccccttctctcctccc

SEQ ID NO: 1363956 - DNA, 21 bp, Homo sapiens
gcaccccttctctcctcccca

SEQ ID NO: 1363957 - DNA, 16 bp, Homo sapiens
gcacctcagcctgcac

SEQ ID NO: 1363958 - DNA, 22 bp, Homo sapiens
gtgaaacttttctagaattatt

SEQ ID NO: 1363959 - DNA, 17 bp, Homo sapiens
gtgaaagcatatgggtt

SEQ ID NO: 1363960 - DNA, 17 bp, Homo sapiens
gtgaacttgggccactg

SEQ ID NO: 1363961 - DNA, 23 bp, Homo sapiens
gtgaataatacagtatctcaggg

SEQ ID NO: 1363962 - DNA, 21 bp, Homo sapiens
gtgaatgatgatcctaggcat

SEQ ID NO: 1363963 - DNA, 17 bp, Homo sapiens
gtgaatttttaagctgc

SEQ ID NO: 1363964 - DNA, 15 bp, Homo sapiens
gtgaatttttattgt

SEQ ID NO: 1363965 - DNA, 16 bp, Homo sapiens
gtgacaattctgtttt

SEQ ID NO: 1363966 - DNA, 20 bp, Homo sapiens
gtgacatggtgcctgagagg

SEQ ID NO: 1363967 - DNA, 23 bp, Homo sapiens
gtgacatggtgcctgagaggcag

SEQ ID NO: 1363968 - DNA, 24 bp, Homo sapiens
gtgacatggtgcctgagaggcagg

SEQ ID NO: 1363969 - DNA, 18 bp, Homo sapiens
gtgaccatgttttgttta

SEQ ID NO: 1363970 - DNA, 19 bp, Homo sapiens
gtgaccggacttttctgca

SEQ ID NO: 1363971 - DNA, 21 bp, Homo sapiens
gtgaccggacttttctgcaaa

SEQ ID NO: 1363972 - DNA, 13 bp, Homo sapiens
gtgacctctctct

SEQ ID NO: 1363973 - DNA, 20 bp, Homo sapiens
gtgagaaggtttattgttaa

SEQ ID NO: 1363974 - DNA, 22 bp, Homo sapiens
gtgagaagtgaatgctgggact

SEQ ID NO: 1363975 - DNA, 22 bp, Homo sapiens
gtgaggaaatcaaagtgctatt

SEQ ID NO: 1363976 - DNA, 20 bp, Homo sapiens
gtgatcaatatttttatatc

SEQ ID NO: 1363977 - DNA, 23 bp, Homo sapiens
gtgatccacccaaccctatctcc

SEQ ID NO: 1363978 - DNA, 21 bp, Homo sapiens
gtgatcctctcacctcagcct

SEQ ID NO: 1363979 - DNA, 20 bp, Homo sapiens
gtgatctgctgcagagcagt

SEQ ID NO: 1363980 - DNA, 17 bp, Homo sapiens
gtgattaaagctaagga

SEQ ID NO: 1363981 - DNA, 16 bp, Homo sapiens
gtgatttaatccagtt

SEQ ID NO: 1363982 - DNA, 15 bp, Homo sapiens
gtgcagaggtaccct

SEQ ID NO: 1363983 - DNA, 19 bp, Homo sapiens
gtgcagaggtaccctgggt

SEQ ID NO: 1363984 - DNA, 14 bp, Homo sapiens
gtgcatagtttctt

SEQ ID NO: 1363985 - DNA, 15 bp, Homo sapiens
gtgcatttttgtaaa

SEQ ID NO: 1363986 - DNA, 14 bp, Homo sapiens
gtgccaaagaaagt

SEQ ID NO: 1363987 - DNA, 21 bp, Homo sapiens
gtgccaaagaaagtggtctta

SEQ ID NO: 1363988 - DNA, 16 bp, Homo sapiens
gtgccaccatgcctca

SEQ ID NO: 1363989 - DNA, 23 bp, Homo sapiens
gtgccactttacccacctagaac

SEQ ID NO: 1363990 - DNA, 20 bp, Homo sapiens
gtgcccaagccagaggctgg

SEQ ID NO: 1363991 - DNA, 16 bp, Homo sapiens
gtgcccagaataagtt

SEQ ID NO: 1363992 - DNA, 22 bp, Homo sapiens
gtgcctcaagaggaatgaaaaa

SEQ ID NO: 1363993 - DNA, 13 bp, Homo sapiens
gtgcctgtgtcca

SEQ ID NO: 1363994 - DNA, 17 bp, Homo sapiens
gtgcctttgcagctcag

SEQ ID NO: 1363995 - DNA, 22 bp, Homo sapiens
gtgcgctctgtggatgccaggg

SEQ ID NO: 1363996 - DNA, 13 bp, Homo sapiens
gtgctatgaattt

SEQ ID NO: 1363997 - DNA, 14 bp, Homo sapiens
gtgctgcagcaccg

SEQ ID NO: 1363998 - DNA, 22 bp, Homo sapiens
gtgctgcagcaccgaggggcct

SEQ ID NO: 1363999 - DNA, 16 bp, Homo sapiens
gtgctgccctgaagaa

SEQ ID NO: 1364000 - DNA, 17 bp, Homo sapiens
gtgctggagtctcctga

SEQ ID NO: 1364001 - DNA, 23 bp, Homo sapiens
gtgctggagtctcctgaggacac

SEQ ID NO: 1364002 - DNA, 23 bp, Homo sapiens
gtgctgggagctccactctgctt

SEQ ID NO: 1364003 - DNA, 15 bp, Homo sapiens
gtgctgggaggaggg

SEQ ID NO: 1364004 - DNA, 19 bp, Homo sapiens
gtgctgggaggagggagag

SEQ ID NO: 1364005 - DNA, 15 bp, Homo sapiens
gtgctgtgagggagg

SEQ ID NO: 1364006 - DNA, 16 bp, Homo sapiens
gtgctgtgagggaggg

SEQ ID NO: 1364007 - DNA, 16 bp, Homo sapiens
gtggaagaagggagaa

SEQ ID NO: 1364008 - DNA, 18 bp, Homo sapiens
gtggaccttaggccttcc

SEQ ID NO: 1364009 - DNA, 21 bp, Homo sapiens
gtggaccttaggccttcctct

SEQ ID NO: 1364010 - DNA, 20 bp, Homo sapiens
gtggactgaccttgtaaaag

SEQ ID NO: 1364011 - DNA, 18 bp, Homo sapiens
gtggactgagtgggaagc

SEQ ID NO: 1364012 - DNA, 15 bp, Homo sapiens
gtggagggaggcccc

SEQ ID NO: 1364013 - DNA, 15 bp, Homo sapiens
gtggaggggtgtggc

SEQ ID NO: 1364014 - DNA, 13 bp, Homo sapiens
gtggatggcccca

SEQ ID NO: 1364015 - DNA, 13 bp, Homo sapiens
gtggcaccagcag

SEQ ID NO: 1364016 - DNA, 19 bp, Homo sapiens
gtggcaccagcagcctgga

SEQ ID NO: 1364017 - DNA, 15 bp, Homo sapiens
gtggccaagaagcag

SEQ ID NO: 1364018 - DNA, 21 bp, Homo sapiens
gtggccacagcgccagcctca

SEQ ID NO: 1364019 - DNA, 18 bp, Homo sapiens
gtggcccaaggctggcag

SEQ ID NO: 1364020 - DNA, 19 bp, Homo sapiens
gtggcccaaggctggcagg

SEQ ID NO: 1364021 - DNA, 17 bp, Homo sapiens
gtttaatattgagaaag

SEQ ID NO: 1364022 - DNA, 21 bp, Homo sapiens
gtttacatttgatgcatgtct

SEQ ID NO: 1364023 - DNA, 13 bp, Homo sapiens
gtttacctttctc

SEQ ID NO: 1364024 - DNA, 19 bp, Homo sapiens
gtttataaaatataaacaa

SEQ ID NO: 1364025 - DNA, 14 bp, Homo sapiens
gtttataaacagaa

SEQ ID NO: 1364026 - DNA, 13 bp, Homo sapiens
gtttataataaaa

SEQ ID NO: 1364027 - DNA, 14 bp, Homo sapiens
gtttataataaaaa

SEQ ID NO: 1364028 - DNA, 14 bp, Homo sapiens
gtttatcattcaag

SEQ ID NO: 1364029 - DNA, 17 bp, Homo sapiens
gtttattacttccatga

SEQ ID NO: 1364030 - DNA, 20 bp, Homo sapiens
gtttattacttccatgaatt

SEQ ID NO: 1364031 - DNA, 16 bp, Homo sapiens
gtttattttaaaacaa

SEQ ID NO: 1364032 - DNA, 19 bp, Homo sapiens
gtttccagacttccttgag

SEQ ID NO: 1364033 - DNA, 13 bp, Homo sapiens
gtttccgtgcgtg

SEQ ID NO: 1364034 - DNA, 17 bp, Homo sapiens
gtttccgtgcgtggcac

SEQ ID NO: 1364035 - DNA, 23 bp, Homo sapiens
gtttcgtggggaggtctaatcta

SEQ ID NO: 1364036 - DNA, 14 bp, Homo sapiens
gtttctctgtggct

SEQ ID NO: 1364037 - DNA, 20 bp, Homo sapiens
gtttctcttgagctggcctc

SEQ ID NO: 1364038 - DNA, 22 bp, Homo sapiens
gtttctggacccttataaaatc

SEQ ID NO: 1364039 - DNA, 22 bp, Homo sapiens
gtttctgtggttggctgggaaa

SEQ ID NO: 1364040 - DNA, 22 bp, Homo sapiens
gtttcttaaccctttccagagt

SEQ ID NO: 1364041 - DNA, 19 bp, Homo sapiens
gtttctttaaccttgtata

SEQ ID NO: 1364042 - DNA, 20 bp, Homo sapiens
gtttgaaaacttcagaagca

SEQ ID NO: 1364043 - DNA, 21 bp, Homo sapiens
gtttgaaaacttcagaagcaa

SEQ ID NO: 1364044 - DNA, 11 bp, Homo sapiens
gtttgagaaat

SEQ ID NO: 1364045 - DNA, 16 bp, Homo sapiens
gtttggtaaatgtttc

SEQ ID NO: 1364046 - DNA, 19 bp, Homo sapiens
gtttggtaaatgtttcttt

SEQ ID NO: 1364047 - DNA, 18 bp, Homo sapiens
gtttgtcgctcatgtgtg

SEQ ID NO: 1364048 - DNA, 20 bp, Homo sapiens
gtttgtgtgttgtctcttga

SEQ ID NO: 1364049 - DNA, 13 bp, Homo sapiens
gtttgttggaaag

SEQ ID NO: 1364050 - DNA, 23 bp, Homo sapiens
gtttgttttttgtttttctgctt

SEQ ID NO: 1364051 - DNA, 16 bp, Homo sapiens
gttttaaactttcaat

SEQ ID NO: 1364052 - DNA, 19 bp, Homo sapiens
gttttaaggactgactgag

SEQ ID NO: 1364053 - DNA, 15 bp, Homo sapiens
gttttatactgaagg

SEQ ID NO: 1364054 - DNA, 21 bp, Homo sapiens
gttttatactgaaggaaaaac

SEQ ID NO: 1364055 - DNA, 17 bp, Homo sapiens
gttttatttatatttat

SEQ ID NO: 1364056 - DNA, 18 bp, Homo sapiens
gttttatttatatttatt

SEQ ID NO: 1364057 - DNA, 19 bp, Homo sapiens
gttttcagaaaaagaaatg

SEQ ID NO: 1364058 - DNA, 20 bp, Homo sapiens
gttttccaggtttaagctgt

SEQ ID NO: 1364059 - DNA, 20 bp, Homo sapiens
gttttggcaaacgctaaaga

SEQ ID NO: 1364060 - DNA, 20 bp, Homo sapiens
gttttggctgaaattctcct

SEQ ID NO: 1364061 - DNA, 13 bp, Homo sapiens
gttttgtaaaaga

SEQ ID NO: 1364062 - DNA, 14 bp, Homo sapiens
gttttgtaaaagaa

SEQ ID NO: 1364063 - DNA, 20 bp, Homo sapiens
gttttgtcattcagagtcag

SEQ ID NO: 1364064 - DNA, 15 bp, Homo sapiens
gtttttatgagaaac

SEQ ID NO: 1364065 - DNA, 12 bp, Homo sapiens
gtttttctacta

SEQ ID NO: 1364066 - DNA, 14 bp, Homo sapiens
gtttttctgcttta

SEQ ID NO: 1364067 - DNA, 19 bp, Homo sapiens
gtttttctgctttagactt

SEQ ID NO: 1364068 - DNA, 18 bp, Homo sapiens
gtttttctgtgtgtcagt

SEQ ID NO: 1364069 - DNA, 23 bp, Homo sapiens
gtttttgaggctttctgttgcca

SEQ ID NO: 1364070 - DNA, 15 bp, Homo sapiens
gtttttgcacatgtt

SEQ ID NO: 1364071 - DNA, 16 bp, Homo sapiens
gtttttgtcttaaaaa

SEQ ID NO: 1364072 - DNA, 18 bp, Homo sapiens
gttttttaagatagtgta

SEQ ID NO: 1364073 - DNA, 17 bp, Homo sapiens
gtttttttgttattaaa

SEQ ID NO: 1364074 - DNA, 15 bp, Homo sapiens
taaaaaaagaaagca

SEQ ID NO: 1364075 - DNA, 23 bp, Homo sapiens
taaaaaactgctgactgttttct

SEQ ID NO: 1364076 - DNA, 14 bp, Homo sapiens
taaaaaagccttcc

SEQ ID NO: 1364077 - DNA, 14 bp, Homo sapiens
taaaaaatggtcac

SEQ ID NO: 1364078 - DNA, 19 bp, Homo sapiens
taaaaaattttaaaaatct

SEQ ID NO: 1364079 - DNA, 15 bp, Homo sapiens
taaaaacataacata

SEQ ID NO: 1364080 - DNA, 20 bp, Homo sapiens
taaaaactcaggcaaagaaa

SEQ ID NO: 1364081 - DNA, 19 bp, Homo sapiens
taaaaatattgtttctgca

SEQ ID NO: 1364082 - DNA, 16 bp, Homo sapiens
agtcaagtgaaaaagg

SEQ ID NO: 1364083 - DNA, 14 bp, Homo sapiens
agtcaataagaaaa

SEQ ID NO: 1364084 - DNA, 16 bp, Homo sapiens
agtcaatatgtggaag

SEQ ID NO: 1364085 - DNA, 18 bp, Homo sapiens
agtcacacattacaaagt

SEQ ID NO: 1364086 - DNA, 22 bp, Homo sapiens
agtcactatgggatgagaaaat

SEQ ID NO: 1364087 - DNA, 23 bp, Homo sapiens
agtcactggaggttgaagccaag

SEQ ID NO: 1364088 - DNA, 19 bp, Homo sapiens
agtcagagacagatacctc

SEQ ID NO: 1364089 - DNA, 18 bp, Homo sapiens
agtcagctttcatctttg

SEQ ID NO: 1364090 - DNA, 23 bp, Homo sapiens
agtcatatcttaatatatttcta

SEQ ID NO: 1364091 - DNA, 22 bp, Homo sapiens
agtcattatgagaggcaatgat

SEQ ID NO: 1364092 - DNA, 21 bp, Homo sapiens
agtccaaaaagctcctggggc

SEQ ID NO: 1364093 - DNA, 13 bp, Homo sapiens
agtccaaaatact

SEQ ID NO: 1364094 - DNA, 14 bp, Homo sapiens
agtccaccctgcct

SEQ ID NO: 1364095 - DNA, 16 bp, Homo sapiens
agtccaccctgcctgc

SEQ ID NO: 1364096 - DNA, 14 bp, Homo sapiens
agtccactttgttt

SEQ ID NO: 1364097 - DNA, 14 bp, Homo sapiens
agtccattctccca

SEQ ID NO: 1364098 - DNA, 15 bp, Homo sapiens
agtccattctcccag

SEQ ID NO: 1364099 - DNA, 17 bp, Homo sapiens
agtccattctcccaggt

SEQ ID NO: 1364100 - DNA, 18 bp, Homo sapiens
agtccccacccctgcccc

SEQ ID NO: 1364101 - DNA, 12 bp, Homo sapiens
gtgcccaagcca

SEQ ID NO: 1364102 - DNA, 20 bp, Homo sapiens
gtgcccttcctgctgcgcag

SEQ ID NO: 1364103 - DNA, 12 bp, Homo sapiens
gtgccgtggcac

SEQ ID NO: 1364104 - DNA, 14 bp, Homo sapiens
gtgccgtggcacca

SEQ ID NO: 1364105 - DNA, 15 bp, Homo sapiens
gtgcctcaagaggaa

SEQ ID NO: 1364106 - DNA, 15 bp, Homo sapiens
gtgcctgagaggcag

SEQ ID NO: 1364107 - DNA, 18 bp, Homo sapiens
gtgcctgagaggcaggca

SEQ ID NO: 1364108 - DNA, 14 bp, Homo sapiens
gtgcctgtgtgcgt

SEQ ID NO: 1364109 - DNA, 20 bp, Homo sapiens
gtgcgcatcttgcctccagg

SEQ ID NO: 1364110 - DNA, 21 bp, Homo sapiens
gtgctcggagaagagcgcagt

SEQ ID NO: 1364111 - DNA, 19 bp, Homo sapiens
gtgctgaatgttgggactg

SEQ ID NO: 1364112 - DNA, 11 bp, Homo sapiens
gtgctgccctg

SEQ ID NO: 1364113 - DNA, 14 bp, Homo sapiens
gtgctgctgctgct

SEQ ID NO: 1364114 - DNA, 16 bp, Homo sapiens
gtgctggagcactggg

SEQ ID NO: 1364115 - DNA, 17 bp, Homo sapiens
gtgctggagcactgggc

SEQ ID NO: 1364116 - DNA, 18 bp, Homo sapiens
gtgctgggcggctgtgct

SEQ ID NO: 1364117 - DNA, 13 bp, Homo sapiens
gtgcttccttgta

SEQ ID NO: 1364118 - DNA, 21 bp, Homo sapiens
gtgcttctgccaccctgctga

SEQ ID NO: 1364119 - DNA, 18 bp, Homo sapiens
gtgcttttatagaggcta

SEQ ID NO: 1364120 - DNA, 12 bp, Homo sapiens
gtggaagcaacc

SEQ ID NO: 1364121 - DNA, 16 bp, Homo sapiens
gtggaaggcaagccag

SEQ ID NO: 1364122 - DNA, 18 bp, Homo sapiens
gtggaatataaggaaagc

SEQ ID NO: 1364123 - DNA, 21 bp, Homo sapiens
gtggactgaccttgtaaaaga

SEQ ID NO: 1364124 - DNA, 22 bp, Homo sapiens
gtggactgtggcacttgcctgg

SEQ ID NO: 1364125 - DNA, 17 bp, Homo sapiens
gtggaggaggaaggcaa

SEQ ID NO: 1364126 - DNA, 16 bp, Homo sapiens
gtggaggctgcagtga

SEQ ID NO: 1364127 - DNA, 13 bp, Homo sapiens
gtggaggcttcct

SEQ ID NO: 1364128 - DNA, 15 bp, Homo sapiens
gtggaggcttcctgc

SEQ ID NO: 1364129 - DNA, 12 bp, Homo sapiens
gtggagggaggg

SEQ ID NO: 1364130 - DNA, 22 bp, Homo sapiens
gtggatcacgaggtcaggagat

SEQ ID NO: 1364131 - DNA, 16 bp, Homo sapiens
gtggatggccccagca

SEQ ID NO: 1364132 - DNA, 19 bp, Homo sapiens
gtggatggccccagcacag

SEQ ID NO: 1364133 - DNA, 17 bp, Homo sapiens
gtggattgcctctgaaa

SEQ ID NO: 1364134 - DNA, 16 bp, Homo sapiens
gtggcaggggacagga

SEQ ID NO: 1364135 - DNA, 20 bp, Homo sapiens
gtggcaggggacaggagtcc

SEQ ID NO: 1364136 - DNA, 16 bp, Homo sapiens
gtggccacagcgccag

SEQ ID NO: 1364137 - DNA, 20 bp, Homo sapiens
gtggccccaccctgggccct

SEQ ID NO: 1364138 - DNA, 16 bp, Homo sapiens
gtggccccgtttctgg

SEQ ID NO: 1364139 - DNA, 22 bp, Homo sapiens
gtggcctcagctcaatgcagtt

SEQ ID NO: 1364140 - DNA, 17 bp, Homo sapiens
gtggcctgtggctgtcg

SEQ ID NO: 1364141 - DNA, 22 bp, Homo sapiens
gtggcgccgtctccaggggctg

SEQ ID NO: 1364142 - DNA, 14 bp, Homo sapiens
gtggctactgacat

SEQ ID NO: 1364143 - DNA, 15 bp, Homo sapiens
gtggctatcctgatt

SEQ ID NO: 1364144 - DNA, 20 bp, Homo sapiens
gtggctggaagatcctgcgg

SEQ ID NO: 1364145 - DNA, 20 bp, Homo sapiens
gtgggaagcccatcctgacc

SEQ ID NO: 1364146 - DNA, 21 bp, Homo sapiens
gtgggaagcccatcctgacca

SEQ ID NO: 1364147 - DNA, 19 bp, Homo sapiens
gtgggacggtgcccaagcc

SEQ ID NO: 1364148 - DNA, 17 bp, Homo sapiens
gtgggaggtggaagaag

SEQ ID NO: 1364149 - DNA, 20 bp, Homo sapiens
gtgggatttccagaaccaca

SEQ ID NO: 1364150 - DNA, 18 bp, Homo sapiens
gtgggccagtctgtggat

SEQ ID NO: 1364151 - DNA, 17 bp, Homo sapiens
gtgggctggacttctac

SEQ ID NO: 1364152 - DNA, 15 bp, Homo sapiens
gtggggcagggagct

SEQ ID NO: 1364153 - DNA, 13 bp, Homo sapiens
gtggggtgtgctg

SEQ ID NO: 1364154 - DNA, 16 bp, Homo sapiens
gtggggtttcctggca

SEQ ID NO: 1364155 - DNA, 22 bp, Homo sapiens
gtggtcacaacttgatggctgc

SEQ ID NO: 1364156 - DNA, 15 bp, Homo sapiens
gtggtcggtgggacc

SEQ ID NO: 1364157 - DNA, 23 bp, Homo sapiens
gtggtctgttggcaggctggcca

SEQ ID NO: 1364158 - DNA, 18 bp, Homo sapiens
gtggtgatttgaaaaata

SEQ ID NO: 1364159 - DNA, 21 bp, Homo sapiens
gtggtgatttgaaaaatataa

SEQ ID NO: 1364160 - DNA, 16 bp, Homo sapiens
gtggtgccatccccag

SEQ ID NO: 1364161 - DNA, 16 bp, Homo sapiens
gtggttgaatatgatt

SEQ ID NO: 1364162 - DNA, 18 bp, Homo sapiens
gtgtaaaatattttgaat

SEQ ID NO: 1364163 - DNA, 15 bp, Homo sapiens
gtgtaacttgcttaa

SEQ ID NO: 1364164 - DNA, 20 bp, Homo sapiens
gtgtaacttgcttaaatttc

SEQ ID NO: 1364165 - DNA, 15 bp, Homo sapiens
ggtgtctccttaagc

SEQ ID NO: 1364166 - DNA, 15 bp, Homo sapiens
ggtgtgaacccggga

SEQ ID NO: 1364167 - DNA, 22 bp, Homo sapiens
ggtgtgctgggagctccactct

SEQ ID NO: 1364168 - DNA, 12 bp, Homo sapiens
ggtgtggagaag

SEQ ID NO: 1364169 - DNA, 11 bp, Homo sapiens
ggtgtggggga

SEQ ID NO: 1364170 - DNA, 21 bp, Homo sapiens
ggttacccagttagctctcaa

SEQ ID NO: 1364171 - DNA, 13 bp, Homo sapiens
ggttagatgttgc

SEQ ID NO: 1364172 - DNA, 16 bp, Homo sapiens
ggttcaaggtcactgt

SEQ ID NO: 1364173 - DNA, 18 bp, Homo sapiens
ggttcaaggtcactgttt

SEQ ID NO: 1364174 - DNA, 16 bp, Homo sapiens
ggttcaccattgagac

SEQ ID NO: 1364175 - DNA, 18 bp, Homo sapiens
ggttcctctgcctgcccc

SEQ ID NO: 1364176 - DNA, 19 bp, Homo sapiens
ggttcgttctgtactgtta

SEQ ID NO: 1364177 - DNA, 14 bp, Homo sapiens
ggttctcaatgaaa

SEQ ID NO: 1364178 - DNA, 20 bp, Homo sapiens
ggttctccgttagctcctgt

SEQ ID NO: 1364179 - DNA, 17 bp, Homo sapiens
ggttgcgggacagagta

SEQ ID NO: 1364180 - DNA, 19 bp, Homo sapiens
ggttgtaattaaattctga

SEQ ID NO: 1364181 - DNA, 20 bp, Homo sapiens
ggtttctctattaaaatgca

SEQ ID NO: 1364182 - DNA, 13 bp, Homo sapiens
ggttttaaacttt

SEQ ID NO: 1364183 - DNA, 17 bp, Homo sapiens
ggttttataaggctgat

SEQ ID NO: 1364184 - DNA, 23 bp, Homo sapiens
ggttttatggttacttcttctct

SEQ ID NO: 1364185 - DNA, 17 bp, Homo sapiens
gtaaaaatggaaactat

SEQ ID NO: 1364186 - DNA, 20 bp, Homo sapiens
gtaaaagaaatcatgtccat

SEQ ID NO: 1364187 - DNA, 21 bp, Homo sapiens
gtaaaagacagtgtatgtaga

SEQ ID NO: 1364188 - DNA, 18 bp, Homo sapiens
gtaaaatattttgaatca

SEQ ID NO: 1364189 - DNA, 19 bp, Homo sapiens
gtaaaatattttgaatcaa

SEQ ID NO: 1364190 - DNA, 14 bp, Homo sapiens
gtaaaatgaagaat

SEQ ID NO: 1364191 - DNA, 17 bp, Homo sapiens
gtaaaatgaagaattta

SEQ ID NO: 1364192 - DNA, 12 bp, Homo sapiens
gtaaacatttat

SEQ ID NO: 1364193 - DNA, 16 bp, Homo sapiens
gtaaactttttgtgct

SEQ ID NO: 1364194 - DNA, 19 bp, Homo sapiens
gtaaagactggttttctgc

SEQ ID NO: 1364195 - DNA, 17 bp, Homo sapiens
gtaaagtatgtattatt

SEQ ID NO: 1364196 - DNA, 21 bp, Homo sapiens
gtaaagtttccgtgcgtggca

SEQ ID NO: 1364197 - DNA, 13 bp, Homo sapiens
gtaaataattctt

SEQ ID NO: 1364198 - DNA, 14 bp, Homo sapiens
gtaaataattcttt

SEQ ID NO: 1364199 - DNA, 15 bp, Homo sapiens
gtaaataattctttt

SEQ ID NO: 1364200 - DNA, 21 bp, Homo sapiens
gtaaataggaatcattcagaa

SEQ ID NO: 1364201 - DNA, 12 bp, Homo sapiens
gtaaatgtaaac

SEQ ID NO: 1364202 - DNA, 13 bp, Homo sapiens
gtaaatgtaaact

SEQ ID NO: 1364203 - DNA, 18 bp, Homo sapiens
gtaaattctgatttcttt

SEQ ID NO: 1364204 - DNA, 21 bp, Homo sapiens
gtaactgtcctgtcctgctca

SEQ ID NO: 1364205 - DNA, 18 bp, Homo sapiens
gtaacttccaaataaata

SEQ ID NO: 1364206 - DNA, 20 bp, Homo sapiens
gtaagatcactgtttagatt

SEQ ID NO: 1364207 - DNA, 20 bp, Homo sapiens
gtaataagcactgtaaactt

SEQ ID NO: 1364208 - DNA, 13 bp, Homo sapiens
gtaatatttatta

SEQ ID NO: 1364209 - DNA, 15 bp, Homo sapiens
gtaatcatctaagtc

SEQ ID NO: 1364210 - DNA, 16 bp, Homo sapiens
gtaatcatctaagtca

SEQ ID NO: 1364211 - DNA, 20 bp, Homo sapiens
gtaatcccctaaaataacag

SEQ ID NO: 1364212 - DNA, 17 bp, Homo sapiens
gtaatcttgttggttca

SEQ ID NO: 1364213 - DNA, 19 bp, Homo sapiens
gtaatctttacctgtatac

SEQ ID NO: 1364214 - DNA, 23 bp, Homo sapiens
gtaattctaccaaggtcttctta

SEQ ID NO: 1364215 - DNA, 10 bp, Homo sapiens
gtaatttaaa

SEQ ID NO: 1364216 - DNA, 14 bp, Homo sapiens
gtacaagtagttct

SEQ ID NO: 1364217 - DNA, 16 bp, Homo sapiens
gtacaagtagttctgt

SEQ ID NO: 1364218 - DNA, 17 bp, Homo sapiens
gtacaagtagttctgta

SEQ ID NO: 1364219 - DNA, 21 bp, Homo sapiens
tcattgacttttataaagcat

SEQ ID NO: 1364220 - DNA, 24 bp, Homo sapiens
tcattgacttttataaagcatgtt

SEQ ID NO: 1364221 - DNA, 15 bp, Homo sapiens
tcatttcatctcatt

SEQ ID NO: 1364222 - DNA, 12 bp, Homo sapiens
tcatttgtttac

SEQ ID NO: 1364223 - DNA, 16 bp, Homo sapiens
tcattttacagtatct

SEQ ID NO: 1364224 - DNA, 16 bp, Homo sapiens
tcattttcttttttaa

SEQ ID NO: 1364225 - DNA, 16 bp, Homo sapiens
tcattttgaaattgtt

SEQ ID NO: 1364226 - DNA, 19 bp, Homo sapiens
tccaaactgaagcagcctc

SEQ ID NO: 1364227 - DNA, 15 bp, Homo sapiens
tccaaagaggctgcc

SEQ ID NO: 1364228 - DNA, 18 bp, Homo sapiens
tccaaagaggctgcccct

SEQ ID NO: 1364229 - DNA, 12 bp, Homo sapiens
tccaaccctgcc

SEQ ID NO: 1364230 - DNA, 22 bp, Homo sapiens
tccaaccctgccgtcaccacca

SEQ ID NO: 1364231 - DNA, 12 bp, Homo sapiens
tccaactccagc

SEQ ID NO: 1364232 - DNA, 16 bp, Homo sapiens
tccaagcctccacagc

SEQ ID NO: 1364233 - DNA, 17 bp, Homo sapiens
tccaagcctccacagcg

SEQ ID NO: 1364234 - DNA, 22 bp, Homo sapiens
tccacaacctcttccccccaaa

SEQ ID NO: 1364235 - DNA, 16 bp, Homo sapiens
tccacacccgtgagaa

SEQ ID NO: 1364236 - DNA, 22 bp, Homo sapiens
tccacagcgagggcagctgcta

SEQ ID NO: 1364237 - DNA, 14 bp, Homo sapiens
tccacatctgcctt

SEQ ID NO: 1364238 - DNA, 19 bp, Homo sapiens
tccaccagcatcacctgcc

SEQ ID NO: 1364239 - DNA, 20 bp, Homo sapiens
tccaccagcatcacctgcct

SEQ ID NO: 1364240 - DNA, 18 bp, Homo sapiens
tccaccccaagagaactc

SEQ ID NO: 1364241 - DNA, 12 bp, Homo sapiens
tccaccccagga

SEQ ID NO: 1364242 - DNA, 15 bp, Homo sapiens
tccacgcgtgccgtg

SEQ ID NO: 1364243 - DNA, 14 bp, Homo sapiens
tccactaaaaatat

SEQ ID NO: 1364244 - DNA, 18 bp, Homo sapiens
tccactacacctggctga

SEQ ID NO: 1364245 - DNA, 14 bp, Homo sapiens
tccactcgtgtgtt

SEQ ID NO: 1364246 - DNA, 18 bp, Homo sapiens
tccactcgtgtgtttcta

SEQ ID NO: 1364247 - DNA, 14 bp, Homo sapiens
tccactctgcttct

SEQ ID NO: 1364248 - DNA, 19 bp, Homo sapiens
tccactctgcttctctgac

SEQ ID NO: 1364249 - DNA, 20 bp, Homo sapiens
tccactctgcttctctgact

SEQ ID NO: 1364250 - DNA, 23 bp, Homo sapiens
tccactctgcttctctgacttct

SEQ ID NO: 1364251 - DNA, 15 bp, Homo sapiens
tccagaaaactgtga

SEQ ID NO: 1364252 - DNA, 19 bp, Homo sapiens
tccagaaccacacttgaaa

SEQ ID NO: 1364253 - DNA, 14 bp, Homo sapiens
tccagactcagagc

SEQ ID NO: 1364254 - DNA, 19 bp, Homo sapiens
tccagacttccttgagaca

SEQ ID NO: 1364255 - DNA, 17 bp, Homo sapiens
tccagatctttcagaaa

SEQ ID NO: 1364256 - DNA, 18 bp, Homo sapiens
tccagatggtcatccaga

SEQ ID NO: 1364257 - DNA, 21 bp, Homo sapiens
tccagatggtcatccagactc

SEQ ID NO: 1364258 - DNA, 19 bp, Homo sapiens
tccagatgtttccagactt

SEQ ID NO: 1364259 - DNA, 19 bp, Homo sapiens
tccagcaacttcttctcca

SEQ ID NO: 1364260 - DNA, 15 bp, Homo sapiens
tccagcaccttgtgc

SEQ ID NO: 1364261 - DNA, 19 bp, Homo sapiens
tccagcaccttgtgcctgg

SEQ ID NO: 1364262 - DNA, 22 bp, Homo sapiens
tccagcaccttgtgcctggggt

SEQ ID NO: 1364263 - DNA, 21 bp, Homo sapiens
tccagcatttagctggccaca

SEQ ID NO: 1364264 - DNA, 14 bp, Homo sapiens
tccagccagcgcct

SEQ ID NO: 1364265 - DNA, 18 bp, Homo sapiens
tccagccagcgcctccct

SEQ ID NO: 1364266 - DNA, 22 bp, Homo sapiens
tccagccagcgcctccctccac

SEQ ID NO: 1364267 - DNA, 23 bp, Homo sapiens
tccagccccgcgaccatgtggcc

SEQ ID NO: 1364268 - DNA, 14 bp, Homo sapiens
tccagcccctctgg

SEQ ID NO: 1364269 - DNA, 13 bp, Homo sapiens
tccagcctcagcc

SEQ ID NO: 1364270 - DNA, 24 bp, Homo sapiens
tccagcctgggtgacagagcaagt

SEQ ID NO: 1364271 - DNA, 23 bp, Homo sapiens
tccaggaaactccacatctgcct

SEQ ID NO: 1364272 - DNA, 15 bp, Homo sapiens
tccaggcagcctctg

SEQ ID NO: 1364273 - DNA, 18 bp, Homo sapiens
tccaggccgcgccctttc

SEQ ID NO: 1364274 - DNA, 20 bp, Homo sapiens
tccaggccgcgccctttccc

SEQ ID NO: 1364275 - DNA, 13 bp, Homo sapiens
tccaggcctgcct

SEQ ID NO: 1364276 - DNA, 14 bp, Homo sapiens
tccaggcctgcctc

SEQ ID NO: 1364277 - DNA, 15 bp, Homo sapiens
tccaggcctgcctcc

SEQ ID NO: 1364278 - DNA, 16 bp, Homo sapiens
tccaggcctgcctccc

SEQ ID NO: 1364279 - DNA, 20 bp, Homo sapiens
tccaggctatgtataaaata

SEQ ID NO: 1364280 - DNA, 16 bp, Homo sapiens
tccaggctgccgtggg

SEQ ID NO: 1364281 - DNA, 19 bp, Homo sapiens
tccagtaagatcactgttt

SEQ ID NO: 1364282 - DNA, 21 bp, Homo sapiens
tccagtaagatcactgtttag

SEQ ID NO: 1364283 - DNA, 17 bp, Homo sapiens
tccagtggatcataaga

SEQ ID NO: 1364284 - DNA, 15 bp, Homo sapiens
tccagttataagaag

SEQ ID NO: 1364285 - DNA, 17 bp, Homo sapiens
tccagtttgtcttggat

SEQ ID NO: 1364286 - DNA, 16 bp, Homo sapiens
tccataaacatgaaaa

SEQ ID NO: 1364287 - DNA, 16 bp, Homo sapiens
tccatagtttggcatt

SEQ ID NO: 1364288 - DNA, 20 bp, Homo sapiens
tccatagtttggcatttgca

SEQ ID NO: 1364289 - DNA, 18 bp, Homo sapiens
tccatattttattactgt

SEQ ID NO: 1364290 - DNA, 20 bp, Homo sapiens
tccatattttattactgttt

SEQ ID NO: 1364291 - DNA, 21 bp, Homo sapiens
tccatccaaggccaggttctc

SEQ ID NO: 1364292 - DNA, 17 bp, Homo sapiens
tccatgaattttaaaat

SEQ ID NO: 1364293 - DNA, 21 bp, Homo sapiens
tccattccacacagaatgcaa

SEQ ID NO: 1364294 - DNA, 19 bp, Homo sapiens
tccatttccattgcttatt

SEQ ID NO: 1364295 - DNA, 15 bp, Homo sapiens
tccatttgctcttca

SEQ ID NO: 1364296 - DNA, 17 bp, Homo sapiens
tccattttaattttaaa

SEQ ID NO: 1364297 - DNA, 21 bp, Homo sapiens
tcccaaacgcctcccctgccc

SEQ ID NO: 1364298 - DNA, 23 bp, Homo sapiens
tcccaaagtgctgggattacaga

SEQ ID NO: 1364299 - DNA, 20 bp, Homo sapiens
tcccaagaatgcaagatttc

SEQ ID NO: 1364300 - DNA, 20 bp, Homo sapiens
tcccaagtaactgggattac

SEQ ID NO: 1364301 - DNA, 20 bp, Homo sapiens
tcccacatccaactccagca

SEQ ID NO: 1364302 - DNA, 23 bp, Homo sapiens
tcccacccccagccccgactcca

SEQ ID NO: 1364303 - DNA, 23 bp, Homo sapiens
tcccactttgctgttccttactt

SEQ ID NO: 1364304 - DNA, 18 bp, Homo sapiens
tcccagatacttgggggg

SEQ ID NO: 1364305 - DNA, 16 bp, Homo sapiens
tcccagcactttggga

SEQ ID NO: 1364306 - DNA, 16 bp, Homo sapiens
tcccagctactcggga

SEQ ID NO: 1364307 - DNA, 18 bp, Homo sapiens
tcccagctacttgggagg

SEQ ID NO: 1364308 - DNA, 19 bp, Homo sapiens
tcccagctacttgggaggc

SEQ ID NO: 1364309 - DNA, 17 bp, Homo sapiens
tcccaggagcctgccca

SEQ ID NO: 1364310 - DNA, 17 bp, Homo sapiens
tcccaggggtctccctg

SEQ ID NO: 1364311 - DNA, 20 bp, Homo sapiens
tcccaggggtctccctggct

SEQ ID NO: 1364312 - DNA, 16 bp, Homo sapiens
tcccaggtaccagctg

SEQ ID NO: 1364313 - DNA, 17 bp, Homo sapiens
tcccaggtaccagctgc

SEQ ID NO: 1364314 - DNA, 19 bp, Homo sapiens
tcccaggtaccagctgcgc

SEQ ID NO: 1364315 - DNA, 19 bp, Homo sapiens
tcccagtgccgagaaggaa

SEQ ID NO: 1364316 - DNA, 22 bp, Homo sapiens
tcccagtgccgagaaggaagcc

SEQ ID NO: 1364317 - DNA, 13 bp, Homo sapiens
tcccatctgcacc

SEQ ID NO: 1364318 - DNA, 14 bp, Homo sapiens
tcccatggggaggg

SEQ ID NO: 1364319 - DNA, 22 bp, Homo sapiens
tcccatgtagccccctggcctc

SEQ ID NO: 1364320 - DNA, 11 bp, Homo sapiens
tcccattccag

SEQ ID NO: 1364321 - DNA, 13 bp, Homo sapiens
tcccattccaggc

SEQ ID NO: 1364322 - DNA, 23 bp, Homo sapiens
tcccatttctacctaagtcagct

SEQ ID NO: 1364323 - DNA, 19 bp, Homo sapiens
tcccatttgtgccagagga

SEQ ID NO: 1364324 - DNA, 22 bp, Homo sapiens
tccccaaccgtgtctgtctggc

SEQ ID NO: 1364325 - DNA, 18 bp, Homo sapiens
tccccacccctgccccca

SEQ ID NO: 1364326 - DNA, 20 bp, Homo sapiens
tccccagcattccagcccct

SEQ ID NO: 1364327 - DNA, 11 bp, Homo sapiens
tccccagcctg

SEQ ID NO: 1364328 - DNA, 17 bp, Homo sapiens
tccccaggtccagctct

SEQ ID NO: 1364329 - DNA, 14 bp, Homo sapiens
tccccatctccctg

SEQ ID NO: 1364330 - DNA, 11 bp, Homo sapiens
tccccatgaca

SEQ ID NO: 1364331 - DNA, 18 bp, Homo sapiens
tccccatttcccatctgc

SEQ ID NO: 1364332 - DNA, 19 bp, Homo sapiens
tccccatttcccatctgca

SEQ ID NO: 1364333 - DNA, 21 bp, Homo sapiens
tcccccaccggtccagctggc

SEQ ID NO: 1364334 - DNA, 12 bp, Homo sapiens
tccccccatctt

SEQ ID NO: 1364335 - DNA, 22 bp, Homo sapiens
tccccccatcttgcttccctaa

SEQ ID NO: 1364336 - DNA, 22 bp, Homo sapiens
tcgcaccggagtgtctggaatt

SEQ ID NO: 1364337 - DNA, 13 bp, Homo sapiens
tcgccacaaactc

SEQ ID NO: 1364338 - DNA, 17 bp, Homo sapiens
tcgccggatctgaggga

SEQ ID NO: 1364339 - DNA, 12 bp, Homo sapiens
tcgcctcagcct

SEQ ID NO: 1364340 - DNA, 12 bp, Homo sapiens
tcgcctttcctc

SEQ ID NO: 1364341 - DNA, 13 bp, Homo sapiens
tcgcctttcctct

SEQ ID NO: 1364342 - DNA, 17 bp, Homo sapiens
tcgcttcttgcctctgt

SEQ ID NO: 1364343 - DNA, 19 bp, Homo sapiens
tcgcttcttgcctctgtgc

SEQ ID NO: 1364344 - DNA, 16 bp, Homo sapiens
tcggagaagagcgcag

SEQ ID NO: 1364345 - DNA, 21 bp, Homo sapiens
tcggagaagagcgcagtgttt

SEQ ID NO: 1364346 - DNA, 23 bp, Homo sapiens
tcggatagttgctatttttgtaa

SEQ ID NO: 1364347 - DNA, 16 bp, Homo sapiens
tcggatcaggctccca

SEQ ID NO: 1364348 - DNA, 22 bp, Homo sapiens
tcggcctagggcccccacagtt

SEQ ID NO: 1364349 - DNA, 14 bp, Homo sapiens
tcggctcagctcgg

SEQ ID NO: 1364350 - DNA, 21 bp, Homo sapiens
tcggctctgcagtcctactca

SEQ ID NO: 1364351 - DNA, 19 bp, Homo sapiens
tcgggaggtcgaggcagga

SEQ ID NO: 1364352 - DNA, 21 bp, Homo sapiens
tcggtacccggggcccagggc

SEQ ID NO: 1364353 - DNA, 22 bp, Homo sapiens
tcggtttgccaaaattcatttc

SEQ ID NO: 1364354 - DNA, 22 bp, Homo sapiens
tcgtacataatactgaaccact

SEQ ID NO: 1364355 - DNA, 20 bp, Homo sapiens
tcgtctttcccatggggagg

SEQ ID NO: 1364356 - DNA, 15 bp, Homo sapiens
tcgtgcctgtgtcca

SEQ ID NO: 1364357 - DNA, 22 bp, Homo sapiens
tcgtggacacacacagactatt

SEQ ID NO: 1364358 - DNA, 18 bp, Homo sapiens
tcgtggggtgtgctggga

SEQ ID NO: 1364359 - DNA, 22 bp, Homo sapiens
tcgtgtcatactcgagtctgag

SEQ ID NO: 1364360 - DNA, 21 bp, Homo sapiens
tcgtgtgtttctattttttga

SEQ ID NO: 1364361 - DNA, 22 bp, Homo sapiens
tcgttggttatacaagttcttg

SEQ ID NO: 1364362 - DNA, 14 bp, Homo sapiens
tctaaaatcatgaa

SEQ ID NO: 1364363 - DNA, 12 bp, Homo sapiens
tctaaagagcat

SEQ ID NO: 1364364 - DNA, 13 bp, Homo sapiens
tctaaagagcatc

SEQ ID NO: 1364365 - DNA, 14 bp, Homo sapiens
tctaaagtaaaaag

SEQ ID NO: 1364366 - DNA, 14 bp, Homo sapiens
tctaaatctattta

SEQ ID NO: 1364367 - DNA, 18 bp, Homo sapiens
gctggccccagccctgct

SEQ ID NO: 1364368 - DNA, 19 bp, Homo sapiens
gctggccccagccctgctg

SEQ ID NO: 1364369 - DNA, 19 bp, Homo sapiens
gctggcctttgtaagtgca

SEQ ID NO: 1364370 - DNA, 14 bp, Homo sapiens
gctggctcctgatc

SEQ ID NO: 1364371 - DNA, 21 bp, Homo sapiens
gctggctcctgatccactttg

SEQ ID NO: 1364372 - DNA, 12 bp, Homo sapiens
gctggctctgag

SEQ ID NO: 1364373 - DNA, 13 bp, Homo sapiens
gctggctctgagc

SEQ ID NO: 1364374 - DNA, 14 bp, Homo sapiens
gctgggactcagcc

SEQ ID NO: 1364375 - DNA, 19 bp, Homo sapiens
gctgggactcagccttcag

SEQ ID NO: 1364376 - DNA, 13 bp, Homo sapiens
gctgggagctcca

SEQ ID NO: 1364377 - DNA, 18 bp, Homo sapiens
gctgggagctccactctg

SEQ ID NO: 1364378 - DNA, 18 bp, Homo sapiens
gctgggaggagggagagg

SEQ ID NO: 1364379 - DNA, 14 bp, Homo sapiens
gctgggcaggttgg

SEQ ID NO: 1364380 - DNA, 17 bp, Homo sapiens
gctgggccatgtccaaa

SEQ ID NO: 1364381 - DNA, 20 bp, Homo sapiens
gctgggcccgacatggctcc

SEQ ID NO: 1364382 - DNA, 21 bp, Homo sapiens
gctgggcccgacatggctccg

SEQ ID NO: 1364383 - DNA, 17 bp, Homo sapiens
gctgggcggctgtgctt

SEQ ID NO: 1364384 - DNA, 13 bp, Homo sapiens
gctggggaaggaa

SEQ ID NO: 1364385 - DNA, 21 bp, Homo sapiens
gctggggatccccgcctggcc

SEQ ID NO: 1364386 - DNA, 21 bp, Homo sapiens
gctgggtggcaccagcagcct

SEQ ID NO: 1364387 - DNA, 16 bp, Homo sapiens
gctggtaaaatgaaga

SEQ ID NO: 1364388 - DNA, 17 bp, Homo sapiens
gctggtacaacggaggc

SEQ ID NO: 1364389 - DNA, 21 bp, Homo sapiens
gctgtcattgcacataagctt

SEQ ID NO: 1364390 - DNA, 20 bp, Homo sapiens
gctgtcccatagtccctgcc

SEQ ID NO: 1364391 - DNA, 22 bp, Homo sapiens
gctgtcccttgcttgcctgcag

SEQ ID NO: 1364392 - DNA, 14 bp, Homo sapiens
gctgtgagggaggg

SEQ ID NO: 1364393 - DNA, 23 bp, Homo sapiens
gctgtgcaacgccgtgggctgcg

SEQ ID NO: 1364394 - DNA, 21 bp, Homo sapiens
gctgtgtatatggtatatata

SEQ ID NO: 1364395 - DNA, 12 bp, Homo sapiens
gctgttctgtgg

SEQ ID NO: 1364396 - DNA, 19 bp, Homo sapiens
gctgttgcttaaaccactt

SEQ ID NO: 1364397 - DNA, 15 bp, Homo sapiens
gcttaaatttcttat

SEQ ID NO: 1364398 - DNA, 16 bp, Homo sapiens
gcttaaatttcttatg

SEQ ID NO: 1364399 - DNA, 16 bp, Homo sapiens
gcttaatcattttcat

SEQ ID NO: 1364400 - DNA, 21 bp, Homo sapiens
gcttaatcattttcattccta

SEQ ID NO: 1364401 - DNA, 13 bp, Homo sapiens
gcttacctcctca

SEQ ID NO: 1364402 - DNA, 22 bp, Homo sapiens
gcttacgtagttctaccggctt

SEQ ID NO: 1364403 - DNA, 16 bp, Homo sapiens
gcttagtttgtgtgtt

SEQ ID NO: 1364404 - DNA, 17 bp, Homo sapiens
gcttatatctggcctct

SEQ ID NO: 1364405 - DNA, 19 bp, Homo sapiens
gcttatctcaggggtgtgc

SEQ ID NO: 1364406 - DNA, 18 bp, Homo sapiens
gcttcacagtagagccag

SEQ ID NO: 1364407 - DNA, 21 bp, Homo sapiens
gcttcacagtagagccagctt

SEQ ID NO: 1364408 - DNA, 22 bp, Homo sapiens
gcttcacagtagagccagcttg

SEQ ID NO: 1364409 - DNA, 19 bp, Homo sapiens
gcttcatgcacttaaagaa

SEQ ID NO: 1364410 - DNA, 13 bp, Homo sapiens
gcttcctcctgga

SEQ ID NO: 1364411 - DNA, 22 bp, Homo sapiens
gcttcctctagaagccaaggga

SEQ ID NO: 1364412 - DNA, 23 bp, Homo sapiens
gcttcctctagaagccaagggaa

SEQ ID NO: 1364413 - DNA, 14 bp, Homo sapiens
gcttctccgccagc

SEQ ID NO: 1364414 - DNA, 16 bp, Homo sapiens
gcttctccgccagcct

SEQ ID NO: 1364415 - DNA, 18 bp, Homo sapiens
gcttctccgccagcctcc

SEQ ID NO: 1364416 - DNA, 19 bp, Homo sapiens
gcttctccgccagcctcct

SEQ ID NO: 1364417 - DNA, 14 bp, Homo sapiens
gcttctctgacttc

SEQ ID NO: 1364418 - DNA, 13 bp, Homo sapiens
gcttctgcttttc

SEQ ID NO: 1364419 - DNA, 20 bp, Homo sapiens
gcttctgcttttctgccctg

SEQ ID NO: 1364420 - DNA, 14 bp, Homo sapiens
gcttcttgcctctg

SEQ ID NO: 1364421 - DNA, 15 bp, Homo sapiens
gcttcttgcctctgt

SEQ ID NO: 1364422 - DNA, 18 bp, Homo sapiens
gcttcttgcctctgtgct

SEQ ID NO: 1364423 - DNA, 11 bp, Homo sapiens
gcttgaagcca

SEQ ID NO: 1364424 - DNA, 16 bp, Homo sapiens
gcttgaagccaaagaa

SEQ ID NO: 1364425 - DNA, 22 bp, Homo sapiens
gcttgagccgggcccctgggct

SEQ ID NO: 1364426 - DNA, 14 bp, Homo sapiens
gcttgcctgcaggg

SEQ ID NO: 1364427 - DNA, 12 bp, Homo sapiens
gcttgcttttct

SEQ ID NO: 1364428 - DNA, 16 bp, Homo sapiens
gcttggcctgctgtga

SEQ ID NO: 1364429 - DNA, 20 bp, Homo sapiens
gcttggggctcacacacctg

SEQ ID NO: 1364430 - DNA, 15 bp, Homo sapiens
gcttggttctgtgaa

SEQ ID NO: 1364431 - DNA, 21 bp, Homo sapiens
gcttgttcatcatccagatgt

SEQ ID NO: 1364432 - DNA, 18 bp, Homo sapiens
gcttgtttacctttctct

SEQ ID NO: 1364433 - DNA, 21 bp, Homo sapiens
gctttaaaaagggaagaaact

SEQ ID NO: 1364434 - DNA, 14 bp, Homo sapiens
gctttaagccttca

SEQ ID NO: 1364435 - DNA, 15 bp, Homo sapiens
gctttagaccctggg

SEQ ID NO: 1364436 - DNA, 16 bp, Homo sapiens
gctttagaccctgggt

SEQ ID NO: 1364437 - DNA, 17 bp, Homo sapiens
gctttagaccctgggtg

SEQ ID NO: 1364438 - DNA, 12 bp, Homo sapiens
gctttagacttg

SEQ ID NO: 1364439 - DNA, 15 bp, Homo sapiens
gctttagacttgaaa

SEQ ID NO: 1364440 - DNA, 17 bp, Homo sapiens
gctttagacttgaaaag

SEQ ID NO: 1364441 - DNA, 21 bp, Homo sapiens
gctttagacttgaaaagagac

SEQ ID NO: 1364442 - DNA, 16 bp, Homo sapiens
gctttatttgtaaatt

SEQ ID NO: 1364443 - DNA, 18 bp, Homo sapiens
gctttattttgagatgta

SEQ ID NO: 1364444 - DNA, 18 bp, Homo sapiens
gctttcatgattagcaag

SEQ ID NO: 1364445 - DNA, 15 bp, Homo sapiens
gctttcccacttccc

SEQ ID NO: 1364446 - DNA, 19 bp, Homo sapiens
gctttctcctttaattgta

SEQ ID NO: 1364447 - DNA, 15 bp, Homo sapiens
gctttctgccatcta

SEQ ID NO: 1364448 - DNA, 17 bp, Homo sapiens
gctttgaataaatgtgt

SEQ ID NO: 1364449 - DNA, 14 bp, Homo sapiens
gctttgatccctga

SEQ ID NO: 1364450 - DNA, 16 bp, Homo sapiens
gctttgccattgtgaa

SEQ ID NO: 1364451 - DNA, 19 bp, Homo sapiens
gctttgtcgtatttggcac

SEQ ID NO: 1364452 - DNA, 21 bp, Homo sapiens
gctttgtttgttgtcagctga

SEQ ID NO: 1364453 - DNA, 17 bp, Homo sapiens
gcttttctgccctggct

SEQ ID NO: 1364454 - DNA, 14 bp, Homo sapiens
gcttttctgtattt

SEQ ID NO: 1364455 - DNA, 18 bp, Homo sapiens
gcttttctgtattttatt

SEQ ID NO: 1364456 - DNA, 13 bp, Homo sapiens
ggaaaaacacaag

SEQ ID NO: 1364457 - DNA, 12 bp, Homo sapiens
aaaaaaaagtca

SEQ ID NO: 1364458 - DNA, 11 bp, Homo sapiens
aaaaaaaccac

SEQ ID NO: 1364459 - DNA, 12 bp, Homo sapiens
aaaaaaataata

SEQ ID NO: 1364460 - DNA, 15 bp, Homo sapiens
aaaaaatattttcct

SEQ ID NO: 1364461 - DNA, 18 bp, Homo sapiens
aaaaacataacataaatt

SEQ ID NO: 1364462 - DNA, 19 bp, Homo sapiens
aaaaaccaccaaaaacaaa

SEQ ID NO: 1364463 - DNA, 13 bp, Homo sapiens
aaaaactgaaaaa

SEQ ID NO: 1364464 - DNA, 14 bp, Homo sapiens
aaaaactgaaaaat

SEQ ID NO: 1364465 - DNA, 14 bp, Homo sapiens
aaaaagatgtacag

SEQ ID NO: 1364466 - DNA, 12 bp, Homo sapiens
aaaaagccttcc

SEQ ID NO: 1364467 - DNA, 19 bp, Homo sapiens
aaaaagctagtcaacagta

SEQ ID NO: 1364468 - DNA, 14 bp, Homo sapiens
aaaaaggaggaaga

SEQ ID NO: 1364469 - DNA, 20 bp, Homo sapiens
aaaaaggcttataaaacaga

SEQ ID NO: 1364470 - DNA, 18 bp, Homo sapiens
aaaaagtcagagacagat

SEQ ID NO: 1364471 - DNA, 20 bp, Homo sapiens
aaaaataaaataattataaa

SEQ ID NO: 1364472 - DNA, 11 bp, Homo sapiens
aaaaatagaaa

SEQ ID NO: 1364473 - DNA, 12 bp, Homo sapiens
aaaaatagaaac

SEQ ID NO: 1364474 - DNA, 15 bp, Homo sapiens
aaaaatatcaaatta

SEQ ID NO: 1364475 - DNA, 11 bp, Homo sapiens
aaaaatattgt

SEQ ID NO: 1364476 - DNA, 12 bp, Homo sapiens
aaaaatattgtt

SEQ ID NO: 1364477 - DNA, 11 bp, Homo sapiens
aaaaattgtta

SEQ ID NO: 1364478 - DNA, 12 bp, Homo sapiens
aaaacaaaattt

SEQ ID NO: 1364479 - DNA, 15 bp, Homo sapiens
aaaacacaagcaaaa

SEQ ID NO: 1364480 - DNA, 15 bp, Homo sapiens
aaaacaccttctata

SEQ ID NO: 1364481 - DNA, 16 bp, Homo sapiens
aaaacatagcatctca

SEQ ID NO: 1364482 - DNA, 12 bp, Homo sapiens
aaaacatttgct

SEQ ID NO: 1364483 - DNA, 13 bp, Homo sapiens
aaaaccaaagagg

SEQ ID NO: 1364484 - DNA, 15 bp, Homo sapiens
aaaaccaatgttctc

SEQ ID NO: 1364485 - DNA, 21 bp, Homo sapiens
aaaaccaatgttctctcttct

SEQ ID NO: 1364486 - DNA, 13 bp, Homo sapiens
aaaaccttttact

SEQ ID NO: 1364487 - DNA, 14 bp, Homo sapiens
aaaactcactgtga

SEQ ID NO: 1364488 - DNA, 12 bp, Homo sapiens
aaaactctttga

SEQ ID NO: 1364489 - DNA, 18 bp, Homo sapiens
aaaactgattgaatgata

SEQ ID NO: 1364490 - DNA, 12 bp, Homo sapiens
aaaactgtgttg

SEQ ID NO: 1364491 - DNA, 17 bp, Homo sapiens
aaaactgtgttgccaca

SEQ ID NO: 1364492 - DNA, 19 bp, Homo sapiens
aaaacttggttttatggtt

SEQ ID NO: 1364493 - DNA, 19 bp, Homo sapiens
aaaagaaatcatgtccata

SEQ ID NO: 1364494 - DNA, 13 bp, Homo sapiens
aaaagaaatgatg

SEQ ID NO: 1364495 - DNA, 13 bp, Homo sapiens
aaaagatgcttct

SEQ ID NO: 1364496 - DNA, 20 bp, Homo sapiens
aaaagcaagtactctggagc

SEQ ID NO: 1364497 - DNA, 15 bp, Homo sapiens
aaaagcactcctgct

SEQ ID NO: 1364498 - DNA, 13 bp, Homo sapiens
aaaagcagacatt

SEQ ID NO: 1364499 - DNA, 10 bp, Homo sapiens
aaaagcattt

SEQ ID NO: 1364500 - DNA, 17 bp, Homo sapiens
aaaagctataaagcagt

SEQ ID NO: 1364501 - DNA, 21 bp, Homo sapiens
aaaagctataaagcagtattt

SEQ ID NO: 1364502 - DNA, 14 bp, Homo sapiens
aaaagctcttttaa

SEQ ID NO: 1364503 - DNA, 14 bp, Homo sapiens
aaaagctgggcagg

SEQ ID NO: 1364504 - DNA, 15 bp, Homo sapiens
aaaaggagtatacaa

SEQ ID NO: 1364505 - DNA, 15 bp, Homo sapiens
aaaaggcgcatctaa

SEQ ID NO: 1364506 - DNA, 20 bp, Homo sapiens
aaaaggcgcatctaacgcgt

SEQ ID NO: 1364507 - DNA, 16 bp, Homo sapiens
aaaaggctgtgctgcc

SEQ ID NO: 1364508 - DNA, 20 bp, Homo sapiens
aaaaggctgtgctgccctga

SEQ ID NO: 1364509 - DNA, 17 bp, Homo sapiens
aaaaggcttataaaaca

SEQ ID NO: 1364510 - DNA, 18 bp, Homo sapiens
aaaagtagaactttgtat

SEQ ID NO: 1364511 - DNA, 14 bp, Homo sapiens
aaaagtcagagaca

SEQ ID NO: 1364512 - DNA, 16 bp, Homo sapiens
aaaagtcagagacaga

SEQ ID NO: 1364513 - DNA, 14 bp, Homo sapiens
aaaagtgcctcaag

SEQ ID NO: 1364514 - DNA, 19 bp, Homo sapiens
aaaagtgtgtatatatttt

SEQ ID NO: 1364515 - DNA, 20 bp, Homo sapiens
aaaagtgtgtatatattttg

SEQ ID NO: 1364516 - DNA, 13 bp, Homo sapiens
aaaataaaacata

SEQ ID NO: 1364517 - DNA, 13 bp, Homo sapiens
aaaataaaatgaa

SEQ ID NO: 1364518 - DNA, 21 bp, Homo sapiens
aaaataaaatgaaaattgtat

SEQ ID NO: 1364519 - DNA, 14 bp, Homo sapiens
aaaataaactataa

SEQ ID NO: 1364520 - DNA, 13 bp, Homo sapiens
aaaataacagtat

SEQ ID NO: 1364521 - DNA, 20 bp, Homo sapiens
aaaataaccctttggttttt

SEQ ID NO: 1364522 - DNA, 13 bp, Homo sapiens
aaaataataataa

SEQ ID NO: 1364523 - DNA, 12 bp, Homo sapiens
aaaatacattgt

SEQ ID NO: 1364524 - DNA, 18 bp, Homo sapiens
aaaatactatttaagatg

SEQ ID NO: 1364525 - DNA, 22 bp, Homo sapiens
aaaatactatttaagatgtgaa

SEQ ID NO: 1364526 - DNA, 23 bp, Homo sapiens
aaaatactatttaagatgtgaaa

SEQ ID NO: 1364527 - DNA, 11 bp, Homo sapiens
aaaatagaaac

SEQ ID NO: 1364528 - DNA, 17 bp, Homo sapiens
aaaatagaaattttgta

SEQ ID NO: 1364529 - DNA, 20 bp, Homo sapiens
aaaatagaaattttgtaaga

SEQ ID NO: 1364530 - DNA, 20 bp, Homo sapiens
aaaatagagtgtagtttaca

SEQ ID NO: 1364531 - DNA, 23 bp, Homo sapiens
aaaatagatataaatttttaaga

SEQ ID NO: 1364532 - DNA, 18 bp, Homo sapiens
aaaatatatttataagga

SEQ ID NO: 1364533 - DNA, 12 bp, Homo sapiens
aaaatatcttgg

SEQ ID NO: 1364534 - DNA, 16 bp, Homo sapiens
aaaatattgtttctgc

SEQ ID NO: 1364535 - DNA, 22 bp, Homo sapiens
aaaatattgtttctgcattcat

SEQ ID NO: 1364536 - DNA, 23 bp, Homo sapiens
aaaatattgtttctgcattcatt

SEQ ID NO: 1364537 - DNA, 14 bp, Homo sapiens
aaaatatttggaat

SEQ ID NO: 1364538 - DNA, 13 bp, Homo sapiens
aaaatattttgaa

SEQ ID NO: 1364539 - DNA, 14 bp, Homo sapiens
aaaatccaaaaaga

SEQ ID NO: 1364540 - DNA, 15 bp, Homo sapiens
aaaatccaaaaagaa

SEQ ID NO: 1364541 - DNA, 20 bp, Homo sapiens
aaaatctgttgataaatcca

SEQ ID NO: 1364542 - DNA, 12 bp, Homo sapiens
aaaatgaaaaat

SEQ ID NO: 1364543 - DNA, 15 bp, Homo sapiens
aaaatgaaaattgta

SEQ ID NO: 1364544 - DNA, 16 bp, Homo sapiens
aaaatgaaaattgtat

SEQ ID NO: 1364545 - DNA, 14 bp, Homo sapiens
aaaatgaaatgcat

SEQ ID NO: 1364546 - DNA, 15 bp, Homo sapiens
aaaatgaagaattta

SEQ ID NO: 1364547 - DNA, 21 bp, Homo sapiens
aaaatgagcctggcaagaatg

SEQ ID NO: 1364548 - DNA, 13 bp, Homo sapiens
aaaatggaaattt

SEQ ID NO: 1364549 - DNA, 14 bp, Homo sapiens
aaaatgtaatttaa

SEQ ID NO: 1364550 - DNA, 18 bp, Homo sapiens
aaaatgtaatttaaatga

SEQ ID NO: 1364551 - DNA, 17 bp, Homo sapiens
aaaatgtctgtaataat

SEQ ID NO: 1364552 - DNA, 13 bp, Homo sapiens
aaaatgtgaccct

SEQ ID NO: 1364553 - DNA, 20 bp, Homo sapiens
aaaatgtgagtggttgaata

SEQ ID NO: 1364554 - DNA, 20 bp, Homo sapiens
aaaattaaggtgtttgaaaa

SEQ ID NO: 1364555 - DNA, 15 bp, Homo sapiens
aaaattagccaagtg

SEQ ID NO: 1364556 - DNA, 18 bp, Homo sapiens
aaaattagccgggcgtgg

SEQ ID NO: 1364557 - DNA, 18 bp, Homo sapiens
aaaattcatagtaagatt

SEQ ID NO: 1364558 - DNA, 15 bp, Homo sapiens
aaaattcatttctaa

SEQ ID NO: 1364559 - DNA, 18 bp, Homo sapiens
aacatgctggtgaatatt

SEQ ID NO: 1364560 - DNA, 22 bp, Homo sapiens
aacatgttaatgacaatattcc

SEQ ID NO: 1364561 - DNA, 16 bp, Homo sapiens
aaccaaaggaaaatgt

SEQ ID NO: 1364562 - DNA, 15 bp, Homo sapiens
aaccaaatctggaag

SEQ ID NO: 1364563 - DNA, 15 bp, Homo sapiens
aaccaagtcaagtga

SEQ ID NO: 1364564 - DNA, 19 bp, Homo sapiens
aaccacacttgaaaccttt

SEQ ID NO: 1364565 - DNA, 17 bp, Homo sapiens
aaccacttgtagatttg

SEQ ID NO: 1364566 - DNA, 15 bp, Homo sapiens
aacccaagcttagaa

SEQ ID NO: 1364567 - DNA, 14 bp, Homo sapiens
aaccccaaacagtg

SEQ ID NO: 1364568 - DNA, 23 bp, Homo sapiens
aacccgggagcggaggttgcagt

SEQ ID NO: 1364569 - DNA, 22 bp, Homo sapiens
aaccctgccgtcaccaccaccc

SEQ ID NO: 1364570 - DNA, 13 bp, Homo sapiens
aaccgaataaatg

SEQ ID NO: 1364571 - DNA, 19 bp, Homo sapiens
aacctcagggctcccaggg

SEQ ID NO: 1364572 - DNA, 15 bp, Homo sapiens
aacctgaagtttttt

SEQ ID NO: 1364573 - DNA, 17 bp, Homo sapiens
aacctgggattcaggaa

SEQ ID NO: 1364574 - DNA, 11 bp, Homo sapiens
aacctttccct

SEQ ID NO: 1364575 - DNA, 13 bp, Homo sapiens
aacctttccctca

SEQ ID NO: 1364576 - DNA, 20 bp, Homo sapiens
aacctttccctcaccccctc

SEQ ID NO: 1364577 - DNA, 20 bp, Homo sapiens
aaccttttactggttgcatg

SEQ ID NO: 1364578 - DNA, 22 bp, Homo sapiens
aacggaggcctgcgaccctggg

SEQ ID NO: 1364579 - DNA, 20 bp, Homo sapiens
aacggtgctgtgagggaggg

SEQ ID NO: 1364580 - DNA, 16 bp, Homo sapiens
aactaaagcaatagaa

SEQ ID NO: 1364581 - DNA, 21 bp, Homo sapiens
aactacctgtatttaaaaata

SEQ ID NO: 1364582 - DNA, 23 bp, Homo sapiens
aactatagcttgcagaactgtag

SEQ ID NO: 1364583 - DNA, 16 bp, Homo sapiens
aactatattttgtcat

SEQ ID NO: 1364584 - DNA, 21 bp, Homo sapiens
aactattgtgctcagagacac

SEQ ID NO: 1364585 - DNA, 22 bp, Homo sapiens
aactattgtgctcagagacact

SEQ ID NO: 1364586 - DNA, 13 bp, Homo sapiens
aactcaaatacac

SEQ ID NO: 1364587 - DNA, 19 bp, Homo sapiens
aactcaatgctttatttgt

SEQ ID NO: 1364588 - DNA, 15 bp, Homo sapiens
aactcactgtgatca

SEQ ID NO: 1364589 - DNA, 23 bp, Homo sapiens
aactcagagaaaaatgctcccca

SEQ ID NO: 1364590 - DNA, 19 bp, Homo sapiens
aactcatttgttaaaatta

SEQ ID NO: 1364591 - DNA, 21 bp, Homo sapiens
aactctatcggagaacatgaa

SEQ ID NO: 1364592 - DNA, 16 bp, Homo sapiens
aactcttctcattact

SEQ ID NO: 1364593 - DNA, 16 bp, Homo sapiens
aactgaaacatgctta

SEQ ID NO: 1364594 - DNA, 20 bp, Homo sapiens
aactgaagcagcctctcccc

SEQ ID NO: 1364595 - DNA, 21 bp, Homo sapiens
aactgaagcagcctctcccca

SEQ ID NO: 1364596 - DNA, 19 bp, Homo sapiens
aactgaggcttagagatag

SEQ ID NO: 1364597 - DNA, 13 bp, Homo sapiens
aactgcaggccct

SEQ ID NO: 1364598 - DNA, 20 bp, Homo sapiens
aactgcaggccctggcctcc

SEQ ID NO: 1364599 - DNA, 16 bp, Homo sapiens
aactgcattggctttg

SEQ ID NO: 1364600 - DNA, 11 bp, Homo sapiens
aactgtaaatc

SEQ ID NO: 1364601 - DNA, 14 bp, Homo sapiens
aactgtagaaatga

SEQ ID NO: 1364602 - DNA, 19 bp, Homo sapiens
aactgtagaaatgatgatg

SEQ ID NO: 1364603 - DNA, 20 bp, Homo sapiens
aactgtatttgaaataagaa

SEQ ID NO: 1364604 - DNA, 11 bp, Homo sapiens
aactgtcctgt

SEQ ID NO: 1364605 - DNA, 17 bp, Homo sapiens
aactgtcctgtcctgct

SEQ ID NO: 1364606 - DNA, 15 bp, Homo sapiens
aactgtcgtgtcata

SEQ ID NO: 1364607 - DNA, 22 bp, Homo sapiens
aactgtttgaaaacttcagaag

SEQ ID NO: 1364608 - DNA, 15 bp, Homo sapiens
aacttaataatcaag

SEQ ID NO: 1364609 - DNA, 17 bp, Homo sapiens
aacttcatatgtaatct

SEQ ID NO: 1364610 - DNA, 16 bp, Homo sapiens
aacttccaaataaata

SEQ ID NO: 1364611 - DNA, 14 bp, Homo sapiens
aacttgcttaaatt

SEQ ID NO: 1364612 - DNA, 15 bp, Homo sapiens
aacttgcttaaattt

SEQ ID NO: 1364613 - DNA, 21 bp, Homo sapiens
aacttggctcgaatctctgtg

SEQ ID NO: 1364614 - DNA, 22 bp, Homo sapiens
aacttggctcgaatctctgtgc

SEQ ID NO: 1364615 - DNA, 15 bp, Homo sapiens
aactttataaatcca

SEQ ID NO: 1364616 - DNA, 15 bp, Homo sapiens
aactttcaattgtca

SEQ ID NO: 1364617 - DNA, 22 bp, Homo sapiens
aactttgggaaaacatgttaat

SEQ ID NO: 1364618 - DNA, 18 bp, Homo sapiens
aactttgtaaaaatcttt

SEQ ID NO: 1364619 - DNA, 12 bp, Homo sapiens
aacttttctaga

SEQ ID NO: 1364620 - DNA, 11 bp, Homo sapiens
aacttttgtac

SEQ ID NO: 1364621 - DNA, 15 bp, Homo sapiens
aagaaaaaaatacta

SEQ ID NO: 1364622 - DNA, 22 bp, Homo sapiens
aagaaaaaaatactatttaaga

SEQ ID NO: 1364623 - DNA, 17 bp, Homo sapiens
aagaaaaatgagcctgg

SEQ ID NO: 1364624 - DNA, 13 bp, Homo sapiens
aagaaaagatgaa

SEQ ID NO: 1364625 - DNA, 14 bp, Homo sapiens
aagaaaattgagtt

SEQ ID NO: 1364626 - DNA, 15 bp, Homo sapiens
aagaaattttttaaa

SEQ ID NO: 1364627 - DNA, 15 bp, Homo sapiens
aagaacacacacata

SEQ ID NO: 1364628 - DNA, 12 bp, Homo sapiens
aagaacaggcct

SEQ ID NO: 1364629 - DNA, 13 bp, Homo sapiens
aagaacaggcctc

SEQ ID NO: 1364630 - DNA, 23 bp, Homo sapiens
aagaactgcaggccctggcctcc

SEQ ID NO: 1364631 - DNA, 13 bp, Homo sapiens
aagaactggaaac

SEQ ID NO: 1364632 - DNA, 13 bp, Homo sapiens
aagaagaagttca

SEQ ID NO: 1364633 - DNA, 20 bp, Homo sapiens
aagaagagctatcaggagaa

SEQ ID NO: 1364634 - DNA, 12 bp, Homo sapiens
aagaagatgctc

SEQ ID NO: 1364635 - DNA, 14 bp, Homo sapiens
aagaagctctctcc

SEQ ID NO: 1364636 - DNA, 17 bp, Homo sapiens
aagaaggatgatgtctt

SEQ ID NO: 1364637 - DNA, 17 bp, Homo sapiens
aagaagggagaagaaag

SEQ ID NO: 1364638 - DNA, 17 bp, Homo sapiens
aagaagttcatgtccaa

SEQ ID NO: 1364639 - DNA, 18 bp, Homo sapiens
aagaatatcctttaaaat

SEQ ID NO: 1364640 - DNA, 19 bp, Homo sapiens
aagaatatcctttaaaatt

SEQ ID NO: 1364641 - DNA, 17 bp, Homo sapiens
aagaatattgcaaaata

SEQ ID NO: 1364642 - DNA, 19 bp, Homo sapiens
aagaatattgcaaaataca

SEQ ID NO: 1364643 - DNA, 16 bp, Homo sapiens
aagaatgtacgtccag

SEQ ID NO: 1364644 - DNA, 16 bp, Homo sapiens
aagaatgttagagtaa

SEQ ID NO: 1364645 - DNA, 18 bp, Homo sapiens
aagaattgaaaagttttt

SEQ ID NO: 1364646 - DNA, 20 bp, Homo sapiens
aagaattgaaaagtttttgt

SEQ ID NO: 1364647 - DNA, 11 bp, Homo sapiens
aagacactgcc

SEQ ID NO: 1364648 - DNA, 12 bp, Homo sapiens
aagacactgcct

SEQ ID NO: 1364649 - DNA, 23 bp, Homo sapiens
aagacatactccttccatcaaat

SEQ ID NO: 1364650 - DNA, 18 bp, Homo sapiens
aagaccaccacttcgaaa

SEQ ID NO: 1364651 - DNA, 16 bp, Homo sapiens
aagaccctcttgccca

SEQ ID NO: 1364652 - DNA, 20 bp, Homo sapiens
aagactatatatataaatgt

SEQ ID NO: 1364653 - DNA, 22 bp, Homo sapiens
aagactatatatataaatgtat

SEQ ID NO: 1364654 - DNA, 22 bp, Homo sapiens
aagactcttgggagggagttac

SEQ ID NO: 1364655 - DNA, 17 bp, Homo sapiens
aagactggttttctgcc

SEQ ID NO: 1364656 - DNA, 16 bp, Homo sapiens
aagactgtagatatgt

SEQ ID NO: 1364657 - DNA, 21 bp, Homo sapiens
aagagaagttattttctacag

SEQ ID NO: 1364658 - DNA, 14 bp, Homo sapiens
aagagacaggcagg

SEQ ID NO: 1364659 - DNA, 15 bp, Homo sapiens
aagagacatccaaat

SEQ ID NO: 1364660 - DNA, 15 bp, Homo sapiens
aagagatccaaagac

SEQ ID NO: 1364661 - DNA, 16 bp, Homo sapiens
aagagatccaaagact

SEQ ID NO: 1364662 - DNA, 17 bp, Homo sapiens
aagagatccaaagactc

SEQ ID NO: 1364663 - DNA, 16 bp, Homo sapiens
aagagattgtggtttc

SEQ ID NO: 1364664 - DNA, 14 bp, Homo sapiens
aagagcatctgatt

SEQ ID NO: 1364665 - DNA, 14 bp, Homo sapiens
aagagcccttgcct

SEQ ID NO: 1364666 - DNA, 14 bp, Homo sapiens
aagagccttaaaac

SEQ ID NO: 1364667 - DNA, 16 bp, Homo sapiens
aagagccttaaaacat

SEQ ID NO: 1364668 - DNA, 20 bp, Homo sapiens
aagagctattgccaaccagt

SEQ ID NO: 1364669 - DNA, 13 bp, Homo sapiens
aagaggaagcaaa

SEQ ID NO: 1364670 - DNA, 14 bp, Homo sapiens
aagaggaagcaaat

SEQ ID NO: 1364671 - DNA, 20 bp, Homo sapiens
aagaggaatgaaaaaagctt

SEQ ID NO: 1364672 - DNA, 18 bp, Homo sapiens
aagaggttttaaaaaaat

SEQ ID NO: 1364673 - DNA, 16 bp, Homo sapiens
aagagttcccttgaaa

SEQ ID NO: 1364674 - DNA, 18 bp, Homo sapiens
aagagtttcagtttgttg

SEQ ID NO: 1364675 - DNA, 14 bp, Homo sapiens
aagatcactgttta

SEQ ID NO: 1364676 - DNA, 14 bp, Homo sapiens
aagatccagctgcc

SEQ ID NO: 1364677 - DNA, 16 bp, Homo sapiens
aagatcgaatttttca

SEQ ID NO: 1364678 - DNA, 15 bp, Homo sapiens
aagtgcccttcctgc

SEQ ID NO: 1364679 - DNA, 19 bp, Homo sapiens
aagtgcctcaagaggaatg

SEQ ID NO: 1364680 - DNA, 20 bp, Homo sapiens
aagtgcctcaagaggaatga

SEQ ID NO: 1364681 - DNA, 17 bp, Homo sapiens
aagtgcggtgctttagc

SEQ ID NO: 1364682 - DNA, 19 bp, Homo sapiens
aagtgctggagtctcctga

SEQ ID NO: 1364683 - DNA, 22 bp, Homo sapiens
aagtgctggcaaccactaagaa

SEQ ID NO: 1364684 - DNA, 19 bp, Homo sapiens
aagtggaaaaatagcctgc

SEQ ID NO: 1364685 - DNA, 13 bp, Homo sapiens
aagtggaaatgtt

SEQ ID NO: 1364686 - DNA, 15 bp, Homo sapiens
aagtgggcccacccg

SEQ ID NO: 1364687 - DNA, 18 bp, Homo sapiens
aagtgtaagttcacaact

SEQ ID NO: 1364688 - DNA, 14 bp, Homo sapiens
aagtgtataatata

SEQ ID NO: 1364689 - DNA, 19 bp, Homo sapiens
aagtgtataatataaaaaa

SEQ ID NO: 1364690 - DNA, 16 bp, Homo sapiens
aagtgtgaatactgct

SEQ ID NO: 1364691 - DNA, 18 bp, Homo sapiens
aagtgtgaatactgcttg

SEQ ID NO: 1364692 - DNA, 13 bp, Homo sapiens
aagtgtgagcaaa

SEQ ID NO: 1364693 - DNA, 16 bp, Homo sapiens
aagtgtgtatatattt

SEQ ID NO: 1364694 - DNA, 17 bp, Homo sapiens
aagtgtgtatatatttt

SEQ ID NO: 1364695 - DNA, 19 bp, Homo sapiens
aagtgtgtatatattttgt

SEQ ID NO: 1364696 - DNA, 16 bp, Homo sapiens
aagtgtgtgtagtttt

SEQ ID NO: 1364697 - DNA, 18 bp, Homo sapiens
aagttaaacattgaagta

SEQ ID NO: 1364698 - DNA, 13 bp, Homo sapiens
aagttatctttga

SEQ ID NO: 1364699 - DNA, 22 bp, Homo sapiens
aagttatctttgaatatgtagt

SEQ ID NO: 1364700 - DNA, 14 bp, Homo sapiens
aagttattgcagtt

SEQ ID NO: 1364701 - DNA, 17 bp, Homo sapiens
aagttattgcagtttat

SEQ ID NO: 1364702 - DNA, 14 bp, Homo sapiens
aagttattttctac

SEQ ID NO: 1364703 - DNA, 21 bp, Homo sapiens
aagttattttctacagtggtt

SEQ ID NO: 1364704 - DNA, 19 bp, Homo sapiens
aagttgagctatgacttaa

SEQ ID NO: 1364705 - DNA, 19 bp, Homo sapiens
aagtttacaatcaaaggaa

SEQ ID NO: 1364706 - DNA, 19 bp, Homo sapiens
aagtttcagtattagatgc

SEQ ID NO: 1364707 - DNA, 16 bp, Homo sapiens
aagtttccatcatcta

SEQ ID NO: 1364708 - DNA, 20 bp, Homo sapiens
aagtttgagatcagcctggg

SEQ ID NO: 1364709 - DNA, 20 bp, Homo sapiens
aagttttcctacacttgaga

SEQ ID NO: 1364710 - DNA, 19 bp, Homo sapiens
aagttttgacaagctggct

SEQ ID NO: 1364711 - DNA, 22 bp, Homo sapiens
aagttttgttgtacttaaatgg

SEQ ID NO: 1364712 - DNA, 13 bp, Homo sapiens
aataaaaatgata

SEQ ID NO: 1364713 - DNA, 11 bp, Homo sapiens
aataaaatttg

SEQ ID NO: 1364714 - DNA, 13 bp, Homo sapiens
aataaaatttgtt

SEQ ID NO: 1364715 - DNA, 16 bp, Homo sapiens
aataaaatttgttgca

SEQ ID NO: 1364716 - DNA, 15 bp, Homo sapiens
aataaaccctcagag

SEQ ID NO: 1364717 - DNA, 20 bp, Homo sapiens
aataaagaagtatggtaatc

SEQ ID NO: 1364718 - DNA, 19 bp, Homo sapiens
aataaagtttgcttagaaa

SEQ ID NO: 1364719 - DNA, 22 bp, Homo sapiens
aataaattttgaaaagtaatat

SEQ ID NO: 1364720 - DNA, 15 bp, Homo sapiens
aataacaaagccctt

SEQ ID NO: 1364721 - DNA, 12 bp, Homo sapiens
aataacagctgc

SEQ ID NO: 1364722 - DNA, 18 bp, Homo sapiens
aataacccataattgaag

SEQ ID NO: 1364723 - DNA, 20 bp, Homo sapiens
aataagctactagcaaaata

SEQ ID NO: 1364724 - DNA, 17 bp, Homo sapiens
aataagctagttgaata

SEQ ID NO: 1364725 - DNA, 18 bp, Homo sapiens
aataagctagttgaatac

SEQ ID NO: 1364726 - DNA, 22 bp, Homo sapiens
aataagctagttgaatacttga

SEQ ID NO: 1364727 - DNA, 18 bp, Homo sapiens
aataagttattgcagttt

SEQ ID NO: 1364728 - DNA, 13 bp, Homo sapiens
aataatagactgt

SEQ ID NO: 1364729 - DNA, 15 bp, Homo sapiens
aataatatattttct

SEQ ID NO: 1364730 - DNA, 15 bp, Homo sapiens
aataatcttgtttct

SEQ ID NO: 1364731 - DNA, 14 bp, Homo sapiens
aataattctttttt

SEQ ID NO: 1364732 - DNA, 15 bp, Homo sapiens
aataattctttttta

SEQ ID NO: 1364733 - DNA, 17 bp, Homo sapiens
aatacaaggtataataa

SEQ ID NO: 1364734 - DNA, 20 bp, Homo sapiens
aatacaaggtataataaaat

SEQ ID NO: 1364735 - DNA, 15 bp, Homo sapiens
aatacacatttgcta

SEQ ID NO: 1364736 - DNA, 17 bp, Homo sapiens
aatacatgaagcttcat

SEQ ID NO: 1364737 - DNA, 19 bp, Homo sapiens
aataccacatcaaataaga

SEQ ID NO: 1364738 - DNA, 21 bp, Homo sapiens
aataccacatcaaataagaaa

SEQ ID NO: 1364739 - DNA, 21 bp, Homo sapiens
aatactatttaagatgtgaaa

SEQ ID NO: 1364740 - DNA, 14 bp, Homo sapiens
aatactgaaccact

SEQ ID NO: 1364741 - DNA, 13 bp, Homo sapiens
aatactgcttgaa

SEQ ID NO: 1364742 - DNA, 19 bp, Homo sapiens
aatagaaattttgtaagaa

SEQ ID NO: 1364743 - DNA, 15 bp, Homo sapiens
aatagacacatacat

SEQ ID NO: 1364744 - DNA, 22 bp, Homo sapiens
aatagatataaatttttaagag

SEQ ID NO: 1364745 - DNA, 19 bp, Homo sapiens
aatagcaacttttgtgtaa

SEQ ID NO: 1364746 - DNA, 20 bp, Homo sapiens
aatagcctgcctcttctcta

SEQ ID NO: 1364747 - DNA, 13 bp, Homo sapiens
aataggaaacaag

SEQ ID NO: 1364748 - DNA, 19 bp, Homo sapiens
aataggaatcattcagaaa

SEQ ID NO: 1364749 - DNA, 22 bp, Homo sapiens
aataggaatcattcagaaatgt

SEQ ID NO: 1364750 - DNA, 23 bp, Homo sapiens
aataggaatcattcagaaatgtt

SEQ ID NO: 1364751 - DNA, 15 bp, Homo sapiens
aataggatttttaga

SEQ ID NO: 1364752 - DNA, 14 bp, Homo sapiens
aatagtatgaaaat

SEQ ID NO: 1364753 - DNA, 15 bp, Homo sapiens
aatagtctatatttt

SEQ ID NO: 1364754 - DNA, 16 bp, Homo sapiens
aatagtctttgccagt

SEQ ID NO: 1364755 - DNA, 20 bp, Homo sapiens
aatagtttattttaaaacaa

SEQ ID NO: 1364756 - DNA, 11 bp, Homo sapiens
aatataaaaaa

SEQ ID NO: 1364757 - DNA, 12 bp, Homo sapiens
aatataaaatta

SEQ ID NO: 1364758 - DNA, 21 bp, Homo sapiens
aatataaacaaagattcatga

SEQ ID NO: 1364759 - DNA, 22 bp, Homo sapiens
aatataaacaaagattcatgat

SEQ ID NO: 1364760 - DNA, 15 bp, Homo sapiens
aatatagctgagact

SEQ ID NO: 1364761 - DNA, 22 bp, Homo sapiens
aatatatatctatctatttgag

SEQ ID NO: 1364762 - DNA, 21 bp, Homo sapiens
aatatatttataaggaaattt

SEQ ID NO: 1364763 - DNA, 15 bp, Homo sapiens
aatatattttctgtt

SEQ ID NO: 1364764 - DNA, 14 bp, Homo sapiens
aatatcaaagtcat

SEQ ID NO: 1364765 - DNA, 21 bp, Homo sapiens
aatatcaaagtcattaaagac

SEQ ID NO: 1364766 - DNA, 19 bp, Homo sapiens
aatatcaaattaattgtgt

SEQ ID NO: 1364767 - DNA, 15 bp, Homo sapiens
aatatgtttaaaata

SEQ ID NO: 1364768 - DNA, 20 bp, Homo sapiens
aatatgtttaaaataaaatg

SEQ ID NO: 1364769 - DNA, 20 bp, Homo sapiens
aatattcagggtaaatagga

SEQ ID NO: 1364770 - DNA, 16 bp, Homo sapiens
aatattccagatcttt

SEQ ID NO: 1364771 - DNA, 16 bp, Homo sapiens
aatattgagaaagaaa

SEQ ID NO: 1364772 - DNA, 20 bp, Homo sapiens
aatattgagaaagaaactaa

SEQ ID NO: 1364773 - DNA, 21 bp, Homo sapiens
aatattgattgggaaaacatt

SEQ ID NO: 1364774 - DNA, 14 bp, Homo sapiens
aatattgcaaaata

SEQ ID NO: 1364775 - DNA, 16 bp, Homo sapiens
aatattgcaaaataca

SEQ ID NO: 1364776 - DNA, 18 bp, Homo sapiens
aatattgcaaaatacatg

SEQ ID NO: 1364777 - DNA, 19 bp, Homo sapiens
aatattgcaaaatacatga

SEQ ID NO: 1364778 - DNA, 12 bp, Homo sapiens
aatattgtttct

SEQ ID NO: 1364779 - DNA, 23 bp, Homo sapiens
aatattgtttctgcattcatttt

SEQ ID NO: 1364780 - DNA, 22 bp, Homo sapiens
aatattgtttggtaaatgtttc

SEQ ID NO: 1364781 - DNA, 15 bp, Homo sapiens
aatatttattaaatt

SEQ ID NO: 1364782 - DNA, 20 bp, Homo sapiens
aatatttttatatttccttt

SEQ ID NO: 1364783 - DNA, 14 bp, Homo sapiens
aatcaaaagtgcct

SEQ ID NO: 1364784 - DNA, 14 bp, Homo sapiens
aatcaaataagtat

SEQ ID NO: 1364785 - DNA, 15 bp, Homo sapiens
aatcaaataagtatt

SEQ ID NO: 1364786 - DNA, 16 bp, Homo sapiens
aatcaaataagtattt

SEQ ID NO: 1364787 - DNA, 18 bp, Homo sapiens
aatcaaataagtatttat

SEQ ID NO: 1364788 - DNA, 12 bp, Homo sapiens
aatcaataatat

SEQ ID NO: 1364789 - DNA, 20 bp, Homo sapiens
aatcaatacactagttgttt

SEQ ID NO: 1364790 - DNA, 15 bp, Homo sapiens
aatcaattctagtca

SEQ ID NO: 1364791 - DNA, 23 bp, Homo sapiens
aatcaccatgtaagcactctgga

SEQ ID NO: 1364792 - DNA, 13 bp, Homo sapiens
aatcactgtgtat

SEQ ID NO: 1364793 - DNA, 15 bp, Homo sapiens
aatcactgtgtatat

SEQ ID NO: 1364794 - DNA, 16 bp, Homo sapiens
aatcactgtgtatatt

SEQ ID NO: 1364795 - DNA, 19 bp, Homo sapiens
aatcactgtgtatatttga

SEQ ID NO: 1364796 - DNA, 17 bp, Homo sapiens
aattcttttttattaat

SEQ ID NO: 1364797 - DNA, 21 bp, Homo sapiens
aattcttttttattaatcact

SEQ ID NO: 1364798 - DNA, 20 bp, Homo sapiens
aattgaagtgtataatataa

SEQ ID NO: 1364799 - DNA, 18 bp, Homo sapiens
aattgagttgcacttatt

SEQ ID NO: 1364800 - DNA, 23 bp, Homo sapiens
aattgcttggttgtaattaaatt

SEQ ID NO: 1364801 - DNA, 16 bp, Homo sapiens
aattggggaggagggg

SEQ ID NO: 1364802 - DNA, 13 bp, Homo sapiens
aattggggcactt

SEQ ID NO: 1364803 - DNA, 21 bp, Homo sapiens
aattgtaaagtaaaagctata

SEQ ID NO: 1364804 - DNA, 13 bp, Homo sapiens
aattgtacaaaat

SEQ ID NO: 1364805 - DNA, 18 bp, Homo sapiens
aattgtggctatcctgat

SEQ ID NO: 1364806 - DNA, 18 bp, Homo sapiens
aatttaaaaaataaataa

SEQ ID NO: 1364807 - DNA, 16 bp, Homo sapiens
aatttaaatgaaagaa

SEQ ID NO: 1364808 - DNA, 18 bp, Homo sapiens
aatttaaatgaaagaaaa

SEQ ID NO: 1364809 - DNA, 17 bp, Homo sapiens
aatttaagttttgacaa

SEQ ID NO: 1364810 - DNA, 24 bp, Homo sapiens
aatttaagttttgacaagctggct

SEQ ID NO: 1364811 - DNA, 13 bp, Homo sapiens
aatttacttgttt

SEQ ID NO: 1364812 - DNA, 16 bp, Homo sapiens
aatttacttgttttgg

SEQ ID NO: 1364813 - DNA, 23 bp, Homo sapiens
aatttagtgtttttttatttcta

SEQ ID NO: 1364814 - DNA, 21 bp, Homo sapiens
aatttatttccactaaaaata

SEQ ID NO: 1364815 - DNA, 22 bp, Homo sapiens
aatttcactactagattgacta

SEQ ID NO: 1364816 - DNA, 12 bp, Homo sapiens
aatttcagggtg

SEQ ID NO: 1364817 - DNA, 16 bp, Homo sapiens
aatttcatgtaaaaca

SEQ ID NO: 1364818 - DNA, 14 bp, Homo sapiens
aatttcctttttga

SEQ ID NO: 1364819 - DNA, 14 bp, Homo sapiens
aatttctcctccct

SEQ ID NO: 1364820 - DNA, 21 bp, Homo sapiens
aatttctgtgttgccaagctc

SEQ ID NO: 1364821 - DNA, 15 bp, Homo sapiens
aatttcttatgtgac

SEQ ID NO: 1364822 - DNA, 18 bp, Homo sapiens
aatttcttatgtgacatt

SEQ ID NO: 1364823 - DNA, 20 bp, Homo sapiens
aatttgcactaaatcagaga

SEQ ID NO: 1364824 - DNA, 15 bp, Homo sapiens
aattttaaaaatcta

SEQ ID NO: 1364825 - DNA, 22 bp, Homo sapiens
aattttaaaatctgagggaaat

SEQ ID NO: 1364826 - DNA, 20 bp, Homo sapiens
aattttacatgtttataaat

SEQ ID NO: 1364827 - DNA, 19 bp, Homo sapiens
aattttcaagtaattgtga

SEQ ID NO: 1364828 - DNA, 21 bp, Homo sapiens
aattttcacttttggcaatga

SEQ ID NO: 1364829 - DNA, 19 bp, Homo sapiens
aattttcattttgcactga

SEQ ID NO: 1364830 - DNA, 14 bp, Homo sapiens
aattttgtacaaat

SEQ ID NO: 1364831 - DNA, 14 bp, Homo sapiens
aatttttaatgatg

SEQ ID NO: 1364832 - DNA, 16 bp, Homo sapiens
aatttttttgtaataa

SEQ ID NO: 1364833 - DNA, 14 bp, Homo sapiens
aatttttttgtatg

SEQ ID NO: 1364834 - DNA, 15 bp, Homo sapiens
aatttttttgtatga

SEQ ID NO: 1364835 - DNA, 19 bp, Homo sapiens
aattttttttaaaatagaa

SEQ ID NO: 1364836 - DNA, 20 bp, Homo sapiens
aattttttttaaaatagaaa

SEQ ID NO: 1364837 - DNA, 11 bp, Homo sapiens
acaaaaaccaa

SEQ ID NO: 1364838 - DNA, 16 bp, Homo sapiens
acaaaaagcataaaaa

SEQ ID NO: 1364839 - DNA, 14 bp, Homo sapiens
acaaaaagcttccc

SEQ ID NO: 1364840 - DNA, 14 bp, Homo sapiens
acaaaacttttcta

SEQ ID NO: 1364841 - DNA, 15 bp, Homo sapiens
acaaaagtctgtctt

SEQ ID NO: 1364842 - DNA, 16 bp, Homo sapiens
acaaaataaaataata

SEQ ID NO: 1364843 - DNA, 20 bp, Homo sapiens
acaaaatttgactaatttta

SEQ ID NO: 1364844 - DNA, 21 bp, Homo sapiens
acaaagaaatccggagaagct

SEQ ID NO: 1364845 - DNA, 14 bp, Homo sapiens
acaaagtgccaaag

SEQ ID NO: 1364846 - DNA, 17 bp, Homo sapiens
acaaagtgccaaagaaa

SEQ ID NO: 1364847 - DNA, 21 bp, Homo sapiens
acaaatgctcaaagaaatcta

SEQ ID NO: 1364848 - DNA, 19 bp, Homo sapiens
acaacaattggtaaaactc

SEQ ID NO: 1364849 - DNA, 14 bp, Homo sapiens
acaaccatgtcatt

SEQ ID NO: 1364850 - DNA, 13 bp, Homo sapiens
acaacggaggcct

SEQ ID NO: 1364851 - DNA, 22 bp, Homo sapiens
acaacggaggcctgcgaccctg

SEQ ID NO: 1364852 - DNA, 13 bp, Homo sapiens
acaactgtgactg

SEQ ID NO: 1364853 - DNA, 15 bp, Homo sapiens
acaacttaaataata

SEQ ID NO: 1364854 - DNA, 17 bp, Homo sapiens
acaagaaataatagaaa

SEQ ID NO: 1364855 - DNA, 16 bp, Homo sapiens
acaagcaagttctgag

SEQ ID NO: 1364856 - DNA, 19 bp, Homo sapiens
acaagctgcaccctcaggc

SEQ ID NO: 1364857 - DNA, 13 bp, Homo sapiens
acaagctggctta

SEQ ID NO: 1364858 - DNA, 19 bp, Homo sapiens
acaagctggcttacactgg

SEQ ID NO: 1364859 - DNA, 16 bp, Homo sapiens
acaagcttcagtaagt

SEQ ID NO: 1364860 - DNA, 22 bp, Homo sapiens
acaagtagttctgtatttgaaa

SEQ ID NO: 1364861 - DNA, 23 bp, Homo sapiens
acaagtagttctgtatttgaaag

SEQ ID NO: 1364862 - DNA, 22 bp, Homo sapiens
acaagtcagctccagctttctg

SEQ ID NO: 1364863 - DNA, 20 bp, Homo sapiens
acaagttgagctatgactta

SEQ ID NO: 1364864 - DNA, 19 bp, Homo sapiens
acaatctctttttgtttgc

SEQ ID NO: 1364865 - DNA, 20 bp, Homo sapiens
acaatgaagttgaaaatcat

SEQ ID NO: 1364866 - DNA, 20 bp, Homo sapiens
acaatttgcactaaatcaga

SEQ ID NO: 1364867 - DNA, 20 bp, Homo sapiens
acacaaatgctcaaagaaat

SEQ ID NO: 1364868 - DNA, 16 bp, Homo sapiens
acacacatatacacga

SEQ ID NO: 1364869 - DNA, 11 bp, Homo sapiens
acacacctgta

SEQ ID NO: 1364870 - DNA, 16 bp, Homo sapiens
acacagaaacactgcc

SEQ ID NO: 1364871 - DNA, 21 bp, Homo sapiens
acacagaaacactgccttttt

SEQ ID NO: 1364872 - DNA, 16 bp, Homo sapiens
acacatacatgtcaca

SEQ ID NO: 1364873 - DNA, 16 bp, Homo sapiens
acacatatatattaca

SEQ ID NO: 1364874 - DNA, 23 bp, Homo sapiens
acacattacaaagttaaaattgt

SEQ ID NO: 1364875 - DNA, 16 bp, Homo sapiens
acacatttgctactgt

SEQ ID NO: 1364876 - DNA, 20 bp, Homo sapiens
acacatttgctactgttgta

SEQ ID NO: 1364877 - DNA, 14 bp, Homo sapiens
acaccaatcttact

SEQ ID NO: 1364878 - DNA, 13 bp, Homo sapiens
acacccaaagctg

SEQ ID NO: 1364879 - DNA, 14 bp, Homo sapiens
acacccaaagctga

SEQ ID NO: 1364880 - DNA, 17 bp, Homo sapiens
acaccctcaacctcttc

SEQ ID NO: 1364881 - DNA, 21 bp, Homo sapiens
acacctctgcacaagctgcac

SEQ ID NO: 1364882 - DNA, 19 bp, Homo sapiens
acacctggctgaggttcct

SEQ ID NO: 1364883 - DNA, 18 bp, Homo sapiens
acacgaatagacatcaaa

SEQ ID NO: 1364884 - DNA, 21 bp, Homo sapiens
acactaacgaaatatcaaagt

SEQ ID NO: 1364885 - DNA, 20 bp, Homo sapiens
acactaactcaccagcccca

SEQ ID NO: 1364886 - DNA, 15 bp, Homo sapiens
acactcaaaagctgg

SEQ ID NO: 1364887 - DNA, 14 bp, Homo sapiens
acactcctctgcgt

SEQ ID NO: 1364888 - DNA, 17 bp, Homo sapiens
acactcctctgcgtcta

SEQ ID NO: 1364889 - DNA, 14 bp, Homo sapiens
acactgaaagtttt

SEQ ID NO: 1364890 - DNA, 13 bp, Homo sapiens
acactgcctgggc

SEQ ID NO: 1364891 - DNA, 15 bp, Homo sapiens
acactgcctgggctg

SEQ ID NO: 1364892 - DNA, 20 bp, Homo sapiens
acactgcctttttatttata

SEQ ID NO: 1364893 - DNA, 13 bp, Homo sapiens
acactggttctca

SEQ ID NO: 1364894 - DNA, 14 bp, Homo sapiens
acactggttctcaa

SEQ ID NO: 1364895 - DNA, 13 bp, Homo sapiens
acacttgaaacct

SEQ ID NO: 1364896 - DNA, 23 bp, Homo sapiens
acactttgttgcaagatgtgaat

SEQ ID NO: 1364897 - DNA, 14 bp, Homo sapiens
acagaaacactgcc

SEQ ID NO: 1364898 - DNA, 15 bp, Homo sapiens
acagaaacactgcct

SEQ ID NO: 1364899 - DNA, 19 bp, Homo sapiens
acagaaacactgccttttt

SEQ ID NO: 1364900 - DNA, 13 bp, Homo sapiens
acagaaatgagga

SEQ ID NO: 1364901 - DNA, 15 bp, Homo sapiens
acagaaattgtatat

SEQ ID NO: 1364902 - DNA, 19 bp, Homo sapiens
acagaacttgaatgtgtca

SEQ ID NO: 1364903 - DNA, 20 bp, Homo sapiens
acagaacttgaatgtgtcag

SEQ ID NO: 1364904 - DNA, 20 bp, Homo sapiens
acagaatgcaaccaagtcac

SEQ ID NO: 1364905 - DNA, 22 bp, Homo sapiens
acagaatgcaaccaagtcacac

SEQ ID NO: 1364906 - DNA, 18 bp, Homo sapiens
acagacccctcgcaactg

SEQ ID NO: 1364907 - DNA, 14 bp, Homo sapiens
acagactattttta

SEQ ID NO: 1364908 - DNA, 15 bp, Homo sapiens
acagagtaatcttgt

SEQ ID NO: 1364909 - DNA, 22 bp, Homo sapiens
acagatacctccaaccctgccg

SEQ ID NO: 1364910 - DNA, 14 bp, Homo sapiens
acagatgaatgtat

SEQ ID NO: 1364911 - DNA, 17 bp, Homo sapiens
acagatgtgctgacaag

SEQ ID NO: 1364912 - DNA, 15 bp, Homo sapiens
acagattctttcagt

SEQ ID NO: 1364913 - DNA, 21 bp, Homo sapiens
acagattctttcagttctttg

SEQ ID NO: 1364914 - DNA, 21 bp, Homo sapiens
accatgtaagcactctggatg

SEQ ID NO: 1364915 - DNA, 18 bp, Homo sapiens
accatgtcatttcagaag

SEQ ID NO: 1364916 - DNA, 16 bp, Homo sapiens
accatgtgagctcttc

SEQ ID NO: 1364917 - DNA, 18 bp, Homo sapiens
accatgtgagctcttcct

SEQ ID NO: 1364918 - DNA, 13 bp, Homo sapiens
accattctgactc

SEQ ID NO: 1364919 - DNA, 21 bp, Homo sapiens
accattctgactcggtttctc

SEQ ID NO: 1364920 - DNA, 22 bp, Homo sapiens
accattgagaccgtgaagatac

SEQ ID NO: 1364921 - DNA, 23 bp, Homo sapiens
accattttttaatttacttgttt

SEQ ID NO: 1364922 - DNA, 11 bp, Homo sapiens
acccaaagctg

SEQ ID NO: 1364923 - DNA, 17 bp, Homo sapiens
acccaaccctatctcct

SEQ ID NO: 1364924 - DNA, 13 bp, Homo sapiens
acccacctagaac

SEQ ID NO: 1364925 - DNA, 15 bp, Homo sapiens
acccagcgtggcctc

SEQ ID NO: 1364926 - DNA, 22 bp, Homo sapiens
acccaggaggcagggaggcagc

SEQ ID NO: 1364927 - DNA, 21 bp, Homo sapiens
acccagggttcccgcggggct

SEQ ID NO: 1364928 - DNA, 18 bp, Homo sapiens
acccagtcacctctgtct

SEQ ID NO: 1364929 - DNA, 18 bp, Homo sapiens
acccatgcaagcagagga

SEQ ID NO: 1364930 - DNA, 22 bp, Homo sapiens
acccatgcaagcagaggaccag

SEQ ID NO: 1364931 - DNA, 13 bp, Homo sapiens
acccattgctgtt

SEQ ID NO: 1364932 - DNA, 20 bp, Homo sapiens
accccaggacgccactcatt

SEQ ID NO: 1364933 - DNA, 18 bp, Homo sapiens
accccatctctacaaaaa

SEQ ID NO: 1364934 - DNA, 14 bp, Homo sapiens
accccctcccaccc

SEQ ID NO: 1364935 - DNA, 16 bp, Homo sapiens
accccctcccaccccc

SEQ ID NO: 1364936 - DNA, 12 bp, Homo sapiens
accccctccttc

SEQ ID NO: 1364937 - DNA, 15 bp, Homo sapiens
accccctccttcaga

SEQ ID NO: 1364938 - DNA, 22 bp, Homo sapiens
accccggccggccacccaggag

SEQ ID NO: 1364939 - DNA, 20 bp, Homo sapiens
acccctcaacacctctgcac

SEQ ID NO: 1364940 - DNA, 23 bp, Homo sapiens
accccttctctcctccccaaatc

SEQ ID NO: 1364941 - DNA, 23 bp, Homo sapiens
acccgaccccccgtgggctcccg

SEQ ID NO: 1364942 - DNA, 23 bp, Homo sapiens
acccgggaacctccccagcctgc

SEQ ID NO: 1364943 - DNA, 21 bp, Homo sapiens
accctagttagtgttttgcct

SEQ ID NO: 1364944 - DNA, 18 bp, Homo sapiens
accctatctcctgacaga

SEQ ID NO: 1364945 - DNA, 19 bp, Homo sapiens
accctattgctgcttgagg

SEQ ID NO: 1364946 - DNA, 22 bp, Homo sapiens
accctccaaatggagaagctgc

SEQ ID NO: 1364947 - DNA, 18 bp, Homo sapiens
accctcgccggaccctct

SEQ ID NO: 1364948 - DNA, 22 bp, Homo sapiens
accctctaacctcgccctctcc

SEQ ID NO: 1364949 - DNA, 14 bp, Homo sapiens
accctcttagaaaa

SEQ ID NO: 1364950 - DNA, 18 bp, Homo sapiens
accctcttgcccatcctg

SEQ ID NO: 1364951 - DNA, 17 bp, Homo sapiens
accctgccgtcaccacc

SEQ ID NO: 1364952 - DNA, 19 bp, Homo sapiens
accctgctgctggtgcaca

SEQ ID NO: 1364953 - DNA, 13 bp, Homo sapiens
accctggagccca

SEQ ID NO: 1364954 - DNA, 14 bp, Homo sapiens
accctgggccctgg

SEQ ID NO: 1364955 - DNA, 18 bp, Homo sapiens
accctgggtgggctctgt

SEQ ID NO: 1364956 - DNA, 20 bp, Homo sapiens
accctgggtgggctctgtgc

SEQ ID NO: 1364957 - DNA, 20 bp, Homo sapiens
accctgggtgtccccgctgc

SEQ ID NO: 1364958 - DNA, 23 bp, Homo sapiens
accctgggtgtccccgctgctgt

SEQ ID NO: 1364959 - DNA, 21 bp, Homo sapiens
accctgtgacatggtgcctga

SEQ ID NO: 1364960 - DNA, 12 bp, Homo sapiens
accctttggttt

SEQ ID NO: 1364961 - DNA, 12 bp, Homo sapiens
accgaataaatg

SEQ ID NO: 1364962 - DNA, 13 bp, Homo sapiens
accgaataaatgt

SEQ ID NO: 1364963 - DNA, 18 bp, Homo sapiens
accgagaaggtttatccc

SEQ ID NO: 1364964 - DNA, 20 bp, Homo sapiens
accgagtagaaaatgtgacc

SEQ ID NO: 1364965 - DNA, 14 bp, Homo sapiens
accgcacagctcag

SEQ ID NO: 1364966 - DNA, 18 bp, Homo sapiens
accgcccttttcccctac

SEQ ID NO: 1364967 - DNA, 16 bp, Homo sapiens
accggacttttctgca

SEQ ID NO: 1364968 - DNA, 14 bp, Homo sapiens
accggtccagctgg

SEQ ID NO: 1364969 - DNA, 16 bp, Homo sapiens
accggtccagctggcc

SEQ ID NO: 1364970 - DNA, 17 bp, Homo sapiens
accggtccagctggcct

SEQ ID NO: 1364971 - DNA, 18 bp, Homo sapiens
accggtccagctggcctg

SEQ ID NO: 1364972 - DNA, 15 bp, Homo sapiens
accgtggaggaggaa

SEQ ID NO: 1364973 - DNA, 18 bp, Homo sapiens
accgtggaggaggaaggc

SEQ ID NO: 1364974 - DNA, 22 bp, Homo sapiens
accgtggaggaggaaggcaaga

SEQ ID NO: 1364975 - DNA, 17 bp, Homo sapiens
accgtgtctgtctggca

SEQ ID NO: 1364976 - DNA, 14 bp, Homo sapiens
acctaccaaaatgg

SEQ ID NO: 1364977 - DNA, 16 bp, Homo sapiens
acctagctaattattt

SEQ ID NO: 1364978 - DNA, 14 bp, Homo sapiens
acctagtgaaactt

SEQ ID NO: 1364979 - DNA, 23 bp, Homo sapiens
acctcaaacttccagtcaggtag

SEQ ID NO: 1364980 - DNA, 14 bp, Homo sapiens
acctcacctagaaa

SEQ ID NO: 1364981 - DNA, 15 bp, Homo sapiens
acctcacctagaaat

SEQ ID NO: 1364982 - DNA, 12 bp, Homo sapiens
acctcagcctgc

SEQ ID NO: 1364983 - DNA, 23 bp, Homo sapiens
acctcagcctgcacagtgtcccc

SEQ ID NO: 1364984 - DNA, 20 bp, Homo sapiens
acctcagggctcccaggggt

SEQ ID NO: 1364985 - DNA, 18 bp, Homo sapiens
acctcaggtgagaagcag

SEQ ID NO: 1364986 - DNA, 22 bp, Homo sapiens
acctcagttattacatgtaatt

SEQ ID NO: 1364987 - DNA, 14 bp, Homo sapiens
acctccaaccctgc

SEQ ID NO: 1364988 - DNA, 22 bp, Homo sapiens
acctccaaccctgccgtcacca

SEQ ID NO: 1364989 - DNA, 23 bp, Homo sapiens
acctccaaccctgccgtcaccac

SEQ ID NO: 1364990 - DNA, 15 bp, Homo sapiens
acctccccagcattc

SEQ ID NO: 1364991 - DNA, 22 bp, Homo sapiens
acctccccagcctgcgcctgct

SEQ ID NO: 1364992 - DNA, 15 bp, Homo sapiens
acctcctcatggcag

SEQ ID NO: 1364993 - DNA, 14 bp, Homo sapiens
acctcgccctctcc

SEQ ID NO: 1364994 - DNA, 22 bp, Homo sapiens
acctcgccctctcctttgttcc

SEQ ID NO: 1364995 - DNA, 18 bp, Homo sapiens
acctcggtcactccaact

SEQ ID NO: 1364996 - DNA, 12 bp, Homo sapiens
acctctgcacaa

SEQ ID NO: 1364997 - DNA, 21 bp, Homo sapiens
acctctgcacaagctgcaccc

SEQ ID NO: 1364998 - DNA, 19 bp, Homo sapiens
acctgaagatgggagcctt

SEQ ID NO: 1364999 - DNA, 14 bp, Homo sapiens
acctgaggctgtgg

SEQ ID NO: 1365000 - DNA, 20 bp, Homo sapiens
acctgccaggcaggggtggg

SEQ ID NO: 1365001 - DNA, 13 bp, Homo sapiens
acctggctgaggt

SEQ ID NO: 1365002 - DNA, 19 bp, Homo sapiens
acctggctgaggttcctct

SEQ ID NO: 1365003 - DNA, 21 bp, Homo sapiens
acctggctgaggttcctctgc

SEQ ID NO: 1365004 - DNA, 22 bp, Homo sapiens
acctggctgaggttcctctgcc

SEQ ID NO: 1365005 - DNA, 18 bp, Homo sapiens
acctgggattcaggaatg

SEQ ID NO: 1365006 - DNA, 15 bp, Homo sapiens
acctgtaacttttgt

SEQ ID NO: 1365007 - DNA, 17 bp, Homo sapiens
acctgtaacttttgtaa

SEQ ID NO: 1365008 - DNA, 14 bp, Homo sapiens
acctgtagtcccag

SEQ ID NO: 1365009 - DNA, 16 bp, Homo sapiens
acctgtagtcccagct

SEQ ID NO: 1365010 - DNA, 16 bp, Homo sapiens
acctgtatacagtgca

SEQ ID NO: 1365011 - DNA, 21 bp, Homo sapiens
acctgtatatttgtaaagcta

SEQ ID NO: 1365012 - DNA, 17 bp, Homo sapiens
acctgtatttaaaaata

SEQ ID NO: 1365013 - DNA, 20 bp, Homo sapiens
acctgtatttaaaaatagaa

SEQ ID NO: 1365014 - DNA, 21 bp, Homo sapiens
acctgtatttaaaaatagaaa

SEQ ID NO: 1365015 - DNA, 14 bp, Homo sapiens
accttagaatacag

SEQ ID NO: 1365016 - DNA, 17 bp, Homo sapiens
accttaggccttcctct

SEQ ID NO: 1365017 - DNA, 21 bp, Homo sapiens
accttaggccttcctctctcc

SEQ ID NO: 1365018 - DNA, 18 bp, Homo sapiens
accttctatagcatcact

SEQ ID NO: 1365019 - DNA, 20 bp, Homo sapiens
accttctatagcatcactta

SEQ ID NO: 1365020 - DNA, 15 bp, Homo sapiens
accttgtaaaagaca

SEQ ID NO: 1365021 - DNA, 22 bp, Homo sapiens
acctttccctcaccccctccca

SEQ ID NO: 1365022 - DNA, 13 bp, Homo sapiens
acctttctctctc

SEQ ID NO: 1365023 - DNA, 21 bp, Homo sapiens
accttttactggttgcatgga

SEQ ID NO: 1365024 - DNA, 13 bp, Homo sapiens
accttttactgtg

SEQ ID NO: 1365025 - DNA, 18 bp, Homo sapiens
acgaaccttggcctgggc

SEQ ID NO: 1365026 - DNA, 15 bp, Homo sapiens
acgaatagacatcaa

SEQ ID NO: 1365027 - DNA, 19 bp, Homo sapiens
acgaatttctgtgccctcc

SEQ ID NO: 1365028 - DNA, 21 bp, Homo sapiens
acgaatttctgtgccctcctg

SEQ ID NO: 1365029 - DNA, 22 bp, Homo sapiens
acgaatttctgtgccctcctga

SEQ ID NO: 1365030 - DNA, 15 bp, Homo sapiens
acgactgcccggcag

SEQ ID NO: 1365031 - DNA, 18 bp, Homo sapiens
actttgtaaattctgatt

SEQ ID NO: 1365032 - DNA, 19 bp, Homo sapiens
actttgtaaattctgattt

SEQ ID NO: 1365033 - DNA, 21 bp, Homo sapiens
actttgttgcaagatgtgaat

SEQ ID NO: 1365034 - DNA, 22 bp, Homo sapiens
actttgttgcaagatgtgaatt

SEQ ID NO: 1365035 - DNA, 21 bp, Homo sapiens
acttttatctattctgagaaa

SEQ ID NO: 1365036 - DNA, 10 bp, Homo sapiens
acttttcatt

SEQ ID NO: 1365037 - DNA, 14 bp, Homo sapiens
acttttcattctct

SEQ ID NO: 1365038 - DNA, 12 bp, Homo sapiens
actttttataaa

SEQ ID NO: 1365039 - DNA, 16 bp, Homo sapiens
acttttttaaatattt

SEQ ID NO: 1365040 - DNA, 14 bp, Homo sapiens
actttttttgtatg

SEQ ID NO: 1365041 - DNA, 19 bp, Homo sapiens
agaaaaaatattttcccta

SEQ ID NO: 1365042 - DNA, 17 bp, Homo sapiens
agaaaaaatattttcct

SEQ ID NO: 1365043 - DNA, 19 bp, Homo sapiens
agaaaagcctaatcacagt

SEQ ID NO: 1365044 - DNA, 19 bp, Homo sapiens
agaaaatatattctttcaa

SEQ ID NO: 1365045 - DNA, 21 bp, Homo sapiens
agaaaatgaaatgcatatttg

SEQ ID NO: 1365046 - DNA, 13 bp, Homo sapiens
agaaacaaacatc

SEQ ID NO: 1365047 - DNA, 21 bp, Homo sapiens
agaaacttatttctcatatca

SEQ ID NO: 1365048 - DNA, 13 bp, Homo sapiens
agaaacttgtgaa

SEQ ID NO: 1365049 - DNA, 23 bp, Homo sapiens
agaaacttgtgaagtggaaatgt

SEQ ID NO: 1365050 - DNA, 22 bp, Homo sapiens
agaaagaatttagtattatcaa

SEQ ID NO: 1365051 - DNA, 22 bp, Homo sapiens
agaaagaggcaccaggaagccg

SEQ ID NO: 1365052 - DNA, 17 bp, Homo sapiens
agaaaggctctattcca

SEQ ID NO: 1365053 - DNA, 22 bp, Homo sapiens
agaaaggtgagtttgagctgcc

SEQ ID NO: 1365054 - DNA, 22 bp, Homo sapiens
agaaagtgggcttaatggagtt

SEQ ID NO: 1365055 - DNA, 20 bp, Homo sapiens
agaaagtggtcttaagaaat

SEQ ID NO: 1365056 - DNA, 16 bp, Homo sapiens
agaaagtgtgagcaaa

SEQ ID NO: 1365057 - DNA, 16 bp, Homo sapiens
agaaataatagaaatg

SEQ ID NO: 1365058 - DNA, 17 bp, Homo sapiens
agaaataatgctacaat

SEQ ID NO: 1365059 - DNA, 17 bp, Homo sapiens
agaaatacagtactgtt

SEQ ID NO: 1365060 - DNA, 16 bp, Homo sapiens
agaaatataacacatt

SEQ ID NO: 1365061 - DNA, 16 bp, Homo sapiens
agaaatggaaattttg

SEQ ID NO: 1365062 - DNA, 17 bp, Homo sapiens
agaaattgtatattgta

SEQ ID NO: 1365063 - DNA, 11 bp, Homo sapiens
agaaattttca

SEQ ID NO: 1365064 - DNA, 22 bp, Homo sapiens
agaacacacacatatacacgaa

SEQ ID NO: 1365065 - DNA, 20 bp, Homo sapiens
agaacactaactcaccagcc

SEQ ID NO: 1365066 - DNA, 13 bp, Homo sapiens
agaaccaaatctg

SEQ ID NO: 1365067 - DNA, 18 bp, Homo sapiens
agaaccaaatctggaagc

SEQ ID NO: 1365068 - DNA, 19 bp, Homo sapiens
agaaccacacttgaaacct

SEQ ID NO: 1365069 - DNA, 22 bp, Homo sapiens
agaaccaccccggccccctgcc

SEQ ID NO: 1365070 - DNA, 16 bp, Homo sapiens
agaacgttttttcctc

SEQ ID NO: 1365071 - DNA, 20 bp, Homo sapiens
agaacgttttttcctcagtg

SEQ ID NO: 1365072 - DNA, 21 bp, Homo sapiens
agaactattgtgctcagagac

SEQ ID NO: 1365073 - DNA, 18 bp, Homo sapiens
agaactcgcgctcagtaa

SEQ ID NO: 1365074 - DNA, 21 bp, Homo sapiens
agaactcgcgctcagtaaacg

SEQ ID NO: 1365075 - DNA, 20 bp, Homo sapiens
agaactgaaaggcttttcaa

SEQ ID NO: 1365076 - DNA, 12 bp, Homo sapiens
agaactgcaggc

SEQ ID NO: 1365077 - DNA, 15 bp, Homo sapiens
agaactgcaggccct

SEQ ID NO: 1365078 - DNA, 20 bp, Homo sapiens
agaactgcaggccctggcct

SEQ ID NO: 1365079 - DNA, 13 bp, Homo sapiens
agaactttgtata

SEQ ID NO: 1365080 - DNA, 19 bp, Homo sapiens
agaagcacagaatattttt

SEQ ID NO: 1365081 - DNA, 20 bp, Homo sapiens
agaagcctgtaacactcctc

SEQ ID NO: 1365082 - DNA, 12 bp, Homo sapiens
agaagccttcag

SEQ ID NO: 1365083 - DNA, 14 bp, Homo sapiens
agaagccttcagct

SEQ ID NO: 1365084 - DNA, 19 bp, Homo sapiens
agaagccttcagctccagg

SEQ ID NO: 1365085 - DNA, 15 bp, Homo sapiens
agaagctgcaggctt

SEQ ID NO: 1365086 - DNA, 19 bp, Homo sapiens
agaagctgcatccagaggc

SEQ ID NO: 1365087 - DNA, 13 bp, Homo sapiens
agaaggatgatgt

SEQ ID NO: 1365088 - DNA, 13 bp, Homo sapiens
agaaggcaatatt

SEQ ID NO: 1365089 - DNA, 14 bp, Homo sapiens
agaagggagaagaa

SEQ ID NO: 1365090 - DNA, 16 bp, Homo sapiens
agaagggagaagaaag

SEQ ID NO: 1365091 - DNA, 15 bp, Homo sapiens
agaaggtgccacttt

SEQ ID NO: 1365092 - DNA, 16 bp, Homo sapiens
agaaggtttattgtta

SEQ ID NO: 1365093 - DNA, 17 bp, Homo sapiens
agaaggtttattgttaa

SEQ ID NO: 1365094 - DNA, 20 bp, Homo sapiens
agaagtaagaggctacctct

SEQ ID NO: 1365095 - DNA, 17 bp, Homo sapiens
agaagtgaatgctggga

SEQ ID NO: 1365096 - DNA, 14 bp, Homo sapiens
agaagtgagcaaaa

SEQ ID NO: 1365097 - DNA, 18 bp, Homo sapiens
agaagtgagcaaaaaaga

SEQ ID NO: 1365098 - DNA, 16 bp, Homo sapiens
agaagttagtttgtat

SEQ ID NO: 1365099 - DNA, 18 bp, Homo sapiens
agaagttagtttgtatat

SEQ ID NO: 1365100 - DNA, 19 bp, Homo sapiens
agaagttagtttgtatata

SEQ ID NO: 1365101 - DNA, 21 bp, Homo sapiens
agaagttgtaaagtatgtatt

SEQ ID NO: 1365102 - DNA, 21 bp, Homo sapiens
agaatatttttatatttcctt

SEQ ID NO: 1365103 - DNA, 22 bp, Homo sapiens
agaatatttttatatttccttt

SEQ ID NO: 1365104 - DNA, 17 bp, Homo sapiens
agaatccctgtgttaat

SEQ ID NO: 1365105 - DNA, 21 bp, Homo sapiens
agaatccctgtgttaatttaa

SEQ ID NO: 1365106 - DNA, 20 bp, Homo sapiens
agaatgagtccttgatttca

SEQ ID NO: 1365107 - DNA, 22 bp, Homo sapiens
agaatgctgcaggacttgagaa

SEQ ID NO: 1365108 - DNA, 21 bp, Homo sapiens
agaatggcgccaccagctctg

SEQ ID NO: 1365109 - DNA, 21 bp, Homo sapiens
agaatgtgtttaaacttggtt

SEQ ID NO: 1365110 - DNA, 20 bp, Homo sapiens
agaattagatttctatagga

SEQ ID NO: 1365111 - DNA, 18 bp, Homo sapiens
agaattctgattgatttg

SEQ ID NO: 1365112 - DNA, 23 bp, Homo sapiens
agaattctgattgatttgattgg

SEQ ID NO: 1365113 - DNA, 21 bp, Homo sapiens
agaattgaaggtttttgatag

SEQ ID NO: 1365114 - DNA, 20 bp, Homo sapiens
agaattgatatacacggatg

SEQ ID NO: 1365115 - DNA, 15 bp, Homo sapiens
agacaaaagagcagt

SEQ ID NO: 1365116 - DNA, 22 bp, Homo sapiens
agacaaaagtctgtctttcctg

SEQ ID NO: 1365117 - DNA, 15 bp, Homo sapiens
agacaagagatggga

SEQ ID NO: 1365118 - DNA, 21 bp, Homo sapiens
agacaagattttttaattgtt

SEQ ID NO: 1365119 - DNA, 20 bp, Homo sapiens
agacaatgtgaaaagaaaaa

SEQ ID NO: 1365120 - DNA, 21 bp, Homo sapiens
agacacatacatgtcacattt

SEQ ID NO: 1365121 - DNA, 19 bp, Homo sapiens
agacaccctcaacctcttc

SEQ ID NO: 1365122 - DNA, 22 bp, Homo sapiens
agacaccttggacatcctcctc

SEQ ID NO: 1365123 - DNA, 21 bp, Homo sapiens
agacacggagcccagccctcc

SEQ ID NO: 1365124 - DNA, 21 bp, Homo sapiens
agacagatacctccaaccctg

SEQ ID NO: 1365125 - DNA, 23 bp, Homo sapiens
agacagatacctccaaccctgcc

SEQ ID NO: 1365126 - DNA, 19 bp, Homo sapiens
agacagccaaaggctggcg

SEQ ID NO: 1365127 - DNA, 14 bp, Homo sapiens
agacagcttttctc

SEQ ID NO: 1365128 - DNA, 20 bp, Homo sapiens
agacattttaaaaaatggtc

SEQ ID NO: 1365129 - DNA, 22 bp, Homo sapiens
agacattttaaaaaatggtcac

SEQ ID NO: 1365130 - DNA, 23 bp, Homo sapiens
agaccacgcccgtcctgcctgtg

SEQ ID NO: 1365131 - DNA, 18 bp, Homo sapiens
agaccagattaaacttca

SEQ ID NO: 1365132 - DNA, 15 bp, Homo sapiens
agaccagggagcctt

SEQ ID NO: 1365133 - DNA, 14 bp, Homo sapiens
agaccatcctggct

SEQ ID NO: 1365134 - DNA, 17 bp, Homo sapiens
agaccgggccctgggtt

SEQ ID NO: 1365135 - DNA, 19 bp, Homo sapiens
agaccgtgaagatactttg

SEQ ID NO: 1365136 - DNA, 21 bp, Homo sapiens
agacgtttataaacagaaatg

SEQ ID NO: 1365137 - DNA, 14 bp, Homo sapiens
agactcggggtgct

SEQ ID NO: 1365138 - DNA, 22 bp, Homo sapiens
agactggtttatccacccacaa

SEQ ID NO: 1365139 - DNA, 21 bp, Homo sapiens
agactgtaacttccaaataaa

SEQ ID NO: 1365140 - DNA, 22 bp, Homo sapiens
agactgtaacttccaaataaat

SEQ ID NO: 1365141 - DNA, 16 bp, Homo sapiens
agacttccttgagaca

SEQ ID NO: 1365142 - DNA, 15 bp, Homo sapiens
agacttgaaaagaga

SEQ ID NO: 1365143 - DNA, 22 bp, Homo sapiens
agacttgaaaagagacaggcag

SEQ ID NO: 1365144 - DNA, 10 bp, Homo sapiens
agagaagaga

SEQ ID NO: 1365145 - DNA, 21 bp, Homo sapiens
agagaagagattgtggtttca

SEQ ID NO: 1365146 - DNA, 13 bp, Homo sapiens
agagacaaaatat

SEQ ID NO: 1365147 - DNA, 15 bp, Homo sapiens
agagagagagagagg

SEQ ID NO: 1365148 - DNA, 18 bp, Homo sapiens
agcctgctggcacccacc

SEQ ID NO: 1365149 - DNA, 15 bp, Homo sapiens
agcctgggaaataag

SEQ ID NO: 1365150 - DNA, 12 bp, Homo sapiens
agcctgggcccc

SEQ ID NO: 1365151 - DNA, 22 bp, Homo sapiens
agcctgggtgacagagcaagtg

SEQ ID NO: 1365152 - DNA, 19 bp, Homo sapiens
agccttaaaacatcattcc

SEQ ID NO: 1365153 - DNA, 22 bp, Homo sapiens
agccttaaaacatcattccttt

SEQ ID NO: 1365154 - DNA, 22 bp, Homo sapiens
agccttcaaaactatagcttgc

SEQ ID NO: 1365155 - DNA, 20 bp, Homo sapiens
agccttctccctagctcctc

SEQ ID NO: 1365156 - DNA, 16 bp, Homo sapiens
agccttgagccctggc

SEQ ID NO: 1365157 - DNA, 19 bp, Homo sapiens
agccttgagccctggctgt

SEQ ID NO: 1365158 - DNA, 19 bp, Homo sapiens
agccttgcggaaggttcta

SEQ ID NO: 1365159 - DNA, 19 bp, Homo sapiens
agcctttggttctggccag

SEQ ID NO: 1365160 - DNA, 18 bp, Homo sapiens
agcctttttaaaacacat

SEQ ID NO: 1365161 - DNA, 22 bp, Homo sapiens
agcctttttaaaacacatgttt

SEQ ID NO: 1365162 - DNA, 22 bp, Homo sapiens
agcgaaccctttatttgaacaa

SEQ ID NO: 1365163 - DNA, 17 bp, Homo sapiens
agcgagggcagctgcta

SEQ ID NO: 1365164 - DNA, 19 bp, Homo sapiens
agcgatctctcctggccta

SEQ ID NO: 1365165 - DNA, 18 bp, Homo sapiens
agcgcctccatccaaggc

SEQ ID NO: 1365166 - DNA, 20 bp, Homo sapiens
agcgcctccatccaaggcca

SEQ ID NO: 1365167 - DNA, 23 bp, Homo sapiens
agcgcctccctccaccccaggac

SEQ ID NO: 1365168 - DNA, 15 bp, Homo sapiens
agcgcggccctcccg

SEQ ID NO: 1365169 - DNA, 14 bp, Homo sapiens
agcgggggaggccc

SEQ ID NO: 1365170 - DNA, 20 bp, Homo sapiens
agcgggggaggcccgcagag

SEQ ID NO: 1365171 - DNA, 16 bp, Homo sapiens
agcgtatggctttatt

SEQ ID NO: 1365172 - DNA, 14 bp, Homo sapiens
agcgtccctggcgc

SEQ ID NO: 1365173 - DNA, 12 bp, Homo sapiens
agctaattattt

SEQ ID NO: 1365174 - DNA, 16 bp, Homo sapiens
agctacctcaaacttc

SEQ ID NO: 1365175 - DNA, 17 bp, Homo sapiens
agctacttgggaggctg

SEQ ID NO: 1365176 - DNA, 18 bp, Homo sapiens
agctagttgaatacttga

SEQ ID NO: 1365177 - DNA, 19 bp, Homo sapiens
agctagttgaatacttgaa

SEQ ID NO: 1365178 - DNA, 11 bp, Homo sapiens
agctatataag

SEQ ID NO: 1365179 - DNA, 15 bp, Homo sapiens
agctatttatgggcc

SEQ ID NO: 1365180 - DNA, 16 bp, Homo sapiens
agctatttatgggccc

SEQ ID NO: 1365181 - DNA, 17 bp, Homo sapiens
agctatttatgggcccc

SEQ ID NO: 1365182 - DNA, 22 bp, Homo sapiens
agctatttatgggcccctggca

SEQ ID NO: 1365183 - DNA, 23 bp, Homo sapiens
agctcaactagtggggtttcctg

SEQ ID NO: 1365184 - DNA, 21 bp, Homo sapiens
agctcattaaacttttttaac

SEQ ID NO: 1365185 - DNA, 15 bp, Homo sapiens
agctccaagccccat

SEQ ID NO: 1365186 - DNA, 14 bp, Homo sapiens
agctccactctgct

SEQ ID NO: 1365187 - DNA, 17 bp, Homo sapiens
agctccactctgcttct

SEQ ID NO: 1365188 - DNA, 18 bp, Homo sapiens
agctcccacttctgccag

SEQ ID NO: 1365189 - DNA, 13 bp, Homo sapiens
agctcctcccctt

SEQ ID NO: 1365190 - DNA, 15 bp, Homo sapiens
agctcctgtggcccc

SEQ ID NO: 1365191 - DNA, 14 bp, Homo sapiens
agctcggctcagct

SEQ ID NO: 1365192 - DNA, 13 bp, Homo sapiens
agctctgaaatct

SEQ ID NO: 1365193 - DNA, 22 bp, Homo sapiens
agctctgaccacttgaggcctg

SEQ ID NO: 1365194 - DNA, 14 bp, Homo sapiens
agctctgccgtctc

SEQ ID NO: 1365195 - DNA, 19 bp, Homo sapiens
agctctgccgtctctggag

SEQ ID NO: 1365196 - DNA, 20 bp, Homo sapiens
agctctggaggggaggggga

SEQ ID NO: 1365197 - DNA, 22 bp, Homo sapiens
agctcttcctatccctctccta

SEQ ID NO: 1365198 - DNA, 22 bp, Homo sapiens
agctgaacaataggctgttccc

SEQ ID NO: 1365199 - DNA, 15 bp, Homo sapiens
agctgaacctgggta

SEQ ID NO: 1365200 - DNA, 15 bp, Homo sapiens
agctgacatcttgaa

SEQ ID NO: 1365201 - DNA, 16 bp, Homo sapiens
agctgacatcttgaat

SEQ ID NO: 1365202 - DNA, 21 bp, Homo sapiens
agctgacttttctgtccgagc

SEQ ID NO: 1365203 - DNA, 22 bp, Homo sapiens
agctgatctgcggatctcagct

SEQ ID NO: 1365204 - DNA, 13 bp, Homo sapiens
agctgcaccctca

SEQ ID NO: 1365205 - DNA, 18 bp, Homo sapiens
agctgcaccctcaggcag

SEQ ID NO: 1365206 - DNA, 20 bp, Homo sapiens
agctgcaccctcaggcaggt

SEQ ID NO: 1365207 - DNA, 19 bp, Homo sapiens
agctgccaggtgagaaact

SEQ ID NO: 1365208 - DNA, 11 bp, Homo sapiens
agctgccagtg

SEQ ID NO: 1365209 - DNA, 14 bp, Homo sapiens
agctgccatggcta

SEQ ID NO: 1365210 - DNA, 24 bp, Homo sapiens
agctgcccactgtttctcttgagc

SEQ ID NO: 1365211 - DNA, 12 bp, Homo sapiens
agctgccttccc

SEQ ID NO: 1365212 - DNA, 13 bp, Homo sapiens
agctgccttccct

SEQ ID NO: 1365213 - DNA, 14 bp, Homo sapiens
agctgccttcccta

SEQ ID NO: 1365214 - DNA, 14 bp, Homo sapiens
agctgccttggctc

SEQ ID NO: 1365215 - DNA, 19 bp, Homo sapiens
agctgccttggctcagaca

SEQ ID NO: 1365216 - DNA, 20 bp, Homo sapiens
agctgctccgaggacccagg

SEQ ID NO: 1365217 - DNA, 23 bp, Homo sapiens
agctggctctgagcgcctccatc

SEQ ID NO: 1365218 - DNA, 15 bp, Homo sapiens
agctgtcacaacttg

SEQ ID NO: 1365219 - DNA, 18 bp, Homo sapiens
agctgtcacaacttgtgt

SEQ ID NO: 1365220 - DNA, 14 bp, Homo sapiens
agctgtcccttgct

SEQ ID NO: 1365221 - DNA, 15 bp, Homo sapiens
agctgtgctcagaag

SEQ ID NO: 1365222 - DNA, 14 bp, Homo sapiens
agctgttactgtct

SEQ ID NO: 1365223 - DNA, 14 bp, Homo sapiens
agctgttcagctgg

SEQ ID NO: 1365224 - DNA, 18 bp, Homo sapiens
agctgttcctgttcagta

SEQ ID NO: 1365225 - DNA, 20 bp, Homo sapiens
agctgttccttggtcctagt

SEQ ID NO: 1365226 - DNA, 13 bp, Homo sapiens
agcttacgtagtt

SEQ ID NO: 1365227 - DNA, 10 bp, Homo sapiens
agcttagaac

SEQ ID NO: 1365228 - DNA, 15 bp, Homo sapiens
agcttataatgggct

SEQ ID NO: 1365229 - DNA, 14 bp, Homo sapiens
agcttatctcaggg

SEQ ID NO: 1365230 - DNA, 22 bp, Homo sapiens
agcttattgtttctctgaaagt

SEQ ID NO: 1365231 - DNA, 19 bp, Homo sapiens
agcttcagttgcttgtctt

SEQ ID NO: 1365232 - DNA, 20 bp, Homo sapiens
agcttcatgcacttaaagaa

SEQ ID NO: 1365233 - DNA, 20 bp, Homo sapiens
agcttccattttaattttaa

SEQ ID NO: 1365234 - DNA, 12 bp, Homo sapiens
agcttctgcttt

SEQ ID NO: 1365235 - DNA, 17 bp, Homo sapiens
agcttctgcttttctgc

SEQ ID NO: 1365236 - DNA, 23 bp, Homo sapiens
agcttctgcttttctgccctggc

SEQ ID NO: 1365237 - DNA, 23 bp, Homo sapiens
agcttgagccgggcccctgggct

SEQ ID NO: 1365238 - DNA, 24 bp, Homo sapiens
agcttgagccgggcccctgggctt

SEQ ID NO: 1365239 - DNA, 18 bp, Homo sapiens
agcttgggaggcttcccc

SEQ ID NO: 1365240 - DNA, 22 bp, Homo sapiens
agcttggggccaccaaagctgc

SEQ ID NO: 1365241 - DNA, 16 bp, Homo sapiens
agctttagaccctggg

SEQ ID NO: 1365242 - DNA, 22 bp, Homo sapiens
agctttagaccctgggtgggct

SEQ ID NO: 1365243 - DNA, 19 bp, Homo sapiens
agctttgaaaattcagtgg

SEQ ID NO: 1365244 - DNA, 19 bp, Homo sapiens
agctttgagaagccttcag

SEQ ID NO: 1365245 - DNA, 15 bp, Homo sapiens
agctttgtcgtattt

SEQ ID NO: 1365246 - DNA, 17 bp, Homo sapiens
aggaaaaacacaagcaa

SEQ ID NO: 1365247 - DNA, 16 bp, Homo sapiens
aggaaaatagtaatgt

SEQ ID NO: 1365248 - DNA, 14 bp, Homo sapiens
aggaaaatgtctgt

SEQ ID NO: 1365249 - DNA, 20 bp, Homo sapiens
aggaaactccacatctgcct

SEQ ID NO: 1365250 - DNA, 19 bp, Homo sapiens
aggaaatcaaagtgctatt

SEQ ID NO: 1365251 - DNA, 17 bp, Homo sapiens
aggaacaatcggctgca

SEQ ID NO: 1365252 - DNA, 14 bp, Homo sapiens
aggaagagaaaaaa

SEQ ID NO: 1365253 - DNA, 14 bp, Homo sapiens
aggaagccgtcctg

SEQ ID NO: 1365254 - DNA, 15 bp, Homo sapiens
aggaaggagaggaga

SEQ ID NO: 1365255 - DNA, 13 bp, Homo sapiens
aggaaggcaagag

SEQ ID NO: 1365256 - DNA, 19 bp, Homo sapiens
aggaaggtgaatctgccct

SEQ ID NO: 1365257 - DNA, 13 bp, Homo sapiens
aggaataaataaa

SEQ ID NO: 1365258 - DNA, 21 bp, Homo sapiens
aggaataaataaaaatggata

SEQ ID NO: 1365259 - DNA, 23 bp, Homo sapiens
aggaatcattcagaaatgttgag

SEQ ID NO: 1365260 - DNA, 16 bp, Homo sapiens
aggaatcctggcagcc

SEQ ID NO: 1365261 - DNA, 20 bp, Homo sapiens
aggaatcctggcagcccaga

SEQ ID NO: 1365262 - DNA, 19 bp, Homo sapiens
aggacaaagtgccaaagaa

SEQ ID NO: 1365263 - DNA, 20 bp, Homo sapiens
aggacatgcaataaaattta

SEQ ID NO: 1365264 - DNA, 21 bp, Homo sapiens
aggacatgcaataaaatttaa

SEQ ID NO: 1365265 - DNA, 22 bp, Homo sapiens
aggacatgcaataaaatttaaa

SEQ ID NO: 1365266 - DNA, 20 bp, Homo sapiens
agtgaacttgggccactgtg

SEQ ID NO: 1365267 - DNA, 19 bp, Homo sapiens
agtgaatgctgggactcag

SEQ ID NO: 1365268 - DNA, 13 bp, Homo sapiens
agtgacctctctc

SEQ ID NO: 1365269 - DNA, 21 bp, Homo sapiens
agtgagaccctgtctcaaaaa

SEQ ID NO: 1365270 - DNA, 17 bp, Homo sapiens
agtgatagtcttttgct

SEQ ID NO: 1365271 - DNA, 20 bp, Homo sapiens
agtgatagtcttttgctttt

SEQ ID NO: 1365272 - DNA, 13 bp, Homo sapiens
agtgcagaatgta

SEQ ID NO: 1365273 - DNA, 14 bp, Homo sapiens
agtgcagaatgtaa

SEQ ID NO: 1365274 - DNA, 23 bp, Homo sapiens
agtgcagaatgtaagtgggccca

SEQ ID NO: 1365275 - DNA, 17 bp, Homo sapiens
agtgcagagccttctca

SEQ ID NO: 1365276 - DNA, 16 bp, Homo sapiens
agtgcatggtggccag

SEQ ID NO: 1365277 - DNA, 17 bp, Homo sapiens
agtgcatttttgtaaat

SEQ ID NO: 1365278 - DNA, 14 bp, Homo sapiens
agtgccctccagcc

SEQ ID NO: 1365279 - DNA, 23 bp, Homo sapiens
agtgccgcatctcacagctatgc

SEQ ID NO: 1365280 - DNA, 20 bp, Homo sapiens
agtgcctttgcagctcagaa

SEQ ID NO: 1365281 - DNA, 11 bp, Homo sapiens
agtggaaaaat

SEQ ID NO: 1365282 - DNA, 16 bp, Homo sapiens
agtggaccgccctttt

SEQ ID NO: 1365283 - DNA, 17 bp, Homo sapiens
agtggaccttaggcctt

SEQ ID NO: 1365284 - DNA, 23 bp, Homo sapiens
agtggaccttaggccttcctctc

SEQ ID NO: 1365285 - DNA, 11 bp, Homo sapiens
agtggcagggg

SEQ ID NO: 1365286 - DNA, 17 bp, Homo sapiens
agtgggaagcccatcct

SEQ ID NO: 1365287 - DNA, 18 bp, Homo sapiens
agtgggggatcacagcct

SEQ ID NO: 1365288 - DNA, 18 bp, Homo sapiens
agtggggtgctgggagga

SEQ ID NO: 1365289 - DNA, 15 bp, Homo sapiens
agtggggtttcctgg

SEQ ID NO: 1365290 - DNA, 17 bp, Homo sapiens
agtggtcctagaggccc

SEQ ID NO: 1365291 - DNA, 15 bp, Homo sapiens
agtggtgatttgaaa

SEQ ID NO: 1365292 - DNA, 22 bp, Homo sapiens
agtggtgatttgaaaaatataa

SEQ ID NO: 1365293 - DNA, 13 bp, Homo sapiens
agtggttgaatat

SEQ ID NO: 1365294 - DNA, 23 bp, Homo sapiens
agtggttttatactgaaggaaaa

SEQ ID NO: 1365295 - DNA, 18 bp, Homo sapiens
agtgtaaaatattttgaa

SEQ ID NO: 1365296 - DNA, 18 bp, Homo sapiens
agtgtacagccagaccag

SEQ ID NO: 1365297 - DNA, 20 bp, Homo sapiens
agtgtctataaaagaaacac

SEQ ID NO: 1365298 - DNA, 16 bp, Homo sapiens
agtgtctggaattgtg

SEQ ID NO: 1365299 - DNA, 17 bp, Homo sapiens
agtgtctggaattgtgg

SEQ ID NO: 1365300 - DNA, 21 bp, Homo sapiens
agtgtctggaattgtggctat

SEQ ID NO: 1365301 - DNA, 14 bp, Homo sapiens
agtgtgaatactgc

SEQ ID NO: 1365302 - DNA, 18 bp, Homo sapiens
agtgtggcctcttctgag

SEQ ID NO: 1365303 - DNA, 16 bp, Homo sapiens
agtgtgggcttgacca

SEQ ID NO: 1365304 - DNA, 18 bp, Homo sapiens
agtgtgggcttgaccagg

SEQ ID NO: 1365305 - DNA, 16 bp, Homo sapiens
agtgtgtatgccaaga

SEQ ID NO: 1365306 - DNA, 15 bp, Homo sapiens
agtgttatatgaaca

SEQ ID NO: 1365307 - DNA, 18 bp, Homo sapiens
agtgtttatgttgtttat

SEQ ID NO: 1365308 - DNA, 16 bp, Homo sapiens
agtgtttttgtgaatt

SEQ ID NO: 1365309 - DNA, 16 bp, Homo sapiens
agttaaggtgggcccg

SEQ ID NO: 1365310 - DNA, 14 bp, Homo sapiens
agttactgtgtaaa

SEQ ID NO: 1365311 - DNA, 15 bp, Homo sapiens
agttagcctccacca

SEQ ID NO: 1365312 - DNA, 23 bp, Homo sapiens
agttatggtgccgaattgtcttt

SEQ ID NO: 1365313 - DNA, 20 bp, Homo sapiens
agttattacatgtaatttga

SEQ ID NO: 1365314 - DNA, 13 bp, Homo sapiens
agttattgcagtt

SEQ ID NO: 1365315 - DNA, 20 bp, Homo sapiens
agttcatcagagttatggtg

SEQ ID NO: 1365316 - DNA, 22 bp, Homo sapiens
agttcccttgaaactttgggaa

SEQ ID NO: 1365317 - DNA, 17 bp, Homo sapiens
agttctactcaggctgg

SEQ ID NO: 1365318 - DNA, 15 bp, Homo sapiens
agttctgtatttgaa

SEQ ID NO: 1365319 - DNA, 16 bp, Homo sapiens
agttctgtatttgaaa

SEQ ID NO: 1365320 - DNA, 17 bp, Homo sapiens
agttctgtatttgaaag

SEQ ID NO: 1365321 - DNA, 14 bp, Homo sapiens
agttcttagttata

SEQ ID NO: 1365322 - DNA, 17 bp, Homo sapiens
agttcttatgaggaggg

SEQ ID NO: 1365323 - DNA, 15 bp, Homo sapiens
agttctttaaactgt

SEQ ID NO: 1365324 - DNA, 16 bp, Homo sapiens
agttgaatacttgaac

SEQ ID NO: 1365325 - DNA, 13 bp, Homo sapiens
agttgagctatga

SEQ ID NO: 1365326 - DNA, 15 bp, Homo sapiens
agttgagctatgact

SEQ ID NO: 1365327 - DNA, 23 bp, Homo sapiens
agttgcacttattgaccattttt

SEQ ID NO: 1365328 - DNA, 14 bp, Homo sapiens
agttgcattttaac

SEQ ID NO: 1365329 - DNA, 19 bp, Homo sapiens
agttgctatttttgtaaag

SEQ ID NO: 1365330 - DNA, 23 bp, Homo sapiens
agttgctatttttgtaaagtttc

SEQ ID NO: 1365331 - DNA, 17 bp, Homo sapiens
agttgctggtaaaatga

SEQ ID NO: 1365332 - DNA, 21 bp, Homo sapiens
agttgctggtaaaatgaagaa

SEQ ID NO: 1365333 - DNA, 20 bp, Homo sapiens
agttgtatttaacagaaatt

SEQ ID NO: 1365334 - DNA, 23 bp, Homo sapiens
agttgtatttaacagaaattgta

SEQ ID NO: 1365335 - DNA, 15 bp, Homo sapiens
agttgtttttgtata

SEQ ID NO: 1365336 - DNA, 16 bp, Homo sapiens
agttgtttttgtatat

SEQ ID NO: 1365337 - DNA, 18 bp, Homo sapiens
agttgtttttgtatattg

SEQ ID NO: 1365338 - DNA, 22 bp, Homo sapiens
agtttaaaagttcttagttata

SEQ ID NO: 1365339 - DNA, 12 bp, Homo sapiens
agtttagaacag

SEQ ID NO: 1365340 - DNA, 16 bp, Homo sapiens
agtttatcattcaagt

SEQ ID NO: 1365341 - DNA, 23 bp, Homo sapiens
agtttattttaaaacaataggat

SEQ ID NO: 1365342 - DNA, 22 bp, Homo sapiens
agtttcagtattagatgcactt

SEQ ID NO: 1365343 - DNA, 18 bp, Homo sapiens
agtttgagatcagcctgg

SEQ ID NO: 1365344 - DNA, 15 bp, Homo sapiens
agtttgagctgcctt

SEQ ID NO: 1365345 - DNA, 11 bp, Homo sapiens
agtttgcttag

SEQ ID NO: 1365346 - DNA, 23 bp, Homo sapiens
agtttggctgctgtcataacatc

SEQ ID NO: 1365347 - DNA, 21 bp, Homo sapiens
agtttgtgtgttgtctcttga

SEQ ID NO: 1365348 - DNA, 24 bp, Homo sapiens
agttttataatccttaaatcttaa

SEQ ID NO: 1365349 - DNA, 19 bp, Homo sapiens
agttttatagcctggactg

SEQ ID NO: 1365350 - DNA, 17 bp, Homo sapiens
agttttatatgctttat

SEQ ID NO: 1365351 - DNA, 17 bp, Homo sapiens
agttttatttatattta

SEQ ID NO: 1365352 - DNA, 20 bp, Homo sapiens
agttttatttatatttattg

SEQ ID NO: 1365353 - DNA, 23 bp, Homo sapiens
agttttatttatatttattgact

SEQ ID NO: 1365354 - DNA, 12 bp, Homo sapiens
agttttcagaaa

SEQ ID NO: 1365355 - DNA, 18 bp, Homo sapiens
agttttcatagtatccat

SEQ ID NO: 1365356 - DNA, 10 bp, Homo sapiens
agttttccta

SEQ ID NO: 1365357 - DNA, 19 bp, Homo sapiens
agttttgacaagctggctt

SEQ ID NO: 1365358 - DNA, 23 bp, Homo sapiens
agttttgttttaaaactggacct

SEQ ID NO: 1365359 - DNA, 16 bp, Homo sapiens
agtttttatgagaaac

SEQ ID NO: 1365360 - DNA, 15 bp, Homo sapiens
ataaaacatagcaaa

SEQ ID NO: 1365361 - DNA, 13 bp, Homo sapiens
ataaaagaaataa

SEQ ID NO: 1365362 - DNA, 20 bp, Homo sapiens
ataaaaggcttgaagctgtg

SEQ ID NO: 1365363 - DNA, 16 bp, Homo sapiens
ataaaatgaaaattgt

SEQ ID NO: 1365364 - DNA, 19 bp, Homo sapiens
ataaaatgtccagtaagat

SEQ ID NO: 1365365 - DNA, 21 bp, Homo sapiens
ataaaatgtccagtaagatca

SEQ ID NO: 1365366 - DNA, 23 bp, Homo sapiens
ataaaatgtccagtaagatcact

SEQ ID NO: 1365367 - DNA, 16 bp, Homo sapiens
ataaacaaagattcat

SEQ ID NO: 1365368 - DNA, 20 bp, Homo sapiens
ataaacaccactggattaat

SEQ ID NO: 1365369 - DNA, 13 bp, Homo sapiens
ataaacagaaatg

SEQ ID NO: 1365370 - DNA, 16 bp, Homo sapiens
ataaactataaaacaa

SEQ ID NO: 1365371 - DNA, 22 bp, Homo sapiens
ataaactttaatataaagtagt

SEQ ID NO: 1365372 - DNA, 23 bp, Homo sapiens
ataaagaaggatgatgtcttttt

SEQ ID NO: 1365373 - DNA, 13 bp, Homo sapiens
ataaagcttgttg

SEQ ID NO: 1365374 - DNA, 18 bp, Homo sapiens
ataaagtaaatacatgca

SEQ ID NO: 1365375 - DNA, 17 bp, Homo sapiens
ataaagtagtcctgtga

SEQ ID NO: 1365376 - DNA, 16 bp, Homo sapiens
ataaagtgctttaaaa

SEQ ID NO: 1365377 - DNA, 17 bp, Homo sapiens
ataaataaaaatggata

SEQ ID NO: 1365378 - DNA, 21 bp, Homo sapiens
ataaatagatgctgtgtatat

SEQ ID NO: 1365379 - DNA, 15 bp, Homo sapiens
ataaatatatacatt

SEQ ID NO: 1365380 - DNA, 14 bp, Homo sapiens
ataaattaggacca

SEQ ID NO: 1365381 - DNA, 17 bp, Homo sapiens
ataaattatttgattat

SEQ ID NO: 1365382 - DNA, 19 bp, Homo sapiens
ataaattatttgattattt

SEQ ID NO: 1365383 - DNA, 21 bp, Homo sapiens
ataaattctataggaacatat

SEQ ID NO: 1365384 - DNA, 13 bp, Homo sapiens
atattacaatgat

SEQ ID NO: 1365385 - DNA, 14 bp, Homo sapiens
atattactgacatt

SEQ ID NO: 1365386 - DNA, 17 bp, Homo sapiens
atattactgacatttct

SEQ ID NO: 1365387 - DNA, 15 bp, Homo sapiens
atattagtatgtatg

SEQ ID NO: 1365388 - DNA, 20 bp, Homo sapiens
atattatacaggaaagcaat

SEQ ID NO: 1365389 - DNA, 19 bp, Homo sapiens
atattattataatcttata

SEQ ID NO: 1365390 - DNA, 17 bp, Homo sapiens
atattccagatctttca

SEQ ID NO: 1365391 - DNA, 15 bp, Homo sapiens
atattctttcaaagg

SEQ ID NO: 1365392 - DNA, 12 bp, Homo sapiens
atattgaacttt

SEQ ID NO: 1365393 - DNA, 18 bp, Homo sapiens
atattgaacttttgtact

SEQ ID NO: 1365394 - DNA, 21 bp, Homo sapiens
atattgattgggaaaacattt

SEQ ID NO: 1365395 - DNA, 23 bp, Homo sapiens
atattgcaaaatacatgaagctt

SEQ ID NO: 1365396 - DNA, 12 bp, Homo sapiens
atattggtttta

SEQ ID NO: 1365397 - DNA, 13 bp, Homo sapiens
atattggttttat

SEQ ID NO: 1365398 - DNA, 18 bp, Homo sapiens
atattggttttatgatga

SEQ ID NO: 1365399 - DNA, 21 bp, Homo sapiens
atattgttgacaactgtgact

SEQ ID NO: 1365400 - DNA, 16 bp, Homo sapiens
atattgtttggtaaat

SEQ ID NO: 1365401 - DNA, 18 bp, Homo sapiens
atattgtttggtaaatgt

SEQ ID NO: 1365402 - DNA, 22 bp, Homo sapiens
atatttaacattatttatatgg

SEQ ID NO: 1365403 - DNA, 20 bp, Homo sapiens
atatttcaggttcttcagaa

SEQ ID NO: 1365404 - DNA, 12 bp, Homo sapiens
atatttccttta

SEQ ID NO: 1365405 - DNA, 14 bp, Homo sapiens
atatttcctttatg

SEQ ID NO: 1365406 - DNA, 20 bp, Homo sapiens
atatttcctttatgtgaatt

SEQ ID NO: 1365407 - DNA, 14 bp, Homo sapiens
atatttgaagggtc

SEQ ID NO: 1365408 - DNA, 12 bp, Homo sapiens
atatttgattta

SEQ ID NO: 1365409 - DNA, 15 bp, Homo sapiens
atatttgatttatta

SEQ ID NO: 1365410 - DNA, 20 bp, Homo sapiens
atatttgcaaagtgtattag

SEQ ID NO: 1365411 - DNA, 15 bp, Homo sapiens
atattttattactgt

SEQ ID NO: 1365412 - DNA, 14 bp, Homo sapiens
atattttgaatcaa

SEQ ID NO: 1365413 - DNA, 19 bp, Homo sapiens
atattttgaatcaataata

SEQ ID NO: 1365414 - DNA, 18 bp, Homo sapiens
atattttgtgtgaaattg

SEQ ID NO: 1365415 - DNA, 22 bp, Homo sapiens
atattttgtgtgaaattgcata

SEQ ID NO: 1365416 - DNA, 19 bp, Homo sapiens
atatttttatatttccttt

SEQ ID NO: 1365417 - DNA, 16 bp, Homo sapiens
atcaaaaaggcttata

SEQ ID NO: 1365418 - DNA, 21 bp, Homo sapiens
atcaaaaaggcttataaaaca

SEQ ID NO: 1365419 - DNA, 21 bp, Homo sapiens
atcaaaggaaaatagtaatgt

SEQ ID NO: 1365420 - DNA, 15 bp, Homo sapiens
atcaaataaagagag

SEQ ID NO: 1365421 - DNA, 17 bp, Homo sapiens
atcaaataaagagagaa

SEQ ID NO: 1365422 - DNA, 21 bp, Homo sapiens
atcaaatagaaccactatgaa

SEQ ID NO: 1365423 - DNA, 16 bp, Homo sapiens
atcaaattaattgtgt

SEQ ID NO: 1365424 - DNA, 16 bp, Homo sapiens
atcaagagccttaaaa

SEQ ID NO: 1365425 - DNA, 18 bp, Homo sapiens
atcaagagccttaaaaca

SEQ ID NO: 1365426 - DNA, 21 bp, Homo sapiens
atcaagagccttaaaacatca

SEQ ID NO: 1365427 - DNA, 21 bp, Homo sapiens
atcaataatatattttctgtt

SEQ ID NO: 1365428 - DNA, 19 bp, Homo sapiens
atcaatacactagttgttt

SEQ ID NO: 1365429 - DNA, 15 bp, Homo sapiens
atcaatatctaatat

SEQ ID NO: 1365430 - DNA, 19 bp, Homo sapiens
atcaatcaaataagtattt

SEQ ID NO: 1365431 - DNA, 11 bp, Homo sapiens
atcacaaatga

SEQ ID NO: 1365432 - DNA, 12 bp, Homo sapiens
atcacaaatgac

SEQ ID NO: 1365433 - DNA, 14 bp, Homo sapiens
atcacaaatgactt

SEQ ID NO: 1365434 - DNA, 15 bp, Homo sapiens
atcacaaatgacttt

SEQ ID NO: 1365435 - DNA, 19 bp, Homo sapiens
atcacaaatgactttatta

SEQ ID NO: 1365436 - DNA, 14 bp, Homo sapiens
atcacctgcctgtt

SEQ ID NO: 1365437 - DNA, 15 bp, Homo sapiens
atcacctgcctgtta

SEQ ID NO: 1365438 - DNA, 12 bp, Homo sapiens
atcactgccaca

SEQ ID NO: 1365439 - DNA, 18 bp, Homo sapiens
atcactgccacactctcc

SEQ ID NO: 1365440 - DNA, 20 bp, Homo sapiens
atcactgccacactctccat

SEQ ID NO: 1365441 - DNA, 18 bp, Homo sapiens
atcactgtatcattttct

SEQ ID NO: 1365442 - DNA, 22 bp, Homo sapiens
atcactgtttagatttgccata

SEQ ID NO: 1365443 - DNA, 18 bp, Homo sapiens
atcacttaaaacacgttt

SEQ ID NO: 1365444 - DNA, 23 bp, Homo sapiens
atcactttgagcctgggaaataa

SEQ ID NO: 1365445 - DNA, 19 bp, Homo sapiens
atcagccaagttttataat

SEQ ID NO: 1365446 - DNA, 19 bp, Homo sapiens
atcagcctgctccagctgt

SEQ ID NO: 1365447 - DNA, 20 bp, Homo sapiens
atcagcctgggcaatgtgat

SEQ ID NO: 1365448 - DNA, 19 bp, Homo sapiens
atcaggaatattttccaaa

SEQ ID NO: 1365449 - DNA, 23 bp, Homo sapiens
atcaggagaaagcttggttctgt

SEQ ID NO: 1365450 - DNA, 14 bp, Homo sapiens
atcaggctcccagg

SEQ ID NO: 1365451 - DNA, 22 bp, Homo sapiens
atcagtaacccccttaaattta

SEQ ID NO: 1365452 - DNA, 15 bp, Homo sapiens
atcatagttactgtg

SEQ ID NO: 1365453 - DNA, 16 bp, Homo sapiens
atcatagttactgtgt

SEQ ID NO: 1365454 - DNA, 17 bp, Homo sapiens
atcatccagatgtggct

SEQ ID NO: 1365455 - DNA, 12 bp, Homo sapiens
atcatctaagtc

SEQ ID NO: 1365456 - DNA, 15 bp, Homo sapiens
atcatctatagaaag

SEQ ID NO: 1365457 - DNA, 19 bp, Homo sapiens
atcatgaatctttgtttca

SEQ ID NO: 1365458 - DNA, 18 bp, Homo sapiens
atcatgtactttttagta

SEQ ID NO: 1365459 - DNA, 16 bp, Homo sapiens
atcatgttgatcatgt

SEQ ID NO: 1365460 - DNA, 21 bp, Homo sapiens
atcattcctttttatttatat

SEQ ID NO: 1365461 - DNA, 14 bp, Homo sapiens
atccaactccagca

SEQ ID NO: 1365462 - DNA, 12 bp, Homo sapiens
atccaagcctcc

SEQ ID NO: 1365463 - DNA, 20 bp, Homo sapiens
atccacccaaccctatctcc

SEQ ID NO: 1365464 - DNA, 15 bp, Homo sapiens
atccactttggggga

SEQ ID NO: 1365465 - DNA, 17 bp, Homo sapiens
atccagaaaactgtgat

SEQ ID NO: 1365466 - DNA, 21 bp, Homo sapiens
atccagcctggggctgaggct

SEQ ID NO: 1365467 - DNA, 19 bp, Homo sapiens
atccagttataagaagaag

SEQ ID NO: 1365468 - DNA, 18 bp, Homo sapiens
atccatattttattactg

SEQ ID NO: 1365469 - DNA, 16 bp, Homo sapiens
atccatttccattgct

SEQ ID NO: 1365470 - DNA, 14 bp, Homo sapiens
atcccaagcctcct

SEQ ID NO: 1365471 - DNA, 12 bp, Homo sapiens
atcccattccag

SEQ ID NO: 1365472 - DNA, 14 bp, Homo sapiens
atcccattccaggc

SEQ ID NO: 1365473 - DNA, 14 bp, Homo sapiens
atcccatttaaaaa

SEQ ID NO: 1365474 - DNA, 15 bp, Homo sapiens
atccccatctccctg

SEQ ID NO: 1365475 - DNA, 16 bp, Homo sapiens
atccccatctccctgc

SEQ ID NO: 1365476 - DNA, 17 bp, Homo sapiens
atccccgcctggccagg

SEQ ID NO: 1365477 - DNA, 15 bp, Homo sapiens
atcccctgtagagtg

SEQ ID NO: 1365478 - DNA, 18 bp, Homo sapiens
atcccgttttccccatga

SEQ ID NO: 1365479 - DNA, 20 bp, Homo sapiens
atcccgttttccccatgaca

SEQ ID NO: 1365480 - DNA, 23 bp, Homo sapiens
atccctctaatgagactgaccat

SEQ ID NO: 1365481 - DNA, 20 bp, Homo sapiens
atccctgatcccattttcct

SEQ ID NO: 1365482 - DNA, 22 bp, Homo sapiens
atccctttattaccccctcctt

SEQ ID NO: 1365483 - DNA, 17 bp, Homo sapiens
atccgactgctttggac

SEQ ID NO: 1365484 - DNA, 16 bp, Homo sapiens
atccgcgtgtgcctgt

SEQ ID NO: 1365485 - DNA, 14 bp, Homo sapiens
atccggagaagctg

SEQ ID NO: 1365486 - DNA, 15 bp, Homo sapiens
atcctaatttctcct

SEQ ID NO: 1365487 - DNA, 16 bp, Homo sapiens
atcctaatttctcctc

SEQ ID NO: 1365488 - DNA, 18 bp, Homo sapiens
atcctaatttctcctccc

SEQ ID NO: 1365489 - DNA, 19 bp, Homo sapiens
atcctccaaccaggctcct

SEQ ID NO: 1365490 - DNA, 16 bp, Homo sapiens
atcctctcacctcagc

SEQ ID NO: 1365491 - DNA, 13 bp, Homo sapiens
atcctgaagagca

SEQ ID NO: 1365492 - DNA, 15 bp, Homo sapiens
atcctgattcctctc

SEQ ID NO: 1365493 - DNA, 18 bp, Homo sapiens
atcctgattcctctctaa

SEQ ID NO: 1365494 - DNA, 20 bp, Homo sapiens
atcctggaacaatattttat

SEQ ID NO: 1365495 - DNA, 12 bp, Homo sapiens
atcctggcagcc

SEQ ID NO: 1365496 - DNA, 13 bp, Homo sapiens
atcctggcagccc

SEQ ID NO: 1365497 - DNA, 18 bp, Homo sapiens
atcctggctaacatggtg

SEQ ID NO: 1365498 - DNA, 21 bp, Homo sapiens
atcctgtattcttcaaccagt

SEQ ID NO: 1365499 - DNA, 20 bp, Homo sapiens
atccttaaatcttaatgttc

SEQ ID NO: 1365500 - DNA, 22 bp, Homo sapiens
atccttaaatcttaatgttcct

SEQ ID NO: 1365501 - DNA, 16 bp, Homo sapiens
atcgagaccatcctgg

SEQ ID NO: 1365502 - DNA, 17 bp, Homo sapiens
atcgagaccatcctggc

SEQ ID NO: 1365503 - DNA, 15 bp, Homo sapiens
atgaggaggggaggg

SEQ ID NO: 1365504 - DNA, 22 bp, Homo sapiens
atgaggagggtgggggagggag

SEQ ID NO: 1365505 - DNA, 19 bp, Homo sapiens
atgagtccttgatttcaaa

SEQ ID NO: 1365506 - DNA, 17 bp, Homo sapiens
atgatacaatgaacact

SEQ ID NO: 1365507 - DNA, 17 bp, Homo sapiens
atgatggttttaaactt

SEQ ID NO: 1365508 - DNA, 19 bp, Homo sapiens
atgatgtctttttattaaa

SEQ ID NO: 1365509 - DNA, 16 bp, Homo sapiens
atgcaaataacacaaa

SEQ ID NO: 1365510 - DNA, 14 bp, Homo sapiens
atgcaaatgagctc

SEQ ID NO: 1365511 - DNA, 19 bp, Homo sapiens
atgcaaatgagctctgaaa

SEQ ID NO: 1365512 - DNA, 23 bp, Homo sapiens
atgcaaatgagctctgaaatctt

SEQ ID NO: 1365513 - DNA, 17 bp, Homo sapiens
atgcaaccaagtcacac

SEQ ID NO: 1365514 - DNA, 14 bp, Homo sapiens
atgcaagcagagga

SEQ ID NO: 1365515 - DNA, 21 bp, Homo sapiens
atgcaagcagaggaccagggc

SEQ ID NO: 1365516 - DNA, 22 bp, Homo sapiens
atgcaagcagaggaccagggcc

SEQ ID NO: 1365517 - DNA, 18 bp, Homo sapiens
atgcaataaaatttaaaa

SEQ ID NO: 1365518 - DNA, 24 bp, Homo sapiens
atgcaatgtaagcatactttgtaa

SEQ ID NO: 1365519 - DNA, 14 bp, Homo sapiens
atgcaccaccaagc

SEQ ID NO: 1365520 - DNA, 18 bp, Homo sapiens
atgcaccaccaagccaag

SEQ ID NO: 1365521 - DNA, 15 bp, Homo sapiens
atgcacttaaagaag

SEQ ID NO: 1365522 - DNA, 17 bp, Homo sapiens
atgcaggctcccctgag

SEQ ID NO: 1365523 - DNA, 22 bp, Homo sapiens
atgcagttagctgaagaattga

SEQ ID NO: 1365524 - DNA, 18 bp, Homo sapiens
atgcatataatgaataaa

SEQ ID NO: 1365525 - DNA, 13 bp, Homo sapiens
atgcatctttgat

SEQ ID NO: 1365526 - DNA, 16 bp, Homo sapiens
atgcatctttgatgtg

SEQ ID NO: 1365527 - DNA, 21 bp, Homo sapiens
atgcatctttgatgtgttgtt

SEQ ID NO: 1365528 - DNA, 16 bp, Homo sapiens
atgcatgcaaatgagc

SEQ ID NO: 1365529 - DNA, 17 bp, Homo sapiens
atgcatgcttcttctca

SEQ ID NO: 1365530 - DNA, 16 bp, Homo sapiens
atgcatgtcaaacatg

SEQ ID NO: 1365531 - DNA, 22 bp, Homo sapiens
atgcatgtcaaacatgagatgt

SEQ ID NO: 1365532 - DNA, 15 bp, Homo sapiens
atgcatgtcttttaa

SEQ ID NO: 1365533 - DNA, 18 bp, Homo sapiens
atgccacttctaagaaaa

SEQ ID NO: 1365534 - DNA, 18 bp, Homo sapiens
atgccagggccgaccaga

SEQ ID NO: 1365535 - DNA, 22 bp, Homo sapiens
atgccatagaaatgtaggtcct

SEQ ID NO: 1365536 - DNA, 17 bp, Homo sapiens
atgcccaccccctgccc

SEQ ID NO: 1365537 - DNA, 15 bp, Homo sapiens
atgcctcactaattt

SEQ ID NO: 1365538 - DNA, 23 bp, Homo sapiens
atgcctcactaatttttgtatta

SEQ ID NO: 1365539 - DNA, 19 bp, Homo sapiens
atgcctttttttctctgca

SEQ ID NO: 1365540 - DNA, 15 bp, Homo sapiens
atgcgctcagggcca

SEQ ID NO: 1365541 - DNA, 17 bp, Homo sapiens
atgctacaattttaaga

SEQ ID NO: 1365542 - DNA, 13 bp, Homo sapiens
atgctatttgaac

SEQ ID NO: 1365543 - DNA, 15 bp, Homo sapiens
atgctatttgaacaa

SEQ ID NO: 1365544 - DNA, 21 bp, Homo sapiens
atgctccccacagcgtccctg

SEQ ID NO: 1365545 - DNA, 19 bp, Homo sapiens
atgctcctggcccactgca

SEQ ID NO: 1365546 - DNA, 22 bp, Homo sapiens
atgctctcactgtttgttttta

SEQ ID NO: 1365547 - DNA, 22 bp, Homo sapiens
atgctgaggcctgggccgctgc

SEQ ID NO: 1365548 - DNA, 13 bp, Homo sapiens
atgcttctcactg

SEQ ID NO: 1365549 - DNA, 19 bp, Homo sapiens
atgcttgtgaaaatgtgtt

SEQ ID NO: 1365550 - DNA, 19 bp, Homo sapiens
atgctttattaatgttttc

SEQ ID NO: 1365551 - DNA, 19 bp, Homo sapiens
atggaattttgcaaagatt

SEQ ID NO: 1365552 - DNA, 15 bp, Homo sapiens
atggacactccaggg

SEQ ID NO: 1365553 - DNA, 14 bp, Homo sapiens
atggagaagctgca

SEQ ID NO: 1365554 - DNA, 19 bp, Homo sapiens
atggaggatctctaaagag

SEQ ID NO: 1365555 - DNA, 21 bp, Homo sapiens
atggaggatctctaaagagca

SEQ ID NO: 1365556 - DNA, 15 bp, Homo sapiens
atggatttccagcca

SEQ ID NO: 1365557 - DNA, 18 bp, Homo sapiens
atggcaaaggaaggtgga

SEQ ID NO: 1365558 - DNA, 20 bp, Homo sapiens
atggcaagttgcatcagaaa

SEQ ID NO: 1365559 - DNA, 19 bp, Homo sapiens
atggcagcctactctcctt

SEQ ID NO: 1365560 - DNA, 14 bp, Homo sapiens
atggccccagcaca

SEQ ID NO: 1365561 - DNA, 15 bp, Homo sapiens
atggccccagcacag

SEQ ID NO: 1365562 - DNA, 18 bp, Homo sapiens
atggccccagcacagctt

SEQ ID NO: 1365563 - DNA, 21 bp, Homo sapiens
atggccgggcgcggtggctca

SEQ ID NO: 1365564 - DNA, 18 bp, Homo sapiens
atggcctcatgtggctgg

SEQ ID NO: 1365565 - DNA, 18 bp, Homo sapiens
atggccttaatttccttt

SEQ ID NO: 1365566 - DNA, 14 bp, Homo sapiens
atggctcagggtgg

SEQ ID NO: 1365567 - DNA, 23 bp, Homo sapiens
atggcttgttcatcatccagatg

SEQ ID NO: 1365568 - DNA, 18 bp, Homo sapiens
atggctttatttttttga

SEQ ID NO: 1365569 - DNA, 19 bp, Homo sapiens
atgggacctgtggctgtcg

SEQ ID NO: 1365570 - DNA, 14 bp, Homo sapiens
atgggatgagaaaa

SEQ ID NO: 1365571 - DNA, 11 bp, Homo sapiens
atggggaggga

SEQ ID NO: 1365572 - DNA, 17 bp, Homo sapiens
atggtaccaatcatgaa

SEQ ID NO: 1365573 - DNA, 20 bp, Homo sapiens
atggtaccaatcatgaatct

SEQ ID NO: 1365574 - DNA, 18 bp, Homo sapiens
atggtagtttctgtggtt

SEQ ID NO: 1365575 - DNA, 22 bp, Homo sapiens
atggtagtttctgtggttggct

SEQ ID NO: 1365576 - DNA, 12 bp, Homo sapiens
atggtatatata

SEQ ID NO: 1365577 - DNA, 14 bp, Homo sapiens
atggtatatataca

SEQ ID NO: 1365578 - DNA, 19 bp, Homo sapiens
atggtatatatacatatat

SEQ ID NO: 1365579 - DNA, 24 bp, Homo sapiens
atggtcacgtttggtgcttctcag

SEQ ID NO: 1365580 - DNA, 20 bp, Homo sapiens
atggtgatgcagtcttagat

SEQ ID NO: 1365581 - DNA, 21 bp, Homo sapiens
atggtgcctgagaggcaggca

SEQ ID NO: 1365582 - DNA, 18 bp, Homo sapiens
atggtgtgaacccgggag

SEQ ID NO: 1365583 - DNA, 15 bp, Homo sapiens
atggtgtggcctgtg

SEQ ID NO: 1365584 - DNA, 18 bp, Homo sapiens
atggttacttcttctctt

SEQ ID NO: 1365585 - DNA, 18 bp, Homo sapiens
atggttctggctgtttga

SEQ ID NO: 1365586 - DNA, 17 bp, Homo sapiens
atggttgatgatacttc

SEQ ID NO: 1365587 - DNA, 13 bp, Homo sapiens
atgtaaataattc

SEQ ID NO: 1365588 - DNA, 14 bp, Homo sapiens
atgtaaataattct

SEQ ID NO: 1365589 - DNA, 20 bp, Homo sapiens
atgtaaattttgtatgaaaa

SEQ ID NO: 1365590 - DNA, 18 bp, Homo sapiens
atgtaagtgggcccaccc

SEQ ID NO: 1365591 - DNA, 13 bp, Homo sapiens
atgtaatttaaat

SEQ ID NO: 1365592 - DNA, 16 bp, Homo sapiens
atgtaatttaaatgaa

SEQ ID NO: 1365593 - DNA, 20 bp, Homo sapiens
atgtaatttaaatgaaagaa

SEQ ID NO: 1365594 - DNA, 14 bp, Homo sapiens
atgtacagattctt

SEQ ID NO: 1365595 - DNA, 16 bp, Homo sapiens
atgtacagattctttc

SEQ ID NO: 1365596 - DNA, 18 bp, Homo sapiens
atgtacagattctttcag

SEQ ID NO: 1365597 - DNA, 14 bp, Homo sapiens
atgtagcagtgagt

SEQ ID NO: 1365598 - DNA, 19 bp, Homo sapiens
atgtagccccctggcctct

SEQ ID NO: 1365599 - DNA, 23 bp, Homo sapiens
atgtaggagctgccttggctcag

SEQ ID NO: 1365600 - DNA, 12 bp, Homo sapiens
atgtaggtcctc

SEQ ID NO: 1365601 - DNA, 14 bp, Homo sapiens
atgtataaaataca

SEQ ID NO: 1365602 - DNA, 15 bp, Homo sapiens
atgtataaaatacat

SEQ ID NO: 1365603 - DNA, 14 bp, Homo sapiens
atgtataaatatac

SEQ ID NO: 1365604 - DNA, 14 bp, Homo sapiens
atgtatattaaaaa

SEQ ID NO: 1365605 - DNA, 17 bp, Homo sapiens
atgtatattaaaaaaga

SEQ ID NO: 1365606 - DNA, 22 bp, Homo sapiens
atgtatattaaaaaagagacat

SEQ ID NO: 1365607 - DNA, 14 bp, Homo sapiens
atgtatgtgtttag

SEQ ID NO: 1365608 - DNA, 15 bp, Homo sapiens
atgtatgtgtttaga

SEQ ID NO: 1365609 - DNA, 20 bp, Homo sapiens
atgtatgtgtttagaattga

SEQ ID NO: 1365610 - DNA, 12 bp, Homo sapiens
atgtatgtttct

SEQ ID NO: 1365611 - DNA, 16 bp, Homo sapiens
atgtattatttataat

SEQ ID NO: 1365612 - DNA, 17 bp, Homo sapiens
atgtcaaaagtagaact

SEQ ID NO: 1365613 - DNA, 22 bp, Homo sapiens
atgtcaaaagtagaactttgta

SEQ ID NO: 1365614 - DNA, 23 bp, Homo sapiens
atgtcaaaagtagaactttgtat

SEQ ID NO: 1365615 - DNA, 22 bp, Homo sapiens
atgtcagcagttgctggtaaaa

SEQ ID NO: 1365616 - DNA, 18 bp, Homo sapiens
atgtccaaagaggctgcc

SEQ ID NO: 1365617 - DNA, 21 bp, Homo sapiens
atgtccagcaccttgtgcctg

SEQ ID NO: 1365618 - DNA, 16 bp, Homo sapiens
atgtccagtaagatca

SEQ ID NO: 1365619 - DNA, 21 bp, Homo sapiens
atgtccagtaagatcactgtt

SEQ ID NO: 1365620 - DNA, 20 bp, Homo sapiens
atgtctcaaggcagttaatt

SEQ ID NO: 1365621 - DNA, 19 bp, Homo sapiens
attctggctttaagccttc

SEQ ID NO: 1365622 - DNA, 14 bp, Homo sapiens
attcttcaaccagt

SEQ ID NO: 1365623 - DNA, 18 bp, Homo sapiens
attcttggcttaatcatt

SEQ ID NO: 1365624 - DNA, 22 bp, Homo sapiens
attcttgttgctgtacaaaagc

SEQ ID NO: 1365625 - DNA, 22 bp, Homo sapiens
attcttttaattgtttcagaat

SEQ ID NO: 1365626 - DNA, 13 bp, Homo sapiens
attcttttctcag

SEQ ID NO: 1365627 - DNA, 19 bp, Homo sapiens
attcttttctcagtgttgg

SEQ ID NO: 1365628 - DNA, 14 bp, Homo sapiens
attcttttttatta

SEQ ID NO: 1365629 - DNA, 15 bp, Homo sapiens
attcttttttattaa

SEQ ID NO: 1365630 - DNA, 16 bp, Homo sapiens
attcttttttattaat

SEQ ID NO: 1365631 - DNA, 19 bp, Homo sapiens
attcttttttattaatcac

SEQ ID NO: 1365632 - DNA, 20 bp, Homo sapiens
attcttttttattaatcact

SEQ ID NO: 1365633 - DNA, 17 bp, Homo sapiens
attgaacttttgtactg

SEQ ID NO: 1365634 - DNA, 19 bp, Homo sapiens
attgaacttttgtactgaa

SEQ ID NO: 1365635 - DNA, 23 bp, Homo sapiens
attgaacttttgtactgaatttt

SEQ ID NO: 1365636 - DNA, 12 bp, Homo sapiens
attgacactgaa

SEQ ID NO: 1365637 - DNA, 22 bp, Homo sapiens
attgacctatttccagaaatac

SEQ ID NO: 1365638 - DNA, 15 bp, Homo sapiens
attgactctgggtcc

SEQ ID NO: 1365639 - DNA, 16 bp, Homo sapiens
attgactcttgagttg

SEQ ID NO: 1365640 - DNA, 19 bp, Homo sapiens
attgactcttgagttgttt

SEQ ID NO: 1365641 - DNA, 22 bp, Homo sapiens
attgactcttgagttgtttttg

SEQ ID NO: 1365642 - DNA, 17 bp, Homo sapiens
attgagaccgtgaagat

SEQ ID NO: 1365643 - DNA, 22 bp, Homo sapiens
attgagaccgtgaagatacttt

SEQ ID NO: 1365644 - DNA, 21 bp, Homo sapiens
attgaggccaagaatattgca

SEQ ID NO: 1365645 - DNA, 16 bp, Homo sapiens
attgagtattgtttaa

SEQ ID NO: 1365646 - DNA, 16 bp, Homo sapiens
attgcaaaatacatga

SEQ ID NO: 1365647 - DNA, 17 bp, Homo sapiens
attgcagtttatcattc

SEQ ID NO: 1365648 - DNA, 23 bp, Homo sapiens
attgcagtttatcattcaagtgt

SEQ ID NO: 1365649 - DNA, 21 bp, Homo sapiens
attgcatactttgtattttga

SEQ ID NO: 1365650 - DNA, 14 bp, Homo sapiens
attgcctgtttctg

SEQ ID NO: 1365651 - DNA, 16 bp, Homo sapiens
attgctgagcctctgc

SEQ ID NO: 1365652 - DNA, 18 bp, Homo sapiens
attgctgtgtgtcccagg

SEQ ID NO: 1365653 - DNA, 13 bp, Homo sapiens
attggaccaggcc

SEQ ID NO: 1365654 - DNA, 15 bp, Homo sapiens
attggaccaggccat

SEQ ID NO: 1365655 - DNA, 23 bp, Homo sapiens
attggctttgggttgcaggacct

SEQ ID NO: 1365656 - DNA, 14 bp, Homo sapiens
attggttttatgat

SEQ ID NO: 1365657 - DNA, 15 bp, Homo sapiens
attggttttatgatg

SEQ ID NO: 1365658 - DNA, 12 bp, Homo sapiens
attgtaaagtaa

SEQ ID NO: 1365659 - DNA, 18 bp, Homo sapiens
attgtaagcgtatggctt

SEQ ID NO: 1365660 - DNA, 15 bp, Homo sapiens
attgtatattacaat

SEQ ID NO: 1365661 - DNA, 19 bp, Homo sapiens
attgtatattacaatgatc

SEQ ID NO: 1365662 - DNA, 18 bp, Homo sapiens
attgtcctattagtgtta

SEQ ID NO: 1365663 - DNA, 16 bp, Homo sapiens
attgtctcccttccag

SEQ ID NO: 1365664 - DNA, 20 bp, Homo sapiens
attgtgcttcacagtagagc

SEQ ID NO: 1365665 - DNA, 20 bp, Homo sapiens
attgttccttggagaaatga

SEQ ID NO: 1365666 - DNA, 12 bp, Homo sapiens
attgtttctgca

SEQ ID NO: 1365667 - DNA, 17 bp, Homo sapiens
attgtttctgcattcat

SEQ ID NO: 1365668 - DNA, 19 bp, Homo sapiens
attgtttggtaaatgtttc

SEQ ID NO: 1365669 - DNA, 15 bp, Homo sapiens
attgttttacaatag

SEQ ID NO: 1365670 - DNA, 19 bp, Homo sapiens
attgttttacaatagttct

SEQ ID NO: 1365671 - DNA, 14 bp, Homo sapiens
atttaaaaaaaatc

SEQ ID NO: 1365672 - DNA, 16 bp, Homo sapiens
atttaaaataattata

SEQ ID NO: 1365673 - DNA, 13 bp, Homo sapiens
atttaaatgaaag

SEQ ID NO: 1365674 - DNA, 13 bp, Homo sapiens
atttaacagaaat

SEQ ID NO: 1365675 - DNA, 18 bp, Homo sapiens
atttaacagaaattgtat

SEQ ID NO: 1365676 - DNA, 13 bp, Homo sapiens
atttaagatgtga

SEQ ID NO: 1365677 - DNA, 15 bp, Homo sapiens
atttaagatgtgaaa

SEQ ID NO: 1365678 - DNA, 14 bp, Homo sapiens
atttaagggaaaaa

SEQ ID NO: 1365679 - DNA, 15 bp, Homo sapiens
atttaagggaaaaat

SEQ ID NO: 1365680 - DNA, 16 bp, Homo sapiens
atttaagggaaaaata

SEQ ID NO: 1365681 - DNA, 18 bp, Homo sapiens
atttaagggaaaaatata

SEQ ID NO: 1365682 - DNA, 17 bp, Homo sapiens
atttaagggaaagaaaa

SEQ ID NO: 1365683 - DNA, 19 bp, Homo sapiens
atttaagggaaagaaaatg

SEQ ID NO: 1365684 - DNA, 19 bp, Homo sapiens
atttaataccagatacctt

SEQ ID NO: 1365685 - DNA, 23 bp, Homo sapiens
atttaatccagttataagaagaa

SEQ ID NO: 1365686 - DNA, 17 bp, Homo sapiens
atttactctaaaaactg

SEQ ID NO: 1365687 - DNA, 14 bp, Homo sapiens
atttagacaagaga

SEQ ID NO: 1365688 - DNA, 16 bp, Homo sapiens
atttagacaagagatg

SEQ ID NO: 1365689 - DNA, 16 bp, Homo sapiens
atttagggagtattct

SEQ ID NO: 1365690 - DNA, 14 bp, Homo sapiens
atttagtaagaata

SEQ ID NO: 1365691 - DNA, 16 bp, Homo sapiens
atttataaggaaattt

SEQ ID NO: 1365692 - DNA, 16 bp, Homo sapiens
atttatatgtactgtt

SEQ ID NO: 1365693 - DNA, 13 bp, Homo sapiens
atttatatgtatg

SEQ ID NO: 1365694 - DNA, 14 bp, Homo sapiens
atttatatgtatgt

SEQ ID NO: 1365695 - DNA, 21 bp, Homo sapiens
atttatatgtatgtgtttaga

SEQ ID NO: 1365696 - DNA, 16 bp, Homo sapiens
atttatccagaaaact

SEQ ID NO: 1365697 - DNA, 20 bp, Homo sapiens
atttatccagaaaactgtga

SEQ ID NO: 1365698 - DNA, 13 bp, Homo sapiens
atttatgggcccc

SEQ ID NO: 1365699 - DNA, 16 bp, Homo sapiens
atttatgggcccctgg

SEQ ID NO: 1365700 - DNA, 19 bp, Homo sapiens
atttatgggcccctggcac

SEQ ID NO: 1365701 - DNA, 14 bp, Homo sapiens
atttattaaatttt

SEQ ID NO: 1365702 - DNA, 24 bp, Homo sapiens
atttattaaatttttttgtatgaa

SEQ ID NO: 1365703 - DNA, 17 bp, Homo sapiens
atttattaacttaataa

SEQ ID NO: 1365704 - DNA, 20 bp, Homo sapiens
atttattaacttaataatca

SEQ ID NO: 1365705 - DNA, 12 bp, Homo sapiens
atttattaatat

SEQ ID NO: 1365706 - DNA, 23 bp, Homo sapiens
atttattaatatttaacattatt

SEQ ID NO: 1365707 - DNA, 11 bp, Homo sapiens
atttattattt

SEQ ID NO: 1365708 - DNA, 13 bp, Homo sapiens
atttattatttat

SEQ ID NO: 1365709 - DNA, 13 bp, Homo sapiens
atttattgactct

SEQ ID NO: 1365710 - DNA, 18 bp, Homo sapiens
atttatttaatatttaat

SEQ ID NO: 1365711 - DNA, 23 bp, Homo sapiens
atttatttacagatgaatgtatt

SEQ ID NO: 1365712 - DNA, 16 bp, Homo sapiens
atttatttatgtactt

SEQ ID NO: 1365713 - DNA, 14 bp, Homo sapiens
atttatttattatt

SEQ ID NO: 1365714 - DNA, 20 bp, Homo sapiens
atttatttccactaaaaata

SEQ ID NO: 1365715 - DNA, 19 bp, Homo sapiens
atttattttcctaaagaga

SEQ ID NO: 1365716 - DNA, 19 bp, Homo sapiens
atttattttttttaattgt

SEQ ID NO: 1365717 - DNA, 23 bp, Homo sapiens
atttattttttttaattgtattt

SEQ ID NO: 1365718 - DNA, 19 bp, Homo sapiens
atttcagaaaatgaaaaat

SEQ ID NO: 1365719 - DNA, 14 bp, Homo sapiens
atttcatctcattt

SEQ ID NO: 1365720 - DNA, 17 bp, Homo sapiens
atttccagccaaagcct

SEQ ID NO: 1365721 - DNA, 19 bp, Homo sapiens
atttcctcgcagcctctca

SEQ ID NO: 1365722 - DNA, 10 bp, Homo sapiens
atttccttta

SEQ ID NO: 1365723 - DNA, 19 bp, Homo sapiens
atttcctttatgtgaattt

SEQ ID NO: 1365724 - DNA, 21 bp, Homo sapiens
atttcctttatgtgaattttt

SEQ ID NO: 1365725 - DNA, 18 bp, Homo sapiens
atttcctttttgacactg

SEQ ID NO: 1365726 - DNA, 15 bp, Homo sapiens
atttctcattgactt

SEQ ID NO: 1365727 - DNA, 19 bp, Homo sapiens
atttctcctcccttccttt

SEQ ID NO: 1365728 - DNA, 13 bp, Homo sapiens
atttctgtatata

SEQ ID NO: 1365729 - DNA, 11 bp, Homo sapiens
atttctgtgtt

SEQ ID NO: 1365730 - DNA, 13 bp, Homo sapiens
atttcttatgtga

SEQ ID NO: 1365731 - DNA, 18 bp, Homo sapiens
atttcttatgtgacatta

SEQ ID NO: 1365732 - DNA, 20 bp, Homo sapiens
atttctttaaaagaatgact

SEQ ID NO: 1365733 - DNA, 20 bp, Homo sapiens
atttcttttcaccattcgta

SEQ ID NO: 1365734 - DNA, 16 bp, Homo sapiens
atttgaaagtgccttt

SEQ ID NO: 1365735 - DNA, 17 bp, Homo sapiens
atttgaaagtgcctttg

SEQ ID NO: 1365736 - DNA, 20 bp, Homo sapiens
atttgaaagtgcctttgcag

SEQ ID NO: 1365737 - DNA, 22 bp, Homo sapiens
atttgaaagtgcctttgcagct

SEQ ID NO: 1365738 - DNA, 15 bp, Homo sapiens
atttgaaataagaat

SEQ ID NO: 1365739 - DNA, 17 bp, Homo sapiens
atttgaacaatgaagtt

SEQ ID NO: 1365740 - DNA, 17 bp, Homo sapiens
caaagtttgacaggaac

SEQ ID NO: 1365741 - DNA, 22 bp, Homo sapiens
caaagttttgttgtacttaaat

SEQ ID NO: 1365742 - DNA, 17 bp, Homo sapiens
caaataaataattttca

SEQ ID NO: 1365743 - DNA, 17 bp, Homo sapiens
caaataagtatttataa

SEQ ID NO: 1365744 - DNA, 18 bp, Homo sapiens
caaataagtatttataat

SEQ ID NO: 1365745 - DNA, 16 bp, Homo sapiens
caaatacacatttgct

SEQ ID NO: 1365746 - DNA, 19 bp, Homo sapiens
caaatcaattctagtcata

SEQ ID NO: 1365747 - DNA, 13 bp, Homo sapiens
caaatctggaagc

SEQ ID NO: 1365748 - DNA, 16 bp, Homo sapiens
caaatgactttattat

SEQ ID NO: 1365749 - DNA, 16 bp, Homo sapiens
caaatgagctctgaaa

SEQ ID NO: 1365750 - DNA, 21 bp, Homo sapiens
caaatgcaaaaactctttgag

SEQ ID NO: 1365751 - DNA, 16 bp, Homo sapiens
caaatgcatctttgat

SEQ ID NO: 1365752 - DNA, 17 bp, Homo sapiens
caaatggagaagctgca

SEQ ID NO: 1365753 - DNA, 13 bp, Homo sapiens
caaatgtttattt

SEQ ID NO: 1365754 - DNA, 12 bp, Homo sapiens
caaattaattgt

SEQ ID NO: 1365755 - DNA, 17 bp, Homo sapiens
caaatttcatgaccagt

SEQ ID NO: 1365756 - DNA, 16 bp, Homo sapiens
caacaataaaattttt

SEQ ID NO: 1365757 - DNA, 15 bp, Homo sapiens
caacaattggtaaaa

SEQ ID NO: 1365758 - DNA, 16 bp, Homo sapiens
caacacagcctgggcc

SEQ ID NO: 1365759 - DNA, 20 bp, Homo sapiens
caacacctctgcacaagctg

SEQ ID NO: 1365760 - DNA, 14 bp, Homo sapiens
caaccatgtcattt

SEQ ID NO: 1365761 - DNA, 18 bp, Homo sapiens
caaccccaaacccaagtg

SEQ ID NO: 1365762 - DNA, 17 bp, Homo sapiens
caacctcagggctccca

SEQ ID NO: 1365763 - DNA, 16 bp, Homo sapiens
caacctcgctgagggc

SEQ ID NO: 1365764 - DNA, 17 bp, Homo sapiens
caacctcttctggctca

SEQ ID NO: 1365765 - DNA, 18 bp, Homo sapiens
caacctttccctcacccc

SEQ ID NO: 1365766 - DNA, 16 bp, Homo sapiens
caacgatcacaaatga

SEQ ID NO: 1365767 - DNA, 18 bp, Homo sapiens
caacgatcacaaatgact

SEQ ID NO: 1365768 - DNA, 19 bp, Homo sapiens
caacgatcacaaatgactt

SEQ ID NO: 1365769 - DNA, 22 bp, Homo sapiens
caactatttattgactctgggt

SEQ ID NO: 1365770 - DNA, 23 bp, Homo sapiens
caactcagagaaaaatgctcccc

SEQ ID NO: 1365771 - DNA, 22 bp, Homo sapiens
caactccagcaacttcttctcc

SEQ ID NO: 1365772 - DNA, 20 bp, Homo sapiens
caactgtctctcttctcaga

SEQ ID NO: 1365773 - DNA, 16 bp, Homo sapiens
caactgtcttcctcaa

SEQ ID NO: 1365774 - DNA, 20 bp, Homo sapiens
caacttttgtgtaatgaaaa

SEQ ID NO: 1365775 - DNA, 19 bp, Homo sapiens
caactttttccctcactaa

SEQ ID NO: 1365776 - DNA, 13 bp, Homo sapiens
caagaagcagtgg

SEQ ID NO: 1365777 - DNA, 14 bp, Homo sapiens
caagaagcagtggc

SEQ ID NO: 1365778 - DNA, 11 bp, Homo sapiens
caagaatgtac

SEQ ID NO: 1365779 - DNA, 18 bp, Homo sapiens
caagactctttggacact

SEQ ID NO: 1365780 - DNA, 14 bp, Homo sapiens
caagagggggtgga

SEQ ID NO: 1365781 - DNA, 16 bp, Homo sapiens
caagatcaaaaaggct

SEQ ID NO: 1365782 - DNA, 22 bp, Homo sapiens
caagatgtgaattattgacact

SEQ ID NO: 1365783 - DNA, 16 bp, Homo sapiens
caagatttaaatgcca

SEQ ID NO: 1365784 - DNA, 19 bp, Homo sapiens
caagattttcctcttgtga

SEQ ID NO: 1365785 - DNA, 18 bp, Homo sapiens
caagattttttaattgtt

SEQ ID NO: 1365786 - DNA, 19 bp, Homo sapiens
caagattttttaattgttt

SEQ ID NO: 1365787 - DNA, 21 bp, Homo sapiens
caagattttttaattgtttaa

SEQ ID NO: 1365788 - DNA, 20 bp, Homo sapiens
caagcagaggaccagggcct

SEQ ID NO: 1365789 - DNA, 15 bp, Homo sapiens
caagcagtcgtgcct

SEQ ID NO: 1365790 - DNA, 16 bp, Homo sapiens
caagcagtcgtgcctg

SEQ ID NO: 1365791 - DNA, 18 bp, Homo sapiens
caagccaagggaacctgt

SEQ ID NO: 1365792 - DNA, 15 bp, Homo sapiens
caagccagaggctgg

SEQ ID NO: 1365793 - DNA, 17 bp, Homo sapiens
caagcctccacagcgag

SEQ ID NO: 1365794 - DNA, 19 bp, Homo sapiens
caagctccaagccccatct

SEQ ID NO: 1365795 - DNA, 20 bp, Homo sapiens
caagctgcaccctcaggcag

SEQ ID NO: 1365796 - DNA, 17 bp, Homo sapiens
caagctggcttacactg

SEQ ID NO: 1365797 - DNA, 12 bp, Homo sapiens
caaggctgcagt

SEQ ID NO: 1365798 - DNA, 21 bp, Homo sapiens
caaggctgggggaagaagctc

SEQ ID NO: 1365799 - DNA, 14 bp, Homo sapiens
caagggaaaggggt

SEQ ID NO: 1365800 - DNA, 20 bp, Homo sapiens
caagggaaaggggtgctttt

SEQ ID NO: 1365801 - DNA, 21 bp, Homo sapiens
caagggaaaggggtgctttta

SEQ ID NO: 1365802 - DNA, 12 bp, Homo sapiens
caaggtgggagg

SEQ ID NO: 1365803 - DNA, 21 bp, Homo sapiens
caaggttataattttttttaa

SEQ ID NO: 1365804 - DNA, 10 bp, Homo sapiens
caagtaaaaa

SEQ ID NO: 1365805 - DNA, 20 bp, Homo sapiens
caagtacatggctagctttt

SEQ ID NO: 1365806 - DNA, 18 bp, Homo sapiens
caagtagttctgtatttg

SEQ ID NO: 1365807 - DNA, 19 bp, Homo sapiens
caagtagttctgtatttga

SEQ ID NO: 1365808 - DNA, 18 bp, Homo sapiens
caagtatagcctatggca

SEQ ID NO: 1365809 - DNA, 17 bp, Homo sapiens
caagtcaagtgaaaaag

SEQ ID NO: 1365810 - DNA, 22 bp, Homo sapiens
caagtcagtaggactccttatt

SEQ ID NO: 1365811 - DNA, 19 bp, Homo sapiens
caagtgaaaaaggaggaag

SEQ ID NO: 1365812 - DNA, 21 bp, Homo sapiens
caagtgctggagtctcctgag

SEQ ID NO: 1365813 - DNA, 19 bp, Homo sapiens
caagtggggtgctgggagg

SEQ ID NO: 1365814 - DNA, 15 bp, Homo sapiens
caagtgtaaaatatt

SEQ ID NO: 1365815 - DNA, 23 bp, Homo sapiens
caagtgtaaaatattttgaatca

SEQ ID NO: 1365816 - DNA, 14 bp, Homo sapiens
caagtgtgaatact

SEQ ID NO: 1365817 - DNA, 22 bp, Homo sapiens
caagtgtggtagagtgtgcctg

SEQ ID NO: 1365818 - DNA, 19 bp, Homo sapiens
caagttgagctatgactta

SEQ ID NO: 1365819 - DNA, 12 bp, Homo sapiens
caagttgtaaat

SEQ ID NO: 1365820 - DNA, 15 bp, Homo sapiens
caagttgtaaataat

SEQ ID NO: 1365821 - DNA, 14 bp, Homo sapiens
caagtttatatata

SEQ ID NO: 1365822 - DNA, 11 bp, Homo sapiens
caataaaattt

SEQ ID NO: 1365823 - DNA, 15 bp, Homo sapiens
caataaaccctcaga

SEQ ID NO: 1365824 - DNA, 14 bp, Homo sapiens
caataaagcttgtt

SEQ ID NO: 1365825 - DNA, 11 bp, Homo sapiens
caataaatttt

SEQ ID NO: 1365826 - DNA, 13 bp, Homo sapiens
caataatatattt

SEQ ID NO: 1365827 - DNA, 14 bp, Homo sapiens
caataatatatttt

SEQ ID NO: 1365828 - DNA, 16 bp, Homo sapiens
caataatatattttct

SEQ ID NO: 1365829 - DNA, 19 bp, Homo sapiens
caatacactagttgtttct

SEQ ID NO: 1365830 - DNA, 16 bp, Homo sapiens
caatagacacatacat

SEQ ID NO: 1365831 - DNA, 16 bp, Homo sapiens
caatagcacatatgga

SEQ ID NO: 1365832 - DNA, 21 bp, Homo sapiens
caataggatgggcttctgtgc

SEQ ID NO: 1365833 - DNA, 22 bp, Homo sapiens
caatatagaaaaataaaaatct

SEQ ID NO: 1365834 - DNA, 14 bp, Homo sapiens
caatatattgaact

SEQ ID NO: 1365835 - DNA, 15 bp, Homo sapiens
caatatattgaactt

SEQ ID NO: 1365836 - DNA, 15 bp, Homo sapiens
caatatctaatatat

SEQ ID NO: 1365837 - DNA, 23 bp, Homo sapiens
caatattgattgggaaaacattt

SEQ ID NO: 1365838 - DNA, 16 bp, Homo sapiens
caatattgtctccctt

SEQ ID NO: 1365839 - DNA, 15 bp, Homo sapiens
caatatttgaatttt

SEQ ID NO: 1365840 - DNA, 15 bp, Homo sapiens
caatattttatggtt

SEQ ID NO: 1365841 - DNA, 22 bp, Homo sapiens
caatattttatggttatgtttt

SEQ ID NO: 1365842 - DNA, 23 bp, Homo sapiens
caatattttatggttatgttttt

SEQ ID NO: 1365843 - DNA, 21 bp, Homo sapiens
caatattttggagtatgttaa

SEQ ID NO: 1365844 - DNA, 22 bp, Homo sapiens
caatcaaataagtatttataat

SEQ ID NO: 1365845 - DNA, 20 bp, Homo sapiens
caatccctttattaccccct

SEQ ID NO: 1365846 - DNA, 14 bp, Homo sapiens
caatctctttttgt

SEQ ID NO: 1365847 - DNA, 12 bp, Homo sapiens
caatctgtgggc

SEQ ID NO: 1365848 - DNA, 16 bp, Homo sapiens
caatcttactttgtaa

SEQ ID NO: 1365849 - DNA, 17 bp, Homo sapiens
caatcttactttgtaaa

SEQ ID NO: 1365850 - DNA, 21 bp, Homo sapiens
caatgaaaaatagtgtctttg

SEQ ID NO: 1365851 - DNA, 18 bp, Homo sapiens
caatgaacacttataagt

SEQ ID NO: 1365852 - DNA, 15 bp, Homo sapiens
caatgaaccataaat

SEQ ID NO: 1365853 - DNA, 16 bp, Homo sapiens
caatgaaccataaatt

SEQ ID NO: 1365854 - DNA, 19 bp, Homo sapiens
caatgagagcataatttaa

SEQ ID NO: 1365855 - DNA, 15 bp, Homo sapiens
caatgattgttaatt

SEQ ID NO: 1365856 - DNA, 15 bp, Homo sapiens
caatggagtattctc

SEQ ID NO: 1365857 - DNA, 23 bp, Homo sapiens
caatgggtttttccctgtacagt

SEQ ID NO: 1365858 - DNA, 18 bp, Homo sapiens
cactgaaagttttgtaaa

SEQ ID NO: 1365859 - DNA, 21 bp, Homo sapiens
cactgaaagttttgtaaaaga

SEQ ID NO: 1365860 - DNA, 14 bp, Homo sapiens
cactgccagcagca

SEQ ID NO: 1365861 - DNA, 16 bp, Homo sapiens
cactgccagcagcagc

SEQ ID NO: 1365862 - DNA, 19 bp, Homo sapiens
cactgccagcagcagcagg

SEQ ID NO: 1365863 - DNA, 21 bp, Homo sapiens
cactgccagcagcagcaggtg

SEQ ID NO: 1365864 - DNA, 13 bp, Homo sapiens
cactgccaggcca

SEQ ID NO: 1365865 - DNA, 20 bp, Homo sapiens
cactgccaggccagcctccg

SEQ ID NO: 1365866 - DNA, 21 bp, Homo sapiens
cactgccaggccagcctccga

SEQ ID NO: 1365867 - DNA, 14 bp, Homo sapiens
cactgcctgcctta

SEQ ID NO: 1365868 - DNA, 19 bp, Homo sapiens
cactgcctgggctgacccc

SEQ ID NO: 1365869 - DNA, 18 bp, Homo sapiens
cactgccttcgcttcttg

SEQ ID NO: 1365870 - DNA, 12 bp, Homo sapiens
cactgccttttt

SEQ ID NO: 1365871 - DNA, 19 bp, Homo sapiens
cactgcctttttatttata

SEQ ID NO: 1365872 - DNA, 15 bp, Homo sapiens
cactggaaaggggag

SEQ ID NO: 1365873 - DNA, 23 bp, Homo sapiens
cactggaaaggggagagcctgct

SEQ ID NO: 1365874 - DNA, 15 bp, Homo sapiens
cactggaccccagca

SEQ ID NO: 1365875 - DNA, 18 bp, Homo sapiens
cactggaggttgaagcca

SEQ ID NO: 1365876 - DNA, 21 bp, Homo sapiens
cactggaggttgaagccaagt

SEQ ID NO: 1365877 - DNA, 13 bp, Homo sapiens
cactggcgaggag

SEQ ID NO: 1365878 - DNA, 22 bp, Homo sapiens
cactggctgtcagtatgacatt

SEQ ID NO: 1365879 - DNA, 16 bp, Homo sapiens
cactgggctcccgggc

SEQ ID NO: 1365880 - DNA, 14 bp, Homo sapiens
cactgtgtatattt

SEQ ID NO: 1365881 - DNA, 15 bp, Homo sapiens
cactgtgtatatttg

SEQ ID NO: 1365882 - DNA, 21 bp, Homo sapiens
cactgttccagtgtctataaa

SEQ ID NO: 1365883 - DNA, 12 bp, Homo sapiens
cactgtttagat

SEQ ID NO: 1365884 - DNA, 15 bp, Homo sapiens
cactgtttagatttg

SEQ ID NO: 1365885 - DNA, 23 bp, Homo sapiens
cactgtttagatttgccatagag

SEQ ID NO: 1365886 - DNA, 18 bp, Homo sapiens
cactgtttctcttgagct

SEQ ID NO: 1365887 - DNA, 21 bp, Homo sapiens
cactgtttctcttgagctggc

SEQ ID NO: 1365888 - DNA, 15 bp, Homo sapiens
cactgtttgttttta

SEQ ID NO: 1365889 - DNA, 13 bp, Homo sapiens
cacttaagactgt

SEQ ID NO: 1365890 - DNA, 21 bp, Homo sapiens
cacttaagactgtgtattcta

SEQ ID NO: 1365891 - DNA, 21 bp, Homo sapiens
cacttaagttagcctccacca

SEQ ID NO: 1365892 - DNA, 17 bp, Homo sapiens
cacttagcgaacccttt

SEQ ID NO: 1365893 - DNA, 21 bp, Homo sapiens
cacttatgaatgatttgcata

SEQ ID NO: 1365894 - DNA, 15 bp, Homo sapiens
cacttattgaatata

SEQ ID NO: 1365895 - DNA, 18 bp, Homo sapiens
cacttcactccagcctgg

SEQ ID NO: 1365896 - DNA, 13 bp, Homo sapiens
cacttctgccaga

SEQ ID NO: 1365897 - DNA, 23 bp, Homo sapiens
cacttgatgatacaatgaacact

SEQ ID NO: 1365898 - DNA, 17 bp, Homo sapiens
cacttgtagatttgatt

SEQ ID NO: 1365899 - DNA, 20 bp, Homo sapiens
cactttctatcctctgtaaa

SEQ ID NO: 1365900 - DNA, 18 bp, Homo sapiens
cactttgaagtctataaa

SEQ ID NO: 1365901 - DNA, 18 bp, Homo sapiens
cactttgagcctgggaaa

SEQ ID NO: 1365902 - DNA, 12 bp, Homo sapiens
cactttgggagg

SEQ ID NO: 1365903 - DNA, 13 bp, Homo sapiens
cactttgggaggc

SEQ ID NO: 1365904 - DNA, 14 bp, Homo sapiens
cactttgttgcaag

SEQ ID NO: 1365905 - DNA, 22 bp, Homo sapiens
cactttgttgcaagatgtgaat

SEQ ID NO: 1365906 - DNA, 19 bp, Homo sapiens
cagaaaaaatgtctgtaaa

SEQ ID NO: 1365907 - DNA, 15 bp, Homo sapiens
cagaaacactgcctt

SEQ ID NO: 1365908 - DNA, 17 bp, Homo sapiens
cagaaacactgcctttt

SEQ ID NO: 1365909 - DNA, 20 bp, Homo sapiens
cagaaacttgtgaagtggaa

SEQ ID NO: 1365910 - DNA, 14 bp, Homo sapiens
cagaaatacaattt

SEQ ID NO: 1365911 - DNA, 16 bp, Homo sapiens
cagaaccacacttgaa

SEQ ID NO: 1365912 - DNA, 21 bp, Homo sapiens
cagaaccacacttgaaacctt

SEQ ID NO: 1365913 - DNA, 22 bp, Homo sapiens
cagaaccacacttgaaaccttt

SEQ ID NO: 1365914 - DNA, 22 bp, Homo sapiens
cagaaggtgccactttacccac

SEQ ID NO: 1365915 - DNA, 20 bp, Homo sapiens
cagaagtttgagatcagcct

SEQ ID NO: 1365916 - DNA, 23 bp, Homo sapiens
cagaatatttttatatttccttt

SEQ ID NO: 1365917 - DNA, 19 bp, Homo sapiens
cagaatgtaagtgggccca

SEQ ID NO: 1365918 - DNA, 22 bp, Homo sapiens
cagaatgtaagtgggcccaccc

SEQ ID NO: 1365919 - DNA, 22 bp, Homo sapiens
cagacaagattttttaattgtt

SEQ ID NO: 1365920 - DNA, 18 bp, Homo sapiens
cagacaataaaccctcag

SEQ ID NO: 1365921 - DNA, 18 bp, Homo sapiens
cagacaccttggacatcc

SEQ ID NO: 1365922 - DNA, 19 bp, Homo sapiens
cagacacgagccacctcac

SEQ ID NO: 1365923 - DNA, 15 bp, Homo sapiens
cagacagaacttgaa

SEQ ID NO: 1365924 - DNA, 18 bp, Homo sapiens
cagacatgttttccgtga

SEQ ID NO: 1365925 - DNA, 22 bp, Homo sapiens
cagacatgttttccgtgaaaac

SEQ ID NO: 1365926 - DNA, 13 bp, Homo sapiens
cagacattttaaa

SEQ ID NO: 1365927 - DNA, 20 bp, Homo sapiens
cagaccacaaaacttttcta

SEQ ID NO: 1365928 - DNA, 24 bp, Homo sapiens
cagaccacgcccgtcctgcctgtg

SEQ ID NO: 1365929 - DNA, 15 bp, Homo sapiens
cagaccagattaaac

SEQ ID NO: 1365930 - DNA, 22 bp, Homo sapiens
cagactatttttagattttctt

SEQ ID NO: 1365931 - DNA, 13 bp, Homo sapiens
cagactcagagct

SEQ ID NO: 1365932 - DNA, 15 bp, Homo sapiens
cagactcagagctct

SEQ ID NO: 1365933 - DNA, 17 bp, Homo sapiens
cagactcagagctctct

SEQ ID NO: 1365934 - DNA, 18 bp, Homo sapiens
cagactcagagctctctc

SEQ ID NO: 1365935 - DNA, 14 bp, Homo sapiens
cagactggggcatc

SEQ ID NO: 1365936 - DNA, 18 bp, Homo sapiens
cagagaaaaatgctcccc

SEQ ID NO: 1365937 - DNA, 20 bp, Homo sapiens
cagagacaaaatatttccca

SEQ ID NO: 1365938 - DNA, 20 bp, Homo sapiens
cagagacagatacctccaac

SEQ ID NO: 1365939 - DNA, 20 bp, Homo sapiens
cagagatgcaccaccaagcc

SEQ ID NO: 1365940 - DNA, 21 bp, Homo sapiens
cagagatgcaccaccaagcca

SEQ ID NO: 1365941 - DNA, 20 bp, Homo sapiens
cagagatttctcattgactt

SEQ ID NO: 1365942 - DNA, 20 bp, Homo sapiens
cagagcaagtgagaccctgt

SEQ ID NO: 1365943 - DNA, 18 bp, Homo sapiens
cagagccggcccgcctct

SEQ ID NO: 1365944 - DNA, 18 bp, Homo sapiens
cagagcgcgcccctagcc

SEQ ID NO: 1365945 - DNA, 19 bp, Homo sapiens
cagagcgcgcccctagccg

SEQ ID NO: 1365946 - DNA, 13 bp, Homo sapiens
cagaggaaggaga

SEQ ID NO: 1365947 - DNA, 17 bp, Homo sapiens
cagaggaatcctggcag

SEQ ID NO: 1365948 - DNA, 19 bp, Homo sapiens
cagaggaatcctggcagcc

SEQ ID NO: 1365949 - DNA, 22 bp, Homo sapiens
cagaggaatcctggcagcccag

SEQ ID NO: 1365950 - DNA, 20 bp, Homo sapiens
cagaggccagaggcccccag

SEQ ID NO: 1365951 - DNA, 22 bp, Homo sapiens
cagaggcccccagcccagggct

SEQ ID NO: 1365952 - DNA, 15 bp, Homo sapiens
cagaggtaccctggg

SEQ ID NO: 1365953 - DNA, 23 bp, Homo sapiens
cagaggtattaaaactaaatttc

SEQ ID NO: 1365954 - DNA, 17 bp, Homo sapiens
cagagtcagccaggacc

SEQ ID NO: 1365955 - DNA, 17 bp, Homo sapiens
cagagttttcattaaat

SEQ ID NO: 1365956 - DNA, 22 bp, Homo sapiens
cagagttttcattaaatccttt

SEQ ID NO: 1365957 - DNA, 19 bp, Homo sapiens
cagataccttatcttacaa

SEQ ID NO: 1365958 - DNA, 22 bp, Homo sapiens
cagataccttatcttacaatat

SEQ ID NO: 1365959 - DNA, 20 bp, Homo sapiens
cagatctttcagaaatataa

SEQ ID NO: 1365960 - DNA, 15 bp, Homo sapiens
cagatgaatgtattt

SEQ ID NO: 1365961 - DNA, 23 bp, Homo sapiens
cagatgaatgtatttatttggga

SEQ ID NO: 1365962 - DNA, 13 bp, Homo sapiens
cagatgcgtccca

SEQ ID NO: 1365963 - DNA, 22 bp, Homo sapiens
cagatgcgtcccaagatgttga

SEQ ID NO: 1365964 - DNA, 18 bp, Homo sapiens
cagatggaaaaactgagg

SEQ ID NO: 1365965 - DNA, 16 bp, Homo sapiens
cagatggtcatccaga

SEQ ID NO: 1365966 - DNA, 12 bp, Homo sapiens
cagatgtggcta

SEQ ID NO: 1365967 - DNA, 20 bp, Homo sapiens
cagatgtggctactgacata

SEQ ID NO: 1365968 - DNA, 14 bp, Homo sapiens
cagatgtttaaaac

SEQ ID NO: 1365969 - DNA, 16 bp, Homo sapiens
cagatgtttaaaacac

SEQ ID NO: 1365970 - DNA, 17 bp, Homo sapiens
cagatgtttaaaacacc

SEQ ID NO: 1365971 - DNA, 14 bp, Homo sapiens
cagatgtttccaga

SEQ ID NO: 1365972 - DNA, 17 bp, Homo sapiens
cagatttctgaggaaat

SEQ ID NO: 1365973 - DNA, 18 bp, Homo sapiens
cagcaaaagatgcttctc

SEQ ID NO: 1365974 - DNA, 22 bp, Homo sapiens
cagcaaatgcaaaaactctttg

SEQ ID NO: 1365975 - DNA, 15 bp, Homo sapiens
caggccacctcccca

SEQ ID NO: 1365976 - DNA, 14 bp, Homo sapiens
caggccctcctctc

SEQ ID NO: 1365977 - DNA, 18 bp, Homo sapiens
caggccctggcctcccct

SEQ ID NO: 1365978 - DNA, 18 bp, Homo sapiens
caggccgcgccctttccc

SEQ ID NO: 1365979 - DNA, 17 bp, Homo sapiens
caggccggcagccccag

SEQ ID NO: 1365980 - DNA, 16 bp, Homo sapiens
caggcctatttcatca

SEQ ID NO: 1365981 - DNA, 13 bp, Homo sapiens
caggcctctccat

SEQ ID NO: 1365982 - DNA, 13 bp, Homo sapiens
caggcctgcctcc

SEQ ID NO: 1365983 - DNA, 15 bp, Homo sapiens
caggcctgcctccca

SEQ ID NO: 1365984 - DNA, 16 bp, Homo sapiens
caggcctgcctcccac

SEQ ID NO: 1365985 - DNA, 17 bp, Homo sapiens
caggctatgtataaaat

SEQ ID NO: 1365986 - DNA, 15 bp, Homo sapiens
caggctcactcacag

SEQ ID NO: 1365987 - DNA, 20 bp, Homo sapiens
caggctcactcacagagtca

SEQ ID NO: 1365988 - DNA, 13 bp, Homo sapiens
caggctcactgcc

SEQ ID NO: 1365989 - DNA, 15 bp, Homo sapiens
caggctcactgccag

SEQ ID NO: 1365990 - DNA, 20 bp, Homo sapiens
caggctcactgccaggccag

SEQ ID NO: 1365991 - DNA, 23 bp, Homo sapiens
caggctcccaggagcctgcccag

SEQ ID NO: 1365992 - DNA, 15 bp, Homo sapiens
caggctcctgtgata

SEQ ID NO: 1365993 - DNA, 21 bp, Homo sapiens
caggctcgtggactgagtggg

SEQ ID NO: 1365994 - DNA, 16 bp, Homo sapiens
caggctgcctcccttg

SEQ ID NO: 1365995 - DNA, 16 bp, Homo sapiens
caggctggccagtcca

SEQ ID NO: 1365996 - DNA, 19 bp, Homo sapiens
caggctggccagtccaggc

SEQ ID NO: 1365997 - DNA, 21 bp, Homo sapiens
caggctggccagtccaggctg

SEQ ID NO: 1365998 - DNA, 11 bp, Homo sapiens
caggctgggcc

SEQ ID NO: 1365999 - DNA, 12 bp, Homo sapiens
caggctgggcca

SEQ ID NO: 1366000 - DNA, 20 bp, Homo sapiens
caggctgggccatgtccaaa

SEQ ID NO: 1366001 - DNA, 15 bp, Homo sapiens
cagggaagccccaca

SEQ ID NO: 1366002 - DNA, 15 bp, Homo sapiens
cagggacacacagcc

SEQ ID NO: 1366003 - DNA, 22 bp, Homo sapiens
cagggagactgggtaggaaaga

SEQ ID NO: 1366004 - DNA, 15 bp, Homo sapiens
cagggagctgggccc

SEQ ID NO: 1366005 - DNA, 16 bp, Homo sapiens
cagggagctgggcccg

SEQ ID NO: 1366006 - DNA, 19 bp, Homo sapiens
cagggagctgggcccgaca

SEQ ID NO: 1366007 - DNA, 14 bp, Homo sapiens
cagggaggcagccg

SEQ ID NO: 1366008 - DNA, 16 bp, Homo sapiens
cagggaggcagccgcc

SEQ ID NO: 1366009 - DNA, 16 bp, Homo sapiens
cagggagggcttctgc

SEQ ID NO: 1366010 - DNA, 22 bp, Homo sapiens
cagggcaagctccgcaggactt

SEQ ID NO: 1366011 - DNA, 21 bp, Homo sapiens
cagggcagcctcccccggctc

SEQ ID NO: 1366012 - DNA, 22 bp, Homo sapiens
cagggccatggctcagggtggt

SEQ ID NO: 1366013 - DNA, 14 bp, Homo sapiens
cagggctcccaggg

SEQ ID NO: 1366014 - DNA, 12 bp, Homo sapiens
cagggctcctgc

SEQ ID NO: 1366015 - DNA, 18 bp, Homo sapiens
cagggctggctcctgatc

SEQ ID NO: 1366016 - DNA, 17 bp, Homo sapiens
caggggaaaatcagcct

SEQ ID NO: 1366017 - DNA, 19 bp, Homo sapiens
caggggaaaatcagcctgc

SEQ ID NO: 1366018 - DNA, 23 bp, Homo sapiens
caggggcctggagatcctcctgc

SEQ ID NO: 1366019 - DNA, 18 bp, Homo sapiens
caggggctgcttcctcct

SEQ ID NO: 1366020 - DNA, 19 bp, Homo sapiens
caggggctgcttcctcctg

SEQ ID NO: 1366021 - DNA, 17 bp, Homo sapiens
caggggtctccctggct

SEQ ID NO: 1366022 - DNA, 20 bp, Homo sapiens
caggggtctccctggctccc

SEQ ID NO: 1366023 - DNA, 15 bp, Homo sapiens
cagggtccctctgtg

SEQ ID NO: 1366024 - DNA, 13 bp, Homo sapiens
cagggtgggcctc

SEQ ID NO: 1366025 - DNA, 23 bp, Homo sapiens
cagggtgggcctcggcccctccc

SEQ ID NO: 1366026 - DNA, 23 bp, Homo sapiens
cagggttctcttagcaactcaga

SEQ ID NO: 1366027 - DNA, 17 bp, Homo sapiens
caggtaccagctgcgct

SEQ ID NO: 1366028 - DNA, 19 bp, Homo sapiens
caggtaccagctgcgcttg

SEQ ID NO: 1366029 - DNA, 21 bp, Homo sapiens
caggtaccagctgcgcttgct

SEQ ID NO: 1366030 - DNA, 18 bp, Homo sapiens
caggtagttgcaattgaa

SEQ ID NO: 1366031 - DNA, 17 bp, Homo sapiens
caggtccagctctggag

SEQ ID NO: 1366032 - DNA, 19 bp, Homo sapiens
caggtccagctctggaggg

SEQ ID NO: 1366033 - DNA, 13 bp, Homo sapiens
caggtgagaaact

SEQ ID NO: 1366034 - DNA, 23 bp, Homo sapiens
caggtgatctgctgcagagcagt

SEQ ID NO: 1366035 - DNA, 20 bp, Homo sapiens
caggtgattggaccaggcca

SEQ ID NO: 1366036 - DNA, 13 bp, Homo sapiens
caggtgcagaggt

SEQ ID NO: 1366037 - DNA, 15 bp, Homo sapiens
caggtgctggagcac

SEQ ID NO: 1366038 - DNA, 18 bp, Homo sapiens
caggtgctggagcactgg

SEQ ID NO: 1366039 - DNA, 19 bp, Homo sapiens
caggtgctggagcactggg

SEQ ID NO: 1366040 - DNA, 16 bp, Homo sapiens
caggtgggccctctga

SEQ ID NO: 1366041 - DNA, 16 bp, Homo sapiens
caggttcagtattatg

SEQ ID NO: 1366042 - DNA, 19 bp, Homo sapiens
cagtaagatcactgtttag

SEQ ID NO: 1366043 - DNA, 21 bp, Homo sapiens
cagtaagatcactgtttagat

SEQ ID NO: 1366044 - DNA, 15 bp, Homo sapiens
cagtaagttatcttt

SEQ ID NO: 1366045 - DNA, 21 bp, Homo sapiens
cagtacttttttaaatatttt

SEQ ID NO: 1366046 - DNA, 23 bp, Homo sapiens
cagtacttttttaaatattttct

SEQ ID NO: 1366047 - DNA, 12 bp, Homo sapiens
cagtagaactgt

SEQ ID NO: 1366048 - DNA, 14 bp, Homo sapiens
cagtagaactgtct

SEQ ID NO: 1366049 - DNA, 18 bp, Homo sapiens
cagtagattttccaaatg

SEQ ID NO: 1366050 - DNA, 20 bp, Homo sapiens
cagtataaccagctgaagtt

SEQ ID NO: 1366051 - DNA, 15 bp, Homo sapiens
cagtatcccacatcc

SEQ ID NO: 1366052 - DNA, 14 bp, Homo sapiens
cagtcactggaggt

SEQ ID NO: 1366053 - DNA, 14 bp, Homo sapiens
cagtccaaaatact

SEQ ID NO: 1366054 - DNA, 17 bp, Homo sapiens
cagtccaccctgcctgc

SEQ ID NO: 1366055 - DNA, 18 bp, Homo sapiens
cagtccaccctgcctgcc

SEQ ID NO: 1366056 - DNA, 18 bp, Homo sapiens
cagtccaggctgccgtgg

SEQ ID NO: 1366057 - DNA, 17 bp, Homo sapiens
cagtcgtgcctgtgtcc

SEQ ID NO: 1366058 - DNA, 17 bp, Homo sapiens
cagtctccggcctctcc

SEQ ID NO: 1366059 - DNA, 15 bp, Homo sapiens
cagtctgtggatcag

SEQ ID NO: 1366060 - DNA, 21 bp, Homo sapiens
cagtgaatttgcactgtttaa

SEQ ID NO: 1366061 - DNA, 24 bp, Homo sapiens
cagtgagccgagattgcaccactg

SEQ ID NO: 1366062 - DNA, 12 bp, Homo sapiens
cagtgcagaatg

SEQ ID NO: 1366063 - DNA, 20 bp, Homo sapiens
cagtgcagagccttctcaga

SEQ ID NO: 1366064 - DNA, 15 bp, Homo sapiens
cagtgcatggtggcc

SEQ ID NO: 1366065 - DNA, 18 bp, Homo sapiens
cagtgcatggtggccaga

SEQ ID NO: 1366066 - DNA, 15 bp, Homo sapiens
cagtgccgagaagga

SEQ ID NO: 1366067 - DNA, 20 bp, Homo sapiens
cagtgcttttaagtgaaaat

SEQ ID NO: 1366068 - DNA, 11 bp, Homo sapiens
cagtggcctta

SEQ ID NO: 1366069 - DNA, 16 bp, Homo sapiens
cagtggtaagaatagt

SEQ ID NO: 1366070 - DNA, 16 bp, Homo sapiens
cagtgtgtaaacaaaa

SEQ ID NO: 1366071 - DNA, 18 bp, Homo sapiens
cagtgttttgcaagtgct

SEQ ID NO: 1366072 - DNA, 21 bp, Homo sapiens
cagtgttttgcaagtgctgga

SEQ ID NO: 1366073 - DNA, 15 bp, Homo sapiens
cagttataagaagaa

SEQ ID NO: 1366074 - DNA, 18 bp, Homo sapiens
cagttattacatgtaatt

SEQ ID NO: 1366075 - DNA, 16 bp, Homo sapiens
cagttcatcgattttc

SEQ ID NO: 1366076 - DNA, 19 bp, Homo sapiens
cagttcatcgattttctat

SEQ ID NO: 1366077 - DNA, 17 bp, Homo sapiens
cagttctactcaggctg

SEQ ID NO: 1366078 - DNA, 16 bp, Homo sapiens
cagttgctctatgctt

SEQ ID NO: 1366079 - DNA, 23 bp, Homo sapiens
cagttgctggtaaaatgaagaat

SEQ ID NO: 1366080 - DNA, 14 bp, Homo sapiens
cagttgtatttaac

SEQ ID NO: 1366081 - DNA, 18 bp, Homo sapiens
cagtttataccctagtta

SEQ ID NO: 1366082 - DNA, 13 bp, Homo sapiens
cagtttatcattc

SEQ ID NO: 1366083 - DNA, 16 bp, Homo sapiens
cagtttgagacaggag

SEQ ID NO: 1366084 - DNA, 14 bp, Homo sapiens
cagttttcagaaaa

SEQ ID NO: 1366085 - DNA, 15 bp, Homo sapiens
cagttttcatagtat

SEQ ID NO: 1366086 - DNA, 22 bp, Homo sapiens
cataaaatgtccagtaagatca

SEQ ID NO: 1366087 - DNA, 17 bp, Homo sapiens
cataaattatttgatta

SEQ ID NO: 1366088 - DNA, 19 bp, Homo sapiens
cataaattcaactttgtaa

SEQ ID NO: 1366089 - DNA, 12 bp, Homo sapiens
cataaatttttt

SEQ ID NO: 1366090 - DNA, 16 bp, Homo sapiens
cataatactgaaccac

SEQ ID NO: 1366091 - DNA, 18 bp, Homo sapiens
cataatactgaaccactt

SEQ ID NO: 1366092 - DNA, 14 bp, Homo sapiens
cataatttaaaaat

SEQ ID NO: 1366093 - DNA, 22 bp, Homo sapiens
catacaaatgcatctttgatgt

SEQ ID NO: 1366094 - DNA, 21 bp, Homo sapiens
catgtccagcaccttgtgcct

SEQ ID NO: 1366095 - DNA, 15 bp, Homo sapiens
catgtcttttaaaat

SEQ ID NO: 1366096 - DNA, 14 bp, Homo sapiens
catgtgagctcttc

SEQ ID NO: 1366097 - DNA, 16 bp, Homo sapiens
catgtgatacattttt

SEQ ID NO: 1366098 - DNA, 22 bp, Homo sapiens
catgtgatacattttttaagct

SEQ ID NO: 1366099 - DNA, 22 bp, Homo sapiens
catgtgatggacactccaggga

SEQ ID NO: 1366100 - DNA, 17 bp, Homo sapiens
catgtgcatagtttctt

SEQ ID NO: 1366101 - DNA, 13 bp, Homo sapiens
catgtggctggaa

SEQ ID NO: 1366102 - DNA, 14 bp, Homo sapiens
catgtggtttgaaa

SEQ ID NO: 1366103 - DNA, 12 bp, Homo sapiens
catgtttataaa

SEQ ID NO: 1366104 - DNA, 23 bp, Homo sapiens
catgtttataaatcttatgctct

SEQ ID NO: 1366105 - DNA, 13 bp, Homo sapiens
catgtttcctcta

SEQ ID NO: 1366106 - DNA, 14 bp, Homo sapiens
catgtttgcctaga

SEQ ID NO: 1366107 - DNA, 15 bp, Homo sapiens
catgttttgtttacg

SEQ ID NO: 1366108 - DNA, 13 bp, Homo sapiens
cattaaacttttt

SEQ ID NO: 1366109 - DNA, 14 bp, Homo sapiens
cattaaactttttt

SEQ ID NO: 1366110 - DNA, 15 bp, Homo sapiens
cattaatactcttta

SEQ ID NO: 1366111 - DNA, 19 bp, Homo sapiens
cattagagaacatcctggc

SEQ ID NO: 1366112 - DNA, 23 bp, Homo sapiens
cattatgccacttccttttaact

SEQ ID NO: 1366113 - DNA, 22 bp, Homo sapiens
cattattctctgctatatataa

SEQ ID NO: 1366114 - DNA, 23 bp, Homo sapiens
cattatttatatggggaatatat

SEQ ID NO: 1366115 - DNA, 14 bp, Homo sapiens
cattcaaatttgtc

SEQ ID NO: 1366116 - DNA, 17 bp, Homo sapiens
cattcaagtgtaaaata

SEQ ID NO: 1366117 - DNA, 18 bp, Homo sapiens
cattcaagtgtaaaatat

SEQ ID NO: 1366118 - DNA, 22 bp, Homo sapiens
cattcaagtgtaaaatattttg

SEQ ID NO: 1366119 - DNA, 23 bp, Homo sapiens
cattcaagtgtaaaatattttga

SEQ ID NO: 1366120 - DNA, 15 bp, Homo sapiens
cattcagaaatgttg

SEQ ID NO: 1366121 - DNA, 20 bp, Homo sapiens
cattcagaaatgttgagtct

SEQ ID NO: 1366122 - DNA, 13 bp, Homo sapiens
cattcagagtcag

SEQ ID NO: 1366123 - DNA, 20 bp, Homo sapiens
cattcagcagcaaattttca

SEQ ID NO: 1366124 - DNA, 16 bp, Homo sapiens
cattcatttttatagc

SEQ ID NO: 1366125 - DNA, 19 bp, Homo sapiens
cattccagcccctctggtc

SEQ ID NO: 1366126 - DNA, 18 bp, Homo sapiens
cattccaggcagcctctg

SEQ ID NO: 1366127 - DNA, 19 bp, Homo sapiens
cattcgtacataatactga

SEQ ID NO: 1366128 - DNA, 13 bp, Homo sapiens
cattctcttttaa

SEQ ID NO: 1366129 - DNA, 19 bp, Homo sapiens
cattctgactcggtttctc

SEQ ID NO: 1366130 - DNA, 22 bp, Homo sapiens
cattctgccgccccctcctgaa

SEQ ID NO: 1366131 - DNA, 21 bp, Homo sapiens
cattctggtcaagggctgtca

SEQ ID NO: 1366132 - DNA, 23 bp, Homo sapiens
cattctggtcaagggctgtcatt

SEQ ID NO: 1366133 - DNA, 12 bp, Homo sapiens
cattcttggctt

SEQ ID NO: 1366134 - DNA, 19 bp, Homo sapiens
cattgaagtaatgaatttt

SEQ ID NO: 1366135 - DNA, 18 bp, Homo sapiens
cattgagaccgtgaagat

SEQ ID NO: 1366136 - DNA, 14 bp, Homo sapiens
cattgagctgtgca

SEQ ID NO: 1366137 - DNA, 9 bp, Homo sapiens
cattgagta

SEQ ID NO: 1366138 - DNA, 10 bp, Homo sapiens
cattgagtat

SEQ ID NO: 1366139 - DNA, 22 bp, Homo sapiens
cattgagtattgtttaaaatgt

SEQ ID NO: 1366140 - DNA, 21 bp, Homo sapiens
cattgctgagcctctgctccc

SEQ ID NO: 1366141 - DNA, 21 bp, Homo sapiens
cattgtaagcgtatggcttta

SEQ ID NO: 1366142 - DNA, 19 bp, Homo sapiens
cattgtctcctatatattt

SEQ ID NO: 1366143 - DNA, 21 bp, Homo sapiens
cattgtctcctatatatttct

SEQ ID NO: 1366144 - DNA, 12 bp, Homo sapiens
catttaaaaaaa

SEQ ID NO: 1366145 - DNA, 15 bp, Homo sapiens
catttaaaaaaaatc

SEQ ID NO: 1366146 - DNA, 16 bp, Homo sapiens
catttaagggaaaaat

SEQ ID NO: 1366147 - DNA, 22 bp, Homo sapiens
catttaagggaaaaatatatat

SEQ ID NO: 1366148 - DNA, 21 bp, Homo sapiens
catttagctggccacatggcg

SEQ ID NO: 1366149 - DNA, 15 bp, Homo sapiens
catttagtaagaata

SEQ ID NO: 1366150 - DNA, 17 bp, Homo sapiens
catttatttatccagaa

SEQ ID NO: 1366151 - DNA, 22 bp, Homo sapiens
catttattttttttaaagaaaa

SEQ ID NO: 1366152 - DNA, 14 bp, Homo sapiens
catttccattgctt

SEQ ID NO: 1366153 - DNA, 15 bp, Homo sapiens
catttccattgctta

SEQ ID NO: 1366154 - DNA, 16 bp, Homo sapiens
catttccattgcttat

SEQ ID NO: 1366155 - DNA, 15 bp, Homo sapiens
catttcccatctgca

SEQ ID NO: 1366156 - DNA, 22 bp, Homo sapiens
catttgatgcatgtcttttaaa

SEQ ID NO: 1366157 - DNA, 16 bp, Homo sapiens
catttgcaataacagc

SEQ ID NO: 1366158 - DNA, 19 bp, Homo sapiens
catttgcaataacagctgc

SEQ ID NO: 1366159 - DNA, 21 bp, Homo sapiens
catttgcaataacagctgcaa

SEQ ID NO: 1366160 - DNA, 12 bp, Homo sapiens
catttgctcttc

SEQ ID NO: 1366161 - DNA, 22 bp, Homo sapiens
catttgctcttcagatgccact

SEQ ID NO: 1366162 - DNA, 16 bp, Homo sapiens
catttgtgctagaaat

SEQ ID NO: 1366163 - DNA, 22 bp, Homo sapiens
catttgttaaaattatcaatat

SEQ ID NO: 1366164 - DNA, 20 bp, Homo sapiens
catttgtttacatttgatgc

SEQ ID NO: 1366165 - DNA, 22 bp, Homo sapiens
cattttaaggaaaactacctgt

SEQ ID NO: 1366166 - DNA, 17 bp, Homo sapiens
cattttcttttttaacc

SEQ ID NO: 1366167 - DNA, 12 bp, Homo sapiens
catttttatagc

SEQ ID NO: 1366168 - DNA, 12 bp, Homo sapiens
catttttgtaaa

SEQ ID NO: 1366169 - DNA, 21 bp, Homo sapiens
cattttttaatttacttgttt

SEQ ID NO: 1366170 - DNA, 11 bp, Homo sapiens
ccaaaaacaaa

SEQ ID NO: 1366171 - DNA, 16 bp, Homo sapiens
ccaaaatctcaagaaa

SEQ ID NO: 1366172 - DNA, 14 bp, Homo sapiens
ccaaaattaaggtg

SEQ ID NO: 1366173 - DNA, 15 bp, Homo sapiens
ccaaaattaaggtgt

SEQ ID NO: 1366174 - DNA, 13 bp, Homo sapiens
ccaaaccggcagg

SEQ ID NO: 1366175 - DNA, 18 bp, Homo sapiens
ccaaaccggcaggtgcga

SEQ ID NO: 1366176 - DNA, 14 bp, Homo sapiens
ccaaagaggctgcc

SEQ ID NO: 1366177 - DNA, 23 bp, Homo sapiens
ccaaagaggctgcccctctcacc

SEQ ID NO: 1366178 - DNA, 15 bp, Homo sapiens
ccaaagagtgatagt

SEQ ID NO: 1366179 - DNA, 17 bp, Homo sapiens
ccaaagcctcctccagc

SEQ ID NO: 1366180 - DNA, 22 bp, Homo sapiens
ccaaagcctcctccagccgcca

SEQ ID NO: 1366181 - DNA, 18 bp, Homo sapiens
ccaaagctgcccactgtt

SEQ ID NO: 1366182 - DNA, 21 bp, Homo sapiens
ccaaagctgcccactgtttct

SEQ ID NO: 1366183 - DNA, 12 bp, Homo sapiens
ccaaataaataa

SEQ ID NO: 1366184 - DNA, 19 bp, Homo sapiens
ccaaatggagaagctgcag

SEQ ID NO: 1366185 - DNA, 20 bp, Homo sapiens
ccaaatggagaagctgcagg

SEQ ID NO: 1366186 - DNA, 21 bp, Homo sapiens
ccaacaagattgcttaataaa

SEQ ID NO: 1366187 - DNA, 14 bp, Homo sapiens
ccaacaagcagctg

SEQ ID NO: 1366188 - DNA, 13 bp, Homo sapiens
ccaacacttccag

SEQ ID NO: 1366189 - DNA, 19 bp, Homo sapiens
ccaaccctatctcctgaca

SEQ ID NO: 1366190 - DNA, 23 bp, Homo sapiens
ccaaccctatctcctgacagaag

SEQ ID NO: 1366191 - DNA, 13 bp, Homo sapiens
ccaaccctgccgt

SEQ ID NO: 1366192 - DNA, 14 bp, Homo sapiens
ccaacctcagggct

SEQ ID NO: 1366193 - DNA, 18 bp, Homo sapiens
ccaacctttccctcaccc

SEQ ID NO: 1366194 - DNA, 20 bp, Homo sapiens
ccaacctttccctcaccccc

SEQ ID NO: 1366195 - DNA, 23 bp, Homo sapiens
ccaacctttccctcaccccctcc

SEQ ID NO: 1366196 - DNA, 22 bp, Homo sapiens
ccaagaatattgcaaaatacat

SEQ ID NO: 1366197 - DNA, 23 bp, Homo sapiens
ccaagaatattgcaaaatacatg

SEQ ID NO: 1366198 - DNA, 11 bp, Homo sapiens
ccaagaatgta

SEQ ID NO: 1366199 - DNA, 17 bp, Homo sapiens
ccaagaatgtacgtcca

SEQ ID NO: 1366200 - DNA, 18 bp, Homo sapiens
ccaagaatgtacgtccag

SEQ ID NO: 1366201 - DNA, 22 bp, Homo sapiens
ccaagatatttttatcccaaga

SEQ ID NO: 1366202 - DNA, 22 bp, Homo sapiens
ccaagattttcctcttgtgatt

SEQ ID NO: 1366203 - DNA, 13 bp, Homo sapiens
ccaagcatcttgg

SEQ ID NO: 1366204 - DNA, 23 bp, Homo sapiens
ccaagcatcttgggggggtggcc

SEQ ID NO: 1366205 - DNA, 20 bp, Homo sapiens
ccaagccaagggaacctgtg

SEQ ID NO: 1366206 - DNA, 16 bp, Homo sapiens
ccaagccagaggctgg

SEQ ID NO: 1366207 - DNA, 17 bp, Homo sapiens
ccaagccagaggctggg

SEQ ID NO: 1366208 - DNA, 13 bp, Homo sapiens
ccaagctccaagc

SEQ ID NO: 1366209 - DNA, 15 bp, Homo sapiens
ccaagctccaagccc

SEQ ID NO: 1366210 - DNA, 13 bp, Homo sapiens
ccaaggccaggtt

SEQ ID NO: 1366211 - DNA, 14 bp, Homo sapiens
ccaaggctggggga

SEQ ID NO: 1366212 - DNA, 18 bp, Homo sapiens
ccatttgcaataacagct

SEQ ID NO: 1366213 - DNA, 19 bp, Homo sapiens
ccatttgcaataacagctg

SEQ ID NO: 1366214 - DNA, 21 bp, Homo sapiens
ccatttgcaataacagctgca

SEQ ID NO: 1366215 - DNA, 15 bp, Homo sapiens
ccatttgtgccagag

SEQ ID NO: 1366216 - DNA, 18 bp, Homo sapiens
ccatttgtgccagaggaa

SEQ ID NO: 1366217 - DNA, 21 bp, Homo sapiens
ccattttaattttaaagtgca

SEQ ID NO: 1366218 - DNA, 17 bp, Homo sapiens
cccaaagatagacaggt

SEQ ID NO: 1366219 - DNA, 13 bp, Homo sapiens
cccaaagctgagc

SEQ ID NO: 1366220 - DNA, 20 bp, Homo sapiens
cccaaccaggcacctcttcc

SEQ ID NO: 1366221 - DNA, 22 bp, Homo sapiens
cccaacctcagggctcccaggg

SEQ ID NO: 1366222 - DNA, 17 bp, Homo sapiens
cccaacctttccctcac

SEQ ID NO: 1366223 - DNA, 20 bp, Homo sapiens
cccaagaatgcaagatttca

SEQ ID NO: 1366224 - DNA, 14 bp, Homo sapiens
cccaagagaactcg

SEQ ID NO: 1366225 - DNA, 14 bp, Homo sapiens
cccaagcttagaac

SEQ ID NO: 1366226 - DNA, 23 bp, Homo sapiens
cccacagacaaaagcgcttttcc

SEQ ID NO: 1366227 - DNA, 18 bp, Homo sapiens
cccacagcgtccctggcg

SEQ ID NO: 1366228 - DNA, 18 bp, Homo sapiens
cccacatccaactccagc

SEQ ID NO: 1366229 - DNA, 13 bp, Homo sapiens
cccacccccagcc

SEQ ID NO: 1366230 - DNA, 17 bp, Homo sapiens
cccaccccggggaccct

SEQ ID NO: 1366231 - DNA, 20 bp, Homo sapiens
cccaccccggggaccctgtg

SEQ ID NO: 1366232 - DNA, 13 bp, Homo sapiens
cccacccggtggg

SEQ ID NO: 1366233 - DNA, 18 bp, Homo sapiens
cccaccctgaaagccctg

SEQ ID NO: 1366234 - DNA, 17 bp, Homo sapiens
cccacgagaccccggct

SEQ ID NO: 1366235 - DNA, 17 bp, Homo sapiens
cccactgccagcagcag

SEQ ID NO: 1366236 - DNA, 22 bp, Homo sapiens
cccactgtttctcttgagctgg

SEQ ID NO: 1366237 - DNA, 17 bp, Homo sapiens
cccacttcccaccctgc

SEQ ID NO: 1366238 - DNA, 21 bp, Homo sapiens
cccactttgctgttccttact

SEQ ID NO: 1366239 - DNA, 22 bp, Homo sapiens
cccagcaagtggtcctagaggc

SEQ ID NO: 1366240 - DNA, 18 bp, Homo sapiens
cccagcacctcagcctgc

SEQ ID NO: 1366241 - DNA, 15 bp, Homo sapiens
cccagcactttggga

SEQ ID NO: 1366242 - DNA, 18 bp, Homo sapiens
cccagcactttgggaggc

SEQ ID NO: 1366243 - DNA, 20 bp, Homo sapiens
cccagcattccagcccctct

SEQ ID NO: 1366244 - DNA, 22 bp, Homo sapiens
cccagcattccagcccctctgg

SEQ ID NO: 1366245 - DNA, 15 bp, Homo sapiens
cccagccatgccagc

SEQ ID NO: 1366246 - DNA, 18 bp, Homo sapiens
cccagccccgactccagc

SEQ ID NO: 1366247 - DNA, 21 bp, Homo sapiens
cccagccccgactccagccag

SEQ ID NO: 1366248 - DNA, 12 bp, Homo sapiens
cccagccctgct

SEQ ID NO: 1366249 - DNA, 14 bp, Homo sapiens
cccagccctgctgg

SEQ ID NO: 1366250 - DNA, 13 bp, Homo sapiens
cccagcctcagcg

SEQ ID NO: 1366251 - DNA, 14 bp, Homo sapiens
cccagcctcagcgc

SEQ ID NO: 1366252 - DNA, 22 bp, Homo sapiens
cccagcctcagcgcggccctcc

SEQ ID NO: 1366253 - DNA, 15 bp, Homo sapiens
cccagctacttggga

SEQ ID NO: 1366254 - DNA, 18 bp, Homo sapiens
cccagctacttgggaggc

SEQ ID NO: 1366255 - DNA, 23 bp, Homo sapiens
cccagctacttgggaggctgagg

SEQ ID NO: 1366256 - DNA, 17 bp, Homo sapiens
cccaggaggcagggagg

SEQ ID NO: 1366257 - DNA, 22 bp, Homo sapiens
cccaggctcgtggactgagtgg

SEQ ID NO: 1366258 - DNA, 23 bp, Homo sapiens
cccagggccctcggtgggagcca

SEQ ID NO: 1366259 - DNA, 16 bp, Homo sapiens
cccaggggacaaggga

SEQ ID NO: 1366260 - DNA, 22 bp, Homo sapiens
cccagggggtctcacccatgca

SEQ ID NO: 1366261 - DNA, 16 bp, Homo sapiens
cccaggggtctccctg

SEQ ID NO: 1366262 - DNA, 14 bp, Homo sapiens
cccaggtaccagct

SEQ ID NO: 1366263 - DNA, 14 bp, Homo sapiens
cccaggtccagctc

SEQ ID NO: 1366264 - DNA, 18 bp, Homo sapiens
cccaggtccagctctgga

SEQ ID NO: 1366265 - DNA, 16 bp, Homo sapiens
cccagtagaccttgtt

SEQ ID NO: 1366266 - DNA, 10 bp, Homo sapiens
cccagtgcag

SEQ ID NO: 1366267 - DNA, 12 bp, Homo sapiens
cccagtgcagaa

SEQ ID NO: 1366268 - DNA, 12 bp, Homo sapiens
cccagtgcatgg

SEQ ID NO: 1366269 - DNA, 22 bp, Homo sapiens
cccagtgcatggtggccagagg

SEQ ID NO: 1366270 - DNA, 18 bp, Homo sapiens
cccagtgccgagaaggaa

SEQ ID NO: 1366271 - DNA, 15 bp, Homo sapiens
cccatagtccctgcc

SEQ ID NO: 1366272 - DNA, 17 bp, Homo sapiens
cccatcgccacaaactc

SEQ ID NO: 1366273 - DNA, 16 bp, Homo sapiens
cccatctcccctcagc

SEQ ID NO: 1366274 - DNA, 19 bp, Homo sapiens
cccatctctacaaaaagca

SEQ ID NO: 1366275 - DNA, 18 bp, Homo sapiens
cccatgacaatgttgtag

SEQ ID NO: 1366276 - DNA, 17 bp, Homo sapiens
cccatgcaagcagagga

SEQ ID NO: 1366277 - DNA, 18 bp, Homo sapiens
cccatgcaagcagaggac

SEQ ID NO: 1366278 - DNA, 13 bp, Homo sapiens
cccatggagccag

SEQ ID NO: 1366279 - DNA, 19 bp, Homo sapiens
cccatggagccagctccct

SEQ ID NO: 1366280 - DNA, 15 bp, Homo sapiens
cccatgtagccccct

SEQ ID NO: 1366281 - DNA, 21 bp, Homo sapiens
cccattaaggggaagaatgaa

SEQ ID NO: 1366282 - DNA, 20 bp, Homo sapiens
cccattccaggcagcctctg

SEQ ID NO: 1366283 - DNA, 16 bp, Homo sapiens
cccatttgtgccagag

SEQ ID NO: 1366284 - DNA, 15 bp, Homo sapiens
ccccaaatcaataca

SEQ ID NO: 1366285 - DNA, 19 bp, Homo sapiens
ccccaacatctccctccca

SEQ ID NO: 1366286 - DNA, 22 bp, Homo sapiens
ccccaacatctccctcccacat

SEQ ID NO: 1366287 - DNA, 20 bp, Homo sapiens
ccccaacctcagggctccca

SEQ ID NO: 1366288 - DNA, 15 bp, Homo sapiens
ccccaacctttccct

SEQ ID NO: 1366289 - DNA, 18 bp, Homo sapiens
ccccacagcgtccctggc

SEQ ID NO: 1366290 - DNA, 23 bp, Homo sapiens
ccccacccctgcccccagccccg

SEQ ID NO: 1366291 - DNA, 15 bp, Homo sapiens
ccccaccctgggccc

SEQ ID NO: 1366292 - DNA, 17 bp, Homo sapiens
ccccaccggtccagctg

SEQ ID NO: 1366293 - DNA, 21 bp, Homo sapiens
ccccaccggtccagctggcct

SEQ ID NO: 1366294 - DNA, 23 bp, Homo sapiens
ccccactcccttgctggccccag

SEQ ID NO: 1366295 - DNA, 17 bp, Homo sapiens
ccccactgccagcagca

SEQ ID NO: 1366296 - DNA, 15 bp, Homo sapiens
ccccacttgcctctt

SEQ ID NO: 1366297 - DNA, 22 bp, Homo sapiens
ccccagcaagtggtcctagagg

SEQ ID NO: 1366298 - DNA, 19 bp, Homo sapiens
ccccagccatgccagctgg

SEQ ID NO: 1366299 - DNA, 20 bp, Homo sapiens
ccccagccatgccagctggc

SEQ ID NO: 1366300 - DNA, 23 bp, Homo sapiens
ccccagccccgactccagccagc

SEQ ID NO: 1366301 - DNA, 13 bp, Homo sapiens
ccccagccctgct

SEQ ID NO: 1366302 - DNA, 20 bp, Homo sapiens
ccccagccctgctggggatc

SEQ ID NO: 1366303 - DNA, 11 bp, Homo sapiens
ccccagcctgc

SEQ ID NO: 1366304 - DNA, 12 bp, Homo sapiens
ccccagcctgct

SEQ ID NO: 1366305 - DNA, 20 bp, Homo sapiens
ccccagcctgctagctagct

SEQ ID NO: 1366306 - DNA, 18 bp, Homo sapiens
ccccaggctcgtggactg

SEQ ID NO: 1366307 - DNA, 22 bp, Homo sapiens
ccccaggtccagctctggaggg

SEQ ID NO: 1366308 - DNA, 18 bp, Homo sapiens
ccccagtccccacccctg

SEQ ID NO: 1366309 - DNA, 13 bp, Homo sapiens
ccccatctccctg

SEQ ID NO: 1366310 - DNA, 15 bp, Homo sapiens
ccccatgcttccttg

SEQ ID NO: 1366311 - DNA, 17 bp, Homo sapiens
ccccatttcccatctgc

SEQ ID NO: 1366312 - DNA, 22 bp, Homo sapiens
ccccatttcccatctgcacccc

SEQ ID NO: 1366313 - DNA, 15 bp, Homo sapiens
cccccaacctttccc

SEQ ID NO: 1366314 - DNA, 20 bp, Homo sapiens
cccccaccccggggaccctg

SEQ ID NO: 1366315 - DNA, 16 bp, Homo sapiens
cccccaccggtccagc

SEQ ID NO: 1366316 - DNA, 19 bp, Homo sapiens
cccccaccggtccagctgg

SEQ ID NO: 1366317 - DNA, 20 bp, Homo sapiens
cccccaccggtccagctggc

SEQ ID NO: 1366318 - DNA, 21 bp, Homo sapiens
cccccagccatgccagctggc

SEQ ID NO: 1366319 - DNA, 14 bp, Homo sapiens
cccccagcccaggg

SEQ ID NO: 1366320 - DNA, 24 bp, Homo sapiens
cccccagccccgactccagccagc

SEQ ID NO: 1366321 - DNA, 13 bp, Homo sapiens
cccccagccccgg

SEQ ID NO: 1366322 - DNA, 20 bp, Homo sapiens
cccccaggttccgaagaaga

SEQ ID NO: 1366323 - DNA, 22 bp, Homo sapiens
cccccagtccccacccctgccc

SEQ ID NO: 1366324 - DNA, 12 bp, Homo sapiens
ccccctgccctg

SEQ ID NO: 1366325 - DNA, 13 bp, Homo sapiens
ccccctgcttcag

SEQ ID NO: 1366326 - DNA, 19 bp, Homo sapiens
ccccctggcctctgtgcct

SEQ ID NO: 1366327 - DNA, 16 bp, Homo sapiens
cccccttaaatttaat

SEQ ID NO: 1366328 - DNA, 14 bp, Homo sapiens
ccccgactccagcc

SEQ ID NO: 1366329 - DNA, 16 bp, Homo sapiens
ccccgactccagccag

SEQ ID NO: 1366330 - DNA, 13 bp, Homo sapiens
ccccgcagccctg

SEQ ID NO: 1366331 - DNA, 22 bp, Homo sapiens
ccccgcgaccatgtggccacaa

SEQ ID NO: 1366332 - DNA, 13 bp, Homo sapiens
ccccgctgctgtg

SEQ ID NO: 1366333 - DNA, 17 bp, Homo sapiens
ccccggcttcctttccc

SEQ ID NO: 1366334 - DNA, 22 bp, Homo sapiens
ccccggggtgagtccattctcc

SEQ ID NO: 1366335 - DNA, 18 bp, Homo sapiens
ccccggtggcggccccag

SEQ ID NO: 1366336 - DNA, 14 bp, Homo sapiens
ccccgtttctggtg

SEQ ID NO: 1366337 - DNA, 21 bp, Homo sapiens
cccctcccacacccaaagctg

SEQ ID NO: 1366338 - DNA, 12 bp, Homo sapiens
cccctcccaccc

SEQ ID NO: 1366339 - DNA, 14 bp, Homo sapiens
cccctcccccagcc

SEQ ID NO: 1366340 - DNA, 16 bp, Homo sapiens
cccctccgccctgcca

SEQ ID NO: 1366341 - DNA, 17 bp, Homo sapiens
cccctccgccctgccac

SEQ ID NO: 1366342 - DNA, 19 bp, Homo sapiens
cccctccgccctgccactc

SEQ ID NO: 1366343 - DNA, 12 bp, Homo sapiens
cccctctggtcg

SEQ ID NO: 1366344 - DNA, 23 bp, Homo sapiens
cccctctggtcgctcctgcccac

SEQ ID NO: 1366345 - DNA, 12 bp, Homo sapiens
cccctgccacca

SEQ ID NO: 1366346 - DNA, 13 bp, Homo sapiens
cccctgccctgca

SEQ ID NO: 1366347 - DNA, 14 bp, Homo sapiens
cccctgccctgcac

SEQ ID NO: 1366348 - DNA, 12 bp, Homo sapiens
cccctggcctct

SEQ ID NO: 1366349 - DNA, 21 bp, Homo sapiens
cccctgggcttggcctgctgt

SEQ ID NO: 1366350 - DNA, 15 bp, Homo sapiens
cccctggtctttgag

SEQ ID NO: 1366351 - DNA, 22 bp, Homo sapiens
ccccttccagatcactgccaca

SEQ ID NO: 1366352 - DNA, 15 bp, Homo sapiens
ccccttctctcctcc

SEQ ID NO: 1366353 - DNA, 20 bp, Homo sapiens
ccccttgtttgtcccttcta

SEQ ID NO: 1366354 - DNA, 15 bp, Homo sapiens
cccgactccagccag

SEQ ID NO: 1366355 - DNA, 16 bp, Homo sapiens
cccgactccagccagc

SEQ ID NO: 1366356 - DNA, 12 bp, Homo sapiens
cccgcctggcca

SEQ ID NO: 1366357 - DNA, 14 bp, Homo sapiens
cccgcctggccagg

SEQ ID NO: 1366358 - DNA, 21 bp, Homo sapiens
cccgcctggccaggagcaggc

SEQ ID NO: 1366359 - DNA, 17 bp, Homo sapiens
cccgcgccacaggaccc

SEQ ID NO: 1366360 - DNA, 12 bp, Homo sapiens
cccgctgctgtg

SEQ ID NO: 1366361 - DNA, 16 bp, Homo sapiens
cccgctgctgtgcaac

SEQ ID NO: 1366362 - DNA, 20 bp, Homo sapiens
cccggcatgagactcagtgc

SEQ ID NO: 1366363 - DNA, 17 bp, Homo sapiens
cccggccgctccaccag

SEQ ID NO: 1366364 - DNA, 22 bp, Homo sapiens
cccggccggccacccaggaggc

SEQ ID NO: 1366365 - DNA, 18 bp, Homo sapiens
cccggctctacgggggcc

SEQ ID NO: 1366366 - DNA, 21 bp, Homo sapiens
cccggctgcagaggccagagg

SEQ ID NO: 1366367 - DNA, 20 bp, Homo sapiens
cccgggaacctccccagcct

SEQ ID NO: 1366368 - DNA, 22 bp, Homo sapiens
cccgggaacctccccagcctgc

SEQ ID NO: 1366369 - DNA, 14 bp, Homo sapiens
cccgggagcggagg

SEQ ID NO: 1366370 - DNA, 16 bp, Homo sapiens
cccggggaccctgtga

SEQ ID NO: 1366371 - DNA, 18 bp, Homo sapiens
cccggtggcggccccagc

SEQ ID NO: 1366372 - DNA, 13 bp, Homo sapiens
cccgtcctgcctg

SEQ ID NO: 1366373 - DNA, 14 bp, Homo sapiens
cccgtggggcaggg

SEQ ID NO: 1366374 - DNA, 18 bp, Homo sapiens
cccgttccaccccaagag

SEQ ID NO: 1366375 - DNA, 12 bp, Homo sapiens
cccgttttcccc

SEQ ID NO: 1366376 - DNA, 16 bp, Homo sapiens
cccgttttccccatga

SEQ ID NO: 1366377 - DNA, 18 bp, Homo sapiens
cccgttttccccatgaca

SEQ ID NO: 1366378 - DNA, 15 bp, Homo sapiens
ccctaatctatggtc

SEQ ID NO: 1366379 - DNA, 20 bp, Homo sapiens
ccctagccaatgtctcctcc

SEQ ID NO: 1366380 - DNA, 18 bp, Homo sapiens
ccctagccggttcctgtc

SEQ ID NO: 1366381 - DNA, 19 bp, Homo sapiens
ccctagctttagaccctgg

SEQ ID NO: 1366382 - DNA, 15 bp, Homo sapiens
ccctatctcctgaca

SEQ ID NO: 1366383 - DNA, 17 bp, Homo sapiens
ccctatctcctgacaga

SEQ ID NO: 1366384 - DNA, 18 bp, Homo sapiens
ccctcaccccctcccacc

SEQ ID NO: 1366385 - DNA, 13 bp, Homo sapiens
ccctccaccccag

SEQ ID NO: 1366386 - DNA, 15 bp, Homo sapiens
ccctccaccccagga

SEQ ID NO: 1366387 - DNA, 19 bp, Homo sapiens
ccctcccacacccaaagct

SEQ ID NO: 1366388 - DNA, 17 bp, Homo sapiens
ccctcccacccccagcc

SEQ ID NO: 1366389 - DNA, 15 bp, Homo sapiens
ccctcccactttgct

SEQ ID NO: 1366390 - DNA, 15 bp, Homo sapiens
ccctccgccctgcca

SEQ ID NO: 1366391 - DNA, 22 bp, Homo sapiens
ccctcctgaaccgcacagctca

SEQ ID NO: 1366392 - DNA, 21 bp, Homo sapiens
ccctctcctttgttcccggct

SEQ ID NO: 1366393 - DNA, 19 bp, Homo sapiens
ccctctggtcgctcctgcc

SEQ ID NO: 1366394 - DNA, 20 bp, Homo sapiens
ccctctgtgtatttgctttt

SEQ ID NO: 1366395 - DNA, 17 bp, Homo sapiens
ccctcttgcccatcctg

SEQ ID NO: 1366396 - DNA, 15 bp, Homo sapiens
ccctgaaagccctga

SEQ ID NO: 1366397 - DNA, 16 bp, Homo sapiens
ccctgaaagccctgag

SEQ ID NO: 1366398 - DNA, 16 bp, Homo sapiens
ccctgatcccattttc

SEQ ID NO: 1366399 - DNA, 18 bp, Homo sapiens
ccctgatcccattttcct

SEQ ID NO: 1366400 - DNA, 22 bp, Homo sapiens
ccctgatcccattttcctctga

SEQ ID NO: 1366401 - DNA, 14 bp, Homo sapiens
ccctgcacgtcatg

SEQ ID NO: 1366402 - DNA, 14 bp, Homo sapiens
ccctgccaccaggc

SEQ ID NO: 1366403 - DNA, 15 bp, Homo sapiens
ccctgccaccaggcc

SEQ ID NO: 1366404 - DNA, 18 bp, Homo sapiens
ccctgccactcactaggc

SEQ ID NO: 1366405 - DNA, 19 bp, Homo sapiens
ccctgccactcactaggcc

SEQ ID NO: 1366406 - DNA, 20 bp, Homo sapiens
ccctgccactcactaggccc

SEQ ID NO: 1366407 - DNA, 12 bp, Homo sapiens
ccctgccctgca

SEQ ID NO: 1366408 - DNA, 20 bp, Homo sapiens
ccctgccgtcaccaccaccc

SEQ ID NO: 1366409 - DNA, 22 bp, Homo sapiens
ccctgccgtcaccaccacccct

SEQ ID NO: 1366410 - DNA, 13 bp, Homo sapiens
ccctgcctggccc

SEQ ID NO: 1366411 - DNA, 21 bp, Homo sapiens
ccctgcctggcccccaacctc

SEQ ID NO: 1366412 - DNA, 16 bp, Homo sapiens
ccctgctgctggtgca

SEQ ID NO: 1366413 - DNA, 19 bp, Homo sapiens
ccctggcctcccctgccac

SEQ ID NO: 1366414 - DNA, 20 bp, Homo sapiens
ccctggcctcccctgccacc

SEQ ID NO: 1366415 - DNA, 15 bp, Homo sapiens
ccctggcctctgtgc

SEQ ID NO: 1366416 - DNA, 18 bp, Homo sapiens
ccctggctccctcctcca

SEQ ID NO: 1366417 - DNA, 22 bp, Homo sapiens
ccctggctgttctgtggttcct

SEQ ID NO: 1366418 - DNA, 13 bp, Homo sapiens
ccctgggccctgg

SEQ ID NO: 1366419 - DNA, 13 bp, Homo sapiens
ccctgggctggaa

SEQ ID NO: 1366420 - DNA, 19 bp, Homo sapiens
ccctgggcttggcctgctg

SEQ ID NO: 1366421 - DNA, 21 bp, Homo sapiens
ccctgggggcacaggaggcag

SEQ ID NO: 1366422 - DNA, 23 bp, Homo sapiens
ccctgggtgtccccgctgctgtg

SEQ ID NO: 1366423 - DNA, 22 bp, Homo sapiens
ccctggttattgatgtggccct

SEQ ID NO: 1366424 - DNA, 23 bp, Homo sapiens
ccctgtctcaaaaaaagaaaaag

SEQ ID NO: 1366425 - DNA, 18 bp, Homo sapiens
ccctgtgacatggtgcct

SEQ ID NO: 1366426 - DNA, 24 bp, Homo sapiens
ccctgtgacatggtgcctgagagg

SEQ ID NO: 1366427 - DNA, 22 bp, Homo sapiens
cccttcctgctgcgcagttctc

SEQ ID NO: 1366428 - DNA, 18 bp, Homo sapiens
cccttccttttccctgct

SEQ ID NO: 1366429 - DNA, 21 bp, Homo sapiens
cccttccttttccctgcttcc

SEQ ID NO: 1366430 - DNA, 15 bp, Homo sapiens
cccttgctggcccca

SEQ ID NO: 1366431 - DNA, 22 bp, Homo sapiens
cccttgcttgcctgcagggcca

SEQ ID NO: 1366432 - DNA, 23 bp, Homo sapiens
cccttgcttgcctgcagggccat

SEQ ID NO: 1366433 - DNA, 12 bp, Homo sapiens
ccctttgctgtc

SEQ ID NO: 1366434 - DNA, 20 bp, Homo sapiens
ccctttggtttttttcttct

SEQ ID NO: 1366435 - DNA, 15 bp, Homo sapiens
cccttttaaagttga

SEQ ID NO: 1366436 - DNA, 13 bp, Homo sapiens
cccttttccccta

SEQ ID NO: 1366437 - DNA, 13 bp, Homo sapiens
ccgacatggctcc

SEQ ID NO: 1366438 - DNA, 18 bp, Homo sapiens
ccgaccagaggagccttt

SEQ ID NO: 1366439 - DNA, 13 bp, Homo sapiens
ccgacgcccaccc

SEQ ID NO: 1366440 - DNA, 12 bp, Homo sapiens
ccgactccagcc

SEQ ID NO: 1366441 - DNA, 15 bp, Homo sapiens
ccgactccagccagc

SEQ ID NO: 1366442 - DNA, 16 bp, Homo sapiens
ccgactgctttggacc

SEQ ID NO: 1366443 - DNA, 17 bp, Homo sapiens
ccgagaaggaagcctcc

SEQ ID NO: 1366444 - DNA, 21 bp, Homo sapiens
ccgagaggtgggccagtctgt

SEQ ID NO: 1366445 - DNA, 19 bp, Homo sapiens
ccgagattgcaccactgca

SEQ ID NO: 1366446 - DNA, 19 bp, Homo sapiens
ccgagctttgaaaattcag

SEQ ID NO: 1366447 - DNA, 13 bp, Homo sapiens
ccgaggacccagg

SEQ ID NO: 1366448 - DNA, 21 bp, Homo sapiens
cctggggtgttagtggcaccg

SEQ ID NO: 1366449 - DNA, 12 bp, Homo sapiens
cctggtgctgct

SEQ ID NO: 1366450 - DNA, 18 bp, Homo sapiens
cctggttattgatgtggc

SEQ ID NO: 1366451 - DNA, 20 bp, Homo sapiens
cctgtacagtagattttcca

SEQ ID NO: 1366452 - DNA, 17 bp, Homo sapiens
cctgtagcacttactgg

SEQ ID NO: 1366453 - DNA, 14 bp, Homo sapiens
cctgtatacagtgc

SEQ ID NO: 1366454 - DNA, 18 bp, Homo sapiens
cctgtatacagtgcagag

SEQ ID NO: 1366455 - DNA, 20 bp, Homo sapiens
cctgtatatttgtaaagcta

SEQ ID NO: 1366456 - DNA, 20 bp, Homo sapiens
cctgtatttaaaaatagaaa

SEQ ID NO: 1366457 - DNA, 17 bp, Homo sapiens
cctgtgaatgccactgc

SEQ ID NO: 1366458 - DNA, 23 bp, Homo sapiens
cctgtgacatggtgcctgagagg

SEQ ID NO: 1366459 - DNA, 16 bp, Homo sapiens
cctgtgactgtctcac

SEQ ID NO: 1366460 - DNA, 22 bp, Homo sapiens
cctgtggccccaccctgggccc

SEQ ID NO: 1366461 - DNA, 21 bp, Homo sapiens
cctgtggcgccgtctccaggg

SEQ ID NO: 1366462 - DNA, 10 bp, Homo sapiens
cctgtgtgca

SEQ ID NO: 1366463 - DNA, 16 bp, Homo sapiens
cctgtgtgcaggttcc

SEQ ID NO: 1366464 - DNA, 13 bp, Homo sapiens
cctgtgttaattt

SEQ ID NO: 1366465 - DNA, 20 bp, Homo sapiens
ccttaagtgaggaaatcaaa

SEQ ID NO: 1366466 - DNA, 18 bp, Homo sapiens
ccttaatttcctttttga

SEQ ID NO: 1366467 - DNA, 22 bp, Homo sapiens
ccttactttactgcctgaataa

SEQ ID NO: 1366468 - DNA, 23 bp, Homo sapiens
ccttactttactgcctgaataaa

SEQ ID NO: 1366469 - DNA, 16 bp, Homo sapiens
ccttagcaaattctgt

SEQ ID NO: 1366470 - DNA, 14 bp, Homo sapiens
ccttaggccttcct

SEQ ID NO: 1366471 - DNA, 19 bp, Homo sapiens
ccttatggatgatttaagt

SEQ ID NO: 1366472 - DNA, 10 bp, Homo sapiens
ccttcagaca

SEQ ID NO: 1366473 - DNA, 17 bp, Homo sapiens
ccttcagacaccctcaa

SEQ ID NO: 1366474 - DNA, 12 bp, Homo sapiens
ccttcagctcca

SEQ ID NO: 1366475 - DNA, 22 bp, Homo sapiens
ccttccccagctttgctgcctg

SEQ ID NO: 1366476 - DNA, 14 bp, Homo sapiens
ccttccccatgctt

SEQ ID NO: 1366477 - DNA, 23 bp, Homo sapiens
ccttccccatgcttccttgcctg

SEQ ID NO: 1366478 - DNA, 22 bp, Homo sapiens
ccttccgcagtgtggccaggct

SEQ ID NO: 1366479 - DNA, 15 bp, Homo sapiens
ccttcctctctccag

SEQ ID NO: 1366480 - DNA, 15 bp, Homo sapiens
ccttcctgctgcgca

SEQ ID NO: 1366481 - DNA, 16 bp, Homo sapiens
ccttccttttccctgc

SEQ ID NO: 1366482 - DNA, 18 bp, Homo sapiens
ccttccttttccctgctt

SEQ ID NO: 1366483 - DNA, 20 bp, Homo sapiens
ccttccttttccctgcttcc

SEQ ID NO: 1366484 - DNA, 20 bp, Homo sapiens
ccttcgcttcttgcctctgt

SEQ ID NO: 1366485 - DNA, 21 bp, Homo sapiens
ccttctatagcatcacttaaa

SEQ ID NO: 1366486 - DNA, 15 bp, Homo sapiens
ccttctctcctcccc

SEQ ID NO: 1366487 - DNA, 20 bp, Homo sapiens
ccttctctcctccccaaatc

SEQ ID NO: 1366488 - DNA, 18 bp, Homo sapiens
ccttgaaactttgggaaa

SEQ ID NO: 1366489 - DNA, 17 bp, Homo sapiens
ccttgaagaacctctca

SEQ ID NO: 1366490 - DNA, 21 bp, Homo sapiens
ccttgaagaactgcaggccct

SEQ ID NO: 1366491 - DNA, 16 bp, Homo sapiens
ccttgagggctgcagt

SEQ ID NO: 1366492 - DNA, 19 bp, Homo sapiens
ccttgattcccttgttatt

SEQ ID NO: 1366493 - DNA, 16 bp, Homo sapiens
ccttggacatcctcct

SEQ ID NO: 1366494 - DNA, 13 bp, Homo sapiens
ccttggcctgggc

SEQ ID NO: 1366495 - DNA, 11 bp, Homo sapiens
ccttgtgcctg

SEQ ID NO: 1366496 - DNA, 23 bp, Homo sapiens
cctttatgtgaatttttaagctg

SEQ ID NO: 1366497 - DNA, 13 bp, Homo sapiens
cctttattttaga

SEQ ID NO: 1366498 - DNA, 19 bp, Homo sapiens
cctttccaccacagccagc

SEQ ID NO: 1366499 - DNA, 17 bp, Homo sapiens
cctttccctcaccccct

SEQ ID NO: 1366500 - DNA, 14 bp, Homo sapiens
cctttggttctggc

SEQ ID NO: 1366501 - DNA, 14 bp, Homo sapiens
cctttgtaagtgca

SEQ ID NO: 1366502 - DNA, 18 bp, Homo sapiens
ccttttactggttgcatg

SEQ ID NO: 1366503 - DNA, 12 bp, Homo sapiens
ccttttcagggc

SEQ ID NO: 1366504 - DNA, 18 bp, Homo sapiens
ccttttcagggctggctc

SEQ ID NO: 1366505 - DNA, 14 bp, Homo sapiens
ccttttccctgctt

SEQ ID NO: 1366506 - DNA, 17 bp, Homo sapiens
ccttttcgcctttcctc

SEQ ID NO: 1366507 - DNA, 13 bp, Homo sapiens
ccttttgttttct

SEQ ID NO: 1366508 - DNA, 11 bp, Homo sapiens
cctttttaagg

SEQ ID NO: 1366509 - DNA, 13 bp, Homo sapiens
cctttttatttat

SEQ ID NO: 1366510 - DNA, 16 bp, Homo sapiens
cctttttatttatatg

SEQ ID NO: 1366511 - DNA, 18 bp, Homo sapiens
cctttttatttatatgta

SEQ ID NO: 1366512 - DNA, 20 bp, Homo sapiens
cctttttatttatatgtatg

SEQ ID NO: 1366513 - DNA, 16 bp, Homo sapiens
ccttttttttttcttg

SEQ ID NO: 1366514 - DNA, 20 bp, Homo sapiens
cgaaaggatgaaagtgacca

SEQ ID NO: 1366515 - DNA, 20 bp, Homo sapiens
cgaagaccctcttgcccatc

SEQ ID NO: 1366516 - DNA, 15 bp, Homo sapiens
cgaagagttcccttg

SEQ ID NO: 1366517 - DNA, 16 bp, Homo sapiens
cgaagttcaagatcaa

SEQ ID NO: 1366518 - DNA, 21 bp, Homo sapiens
cgaccaccgcccctggccgcg

SEQ ID NO: 1366519 - DNA, 16 bp, Homo sapiens
cgaccagaggagcctt

SEQ ID NO: 1366520 - DNA, 17 bp, Homo sapiens
cgaccagaggagccttt

SEQ ID NO: 1366521 - DNA, 14 bp, Homo sapiens
cgaccatgtggcca

SEQ ID NO: 1366522 - DNA, 19 bp, Homo sapiens
cgaccccccgtgggctccc

SEQ ID NO: 1366523 - DNA, 19 bp, Homo sapiens
cgaccctgggggcacagga

SEQ ID NO: 1366524 - DNA, 23 bp, Homo sapiens
cgaccctgggggcacaggaggca

SEQ ID NO: 1366525 - DNA, 12 bp, Homo sapiens
cgacgcccaccc

SEQ ID NO: 1366526 - DNA, 15 bp, Homo sapiens
cgactaaactagatt

SEQ ID NO: 1366527 - DNA, 21 bp, Homo sapiens
cgactaaactagattttcact

SEQ ID NO: 1366528 - DNA, 12 bp, Homo sapiens
cgactatagaaa

SEQ ID NO: 1366529 - DNA, 21 bp, Homo sapiens
cgactccagccagcgcctccc

SEQ ID NO: 1366530 - DNA, 23 bp, Homo sapiens
cgactctgtgcctccctccccag

SEQ ID NO: 1366531 - DNA, 14 bp, Homo sapiens
cgactttctgcctg

SEQ ID NO: 1366532 - DNA, 22 bp, Homo sapiens
cgagaccgggccctgggttcct

SEQ ID NO: 1366533 - DNA, 15 bp, Homo sapiens
cgagaggtgggccag

SEQ ID NO: 1366534 - DNA, 19 bp, Homo sapiens
cgagaggtgggccagtctg

SEQ ID NO: 1366535 - DNA, 20 bp, Homo sapiens
cgagaggtgggccagtctgt

SEQ ID NO: 1366536 - DNA, 23 bp, Homo sapiens
cgagaggtgggccagtctgtgga

SEQ ID NO: 1366537 - DNA, 13 bp, Homo sapiens
cgaggtcaggaga

SEQ ID NO: 1366538 - DNA, 20 bp, Homo sapiens
cgagtagaaaatgtgaccct

SEQ ID NO: 1366539 - DNA, 13 bp, Homo sapiens
cgagtctgaggcc

SEQ ID NO: 1366540 - DNA, 15 bp, Homo sapiens
cgatcacaaatgact

SEQ ID NO: 1366541 - DNA, 17 bp, Homo sapiens
cgatcacaaatgacttt

SEQ ID NO: 1366542 - DNA, 21 bp, Homo sapiens
cgatcacaaatgactttatta

SEQ ID NO: 1366543 - DNA, 13 bp, Homo sapiens
cgatctctcctgg

SEQ ID NO: 1366544 - DNA, 14 bp, Homo sapiens
cgatttaaggtatt

SEQ ID NO: 1366545 - DNA, 15 bp, Homo sapiens
cgcaccattctgact

SEQ ID NO: 1366546 - DNA, 20 bp, Homo sapiens
cgcagaacgaaccttggcct

SEQ ID NO: 1366547 - DNA, 21 bp, Homo sapiens
cgcagagcgcgcccctagccg

SEQ ID NO: 1366548 - DNA, 23 bp, Homo sapiens
cgcagcctctcagtgccctccag

SEQ ID NO: 1366549 - DNA, 14 bp, Homo sapiens
cgcaggtgggctgg

SEQ ID NO: 1366550 - DNA, 18 bp, Homo sapiens
cgcaggtgggctggactt

SEQ ID NO: 1366551 - DNA, 17 bp, Homo sapiens
cgcatcttgcctccagg

SEQ ID NO: 1366552 - DNA, 23 bp, Homo sapiens
cgccaccgcgggtgtgggaaagc

SEQ ID NO: 1366553 - DNA, 12 bp, Homo sapiens
cgccactcattt

SEQ ID NO: 1366554 - DNA, 16 bp, Homo sapiens
cgccactcatttcatc

SEQ ID NO: 1366555 - DNA, 17 bp, Homo sapiens
cgccactcatttcatct

SEQ ID NO: 1366556 - DNA, 19 bp, Homo sapiens
cgccactcatttcatctca

SEQ ID NO: 1366557 - DNA, 13 bp, Homo sapiens
cgccagcctcctc

SEQ ID NO: 1366558 - DNA, 23 bp, Homo sapiens
cgccagcctcctctggacggcag

SEQ ID NO: 1366559 - DNA, 23 bp, Homo sapiens
cgccatgtgatggacactccagg

SEQ ID NO: 1366560 - DNA, 18 bp, Homo sapiens
cgcccatgcactggggac

SEQ ID NO: 1366561 - DNA, 21 bp, Homo sapiens
cgcccctagccggttcctgtc

SEQ ID NO: 1366562 - DNA, 14 bp, Homo sapiens
cgcccgtcctgcct

SEQ ID NO: 1366563 - DNA, 17 bp, Homo sapiens
cgcccgtcctgcctgtg

SEQ ID NO: 1366564 - DNA, 15 bp, Homo sapiens
cgccggatctgaggg

SEQ ID NO: 1366565 - DNA, 15 bp, Homo sapiens
cgccgtctccagggg

SEQ ID NO: 1366566 - DNA, 22 bp, Homo sapiens
ctcaatcctaatttctcctccc

SEQ ID NO: 1366567 - DNA, 23 bp, Homo sapiens
ctcaatcctaatttctcctccct

SEQ ID NO: 1366568 - DNA, 12 bp, Homo sapiens
ctcaatgaaaaa

SEQ ID NO: 1366569 - DNA, 22 bp, Homo sapiens
ctcaatgaaaaatagtgtcttt

SEQ ID NO: 1366570 - DNA, 20 bp, Homo sapiens
ctcaatgaaccataaattca

SEQ ID NO: 1366571 - DNA, 19 bp, Homo sapiens
ctcaatgctttatttgtaa

SEQ ID NO: 1366572 - DNA, 18 bp, Homo sapiens
ctcacactcccctagggg

SEQ ID NO: 1366573 - DNA, 22 bp, Homo sapiens
ctcacagagtcaaggcctgctc

SEQ ID NO: 1366574 - DNA, 20 bp, Homo sapiens
ctcaccagccccactgccag

SEQ ID NO: 1366575 - DNA, 22 bp, Homo sapiens
ctcacccatgcaagcagaggac

SEQ ID NO: 1366576 - DNA, 14 bp, Homo sapiens
ctcaccccctccca

SEQ ID NO: 1366577 - DNA, 22 bp, Homo sapiens
ctcaccccctcccacccccagc

SEQ ID NO: 1366578 - DNA, 23 bp, Homo sapiens
ctcaccccctcccacccccagcc

SEQ ID NO: 1366579 - DNA, 14 bp, Homo sapiens
ctcacctcatgccc

SEQ ID NO: 1366580 - DNA, 18 bp, Homo sapiens
ctcacgcctgtaatccca

SEQ ID NO: 1366581 - DNA, 21 bp, Homo sapiens
ctcacgcctgtaatcccagca

SEQ ID NO: 1366582 - DNA, 17 bp, Homo sapiens
ctcactatcctacccca

SEQ ID NO: 1366583 - DNA, 16 bp, Homo sapiens
ctcactcacagagtca

SEQ ID NO: 1366584 - DNA, 22 bp, Homo sapiens
ctcactcgggtttctctgtggc

SEQ ID NO: 1366585 - DNA, 13 bp, Homo sapiens
ctcactgccaggc

SEQ ID NO: 1366586 - DNA, 18 bp, Homo sapiens
ctcactgccaggccagcc

SEQ ID NO: 1366587 - DNA, 20 bp, Homo sapiens
ctcactgccaggccagcctc

SEQ ID NO: 1366588 - DNA, 19 bp, Homo sapiens
ctcactgccatgccagctt

SEQ ID NO: 1366589 - DNA, 22 bp, Homo sapiens
ctcactgccatgccagcttatc

SEQ ID NO: 1366590 - DNA, 10 bp, Homo sapiens
ctcactgtga

SEQ ID NO: 1366591 - DNA, 22 bp, Homo sapiens
ctcactgtgatcaatattttta

SEQ ID NO: 1366592 - DNA, 21 bp, Homo sapiens
ctcactgtttgtttttattta

SEQ ID NO: 1366593 - DNA, 14 bp, Homo sapiens
ctcacttcaccctg

SEQ ID NO: 1366594 - DNA, 13 bp, Homo sapiens
ctcagaagcacag

SEQ ID NO: 1366595 - DNA, 22 bp, Homo sapiens
ctcagagacactgttgataaaa

SEQ ID NO: 1366596 - DNA, 21 bp, Homo sapiens
ctcagagtggtgggggaaggc

SEQ ID NO: 1366597 - DNA, 16 bp, Homo sapiens
ctcagatttctgagga

SEQ ID NO: 1366598 - DNA, 15 bp, Homo sapiens
ctcagccttcagaca

SEQ ID NO: 1366599 - DNA, 13 bp, Homo sapiens
ctcagctttgaga

SEQ ID NO: 1366600 - DNA, 16 bp, Homo sapiens
ctcagctttgagaagc

SEQ ID NO: 1366601 - DNA, 19 bp, Homo sapiens
ctcaggaggcgcccttggc

SEQ ID NO: 1366602 - DNA, 18 bp, Homo sapiens
ctcaggagtttgagacca

SEQ ID NO: 1366603 - DNA, 18 bp, Homo sapiens
ctcaggcaggtgggatgg

SEQ ID NO: 1366604 - DNA, 21 bp, Homo sapiens
ctcaggccggcagccccagcc

SEQ ID NO: 1366605 - DNA, 24 bp, Homo sapiens
ctcaggccggcagccccagcctgc

SEQ ID NO: 1366606 - DNA, 21 bp, Homo sapiens
ctcagggcagcctcccccggc

SEQ ID NO: 1366607 - DNA, 14 bp, Homo sapiens
ctcagggcctggtc

SEQ ID NO: 1366608 - DNA, 13 bp, Homo sapiens
ctcagggctccca

SEQ ID NO: 1366609 - DNA, 15 bp, Homo sapiens
ctcagggctcccagg

SEQ ID NO: 1366610 - DNA, 16 bp, Homo sapiens
ctcagggtggtctctt

SEQ ID NO: 1366611 - DNA, 20 bp, Homo sapiens
ctcaggtgagaagcagagga

SEQ ID NO: 1366612 - DNA, 14 bp, Homo sapiens
ctcaggtgggccct

SEQ ID NO: 1366613 - DNA, 12 bp, Homo sapiens
ctcagtaaacgg

SEQ ID NO: 1366614 - DNA, 21 bp, Homo sapiens
ctcagtaaacgggaacatgcc

SEQ ID NO: 1366615 - DNA, 15 bp, Homo sapiens
ctcagtgcagatgga

SEQ ID NO: 1366616 - DNA, 19 bp, Homo sapiens
ctcagtgttggtatatttt

SEQ ID NO: 1366617 - DNA, 21 bp, Homo sapiens
ctcagtgttggtatattttat

SEQ ID NO: 1366618 - DNA, 13 bp, Homo sapiens
ctcatataagaca

SEQ ID NO: 1366619 - DNA, 21 bp, Homo sapiens
ctcatatcaacttagtcaata

SEQ ID NO: 1366620 - DNA, 21 bp, Homo sapiens
ctcatctgaaatgttacaaaa

SEQ ID NO: 1366621 - DNA, 13 bp, Homo sapiens
ctcatctgcaaaa

SEQ ID NO: 1366622 - DNA, 12 bp, Homo sapiens
ctcatctgctgg

SEQ ID NO: 1366623 - DNA, 17 bp, Homo sapiens
ctcatctggagttctca

SEQ ID NO: 1366624 - DNA, 15 bp, Homo sapiens
ctcattaaacttttt

SEQ ID NO: 1366625 - DNA, 19 bp, Homo sapiens
ctcattacttgttgcctat

SEQ ID NO: 1366626 - DNA, 21 bp, Homo sapiens
ctcattagcattttgctaaat

SEQ ID NO: 1366627 - DNA, 19 bp, Homo sapiens
ctcattgctgagcctctgc

SEQ ID NO: 1366628 - DNA, 16 bp, Homo sapiens
ctcatttaagggaaaa

SEQ ID NO: 1366629 - DNA, 22 bp, Homo sapiens
ctcatttaagggaaaaatatat

SEQ ID NO: 1366630 - DNA, 18 bp, Homo sapiens
ctcatttcatctcattta

SEQ ID NO: 1366631 - DNA, 23 bp, Homo sapiens
ctccaaactgaagcagcctctcc

SEQ ID NO: 1366632 - DNA, 15 bp, Homo sapiens
ctccaaccctgccgt

SEQ ID NO: 1366633 - DNA, 17 bp, Homo sapiens
ctccaagccccatcttc

SEQ ID NO: 1366634 - DNA, 14 bp, Homo sapiens
ctccacatctgcct

SEQ ID NO: 1366635 - DNA, 15 bp, Homo sapiens
ctccacatctgcctt

SEQ ID NO: 1366636 - DNA, 12 bp, Homo sapiens
ctccaccccagg

SEQ ID NO: 1366637 - DNA, 13 bp, Homo sapiens
ctccactgtgcac

SEQ ID NO: 1366638 - DNA, 17 bp, Homo sapiens
ctccagatgtttccaga

SEQ ID NO: 1366639 - DNA, 14 bp, Homo sapiens
ctccagccagcgcc

SEQ ID NO: 1366640 - DNA, 19 bp, Homo sapiens
ctccagccagcgcctccct

SEQ ID NO: 1366641 - DNA, 16 bp, Homo sapiens
ctccagccccgcgacc

SEQ ID NO: 1366642 - DNA, 16 bp, Homo sapiens
ctccagcctcagcccc

SEQ ID NO: 1366643 - DNA, 22 bp, Homo sapiens
ctccagcgatctctccactgtg

SEQ ID NO: 1366644 - DNA, 19 bp, Homo sapiens
ctccagctgttcagctggt

SEQ ID NO: 1366645 - DNA, 20 bp, Homo sapiens
ctccaggccctcctctccca

SEQ ID NO: 1366646 - DNA, 13 bp, Homo sapiens
ctccaggcctgcc

SEQ ID NO: 1366647 - DNA, 17 bp, Homo sapiens
ctccaggcctgcctccc

SEQ ID NO: 1366648 - DNA, 19 bp, Homo sapiens
ctccaggcctgcctcccac

SEQ ID NO: 1366649 - DNA, 16 bp, Homo sapiens
ctccagggaatccaag

SEQ ID NO: 1366650 - DNA, 20 bp, Homo sapiens
ctccagggaatccaagcctc

SEQ ID NO: 1366651 - DNA, 19 bp, Homo sapiens
ctccagggacacacagcct

SEQ ID NO: 1366652 - DNA, 18 bp, Homo sapiens
ctccaggggctgcttcct

SEQ ID NO: 1366653 - DNA, 22 bp, Homo sapiens
ctccagtgtgggcttgaccagg

SEQ ID NO: 1366654 - DNA, 14 bp, Homo sapiens
ctccatccaaggcc

SEQ ID NO: 1366655 - DNA, 12 bp, Homo sapiens
ctccatccctct

SEQ ID NO: 1366656 - DNA, 22 bp, Homo sapiens
ctccatccctctaatgagactg

SEQ ID NO: 1366657 - DNA, 22 bp, Homo sapiens
ctccatttgagaaaataaagct

SEQ ID NO: 1366658 - DNA, 11 bp, Homo sapiens
ctcccaccccc

SEQ ID NO: 1366659 - DNA, 20 bp, Homo sapiens
ctcccactttgctgttcctt

SEQ ID NO: 1366660 - DNA, 11 bp, Homo sapiens
ctcccagcctc

SEQ ID NO: 1366661 - DNA, 14 bp, Homo sapiens
ctcccagcctcagc

SEQ ID NO: 1366662 - DNA, 16 bp, Homo sapiens
ctcccaggaagcccag

SEQ ID NO: 1366663 - DNA, 18 bp, Homo sapiens
ctcccaggagcctgccca

SEQ ID NO: 1366664 - DNA, 20 bp, Homo sapiens
ctcccaggggtctccctggc

SEQ ID NO: 1366665 - DNA, 21 bp, Homo sapiens
ctcccaggggtctccctggct

SEQ ID NO: 1366666 - DNA, 23 bp, Homo sapiens
ctcccaggggtctccctggctcc

SEQ ID NO: 1366667 - DNA, 21 bp, Homo sapiens
ctcccaggtaccagctgcgct

SEQ ID NO: 1366668 - DNA, 24 bp, Homo sapiens
ctcccaggtaccagctgcgcttgc

SEQ ID NO: 1366669 - DNA, 11 bp, Homo sapiens
ctccccacagc

SEQ ID NO: 1366670 - DNA, 18 bp, Homo sapiens
ctccccacagcgtccctg

SEQ ID NO: 1366671 - DNA, 19 bp, Homo sapiens
ctccccacagcgtccctgg

SEQ ID NO: 1366672 - DNA, 16 bp, Homo sapiens
ctccccacctccaggc

SEQ ID NO: 1366673 - DNA, 22 bp, Homo sapiens
ctccccagcattccagcccctc

SEQ ID NO: 1366674 - DNA, 23 bp, Homo sapiens
ctccccagcattccagcccctct

SEQ ID NO: 1366675 - DNA, 14 bp, Homo sapiens
ctccccagcctgcg

SEQ ID NO: 1366676 - DNA, 16 bp, Homo sapiens
ctccccaggtccagct

SEQ ID NO: 1366677 - DNA, 18 bp, Homo sapiens
ctccccaggtccagctct

SEQ ID NO: 1366678 - DNA, 21 bp, Homo sapiens
ctccccaggtccagctctgga

SEQ ID NO: 1366679 - DNA, 12 bp, Homo sapiens
ctccccatggag

SEQ ID NO: 1366680 - DNA, 17 bp, Homo sapiens
ctccccatttcccatct

SEQ ID NO: 1366681 - DNA, 12 bp, Homo sapiens
ctcccctgagga

SEQ ID NO: 1366682 - DNA, 12 bp, Homo sapiens
ctcccctgccac

SEQ ID NO: 1366683 - DNA, 18 bp, Homo sapiens
ctcccctgccaccaggcc

SEQ ID NO: 1366684 - DNA, 23 bp, Homo sapiens
ctctggacggcaggctcactgcc

SEQ ID NO: 1366685 - DNA, 16 bp, Homo sapiens
ctctgggatcctgggg

SEQ ID NO: 1366686 - DNA, 15 bp, Homo sapiens
ctctgggtccttcct

SEQ ID NO: 1366687 - DNA, 17 bp, Homo sapiens
ctctgggtccttcctga

SEQ ID NO: 1366688 - DNA, 13 bp, Homo sapiens
ctctgtcaggcct

SEQ ID NO: 1366689 - DNA, 23 bp, Homo sapiens
ctctgtgagaaggtttattgtta

SEQ ID NO: 1366690 - DNA, 22 bp, Homo sapiens
ctctgtgcctccctccccagtg

SEQ ID NO: 1366691 - DNA, 15 bp, Homo sapiens
ctctgtgccttcttt

SEQ ID NO: 1366692 - DNA, 20 bp, Homo sapiens
ctctgtggctccaggccaaa

SEQ ID NO: 1366693 - DNA, 19 bp, Homo sapiens
ctctgtgtatttgcttttt

SEQ ID NO: 1366694 - DNA, 24 bp, Homo sapiens
ctcttaaaacccaagtgccttagc

SEQ ID NO: 1366695 - DNA, 15 bp, Homo sapiens
ctcttagaaaaacca

SEQ ID NO: 1366696 - DNA, 17 bp, Homo sapiens
ctcttcatcccattcca

SEQ ID NO: 1366697 - DNA, 13 bp, Homo sapiens
ctcttccccccaa

SEQ ID NO: 1366698 - DNA, 20 bp, Homo sapiens
ctcttcctatccctctccta

SEQ ID NO: 1366699 - DNA, 18 bp, Homo sapiens
ctcttctcattacttgtt

SEQ ID NO: 1366700 - DNA, 11 bp, Homo sapiens
ctcttctggct

SEQ ID NO: 1366701 - DNA, 19 bp, Homo sapiens
ctcttctggggcaggctgg

SEQ ID NO: 1366702 - DNA, 21 bp, Homo sapiens
ctcttctggggcaggctgggc

SEQ ID NO: 1366703 - DNA, 19 bp, Homo sapiens
ctcttgaccaggctgcctc

SEQ ID NO: 1366704 - DNA, 16 bp, Homo sapiens
ctcttgagctggcctc

SEQ ID NO: 1366705 - DNA, 13 bp, Homo sapiens
ctcttgagttgtt

SEQ ID NO: 1366706 - DNA, 16 bp, Homo sapiens
ctcttgagttgttttt

SEQ ID NO: 1366707 - DNA, 21 bp, Homo sapiens
ctcttgagttgtttttgtata

SEQ ID NO: 1366708 - DNA, 22 bp, Homo sapiens
ctcttgagttgtttttgtatat

SEQ ID NO: 1366709 - DNA, 23 bp, Homo sapiens
ctcttgagttgtttttgtatatt

SEQ ID NO: 1366710 - DNA, 14 bp, Homo sapiens
ctcttgcccatcct

SEQ ID NO: 1366711 - DNA, 16 bp, Homo sapiens
ctcttgcccatcctga

SEQ ID NO: 1366712 - DNA, 20 bp, Homo sapiens
ctcttgcccatcctgactga

SEQ ID NO: 1366713 - DNA, 14 bp, Homo sapiens
ctcttgtaaagact

SEQ ID NO: 1366714 - DNA, 21 bp, Homo sapiens
ctcttgtatccctagtgctcc

SEQ ID NO: 1366715 - DNA, 12 bp, Homo sapiens
ctcttgtgattt

SEQ ID NO: 1366716 - DNA, 17 bp, Homo sapiens
ctcttgtgatttcttta

SEQ ID NO: 1366717 - DNA, 22 bp, Homo sapiens
ctcttgtgatttctttaaaaga

SEQ ID NO: 1366718 - DNA, 19 bp, Homo sapiens
ctctttaaaaggaaagaaa

SEQ ID NO: 1366719 - DNA, 20 bp, Homo sapiens
ctctttaaaaggaaagaaaa

SEQ ID NO: 1366720 - DNA, 11 bp, Homo sapiens
ctctttgatta

SEQ ID NO: 1366721 - DNA, 16 bp, Homo sapiens
ctctttgattatttgc

SEQ ID NO: 1366722 - DNA, 18 bp, Homo sapiens
ctctttgattatttgcat

SEQ ID NO: 1366723 - DNA, 22 bp, Homo sapiens
ctgaaaagtgtgtatatatttt

SEQ ID NO: 1366724 - DNA, 17 bp, Homo sapiens
ctgaaaatattgtttta

SEQ ID NO: 1366725 - DNA, 21 bp, Homo sapiens
ctgaaaattggacagattgcc

SEQ ID NO: 1366726 - DNA, 12 bp, Homo sapiens
ctgaaagtgtgt

SEQ ID NO: 1366727 - DNA, 21 bp, Homo sapiens
ctgaaagtgtgtgtagtttta

SEQ ID NO: 1366728 - DNA, 16 bp, Homo sapiens
ctgaaagttttgtaaa

SEQ ID NO: 1366729 - DNA, 23 bp, Homo sapiens
ctgaaagttttgtaaaagaaatc

SEQ ID NO: 1366730 - DNA, 18 bp, Homo sapiens
ctgaaattctcctggagg

SEQ ID NO: 1366731 - DNA, 19 bp, Homo sapiens
ctgaaattctcctggaggt

SEQ ID NO: 1366732 - DNA, 19 bp, Homo sapiens
ctgaacaataggctgttcc

SEQ ID NO: 1366733 - DNA, 17 bp, Homo sapiens
ctgaaccgcacagctca

SEQ ID NO: 1366734 - DNA, 23 bp, Homo sapiens
ctgaaccgcacagctcaggaggc

SEQ ID NO: 1366735 - DNA, 21 bp, Homo sapiens
ctgaacctgggtaactaggga

SEQ ID NO: 1366736 - DNA, 12 bp, Homo sapiens
ctgaagagcatt

SEQ ID NO: 1366737 - DNA, 20 bp, Homo sapiens
ctgaagagctattatataaa

SEQ ID NO: 1366738 - DNA, 11 bp, Homo sapiens
ctgaaggaaaa

SEQ ID NO: 1366739 - DNA, 21 bp, Homo sapiens
ctgaaggaaaaacacaagcaa

SEQ ID NO: 1366740 - DNA, 20 bp, Homo sapiens
ctgaagtcttactacagaaa

SEQ ID NO: 1366741 - DNA, 16 bp, Homo sapiens
ctgaatgttgggactg

SEQ ID NO: 1366742 - DNA, 16 bp, Homo sapiens
ctgaatttttttgtaa

SEQ ID NO: 1366743 - DNA, 13 bp, Homo sapiens
ctgacatcttgaa

SEQ ID NO: 1366744 - DNA, 15 bp, Homo sapiens
ctgacatcttgaatc

SEQ ID NO: 1366745 - DNA, 16 bp, Homo sapiens
ctgaccagctgctccg

SEQ ID NO: 1366746 - DNA, 15 bp, Homo sapiens
ctgaccatgctcatc

SEQ ID NO: 1366747 - DNA, 20 bp, Homo sapiens
ctgaccatgctcatctgctg

SEQ ID NO: 1366748 - DNA, 23 bp, Homo sapiens
ctgacctggcatctaattctgat

SEQ ID NO: 1366749 - DNA, 17 bp, Homo sapiens
ctgactgaggcagtttg

SEQ ID NO: 1366750 - DNA, 21 bp, Homo sapiens
ctgactgtcgggctttaaaaa

SEQ ID NO: 1366751 - DNA, 12 bp, Homo sapiens
ctgacttctgcc

SEQ ID NO: 1366752 - DNA, 13 bp, Homo sapiens
ctgacttctgcct

SEQ ID NO: 1366753 - DNA, 15 bp, Homo sapiens
ctgacttctgcctgg

SEQ ID NO: 1366754 - DNA, 13 bp, Homo sapiens
ctgagaggcaggc

SEQ ID NO: 1366755 - DNA, 17 bp, Homo sapiens
ctgagaggcaggcatag

SEQ ID NO: 1366756 - DNA, 21 bp, Homo sapiens
ctgagatcaaaacggttttac

SEQ ID NO: 1366757 - DNA, 19 bp, Homo sapiens
ctgagatcgtgctactgca

SEQ ID NO: 1366758 - DNA, 15 bp, Homo sapiens
ctgagatggaaaagt

SEQ ID NO: 1366759 - DNA, 20 bp, Homo sapiens
ctgagccctactccctgcag

SEQ ID NO: 1366760 - DNA, 16 bp, Homo sapiens
ctgagccggccccagg

SEQ ID NO: 1366761 - DNA, 19 bp, Homo sapiens
ctgagccggccccaggctc

SEQ ID NO: 1366762 - DNA, 16 bp, Homo sapiens
ctgagcctctgctccc

SEQ ID NO: 1366763 - DNA, 18 bp, Homo sapiens
ctgagcctgcagggaagc

SEQ ID NO: 1366764 - DNA, 16 bp, Homo sapiens
ctgaggcctgcagcac

SEQ ID NO: 1366765 - DNA, 14 bp, Homo sapiens
ctgaggcctgggcc

SEQ ID NO: 1366766 - DNA, 15 bp, Homo sapiens
ctgaggcctgggccg

SEQ ID NO: 1366767 - DNA, 22 bp, Homo sapiens
ctgaggcctgggccgctgccac

SEQ ID NO: 1366768 - DNA, 23 bp, Homo sapiens
ctgaggcctgggccgctgccacg

SEQ ID NO: 1366769 - DNA, 14 bp, Homo sapiens
ctgaggctgtggtc

SEQ ID NO: 1366770 - DNA, 17 bp, Homo sapiens
ctgagggaaatgttttg

SEQ ID NO: 1366771 - DNA, 21 bp, Homo sapiens
ctgagggaaatgttttgtaaa

SEQ ID NO: 1366772 - DNA, 19 bp, Homo sapiens
ctgagggcagactggggca

SEQ ID NO: 1366773 - DNA, 22 bp, Homo sapiens
ctgaggtcatcggcgtggccca

SEQ ID NO: 1366774 - DNA, 23 bp, Homo sapiens
ctgaggttcctctgcctgccccg

SEQ ID NO: 1366775 - DNA, 21 bp, Homo sapiens
ctgagtattaatatctgagga

SEQ ID NO: 1366776 - DNA, 21 bp, Homo sapiens
ctgagtgggaagcccatcctg

SEQ ID NO: 1366777 - DNA, 20 bp, Homo sapiens
ctgatcccattttcctctga

SEQ ID NO: 1366778 - DNA, 12 bp, Homo sapiens
ctgatctgcgga

SEQ ID NO: 1366779 - DNA, 20 bp, Homo sapiens
ctgatctgcggatctcagct

SEQ ID NO: 1366780 - DNA, 18 bp, Homo sapiens
ctgattctggctttaagc

SEQ ID NO: 1366781 - DNA, 23 bp, Homo sapiens
ctgatttgatgatacatttcatt

SEQ ID NO: 1366782 - DNA, 19 bp, Homo sapiens
ctgcaaaaggcctcttgta

SEQ ID NO: 1366783 - DNA, 19 bp, Homo sapiens
ctgcaaatctgatggcctt

SEQ ID NO: 1366784 - DNA, 20 bp, Homo sapiens
ctgcaaatctgatggcctta

SEQ ID NO: 1366785 - DNA, 19 bp, Homo sapiens
ctgcaatatttgaatttta

SEQ ID NO: 1366786 - DNA, 13 bp, Homo sapiens
ctgcacaagctgc

SEQ ID NO: 1366787 - DNA, 21 bp, Homo sapiens
ctgcaccccttctctcctccc

SEQ ID NO: 1366788 - DNA, 12 bp, Homo sapiens
ctgcacgtcatg

SEQ ID NO: 1366789 - DNA, 15 bp, Homo sapiens
ctgcacttacttgct

SEQ ID NO: 1366790 - DNA, 23 bp, Homo sapiens
ctgcagagatttctcattgactt

SEQ ID NO: 1366791 - DNA, 13 bp, Homo sapiens
ctgcagaggccag

SEQ ID NO: 1366792 - DNA, 16 bp, Homo sapiens
ctgcagatgccaccct

SEQ ID NO: 1366793 - DNA, 19 bp, Homo sapiens
ctgcagatgccaccctagc

SEQ ID NO: 1366794 - DNA, 22 bp, Homo sapiens
ctgcagatgccaccctagccaa

SEQ ID NO: 1366795 - DNA, 22 bp, Homo sapiens
ctgcagcaccgaggggcctttg

SEQ ID NO: 1366796 - DNA, 16 bp, Homo sapiens
ctgcaggccctggcct

SEQ ID NO: 1366797 - DNA, 18 bp, Homo sapiens
ctgcaggccctggcctcc

SEQ ID NO: 1366798 - DNA, 18 bp, Homo sapiens
ctgcagtcctactcaagc

SEQ ID NO: 1366799 - DNA, 21 bp, Homo sapiens
ctgcagtttgagacaggagac

SEQ ID NO: 1366800 - DNA, 13 bp, Homo sapiens
ctgcatccagcct

SEQ ID NO: 1366801 - DNA, 18 bp, Homo sapiens
ctgtcaaatgatgtgcaa

SEQ ID NO: 1366802 - DNA, 21 bp, Homo sapiens
ctgtcactcattgctgagcct

SEQ ID NO: 1366803 - DNA, 18 bp, Homo sapiens
ctgtcaggctgaaaacaa

SEQ ID NO: 1366804 - DNA, 15 bp, Homo sapiens
ctgtcattgcacata

SEQ ID NO: 1366805 - DNA, 22 bp, Homo sapiens
ctgtcccagtgccgagaaggaa

SEQ ID NO: 1366806 - DNA, 12 bp, Homo sapiens
ctgtcctgtcct

SEQ ID NO: 1366807 - DNA, 15 bp, Homo sapiens
ctgtcggtgggacct

SEQ ID NO: 1366808 - DNA, 21 bp, Homo sapiens
ctgtctctcttctcagagtgg

SEQ ID NO: 1366809 - DNA, 13 bp, Homo sapiens
ctgtcttcctcaa

SEQ ID NO: 1366810 - DNA, 14 bp, Homo sapiens
ctgtcttcctcaaa

SEQ ID NO: 1366811 - DNA, 20 bp, Homo sapiens
ctgtcttcctcaaaataaag

SEQ ID NO: 1366812 - DNA, 18 bp, Homo sapiens
ctgtctttcctgaaccat

SEQ ID NO: 1366813 - DNA, 21 bp, Homo sapiens
ctgtgaatgccactgccttcg

SEQ ID NO: 1366814 - DNA, 17 bp, Homo sapiens
ctgtgacatggtgcctg

SEQ ID NO: 1366815 - DNA, 22 bp, Homo sapiens
ctgtgacatggtgcctgagagg

SEQ ID NO: 1366816 - DNA, 18 bp, Homo sapiens
ctgtgaccaggaaggaag

SEQ ID NO: 1366817 - DNA, 23 bp, Homo sapiens
ctgtgaccaggaaggaagtcagc

SEQ ID NO: 1366818 - DNA, 20 bp, Homo sapiens
ctgtgagaaggtttattgtt

SEQ ID NO: 1366819 - DNA, 23 bp, Homo sapiens
ctgtgatcaatatttttatatca

SEQ ID NO: 1366820 - DNA, 19 bp, Homo sapiens
ctgtgatccacccaaccct

SEQ ID NO: 1366821 - DNA, 15 bp, Homo sapiens
ctgtgatgagctgat

SEQ ID NO: 1366822 - DNA, 17 bp, Homo sapiens
ctgtgcaacgccgtggg

SEQ ID NO: 1366823 - DNA, 18 bp, Homo sapiens
ctgtgcaacgccgtgggc

SEQ ID NO: 1366824 - DNA, 16 bp, Homo sapiens
ctgtgcaaggcctggt

SEQ ID NO: 1366825 - DNA, 16 bp, Homo sapiens
ctgtgcagtcactgga

SEQ ID NO: 1366826 - DNA, 19 bp, Homo sapiens
ctgtgccttcttttgatta

SEQ ID NO: 1366827 - DNA, 22 bp, Homo sapiens
ctgtgcgtcttggtgtaatttg

SEQ ID NO: 1366828 - DNA, 15 bp, Homo sapiens
ctgtgctatgaattt

SEQ ID NO: 1366829 - DNA, 17 bp, Homo sapiens
ctgtgctgccctgaaga

SEQ ID NO: 1366830 - DNA, 13 bp, Homo sapiens
ctgtgctgtgtgt

SEQ ID NO: 1366831 - DNA, 17 bp, Homo sapiens
ctgtgcttcctcctgcc

SEQ ID NO: 1366832 - DNA, 16 bp, Homo sapiens
ctgtggatgccagggc

SEQ ID NO: 1366833 - DNA, 17 bp, Homo sapiens
ctgtggcacttgcctgg

SEQ ID NO: 1366834 - DNA, 14 bp, Homo sapiens
ctgtggcataaatt

SEQ ID NO: 1366835 - DNA, 20 bp, Homo sapiens
ctgtggcgccgtctccaggg

SEQ ID NO: 1366836 - DNA, 24 bp, Homo sapiens
ctgtggcgccgtctccaggggctg

SEQ ID NO: 1366837 - DNA, 21 bp, Homo sapiens
ctgtggggggtaatccctgct

SEQ ID NO: 1366838 - DNA, 17 bp, Homo sapiens
ctgtggttggctgggaa

SEQ ID NO: 1366839 - DNA, 14 bp, Homo sapiens
ctgtgtgtcagttt

SEQ ID NO: 1366840 - DNA, 15 bp, Homo sapiens
ctgtgttaatttaag

SEQ ID NO: 1366841 - DNA, 21 bp, Homo sapiens
ctgtgttaatttaagttttga

SEQ ID NO: 1366842 - DNA, 13 bp, Homo sapiens
ctgtgttgccaag

SEQ ID NO: 1366843 - DNA, 19 bp, Homo sapiens
ctgtgttgccaagctccaa

SEQ ID NO: 1366844 - DNA, 19 bp, Homo sapiens
ctgtgtttataaaatataa

SEQ ID NO: 1366845 - DNA, 15 bp, Homo sapiens
ctgttactgggccct

SEQ ID NO: 1366846 - DNA, 13 bp, Homo sapiens
ctgttatgggctt

SEQ ID NO: 1366847 - DNA, 15 bp, Homo sapiens
ctgttcactcactct

SEQ ID NO: 1366848 - DNA, 21 bp, Homo sapiens
ctgttcagctggttgaggttt

SEQ ID NO: 1366849 - DNA, 20 bp, Homo sapiens
ctgttcccatgtagccccct

SEQ ID NO: 1366850 - DNA, 16 bp, Homo sapiens
ctgttcctgttcagta

SEQ ID NO: 1366851 - DNA, 18 bp, Homo sapiens
ctgttcggaaggggttcc

SEQ ID NO: 1366852 - DNA, 21 bp, Homo sapiens
ctgttctgtggttcctctgct

SEQ ID NO: 1366853 - DNA, 18 bp, Homo sapiens
ctgttgacgcacctgtgg

SEQ ID NO: 1366854 - DNA, 18 bp, Homo sapiens
ctgttgataaaaactcag

SEQ ID NO: 1366855 - DNA, 15 bp, Homo sapiens
ctgttggcaggctgg

SEQ ID NO: 1366856 - DNA, 13 bp, Homo sapiens
ctgtttattactt

SEQ ID NO: 1366857 - DNA, 17 bp, Homo sapiens
ctgtttctgatttgctg

SEQ ID NO: 1366858 - DNA, 17 bp, Homo sapiens
ctgtttctgcttgctct

SEQ ID NO: 1366859 - DNA, 14 bp, Homo sapiens
ctgtttttttgtta

SEQ ID NO: 1366860 - DNA, 15 bp, Homo sapiens
cttaaaaactgaaaa

SEQ ID NO: 1366861 - DNA, 16 bp, Homo sapiens
cttaaaaagtggaaaa

SEQ ID NO: 1366862 - DNA, 13 bp, Homo sapiens
cttaaaacatcat

SEQ ID NO: 1366863 - DNA, 17 bp, Homo sapiens
cttaaaacatcattcct

SEQ ID NO: 1366864 - DNA, 18 bp, Homo sapiens
cttaaaacatcattcctt

SEQ ID NO: 1366865 - DNA, 19 bp, Homo sapiens
cttaaaacatcattccttt

SEQ ID NO: 1366866 - DNA, 13 bp, Homo sapiens
cttaaaaccaaag

SEQ ID NO: 1366867 - DNA, 15 bp, Homo sapiens
cttaaagttgtcact

SEQ ID NO: 1366868 - DNA, 16 bp, Homo sapiens
cttaaatgttattatc

SEQ ID NO: 1366869 - DNA, 20 bp, Homo sapiens
cttaaatttcttatgtgaca

SEQ ID NO: 1366870 - DNA, 22 bp, Homo sapiens
cttaaatttcttatgtgacatt

SEQ ID NO: 1366871 - DNA, 16 bp, Homo sapiens
cttaacagttgtattt

SEQ ID NO: 1366872 - DNA, 19 bp, Homo sapiens
cttaactgcatttttagac

SEQ ID NO: 1366873 - DNA, 20 bp, Homo sapiens
cttaagaaatgtataaactt

SEQ ID NO: 1366874 - DNA, 19 bp, Homo sapiens
cttaagacagagtatcctg

SEQ ID NO: 1366875 - DNA, 18 bp, Homo sapiens
cttaaggacaaagtgcca

SEQ ID NO: 1366876 - DNA, 21 bp, Homo sapiens
cttaagtgaggaaatcaaagt

SEQ ID NO: 1366877 - DNA, 15 bp, Homo sapiens
cttaataactgtgta

SEQ ID NO: 1366878 - DNA, 20 bp, Homo sapiens
cttaataactgtgtactgtt

SEQ ID NO: 1366879 - DNA, 23 bp, Homo sapiens
cttaatatatttctaaatgtttg

SEQ ID NO: 1366880 - DNA, 14 bp, Homo sapiens
cttaatcattttca

SEQ ID NO: 1366881 - DNA, 18 bp, Homo sapiens
cttaattgatgcaaataa

SEQ ID NO: 1366882 - DNA, 14 bp, Homo sapiens
cttaatttcctttt

SEQ ID NO: 1366883 - DNA, 21 bp, Homo sapiens
cttacaatattgattgggaaa

SEQ ID NO: 1366884 - DNA, 13 bp, Homo sapiens
cttaccattaaag

SEQ ID NO: 1366885 - DNA, 16 bp, Homo sapiens
cttacctagtgaaact

SEQ ID NO: 1366886 - DNA, 13 bp, Homo sapiens
cttacctcggtgc

SEQ ID NO: 1366887 - DNA, 19 bp, Homo sapiens
cttacctcggtgccttcct

SEQ ID NO: 1366888 - DNA, 21 bp, Homo sapiens
cttactaaaaagtataaaata

SEQ ID NO: 1366889 - DNA, 17 bp, Homo sapiens
cttactttgtaaattct

SEQ ID NO: 1366890 - DNA, 15 bp, Homo sapiens
cttagaatccctgtg

SEQ ID NO: 1366891 - DNA, 20 bp, Homo sapiens
cttagaatccctgtgttaat

SEQ ID NO: 1366892 - DNA, 15 bp, Homo sapiens
cttagggcaccaggg

SEQ ID NO: 1366893 - DNA, 17 bp, Homo sapiens
cttaggttggcaaaaag

SEQ ID NO: 1366894 - DNA, 23 bp, Homo sapiens
cttaggttggcaaaaaggcagga

SEQ ID NO: 1366895 - DNA, 23 bp, Homo sapiens
cttagtttgtgtgttgtctcttg

SEQ ID NO: 1366896 - DNA, 14 bp, Homo sapiens
cttataattgttct

SEQ ID NO: 1366897 - DNA, 16 bp, Homo sapiens
cttatagtctaagact

SEQ ID NO: 1366898 - DNA, 18 bp, Homo sapiens
cttatctccacaacctct

SEQ ID NO: 1366899 - DNA, 20 bp, Homo sapiens
cttatcttacaatattgatt

SEQ ID NO: 1366900 - DNA, 18 bp, Homo sapiens
cttatgaatgatttgcat

SEQ ID NO: 1366901 - DNA, 20 bp, Homo sapiens
cttatgaatgatttgcatat

SEQ ID NO: 1366902 - DNA, 15 bp, Homo sapiens
cttatgaggagggga

SEQ ID NO: 1366903 - DNA, 16 bp, Homo sapiens
cttattgaccattttt

SEQ ID NO: 1366904 - DNA, 18 bp, Homo sapiens
cttattgtttctctgaaa

SEQ ID NO: 1366905 - DNA, 14 bp, Homo sapiens
cttcacacagacac

SEQ ID NO: 1366906 - DNA, 20 bp, Homo sapiens
cttcacagtagagccagctt

SEQ ID NO: 1366907 - DNA, 17 bp, Homo sapiens
cttcaccatcaatcctg

SEQ ID NO: 1366908 - DNA, 20 bp, Homo sapiens
cttcaccatcaatcctgatt

SEQ ID NO: 1366909 - DNA, 15 bp, Homo sapiens
cttcacggaagagcc

SEQ ID NO: 1366910 - DNA, 20 bp, Homo sapiens
cttcactccagcctgggtga

SEQ ID NO: 1366911 - DNA, 22 bp, Homo sapiens
cttcagtcccttccccatgctt

SEQ ID NO: 1366912 - DNA, 14 bp, Homo sapiens
cttcagttgcttgt

SEQ ID NO: 1366913 - DNA, 23 bp, Homo sapiens
cttcagttgcttgtcttctggta

SEQ ID NO: 1366914 - DNA, 14 bp, Homo sapiens
cttcattattctct

SEQ ID NO: 1366915 - DNA, 18 bp, Homo sapiens
cttcattattttaaaaat

SEQ ID NO: 1366916 - DNA, 18 bp, Homo sapiens
cttccagatcactgccac

SEQ ID NO: 1366917 - DNA, 18 bp, Homo sapiens
cttccagatggtcatcca

SEQ ID NO: 1366918 - DNA, 20 bp, Homo sapiens
cttccagatggtcatccaga

SEQ ID NO: 1366919 - DNA, 12 bp, Homo sapiens
cttggctcagac

SEQ ID NO: 1366920 - DNA, 20 bp, Homo sapiens
cttggctcgaatctctgtgc

SEQ ID NO: 1366921 - DNA, 16 bp, Homo sapiens
cttgggaggctgaggc

SEQ ID NO: 1366922 - DNA, 15 bp, Homo sapiens
cttgggcagagctgg

SEQ ID NO: 1366923 - DNA, 19 bp, Homo sapiens
cttgggcagagctggctct

SEQ ID NO: 1366924 - DNA, 23 bp, Homo sapiens
cttgggcagagctggctctgagc

SEQ ID NO: 1366925 - DNA, 19 bp, Homo sapiens
cttggggcccagtgcatgg

SEQ ID NO: 1366926 - DNA, 14 bp, Homo sapiens
cttgggggggtggc

SEQ ID NO: 1366927 - DNA, 19 bp, Homo sapiens
cttgggggggtggccgctg

SEQ ID NO: 1366928 - DNA, 22 bp, Homo sapiens
cttgggggggtggccgctgagt

SEQ ID NO: 1366929 - DNA, 13 bp, Homo sapiens
cttgtaaagactg

SEQ ID NO: 1366930 - DNA, 14 bp, Homo sapiens
cttgtaaagactgg

SEQ ID NO: 1366931 - DNA, 15 bp, Homo sapiens
cttgtagttctttaa

SEQ ID NO: 1366932 - DNA, 17 bp, Homo sapiens
cttgtattaaagacaga

SEQ ID NO: 1366933 - DNA, 14 bp, Homo sapiens
cttgtctgatttct

SEQ ID NO: 1366934 - DNA, 16 bp, Homo sapiens
cttgtgaaaatgtgtt

SEQ ID NO: 1366935 - DNA, 17 bp, Homo sapiens
cttgtgattatttatta

SEQ ID NO: 1366936 - DNA, 22 bp, Homo sapiens
cttgtgatttctttaaaagaat

SEQ ID NO: 1366937 - DNA, 14 bp, Homo sapiens
cttgttacttctga

SEQ ID NO: 1366938 - DNA, 16 bp, Homo sapiens
cttgttattcaacagc

SEQ ID NO: 1366939 - DNA, 12 bp, Homo sapiens
cttgtttctgaa

SEQ ID NO: 1366940 - DNA, 17 bp, Homo sapiens
cttgttttggatggctt

SEQ ID NO: 1366941 - DNA, 12 bp, Homo sapiens
ctttaaaagaat

SEQ ID NO: 1366942 - DNA, 15 bp, Homo sapiens
ctttaaaagaatgac

SEQ ID NO: 1366943 - DNA, 16 bp, Homo sapiens
ctttaaaagaatgact

SEQ ID NO: 1366944 - DNA, 14 bp, Homo sapiens
ctttaaactgtcgt

SEQ ID NO: 1366945 - DNA, 15 bp, Homo sapiens
ctttaaccttgtata

SEQ ID NO: 1366946 - DNA, 14 bp, Homo sapiens
ctttacctgtatac

SEQ ID NO: 1366947 - DNA, 13 bp, Homo sapiens
ctttagacttgaa

SEQ ID NO: 1366948 - DNA, 22 bp, Homo sapiens
ctttaggagatttattttttgg

SEQ ID NO: 1366949 - DNA, 21 bp, Homo sapiens
ctttagtttttggttgggaat

SEQ ID NO: 1366950 - DNA, 13 bp, Homo sapiens
ctttatgtgaatt

SEQ ID NO: 1366951 - DNA, 14 bp, Homo sapiens
ctttattaatgttt

SEQ ID NO: 1366952 - DNA, 22 bp, Homo sapiens
ctttattaccccctccttcaga

SEQ ID NO: 1366953 - DNA, 13 bp, Homo sapiens
ctttattatttat

SEQ ID NO: 1366954 - DNA, 14 bp, Homo sapiens
ctttattatttatt

SEQ ID NO: 1366955 - DNA, 17 bp, Homo sapiens
ctttatttgtaaattta

SEQ ID NO: 1366956 - DNA, 19 bp, Homo sapiens
ctttattttgagatgtaaa

SEQ ID NO: 1366957 - DNA, 14 bp, Homo sapiens
ctttattttgtgta

SEQ ID NO: 1366958 - DNA, 17 bp, Homo sapiens
ctttattttgtgtaaaa

SEQ ID NO: 1366959 - DNA, 22 bp, Homo sapiens
ctttcaagcagtcgtgcctgtg

SEQ ID NO: 1366960 - DNA, 20 bp, Homo sapiens
ctttcaattgtcacttttta

SEQ ID NO: 1366961 - DNA, 14 bp, Homo sapiens
ctttcagaaagctt

SEQ ID NO: 1366962 - DNA, 22 bp, Homo sapiens
ctttcatggctgctgttgctta

SEQ ID NO: 1366963 - DNA, 16 bp, Homo sapiens
ctttccaaatgcccag

SEQ ID NO: 1366964 - DNA, 21 bp, Homo sapiens
ctttccaccacagccagcacc

SEQ ID NO: 1366965 - DNA, 11 bp, Homo sapiens
ctttcccaagc

SEQ ID NO: 1366966 - DNA, 17 bp, Homo sapiens
ctttcccatggggaggg

SEQ ID NO: 1366967 - DNA, 14 bp, Homo sapiens
ctttccctcacccc

SEQ ID NO: 1366968 - DNA, 16 bp, Homo sapiens
ctttcctctctatatt

SEQ ID NO: 1366969 - DNA, 17 bp, Homo sapiens
ctttcctctctatattt

SEQ ID NO: 1366970 - DNA, 18 bp, Homo sapiens
ctttcctctctatatttc

SEQ ID NO: 1366971 - DNA, 16 bp, Homo sapiens
ctttctatcctctgta

SEQ ID NO: 1366972 - DNA, 18 bp, Homo sapiens
ctttctcctttaattgta

SEQ ID NO: 1366973 - DNA, 22 bp, Homo sapiens
ctttctgccatctagccagccc

SEQ ID NO: 1366974 - DNA, 15 bp, Homo sapiens
ctttctgcctggagt

SEQ ID NO: 1366975 - DNA, 16 bp, Homo sapiens
ctttgaataaatgtgt

SEQ ID NO: 1366976 - DNA, 19 bp, Homo sapiens
ctttgagaagccttcagct

SEQ ID NO: 1366977 - DNA, 23 bp, Homo sapiens
ctttgagctcccacttctgccag

SEQ ID NO: 1366978 - DNA, 13 bp, Homo sapiens
ctttgatgtgttg

SEQ ID NO: 1366979 - DNA, 16 bp, Homo sapiens
ctttgatgtgttgttc

SEQ ID NO: 1366980 - DNA, 15 bp, Homo sapiens
ctttgattatttgca

SEQ ID NO: 1366981 - DNA, 19 bp, Homo sapiens
ctttgattatttgcatgtt

SEQ ID NO: 1366982 - DNA, 23 bp, Homo sapiens
ctttgcatattataaaggataaa

SEQ ID NO: 1366983 - DNA, 20 bp, Homo sapiens
ctttggacctaaatggcctc

SEQ ID NO: 1366984 - DNA, 14 bp, Homo sapiens
ctttgggaaaacat

SEQ ID NO: 1366985 - DNA, 14 bp, Homo sapiens
ctttggttctggcc

SEQ ID NO: 1366986 - DNA, 19 bp, Homo sapiens
ctttggttctggccagaat

SEQ ID NO: 1366987 - DNA, 19 bp, Homo sapiens
ctttggtttttttcttctg

SEQ ID NO: 1366988 - DNA, 16 bp, Homo sapiens
ctttgtaaaaatcttt

SEQ ID NO: 1366989 - DNA, 18 bp, Homo sapiens
ctttgtatagttatgtaa

SEQ ID NO: 1366990 - DNA, 16 bp, Homo sapiens
ctttgtattgtcctat

SEQ ID NO: 1366991 - DNA, 13 bp, Homo sapiens
ctttgtattttga

SEQ ID NO: 1366992 - DNA, 18 bp, Homo sapiens
ctttgtttcgtggggagg

SEQ ID NO: 1366993 - DNA, 18 bp, Homo sapiens
ctttgtttgttgtcagct

SEQ ID NO: 1366994 - DNA, 17 bp, Homo sapiens
ctttgttttctgactaa

SEQ ID NO: 1366995 - DNA, 13 bp, Homo sapiens
cttttaaaatgca

SEQ ID NO: 1366996 - DNA, 18 bp, Homo sapiens
cttttaaagaccctccta

SEQ ID NO: 1366997 - DNA, 22 bp, Homo sapiens
cttttaactgttgtagaagaca

SEQ ID NO: 1366998 - DNA, 16 bp, Homo sapiens
cttttataaagcatgt

SEQ ID NO: 1366999 - DNA, 16 bp, Homo sapiens
cttttattaatgcact

SEQ ID NO: 1367000 - DNA, 20 bp, Homo sapiens
cttttattttacacagaaac

SEQ ID NO: 1367001 - DNA, 13 bp, Homo sapiens
cttttcagggctg

SEQ ID NO: 1367002 - DNA, 17 bp, Homo sapiens
cttttcagggctggctc

SEQ ID NO: 1367003 - DNA, 17 bp, Homo sapiens
cttttcattctctttta

SEQ ID NO: 1367004 - DNA, 15 bp, Homo sapiens
cttttccttggcatt

SEQ ID NO: 1367005 - DNA, 20 bp, Homo sapiens
cttttctcaactgggtccag

SEQ ID NO: 1367006 - DNA, 14 bp, Homo sapiens
cttttctgccctgg

SEQ ID NO: 1367007 - DNA, 15 bp, Homo sapiens
cttttctgccctggc

SEQ ID NO: 1367008 - DNA, 13 bp, Homo sapiens
cttttctgtattt

SEQ ID NO: 1367009 - DNA, 18 bp, Homo sapiens
cttttctgtccgagcttt

SEQ ID NO: 1367010 - DNA, 24 bp, Homo sapiens
cttttgcaaccaggaacagcaaat

SEQ ID NO: 1367011 - DNA, 11 bp, Homo sapiens
cttttgctttt

SEQ ID NO: 1367012 - DNA, 15 bp, Homo sapiens
cttttgcttttggca

SEQ ID NO: 1367013 - DNA, 20 bp, Homo sapiens
cttttggtaaagactggctt

SEQ ID NO: 1367014 - DNA, 12 bp, Homo sapiens
cttttgtactga

SEQ ID NO: 1367015 - DNA, 21 bp, Homo sapiens
ctttttaaaaattgttattta

SEQ ID NO: 1367016 - DNA, 14 bp, Homo sapiens
ctttttaaaacaca

SEQ ID NO: 1367017 - DNA, 15 bp, Homo sapiens
ctttttatgctattt

SEQ ID NO: 1367018 - DNA, 18 bp, Homo sapiens
ctttttattaaaatattt

SEQ ID NO: 1367019 - DNA, 12 bp, Homo sapiens
ctttttatttat

SEQ ID NO: 1367020 - DNA, 20 bp, Homo sapiens
ctttttatttatatgtactg

SEQ ID NO: 1367021 - DNA, 15 bp, Homo sapiens
cttttttattaatca

SEQ ID NO: 1367022 - DNA, 19 bp, Homo sapiens
cttttttattaatcactgt

SEQ ID NO: 1367023 - DNA, 21 bp, Homo sapiens
cttttttattaatcactgtgt

SEQ ID NO: 1367024 - DNA, 16 bp, Homo sapiens
cttttttcaaaagaaa

SEQ ID NO: 1367025 - DNA, 22 bp, Homo sapiens
ctttttttctctgcatttaaaa

SEQ ID NO: 1367026 - DNA, 12 bp, Homo sapiens
ctttttttgtat

SEQ ID NO: 1367027 - DNA, 14 bp, Homo sapiens
ctttttttttaagt

SEQ ID NO: 1367028 - DNA, 14 bp, Homo sapiens
gaaaaaaatactat

SEQ ID NO: 1367029 - DNA, 22 bp, Homo sapiens
gaaaaaaatgtcaaaagtagaa

SEQ ID NO: 1367030 - DNA, 17 bp, Homo sapiens
gaaaaacacaagcaaaa

SEQ ID NO: 1367031 - DNA, 14 bp, Homo sapiens
gaaaaagatgtaca

SEQ ID NO: 1367032 - DNA, 15 bp, Homo sapiens
gaaaaaggctgtgct

SEQ ID NO: 1367033 - DNA, 16 bp, Homo sapiens
gaaaaaggctgtgctg

SEQ ID NO: 1367034 - DNA, 22 bp, Homo sapiens
gaaaaataaagacacctggttg

SEQ ID NO: 1367035 - DNA, 17 bp, Homo sapiens
gaaaaatagtgtctttg

SEQ ID NO: 1367036 - DNA, 16 bp, Homo sapiens
gaaaaatataaaatta

SEQ ID NO: 1367037 - DNA, 16 bp, Homo sapiens
gaaaaatatcttggcc

SEQ ID NO: 1367038 - DNA, 19 bp, Homo sapiens
gactcagccttcagacaga

SEQ ID NO: 1367039 - DNA, 12 bp, Homo sapiens
gactccagccag

SEQ ID NO: 1367040 - DNA, 14 bp, Homo sapiens
gactccagccagcg

SEQ ID NO: 1367041 - DNA, 16 bp, Homo sapiens
gactccagccagcgcc

SEQ ID NO: 1367042 - DNA, 19 bp, Homo sapiens
gactccagccagcgcctcc

SEQ ID NO: 1367043 - DNA, 16 bp, Homo sapiens
gactccgttggccact

SEQ ID NO: 1367044 - DNA, 17 bp, Homo sapiens
gactcgactctgtgcct

SEQ ID NO: 1367045 - DNA, 14 bp, Homo sapiens
gactcgggggtggg

SEQ ID NO: 1367046 - DNA, 13 bp, Homo sapiens
gactctgggtcct

SEQ ID NO: 1367047 - DNA, 16 bp, Homo sapiens
gactcttgagttgttt

SEQ ID NO: 1367048 - DNA, 21 bp, Homo sapiens
gactgaccttgtaaaagacag

SEQ ID NO: 1367049 - DNA, 15 bp, Homo sapiens
gactgactgaggcag

SEQ ID NO: 1367050 - DNA, 16 bp, Homo sapiens
gactgagtgggaagcc

SEQ ID NO: 1367051 - DNA, 17 bp, Homo sapiens
gactgagtgggaagccc

SEQ ID NO: 1367052 - DNA, 13 bp, Homo sapiens
gactgcccggcag

SEQ ID NO: 1367053 - DNA, 21 bp, Homo sapiens
gactgctttggacctaaatgg

SEQ ID NO: 1367054 - DNA, 10 bp, Homo sapiens
gactggcttt

SEQ ID NO: 1367055 - DNA, 17 bp, Homo sapiens
gactgggtaggaaagag

SEQ ID NO: 1367056 - DNA, 21 bp, Homo sapiens
gactgggtaggaaagaggaag

SEQ ID NO: 1367057 - DNA, 15 bp, Homo sapiens
gactggtgctgcagc

SEQ ID NO: 1367058 - DNA, 15 bp, Homo sapiens
gactggttttctgcc

SEQ ID NO: 1367059 - DNA, 13 bp, Homo sapiens
gactgtagggagg

SEQ ID NO: 1367060 - DNA, 23 bp, Homo sapiens
gactgtagggagggcggcagggg

SEQ ID NO: 1367061 - DNA, 19 bp, Homo sapiens
gactgtctcacttaatcct

SEQ ID NO: 1367062 - DNA, 17 bp, Homo sapiens
gactgtggcacttgcct

SEQ ID NO: 1367063 - DNA, 22 bp, Homo sapiens
gactgtgtattctagttttgtc

SEQ ID NO: 1367064 - DNA, 16 bp, Homo sapiens
gactgttttctcttga

SEQ ID NO: 1367065 - DNA, 21 bp, Homo sapiens
gacttaacatagccaaaatgt

SEQ ID NO: 1367066 - DNA, 12 bp, Homo sapiens
gacttagaatcc

SEQ ID NO: 1367067 - DNA, 18 bp, Homo sapiens
gacttccccggagggctg

SEQ ID NO: 1367068 - DNA, 16 bp, Homo sapiens
gacttctgcctggaga

SEQ ID NO: 1367069 - DNA, 17 bp, Homo sapiens
gacttgaaaagagacag

SEQ ID NO: 1367070 - DNA, 15 bp, Homo sapiens
gacttgtttttgcac

SEQ ID NO: 1367071 - DNA, 14 bp, Homo sapiens
gactttattattta

SEQ ID NO: 1367072 - DNA, 15 bp, Homo sapiens
gactttctgcctgga

SEQ ID NO: 1367073 - DNA, 18 bp, Homo sapiens
gactttctgcctggagtg

SEQ ID NO: 1367074 - DNA, 15 bp, Homo sapiens
gactttgtagatcct

SEQ ID NO: 1367075 - DNA, 23 bp, Homo sapiens
gagaaataaagtttgcttagaaa

SEQ ID NO: 1367076 - DNA, 13 bp, Homo sapiens
gagaacaggacta

SEQ ID NO: 1367077 - DNA, 19 bp, Homo sapiens
gagaacatgaatcaaaagt

SEQ ID NO: 1367078 - DNA, 13 bp, Homo sapiens
gagaaccaaatct

SEQ ID NO: 1367079 - DNA, 16 bp, Homo sapiens
gagaacccagtttccc

SEQ ID NO: 1367080 - DNA, 13 bp, Homo sapiens
gagaagcggctgg

SEQ ID NO: 1367081 - DNA, 15 bp, Homo sapiens
gagaagcggctggca

SEQ ID NO: 1367082 - DNA, 17 bp, Homo sapiens
gagaagcggctggcagc

SEQ ID NO: 1367083 - DNA, 14 bp, Homo sapiens
gagaagctgcatcc

SEQ ID NO: 1367084 - DNA, 12 bp, Homo sapiens
gagaaggaagcc

SEQ ID NO: 1367085 - DNA, 16 bp, Homo sapiens
gagaaggtttattgtt

SEQ ID NO: 1367086 - DNA, 16 bp, Homo sapiens
gagaagttgtaaagta

SEQ ID NO: 1367087 - DNA, 23 bp, Homo sapiens
gagaatggtgtgaacccgggagc

SEQ ID NO: 1367088 - DNA, 15 bp, Homo sapiens
gagacagatacctcc

SEQ ID NO: 1367089 - DNA, 16 bp, Homo sapiens
gagaccagggagcctt

SEQ ID NO: 1367090 - DNA, 21 bp, Homo sapiens
gagaccctgtctcaaaaaaag

SEQ ID NO: 1367091 - DNA, 20 bp, Homo sapiens
gagacgtttataaacagaaa

SEQ ID NO: 1367092 - DNA, 15 bp, Homo sapiens
gagactcagtgcaga

SEQ ID NO: 1367093 - DNA, 16 bp, Homo sapiens
gagactcgactctgtg

SEQ ID NO: 1367094 - DNA, 21 bp, Homo sapiens
gagacttagggcaccaggggt

SEQ ID NO: 1367095 - DNA, 14 bp, Homo sapiens
gagactttgatgtc

SEQ ID NO: 1367096 - DNA, 19 bp, Homo sapiens
gagactttgatgtcagcag

SEQ ID NO: 1367097 - DNA, 14 bp, Homo sapiens
gagagagagagaga

SEQ ID NO: 1367098 - DNA, 14 bp, Homo sapiens
gagagagagaggac

SEQ ID NO: 1367099 - DNA, 19 bp, Homo sapiens
gagagaggttgaaaaacaa

SEQ ID NO: 1367100 - DNA, 12 bp, Homo sapiens
gagagcataatt

SEQ ID NO: 1367101 - DNA, 15 bp, Homo sapiens
gagagcctgctggca

SEQ ID NO: 1367102 - DNA, 19 bp, Homo sapiens
gagaggacaatactggggt

SEQ ID NO: 1367103 - DNA, 23 bp, Homo sapiens
gagaggtgggccagtctgtggat

SEQ ID NO: 1367104 - DNA, 17 bp, Homo sapiens
gagagtatttttataca

SEQ ID NO: 1367105 - DNA, 19 bp, Homo sapiens
gagataattactgccttga

SEQ ID NO: 1367106 - DNA, 13 bp, Homo sapiens
gagatcagcctgg

SEQ ID NO: 1367107 - DNA, 14 bp, Homo sapiens
gagatcagcctggg

SEQ ID NO: 1367108 - DNA, 13 bp, Homo sapiens
gagatccaaagac

SEQ ID NO: 1367109 - DNA, 19 bp, Homo sapiens
gagatcgagaccatcctgg

SEQ ID NO: 1367110 - DNA, 21 bp, Homo sapiens
gagatgggaatgaggtgggag

SEQ ID NO: 1367111 - DNA, 20 bp, Homo sapiens
gagatgtatgtttggctctg

SEQ ID NO: 1367112 - DNA, 13 bp, Homo sapiens
gagattataataa

SEQ ID NO: 1367113 - DNA, 17 bp, Homo sapiens
gagattggttttcctgt

SEQ ID NO: 1367114 - DNA, 18 bp, Homo sapiens
gagatttcttgttgctca

SEQ ID NO: 1367115 - DNA, 19 bp, Homo sapiens
gagatttttaaaaaatatt

SEQ ID NO: 1367116 - DNA, 21 bp, Homo sapiens
gagcaggcacgggtggtcccc

SEQ ID NO: 1367117 - DNA, 16 bp, Homo sapiens
gagcatagtccaaaaa

SEQ ID NO: 1367118 - DNA, 18 bp, Homo sapiens
gagccagctccctctatt

SEQ ID NO: 1367119 - DNA, 20 bp, Homo sapiens
gagccctaaccccttccaga

SEQ ID NO: 1367120 - DNA, 21 bp, Homo sapiens
gagccctaaccccttccagat

SEQ ID NO: 1367121 - DNA, 17 bp, Homo sapiens
gagccctactccctgca

SEQ ID NO: 1367122 - DNA, 16 bp, Homo sapiens
gagcccttgcctcccc

SEQ ID NO: 1367123 - DNA, 17 bp, Homo sapiens
gagccggtaactgtcct

SEQ ID NO: 1367124 - DNA, 10 bp, Homo sapiens
gagcctgctg

SEQ ID NO: 1367125 - DNA, 13 bp, Homo sapiens
gagcctgggaggt

SEQ ID NO: 1367126 - DNA, 14 bp, Homo sapiens
gagccttaaaacat

SEQ ID NO: 1367127 - DNA, 19 bp, Homo sapiens
gagccttagccgcccatgc

SEQ ID NO: 1367128 - DNA, 17 bp, Homo sapiens
gagccttctcagaagca

SEQ ID NO: 1367129 - DNA, 18 bp, Homo sapiens
gagccttctcagaagcac

SEQ ID NO: 1367130 - DNA, 23 bp, Homo sapiens
gagcctttggttctggccagaat

SEQ ID NO: 1367131 - DNA, 20 bp, Homo sapiens
gagcctttttaaaacacatg

SEQ ID NO: 1367132 - DNA, 23 bp, Homo sapiens
gagcgcctccatccaaggccagg

SEQ ID NO: 1367133 - DNA, 13 bp, Homo sapiens
gagctccactctg

SEQ ID NO: 1367134 - DNA, 18 bp, Homo sapiens
gagctccactctgcttct

SEQ ID NO: 1367135 - DNA, 15 bp, Homo sapiens
gagctctgaaatctt

SEQ ID NO: 1367136 - DNA, 19 bp, Homo sapiens
gagctctgaaatcttccca

SEQ ID NO: 1367137 - DNA, 11 bp, Homo sapiens
gagctgccagt

SEQ ID NO: 1367138 - DNA, 13 bp, Homo sapiens
gagctgccagtgg

SEQ ID NO: 1367139 - DNA, 11 bp, Homo sapiens
gagctgccttc

SEQ ID NO: 1367140 - DNA, 23 bp, Homo sapiens
gagctgccttccctagctttaga

SEQ ID NO: 1367141 - DNA, 18 bp, Homo sapiens
gagctgccttggctcaga

SEQ ID NO: 1367142 - DNA, 11 bp, Homo sapiens
gagctggcctc

SEQ ID NO: 1367143 - DNA, 17 bp, Homo sapiens
gagctggctctgagcgc

SEQ ID NO: 1367144 - DNA, 16 bp, Homo sapiens
gagctgggcccgacat

SEQ ID NO: 1367145 - DNA, 21 bp, Homo sapiens
gagcttaatgctacatgtgag

SEQ ID NO: 1367146 - DNA, 20 bp, Homo sapiens
gagctttgaaaattcagtgg

SEQ ID NO: 1367147 - DNA, 12 bp, Homo sapiens
gaggaaatcaaa

SEQ ID NO: 1367148 - DNA, 13 bp, Homo sapiens
gaggaaggcaaga

SEQ ID NO: 1367149 - DNA, 21 bp, Homo sapiens
gaggaaggcaagagggggtgg

SEQ ID NO: 1367150 - DNA, 16 bp, Homo sapiens
gaggaatcctggcagc

SEQ ID NO: 1367151 - DNA, 17 bp, Homo sapiens
gaggaatcctggcagcc

SEQ ID NO: 1367152 - DNA, 20 bp, Homo sapiens
gaggaatcctggcagcccag

SEQ ID NO: 1367153 - DNA, 15 bp, Homo sapiens
gaggaatgaaaaaag

SEQ ID NO: 1367154 - DNA, 14 bp, Homo sapiens
gaggaccagggcct

SEQ ID NO: 1367155 - DNA, 13 bp, Homo sapiens
gaggagccttttt

SEQ ID NO: 1367156 - DNA, 17 bp, Homo sapiens
gaggagggagagggagg

SEQ ID NO: 1367157 - DNA, 20 bp, Homo sapiens
gatgcaggctcccctgagga

SEQ ID NO: 1367158 - DNA, 17 bp, Homo sapiens
gatgcatgtcttttaaa

SEQ ID NO: 1367159 - DNA, 18 bp, Homo sapiens
gatgccagttacttgctt

SEQ ID NO: 1367160 - DNA, 23 bp, Homo sapiens
gatgctgccagggcgccatcgcc

SEQ ID NO: 1367161 - DNA, 23 bp, Homo sapiens
gatgcttctcactgccatgccag

SEQ ID NO: 1367162 - DNA, 18 bp, Homo sapiens
gatggaaaagtgtccttc

SEQ ID NO: 1367163 - DNA, 15 bp, Homo sapiens
gatggccccagcaca

SEQ ID NO: 1367164 - DNA, 16 bp, Homo sapiens
gatggtgtggcctgtg

SEQ ID NO: 1367165 - DNA, 15 bp, Homo sapiens
gatgtcaatttctgt

SEQ ID NO: 1367166 - DNA, 18 bp, Homo sapiens
gatgtcaatttctgtgtt

SEQ ID NO: 1367167 - DNA, 17 bp, Homo sapiens
gatgtcagcagttgctg

SEQ ID NO: 1367168 - DNA, 20 bp, Homo sapiens
gatgtgcaaaaccttttact

SEQ ID NO: 1367169 - DNA, 21 bp, Homo sapiens
gatgtggctactgacatatct

SEQ ID NO: 1367170 - DNA, 17 bp, Homo sapiens
gatgttgccatgtgttt

SEQ ID NO: 1367171 - DNA, 12 bp, Homo sapiens
gatgtttccaga

SEQ ID NO: 1367172 - DNA, 19 bp, Homo sapiens
gatgtttccagacttcctt

SEQ ID NO: 1367173 - DNA, 12 bp, Homo sapiens
gattaaatacat

SEQ ID NO: 1367174 - DNA, 15 bp, Homo sapiens
gattatggttttgtg

SEQ ID NO: 1367175 - DNA, 16 bp, Homo sapiens
gattatggttttgtga

SEQ ID NO: 1367176 - DNA, 13 bp, Homo sapiens
gattatttgcatg

SEQ ID NO: 1367177 - DNA, 14 bp, Homo sapiens
gattatttgcatgt

SEQ ID NO: 1367178 - DNA, 22 bp, Homo sapiens
gattcagtcacatggcatggtt

SEQ ID NO: 1367179 - DNA, 12 bp, Homo sapiens
gattcatgattt

SEQ ID NO: 1367180 - DNA, 20 bp, Homo sapiens
gattccactacacctggctg

SEQ ID NO: 1367181 - DNA, 13 bp, Homo sapiens
gattcccttgtta

SEQ ID NO: 1367182 - DNA, 16 bp, Homo sapiens
gattcccttgttattc

SEQ ID NO: 1367183 - DNA, 17 bp, Homo sapiens
gattcctctctaagtgg

SEQ ID NO: 1367184 - DNA, 17 bp, Homo sapiens
gattcggtatcccccca

SEQ ID NO: 1367185 - DNA, 14 bp, Homo sapiens
gattctaaatacat

SEQ ID NO: 1367186 - DNA, 16 bp, Homo sapiens
gattcttctgtgttta

SEQ ID NO: 1367187 - DNA, 16 bp, Homo sapiens
gattgcaccactgcac

SEQ ID NO: 1367188 - DNA, 14 bp, Homo sapiens
gattgcctctgaaa

SEQ ID NO: 1367189 - DNA, 12 bp, Homo sapiens
gatttaaatcag

SEQ ID NO: 1367190 - DNA, 12 bp, Homo sapiens
gatttattaact

SEQ ID NO: 1367191 - DNA, 15 bp, Homo sapiens
gatttcagaagccta

SEQ ID NO: 1367192 - DNA, 22 bp, Homo sapiens
gatttccagaaccacacttgaa

SEQ ID NO: 1367193 - DNA, 19 bp, Homo sapiens
gatttggcactagccaaag

SEQ ID NO: 1367194 - DNA, 22 bp, Homo sapiens
gatttgttgccatgtgcacctt

SEQ ID NO: 1367195 - DNA, 22 bp, Homo sapiens
gattttaatagggaatatatct

SEQ ID NO: 1367196 - DNA, 17 bp, Homo sapiens
gattttacagagcgcac

SEQ ID NO: 1367197 - DNA, 13 bp, Homo sapiens
gattttccaaatg

SEQ ID NO: 1367198 - DNA, 17 bp, Homo sapiens
gatttttaaaaaatatt

SEQ ID NO: 1367199 - DNA, 15 bp, Homo sapiens
gcaaaaccttttact

SEQ ID NO: 1367200 - DNA, 16 bp, Homo sapiens
gcaaaaccttttactg

SEQ ID NO: 1367201 - DNA, 22 bp, Homo sapiens
gcaaaactctacttaatccaat

SEQ ID NO: 1367202 - DNA, 23 bp, Homo sapiens
gcaaaactctacttaatccaatg

SEQ ID NO: 1367203 - DNA, 16 bp, Homo sapiens
gcaaaagatgcttctc

SEQ ID NO: 1367204 - DNA, 23 bp, Homo sapiens
gcaaaaggcctcttgtaaagact

SEQ ID NO: 1367205 - DNA, 13 bp, Homo sapiens
gcaaaatacatga

SEQ ID NO: 1367206 - DNA, 14 bp, Homo sapiens
gcaaaatacatgaa

SEQ ID NO: 1367207 - DNA, 10 bp, Homo sapiens
gcaaaatatg

SEQ ID NO: 1367208 - DNA, 13 bp, Homo sapiens
gcaaaatatgttt

SEQ ID NO: 1367209 - DNA, 16 bp, Homo sapiens
gcaaagatttaatctg

SEQ ID NO: 1367210 - DNA, 22 bp, Homo sapiens
gcaaagggcctgcccagacaag

SEQ ID NO: 1367211 - DNA, 20 bp, Homo sapiens
gcaaatcagaaacttgtgaa

SEQ ID NO: 1367212 - DNA, 22 bp, Homo sapiens
gcaaatcagaaacttgtgaagt

SEQ ID NO: 1367213 - DNA, 16 bp, Homo sapiens
gcaaatgagctctgaa

SEQ ID NO: 1367214 - DNA, 12 bp, Homo sapiens
gcaaatgttaaa

SEQ ID NO: 1367215 - DNA, 15 bp, Homo sapiens
gcaacaacaattggt

SEQ ID NO: 1367216 - DNA, 15 bp, Homo sapiens
gcaacacagcctggg

SEQ ID NO: 1367217 - DNA, 18 bp, Homo sapiens
gcaacacagcctgggccc

SEQ ID NO: 1367218 - DNA, 23 bp, Homo sapiens
gcaacacagcctgggccccagct

SEQ ID NO: 1367219 - DNA, 15 bp, Homo sapiens
gcaaccaagtcacac

SEQ ID NO: 1367220 - DNA, 14 bp, Homo sapiens
gcaaccactaagaa

SEQ ID NO: 1367221 - DNA, 20 bp, Homo sapiens
gcaacgatcacaaatgactt

SEQ ID NO: 1367222 - DNA, 21 bp, Homo sapiens
gcaacgatcacaaatgacttt

SEQ ID NO: 1367223 - DNA, 22 bp, Homo sapiens
gcaacggtctcctgactggtgc

SEQ ID NO: 1367224 - DNA, 14 bp, Homo sapiens
gcaagatgtgaatt

SEQ ID NO: 1367225 - DNA, 13 bp, Homo sapiens
gcaagcagaggac

SEQ ID NO: 1367226 - DNA, 21 bp, Homo sapiens
gcaagcagaggaccagggcct

SEQ ID NO: 1367227 - DNA, 16 bp, Homo sapiens
gcaagcatgcttgtga

SEQ ID NO: 1367228 - DNA, 14 bp, Homo sapiens
gcaaggactttgta

SEQ ID NO: 1367229 - DNA, 16 bp, Homo sapiens
gcaaggactttgtaca

SEQ ID NO: 1367230 - DNA, 15 bp, Homo sapiens
gcaaggctatgtgat

SEQ ID NO: 1367231 - DNA, 12 bp, Homo sapiens
gcaagtgctgga

SEQ ID NO: 1367232 - DNA, 15 bp, Homo sapiens
gcaagtgctggagtc

SEQ ID NO: 1367233 - DNA, 12 bp, Homo sapiens
gcaataaaattt

SEQ ID NO: 1367234 - DNA, 19 bp, Homo sapiens
gcaataaaatttaaaaaat

SEQ ID NO: 1367235 - DNA, 21 bp, Homo sapiens
gcaataaaatttaaaaaataa

SEQ ID NO: 1367236 - DNA, 14 bp, Homo sapiens
gcaataaattttga

SEQ ID NO: 1367237 - DNA, 15 bp, Homo sapiens
gcaataaattttgaa

SEQ ID NO: 1367238 - DNA, 16 bp, Homo sapiens
gcaataaattttgaaa

SEQ ID NO: 1367239 - DNA, 12 bp, Homo sapiens
gcaatagaaaca

SEQ ID NO: 1367240 - DNA, 18 bp, Homo sapiens
gcaatatttgaattttaa

SEQ ID NO: 1367241 - DNA, 19 bp, Homo sapiens
gcaatcaaggttataattt

SEQ ID NO: 1367242 - DNA, 17 bp, Homo sapiens
gcaatctcttcattatt

SEQ ID NO: 1367243 - DNA, 22 bp, Homo sapiens
gcacaagctgcaccctcaggca

SEQ ID NO: 1367244 - DNA, 16 bp, Homo sapiens
gcacaccaatcttact

SEQ ID NO: 1367245 - DNA, 17 bp, Homo sapiens
gcacaccaatcttactt

SEQ ID NO: 1367246 - DNA, 14 bp, Homo sapiens
gcacagaatatttt

SEQ ID NO: 1367247 - DNA, 20 bp, Homo sapiens
gcacagctcaggaggcgccc

SEQ ID NO: 1367248 - DNA, 14 bp, Homo sapiens
gcacagcttgacct

SEQ ID NO: 1367249 - DNA, 20 bp, Homo sapiens
gcacagcttgacctgaggct

SEQ ID NO: 1367250 - DNA, 22 bp, Homo sapiens
gcacaggaggcaggcatggccc

SEQ ID NO: 1367251 - DNA, 16 bp, Homo sapiens
gcacagtgaagtgctg

SEQ ID NO: 1367252 - DNA, 19 bp, Homo sapiens
gcacatccgcgtgtgcctg

SEQ ID NO: 1367253 - DNA, 12 bp, Homo sapiens
gcacatgtttcc

SEQ ID NO: 1367254 - DNA, 14 bp, Homo sapiens
gcacattgagctgt

SEQ ID NO: 1367255 - DNA, 13 bp, Homo sapiens
gcaccaccaagcc

SEQ ID NO: 1367256 - DNA, 14 bp, Homo sapiens
gcaccaccaagcca

SEQ ID NO: 1367257 - DNA, 23 bp, Homo sapiens
gcaccacgggacatcacagggtg

SEQ ID NO: 1367258 - DNA, 14 bp, Homo sapiens
gcaccaggaagccg

SEQ ID NO: 1367259 - DNA, 19 bp, Homo sapiens
gcaccaggggtttctcgca

SEQ ID NO: 1367260 - DNA, 23 bp, Homo sapiens
gcaccattctgactcggtttctc

SEQ ID NO: 1367261 - DNA, 22 bp, Homo sapiens
gcaccccttctctcctccccaa

SEQ ID NO: 1367262 - DNA, 15 bp, Homo sapiens
gcaccctcaggcagg

SEQ ID NO: 1367263 - DNA, 13 bp, Homo sapiens
gcacctcagcctg

SEQ ID NO: 1367264 - DNA, 14 bp, Homo sapiens
gcaccttgtgcctg

SEQ ID NO: 1367265 - DNA, 19 bp, Homo sapiens
gcaccttgtgcctggggtg

SEQ ID NO: 1367266 - DNA, 16 bp, Homo sapiens
gcacgggtggtccccg

SEQ ID NO: 1367267 - DNA, 17 bp, Homo sapiens
gcactaaatcagagaca

SEQ ID NO: 1367268 - DNA, 17 bp, Homo sapiens
gcactccagcctgggtg

SEQ ID NO: 1367269 - DNA, 19 bp, Homo sapiens
gcactcctcggtactccca

SEQ ID NO: 1367270 - DNA, 18 bp, Homo sapiens
gcactcttgttcccacac

SEQ ID NO: 1367271 - DNA, 16 bp, Homo sapiens
gcactgactgggcata

SEQ ID NO: 1367272 - DNA, 18 bp, Homo sapiens
gcactgttgagaaggaga

SEQ ID NO: 1367273 - DNA, 17 bp, Homo sapiens
gcagaaaaaggctgtgc

SEQ ID NO: 1367274 - DNA, 20 bp, Homo sapiens
gcagacaataaaccctcaga

SEQ ID NO: 1367275 - DNA, 19 bp, Homo sapiens
gcagagcgcgcccctagcc

SEQ ID NO: 1367276 - DNA, 22 bp, Homo sapiens
gccggggaagagatccaaagac

SEQ ID NO: 1367277 - DNA, 20 bp, Homo sapiens
gccgtatctccggctcccag

SEQ ID NO: 1367278 - DNA, 21 bp, Homo sapiens
gccgtatctccggctcccagc

SEQ ID NO: 1367279 - DNA, 16 bp, Homo sapiens
gccgtctccaggggct

SEQ ID NO: 1367280 - DNA, 20 bp, Homo sapiens
gccgtggggccgccgcctct

SEQ ID NO: 1367281 - DNA, 14 bp, Homo sapiens
gcctaccccgcaga

SEQ ID NO: 1367282 - DNA, 14 bp, Homo sapiens
gcctagcacagcag

SEQ ID NO: 1367283 - DNA, 21 bp, Homo sapiens
gcctagcgatctctcctggcc

SEQ ID NO: 1367284 - DNA, 17 bp, Homo sapiens
gcctagggcccccacag

SEQ ID NO: 1367285 - DNA, 19 bp, Homo sapiens
gcctataagccaaaattaa

SEQ ID NO: 1367286 - DNA, 22 bp, Homo sapiens
gcctataagccaaaattaaggt

SEQ ID NO: 1367287 - DNA, 13 bp, Homo sapiens
gcctatccgctgc

SEQ ID NO: 1367288 - DNA, 18 bp, Homo sapiens
gcctatccgctgccagcc

SEQ ID NO: 1367289 - DNA, 16 bp, Homo sapiens
gcctatggcagaaaaa

SEQ ID NO: 1367290 - DNA, 15 bp, Homo sapiens
gcctattgatacttg

SEQ ID NO: 1367291 - DNA, 19 bp, Homo sapiens
gcctcactaatttttgtat

SEQ ID NO: 1367292 - DNA, 21 bp, Homo sapiens
gcctccacagcgagggcagct

SEQ ID NO: 1367293 - DNA, 23 bp, Homo sapiens
gcctccacagcgagggcagctgc

SEQ ID NO: 1367294 - DNA, 12 bp, Homo sapiens
gcctccagaact

SEQ ID NO: 1367295 - DNA, 17 bp, Homo sapiens
gcctccagaactcactg

SEQ ID NO: 1367296 - DNA, 19 bp, Homo sapiens
gcctccagaactcactggg

SEQ ID NO: 1367297 - DNA, 16 bp, Homo sapiens
gcctccatccaaggcc

SEQ ID NO: 1367298 - DNA, 19 bp, Homo sapiens
gcctccccatttcccatct

SEQ ID NO: 1367299 - DNA, 21 bp, Homo sapiens
gcctccccatttcccatctgc

SEQ ID NO: 1367300 - DNA, 14 bp, Homo sapiens
gcctcccctgccac

SEQ ID NO: 1367301 - DNA, 16 bp, Homo sapiens
gcctcccctgccacca

SEQ ID NO: 1367302 - DNA, 19 bp, Homo sapiens
gcctcccctgccaccaggc

SEQ ID NO: 1367303 - DNA, 16 bp, Homo sapiens
gcctccctccacccca

SEQ ID NO: 1367304 - DNA, 17 bp, Homo sapiens
gcctccctccaccccag

SEQ ID NO: 1367305 - DNA, 20 bp, Homo sapiens
gcctccctccaccccaggac

SEQ ID NO: 1367306 - DNA, 21 bp, Homo sapiens
gcctccctccaccccaggacg

SEQ ID NO: 1367307 - DNA, 17 bp, Homo sapiens
gcctcctctggacggca

SEQ ID NO: 1367308 - DNA, 13 bp, Homo sapiens
gcctcggcccctc

SEQ ID NO: 1367309 - DNA, 15 bp, Homo sapiens
gcctctcagtgccct

SEQ ID NO: 1367310 - DNA, 19 bp, Homo sapiens
gcctctcagtgccctccag

SEQ ID NO: 1367311 - DNA, 18 bp, Homo sapiens
gcctctccccaggtccag

SEQ ID NO: 1367312 - DNA, 20 bp, Homo sapiens
gcctctccccaggtccagct

SEQ ID NO: 1367313 - DNA, 22 bp, Homo sapiens
gcctctccccaggtccagctct

SEQ ID NO: 1367314 - DNA, 11 bp, Homo sapiens
gcctctgtgct

SEQ ID NO: 1367315 - DNA, 14 bp, Homo sapiens
gcctctgtgctgtg

SEQ ID NO: 1367316 - DNA, 15 bp, Homo sapiens
gcctcttgaccaggc

SEQ ID NO: 1367317 - DNA, 20 bp, Homo sapiens
gcctcttgaccaggctgcct

SEQ ID NO: 1367318 - DNA, 16 bp, Homo sapiens
gcctcttgtaaagact

SEQ ID NO: 1367319 - DNA, 18 bp, Homo sapiens
gcctcttgtaaagactgg

SEQ ID NO: 1367320 - DNA, 16 bp, Homo sapiens
gcctctttccctagga

SEQ ID NO: 1367321 - DNA, 11 bp, Homo sapiens
gcctgaataaa

SEQ ID NO: 1367322 - DNA, 16 bp, Homo sapiens
gcctgagaggcaggca

SEQ ID NO: 1367323 - DNA, 20 bp, Homo sapiens
gcctgagaggcaggcataga

SEQ ID NO: 1367324 - DNA, 13 bp, Homo sapiens
gcctgatctgccc

SEQ ID NO: 1367325 - DNA, 15 bp, Homo sapiens
gcctgatctgcccat

SEQ ID NO: 1367326 - DNA, 21 bp, Homo sapiens
gcctgatgacaataaagcttg

SEQ ID NO: 1367327 - DNA, 17 bp, Homo sapiens
gcctgcactcctcaggg

SEQ ID NO: 1367328 - DNA, 20 bp, Homo sapiens
gcctgcagggaagccccaca

SEQ ID NO: 1367329 - DNA, 16 bp, Homo sapiens
gcctgcagggccatgg

SEQ ID NO: 1367330 - DNA, 13 bp, Homo sapiens
gcctgcctcccac

SEQ ID NO: 1367331 - DNA, 20 bp, Homo sapiens
gcctgccttaagtgaggaaa

SEQ ID NO: 1367332 - DNA, 16 bp, Homo sapiens
gcctgcgcctgctgca

SEQ ID NO: 1367333 - DNA, 23 bp, Homo sapiens
gcctgctagctagctcaactagt

SEQ ID NO: 1367334 - DNA, 18 bp, Homo sapiens
gcctgctgcatgccctct

SEQ ID NO: 1367335 - DNA, 13 bp, Homo sapiens
gcctgctggcacc

SEQ ID NO: 1367336 - DNA, 16 bp, Homo sapiens
gcctgctggcacccac

SEQ ID NO: 1367337 - DNA, 19 bp, Homo sapiens
gcctgctggcacccaccgt

SEQ ID NO: 1367338 - DNA, 21 bp, Homo sapiens
gcctgctttgaataaatgtgt

SEQ ID NO: 1367339 - DNA, 17 bp, Homo sapiens
gcctggagacttagggc

SEQ ID NO: 1367340 - DNA, 23 bp, Homo sapiens
gcctggagacttagggcaccagg

SEQ ID NO: 1367341 - DNA, 18 bp, Homo sapiens
gcctggagatcctcctgc

SEQ ID NO: 1367342 - DNA, 19 bp, Homo sapiens
gcctggagatcctcctgca

SEQ ID NO: 1367343 - DNA, 24 bp, Homo sapiens
gcctggagtgtatgactgcacatg

SEQ ID NO: 1367344 - DNA, 15 bp, Homo sapiens
gcctggccaggagca

SEQ ID NO: 1367345 - DNA, 20 bp, Homo sapiens
gcctggcccccaacctcagg

SEQ ID NO: 1367346 - DNA, 16 bp, Homo sapiens
gcctgggccgctgcca

SEQ ID NO: 1367347 - DNA, 17 bp, Homo sapiens
gcctgggccgctgccac

SEQ ID NO: 1367348 - DNA, 18 bp, Homo sapiens
gcctgggccgctgccacg

SEQ ID NO: 1367349 - DNA, 22 bp, Homo sapiens
gcctgggccgtatctccggctc

SEQ ID NO: 1367350 - DNA, 20 bp, Homo sapiens
gcctgggcgacagagcgaga

SEQ ID NO: 1367351 - DNA, 21 bp, Homo sapiens
gcctgggctgaccccggtggc

SEQ ID NO: 1367352 - DNA, 22 bp, Homo sapiens
gcctggggctgaggctgaggca

SEQ ID NO: 1367353 - DNA, 21 bp, Homo sapiens
gcctggggtgttagtggcacc

SEQ ID NO: 1367354 - DNA, 15 bp, Homo sapiens
gcctgggttgggggc

SEQ ID NO: 1367355 - DNA, 15 bp, Homo sapiens
gcctgtaatcctagc

SEQ ID NO: 1367356 - DNA, 19 bp, Homo sapiens
gcctgtggcgccgtctcca

SEQ ID NO: 1367357 - DNA, 21 bp, Homo sapiens
gcctgtggcgccgtctccagg

SEQ ID NO: 1367358 - DNA, 23 bp, Homo sapiens
gcctgtggctgtcggtgggactc

SEQ ID NO: 1367359 - DNA, 19 bp, Homo sapiens
gcctgtgtccatgcgctca

SEQ ID NO: 1367360 - DNA, 16 bp, Homo sapiens
gccttaaaacatcatt

SEQ ID NO: 1367361 - DNA, 14 bp, Homo sapiens
gccttaaaaccaaa

SEQ ID NO: 1367362 - DNA, 17 bp, Homo sapiens
gccttaaaaccaaagag

SEQ ID NO: 1367363 - DNA, 23 bp, Homo sapiens
gccttaatttcctttttgacact

SEQ ID NO: 1367364 - DNA, 13 bp, Homo sapiens
gccttcctctctc

SEQ ID NO: 1367365 - DNA, 15 bp, Homo sapiens
gccttctcagaagca

SEQ ID NO: 1367366 - DNA, 16 bp, Homo sapiens
gccttgagccctggct

SEQ ID NO: 1367367 - DNA, 20 bp, Homo sapiens
gccttgattcccttgttatt

SEQ ID NO: 1367368 - DNA, 19 bp, Homo sapiens
gccttgctgtttgtcctga

SEQ ID NO: 1367369 - DNA, 22 bp, Homo sapiens
gccttgctgtttgtcctgagat

SEQ ID NO: 1367370 - DNA, 14 bp, Homo sapiens
gccttggaaattcc

SEQ ID NO: 1367371 - DNA, 16 bp, Homo sapiens
gccttggctcagacat

SEQ ID NO: 1367372 - DNA, 13 bp, Homo sapiens
gcctttcctctct

SEQ ID NO: 1367373 - DNA, 21 bp, Homo sapiens
gcctttgcagctcagaaccac

SEQ ID NO: 1367374 - DNA, 16 bp, Homo sapiens
gccttttctggcaccg

SEQ ID NO: 1367375 - DNA, 22 bp, Homo sapiens
gccttttctggcaccgcagttt

SEQ ID NO: 1367376 - DNA, 18 bp, Homo sapiens
gccttttgcaaccaggaa

SEQ ID NO: 1367377 - DNA, 17 bp, Homo sapiens
gcgaaccctttatttga

SEQ ID NO: 1367378 - DNA, 17 bp, Homo sapiens
gcgactaaactagattt

SEQ ID NO: 1367379 - DNA, 14 bp, Homo sapiens
gcgactttctgcct

SEQ ID NO: 1367380 - DNA, 16 bp, Homo sapiens
gcgactttctgcctgg

SEQ ID NO: 1367381 - DNA, 18 bp, Homo sapiens
gcgagactccgtctcaaa

SEQ ID NO: 1367382 - DNA, 14 bp, Homo sapiens
gcgagggcagctgc

SEQ ID NO: 1367383 - DNA, 15 bp, Homo sapiens
gcgagggcagctgct

SEQ ID NO: 1367384 - DNA, 17 bp, Homo sapiens
gcgcagtgttttgcaag

SEQ ID NO: 1367385 - DNA, 18 bp, Homo sapiens
gcgcatcttgcctccagg

SEQ ID NO: 1367386 - DNA, 14 bp, Homo sapiens
gcgccacaggaccc

SEQ ID NO: 1367387 - DNA, 15 bp, Homo sapiens
gcgccaccagctctg

SEQ ID NO: 1367388 - DNA, 12 bp, Homo sapiens
gcgcccctagcc

SEQ ID NO: 1367389 - DNA, 13 bp, Homo sapiens
gcgcccctagccg

SEQ ID NO: 1367390 - DNA, 13 bp, Homo sapiens
gcgccgtctccag

SEQ ID NO: 1367391 - DNA, 19 bp, Homo sapiens
gcgcctccctccaccccag

SEQ ID NO: 1367392 - DNA, 23 bp, Homo sapiens
gcgcctccctccaccccaggacg

SEQ ID NO: 1367393 - DNA, 15 bp, Homo sapiens
gcgcgcccctagccg

SEQ ID NO: 1367394 - DNA, 22 bp, Homo sapiens
ggaaaccgagtagaaaatgtga

SEQ ID NO: 1367395 - DNA, 20 bp, Homo sapiens
ggaaagacactgcctgggct

SEQ ID NO: 1367396 - DNA, 12 bp, Homo sapiens
ggaaaggggaga

SEQ ID NO: 1367397 - DNA, 14 bp, Homo sapiens
ggaaaggggagagc

SEQ ID NO: 1367398 - DNA, 23 bp, Homo sapiens
ggaaagtggccaagaagcagtgg

SEQ ID NO: 1367399 - DNA, 17 bp, Homo sapiens
ggaaatcaaagtgctat

SEQ ID NO: 1367400 - DNA, 23 bp, Homo sapiens
ggaaatcagccaagttttataat

SEQ ID NO: 1367401 - DNA, 18 bp, Homo sapiens
ggaaatgttttgtaaaca

SEQ ID NO: 1367402 - DNA, 16 bp, Homo sapiens
ggaaattcctgtactg

SEQ ID NO: 1367403 - DNA, 14 bp, Homo sapiens
ggaacatactgttc

SEQ ID NO: 1367404 - DNA, 16 bp, Homo sapiens
ggaacctccccagcct

SEQ ID NO: 1367405 - DNA, 17 bp, Homo sapiens
ggaacctccccagcctg

SEQ ID NO: 1367406 - DNA, 15 bp, Homo sapiens
ggaagaagggagaag

SEQ ID NO: 1367407 - DNA, 16 bp, Homo sapiens
ggaagaagggagaaga

SEQ ID NO: 1367408 - DNA, 14 bp, Homo sapiens
ggaagacaatgtga

SEQ ID NO: 1367409 - DNA, 14 bp, Homo sapiens
ggaagagatccaaa

SEQ ID NO: 1367410 - DNA, 17 bp, Homo sapiens
ggaagagatccaaagac

SEQ ID NO: 1367411 - DNA, 18 bp, Homo sapiens
ggaagagatccaaagact

SEQ ID NO: 1367412 - DNA, 12 bp, Homo sapiens
ggaagatcctgc

SEQ ID NO: 1367413 - DNA, 22 bp, Homo sapiens
ggaagatcctgcgggtggggct

SEQ ID NO: 1367414 - DNA, 19 bp, Homo sapiens
ggaagcccaggagcctcac

SEQ ID NO: 1367415 - DNA, 17 bp, Homo sapiens
ggaagcccatcctgacc

SEQ ID NO: 1367416 - DNA, 13 bp, Homo sapiens
ggaagccccacat

SEQ ID NO: 1367417 - DNA, 11 bp, Homo sapiens
ggaaggaagcc

SEQ ID NO: 1367418 - DNA, 15 bp, Homo sapiens
ggaagggaaagtttt

SEQ ID NO: 1367419 - DNA, 17 bp, Homo sapiens
ggaagggaaagtttttt

SEQ ID NO: 1367420 - DNA, 19 bp, Homo sapiens
ggaaggggttcctcaaatt

SEQ ID NO: 1367421 - DNA, 18 bp, Homo sapiens
ggaagtatgtatattaaa

SEQ ID NO: 1367422 - DNA, 18 bp, Homo sapiens
ggaataaaaggcttgaag

SEQ ID NO: 1367423 - DNA, 22 bp, Homo sapiens
ggaataaaaggcttgaagctgt

SEQ ID NO: 1367424 - DNA, 23 bp, Homo sapiens
ggaatataaggaaagcaataaat

SEQ ID NO: 1367425 - DNA, 12 bp, Homo sapiens
ggaatcctggca

SEQ ID NO: 1367426 - DNA, 18 bp, Homo sapiens
ggaatgaaaaaagcttta

SEQ ID NO: 1367427 - DNA, 16 bp, Homo sapiens
ggaatgaggaaaattc

SEQ ID NO: 1367428 - DNA, 19 bp, Homo sapiens
ggaattacgtgctctgtgg

SEQ ID NO: 1367429 - DNA, 21 bp, Homo sapiens
ggaattgtggctatcctgatt

SEQ ID NO: 1367430 - DNA, 13 bp, Homo sapiens
ggaatttttttgt

SEQ ID NO: 1367431 - DNA, 17 bp, Homo sapiens
ggacaaagtgccaaaga

SEQ ID NO: 1367432 - DNA, 18 bp, Homo sapiens
ggacaaagtgccaaagaa

SEQ ID NO: 1367433 - DNA, 13 bp, Homo sapiens
ggacacacagcct

SEQ ID NO: 1367434 - DNA, 18 bp, Homo sapiens
ggacagtatcccacatcc

SEQ ID NO: 1367435 - DNA, 13 bp, Homo sapiens
ggacatcctcctc

SEQ ID NO: 1367436 - DNA, 16 bp, Homo sapiens
ggacatgcaataaaat

SEQ ID NO: 1367437 - DNA, 19 bp, Homo sapiens
ggacatgcaataaaattta

SEQ ID NO: 1367438 - DNA, 16 bp, Homo sapiens
ggaccaagcatcttgg

SEQ ID NO: 1367439 - DNA, 15 bp, Homo sapiens
ggaccaccctgagcc

SEQ ID NO: 1367440 - DNA, 11 bp, Homo sapiens
ggacccagtgc

SEQ ID NO: 1367441 - DNA, 16 bp, Homo sapiens
ggacccagtgcagaat

SEQ ID NO: 1367442 - DNA, 16 bp, Homo sapiens
ggacccccgtggggca

SEQ ID NO: 1367443 - DNA, 22 bp, Homo sapiens
ggacccccgtggggcagggagc

SEQ ID NO: 1367444 - DNA, 23 bp, Homo sapiens
ggacccgaccccccgtgggctcc

SEQ ID NO: 1367445 - DNA, 18 bp, Homo sapiens
ggaccctttttgttatga

SEQ ID NO: 1367446 - DNA, 19 bp, Homo sapiens
ggacctttccaccacagcc

SEQ ID NO: 1367447 - DNA, 20 bp, Homo sapiens
ggacctttccaccacagcca

SEQ ID NO: 1367448 - DNA, 19 bp, Homo sapiens
ggacgccactcatttcatc

SEQ ID NO: 1367449 - DNA, 17 bp, Homo sapiens
ggacggccaagaatgta

SEQ ID NO: 1367450 - DNA, 14 bp, Homo sapiens
ggacggcggcagta

SEQ ID NO: 1367451 - DNA, 17 bp, Homo sapiens
ggacggtgcccaagcca

SEQ ID NO: 1367452 - DNA, 19 bp, Homo sapiens
ggactcagtgggttaacat

SEQ ID NO: 1367453 - DNA, 17 bp, Homo sapiens
ggactgagtgggaagcc

SEQ ID NO: 1367454 - DNA, 18 bp, Homo sapiens
ggactgagtgggaagccc

SEQ ID NO: 1367455 - DNA, 18 bp, Homo sapiens
ggactgctaaataaaatt

SEQ ID NO: 1367456 - DNA, 23 bp, Homo sapiens
ggactgctacctttcaaagcttg

SEQ ID NO: 1367457 - DNA, 19 bp, Homo sapiens
ggacttccccggagggctg

SEQ ID NO: 1367458 - DNA, 20 bp, Homo sapiens
ggagaaccaaatctggaagc

SEQ ID NO: 1367459 - DNA, 17 bp, Homo sapiens
ggagacagcatcagggt

SEQ ID NO: 1367460 - DNA, 18 bp, Homo sapiens
ggagacagcatcagggtt

SEQ ID NO: 1367461 - DNA, 12 bp, Homo sapiens
ggagacgccatg

SEQ ID NO: 1367462 - DNA, 18 bp, Homo sapiens
ggagagcatcggcctagg

SEQ ID NO: 1367463 - DNA, 21 bp, Homo sapiens
ggagagccatacataaaagaa

SEQ ID NO: 1367464 - DNA, 11 bp, Homo sapiens
ggagagcctgc

SEQ ID NO: 1367465 - DNA, 19 bp, Homo sapiens
ggagataattactgccttg

SEQ ID NO: 1367466 - DNA, 15 bp, Homo sapiens
ggagcactgggctcc

SEQ ID NO: 1367467 - DNA, 16 bp, Homo sapiens
ggagcaggcacgggtg

SEQ ID NO: 1367468 - DNA, 21 bp, Homo sapiens
ggagccagctccctctattta

SEQ ID NO: 1367469 - DNA, 22 bp, Homo sapiens
ggagccatgcgccccctccgcc

SEQ ID NO: 1367470 - DNA, 18 bp, Homo sapiens
ggagccggtaactgtcct

SEQ ID NO: 1367471 - DNA, 23 bp, Homo sapiens
ggagccggtaactgtcctgtcct

SEQ ID NO: 1367472 - DNA, 20 bp, Homo sapiens
ggagcctttggttctggcca

SEQ ID NO: 1367473 - DNA, 19 bp, Homo sapiens
ggagcctttttaaaacaca

SEQ ID NO: 1367474 - DNA, 17 bp, Homo sapiens
ggagctcatctgcaaaa

SEQ ID NO: 1367475 - DNA, 16 bp, Homo sapiens
ggagctgagtggggga

SEQ ID NO: 1367476 - DNA, 17 bp, Homo sapiens
ggagctgccttggctca

SEQ ID NO: 1367477 - DNA, 18 bp, Homo sapiens
ggagctgccttggctcag

SEQ ID NO: 1367478 - DNA, 21 bp, Homo sapiens
ggagctgccttggctcagaca

SEQ ID NO: 1367479 - DNA, 19 bp, Homo sapiens
ggaggaaccagagtgctga

SEQ ID NO: 1367480 - DNA, 21 bp, Homo sapiens
ggaggaagaactgaaaggctt

SEQ ID NO: 1367481 - DNA, 21 bp, Homo sapiens
ggaggatctcttgagcctggg

SEQ ID NO: 1367482 - DNA, 18 bp, Homo sapiens
ggaggccaaggtgggagg

SEQ ID NO: 1367483 - DNA, 20 bp, Homo sapiens
ggaggccaaggtgggaggat

SEQ ID NO: 1367484 - DNA, 20 bp, Homo sapiens
ggaggcgggggctgcccttg

SEQ ID NO: 1367485 - DNA, 21 bp, Homo sapiens
ggagggcaaggggttcccttg

SEQ ID NO: 1367486 - DNA, 14 bp, Homo sapiens
ggaggggagacttt

SEQ ID NO: 1367487 - DNA, 16 bp, Homo sapiens
ggagggggcttgaagc

SEQ ID NO: 1367488 - DNA, 21 bp, Homo sapiens
ggagggggcttgaagccaaag

SEQ ID NO: 1367489 - DNA, 20 bp, Homo sapiens
ggagggtaaataaaccactg

SEQ ID NO: 1367490 - DNA, 14 bp, Homo sapiens
ggaggtcgaggcag

SEQ ID NO: 1367491 - DNA, 18 bp, Homo sapiens
ggaggtcgaggcaggagg

SEQ ID NO: 1367492 - DNA, 17 bp, Homo sapiens
ggaggtggaagaaggga

SEQ ID NO: 1367493 - DNA, 20 bp, Homo sapiens
ggaggtggaggctgcagtga

SEQ ID NO: 1367494 - DNA, 21 bp, Homo sapiens
ggagtattgaatggtggtgga

SEQ ID NO: 1367495 - DNA, 24 bp, Homo sapiens
ggagtcgtggggtgtgctgggagc

SEQ ID NO: 1367496 - DNA, 19 bp, Homo sapiens
ggagtgtgagccacctaag

SEQ ID NO: 1367497 - DNA, 18 bp, Homo sapiens
ggatagctaactgtaaat

SEQ ID NO: 1367498 - DNA, 18 bp, Homo sapiens
ggatattgaatgttaaag

SEQ ID NO: 1367499 - DNA, 16 bp, Homo sapiens
ggatcacagcctctga

SEQ ID NO: 1367500 - DNA, 16 bp, Homo sapiens
ggatcccaagcctcct

SEQ ID NO: 1367501 - DNA, 19 bp, Homo sapiens
ggatccccgcctggccagg

SEQ ID NO: 1367502 - DNA, 19 bp, Homo sapiens
ggatccgactgctttggac

SEQ ID NO: 1367503 - DNA, 13 bp, Homo sapiens
ggatctaccagca

SEQ ID NO: 1367504 - DNA, 16 bp, Homo sapiens
ggatctcagctttgag

SEQ ID NO: 1367505 - DNA, 18 bp, Homo sapiens
ggatgcaggctcccctga

SEQ ID NO: 1367506 - DNA, 18 bp, Homo sapiens
ggatggatttccagccaa

SEQ ID NO: 1367507 - DNA, 13 bp, Homo sapiens
ggatggccccagc

SEQ ID NO: 1367508 - DNA, 16 bp, Homo sapiens
ggatgtatggggaatc

SEQ ID NO: 1367509 - DNA, 15 bp, Homo sapiens
ggattctaaatacat

SEQ ID NO: 1367510 - DNA, 16 bp, Homo sapiens
ggcaaccactaagaat

SEQ ID NO: 1367511 - DNA, 19 bp, Homo sapiens
ggcaaccactaagaattca

SEQ ID NO: 1367512 - DNA, 13 bp, Homo sapiens
ggtaactgtcctg

SEQ ID NO: 1367513 - DNA, 14 bp, Homo sapiens
ggtaactgtcctgt

SEQ ID NO: 1367514 - DNA, 16 bp, Homo sapiens
ggtacaacggaggcct

SEQ ID NO: 1367515 - DNA, 14 bp, Homo sapiens
ggtaccagctgcgc

SEQ ID NO: 1367516 - DNA, 11 bp, Homo sapiens
ggtaccctggg

SEQ ID NO: 1367517 - DNA, 17 bp, Homo sapiens
ggtaggagggtgggaag

SEQ ID NO: 1367518 - DNA, 19 bp, Homo sapiens
ggtaggttcagccaaggtt

SEQ ID NO: 1367519 - DNA, 18 bp, Homo sapiens
ggtagttgcaattgaatt

SEQ ID NO: 1367520 - DNA, 19 bp, Homo sapiens
ggtattaaaactaaatttc

SEQ ID NO: 1367521 - DNA, 16 bp, Homo sapiens
ggtattttttcctttt

SEQ ID NO: 1367522 - DNA, 20 bp, Homo sapiens
ggtcacgtttggtgcttctc

SEQ ID NO: 1367523 - DNA, 20 bp, Homo sapiens
ggtccaaccagacctggaag

SEQ ID NO: 1367524 - DNA, 14 bp, Homo sapiens
ggtccagaagagaa

SEQ ID NO: 1367525 - DNA, 11 bp, Homo sapiens
ggtccagctct

SEQ ID NO: 1367526 - DNA, 14 bp, Homo sapiens
ggtccagctctgga

SEQ ID NO: 1367527 - DNA, 16 bp, Homo sapiens
ggtccagctctggagg

SEQ ID NO: 1367528 - DNA, 22 bp, Homo sapiens
ggtccagctctggaggggaggg

SEQ ID NO: 1367529 - DNA, 20 bp, Homo sapiens
ggtccagctggcctggacag

SEQ ID NO: 1367530 - DNA, 15 bp, Homo sapiens
ggtcctagtaagaag

SEQ ID NO: 1367531 - DNA, 13 bp, Homo sapiens
ggtcctctggagc

SEQ ID NO: 1367532 - DNA, 12 bp, Homo sapiens
ggtcctgtcccc

SEQ ID NO: 1367533 - DNA, 15 bp, Homo sapiens
ggtcctgtccccgca

SEQ ID NO: 1367534 - DNA, 11 bp, Homo sapiens
ggtctccctgg

SEQ ID NO: 1367535 - DNA, 16 bp, Homo sapiens
ggtctccctggctccc

SEQ ID NO: 1367536 - DNA, 24 bp, Homo sapiens
ggtctccctggctccctcctccag

SEQ ID NO: 1367537 - DNA, 19 bp, Homo sapiens
ggtctcggatcaggctccc

SEQ ID NO: 1367538 - DNA, 18 bp, Homo sapiens
ggtgagacccatggctgt

SEQ ID NO: 1367539 - DNA, 17 bp, Homo sapiens
ggtgaggggctggcact

SEQ ID NO: 1367540 - DNA, 19 bp, Homo sapiens
ggtgagtttgagctgcctt

SEQ ID NO: 1367541 - DNA, 19 bp, Homo sapiens
ggtgatcccgttttcccca

SEQ ID NO: 1367542 - DNA, 18 bp, Homo sapiens
ggtgattggaccaggcca

SEQ ID NO: 1367543 - DNA, 19 bp, Homo sapiens
ggtgccactttacccacct

SEQ ID NO: 1367544 - DNA, 21 bp, Homo sapiens
ggtgcccaagccagaggctgg

SEQ ID NO: 1367545 - DNA, 20 bp, Homo sapiens
ggtgctcggagaagagcgca

SEQ ID NO: 1367546 - DNA, 20 bp, Homo sapiens
ggtgctggagcactgggctc

SEQ ID NO: 1367547 - DNA, 15 bp, Homo sapiens
ggtggaggcttcctg

SEQ ID NO: 1367548 - DNA, 16 bp, Homo sapiens
ggtggcggccccagca

SEQ ID NO: 1367549 - DNA, 15 bp, Homo sapiens
ggtgggaaggggagc

SEQ ID NO: 1367550 - DNA, 23 bp, Homo sapiens
ggtgggaaggggagcacaatttc

SEQ ID NO: 1367551 - DNA, 20 bp, Homo sapiens
ggtgggacccccgtggggca

SEQ ID NO: 1367552 - DNA, 20 bp, Homo sapiens
ggtgggaggatctcttgagc

SEQ ID NO: 1367553 - DNA, 20 bp, Homo sapiens
ggtgggaggattgcttgagc

SEQ ID NO: 1367554 - DNA, 13 bp, Homo sapiens
ggtgggctctgtg

SEQ ID NO: 1367555 - DNA, 16 bp, Homo sapiens
ggtgggctctgtgcag

SEQ ID NO: 1367556 - DNA, 14 bp, Homo sapiens
ggtgggggagggag

SEQ ID NO: 1367557 - DNA, 20 bp, Homo sapiens
ggtgtagccctcccactttg

SEQ ID NO: 1367558 - DNA, 21 bp, Homo sapiens
ggtgtcacccaaaccggcagg

SEQ ID NO: 1367559 - DNA, 16 bp, Homo sapiens
ggtgtgaacccgggag

SEQ ID NO: 1367560 - DNA, 17 bp, Homo sapiens
ggtgtgaacccgggagc

SEQ ID NO: 1367561 - DNA, 21 bp, Homo sapiens
ggtgtgcggcctttggcttca

SEQ ID NO: 1367562 - DNA, 19 bp, Homo sapiens
ggtgtgctgggagctccac

SEQ ID NO: 1367563 - DNA, 15 bp, Homo sapiens
ggttacttcttctct

SEQ ID NO: 1367564 - DNA, 19 bp, Homo sapiens
ggttcctcaaattttttga

SEQ ID NO: 1367565 - DNA, 16 bp, Homo sapiens
ggttcctcctctccta

SEQ ID NO: 1367566 - DNA, 14 bp, Homo sapiens
ggttcctctgcctg

SEQ ID NO: 1367567 - DNA, 21 bp, Homo sapiens
ggttctccgttagctcctgtg

SEQ ID NO: 1367568 - DNA, 13 bp, Homo sapiens
ggttctggctgtt

SEQ ID NO: 1367569 - DNA, 20 bp, Homo sapiens
ggtttcctggcactggaccc

SEQ ID NO: 1367570 - DNA, 15 bp, Homo sapiens
ggtttctctgtggct

SEQ ID NO: 1367571 - DNA, 21 bp, Homo sapiens
ggttttggcaaacgctaaaga

SEQ ID NO: 1367572 - DNA, 13 bp, Homo sapiens
ggttttgtgccat

SEQ ID NO: 1367573 - DNA, 19 bp, Homo sapiens
gtaaaaagtattttttcaa

SEQ ID NO: 1367574 - DNA, 14 bp, Homo sapiens
gtaaaacaaaattt

SEQ ID NO: 1367575 - DNA, 16 bp, Homo sapiens
gtaaaatgaagaattt

SEQ ID NO: 1367576 - DNA, 19 bp, Homo sapiens
gtaaacagcctctttttga

SEQ ID NO: 1367577 - DNA, 22 bp, Homo sapiens
gtaaacgggaacatgccccctg

SEQ ID NO: 1367578 - DNA, 14 bp, Homo sapiens
gtaaagactggctt

SEQ ID NO: 1367579 - DNA, 14 bp, Homo sapiens
gtaaagactggttt

SEQ ID NO: 1367580 - DNA, 20 bp, Homo sapiens
gtaaagctatttatgggccc

SEQ ID NO: 1367581 - DNA, 12 bp, Homo sapiens
gtaaagctccta

SEQ ID NO: 1367582 - DNA, 15 bp, Homo sapiens
gtaaagtatgtatta

SEQ ID NO: 1367583 - DNA, 22 bp, Homo sapiens
gtaaagtatgtattatttacat

SEQ ID NO: 1367584 - DNA, 15 bp, Homo sapiens
gtaaataatttattt

SEQ ID NO: 1367585 - DNA, 16 bp, Homo sapiens
gtaaatacatgcatat

SEQ ID NO: 1367586 - DNA, 20 bp, Homo sapiens
gtaaataggatttttagaat

SEQ ID NO: 1367587 - DNA, 12 bp, Homo sapiens
gtaaatgtgtac

SEQ ID NO: 1367588 - DNA, 13 bp, Homo sapiens
gtaaatgtttctt

SEQ ID NO: 1367589 - DNA, 12 bp, Homo sapiens
gtaaattctgat

SEQ ID NO: 1367590 - DNA, 22 bp, Homo sapiens
gtaaatttagtgtttttttatt

SEQ ID NO: 1367591 - DNA, 18 bp, Homo sapiens
gtaaattttgtatgaaaa

SEQ ID NO: 1367592 - DNA, 23 bp, Homo sapiens
gtaactgtcaggctgaaaacaat

SEQ ID NO: 1367593 - DNA, 15 bp, Homo sapiens
gtaactgtcctgtcc

SEQ ID NO: 1367594 - DNA, 17 bp, Homo sapiens
gtaactgtcctgtcctg

SEQ ID NO: 1367595 - DNA, 20 bp, Homo sapiens
gtaacttgcttaaatttctt

SEQ ID NO: 1367596 - DNA, 16 bp, Homo sapiens
gtaagaagacaaactg

SEQ ID NO: 1367597 - DNA, 22 bp, Homo sapiens
gtaagatatctcaatgaaccat

SEQ ID NO: 1367598 - DNA, 13 bp, Homo sapiens
gtaagatcactgt

SEQ ID NO: 1367599 - DNA, 20 bp, Homo sapiens
gtaagcgtatggctttattt

SEQ ID NO: 1367600 - DNA, 16 bp, Homo sapiens
gtaagttatctttgaa

SEQ ID NO: 1367601 - DNA, 13 bp, Homo sapiens
gtaataagcactg

SEQ ID NO: 1367602 - DNA, 17 bp, Homo sapiens
gtaatacttccagaagt

SEQ ID NO: 1367603 - DNA, 14 bp, Homo sapiens
gtaatatttattaa

SEQ ID NO: 1367604 - DNA, 18 bp, Homo sapiens
gtaatatttattaaattt

SEQ ID NO: 1367605 - DNA, 21 bp, Homo sapiens
gtaatatttattaaatttttt

SEQ ID NO: 1367606 - DNA, 17 bp, Homo sapiens
gtaatcccctaaaataa

SEQ ID NO: 1367607 - DNA, 17 bp, Homo sapiens
gtaatctttacctgtat

SEQ ID NO: 1367608 - DNA, 16 bp, Homo sapiens
gtaatgcttcaatcag

SEQ ID NO: 1367609 - DNA, 14 bp, Homo sapiens
gtaatgtgaataaa

SEQ ID NO: 1367610 - DNA, 16 bp, Homo sapiens
gtaatgtgaataaatt

SEQ ID NO: 1367611 - DNA, 21 bp, Homo sapiens
gtaatttctttttttcctttt

SEQ ID NO: 1367612 - DNA, 13 bp, Homo sapiens
gtaatttgaagat

SEQ ID NO: 1367613 - DNA, 14 bp, Homo sapiens
gtaatttgaagatt

SEQ ID NO: 1367614 - DNA, 14 bp, Homo sapiens
gtacaacggaggcc

SEQ ID NO: 1367615 - DNA, 15 bp, Homo sapiens
gtacaacggaggcct

SEQ ID NO: 1367616 - DNA, 23 bp, Homo sapiens
gtacaacggaggcctgcgaccct

SEQ ID NO: 1367617 - DNA, 15 bp, Homo sapiens
gtacaagtagttctg

SEQ ID NO: 1367618 - DNA, 13 bp, Homo sapiens
gtacactgcctgc

SEQ ID NO: 1367619 - DNA, 14 bp, Homo sapiens
gtacataatactga

SEQ ID NO: 1367620 - DNA, 16 bp, Homo sapiens
gtacataatactgaac

SEQ ID NO: 1367621 - DNA, 14 bp, Homo sapiens
gtacatttctataa

SEQ ID NO: 1367622 - DNA, 16 bp, Homo sapiens
gtaccagctgcgcttg

SEQ ID NO: 1367623 - DNA, 17 bp, Homo sapiens
gtaccagctgcgcttgc

SEQ ID NO: 1367624 - DNA, 22 bp, Homo sapiens
gtactgaatttttttgtaataa

SEQ ID NO: 1367625 - DNA, 17 bp, Homo sapiens
gtactgttcggaagggg

SEQ ID NO: 1367626 - DNA, 23 bp, Homo sapiens
gtacttaaatggtaataagcact

SEQ ID NO: 1367627 - DNA, 17 bp, Homo sapiens
gtactttctattttaat

SEQ ID NO: 1367628 - DNA, 16 bp, Homo sapiens
gtacttttaaaaacat

SEQ ID NO: 1367629 - DNA, 18 bp, Homo sapiens
gtacttttcattctcttt

SEQ ID NO: 1367630 - DNA, 21 bp, Homo sapiens
gtacttttttaaatattttct

SEQ ID NO: 1367631 - DNA, 13 bp, Homo sapiens
gtagaaaatgtga

SEQ ID NO: 1367632 - DNA, 15 bp, Homo sapiens
gtagaaaatgtgacc

SEQ ID NO: 1367633 - DNA, 17 bp, Homo sapiens
gtagaactccaggccct

SEQ ID NO: 1367634 - DNA, 15 bp, Homo sapiens
gtagaactttgtata

SEQ ID NO: 1367635 - DNA, 19 bp, Homo sapiens
gtagaccttgttacttctg

SEQ ID NO: 1367636 - DNA, 20 bp, Homo sapiens
gtagaccttgttacttctga

SEQ ID NO: 1367637 - DNA, 14 bp, Homo sapiens
gtagagccagcttg

SEQ ID NO: 1367638 - DNA, 13 bp, Homo sapiens
gtagagtgggagc

SEQ ID NO: 1367639 - DNA, 15 bp, Homo sapiens
gtagagtgggagctg

SEQ ID NO: 1367640 - DNA, 18 bp, Homo sapiens
gtagatatgtattctttt

SEQ ID NO: 1367641 - DNA, 15 bp, Homo sapiens
gtagatccatttcca

SEQ ID NO: 1367642 - DNA, 22 bp, Homo sapiens
gtagcagtgagtcatatcttaa

SEQ ID NO: 1367643 - DNA, 17 bp, Homo sapiens
gtagccccctggcctct

SEQ ID NO: 1367644 - DNA, 17 bp, Homo sapiens
gtagccctcccactttg

SEQ ID NO: 1367645 - DNA, 19 bp, Homo sapiens
gtaggaccaagcatcttgg

SEQ ID NO: 1367646 - DNA, 23 bp, Homo sapiens
gtaggagctgccttggctcagac

SEQ ID NO: 1367647 - DNA, 13 bp, Homo sapiens
gtagggagggcgg

SEQ ID NO: 1367648 - DNA, 16 bp, Homo sapiens
gtaggttcagccaagg

SEQ ID NO: 1367649 - DNA, 23 bp, Homo sapiens
gtagtcccagctacttgggaggc

SEQ ID NO: 1367650 - DNA, 16 bp, Homo sapiens
gtagttctgtatttga

SEQ ID NO: 1367651 - DNA, 17 bp, Homo sapiens
gtagttgccttaaaata

SEQ ID NO: 1367652 - DNA, 14 bp, Homo sapiens
gtataaaatacata

SEQ ID NO: 1367653 - DNA, 15 bp, Homo sapiens
gtatagttatgtaaa

SEQ ID NO: 1367654 - DNA, 22 bp, Homo sapiens
gtatatattttgtgtgaaattg

SEQ ID NO: 1367655 - DNA, 19 bp, Homo sapiens
gtatatggtatatatacat

SEQ ID NO: 1367656 - DNA, 15 bp, Homo sapiens
gtatattacaatgat

SEQ ID NO: 1367657 - DNA, 17 bp, Homo sapiens
gtatatttgatttatta

SEQ ID NO: 1367658 - DNA, 19 bp, Homo sapiens
gtatatttgatttattaac

SEQ ID NO: 1367659 - DNA, 17 bp, Homo sapiens
gtatatttgtaaagcta

SEQ ID NO: 1367660 - DNA, 16 bp, Homo sapiens
gtatcatatatttaat

SEQ ID NO: 1367661 - DNA, 21 bp, Homo sapiens
gtatccatattttattactgt

SEQ ID NO: 1367662 - DNA, 21 bp, Homo sapiens
gtatcctggaacaatatttta

SEQ ID NO: 1367663 - DNA, 21 bp, Homo sapiens
gtatctccggctcccagcctc

SEQ ID NO: 1367664 - DNA, 16 bp, Homo sapiens
gtatggaagttttcct

SEQ ID NO: 1367665 - DNA, 17 bp, Homo sapiens
gtatggaagttttccta

SEQ ID NO: 1367666 - DNA, 14 bp, Homo sapiens
gtatggtaatcttt

SEQ ID NO: 1367667 - DNA, 17 bp, Homo sapiens
gtatgtttctctttgat

SEQ ID NO: 1367668 - DNA, 18 bp, Homo sapiens
gtattaaaactaaatttc

SEQ ID NO: 1367669 - DNA, 20 bp, Homo sapiens
gtattaaaactaaatttcac

SEQ ID NO: 1367670 - DNA, 13 bp, Homo sapiens
gtattaaagacag

SEQ ID NO: 1367671 - DNA, 20 bp, Homo sapiens
gtattatacatgtgatacat

SEQ ID NO: 1367672 - DNA, 22 bp, Homo sapiens
gtattatacatgtgatacattt

SEQ ID NO: 1367673 - DNA, 12 bp, Homo sapiens
gtattatttata

SEQ ID NO: 1367674 - DNA, 13 bp, Homo sapiens
gtattgtcctatt

SEQ ID NO: 1367675 - DNA, 21 bp, Homo sapiens
gtatttaacagaaattgtata

SEQ ID NO: 1367676 - DNA, 14 bp, Homo sapiens
gtattttcatacaa

SEQ ID NO: 1367677 - DNA, 15 bp, Homo sapiens
gtattttcatgaaaa

SEQ ID NO: 1367678 - DNA, 15 bp, Homo sapiens
gtattttcttctctg

SEQ ID NO: 1367679 - DNA, 19 bp, Homo sapiens
gtattttcttctctgtgag

SEQ ID NO: 1367680 - DNA, 22 bp, Homo sapiens
gtatttttagaataagaatttg

SEQ ID NO: 1367681 - DNA, 14 bp, Homo sapiens
gtattttttccttt

SEQ ID NO: 1367682 - DNA, 18 bp, Homo sapiens
gtatttttttttctaaga

SEQ ID NO: 1367683 - DNA, 16 bp, Homo sapiens
gtcaaactgtagaaat

SEQ ID NO: 1367684 - DNA, 21 bp, Homo sapiens
gtcaacctcgcgcttgctggc

SEQ ID NO: 1367685 - DNA, 15 bp, Homo sapiens
gtcaaggcctgctcc

SEQ ID NO: 1367686 - DNA, 18 bp, Homo sapiens
gtcaagtgaaaaaggagg

SEQ ID NO: 1367687 - DNA, 21 bp, Homo sapiens
gtcaatggcttgttcatcatc

SEQ ID NO: 1367688 - DNA, 17 bp, Homo sapiens
gtcaatttctgtgttgc

SEQ ID NO: 1367689 - DNA, 20 bp, Homo sapiens
gtcacccaggctggactgca

SEQ ID NO: 1367690 - DNA, 14 bp, Homo sapiens
gtcactaatacaca

SEQ ID NO: 1367691 - DNA, 20 bp, Homo sapiens
gtcactatgggatgagaaaa

SEQ ID NO: 1367692 - DNA, 21 bp, Homo sapiens
gtcactcattgctgagcctct

SEQ ID NO: 1367693 - DNA, 12 bp, Homo sapiens
gtcactggaaag

SEQ ID NO: 1367694 - DNA, 15 bp, Homo sapiens
gtcactggaaagggg

SEQ ID NO: 1367695 - DNA, 20 bp, Homo sapiens
gtcactggaaaggggagagc

SEQ ID NO: 1367696 - DNA, 18 bp, Homo sapiens
gtcactggaggttgaagc

SEQ ID NO: 1367697 - DNA, 20 bp, Homo sapiens
gtcactggaggttgaagcca

SEQ ID NO: 1367698 - DNA, 14 bp, Homo sapiens
gtcactttttatgc

SEQ ID NO: 1367699 - DNA, 10 bp, Homo sapiens
gtcagagaca

SEQ ID NO: 1367700 - DNA, 18 bp, Homo sapiens
gtcagatgtttaaaacac

SEQ ID NO: 1367701 - DNA, 12 bp, Homo sapiens
gtcagctccagc

SEQ ID NO: 1367702 - DNA, 21 bp, Homo sapiens
gtcaggagatcgagaccatcc

SEQ ID NO: 1367703 - DNA, 16 bp, Homo sapiens
gtcaggctgaaaacaa

SEQ ID NO: 1367704 - DNA, 20 bp, Homo sapiens
gtcatactcgagtctgaggc

SEQ ID NO: 1367705 - DNA, 17 bp, Homo sapiens
gtcatcggcgtggccca

SEQ ID NO: 1367706 - DNA, 13 bp, Homo sapiens
gtcatgtatgttt

SEQ ID NO: 1367707 - DNA, 14 bp, Homo sapiens
gtcattcagagtca

SEQ ID NO: 1367708 - DNA, 19 bp, Homo sapiens
gtcattgcacataagcttc

SEQ ID NO: 1367709 - DNA, 17 bp, Homo sapiens
gtccaaacgtcctcttt

SEQ ID NO: 1367710 - DNA, 16 bp, Homo sapiens
gtccaaagaggctgcc

SEQ ID NO: 1367711 - DNA, 23 bp, Homo sapiens
gtccagcaccttgtgcctggggt

SEQ ID NO: 1367712 - DNA, 23 bp, Homo sapiens
gtccagcctgccccggagctgga

SEQ ID NO: 1367713 - DNA, 14 bp, Homo sapiens
gtccagctctggag

SEQ ID NO: 1367714 - DNA, 22 bp, Homo sapiens
gtccagctgcccttccgcagtg

SEQ ID NO: 1367715 - DNA, 16 bp, Homo sapiens
gtccaggctgccgtgg

SEQ ID NO: 1367716 - DNA, 20 bp, Homo sapiens
gtccaggctgccgtggggcc

SEQ ID NO: 1367717 - DNA, 18 bp, Homo sapiens
gtccatgctaacaaagac

SEQ ID NO: 1367718 - DNA, 17 bp, Homo sapiens
gtcccagatacttgggg

SEQ ID NO: 1367719 - DNA, 14 bp, Homo sapiens
gtcccagctactcg

SEQ ID NO: 1367720 - DNA, 14 bp, Homo sapiens
gtccccacccctgc

SEQ ID NO: 1367721 - DNA, 16 bp, Homo sapiens
gtccccacccctgccc

SEQ ID NO: 1367722 - DNA, 13 bp, Homo sapiens
gtccccgcagccc

SEQ ID NO: 1367723 - DNA, 18 bp, Homo sapiens
gtccctagcagcccaccc

SEQ ID NO: 1367724 - DNA, 12 bp, Homo sapiens
gtccctctgtgt

SEQ ID NO: 1367725 - DNA, 13 bp, Homo sapiens
gtccctctgtgta

SEQ ID NO: 1367726 - DNA, 17 bp, Homo sapiens
gtccctggcgcaggtgg

SEQ ID NO: 1367727 - DNA, 17 bp, Homo sapiens
gtcccttccccatgctt

SEQ ID NO: 1367728 - DNA, 20 bp, Homo sapiens
gtcccttgcttgcctgcagg

SEQ ID NO: 1367729 - DNA, 21 bp, Homo sapiens
gtccggtccctgtcccagtgc

SEQ ID NO: 1367730 - DNA, 19 bp, Homo sapiens
gtccgtgggacggtgccca

SEQ ID NO: 1367731 - DNA, 13 bp, Homo sapiens
gtcctaatggtga

SEQ ID NO: 1367732 - DNA, 13 bp, Homo sapiens
gtcctcctcacct

SEQ ID NO: 1367733 - DNA, 17 bp, Homo sapiens
gtcctctttagtttttg

SEQ ID NO: 1367734 - DNA, 11 bp, Homo sapiens
gtcctgcctgt

SEQ ID NO: 1367735 - DNA, 13 bp, Homo sapiens
gtcctgcctgtgg

SEQ ID NO: 1367736 - DNA, 14 bp, Homo sapiens
gtcctgcctgtggc

SEQ ID NO: 1367737 - DNA, 18 bp, Homo sapiens
gtcctgtgaatgccactg

SEQ ID NO: 1367738 - DNA, 14 bp, Homo sapiens
gtccttgatttcaa

SEQ ID NO: 1367739 - DNA, 19 bp, Homo sapiens
gtccttgatttcaaagttt

SEQ ID NO: 1367740 - DNA, 16 bp, Homo sapiens
gtcgctcatgtgtgca

SEQ ID NO: 1367741 - DNA, 21 bp, Homo sapiens
gtcgctcatgtgtgcaacagg

SEQ ID NO: 1367742 - DNA, 15 bp, Homo sapiens
gtcgctcctgcccac

SEQ ID NO: 1367743 - DNA, 14 bp, Homo sapiens
gtcggctgaccatg

SEQ ID NO: 1367744 - DNA, 17 bp, Homo sapiens
gtcgtggggtgtgctgg

SEQ ID NO: 1367745 - DNA, 23 bp, Homo sapiens
gtctaagactatatatataaatg

SEQ ID NO: 1367746 - DNA, 21 bp, Homo sapiens
gtctaatctagatatcgactt

SEQ ID NO: 1367747 - DNA, 23 bp, Homo sapiens
gtctatttaaaaaaaaagtcaga

SEQ ID NO: 1367748 - DNA, 15 bp, Homo sapiens
gtctccaggggctgc

SEQ ID NO: 1367749 - DNA, 15 bp, Homo sapiens
gtctccctggctccc

SEQ ID NO: 1367750 - DNA, 19 bp, Homo sapiens
gtttttgatagcattgtaa

SEQ ID NO: 1367751 - DNA, 14 bp, Homo sapiens
gtttttgtatattg

SEQ ID NO: 1367752 - DNA, 15 bp, Homo sapiens
gtttttgtttggaga

SEQ ID NO: 1367753 - DNA, 21 bp, Homo sapiens
gttttttaaaatatttatctg

SEQ ID NO: 1367754 - DNA, 15 bp, Homo sapiens
gttttttcctcagtg

SEQ ID NO: 1367755 - DNA, 20 bp, Homo sapiens
gttttttcctcagtgcattt

SEQ ID NO: 1367756 - DNA, 9 bp, Homo sapiens
gttttttgt

SEQ ID NO: 1367757 - DNA, 14 bp, Homo sapiens
gtttttttatttct

SEQ ID NO: 1367758 - DNA, 14 bp, Homo sapiens
taaaaaaaaagtca

SEQ ID NO: 1367759 - DNA, 22 bp, Homo sapiens
taaaaaaaccaccaaaaacaaa

SEQ ID NO: 1367760 - DNA, 14 bp, Homo sapiens
taaaaaatattttc

SEQ ID NO: 1367761 - DNA, 18 bp, Homo sapiens
taaaaaatattttctctg

SEQ ID NO: 1367762 - DNA, 17 bp, Homo sapiens
taaaaacataacataaa

SEQ ID NO: 1367763 - DNA, 16 bp, Homo sapiens
taaaaaccgaataaat

SEQ ID NO: 1367764 - DNA, 17 bp, Homo sapiens
taaaaaccgaataaatg

SEQ ID NO: 1367765 - DNA, 20 bp, Homo sapiens
taaaaaccgaataaatgttt

SEQ ID NO: 1367766 - DNA, 17 bp, Homo sapiens
taaaaaggagtatacaa

SEQ ID NO: 1367767 - DNA, 13 bp, Homo sapiens
taaaaatagaaac

SEQ ID NO: 1367768 - DNA, 15 bp, Homo sapiens
taaaaatcatagtac

SEQ ID NO: 1367769 - DNA, 11 bp, Homo sapiens
taaaaatcttt

SEQ ID NO: 1367770 - DNA, 17 bp, Homo sapiens
taaaaatgatactgatg

SEQ ID NO: 1367771 - DNA, 15 bp, Homo sapiens
taaaacaaaatttga

SEQ ID NO: 1367772 - DNA, 15 bp, Homo sapiens
taaaacatcattcct

SEQ ID NO: 1367773 - DNA, 18 bp, Homo sapiens
taaaactggacctgtata

SEQ ID NO: 1367774 - DNA, 13 bp, Homo sapiens
taaaagaaacact

SEQ ID NO: 1367775 - DNA, 14 bp, Homo sapiens
taaaagaaataaac

SEQ ID NO: 1367776 - DNA, 18 bp, Homo sapiens
taaaaggcttgaagctgt

SEQ ID NO: 1367777 - DNA, 21 bp, Homo sapiens
taaaataaaatgaaaattgta

SEQ ID NO: 1367778 - DNA, 19 bp, Homo sapiens
taaaatagaaattttgtaa

SEQ ID NO: 1367779 - DNA, 16 bp, Homo sapiens
taaaatagagtgtagt

SEQ ID NO: 1367780 - DNA, 21 bp, Homo sapiens
taaaatagagtgtagtttaca

SEQ ID NO: 1367781 - DNA, 15 bp, Homo sapiens
taaaatagatataaa

SEQ ID NO: 1367782 - DNA, 16 bp, Homo sapiens
taaaatagatataaat

SEQ ID NO: 1367783 - DNA, 14 bp, Homo sapiens
taaaatattttgaa

SEQ ID NO: 1367784 - DNA, 16 bp, Homo sapiens
taaaatattttgaatc

SEQ ID NO: 1367785 - DNA, 20 bp, Homo sapiens
taaaatattttgaatcaata

SEQ ID NO: 1367786 - DNA, 18 bp, Homo sapiens
taaaatcatgaaacttgt

SEQ ID NO: 1367787 - DNA, 21 bp, Homo sapiens
taaaatctgagggaaatgttt

SEQ ID NO: 1367788 - DNA, 23 bp, Homo sapiens
taaaatctgagggaaatgttttg

SEQ ID NO: 1367789 - DNA, 16 bp, Homo sapiens
taaaatgaagaattta

SEQ ID NO: 1367790 - DNA, 17 bp, Homo sapiens
taaaatgaagaatttaa

SEQ ID NO: 1367791 - DNA, 18 bp, Homo sapiens
taaaatggctgtaatcat

SEQ ID NO: 1367792 - DNA, 20 bp, Homo sapiens
taaaatgtccagtaagatca

SEQ ID NO: 1367793 - DNA, 21 bp, Homo sapiens
taaaatgtccagtaagatcac

SEQ ID NO: 1367794 - DNA, 22 bp, Homo sapiens
taaaattatgagattggttttc

SEQ ID NO: 1367795 - DNA, 16 bp, Homo sapiens
taaaattgttatcaaa

SEQ ID NO: 1367796 - DNA, 18 bp, Homo sapiens
taaacaaagattcatgat

SEQ ID NO: 1367797 - DNA, 18 bp, Homo sapiens
taaacattgaagtaatga

SEQ ID NO: 1367798 - DNA, 14 bp, Homo sapiens
taaaccactgtgcg

SEQ ID NO: 1367799 - DNA, 22 bp, Homo sapiens
taaaccacttaaacgaagagtt

SEQ ID NO: 1367800 - DNA, 16 bp, Homo sapiens
taaaccctcagagcct

SEQ ID NO: 1367801 - DNA, 16 bp, Homo sapiens
taaaccgccaaggctg

SEQ ID NO: 1367802 - DNA, 18 bp, Homo sapiens
taaaccgccaaggctggg

SEQ ID NO: 1367803 - DNA, 18 bp, Homo sapiens
taaacttcatatgtaatc

SEQ ID NO: 1367804 - DNA, 15 bp, Homo sapiens
taaagaaaaaaatac

SEQ ID NO: 1367805 - DNA, 13 bp, Homo sapiens
taaagaaaagatg

SEQ ID NO: 1367806 - DNA, 15 bp, Homo sapiens
taaagaagtattttt

SEQ ID NO: 1367807 - DNA, 17 bp, Homo sapiens
taaagaagtatttttag

SEQ ID NO: 1367808 - DNA, 23 bp, Homo sapiens
taaagaccctcctattctataaa

SEQ ID NO: 1367809 - DNA, 14 bp, Homo sapiens
taaagactggcttt

SEQ ID NO: 1367810 - DNA, 22 bp, Homo sapiens
taaagacttgtatagcatgaaa

SEQ ID NO: 1367811 - DNA, 13 bp, Homo sapiens
taaagagaatgag

SEQ ID NO: 1367812 - DNA, 21 bp, Homo sapiens
taaagagcccttgcctcccca

SEQ ID NO: 1367813 - DNA, 14 bp, Homo sapiens
taaagcagtatttt

SEQ ID NO: 1367814 - DNA, 16 bp, Homo sapiens
taaagcatgaaatgtg

SEQ ID NO: 1367815 - DNA, 20 bp, Homo sapiens
taaaggaagcactctgtata

SEQ ID NO: 1367816 - DNA, 21 bp, Homo sapiens
taaagtatgtattatttacat

SEQ ID NO: 1367817 - DNA, 14 bp, Homo sapiens
taaagtattcttct

SEQ ID NO: 1367818 - DNA, 14 bp, Homo sapiens
taaagtttgcttag

SEQ ID NO: 1367819 - DNA, 14 bp, Homo sapiens
taaataaaaatgga

SEQ ID NO: 1367820 - DNA, 15 bp, Homo sapiens
taaataaaaatgtct

SEQ ID NO: 1367821 - DNA, 15 bp, Homo sapiens
taaataaaccactgt

SEQ ID NO: 1367822 - DNA, 17 bp, Homo sapiens
taaataattctttttta

SEQ ID NO: 1367823 - DNA, 20 bp, Homo sapiens
taaatacatgcatataatga

SEQ ID NO: 1367824 - DNA, 21 bp, Homo sapiens
taaatacatgcatataatgaa

SEQ ID NO: 1367825 - DNA, 20 bp, Homo sapiens
taaatacatgccacatcaaa

SEQ ID NO: 1367826 - DNA, 14 bp, Homo sapiens
taaatattttctat

SEQ ID NO: 1367827 - DNA, 19 bp, Homo sapiens
taaatcagccgtgtaacca

SEQ ID NO: 1367828 - DNA, 21 bp, Homo sapiens
taaatccatcactataataaa

SEQ ID NO: 1367829 - DNA, 15 bp, Homo sapiens
taaatctaaatctat

SEQ ID NO: 1367830 - DNA, 19 bp, Homo sapiens
taaatctaaatctatttat

SEQ ID NO: 1367831 - DNA, 19 bp, Homo sapiens
taaatctatttattaatat

SEQ ID NO: 1367832 - DNA, 14 bp, Homo sapiens
taaatgaaagaaaa

SEQ ID NO: 1367833 - DNA, 16 bp, Homo sapiens
taaatgtaaactcagc

SEQ ID NO: 1367834 - DNA, 22 bp, Homo sapiens
taaatgtataaatatacagtat

SEQ ID NO: 1367835 - DNA, 18 bp, Homo sapiens
taaatgttacctctgaat

SEQ ID NO: 1367836 - DNA, 20 bp, Homo sapiens
taaatgtttggcatgtaaat

SEQ ID NO: 1367837 - DNA, 16 bp, Homo sapiens
taaattacaattttat

SEQ ID NO: 1367838 - DNA, 22 bp, Homo sapiens
taaattaggaataaataaaaat

SEQ ID NO: 1367839 - DNA, 17 bp, Homo sapiens
taaattatagtgtagaa

SEQ ID NO: 1367840 - DNA, 16 bp, Homo sapiens
taaattcaactttgta

SEQ ID NO: 1367841 - DNA, 18 bp, Homo sapiens
taaattcaactttgtaaa

SEQ ID NO: 1367842 - DNA, 19 bp, Homo sapiens
taaattcaactttgtaaaa

SEQ ID NO: 1367843 - DNA, 14 bp, Homo sapiens
taaatttagtgttt

SEQ ID NO: 1367844 - DNA, 14 bp, Homo sapiens
taaattttgaaaag

SEQ ID NO: 1367845 - DNA, 15 bp, Homo sapiens
taaattttgaaaagt

SEQ ID NO: 1367846 - DNA, 15 bp, Homo sapiens
taaatttttttgtat

SEQ ID NO: 1367847 - DNA, 12 bp, Homo sapiens
taacaaataaaa

SEQ ID NO: 1367848 - DNA, 18 bp, Homo sapiens
taacacaaatgctcaaag

SEQ ID NO: 1367849 - DNA, 14 bp, Homo sapiens
taacactcctctgc

SEQ ID NO: 1367850 - DNA, 22 bp, Homo sapiens
taacacttcttacgcaatgctt

SEQ ID NO: 1367851 - DNA, 15 bp, Homo sapiens
taacagaaattgtat

SEQ ID NO: 1367852 - DNA, 12 bp, Homo sapiens
taacagctgcaa

SEQ ID NO: 1367853 - DNA, 21 bp, Homo sapiens
taacagtatgtgggatattga

SEQ ID NO: 1367854 - DNA, 18 bp, Homo sapiens
taacagttgtatttaaca

SEQ ID NO: 1367855 - DNA, 19 bp, Homo sapiens
taacagttgtatttaacag

SEQ ID NO: 1367856 - DNA, 19 bp, Homo sapiens
taacagttttgtgtaactc

SEQ ID NO: 1367857 - DNA, 19 bp, Homo sapiens
taacatagccaaaatgtga

SEQ ID NO: 1367858 - DNA, 20 bp, Homo sapiens
taaccctttggtttttttct

SEQ ID NO: 1367859 - DNA, 22 bp, Homo sapiens
taacctaatcaccatgtaagca

SEQ ID NO: 1367860 - DNA, 15 bp, Homo sapiens
taacctcgccctctc

SEQ ID NO: 1367861 - DNA, 22 bp, Homo sapiens
taacgcgtatctaggctttggt

SEQ ID NO: 1367862 - DNA, 16 bp, Homo sapiens
taactcaccagcccca

SEQ ID NO: 1367863 - DNA, 20 bp, Homo sapiens
taactcatttgttaaaatta

SEQ ID NO: 1367864 - DNA, 21 bp, Homo sapiens
taactgatttgcaataaaaat

SEQ ID NO: 1367865 - DNA, 11 bp, Homo sapiens
taactgtcctg

SEQ ID NO: 1367866 - DNA, 15 bp, Homo sapiens
taacttccaaataaa

SEQ ID NO: 1367867 - DNA, 19 bp, Homo sapiens
taacttccaaataaataat

SEQ ID NO: 1367868 - DNA, 22 bp, Homo sapiens
taacttgagagtagatggtttg

SEQ ID NO: 1367869 - DNA, 17 bp, Homo sapiens
tagaattgaaggttttt

SEQ ID NO: 1367870 - DNA, 21 bp, Homo sapiens
tagaattgaaggtttttgata

SEQ ID NO: 1367871 - DNA, 23 bp, Homo sapiens
tagaattgaaggtttttgatagc

SEQ ID NO: 1367872 - DNA, 22 bp, Homo sapiens
tagacatcaaactcaatgcttt

SEQ ID NO: 1367873 - DNA, 19 bp, Homo sapiens
tagaccttgttacttctga

SEQ ID NO: 1367874 - DNA, 21 bp, Homo sapiens
tagactagcaatctcttcatt

SEQ ID NO: 1367875 - DNA, 21 bp, Homo sapiens
tagactcggggtgcttccttg

SEQ ID NO: 1367876 - DNA, 16 bp, Homo sapiens
tagagaagcaagtaaa

SEQ ID NO: 1367877 - DNA, 14 bp, Homo sapiens
tagaggcttctccg

SEQ ID NO: 1367878 - DNA, 21 bp, Homo sapiens
tagaggcttctccgccagcct

SEQ ID NO: 1367879 - DNA, 23 bp, Homo sapiens
tagaggcttctccgccagcctcc

SEQ ID NO: 1367880 - DNA, 12 bp, Homo sapiens
tagagtaatgaa

SEQ ID NO: 1367881 - DNA, 13 bp, Homo sapiens
tagagtacactgc

SEQ ID NO: 1367882 - DNA, 21 bp, Homo sapiens
tagagtacactgcctgcctta

SEQ ID NO: 1367883 - DNA, 20 bp, Homo sapiens
tagagtgtagtttacagaaa

SEQ ID NO: 1367884 - DNA, 13 bp, Homo sapiens
tagataatattgt

SEQ ID NO: 1367885 - DNA, 22 bp, Homo sapiens
tagatatgtattcttttctcag

SEQ ID NO: 1367886 - DNA, 21 bp, Homo sapiens
tagatatttttcataaacaag

SEQ ID NO: 1367887 - DNA, 19 bp, Homo sapiens
tagatcatagttttattta

SEQ ID NO: 1367888 - DNA, 18 bp, Homo sapiens
tagatccatttccattgc

SEQ ID NO: 1367889 - DNA, 21 bp, Homo sapiens
tagatccatttccattgctta

SEQ ID NO: 1367890 - DNA, 22 bp, Homo sapiens
tagattgactaactcaaataca

SEQ ID NO: 1367891 - DNA, 17 bp, Homo sapiens
tagcaaaataaaacata

SEQ ID NO: 1367892 - DNA, 23 bp, Homo sapiens
tagcaaaataaaacatagcaaat

SEQ ID NO: 1367893 - DNA, 21 bp, Homo sapiens
tagcaaaattcttaagtatgt

SEQ ID NO: 1367894 - DNA, 16 bp, Homo sapiens
tagcaacaacaattgg

SEQ ID NO: 1367895 - DNA, 19 bp, Homo sapiens
tagcaacaacaattggtaa

SEQ ID NO: 1367896 - DNA, 17 bp, Homo sapiens
tagcaacttttgtgtaa

SEQ ID NO: 1367897 - DNA, 18 bp, Homo sapiens
tagcaagttacagtgatg

SEQ ID NO: 1367898 - DNA, 14 bp, Homo sapiens
tagcaatctcttca

SEQ ID NO: 1367899 - DNA, 18 bp, Homo sapiens
tagcagccagttcaaaaa

SEQ ID NO: 1367900 - DNA, 14 bp, Homo sapiens
tagcagcccaccct

SEQ ID NO: 1367901 - DNA, 15 bp, Homo sapiens
tagcagcccaccctg

SEQ ID NO: 1367902 - DNA, 17 bp, Homo sapiens
tagcagcccaccctgct

SEQ ID NO: 1367903 - DNA, 21 bp, Homo sapiens
tagcagcccaccctgctgctg

SEQ ID NO: 1367904 - DNA, 23 bp, Homo sapiens
tagcatcacttaaaacacgtttt

SEQ ID NO: 1367905 - DNA, 16 bp, Homo sapiens
tagcatgaaataaaat

SEQ ID NO: 1367906 - DNA, 12 bp, Homo sapiens
tagcatgtaatg

SEQ ID NO: 1367907 - DNA, 18 bp, Homo sapiens
tagccagcccctcttccc

SEQ ID NO: 1367908 - DNA, 15 bp, Homo sapiens
tagccccctggcctc

SEQ ID NO: 1367909 - DNA, 19 bp, Homo sapiens
tagccgcccatgcactggg

SEQ ID NO: 1367910 - DNA, 17 bp, Homo sapiens
tagcctgcctcttctct

SEQ ID NO: 1367911 - DNA, 14 bp, Homo sapiens
tagcctggactgct

SEQ ID NO: 1367912 - DNA, 20 bp, Homo sapiens
tagcgaaccctttatttgaa

SEQ ID NO: 1367913 - DNA, 20 bp, Homo sapiens
tagcgactaaactagatttt

SEQ ID NO: 1367914 - DNA, 19 bp, Homo sapiens
tagcgatctctcctggcct

SEQ ID NO: 1367915 - DNA, 15 bp, Homo sapiens
tagctaactgtaaat

SEQ ID NO: 1367916 - DNA, 21 bp, Homo sapiens
tagctccccgcttctgcctgc

SEQ ID NO: 1367917 - DNA, 19 bp, Homo sapiens
tagctcctccccttcctct

SEQ ID NO: 1367918 - DNA, 22 bp, Homo sapiens
tagctcctgtggccccaccctg

SEQ ID NO: 1367919 - DNA, 15 bp, Homo sapiens
tagctgaagaattga

SEQ ID NO: 1367920 - DNA, 19 bp, Homo sapiens
tagcttgggaggcttcccc

SEQ ID NO: 1367921 - DNA, 16 bp, Homo sapiens
tagctttagaccctgg

SEQ ID NO: 1367922 - DNA, 12 bp, Homo sapiens
taggaataaata

SEQ ID NO: 1367923 - DNA, 20 bp, Homo sapiens
taggaatcattcagaaatgt

SEQ ID NO: 1367924 - DNA, 14 bp, Homo sapiens
taggaccaagaaag

SEQ ID NO: 1367925 - DNA, 21 bp, Homo sapiens
taggacctttccaccacagcc

SEQ ID NO: 1367926 - DNA, 16 bp, Homo sapiens
taggagggtgggaagg

SEQ ID NO: 1367927 - DNA, 17 bp, Homo sapiens
taggatgggcttctgtg

SEQ ID NO: 1367928 - DNA, 23 bp, Homo sapiens
taggattttaacttaactgaaat

SEQ ID NO: 1367929 - DNA, 14 bp, Homo sapiens
taggatttttagaa

SEQ ID NO: 1367930 - DNA, 19 bp, Homo sapiens
taggcaaggctatgtgatt

SEQ ID NO: 1367931 - DNA, 14 bp, Homo sapiens
taggcccccacttg

SEQ ID NO: 1367932 - DNA, 19 bp, Homo sapiens
taggcccccacttgcctct

SEQ ID NO: 1367933 - DNA, 15 bp, Homo sapiens
taggcgaccaccgcc

SEQ ID NO: 1367934 - DNA, 18 bp, Homo sapiens
taggcttagtttgtgtgt

SEQ ID NO: 1367935 - DNA, 11 bp, Homo sapiens
tagggaaaaac

SEQ ID NO: 1367936 - DNA, 18 bp, Homo sapiens
tagggagggcggcagggg

SEQ ID NO: 1367937 - DNA, 15 bp, Homo sapiens
tagggcaccaggggt

SEQ ID NO: 1367938 - DNA, 15 bp, Homo sapiens
tagggggctttctgg

SEQ ID NO: 1367939 - DNA, 20 bp, Homo sapiens
taggtagaagtgagcaaaaa

SEQ ID NO: 1367940 - DNA, 15 bp, Homo sapiens
taggtagagtctgag

SEQ ID NO: 1367941 - DNA, 12 bp, Homo sapiens
taggtctccagt

SEQ ID NO: 1367942 - DNA, 13 bp, Homo sapiens
taggtgtggggga

SEQ ID NO: 1367943 - DNA, 14 bp, Homo sapiens
taggttcagccaag

SEQ ID NO: 1367944 - DNA, 18 bp, Homo sapiens
tagtaagaagacaaactg

SEQ ID NO: 1367945 - DNA, 21 bp, Homo sapiens
tagtaagattgatatctataa

SEQ ID NO: 1367946 - DNA, 12 bp, Homo sapiens
tagtaagcatag

SEQ ID NO: 1367947 - DNA, 14 bp, Homo sapiens
tagtaatttctttt

SEQ ID NO: 1367948 - DNA, 21 bp, Homo sapiens
tagtaatttctttttttcctt

SEQ ID NO: 1367949 - DNA, 13 bp, Homo sapiens
tagtatgaaaatg

SEQ ID NO: 1367950 - DNA, 17 bp, Homo sapiens
tagtcatatattaaaca

SEQ ID NO: 1367951 - DNA, 21 bp, Homo sapiens
tagtccaaaaagctcctgggg

SEQ ID NO: 1367952 - DNA, 16 bp, Homo sapiens
tagtctctttaaaagg

SEQ ID NO: 1367953 - DNA, 16 bp, Homo sapiens
tagtcttttgcttttg

SEQ ID NO: 1367954 - DNA, 14 bp, Homo sapiens
tagtgaaacttttc

SEQ ID NO: 1367955 - DNA, 22 bp, Homo sapiens
tagtgctccatagtttggcatt

SEQ ID NO: 1367956 - DNA, 23 bp, Homo sapiens
tagtgtaacttgcttaaatttct

SEQ ID NO: 1367957 - DNA, 18 bp, Homo sapiens
tagtgtacatttctataa

SEQ ID NO: 1367958 - DNA, 13 bp, Homo sapiens
tagtgttatatga

SEQ ID NO: 1367959 - DNA, 15 bp, Homo sapiens
tagtgttatatgaac

SEQ ID NO: 1367960 - DNA, 17 bp, Homo sapiens
tagtgttatatgaacat

SEQ ID NO: 1367961 - DNA, 16 bp, Homo sapiens
tagttactgtgtaaac

SEQ ID NO: 1367962 - DNA, 19 bp, Homo sapiens
tagttactgtgtaaactca

SEQ ID NO: 1367963 - DNA, 13 bp, Homo sapiens
tagttatgtaaat

SEQ ID NO: 1367964 - DNA, 15 bp, Homo sapiens
tagttctgtatttga

SEQ ID NO: 1367965 - DNA, 17 bp, Homo sapiens
tagttctgtatttgaaa

SEQ ID NO: 1367966 - DNA, 20 bp, Homo sapiens
tagttctttaaactgtcgtg

SEQ ID NO: 1367967 - DNA, 17 bp, Homo sapiens
tagttgaatacttgaac

SEQ ID NO: 1367968 - DNA, 20 bp, Homo sapiens
tagttgaatacttgaaccat

SEQ ID NO: 1367969 - DNA, 17 bp, Homo sapiens
tagttgccttaaaataa

SEQ ID NO: 1367970 - DNA, 17 bp, Homo sapiens
tagtttctttattttgt

SEQ ID NO: 1367971 - DNA, 13 bp, Homo sapiens
tagtttgtgagaa

SEQ ID NO: 1367972 - DNA, 15 bp, Homo sapiens
tagtttgtgagaaac

SEQ ID NO: 1367973 - DNA, 15 bp, Homo sapiens
tagttttatttatat

SEQ ID NO: 1367974 - DNA, 22 bp, Homo sapiens
tagttttatttatatttattga

SEQ ID NO: 1367975 - DNA, 15 bp, Homo sapiens
tagttttgtcaaact

SEQ ID NO: 1367976 - DNA, 15 bp, Homo sapiens
tataaaatacatagt

SEQ ID NO: 1367977 - DNA, 21 bp, Homo sapiens
tataaaatacatagtgaaaat

SEQ ID NO: 1367978 - DNA, 19 bp, Homo sapiens
tataaaatataaacaaaga

SEQ ID NO: 1367979 - DNA, 17 bp, Homo sapiens
tataaaatcctgtgcaa

SEQ ID NO: 1367980 - DNA, 21 bp, Homo sapiens
tataaaatcctgtgcaataga

SEQ ID NO: 1367981 - DNA, 20 bp, Homo sapiens
tataaaattatgagattggt

SEQ ID NO: 1367982 - DNA, 18 bp, Homo sapiens
tataaacaaagattcatg

SEQ ID NO: 1367983 - DNA, 21 bp, Homo sapiens
tataaacagaaatggaaagca

SEQ ID NO: 1367984 - DNA, 12 bp, Homo sapiens
tataaagcagta

SEQ ID NO: 1367985 - DNA, 16 bp, Homo sapiens
tataaagtagtcctgt

SEQ ID NO: 1367986 - DNA, 18 bp, Homo sapiens
tataaagtagtcctgtga

SEQ ID NO: 1367987 - DNA, 22 bp, Homo sapiens
tattaaatttttttgtatgaaa

SEQ ID NO: 1367988 - DNA, 14 bp, Homo sapiens
tattaaggaagaca

SEQ ID NO: 1367989 - DNA, 13 bp, Homo sapiens
tattaatatttaa

SEQ ID NO: 1367990 - DNA, 17 bp, Homo sapiens
tattaatcactgtgtat

SEQ ID NO: 1367991 - DNA, 20 bp, Homo sapiens
tattaatgcactttctatcc

SEQ ID NO: 1367992 - DNA, 14 bp, Homo sapiens
tattacaatgatca

SEQ ID NO: 1367993 - DNA, 18 bp, Homo sapiens
tattacatgtaatttgat

SEQ ID NO: 1367994 - DNA, 21 bp, Homo sapiens
tattaccccctccttcagaca

SEQ ID NO: 1367995 - DNA, 20 bp, Homo sapiens
tattacgaagttcaagatca

SEQ ID NO: 1367996 - DNA, 17 bp, Homo sapiens
tattactgacatttctt

SEQ ID NO: 1367997 - DNA, 18 bp, Homo sapiens
tattactgacatttcttc

SEQ ID NO: 1367998 - DNA, 15 bp, Homo sapiens
tattactgtttatta

SEQ ID NO: 1367999 - DNA, 15 bp, Homo sapiens
tattacttccatgaa

SEQ ID NO: 1368000 - DNA, 15 bp, Homo sapiens
tattagatgcactta

SEQ ID NO: 1368001 - DNA, 21 bp, Homo sapiens
tattagccaggtaatgtgaat

SEQ ID NO: 1368002 - DNA, 13 bp, Homo sapiens
tattagtgttata

SEQ ID NO: 1368003 - DNA, 14 bp, Homo sapiens
tattagtgttatat

SEQ ID NO: 1368004 - DNA, 18 bp, Homo sapiens
tattagtgttatatgaac

SEQ ID NO: 1368005 - DNA, 19 bp, Homo sapiens
tattatacatgtgatacat

SEQ ID NO: 1368006 - DNA, 22 bp, Homo sapiens
tattatcaaagggataaagaaa

SEQ ID NO: 1368007 - DNA, 20 bp, Homo sapiens
tattatcaggggagaaaaat

SEQ ID NO: 1368008 - DNA, 20 bp, Homo sapiens
tattatggaaaactgtgttg

SEQ ID NO: 1368009 - DNA, 15 bp, Homo sapiens
tattatgtagttgtt

SEQ ID NO: 1368010 - DNA, 22 bp, Homo sapiens
tattatttattttttttaattg

SEQ ID NO: 1368011 - DNA, 14 bp, Homo sapiens
tattcactggcccc

SEQ ID NO: 1368012 - DNA, 22 bp, Homo sapiens
tattccagatctttcagaaata

SEQ ID NO: 1368013 - DNA, 19 bp, Homo sapiens
tattctataaaactctgca

SEQ ID NO: 1368014 - DNA, 17 bp, Homo sapiens
tattctgagaaaacaag

SEQ ID NO: 1368015 - DNA, 13 bp, Homo sapiens
tattcttctcttc

SEQ ID NO: 1368016 - DNA, 13 bp, Homo sapiens
tattcttttctca

SEQ ID NO: 1368017 - DNA, 16 bp, Homo sapiens
tattgacactgaactt

SEQ ID NO: 1368018 - DNA, 19 bp, Homo sapiens
tattgacactgaacttaat

SEQ ID NO: 1368019 - DNA, 15 bp, Homo sapiens
tattgactctgggtc

SEQ ID NO: 1368020 - DNA, 20 bp, Homo sapiens
tattgactctgggtccttcc

SEQ ID NO: 1368021 - DNA, 22 bp, Homo sapiens
tattgaggccaagaatattgca

SEQ ID NO: 1368022 - DNA, 23 bp, Homo sapiens
tattgaggccaagaatattgcaa

SEQ ID NO: 1368023 - DNA, 14 bp, Homo sapiens
tattgattgggaaa

SEQ ID NO: 1368024 - DNA, 18 bp, Homo sapiens
tattgattgggaaaacat

SEQ ID NO: 1368025 - DNA, 13 bp, Homo sapiens
tattgcagtttat

SEQ ID NO: 1368026 - DNA, 18 bp, Homo sapiens
tattggggccatgagtaa

SEQ ID NO: 1368027 - DNA, 15 bp, Homo sapiens
tattggttttatgat

SEQ ID NO: 1368028 - DNA, 16 bp, Homo sapiens
tattgttaatacaagg

SEQ ID NO: 1368029 - DNA, 13 bp, Homo sapiens
tattgtttctgca

SEQ ID NO: 1368030 - DNA, 17 bp, Homo sapiens
tattgtttggtaaatgt

SEQ ID NO: 1368031 - DNA, 14 bp, Homo sapiens
tattgttttacaat

SEQ ID NO: 1368032 - DNA, 21 bp, Homo sapiens
tatttaaatcctgaagagcat

SEQ ID NO: 1368033 - DNA, 14 bp, Homo sapiens
tatttaaattacaa

SEQ ID NO: 1368034 - DNA, 15 bp, Homo sapiens
tatttaacattattt

SEQ ID NO: 1368035 - DNA, 14 bp, Homo sapiens
tatttaagatgtga

SEQ ID NO: 1368036 - DNA, 16 bp, Homo sapiens
tatttaagatgtgaaa

SEQ ID NO: 1368037 - DNA, 22 bp, Homo sapiens
tatttagttgtaaaccaagtga

SEQ ID NO: 1368038 - DNA, 15 bp, Homo sapiens
tatttatatgtatgt

SEQ ID NO: 1368039 - DNA, 17 bp, Homo sapiens
tatttatatgtatgtgt

SEQ ID NO: 1368040 - DNA, 19 bp, Homo sapiens
tatttatatgtatgtgttt

SEQ ID NO: 1368041 - DNA, 22 bp, Homo sapiens
tatttatatgtatgtgtttaga

SEQ ID NO: 1368042 - DNA, 20 bp, Homo sapiens
tatttatccagaaaactgtg

SEQ ID NO: 1368043 - DNA, 22 bp, Homo sapiens
tatttatgggcccctggcactc

SEQ ID NO: 1368044 - DNA, 13 bp, Homo sapiens
tatttatgtttgc

SEQ ID NO: 1368045 - DNA, 13 bp, Homo sapiens
tatttattaatat

SEQ ID NO: 1368046 - DNA, 17 bp, Homo sapiens
tatttattaatatttaa

SEQ ID NO: 1368047 - DNA, 14 bp, Homo sapiens
tatttattatttat

SEQ ID NO: 1368048 - DNA, 11 bp, Homo sapiens
tatttatttac

SEQ ID NO: 1368049 - DNA, 14 bp, Homo sapiens
tatttatttatgta

SEQ ID NO: 1368050 - DNA, 21 bp, Homo sapiens
tatttattttcctaaagagag

SEQ ID NO: 1368051 - DNA, 20 bp, Homo sapiens
tatttcaaaatatacattca

SEQ ID NO: 1368052 - DNA, 16 bp, Homo sapiens
tatttcacttgatgat

SEQ ID NO: 1368053 - DNA, 19 bp, Homo sapiens
tatttccactaaaaatatt

SEQ ID NO: 1368054 - DNA, 18 bp, Homo sapiens
tatttccctctcattttg

SEQ ID NO: 1368055 - DNA, 14 bp, Homo sapiens
tatttcctttatgt

SEQ ID NO: 1368056 - DNA, 18 bp, Homo sapiens
tatttcctttatgtgaat

SEQ ID NO: 1368057 - DNA, 13 bp, Homo sapiens
tatttctattatt

SEQ ID NO: 1368058 - DNA, 21 bp, Homo sapiens
tatttctattattaattgcaa

SEQ ID NO: 1368059 - DNA, 15 bp, Homo sapiens
tatttgaaagtgcct

SEQ ID NO: 1368060 - DNA, 12 bp, Homo sapiens
tatttgaatttt

SEQ ID NO: 1368061 - DNA, 21 bp, Homo sapiens
tatttgacaacgtttcagcga

SEQ ID NO: 1368062 - DNA, 15 bp, Homo sapiens
tatttgatttattaa

SEQ ID NO: 1368063 - DNA, 23 bp, Homo sapiens
tatttgatttattaacttaataa

SEQ ID NO: 1368064 - DNA, 12 bp, Homo sapiens
tatttgcatgtt

SEQ ID NO: 1368065 - DNA, 20 bp, Homo sapiens
tatttgtaaatttagtgttt

SEQ ID NO: 1368066 - DNA, 21 bp, Homo sapiens
tatttgtaaatttagtgtttt

SEQ ID NO: 1368067 - DNA, 23 bp, Homo sapiens
tattttaagactgattttaatag

SEQ ID NO: 1368068 - DNA, 15 bp, Homo sapiens
tattttacacagaaa

SEQ ID NO: 1368069 - DNA, 17 bp, Homo sapiens
tattttacacagaaaca

SEQ ID NO: 1368070 - DNA, 18 bp, Homo sapiens
tattttacacagaaacac

SEQ ID NO: 1368071 - DNA, 23 bp, Homo sapiens
tattttacacagaaacactgcct

SEQ ID NO: 1368072 - DNA, 13 bp, Homo sapiens
tattttatggtta

SEQ ID NO: 1368073 - DNA, 15 bp, Homo sapiens
tattttattactgtt

SEQ ID NO: 1368074 - DNA, 22 bp, Homo sapiens
tattttccctattagagaagag

SEQ ID NO: 1368075 - DNA, 14 bp, Homo sapiens
tattttctatttta

SEQ ID NO: 1368076 - DNA, 20 bp, Homo sapiens
tattttctctgtacttttca

SEQ ID NO: 1368077 - DNA, 22 bp, Homo sapiens
tattttgaatcaataatatatt

SEQ ID NO: 1368078 - DNA, 18 bp, Homo sapiens
tattttgtcatatcaaat

SEQ ID NO: 1368079 - DNA, 19 bp, Homo sapiens
tatttttagactcatcaat

SEQ ID NO: 1368080 - DNA, 20 bp, Homo sapiens
tatttttataattgtacaaa

SEQ ID NO: 1368081 - DNA, 20 bp, Homo sapiens
tatttttatatcatgcaaaa

SEQ ID NO: 1368082 - DNA, 17 bp, Homo sapiens
tatttttatatttcctt

SEQ ID NO: 1368083 - DNA, 15 bp, Homo sapiens
tattttttggacttc

SEQ ID NO: 1368084 - DNA, 15 bp, Homo sapiens
tatttttttaaaatt

SEQ ID NO: 1368085 - DNA, 16 bp, Homo sapiens
tatttttttttctaag

SEQ ID NO: 1368086 - DNA, 19 bp, Homo sapiens
tatttttttttctaagaga

SEQ ID NO: 1368087 - DNA, 17 bp, Homo sapiens
tattttttttttcttct

SEQ ID NO: 1368088 - DNA, 19 bp, Homo sapiens
tcaaaaaggcttataaaac

SEQ ID NO: 1368089 - DNA, 20 bp, Homo sapiens
tcaaaaaggcttataaaaca

SEQ ID NO: 1368090 - DNA, 16 bp, Homo sapiens
tcaaaagctgggcagg

SEQ ID NO: 1368091 - DNA, 21 bp, Homo sapiens
tcaaaaggtattatacatgtg

SEQ ID NO: 1368092 - DNA, 23 bp, Homo sapiens
tcaaaagtagaactttgtatagt

SEQ ID NO: 1368093 - DNA, 23 bp, Homo sapiens
tcaaaatccaaaaagaaatgatg

SEQ ID NO: 1368094 - DNA, 17 bp, Homo sapiens
tcaaacatgagatgtgt

SEQ ID NO: 1368095 - DNA, 18 bp, Homo sapiens
tcaaactcaatgctttat

SEQ ID NO: 1368096 - DNA, 22 bp, Homo sapiens
tcaaactcaatgctttatttgt

SEQ ID NO: 1368097 - DNA, 14 bp, Homo sapiens
tcaaacttccagtc

SEQ ID NO: 1368098 - DNA, 15 bp, Homo sapiens
tcaaagaaatattaa

SEQ ID NO: 1368099 - DNA, 21 bp, Homo sapiens
tcaaagacctggggctgctgt

SEQ ID NO: 1368100 - DNA, 12 bp, Homo sapiens
tcaaagaggttt

SEQ ID NO: 1368101 - DNA, 11 bp, Homo sapiens
tcaaagccttc

SEQ ID NO: 1368102 - DNA, 22 bp, Homo sapiens
tcaaagcttggattaaatacat

SEQ ID NO: 1368103 - DNA, 13 bp, Homo sapiens
tcaaagtcattaa

SEQ ID NO: 1368104 - DNA, 17 bp, Homo sapiens
tcaaagtcattaaagac

SEQ ID NO: 1368105 - DNA, 20 bp, Homo sapiens
tccaggctttcccacttccc

SEQ ID NO: 1368106 - DNA, 22 bp, Homo sapiens
tccaggctttcccacttcccac

SEQ ID NO: 1368107 - DNA, 14 bp, Homo sapiens
tccagggaatccaa

SEQ ID NO: 1368108 - DNA, 20 bp, Homo sapiens
tccagggaatccaagcctcc

SEQ ID NO: 1368109 - DNA, 11 bp, Homo sapiens
tccagggaggg

SEQ ID NO: 1368110 - DNA, 20 bp, Homo sapiens
tccaggtttaagctgttact

SEQ ID NO: 1368111 - DNA, 15 bp, Homo sapiens
tccagtaagatcact

SEQ ID NO: 1368112 - DNA, 17 bp, Homo sapiens
tccagtaagatcactgt

SEQ ID NO: 1368113 - DNA, 18 bp, Homo sapiens
tccagtaagatcactgtt

SEQ ID NO: 1368114 - DNA, 14 bp, Homo sapiens
tccagtgacctctc

SEQ ID NO: 1368115 - DNA, 20 bp, Homo sapiens
tccagttcatcgattttcta

SEQ ID NO: 1368116 - DNA, 19 bp, Homo sapiens
tccatagtttggcatttgc

SEQ ID NO: 1368117 - DNA, 19 bp, Homo sapiens
tccatattttattactgtt

SEQ ID NO: 1368118 - DNA, 23 bp, Homo sapiens
tccatattttattactgtttatt

SEQ ID NO: 1368119 - DNA, 13 bp, Homo sapiens
tccatccaaggcc

SEQ ID NO: 1368120 - DNA, 15 bp, Homo sapiens
tccatccctctaatg

SEQ ID NO: 1368121 - DNA, 22 bp, Homo sapiens
tccattccacacagaatgcaac

SEQ ID NO: 1368122 - DNA, 16 bp, Homo sapiens
tccattctcccaggta

SEQ ID NO: 1368123 - DNA, 12 bp, Homo sapiens
tccatttgagaa

SEQ ID NO: 1368124 - DNA, 14 bp, Homo sapiens
tccatttgagaaaa

SEQ ID NO: 1368125 - DNA, 15 bp, Homo sapiens
tcccaaacgcctccc

SEQ ID NO: 1368126 - DNA, 15 bp, Homo sapiens
tcccaacaagcagct

SEQ ID NO: 1368127 - DNA, 15 bp, Homo sapiens
tcccaaccaggcacc

SEQ ID NO: 1368128 - DNA, 14 bp, Homo sapiens
tcccaagatgttga

SEQ ID NO: 1368129 - DNA, 23 bp, Homo sapiens
tcccaagatgttgatttttactg

SEQ ID NO: 1368130 - DNA, 12 bp, Homo sapiens
tcccacacccaa

SEQ ID NO: 1368131 - DNA, 14 bp, Homo sapiens
tcccacccccagcc

SEQ ID NO: 1368132 - DNA, 17 bp, Homo sapiens
tcccacccccagccccg

SEQ ID NO: 1368133 - DNA, 16 bp, Homo sapiens
tcccacttctgccaga

SEQ ID NO: 1368134 - DNA, 16 bp, Homo sapiens
tcccagatacttgggg

SEQ ID NO: 1368135 - DNA, 15 bp, Homo sapiens
tcccagcctcagcgc

SEQ ID NO: 1368136 - DNA, 15 bp, Homo sapiens
tcccaggaagcccag

SEQ ID NO: 1368137 - DNA, 13 bp, Homo sapiens
tcccaggagcctg

SEQ ID NO: 1368138 - DNA, 18 bp, Homo sapiens
tcccatagtccctgccac

SEQ ID NO: 1368139 - DNA, 19 bp, Homo sapiens
tcccatctgcaccccttct

SEQ ID NO: 1368140 - DNA, 13 bp, Homo sapiens
tcccatgtagccc

SEQ ID NO: 1368141 - DNA, 15 bp, Homo sapiens
tcccatgtagccccc

SEQ ID NO: 1368142 - DNA, 14 bp, Homo sapiens
tcccattccaggca

SEQ ID NO: 1368143 - DNA, 23 bp, Homo sapiens
tccccaaatcaatacactagttg

SEQ ID NO: 1368144 - DNA, 17 bp, Homo sapiens
tccccacagcgtccctg

SEQ ID NO: 1368145 - DNA, 20 bp, Homo sapiens
tccccacagcgtccctggcg

SEQ ID NO: 1368146 - DNA, 13 bp, Homo sapiens
tccccacccctgc

SEQ ID NO: 1368147 - DNA, 15 bp, Homo sapiens
tccccacccctgccc

SEQ ID NO: 1368148 - DNA, 20 bp, Homo sapiens
tccccagcctgcgcctgctg

SEQ ID NO: 1368149 - DNA, 16 bp, Homo sapiens
tccccaggtccagctc

SEQ ID NO: 1368150 - DNA, 20 bp, Homo sapiens
tccccatctccctgcctggc

SEQ ID NO: 1368151 - DNA, 15 bp, Homo sapiens
tccccatttcccatc

SEQ ID NO: 1368152 - DNA, 22 bp, Homo sapiens
tcccccaccggtccagctggcc

SEQ ID NO: 1368153 - DNA, 21 bp, Homo sapiens
tcccccagccatgccagctgg

SEQ ID NO: 1368154 - DNA, 23 bp, Homo sapiens
tcccccagccatgccagctggcc

SEQ ID NO: 1368155 - DNA, 15 bp, Homo sapiens
tccccccatcttgct

SEQ ID NO: 1368156 - DNA, 14 bp, Homo sapiens
tccccgcctggcca

SEQ ID NO: 1368157 - DNA, 16 bp, Homo sapiens
tccccgcctggccagg

SEQ ID NO: 1368158 - DNA, 18 bp, Homo sapiens
tccccgcctggccaggag

SEQ ID NO: 1368159 - DNA, 20 bp, Homo sapiens
tccccgcctggccaggagca

SEQ ID NO: 1368160 - DNA, 16 bp, Homo sapiens
tccccgctgctgtgca

SEQ ID NO: 1368161 - DNA, 13 bp, Homo sapiens
tcccctgccacca

SEQ ID NO: 1368162 - DNA, 17 bp, Homo sapiens
tcccctgccaccaggcc

SEQ ID NO: 1368163 - DNA, 19 bp, Homo sapiens
tcccctgccaccaggccac

SEQ ID NO: 1368164 - DNA, 22 bp, Homo sapiens
tcccctgtagagtgggagctga

SEQ ID NO: 1368165 - DNA, 18 bp, Homo sapiens
tccccttcctcttgtctg

SEQ ID NO: 1368166 - DNA, 17 bp, Homo sapiens
tcccgggccccacagac

SEQ ID NO: 1368167 - DNA, 17 bp, Homo sapiens
tcccgttttccccatga

SEQ ID NO: 1368168 - DNA, 18 bp, Homo sapiens
tccctaccgacccagggt

SEQ ID NO: 1368169 - DNA, 20 bp, Homo sapiens
tccctagctttagaccctgg

SEQ ID NO: 1368170 - DNA, 10 bp, Homo sapiens
tccctcaccc

SEQ ID NO: 1368171 - DNA, 17 bp, Homo sapiens
tccctcaccccctccca

SEQ ID NO: 1368172 - DNA, 23 bp, Homo sapiens
tccctcaccccctcccaccccca

SEQ ID NO: 1368173 - DNA, 13 bp, Homo sapiens
tccctccacccca

SEQ ID NO: 1368174 - DNA, 14 bp, Homo sapiens
tccctcctccaggc

SEQ ID NO: 1368175 - DNA, 16 bp, Homo sapiens
tccctcctccaggcct

SEQ ID NO: 1368176 - DNA, 21 bp, Homo sapiens
tccctcctccaggcctgcctc

SEQ ID NO: 1368177 - DNA, 19 bp, Homo sapiens
tccctctaatgagactgac

SEQ ID NO: 1368178 - DNA, 14 bp, Homo sapiens
tccctctcctaact

SEQ ID NO: 1368179 - DNA, 12 bp, Homo sapiens
tccctgcttcca

SEQ ID NO: 1368180 - DNA, 22 bp, Homo sapiens
tcccttccagatggtcatccag

SEQ ID NO: 1368181 - DNA, 16 bp, Homo sapiens
tcccttccccatgctt

SEQ ID NO: 1368182 - DNA, 19 bp, Homo sapiens
tcccttccttttccctgct

SEQ ID NO: 1368183 - DNA, 19 bp, Homo sapiens
tcccttgagggctgcagtt

SEQ ID NO: 1368184 - DNA, 13 bp, Homo sapiens
tccgagagggaga

SEQ ID NO: 1368185 - DNA, 18 bp, Homo sapiens
tccgcagtgtggccaggc

SEQ ID NO: 1368186 - DNA, 19 bp, Homo sapiens
tccgcagtgtggccaggct

SEQ ID NO: 1368187 - DNA, 14 bp, Homo sapiens
tccgcatccctacc

SEQ ID NO: 1368188 - DNA, 11 bp, Homo sapiens
tccgccagcct

SEQ ID NO: 1368189 - DNA, 12 bp, Homo sapiens
tccgccagcctc

SEQ ID NO: 1368190 - DNA, 14 bp, Homo sapiens
tccgccagcctcct

SEQ ID NO: 1368191 - DNA, 20 bp, Homo sapiens
tccgccagcctcctctggac

SEQ ID NO: 1368192 - DNA, 13 bp, Homo sapiens
tccgccctgccac

SEQ ID NO: 1368193 - DNA, 16 bp, Homo sapiens
tccgctgccagccttg

SEQ ID NO: 1368194 - DNA, 14 bp, Homo sapiens
tccgctgccgtgcc

SEQ ID NO: 1368195 - DNA, 19 bp, Homo sapiens
tccggcctctccagcctca

SEQ ID NO: 1368196 - DNA, 18 bp, Homo sapiens
tccggcctctgcctttgc

SEQ ID NO: 1368197 - DNA, 17 bp, Homo sapiens
tccggctcccagcctca

SEQ ID NO: 1368198 - DNA, 17 bp, Homo sapiens
tccgtgggacggtgccc

SEQ ID NO: 1368199 - DNA, 13 bp, Homo sapiens
tccgttggccact

SEQ ID NO: 1368200 - DNA, 15 bp, Homo sapiens
tccgttggccactcc

SEQ ID NO: 1368201 - DNA, 23 bp, Homo sapiens
tcctaaagaaaaatatcttggcc

SEQ ID NO: 1368202 - DNA, 14 bp, Homo sapiens
tcctaatggtgatg

SEQ ID NO: 1368203 - DNA, 13 bp, Homo sapiens
tcctacccttttc

SEQ ID NO: 1368204 - DNA, 22 bp, Homo sapiens
tcctactctcacactggttctc

SEQ ID NO: 1368205 - DNA, 18 bp, Homo sapiens
tcctagaggccctttgct

SEQ ID NO: 1368206 - DNA, 22 bp, Homo sapiens
tcctagcttgggaggcttcccc

SEQ ID NO: 1368207 - DNA, 13 bp, Homo sapiens
tcctaggcatttg

SEQ ID NO: 1368208 - DNA, 14 bp, Homo sapiens
tcctattagtgtta

SEQ ID NO: 1368209 - DNA, 19 bp, Homo sapiens
tcctattagtgttatatga

SEQ ID NO: 1368210 - DNA, 19 bp, Homo sapiens
tcctcaaattttttgactt

SEQ ID NO: 1368211 - DNA, 16 bp, Homo sapiens
tcctcacctcatgccc

SEQ ID NO: 1368212 - DNA, 13 bp, Homo sapiens
tcctccaggcctg

SEQ ID NO: 1368213 - DNA, 19 bp, Homo sapiens
tcctccaggcctgcctccc

SEQ ID NO: 1368214 - DNA, 17 bp, Homo sapiens
tcctcccttccttttcc

SEQ ID NO: 1368215 - DNA, 16 bp, Homo sapiens
tcctcctcacctcatg

SEQ ID NO: 1368216 - DNA, 15 bp, Homo sapiens
tcctcctgcagacca

SEQ ID NO: 1368217 - DNA, 20 bp, Homo sapiens
tcctcctgcagaccacgccc

SEQ ID NO: 1368218 - DNA, 19 bp, Homo sapiens
tcctcgcagcctctcagtg

SEQ ID NO: 1368219 - DNA, 21 bp, Homo sapiens
tcctcgcagcctctcagtgcc

SEQ ID NO: 1368220 - DNA, 16 bp, Homo sapiens
tcctctagaagccaag

SEQ ID NO: 1368221 - DNA, 17 bp, Homo sapiens
tcctctcccatccttga

SEQ ID NO: 1368222 - DNA, 14 bp, Homo sapiens
tcctctgcctgccc

SEQ ID NO: 1368223 - DNA, 22 bp, Homo sapiens
tcctctgcctgccccgccccca

SEQ ID NO: 1368224 - DNA, 19 bp, Homo sapiens
tctgtgtgtcagttttcat

SEQ ID NO: 1368225 - DNA, 17 bp, Homo sapiens
tctgttgataaatccat

SEQ ID NO: 1368226 - DNA, 18 bp, Homo sapiens
tctgttgtgtgtcatgcc

SEQ ID NO: 1368227 - DNA, 18 bp, Homo sapiens
tctgtttaattttcactt

SEQ ID NO: 1368228 - DNA, 14 bp, Homo sapiens
tcttaagaaatgta

SEQ ID NO: 1368229 - DNA, 15 bp, Homo sapiens
tcttaatgttcctca

SEQ ID NO: 1368230 - DNA, 16 bp, Homo sapiens
tcttactaaaaagtat

SEQ ID NO: 1368231 - DNA, 14 bp, Homo sapiens
tcttactttgtaaa

SEQ ID NO: 1368232 - DNA, 16 bp, Homo sapiens
tcttactttgtaaatt

SEQ ID NO: 1368233 - DNA, 17 bp, Homo sapiens
tcttactttgtaaattc

SEQ ID NO: 1368234 - DNA, 18 bp, Homo sapiens
tcttactttgtaaattct

SEQ ID NO: 1368235 - DNA, 16 bp, Homo sapiens
tcttagatcatagttt

SEQ ID NO: 1368236 - DNA, 21 bp, Homo sapiens
tcttataattgttctcagaat

SEQ ID NO: 1368237 - DNA, 17 bp, Homo sapiens
tcttcaaagccttctcc

SEQ ID NO: 1368238 - DNA, 18 bp, Homo sapiens
tcttcacctcctgccagc

SEQ ID NO: 1368239 - DNA, 17 bp, Homo sapiens
tcttcatcccattccag

SEQ ID NO: 1368240 - DNA, 17 bp, Homo sapiens
tcttcccatgcattctg

SEQ ID NO: 1368241 - DNA, 22 bp, Homo sapiens
tcttcctatccctctcctaact

SEQ ID NO: 1368242 - DNA, 23 bp, Homo sapiens
tcttcctcaaaataaagaagtat

SEQ ID NO: 1368243 - DNA, 23 bp, Homo sapiens
tcttccttgaagaactgcaggcc

SEQ ID NO: 1368244 - DNA, 15 bp, Homo sapiens
tcttctaattgctgt

SEQ ID NO: 1368245 - DNA, 14 bp, Homo sapiens
tcttctcagagtgg

SEQ ID NO: 1368246 - DNA, 17 bp, Homo sapiens
tcttctcattacttgtt

SEQ ID NO: 1368247 - DNA, 19 bp, Homo sapiens
tcttctcttccttttatca

SEQ ID NO: 1368248 - DNA, 21 bp, Homo sapiens
tcttctcttccttttatcagt

SEQ ID NO: 1368249 - DNA, 12 bp, Homo sapiens
tcttctggctca

SEQ ID NO: 1368250 - DNA, 18 bp, Homo sapiens
tcttctggctcaaaaaga

SEQ ID NO: 1368251 - DNA, 14 bp, Homo sapiens
tcttctgtattttt

SEQ ID NO: 1368252 - DNA, 22 bp, Homo sapiens
tcttcttaatatgttcttttaa

SEQ ID NO: 1368253 - DNA, 21 bp, Homo sapiens
tcttcttggggcccagtgcat

SEQ ID NO: 1368254 - DNA, 19 bp, Homo sapiens
tcttgaagcccccagccct

SEQ ID NO: 1368255 - DNA, 13 bp, Homo sapiens
tcttgagctggcc

SEQ ID NO: 1368256 - DNA, 17 bp, Homo sapiens
tcttgagctggcctctc

SEQ ID NO: 1368257 - DNA, 20 bp, Homo sapiens
tcttgagttgtttttgtata

SEQ ID NO: 1368258 - DNA, 18 bp, Homo sapiens
tcttgatacattcaaatt

SEQ ID NO: 1368259 - DNA, 15 bp, Homo sapiens
tcttgattcagtcac

SEQ ID NO: 1368260 - DNA, 17 bp, Homo sapiens
tcttgattcagtcacat

SEQ ID NO: 1368261 - DNA, 16 bp, Homo sapiens
tcttgcaccaaattat

SEQ ID NO: 1368262 - DNA, 21 bp, Homo sapiens
tcttgcaccaaattatcttga

SEQ ID NO: 1368263 - DNA, 15 bp, Homo sapiens
tcttgcccatcctga

SEQ ID NO: 1368264 - DNA, 18 bp, Homo sapiens
tcttgcccatcctgactg

SEQ ID NO: 1368265 - DNA, 14 bp, Homo sapiens
tcttgcctccaggt

SEQ ID NO: 1368266 - DNA, 18 bp, Homo sapiens
tcttgcctccaggtgcag

SEQ ID NO: 1368267 - DNA, 14 bp, Homo sapiens
tcttgcctctgtgc

SEQ ID NO: 1368268 - DNA, 15 bp, Homo sapiens
tcttgcctctgtgct

SEQ ID NO: 1368269 - DNA, 22 bp, Homo sapiens
tcttgcttccctaatctatggt

SEQ ID NO: 1368270 - DNA, 16 bp, Homo sapiens
tcttggcaataaattt

SEQ ID NO: 1368271 - DNA, 20 bp, Homo sapiens
tcttggcaataaattttgaa

SEQ ID NO: 1368272 - DNA, 14 bp, Homo sapiens
tcttggccagccaa

SEQ ID NO: 1368273 - DNA, 15 bp, Homo sapiens
tcttggcttaatcat

SEQ ID NO: 1368274 - DNA, 20 bp, Homo sapiens
tcttggcttaatcattttca

SEQ ID NO: 1368275 - DNA, 19 bp, Homo sapiens
tcttgggcagagctggctc

SEQ ID NO: 1368276 - DNA, 23 bp, Homo sapiens
tcttgggcagagctggctctgag

SEQ ID NO: 1368277 - DNA, 14 bp, Homo sapiens
tcttggtgtaattt

SEQ ID NO: 1368278 - DNA, 23 bp, Homo sapiens
tcttgtaaagactggttttctgc

SEQ ID NO: 1368279 - DNA, 13 bp, Homo sapiens
tcttgtcctagct

SEQ ID NO: 1368280 - DNA, 20 bp, Homo sapiens
tcttgtcctcattcttgcct

SEQ ID NO: 1368281 - DNA, 22 bp, Homo sapiens
tcttgttgctcaaaaaatgagc

SEQ ID NO: 1368282 - DNA, 14 bp, Homo sapiens
tcttgtttctgaaa

SEQ ID NO: 1368283 - DNA, 15 bp, Homo sapiens
tctttaaaagaatga

SEQ ID NO: 1368284 - DNA, 17 bp, Homo sapiens
tctttaaaagaatgact

SEQ ID NO: 1368285 - DNA, 15 bp, Homo sapiens
tctttaataaataac

SEQ ID NO: 1368286 - DNA, 22 bp, Homo sapiens
tctttagtttttggttgggaat

SEQ ID NO: 1368287 - DNA, 18 bp, Homo sapiens
tctttattttgtgtaaaa

SEQ ID NO: 1368288 - DNA, 23 bp, Homo sapiens
tctttcaaaggaacattgtgtct

SEQ ID NO: 1368289 - DNA, 18 bp, Homo sapiens
tctttcagaaatataaca

SEQ ID NO: 1368290 - DNA, 16 bp, Homo sapiens
tctttcagtacttttt

SEQ ID NO: 1368291 - DNA, 18 bp, Homo sapiens
tctttcccatggggaggg

SEQ ID NO: 1368292 - DNA, 16 bp, Homo sapiens
tctttcctgaaccatg

SEQ ID NO: 1368293 - DNA, 16 bp, Homo sapiens
tctttgaatatgtagt

SEQ ID NO: 1368294 - DNA, 21 bp, Homo sapiens
tctttgccagtcattcagcag

SEQ ID NO: 1368295 - DNA, 13 bp, Homo sapiens
tcttttaaagacc

SEQ ID NO: 1368296 - DNA, 23 bp, Homo sapiens
tcttttgccttttgcaaccagga

SEQ ID NO: 1368297 - DNA, 18 bp, Homo sapiens
tcttttgcttttggcaaa

SEQ ID NO: 1368298 - DNA, 12 bp, Homo sapiens
tcttttgtttgg

SEQ ID NO: 1368299 - DNA, 16 bp, Homo sapiens
tcttttgtttggtaaa

SEQ ID NO: 1368300 - DNA, 12 bp, Homo sapiens
tcttttttaacc

SEQ ID NO: 1368301 - DNA, 23 bp, Homo sapiens
tcttttttaaccggtaagagttt

SEQ ID NO: 1368302 - DNA, 15 bp, Homo sapiens
tcttttttattaatc

SEQ ID NO: 1368303 - DNA, 16 bp, Homo sapiens
tctttttttttaagtt

SEQ ID NO: 1368304 - DNA, 12 bp, Homo sapiens
tgaaaaatataa

SEQ ID NO: 1368305 - DNA, 13 bp, Homo sapiens
tgaaaaatataaa

SEQ ID NO: 1368306 - DNA, 17 bp, Homo sapiens
tgaaaaatataaaatta

SEQ ID NO: 1368307 - DNA, 23 bp, Homo sapiens
tgaaaaatctgttgataaatcca

SEQ ID NO: 1368308 - DNA, 20 bp, Homo sapiens
tgaaaagaaaaatgagcctg

SEQ ID NO: 1368309 - DNA, 23 bp, Homo sapiens
tgaaaatacaacttaaataataa

SEQ ID NO: 1368310 - DNA, 20 bp, Homo sapiens
tgaaaatagtttattttaaa

SEQ ID NO: 1368311 - DNA, 23 bp, Homo sapiens
tgaaaatagtttattttaaaaca

SEQ ID NO: 1368312 - DNA, 23 bp, Homo sapiens
tgaaaatgaatatctattaatat

SEQ ID NO: 1368313 - DNA, 22 bp, Homo sapiens
tgaaaattcatagtaagattga

SEQ ID NO: 1368314 - DNA, 22 bp, Homo sapiens
tgaaaattgtttagtgatatta

SEQ ID NO: 1368315 - DNA, 23 bp, Homo sapiens
tgaaaccccaaacagtgactgta

SEQ ID NO: 1368316 - DNA, 19 bp, Homo sapiens
tgaaactaaagcaatagaa

SEQ ID NO: 1368317 - DNA, 20 bp, Homo sapiens
tgaaactaaagcaatagaaa

SEQ ID NO: 1368318 - DNA, 21 bp, Homo sapiens
tgaaactttgggaaaacatgt

SEQ ID NO: 1368319 - DNA, 23 bp, Homo sapiens
tgaaactttgggaaaacatgtta

SEQ ID NO: 1368320 - DNA, 23 bp, Homo sapiens
tgaaacttttctagaattatttt

SEQ ID NO: 1368321 - DNA, 14 bp, Homo sapiens
tgaaagaaaattga

SEQ ID NO: 1368322 - DNA, 15 bp, Homo sapiens
tgaaagaaaattgag

SEQ ID NO: 1368323 - DNA, 17 bp, Homo sapiens
tgaaagaaaattgagtt

SEQ ID NO: 1368324 - DNA, 16 bp, Homo sapiens
tgaaagatgatcattt

SEQ ID NO: 1368325 - DNA, 18 bp, Homo sapiens
tgaaagccctgagctttc

SEQ ID NO: 1368326 - DNA, 20 bp, Homo sapiens
tgaaaggcaggcctatttca

SEQ ID NO: 1368327 - DNA, 11 bp, Homo sapiens
tgaaaggcttt

SEQ ID NO: 1368328 - DNA, 14 bp, Homo sapiens
tgaaagtgcatttt

SEQ ID NO: 1368329 - DNA, 18 bp, Homo sapiens
tgaaagtgcatttttgta

SEQ ID NO: 1368330 - DNA, 13 bp, Homo sapiens
tgaaagtgccttt

SEQ ID NO: 1368331 - DNA, 16 bp, Homo sapiens
tgaaagtgcctttgca

SEQ ID NO: 1368332 - DNA, 21 bp, Homo sapiens
tgaaagtgcctttgcagctca

SEQ ID NO: 1368333 - DNA, 17 bp, Homo sapiens
tgaaagttttgtaaaag

SEQ ID NO: 1368334 - DNA, 20 bp, Homo sapiens
tgaaagttttgtaaaagaaa

SEQ ID NO: 1368335 - DNA, 22 bp, Homo sapiens
tgaaagttttgtaaaagaaatc

SEQ ID NO: 1368336 - DNA, 20 bp, Homo sapiens
tgaaatgtgaatttttattg

SEQ ID NO: 1368337 - DNA, 22 bp, Homo sapiens
tgaaatgtgaatttttattgtt

SEQ ID NO: 1368338 - DNA, 22 bp, Homo sapiens
tgaaatgttacaaaaataaact

SEQ ID NO: 1368339 - DNA, 19 bp, Homo sapiens
tgaaattacgggtacctga

SEQ ID NO: 1368340 - DNA, 20 bp, Homo sapiens
tgaaattacgggtacctgaa

SEQ ID NO: 1368341 - DNA, 20 bp, Homo sapiens
tgatttaagtgtctcactaa

SEQ ID NO: 1368342 - DNA, 19 bp, Homo sapiens
tgatttattaacttaataa

SEQ ID NO: 1368343 - DNA, 15 bp, Homo sapiens
tgatttcctccctct

SEQ ID NO: 1368344 - DNA, 17 bp, Homo sapiens
tgatttgctgctcttca

SEQ ID NO: 1368345 - DNA, 13 bp, Homo sapiens
tgatttggtgacc

SEQ ID NO: 1368346 - DNA, 20 bp, Homo sapiens
tgatttggtgaccaactgtc

SEQ ID NO: 1368347 - DNA, 13 bp, Homo sapiens
tgatttttactgt

SEQ ID NO: 1368348 - DNA, 21 bp, Homo sapiens
tgcaaaaactctttgagaggg

SEQ ID NO: 1368349 - DNA, 21 bp, Homo sapiens
tgcaaaaagctagtcaacagt

SEQ ID NO: 1368350 - DNA, 19 bp, Homo sapiens
tgcaaaaccttttactggt

SEQ ID NO: 1368351 - DNA, 12 bp, Homo sapiens
tgcaaaatacat

SEQ ID NO: 1368352 - DNA, 13 bp, Homo sapiens
tgcaaaatacatg

SEQ ID NO: 1368353 - DNA, 14 bp, Homo sapiens
tgcaaaatacatga

SEQ ID NO: 1368354 - DNA, 14 bp, Homo sapiens
tgcaaatctgatgg

SEQ ID NO: 1368355 - DNA, 18 bp, Homo sapiens
tgcaaatgagctctgaaa

SEQ ID NO: 1368356 - DNA, 24 bp, Homo sapiens
tgcaacagggtatggactatctgt

SEQ ID NO: 1368357 - DNA, 14 bp, Homo sapiens
tgcaagatgtgaat

SEQ ID NO: 1368358 - DNA, 21 bp, Homo sapiens
tgcaagcagaggaccagggcc

SEQ ID NO: 1368359 - DNA, 15 bp, Homo sapiens
tgcaagtgctggagt

SEQ ID NO: 1368360 - DNA, 23 bp, Homo sapiens
tgcaagtgctggagtctcctgag

SEQ ID NO: 1368361 - DNA, 15 bp, Homo sapiens
tgcaataaaatttaa

SEQ ID NO: 1368362 - DNA, 18 bp, Homo sapiens
tgcaataacagctgcaat

SEQ ID NO: 1368363 - DNA, 14 bp, Homo sapiens
tgcaatatttgaat

SEQ ID NO: 1368364 - DNA, 18 bp, Homo sapiens
tgcacaagctgcaccctc

SEQ ID NO: 1368365 - DNA, 14 bp, Homo sapiens
tgcacagtaaaaat

SEQ ID NO: 1368366 - DNA, 22 bp, Homo sapiens
tgcacatccgcgtgtgcctgtg

SEQ ID NO: 1368367 - DNA, 21 bp, Homo sapiens
tgcacatgactcgggggtggg

SEQ ID NO: 1368368 - DNA, 12 bp, Homo sapiens
tgcaccaccaag

SEQ ID NO: 1368369 - DNA, 21 bp, Homo sapiens
tgcaccactgcactccagcct

SEQ ID NO: 1368370 - DNA, 18 bp, Homo sapiens
tgcacccacccaggagtg

SEQ ID NO: 1368371 - DNA, 17 bp, Homo sapiens
tgcacccagaacagtgg

SEQ ID NO: 1368372 - DNA, 16 bp, Homo sapiens
tgcacccatggtacca

SEQ ID NO: 1368373 - DNA, 19 bp, Homo sapiens
tgcaccccttctctcctcc

SEQ ID NO: 1368374 - DNA, 20 bp, Homo sapiens
tgcaccccttctctcctccc

SEQ ID NO: 1368375 - DNA, 16 bp, Homo sapiens
tgcaccctcaggcagg

SEQ ID NO: 1368376 - DNA, 17 bp, Homo sapiens
tgcaccctcaggcaggt

SEQ ID NO: 1368377 - DNA, 18 bp, Homo sapiens
tgcactaaatcagagaca

SEQ ID NO: 1368378 - DNA, 19 bp, Homo sapiens
tgcactccagcctgggcga

SEQ ID NO: 1368379 - DNA, 18 bp, Homo sapiens
tgcactccagcctggggg

SEQ ID NO: 1368380 - DNA, 19 bp, Homo sapiens
tgcacttattgaccatttt

SEQ ID NO: 1368381 - DNA, 20 bp, Homo sapiens
tgcactttctatcctctgta

SEQ ID NO: 1368382 - DNA, 20 bp, Homo sapiens
tgcagaatgtaagtgggccc

SEQ ID NO: 1368383 - DNA, 18 bp, Homo sapiens
tgcagagcagtaagggaa

SEQ ID NO: 1368384 - DNA, 15 bp, Homo sapiens
tgcagagccttctca

SEQ ID NO: 1368385 - DNA, 17 bp, Homo sapiens
tgcagagccttctcaga

SEQ ID NO: 1368386 - DNA, 14 bp, Homo sapiens
tgcagaggccagag

SEQ ID NO: 1368387 - DNA, 15 bp, Homo sapiens
tgcagaggccagagg

SEQ ID NO: 1368388 - DNA, 17 bp, Homo sapiens
tgcagatgccaccctag

SEQ ID NO: 1368389 - DNA, 20 bp, Homo sapiens
tgcagatgccaccctagcca

SEQ ID NO: 1368390 - DNA, 17 bp, Homo sapiens
tgcagcaccgaggggcc

SEQ ID NO: 1368391 - DNA, 15 bp, Homo sapiens
tgcagctcagaacca

SEQ ID NO: 1368392 - DNA, 20 bp, Homo sapiens
tgcagctcagaaccacagca

SEQ ID NO: 1368393 - DNA, 15 bp, Homo sapiens
tgcagctttgcaaac

SEQ ID NO: 1368394 - DNA, 16 bp, Homo sapiens
tgcaggacctcaggtg

SEQ ID NO: 1368395 - DNA, 15 bp, Homo sapiens
tgcaggccctggcct

SEQ ID NO: 1368396 - DNA, 19 bp, Homo sapiens
tgcaggctttgccattgtg

SEQ ID NO: 1368397 - DNA, 19 bp, Homo sapiens
tgcagggccatggctcagg

SEQ ID NO: 1368398 - DNA, 17 bp, Homo sapiens
tgcagtcactggaggtt

SEQ ID NO: 1368399 - DNA, 17 bp, Homo sapiens
tgcagtcctactcaagc

SEQ ID NO: 1368400 - DNA, 13 bp, Homo sapiens
tgcagtgagctga

SEQ ID NO: 1368401 - DNA, 19 bp, Homo sapiens
tgcagtttatcattcaagt

SEQ ID NO: 1368402 - DNA, 20 bp, Homo sapiens
tgcatacttacctagtgaaa

SEQ ID NO: 1368403 - DNA, 22 bp, Homo sapiens
tgcatacttacctagtgaaact

SEQ ID NO: 1368404 - DNA, 13 bp, Homo sapiens
tgcatactttgta

SEQ ID NO: 1368405 - DNA, 13 bp, Homo sapiens
tgcatagtttctt

SEQ ID NO: 1368406 - DNA, 16 bp, Homo sapiens
tgcatataatgaataa

SEQ ID NO: 1368407 - DNA, 20 bp, Homo sapiens
tgcatataatgaataaatca

SEQ ID NO: 1368408 - DNA, 19 bp, Homo sapiens
tgcatatttgcaaagtgta

SEQ ID NO: 1368409 - DNA, 21 bp, Homo sapiens
tgcatcactgtatcattttct

SEQ ID NO: 1368410 - DNA, 23 bp, Homo sapiens
tgcatcccaaaccacgcctcttg

SEQ ID NO: 1368411 - DNA, 13 bp, Homo sapiens
tgcatccctgaga

SEQ ID NO: 1368412 - DNA, 22 bp, Homo sapiens
tgcatctgaaataggaaacaag

SEQ ID NO: 1368413 - DNA, 14 bp, Homo sapiens
tgcatgccctctca

SEQ ID NO: 1368414 - DNA, 16 bp, Homo sapiens
tgcatgccctctcagg

SEQ ID NO: 1368415 - DNA, 17 bp, Homo sapiens
tgcatggaaatcagcca

SEQ ID NO: 1368416 - DNA, 22 bp, Homo sapiens
tgcatggaaatcagccaagttt

SEQ ID NO: 1368417 - DNA, 15 bp, Homo sapiens
tgcatggtggccaga

SEQ ID NO: 1368418 - DNA, 18 bp, Homo sapiens
tgcatgtagaggcttgtt

SEQ ID NO: 1368419 - DNA, 18 bp, Homo sapiens
tgcattcatttttatagc

SEQ ID NO: 1368420 - DNA, 21 bp, Homo sapiens
tgcattcgttgtgttttttaa

SEQ ID NO: 1368421 - DNA, 12 bp, Homo sapiens
tgcattgaagat

SEQ ID NO: 1368422 - DNA, 18 bp, Homo sapiens
tgcatttgtgctagaaat

SEQ ID NO: 1368423 - DNA, 19 bp, Homo sapiens
tgcattttaaccctatttt

SEQ ID NO: 1368424 - DNA, 15 bp, Homo sapiens
tgcatttttgtaaat

SEQ ID NO: 1368425 - DNA, 15 bp, Homo sapiens
tgccaaagaaagtgg

SEQ ID NO: 1368426 - DNA, 14 bp, Homo sapiens
tgccacactctcca

SEQ ID NO: 1368427 - DNA, 14 bp, Homo sapiens
tgccaccaggccac

SEQ ID NO: 1368428 - DNA, 15 bp, Homo sapiens
tgccacgaatttctg

SEQ ID NO: 1368429 - DNA, 23 bp, Homo sapiens
tgccacgaatttctgtgccctcc

SEQ ID NO: 1368430 - DNA, 14 bp, Homo sapiens
tgccactcactagg

SEQ ID NO: 1368431 - DNA, 20 bp, Homo sapiens
tgccactcactaggccccca

SEQ ID NO: 1368432 - DNA, 21 bp, Homo sapiens
tgccactcactaggcccccac

SEQ ID NO: 1368433 - DNA, 22 bp, Homo sapiens
tgccactgccttcgcttcttgc

SEQ ID NO: 1368434 - DNA, 20 bp, Homo sapiens
tgccacttcactccagcctg

SEQ ID NO: 1368435 - DNA, 20 bp, Homo sapiens
tgccactttacccacctaga

SEQ ID NO: 1368436 - DNA, 22 bp, Homo sapiens
tgccactttacccacctagaac

SEQ ID NO: 1368437 - DNA, 21 bp, Homo sapiens
tgccagaggaatcctggcagc

SEQ ID NO: 1368438 - DNA, 22 bp, Homo sapiens
tgccagaggaatcctggcagcc

SEQ ID NO: 1368439 - DNA, 10 bp, Homo sapiens
tgccagcagc

SEQ ID NO: 1368440 - DNA, 14 bp, Homo sapiens
tgccagcagcagca

SEQ ID NO: 1368441 - DNA, 22 bp, Homo sapiens
tgccagccccctaaaagcactc

SEQ ID NO: 1368442 - DNA, 23 bp, Homo sapiens
tgccagccccctaaaagcactcc

SEQ ID NO: 1368443 - DNA, 23 bp, Homo sapiens
tgccagctgacatcttgaatcct

SEQ ID NO: 1368444 - DNA, 18 bp, Homo sapiens
tgccagctggcctttgta

SEQ ID NO: 1368445 - DNA, 18 bp, Homo sapiens
tgccaggcaggggtgggg

SEQ ID NO: 1368446 - DNA, 17 bp, Homo sapiens
tgccaggccagcctccg

SEQ ID NO: 1368447 - DNA, 18 bp, Homo sapiens
tgccaggccagcctccga

SEQ ID NO: 1368448 - DNA, 16 bp, Homo sapiens
tgccagggccgaccag

SEQ ID NO: 1368449 - DNA, 16 bp, Homo sapiens
tgccatctagccagcc

SEQ ID NO: 1368450 - DNA, 17 bp, Homo sapiens
tgccatctagccagccc

SEQ ID NO: 1368451 - DNA, 20 bp, Homo sapiens
tgccatgaagggaccctttg

SEQ ID NO: 1368452 - DNA, 15 bp, Homo sapiens
tgccatgttggccag

SEQ ID NO: 1368453 - DNA, 21 bp, Homo sapiens
tgccatgttggccaggctggt

SEQ ID NO: 1368454 - DNA, 22 bp, Homo sapiens
tgccattacagaggtattaaaa

SEQ ID NO: 1368455 - DNA, 20 bp, Homo sapiens
tgccattttaaggaaaacta

SEQ ID NO: 1368456 - DNA, 14 bp, Homo sapiens
tgcccaagccagag

SEQ ID NO: 1368457 - DNA, 15 bp, Homo sapiens
tgcccaagccagagg

SEQ ID NO: 1368458 - DNA, 18 bp, Homo sapiens
tgcccaagccagaggctg

SEQ ID NO: 1368459 - DNA, 20 bp, Homo sapiens
tggcctcccctgccaccagg

SEQ ID NO: 1368460 - DNA, 24 bp, Homo sapiens
tggcctgggccgtatctccggctc

SEQ ID NO: 1368461 - DNA, 12 bp, Homo sapiens
tggcctgtggct

SEQ ID NO: 1368462 - DNA, 14 bp, Homo sapiens
tggcgcaggtgggc

SEQ ID NO: 1368463 - DNA, 17 bp, Homo sapiens
tggcgccaccagctctg

SEQ ID NO: 1368464 - DNA, 18 bp, Homo sapiens
tggcgtgggagccagcct

SEQ ID NO: 1368465 - DNA, 14 bp, Homo sapiens
tggctccaggccaa

SEQ ID NO: 1368466 - DNA, 17 bp, Homo sapiens
tggctccctcctccagg

SEQ ID NO: 1368467 - DNA, 14 bp, Homo sapiens
tggctccggcctct

SEQ ID NO: 1368468 - DNA, 12 bp, Homo sapiens
tggctcctgatc

SEQ ID NO: 1368469 - DNA, 18 bp, Homo sapiens
tggctcgaatctctgtgc

SEQ ID NO: 1368470 - DNA, 21 bp, Homo sapiens
tggctcgaatctctgtgcctt

SEQ ID NO: 1368471 - DNA, 15 bp, Homo sapiens
tggctctgggatcct

SEQ ID NO: 1368472 - DNA, 18 bp, Homo sapiens
tggctctgggatcctggg

SEQ ID NO: 1368473 - DNA, 18 bp, Homo sapiens
tggctgaggttcctctgc

SEQ ID NO: 1368474 - DNA, 22 bp, Homo sapiens
tggctgaggttcctctgcctgc

SEQ ID NO: 1368475 - DNA, 23 bp, Homo sapiens
tggctgaggttcctctgcctgcc

SEQ ID NO: 1368476 - DNA, 24 bp, Homo sapiens
tggctgaggttcctctgcctgccc

SEQ ID NO: 1368477 - DNA, 12 bp, Homo sapiens
tggctgctgccc

SEQ ID NO: 1368478 - DNA, 20 bp, Homo sapiens
tggctggaagatcctgcggg

SEQ ID NO: 1368479 - DNA, 22 bp, Homo sapiens
tggctgtaatcatttgtttaca

SEQ ID NO: 1368480 - DNA, 14 bp, Homo sapiens
tggctgtttgagat

SEQ ID NO: 1368481 - DNA, 15 bp, Homo sapiens
tggcttaatcatttt

SEQ ID NO: 1368482 - DNA, 23 bp, Homo sapiens
tggcttcacggaagagccttgcg

SEQ ID NO: 1368483 - DNA, 13 bp, Homo sapiens
tggcttctgtgat

SEQ ID NO: 1368484 - DNA, 21 bp, Homo sapiens
tggcttgttcatcatccagat

SEQ ID NO: 1368485 - DNA, 15 bp, Homo sapiens
tggctttaagccttc

SEQ ID NO: 1368486 - DNA, 17 bp, Homo sapiens
tggcttttattaatgca

SEQ ID NO: 1368487 - DNA, 21 bp, Homo sapiens
tggcttttattaatgcacttt

SEQ ID NO: 1368488 - DNA, 19 bp, Homo sapiens
tgggaagcccatcctgacc

SEQ ID NO: 1368489 - DNA, 17 bp, Homo sapiens
tgggacctgccaggcag

SEQ ID NO: 1368490 - DNA, 20 bp, Homo sapiens
tgggacctgccaggcagggg

SEQ ID NO: 1368491 - DNA, 14 bp, Homo sapiens
tgggacctgtggct

SEQ ID NO: 1368492 - DNA, 23 bp, Homo sapiens
tgggactcagccttcagacagag

SEQ ID NO: 1368493 - DNA, 13 bp, Homo sapiens
tgggagccagcct

SEQ ID NO: 1368494 - DNA, 22 bp, Homo sapiens
tgggagctccactctgcttctc

SEQ ID NO: 1368495 - DNA, 13 bp, Homo sapiens
tgggaggagcaga

SEQ ID NO: 1368496 - DNA, 18 bp, Homo sapiens
tgggaggagggagaggga

SEQ ID NO: 1368497 - DNA, 16 bp, Homo sapiens
tgggaggatctcttga

SEQ ID NO: 1368498 - DNA, 21 bp, Homo sapiens
tgggaggatctcttgagcctg

SEQ ID NO: 1368499 - DNA, 21 bp, Homo sapiens
tgggaggattgcttgagctca

SEQ ID NO: 1368500 - DNA, 11 bp, Homo sapiens
tgggaggctga

SEQ ID NO: 1368501 - DNA, 23 bp, Homo sapiens
tgggagggggcttgaagccaaag

SEQ ID NO: 1368502 - DNA, 20 bp, Homo sapiens
tgggaggtcaaggctgcagt

SEQ ID NO: 1368503 - DNA, 19 bp, Homo sapiens
tgggaggtggaagaaggga

SEQ ID NO: 1368504 - DNA, 20 bp, Homo sapiens
tgggatataagaggcagcgt

SEQ ID NO: 1368505 - DNA, 12 bp, Homo sapiens
tgggcagagctg

SEQ ID NO: 1368506 - DNA, 20 bp, Homo sapiens
tgggcagagctggctctgag

SEQ ID NO: 1368507 - DNA, 23 bp, Homo sapiens
tgggccatgtccaaagaggctgc

SEQ ID NO: 1368508 - DNA, 21 bp, Homo sapiens
tgggccctgagtctgggcagc

SEQ ID NO: 1368509 - DNA, 17 bp, Homo sapiens
tgggccctgggctggaa

SEQ ID NO: 1368510 - DNA, 20 bp, Homo sapiens
tgggccgtatctccggctcc

SEQ ID NO: 1368511 - DNA, 21 bp, Homo sapiens
tgggccgtatctccggctccc

SEQ ID NO: 1368512 - DNA, 19 bp, Homo sapiens
tgggctatttggactcagg

SEQ ID NO: 1368513 - DNA, 19 bp, Homo sapiens
tgggctcccgtgttttgta

SEQ ID NO: 1368514 - DNA, 18 bp, Homo sapiens
tgggctctgtgcagtcac

SEQ ID NO: 1368515 - DNA, 20 bp, Homo sapiens
tgggcttatatctggcctct

SEQ ID NO: 1368516 - DNA, 12 bp, Homo sapiens
tgggcttctgtg

SEQ ID NO: 1368517 - DNA, 16 bp, Homo sapiens
tgggcttctgtgccca

SEQ ID NO: 1368518 - DNA, 16 bp, Homo sapiens
tgggcttggcctgctg

SEQ ID NO: 1368519 - DNA, 17 bp, Homo sapiens
tgggcttggcctgctgt

SEQ ID NO: 1368520 - DNA, 18 bp, Homo sapiens
tgggcttggcctgctgtg

SEQ ID NO: 1368521 - DNA, 21 bp, Homo sapiens
tgggcttgtctgtagatttta

SEQ ID NO: 1368522 - DNA, 21 bp, Homo sapiens
tgggcttttggggagccagaa

SEQ ID NO: 1368523 - DNA, 20 bp, Homo sapiens
tggggaaagacactgcctgg

SEQ ID NO: 1368524 - DNA, 22 bp, Homo sapiens
tggggaaagacactgcctgggc

SEQ ID NO: 1368525 - DNA, 21 bp, Homo sapiens
tggggaaaggggtcggctgac

SEQ ID NO: 1368526 - DNA, 23 bp, Homo sapiens
tggggaaaggggtcggctgacca

SEQ ID NO: 1368527 - DNA, 18 bp, Homo sapiens
tggggatccccgcctggc

SEQ ID NO: 1368528 - DNA, 23 bp, Homo sapiens
tggggatccccgcctggccagga

SEQ ID NO: 1368529 - DNA, 17 bp, Homo sapiens
tggggcaggctgggcca

SEQ ID NO: 1368530 - DNA, 13 bp, Homo sapiens
tggggcagggagc

SEQ ID NO: 1368531 - DNA, 14 bp, Homo sapiens
tggggcagggagct

SEQ ID NO: 1368532 - DNA, 20 bp, Homo sapiens
tggggccaccaaagctgccc

SEQ ID NO: 1368533 - DNA, 12 bp, Homo sapiens
tggggcccagtg

SEQ ID NO: 1368534 - DNA, 14 bp, Homo sapiens
tggggcccagtgca

SEQ ID NO: 1368535 - DNA, 19 bp, Homo sapiens
tggggccgccgcctctttc

SEQ ID NO: 1368536 - DNA, 18 bp, Homo sapiens
tggggcctacagctttga

SEQ ID NO: 1368537 - DNA, 20 bp, Homo sapiens
tggggcctccagaactcact

SEQ ID NO: 1368538 - DNA, 17 bp, Homo sapiens
tggggcctgaggtcatc

SEQ ID NO: 1368539 - DNA, 19 bp, Homo sapiens
tggggctggggaaggaagc

SEQ ID NO: 1368540 - DNA, 19 bp, Homo sapiens
tggggggacccagtgcaga

SEQ ID NO: 1368541 - DNA, 13 bp, Homo sapiens
tgggggggtggcc

SEQ ID NO: 1368542 - DNA, 14 bp, Homo sapiens
tggggtttcctggc

SEQ ID NO: 1368543 - DNA, 21 bp, Homo sapiens
tgggtggcaccagcagcctgg

SEQ ID NO: 1368544 - DNA, 22 bp, Homo sapiens
tgggtggcaccagcagcctgga

SEQ ID NO: 1368545 - DNA, 19 bp, Homo sapiens
tgggtgggctctgtgcagt

SEQ ID NO: 1368546 - DNA, 17 bp, Homo sapiens
tgggtgtctccttaagc

SEQ ID NO: 1368547 - DNA, 15 bp, Homo sapiens
tggtaaaactcactg

SEQ ID NO: 1368548 - DNA, 19 bp, Homo sapiens
tggtaaaatgaagaattta

SEQ ID NO: 1368549 - DNA, 16 bp, Homo sapiens
tggtaaagactggctt

SEQ ID NO: 1368550 - DNA, 17 bp, Homo sapiens
tggtaaagactggcttt

SEQ ID NO: 1368551 - DNA, 14 bp, Homo sapiens
tggtaaatgtttct

SEQ ID NO: 1368552 - DNA, 23 bp, Homo sapiens
tggtaatcccctaaaataacagt

SEQ ID NO: 1368553 - DNA, 17 bp, Homo sapiens
tggtaatctttacctgt

SEQ ID NO: 1368554 - DNA, 22 bp, Homo sapiens
tggtaatctttacctgtataca

SEQ ID NO: 1368555 - DNA, 15 bp, Homo sapiens
tggtacaacggaggc

SEQ ID NO: 1368556 - DNA, 16 bp, Homo sapiens
tggtacaacggaggcc

SEQ ID NO: 1368557 - DNA, 20 bp, Homo sapiens
tggtagagtgtgcctgaagt

SEQ ID NO: 1368558 - DNA, 15 bp, Homo sapiens
tggtagtttctgtgg

SEQ ID NO: 1368559 - DNA, 14 bp, Homo sapiens
tggtatcatatatt

SEQ ID NO: 1368560 - DNA, 18 bp, Homo sapiens
tggtatttttttaaatca

SEQ ID NO: 1368561 - DNA, 22 bp, Homo sapiens
tggtcacaacttgatggctgcg

SEQ ID NO: 1368562 - DNA, 15 bp, Homo sapiens
tggtcacagcggagg

SEQ ID NO: 1368563 - DNA, 14 bp, Homo sapiens
tggtcaccatgaaa

SEQ ID NO: 1368564 - DNA, 19 bp, Homo sapiens
tggtcacgtttggtgcttc

SEQ ID NO: 1368565 - DNA, 20 bp, Homo sapiens
tggtccgtgggacggtgccc

SEQ ID NO: 1368566 - DNA, 17 bp, Homo sapiens
tggtcctagaggccctt

SEQ ID NO: 1368567 - DNA, 22 bp, Homo sapiens
tggtcctagaggccctttgctg

SEQ ID NO: 1368568 - DNA, 16 bp, Homo sapiens
tggtcctgtccccgca

SEQ ID NO: 1368569 - DNA, 14 bp, Homo sapiens
tggtctgttggcag

SEQ ID NO: 1368570 - DNA, 16 bp, Homo sapiens
tggtcttaagaaatgt

SEQ ID NO: 1368571 - DNA, 19 bp, Homo sapiens
tggtgatttgaaaaatata

SEQ ID NO: 1368572 - DNA, 14 bp, Homo sapiens
tggtgccatcccca

SEQ ID NO: 1368573 - DNA, 13 bp, Homo sapiens
tggtgcctgagag

SEQ ID NO: 1368574 - DNA, 19 bp, Homo sapiens
tggtgcctgagaggcaggc

SEQ ID NO: 1368575 - DNA, 20 bp, Homo sapiens
tggtgcctgagaggcaggca

SEQ ID NO: 1368576 - DNA, 19 bp, Homo sapiens
tgtctgggtttgagaaatg

SEQ ID NO: 1368577 - DNA, 16 bp, Homo sapiens
tgtctggtggccccgt

SEQ ID NO: 1368578 - DNA, 11 bp, Homo sapiens
tgtcttcctca

SEQ ID NO: 1368579 - DNA, 22 bp, Homo sapiens
tgtcttcctcaaaataaagaag

SEQ ID NO: 1368580 - DNA, 16 bp, Homo sapiens
tgtcttgggcagagct

SEQ ID NO: 1368581 - DNA, 22 bp, Homo sapiens
tgtcttgggcagagctggctct

SEQ ID NO: 1368582 - DNA, 22 bp, Homo sapiens
tgtctttcctgaaccatgtgga

SEQ ID NO: 1368583 - DNA, 17 bp, Homo sapiens
tgtgaaaagaaaaatga

SEQ ID NO: 1368584 - DNA, 23 bp, Homo sapiens
tgtgaacagagagacccttgtgg

SEQ ID NO: 1368585 - DNA, 12 bp, Homo sapiens
tgtgaagctgga

SEQ ID NO: 1368586 - DNA, 21 bp, Homo sapiens
tgtgaagctggaactgcggga

SEQ ID NO: 1368587 - DNA, 21 bp, Homo sapiens
tgtgaatactgcttgaataaa

SEQ ID NO: 1368588 - DNA, 15 bp, Homo sapiens
tgtgaattattgaca

SEQ ID NO: 1368589 - DNA, 16 bp, Homo sapiens
tgtgaatttttaagct

SEQ ID NO: 1368590 - DNA, 17 bp, Homo sapiens
tgtgaatttttaagctg

SEQ ID NO: 1368591 - DNA, 17 bp, Homo sapiens
tgtgaatttttattgtt

SEQ ID NO: 1368592 - DNA, 19 bp, Homo sapiens
tgtgacaattctgttttta

SEQ ID NO: 1368593 - DNA, 21 bp, Homo sapiens
tgtgacaattctgtttttaat

SEQ ID NO: 1368594 - DNA, 17 bp, Homo sapiens
tgtgacatggtgcctga

SEQ ID NO: 1368595 - DNA, 15 bp, Homo sapiens
tgtgaccctccaaat

SEQ ID NO: 1368596 - DNA, 13 bp, Homo sapiens
tgtgagaagccag

SEQ ID NO: 1368597 - DNA, 18 bp, Homo sapiens
tgtgagaaggtttattgt

SEQ ID NO: 1368598 - DNA, 21 bp, Homo sapiens
tgtgagaaggtttattgttaa

SEQ ID NO: 1368599 - DNA, 22 bp, Homo sapiens
tgtgagggaggggaaaagcatt

SEQ ID NO: 1368600 - DNA, 14 bp, Homo sapiens
tgtgatttctttaa

SEQ ID NO: 1368601 - DNA, 19 bp, Homo sapiens
tgtgcaaaaccttttactg

SEQ ID NO: 1368602 - DNA, 13 bp, Homo sapiens
tgtgccatctgta

SEQ ID NO: 1368603 - DNA, 13 bp, Homo sapiens
tgtgcctgtgtgc

SEQ ID NO: 1368604 - DNA, 23 bp, Homo sapiens
tgtgccttcgtctttcccatggg

SEQ ID NO: 1368605 - DNA, 15 bp, Homo sapiens
tgtgcttcctcctgc

SEQ ID NO: 1368606 - DNA, 19 bp, Homo sapiens
tgtggaaggcaagccaggc

SEQ ID NO: 1368607 - DNA, 17 bp, Homo sapiens
tgtggatcagagatgca

SEQ ID NO: 1368608 - DNA, 18 bp, Homo sapiens
tgtggcacttgcctgggt

SEQ ID NO: 1368609 - DNA, 11 bp, Homo sapiens
tgtggcagtgg

SEQ ID NO: 1368610 - DNA, 12 bp, Homo sapiens
tgtggcagtggt

SEQ ID NO: 1368611 - DNA, 16 bp, Homo sapiens
tgtggcagtggttttg

SEQ ID NO: 1368612 - DNA, 12 bp, Homo sapiens
tgtggccccacc

SEQ ID NO: 1368613 - DNA, 17 bp, Homo sapiens
tgtggccccaccctggg

SEQ ID NO: 1368614 - DNA, 17 bp, Homo sapiens
tgtggctactgacatat

SEQ ID NO: 1368615 - DNA, 17 bp, Homo sapiens
tgtggctccaggccaaa

SEQ ID NO: 1368616 - DNA, 11 bp, Homo sapiens
tgtgggaaagc

SEQ ID NO: 1368617 - DNA, 17 bp, Homo sapiens
tgtgggatattgaatgt

SEQ ID NO: 1368618 - DNA, 19 bp, Homo sapiens
tgtggggggtaatccctgc

SEQ ID NO: 1368619 - DNA, 22 bp, Homo sapiens
tgtggggggtaatccctgcttt

SEQ ID NO: 1368620 - DNA, 16 bp, Homo sapiens
tgtggtcaaggctaca

SEQ ID NO: 1368621 - DNA, 13 bp, Homo sapiens
tgtggtgatgaaa

SEQ ID NO: 1368622 - DNA, 17 bp, Homo sapiens
tgtggttcctctgctca

SEQ ID NO: 1368623 - DNA, 19 bp, Homo sapiens
tgtgtatatattttgtgtg

SEQ ID NO: 1368624 - DNA, 21 bp, Homo sapiens
tgtgtatatttgatttattaa

SEQ ID NO: 1368625 - DNA, 19 bp, Homo sapiens
tgtgtcagcatagaagtaa

SEQ ID NO: 1368626 - DNA, 14 bp, Homo sapiens
tgtgtcagttttca

SEQ ID NO: 1368627 - DNA, 20 bp, Homo sapiens
tgtgtctttggaggtgctgc

SEQ ID NO: 1368628 - DNA, 23 bp, Homo sapiens
tgtgtggactgtggcacttgcct

SEQ ID NO: 1368629 - DNA, 16 bp, Homo sapiens
tgtgtggtagaaacaa

SEQ ID NO: 1368630 - DNA, 19 bp, Homo sapiens
tgtgtgtccccttgcagcc

SEQ ID NO: 1368631 - DNA, 13 bp, Homo sapiens
tgtgtgtgcgtgt

SEQ ID NO: 1368632 - DNA, 12 bp, Homo sapiens
tgtgtgtgtgca

SEQ ID NO: 1368633 - DNA, 15 bp, Homo sapiens
tgtgtgtgtgcacat

SEQ ID NO: 1368634 - DNA, 14 bp, Homo sapiens
tgtgtgtgtgtgcg

SEQ ID NO: 1368635 - DNA, 18 bp, Homo sapiens
tgtgtgttgtctcttgag

SEQ ID NO: 1368636 - DNA, 18 bp, Homo sapiens
tgtgttaatttaagtttt

SEQ ID NO: 1368637 - DNA, 16 bp, Homo sapiens
tgtgttgccaagctcc

SEQ ID NO: 1368638 - DNA, 22 bp, Homo sapiens
tgtgttgccacagtagaactgt

SEQ ID NO: 1368639 - DNA, 22 bp, Homo sapiens
tgtgtttagaattgaaggtttt

SEQ ID NO: 1368640 - DNA, 14 bp, Homo sapiens
tgtgtttataaaat

SEQ ID NO: 1368641 - DNA, 12 bp, Homo sapiens
tgtgttttataa

SEQ ID NO: 1368642 - DNA, 17 bp, Homo sapiens
tgtgttttttaagatag

SEQ ID NO: 1368643 - DNA, 20 bp, Homo sapiens
tgttaaaagttttatatgct

SEQ ID NO: 1368644 - DNA, 16 bp, Homo sapiens
tgttaaagagaatgag

SEQ ID NO: 1368645 - DNA, 14 bp, Homo sapiens
tgttaaatgaaacc

SEQ ID NO: 1368646 - DNA, 14 bp, Homo sapiens
tgttaatacaaggt

SEQ ID NO: 1368647 - DNA, 16 bp, Homo sapiens
tgttaatacaaggtat

SEQ ID NO: 1368648 - DNA, 16 bp, Homo sapiens
tgttaatttaagtttt

SEQ ID NO: 1368649 - DNA, 16 bp, Homo sapiens
tgttactgtcttcagt

SEQ ID NO: 1368650 - DNA, 15 bp, Homo sapiens
tgttactttatacag

SEQ ID NO: 1368651 - DNA, 19 bp, Homo sapiens
tgttagatatttttcataa

SEQ ID NO: 1368652 - DNA, 13 bp, Homo sapiens
tgttatatgaaca

SEQ ID NO: 1368653 - DNA, 14 bp, Homo sapiens
tgttatatgaacat

SEQ ID NO: 1368654 - DNA, 14 bp, Homo sapiens
tgttattaaacaaa

SEQ ID NO: 1368655 - DNA, 14 bp, Homo sapiens
tgttattagatgtt

SEQ ID NO: 1368656 - DNA, 23 bp, Homo sapiens
tgttattatctgggcttatatct

SEQ ID NO: 1368657 - DNA, 13 bp, Homo sapiens
tgttcagtaataa

SEQ ID NO: 1368658 - DNA, 19 bp, Homo sapiens
tgttcatagcccagtagac

SEQ ID NO: 1368659 - DNA, 20 bp, Homo sapiens
tgttcatcatccagatgtgg

SEQ ID NO: 1368660 - DNA, 22 bp, Homo sapiens
tgttcctcaaagcttggattaa

SEQ ID NO: 1368661 - DNA, 19 bp, Homo sapiens
tgttcgttggttatacaag

SEQ ID NO: 1368662 - DNA, 17 bp, Homo sapiens
tgttctcggagtgtgta

SEQ ID NO: 1368663 - DNA, 21 bp, Homo sapiens
tgttctggggggacccagtgc

SEQ ID NO: 1368664 - DNA, 19 bp, Homo sapiens
tgttctgtggttcctctgc

SEQ ID NO: 1368665 - DNA, 23 bp, Homo sapiens
tgttctgtggttcctctgctcac

SEQ ID NO: 1368666 - DNA, 20 bp, Homo sapiens
tgttcttggcaataaatttt

SEQ ID NO: 1368667 - DNA, 22 bp, Homo sapiens
tgttcttggcaataaattttga

SEQ ID NO: 1368668 - DNA, 23 bp, Homo sapiens
tgttcttggcaataaattttgaa

SEQ ID NO: 1368669 - DNA, 14 bp, Homo sapiens
tgttgagcaagcag

SEQ ID NO: 1368670 - DNA, 20 bp, Homo sapiens
tgttgatcatgtacttttta

SEQ ID NO: 1368671 - DNA, 18 bp, Homo sapiens
tgttgatttttactgtgt

SEQ ID NO: 1368672 - DNA, 22 bp, Homo sapiens
tgttgatttttactgtgtttta

SEQ ID NO: 1368673 - DNA, 15 bp, Homo sapiens
tgttgcaagatgtga

SEQ ID NO: 1368674 - DNA, 17 bp, Homo sapiens
tgttgcctataagccaa

SEQ ID NO: 1368675 - DNA, 18 bp, Homo sapiens
tgttgcctataagccaaa

SEQ ID NO: 1368676 - DNA, 22 bp, Homo sapiens
tgttgcctataagccaaaatta

SEQ ID NO: 1368677 - DNA, 23 bp, Homo sapiens
tgttgctcagtgtttttgtgaat

SEQ ID NO: 1368678 - DNA, 13 bp, Homo sapiens
tgttggaaagtaa

SEQ ID NO: 1368679 - DNA, 18 bp, Homo sapiens
tgttggcaggctggccag

SEQ ID NO: 1368680 - DNA, 19 bp, Homo sapiens
tgttgggactgctaaataa

SEQ ID NO: 1368681 - DNA, 18 bp, Homo sapiens
tgttgtaagaattctgat

SEQ ID NO: 1368682 - DNA, 19 bp, Homo sapiens
tgttgttcttggcaataaa

SEQ ID NO: 1368683 - DNA, 20 bp, Homo sapiens
tgttgtttataataaaaata

SEQ ID NO: 1368684 - DNA, 21 bp, Homo sapiens
tgttgtttataataaaaatat

SEQ ID NO: 1368685 - DNA, 20 bp, Homo sapiens
tgtttaaaacaccttctata

SEQ ID NO: 1368686 - DNA, 15 bp, Homo sapiens
tgtttaaaataaaat

SEQ ID NO: 1368687 - DNA, 21 bp, Homo sapiens
tgtttaaaataaaatgaaaat

SEQ ID NO: 1368688 - DNA, 16 bp, Homo sapiens
tgtttaatattgagaa

SEQ ID NO: 1368689 - DNA, 20 bp, Homo sapiens
tgtttaatattgagaaagaa

SEQ ID NO: 1368690 - DNA, 21 bp, Homo sapiens
tgtttaatcatagttactgtg

SEQ ID NO: 1368691 - DNA, 12 bp, Homo sapiens
tgtttagaattg

SEQ ID NO: 1368692 - DNA, 17 bp, Homo sapiens
tgtttagaattgaaggt

SEQ ID NO: 1368693 - DNA, 17 bp, Homo sapiens
tgtttagatttgccata

SEQ ID NO: 1368694 - DNA, 22 bp, Homo sapiens
ttcaggaagggatgcaggctcc

SEQ ID NO: 1368695 - DNA, 23 bp, Homo sapiens
ttcagggtgcagcccaatctgcc

SEQ ID NO: 1368696 - DNA, 20 bp, Homo sapiens
ttcagtaagttatctttgaa

SEQ ID NO: 1368697 - DNA, 14 bp, Homo sapiens
ttcagtactttttt

SEQ ID NO: 1368698 - DNA, 19 bp, Homo sapiens
ttcagtacttttttaaata

SEQ ID NO: 1368699 - DNA, 20 bp, Homo sapiens
ttcagtattatgtagttgtt

SEQ ID NO: 1368700 - DNA, 14 bp, Homo sapiens
ttcagttctttgga

SEQ ID NO: 1368701 - DNA, 17 bp, Homo sapiens
ttcagttgcttgtcttc

SEQ ID NO: 1368702 - DNA, 14 bp, Homo sapiens
ttcataaattattt

SEQ ID NO: 1368703 - DNA, 23 bp, Homo sapiens
ttcatagtatccatattttatta

SEQ ID NO: 1368704 - DNA, 15 bp, Homo sapiens
ttcatcatccagatg

SEQ ID NO: 1368705 - DNA, 13 bp, Homo sapiens
ttcatctcattta

SEQ ID NO: 1368706 - DNA, 16 bp, Homo sapiens
ttcatctcatttaagg

SEQ ID NO: 1368707 - DNA, 19 bp, Homo sapiens
ttcatctcatttaagggaa

SEQ ID NO: 1368708 - DNA, 20 bp, Homo sapiens
ttcatcttccaactcaaact

SEQ ID NO: 1368709 - DNA, 15 bp, Homo sapiens
ttcatgcacttaaag

SEQ ID NO: 1368710 - DNA, 15 bp, Homo sapiens
ttcattattctctgc

SEQ ID NO: 1368711 - DNA, 15 bp, Homo sapiens
ttcatttaagggaaa

SEQ ID NO: 1368712 - DNA, 15 bp, Homo sapiens
ttcatttctaattaa

SEQ ID NO: 1368713 - DNA, 22 bp, Homo sapiens
ttcattttgcactgaggatatt

SEQ ID NO: 1368714 - DNA, 21 bp, Homo sapiens
ttccaaatgtaataaacttta

SEQ ID NO: 1368715 - DNA, 17 bp, Homo sapiens
ttccacacagaatgcaa

SEQ ID NO: 1368716 - DNA, 18 bp, Homo sapiens
ttccaccccaagagaact

SEQ ID NO: 1368717 - DNA, 19 bp, Homo sapiens
ttccaccccaagagaactc

SEQ ID NO: 1368718 - DNA, 20 bp, Homo sapiens
ttccaccccaagagaactcg

SEQ ID NO: 1368719 - DNA, 15 bp, Homo sapiens
ttccactacacctgg

SEQ ID NO: 1368720 - DNA, 18 bp, Homo sapiens
ttccactacacctggctg

SEQ ID NO: 1368721 - DNA, 21 bp, Homo sapiens
ttccagaaccacacttgaaac

SEQ ID NO: 1368722 - DNA, 16 bp, Homo sapiens
ttccagatctttcaga

SEQ ID NO: 1368723 - DNA, 17 bp, Homo sapiens
ttccagcccctctggtc

SEQ ID NO: 1368724 - DNA, 22 bp, Homo sapiens
ttccaggaaactccacatctgc

SEQ ID NO: 1368725 - DNA, 19 bp, Homo sapiens
ttccaggcagcctctgtca

SEQ ID NO: 1368726 - DNA, 16 bp, Homo sapiens
ttccagggtccctctg

SEQ ID NO: 1368727 - DNA, 18 bp, Homo sapiens
ttccagggtccctctgtg

SEQ ID NO: 1368728 - DNA, 19 bp, Homo sapiens
ttccagggtccctctgtgt

SEQ ID NO: 1368729 - DNA, 17 bp, Homo sapiens
ttccaggtttaagctgt

SEQ ID NO: 1368730 - DNA, 17 bp, Homo sapiens
ttccagtataaccagct

SEQ ID NO: 1368731 - DNA, 16 bp, Homo sapiens
ttccatgaaggcagag

SEQ ID NO: 1368732 - DNA, 18 bp, Homo sapiens
ttccattttaattttaaa

SEQ ID NO: 1368733 - DNA, 12 bp, Homo sapiens
ttcccatctgca

SEQ ID NO: 1368734 - DNA, 14 bp, Homo sapiens
ttcccatctgcacc

SEQ ID NO: 1368735 - DNA, 15 bp, Homo sapiens
ttcccatggggaggg

SEQ ID NO: 1368736 - DNA, 20 bp, Homo sapiens
ttcccatttgtgccagagga

SEQ ID NO: 1368737 - DNA, 12 bp, Homo sapiens
ttccccatgaca

SEQ ID NO: 1368738 - DNA, 16 bp, Homo sapiens
ttccctaatctatggt

SEQ ID NO: 1368739 - DNA, 15 bp, Homo sapiens
ttccctattagagaa

SEQ ID NO: 1368740 - DNA, 12 bp, Homo sapiens
ttccctcacccc

SEQ ID NO: 1368741 - DNA, 18 bp, Homo sapiens
ttccctcaccccctccca

SEQ ID NO: 1368742 - DNA, 14 bp, Homo sapiens
ttccctgcttccag

SEQ ID NO: 1368743 - DNA, 14 bp, Homo sapiens
ttcccttgaaactt

SEQ ID NO: 1368744 - DNA, 14 bp, Homo sapiens
ttcctcaaattttt

SEQ ID NO: 1368745 - DNA, 13 bp, Homo sapiens
ttcctcctggaaa

SEQ ID NO: 1368746 - DNA, 17 bp, Homo sapiens
ttcctctagttctttgt

SEQ ID NO: 1368747 - DNA, 15 bp, Homo sapiens
ttcctctctatattt

SEQ ID NO: 1368748 - DNA, 19 bp, Homo sapiens
ttcctgcgtcctcctcacc

SEQ ID NO: 1368749 - DNA, 12 bp, Homo sapiens
ttcctgtactgt

SEQ ID NO: 1368750 - DNA, 22 bp, Homo sapiens
ttcctgtccctgcgcctttcct

SEQ ID NO: 1368751 - DNA, 17 bp, Homo sapiens
ttcctgtgatccaccca

SEQ ID NO: 1368752 - DNA, 22 bp, Homo sapiens
ttcctgtgatccacccaaccct

SEQ ID NO: 1368753 - DNA, 14 bp, Homo sapiens
ttcctgttcagtaa

SEQ ID NO: 1368754 - DNA, 18 bp, Homo sapiens
ttccttacagaactactt

SEQ ID NO: 1368755 - DNA, 24 bp, Homo sapiens
ttccttgagacacggagcccagcc

SEQ ID NO: 1368756 - DNA, 15 bp, Homo sapiens
ttcctttatgtgaat

SEQ ID NO: 1368757 - DNA, 14 bp, Homo sapiens
ttcctttgcatatt

SEQ ID NO: 1368758 - DNA, 19 bp, Homo sapiens
ttcctttgcatattataaa

SEQ ID NO: 1368759 - DNA, 16 bp, Homo sapiens
ttcctttttgacactg

SEQ ID NO: 1368760 - DNA, 22 bp, Homo sapiens
ttcgcttcttgcctctgtgctg

SEQ ID NO: 1368761 - DNA, 20 bp, Homo sapiens
ttcgggaggtcgaggcagga

SEQ ID NO: 1368762 - DNA, 18 bp, Homo sapiens
ttcgggcgtctgtgtgcg

SEQ ID NO: 1368763 - DNA, 20 bp, Homo sapiens
ttcgttgtgttttttaagat

SEQ ID NO: 1368764 - DNA, 14 bp, Homo sapiens
ttctaaaaacttct

SEQ ID NO: 1368765 - DNA, 20 bp, Homo sapiens
ttctaaatgtttggcatgta

SEQ ID NO: 1368766 - DNA, 22 bp, Homo sapiens
ttctaattaaccttactaatta

SEQ ID NO: 1368767 - DNA, 15 bp, Homo sapiens
ttctacagtggtttt

SEQ ID NO: 1368768 - DNA, 21 bp, Homo sapiens
ttctacagtggttttatactg

SEQ ID NO: 1368769 - DNA, 13 bp, Homo sapiens
ttctacctgccct

SEQ ID NO: 1368770 - DNA, 21 bp, Homo sapiens
ttctagaaacaaacatctaat

SEQ ID NO: 1368771 - DNA, 22 bp, Homo sapiens
ttctagagttttatagcctgga

SEQ ID NO: 1368772 - DNA, 13 bp, Homo sapiens
ttctagttttgtc

SEQ ID NO: 1368773 - DNA, 16 bp, Homo sapiens
ttctatgcaaagttct

SEQ ID NO: 1368774 - DNA, 15 bp, Homo sapiens
ttctattatggaaaa

SEQ ID NO: 1368775 - DNA, 11 bp, Homo sapiens
ttctcaatgaa

SEQ ID NO: 1368776 - DNA, 19 bp, Homo sapiens
ttctcagagtggtggggga

SEQ ID NO: 1368777 - DNA, 15 bp, Homo sapiens
ttctcagatttctga

SEQ ID NO: 1368778 - DNA, 20 bp, Homo sapiens
ttctcagatttctgaggaaa

SEQ ID NO: 1368779 - DNA, 12 bp, Homo sapiens
ttctccatccct

SEQ ID NO: 1368780 - DNA, 20 bp, Homo sapiens
ttctcccaggtaccagctgc

SEQ ID NO: 1368781 - DNA, 17 bp, Homo sapiens
ttctccgccagcctcct

SEQ ID NO: 1368782 - DNA, 19 bp, Homo sapiens
ttctccgccagcctcctct

SEQ ID NO: 1368783 - DNA, 20 bp, Homo sapiens
ttctccgttagctcctgtgg

SEQ ID NO: 1368784 - DNA, 22 bp, Homo sapiens
ttctccgttagctcctgtggcc

SEQ ID NO: 1368785 - DNA, 15 bp, Homo sapiens
ttctctattaaaatg

SEQ ID NO: 1368786 - DNA, 18 bp, Homo sapiens
ttctcttgagctggcctc

SEQ ID NO: 1368787 - DNA, 18 bp, Homo sapiens
ttctgactcggtttctcc

SEQ ID NO: 1368788 - DNA, 13 bp, Homo sapiens
ttctgatttcttt

SEQ ID NO: 1368789 - DNA, 14 bp, Homo sapiens
ttctgccctggctg

SEQ ID NO: 1368790 - DNA, 16 bp, Homo sapiens
ttctgccctggctgct

SEQ ID NO: 1368791 - DNA, 17 bp, Homo sapiens
ttctgcttttctgccct

SEQ ID NO: 1368792 - DNA, 18 bp, Homo sapiens
ttctgcttttctgccctg

SEQ ID NO: 1368793 - DNA, 11 bp, Homo sapiens
ttctggcaccg

SEQ ID NO: 1368794 - DNA, 15 bp, Homo sapiens
ttctggctgtttgag

SEQ ID NO: 1368795 - DNA, 20 bp, Homo sapiens
ttctggggaaagacactgcc

SEQ ID NO: 1368796 - DNA, 23 bp, Homo sapiens
ttctggggaaagacactgcctgg

SEQ ID NO: 1368797 - DNA, 18 bp, Homo sapiens
ttctggggcaggctgggc

SEQ ID NO: 1368798 - DNA, 20 bp, Homo sapiens
ttctggggcaggctgggcca

SEQ ID NO: 1368799 - DNA, 19 bp, Homo sapiens
ttctggggggacccagtgc

SEQ ID NO: 1368800 - DNA, 20 bp, Homo sapiens
ttctggggggacccagtgca

SEQ ID NO: 1368801 - DNA, 22 bp, Homo sapiens
ttctggggggacccagtgcaga

SEQ ID NO: 1368802 - DNA, 17 bp, Homo sapiens
ttctggttccagggtcc

SEQ ID NO: 1368803 - DNA, 15 bp, Homo sapiens
ttctgtactgttact

SEQ ID NO: 1368804 - DNA, 21 bp, Homo sapiens
ttctgtactgttactgggccc

SEQ ID NO: 1368805 - DNA, 13 bp, Homo sapiens
ttctgtatttgaa

SEQ ID NO: 1368806 - DNA, 16 bp, Homo sapiens
ttctgtatttgaaagt

SEQ ID NO: 1368807 - DNA, 17 bp, Homo sapiens
ttctgtatttgaaagtg

SEQ ID NO: 1368808 - DNA, 20 bp, Homo sapiens
ttctgtatttttttttctaa

SEQ ID NO: 1368809 - DNA, 17 bp, Homo sapiens
ttctgtccgagctttga

SEQ ID NO: 1368810 - DNA, 17 bp, Homo sapiens
ttctgtgatgagctgat

SEQ ID NO: 1368811 - DNA, 21 bp, Homo sapiens
ttctgtggttcctctgctcac

SEQ ID NO: 1368812 - DNA, 15 bp, Homo sapiens
tttagaattgaaggt

SEQ ID NO: 1368813 - DNA, 21 bp, Homo sapiens
tttagaattgaaggtttttga

SEQ ID NO: 1368814 - DNA, 14 bp, Homo sapiens
tttagacttgaaaa

SEQ ID NO: 1368815 - DNA, 15 bp, Homo sapiens
tttagacttgaaaag

SEQ ID NO: 1368816 - DNA, 19 bp, Homo sapiens
tttagattttcttttgcct

SEQ ID NO: 1368817 - DNA, 13 bp, Homo sapiens
tttagctggccac

SEQ ID NO: 1368818 - DNA, 18 bp, Homo sapiens
tttagggagtattctaat

SEQ ID NO: 1368819 - DNA, 15 bp, Homo sapiens
tttagtattatcaaa

SEQ ID NO: 1368820 - DNA, 23 bp, Homo sapiens
tttagttcaatatttgttactgt

SEQ ID NO: 1368821 - DNA, 17 bp, Homo sapiens
tttataaaatataaaca

SEQ ID NO: 1368822 - DNA, 12 bp, Homo sapiens
tttataaagcat

SEQ ID NO: 1368823 - DNA, 18 bp, Homo sapiens
tttataatagcaactttt

SEQ ID NO: 1368824 - DNA, 20 bp, Homo sapiens
tttataattgtacaaaatta

SEQ ID NO: 1368825 - DNA, 18 bp, Homo sapiens
tttatagcaacaacaatt

SEQ ID NO: 1368826 - DNA, 17 bp, Homo sapiens
tttatatcatgcaaaat

SEQ ID NO: 1368827 - DNA, 13 bp, Homo sapiens
tttatatttcctt

SEQ ID NO: 1368828 - DNA, 14 bp, Homo sapiens
tttatatttccttt

SEQ ID NO: 1368829 - DNA, 19 bp, Homo sapiens
tttatatttcctttatgtg

SEQ ID NO: 1368830 - DNA, 20 bp, Homo sapiens
tttatatttcctttatgtga

SEQ ID NO: 1368831 - DNA, 22 bp, Homo sapiens
tttatatttcctttatgtgaat

SEQ ID NO: 1368832 - DNA, 15 bp, Homo sapiens
tttatcattcaagtg

SEQ ID NO: 1368833 - DNA, 17 bp, Homo sapiens
tttatcattcaagtgta

SEQ ID NO: 1368834 - DNA, 20 bp, Homo sapiens
tttatgtgaatttttaagct

SEQ ID NO: 1368835 - DNA, 12 bp, Homo sapiens
tttattaaaaca

SEQ ID NO: 1368836 - DNA, 12 bp, Homo sapiens
tttattaaattt

SEQ ID NO: 1368837 - DNA, 20 bp, Homo sapiens
tttattaacttaataatcaa

SEQ ID NO: 1368838 - DNA, 21 bp, Homo sapiens
tttattaatcactgtgtatat

SEQ ID NO: 1368839 - DNA, 12 bp, Homo sapiens
tttattaccccc

SEQ ID NO: 1368840 - DNA, 15 bp, Homo sapiens
tttattgttaataca

SEQ ID NO: 1368841 - DNA, 15 bp, Homo sapiens
tttatttagggaaca

SEQ ID NO: 1368842 - DNA, 14 bp, Homo sapiens
tttatttatttaca

SEQ ID NO: 1368843 - DNA, 20 bp, Homo sapiens
tttatttcatttttcaatag

SEQ ID NO: 1368844 - DNA, 20 bp, Homo sapiens
tttatttccactaaaaatat

SEQ ID NO: 1368845 - DNA, 21 bp, Homo sapiens
tttatttctactgtcaaatga

SEQ ID NO: 1368846 - DNA, 12 bp, Homo sapiens
tttattttccta

SEQ ID NO: 1368847 - DNA, 17 bp, Homo sapiens
tttattttttggacttc

SEQ ID NO: 1368848 - DNA, 18 bp, Homo sapiens
tttattttttttaaagaa

SEQ ID NO: 1368849 - DNA, 21 bp, Homo sapiens
tttattttttttaattgtatt

SEQ ID NO: 1368850 - DNA, 20 bp, Homo sapiens
tttcaaaaggtattatacat

SEQ ID NO: 1368851 - DNA, 21 bp, Homo sapiens
tttcaaaatccaaaaagaaat

SEQ ID NO: 1368852 - DNA, 19 bp, Homo sapiens
tttcaaacaatcaagttga

SEQ ID NO: 1368853 - DNA, 18 bp, Homo sapiens
tttcaaaggaacattgtg

SEQ ID NO: 1368854 - DNA, 20 bp, Homo sapiens
tttcaaagttttgttgtact

SEQ ID NO: 1368855 - DNA, 15 bp, Homo sapiens
tttcaatagcacata

SEQ ID NO: 1368856 - DNA, 14 bp, Homo sapiens
tttcaatatattga

SEQ ID NO: 1368857 - DNA, 18 bp, Homo sapiens
tttcacttgtgttttaaa

SEQ ID NO: 1368858 - DNA, 13 bp, Homo sapiens
tttcagaaatata

SEQ ID NO: 1368859 - DNA, 14 bp, Homo sapiens
tttcagaaatataa

SEQ ID NO: 1368860 - DNA, 20 bp, Homo sapiens
tttcagaaatataacacatt

SEQ ID NO: 1368861 - DNA, 20 bp, Homo sapiens
tttcagaagttagtttgtat

SEQ ID NO: 1368862 - DNA, 18 bp, Homo sapiens
tttcagcattaagctgtt

SEQ ID NO: 1368863 - DNA, 18 bp, Homo sapiens
tttcagcgactccgttgg

SEQ ID NO: 1368864 - DNA, 13 bp, Homo sapiens
tttcagggctggc

SEQ ID NO: 1368865 - DNA, 18 bp, Homo sapiens
tttcaggttatatccaat

SEQ ID NO: 1368866 - DNA, 21 bp, Homo sapiens
tttcatctcatttaagggaaa

SEQ ID NO: 1368867 - DNA, 17 bp, Homo sapiens
tttcatgaccagtaaag

SEQ ID NO: 1368868 - DNA, 24 bp, Homo sapiens
tttcatgaccagtaaaggctgctg

SEQ ID NO: 1368869 - DNA, 16 bp, Homo sapiens
tttccaaaccttatct

SEQ ID NO: 1368870 - DNA, 16 bp, Homo sapiens
tttccactaaaaatat

SEQ ID NO: 1368871 - DNA, 21 bp, Homo sapiens
tttccagaaccacacttgaaa

SEQ ID NO: 1368872 - DNA, 11 bp, Homo sapiens
tttccagggag

SEQ ID NO: 1368873 - DNA, 13 bp, Homo sapiens
tttccagggaggg

SEQ ID NO: 1368874 - DNA, 13 bp, Homo sapiens
tttcccatctgca

SEQ ID NO: 1368875 - DNA, 22 bp, Homo sapiens
tttcccatctgcaccccttctc

SEQ ID NO: 1368876 - DNA, 19 bp, Homo sapiens
tttccctcaccccctccca

SEQ ID NO: 1368877 - DNA, 18 bp, Homo sapiens
tttcctgaaccatgtgga

SEQ ID NO: 1368878 - DNA, 21 bp, Homo sapiens
tttcctggcactggaccccag

SEQ ID NO: 1368879 - DNA, 23 bp, Homo sapiens
tttcctggcactggaccccagca

SEQ ID NO: 1368880 - DNA, 22 bp, Homo sapiens
tttcctgtggcataaattgcat

SEQ ID NO: 1368881 - DNA, 13 bp, Homo sapiens
tttcctttatgtg

SEQ ID NO: 1368882 - DNA, 14 bp, Homo sapiens
tttcctttatgtga

SEQ ID NO: 1368883 - DNA, 17 bp, Homo sapiens
tttcctttatgtgaatt

SEQ ID NO: 1368884 - DNA, 23 bp, Homo sapiens
tttcctttatgtgaatttttaag

SEQ ID NO: 1368885 - DNA, 21 bp, Homo sapiens
tttcctttttaaggtctttca

SEQ ID NO: 1368886 - DNA, 16 bp, Homo sapiens
tttcctttttgacact

SEQ ID NO: 1368887 - DNA, 17 bp, Homo sapiens
tttcctttttgacactg

SEQ ID NO: 1368888 - DNA, 19 bp, Homo sapiens
tttcctttttgacactgaa

SEQ ID NO: 1368889 - DNA, 21 bp, Homo sapiens
tttctagaattatttttcact

SEQ ID NO: 1368890 - DNA, 15 bp, Homo sapiens
tttctatcctctgta

SEQ ID NO: 1368891 - DNA, 20 bp, Homo sapiens
tttctattatggaaaactgt

SEQ ID NO: 1368892 - DNA, 17 bp, Homo sapiens
tttctcagtgttggtat

SEQ ID NO: 1368893 - DNA, 16 bp, Homo sapiens
tttctcctcccttcct

SEQ ID NO: 1368894 - DNA, 22 bp, Homo sapiens
tttctcctttaattgtaaagta

SEQ ID NO: 1368895 - DNA, 16 bp, Homo sapiens
tttctctattaaaatg

SEQ ID NO: 1368896 - DNA, 16 bp, Homo sapiens
tttctctgtacttttc

SEQ ID NO: 1368897 - DNA, 16 bp, Homo sapiens
tttctcttgagctggc

SEQ ID NO: 1368898 - DNA, 13 bp, Homo sapiens
tttctgccctggc

SEQ ID NO: 1368899 - DNA, 20 bp, Homo sapiens
tttctgctttagacttgaaa

SEQ ID NO: 1368900 - DNA, 13 bp, Homo sapiens
tttctgtgccctc

SEQ ID NO: 1368901 - DNA, 17 bp, Homo sapiens
tttctgtgccctcctga

SEQ ID NO: 1368902 - DNA, 18 bp, Homo sapiens
tttctgtgtgtcagtttt

SEQ ID NO: 1368903 - DNA, 15 bp, Homo sapiens
tttctgttgaagttt

SEQ ID NO: 1368904 - DNA, 14 bp, Homo sapiens
tttcttatgtgaca

SEQ ID NO: 1368905 - DNA, 15 bp, Homo sapiens
tttcttatgtgacat

SEQ ID NO: 1368906 - DNA, 16 bp, Homo sapiens
tttcttcagggctgct

SEQ ID NO: 1368907 - DNA, 17 bp, Homo sapiens
tttgaaaagtaatattt

SEQ ID NO: 1368908 - DNA, 22 bp, Homo sapiens
tttgaaaagtaatatttattaa

SEQ ID NO: 1368909 - DNA, 11 bp, Homo sapiens
tttgaaaatag

SEQ ID NO: 1368910 - DNA, 21 bp, Homo sapiens
tttgaacaatgaagttgaaaa

SEQ ID NO: 1368911 - DNA, 15 bp, Homo sapiens
tttgaataaatgtgt

SEQ ID NO: 1368912 - DNA, 19 bp, Homo sapiens
tttgaatatgtagtatcta

SEQ ID NO: 1368913 - DNA, 19 bp, Homo sapiens
tttgaatcaataatatatt

SEQ ID NO: 1368914 - DNA, 20 bp, Homo sapiens
tttgacaacgtttcagcgac

SEQ ID NO: 1368915 - DNA, 16 bp, Homo sapiens
tttgagaaaataaagc

SEQ ID NO: 1368916 - DNA, 16 bp, Homo sapiens
tttgagcctgggaaat

SEQ ID NO: 1368917 - DNA, 19 bp, Homo sapiens
tttgagctcccacttctgc

SEQ ID NO: 1368918 - DNA, 17 bp, Homo sapiens
tttgagctgccttccct

SEQ ID NO: 1368919 - DNA, 22 bp, Homo sapiens
tttgatacagttttcagaaaaa

SEQ ID NO: 1368920 - DNA, 21 bp, Homo sapiens
tttgatattatacaggaaagc

SEQ ID NO: 1368921 - DNA, 21 bp, Homo sapiens
tttgatgaggtattttttcct

SEQ ID NO: 1368922 - DNA, 14 bp, Homo sapiens
tttgatgtcagcag

SEQ ID NO: 1368923 - DNA, 21 bp, Homo sapiens
tttgatgtgttgttcttggca

SEQ ID NO: 1368924 - DNA, 14 bp, Homo sapiens
tttgattatttgca

SEQ ID NO: 1368925 - DNA, 21 bp, Homo sapiens
tttgatttattaacttaataa

SEQ ID NO: 1368926 - DNA, 18 bp, Homo sapiens
tttgcaaagtgtattagg

SEQ ID NO: 1368927 - DNA, 23 bp, Homo sapiens
tttgcaaccaggaacagcaaatg

SEQ ID NO: 1368928 - DNA, 19 bp, Homo sapiens
tttgcactaaatcagagac

SEQ ID NO: 1368929 - DNA, 20 bp, Homo sapiens
tttgcactaaatcagagaca

SEQ ID NO: 1368930 - DNA, 13 bp, Homo sapiens
aaaaaaaagtcag

SEQ ID NO: 1368931 - DNA, 17 bp, Homo sapiens
aaaaagaatgaagcctc

SEQ ID NO: 1368932 - DNA, 19 bp, Homo sapiens
aaaaagactttaaaagtga

SEQ ID NO: 1368933 - DNA, 12 bp, Homo sapiens
aaaaagagacat

SEQ ID NO: 1368934 - DNA, 12 bp, Homo sapiens
aaaaaggcagga

SEQ ID NO: 1368935 - DNA, 13 bp, Homo sapiens
aaaaatagaaaca

SEQ ID NO: 1368936 - DNA, 15 bp, Homo sapiens
aaaaatagaaacata

SEQ ID NO: 1368937 - DNA, 18 bp, Homo sapiens
aaaaatatatatctatct

SEQ ID NO: 1368938 - DNA, 18 bp, Homo sapiens
aaaaatgtcaaaagtaga

SEQ ID NO: 1368939 - DNA, 23 bp, Homo sapiens
aaaaatgtcaaaagtagaacttt

SEQ ID NO: 1368940 - DNA, 18 bp, Homo sapiens
aaaacaataggatgggct

SEQ ID NO: 1368941 - DNA, 18 bp, Homo sapiens
aaaacaatggagtattct

SEQ ID NO: 1368942 - DNA, 20 bp, Homo sapiens
aaaacagtgtgtaaacaaaa

SEQ ID NO: 1368943 - DNA, 15 bp, Homo sapiens
aaaacataacataaa

SEQ ID NO: 1368944 - DNA, 17 bp, Homo sapiens
aaaacataacataaatt

SEQ ID NO: 1368945 - DNA, 14 bp, Homo sapiens
aaaacatcattcct

SEQ ID NO: 1368946 - DNA, 22 bp, Homo sapiens
aaaaccaaagagggcttcctct

SEQ ID NO: 1368947 - DNA, 18 bp, Homo sapiens
aaaaccaaatgtttattt

SEQ ID NO: 1368948 - DNA, 15 bp, Homo sapiens
aaaactcactgtgat

SEQ ID NO: 1368949 - DNA, 18 bp, Homo sapiens
aaaactctacttaatcca

SEQ ID NO: 1368950 - DNA, 20 bp, Homo sapiens
aaaactgctgactgttttct

SEQ ID NO: 1368951 - DNA, 23 bp, Homo sapiens
aaaactgctgactgttttctctt

SEQ ID NO: 1368952 - DNA, 16 bp, Homo sapiens
aaaactggacctgtat

SEQ ID NO: 1368953 - DNA, 11 bp, Homo sapiens
aaaagaaagca

SEQ ID NO: 1368954 - DNA, 14 bp, Homo sapiens
aaaagaaatgaaca

SEQ ID NO: 1368955 - DNA, 19 bp, Homo sapiens
aaaagacagtgtatgtaga

SEQ ID NO: 1368956 - DNA, 16 bp, Homo sapiens
aaaagatggtatcata

SEQ ID NO: 1368957 - DNA, 16 bp, Homo sapiens
aaaagcctaatcacag

SEQ ID NO: 1368958 - DNA, 15 bp, Homo sapiens
aaaagctcctggggc

SEQ ID NO: 1368959 - DNA, 13 bp, Homo sapiens
aaaagctctttta

SEQ ID NO: 1368960 - DNA, 13 bp, Homo sapiens
aaaaggaaagaaa

SEQ ID NO: 1368961 - DNA, 11 bp, Homo sapiens
aaaaggcagga

SEQ ID NO: 1368962 - DNA, 22 bp, Homo sapiens
aaaaggcctcttgtaaagactg

SEQ ID NO: 1368963 - DNA, 15 bp, Homo sapiens
aaaagggaagaaact

SEQ ID NO: 1368964 - DNA, 15 bp, Homo sapiens
aaaaggtctttaaaa

SEQ ID NO: 1368965 - DNA, 15 bp, Homo sapiens
aaaagtaatatttat

SEQ ID NO: 1368966 - DNA, 17 bp, Homo sapiens
aaaagtagaactttgta

SEQ ID NO: 1368967 - DNA, 20 bp, Homo sapiens
aaaagtagaactttgtatag

SEQ ID NO: 1368968 - DNA, 18 bp, Homo sapiens
aaaagtctgtctttcctg

SEQ ID NO: 1368969 - DNA, 16 bp, Homo sapiens
aaaagtttttgtttgg

SEQ ID NO: 1368970 - DNA, 16 bp, Homo sapiens
aaaataaaacatagca

SEQ ID NO: 1368971 - DNA, 17 bp, Homo sapiens
aaaataaaacatagcaa

SEQ ID NO: 1368972 - DNA, 14 bp, Homo sapiens
aaaataaagaagta

SEQ ID NO: 1368973 - DNA, 20 bp, Homo sapiens
aaaataaataaaaactaatt

SEQ ID NO: 1368974 - DNA, 16 bp, Homo sapiens
aaaatacatagtgaaa

SEQ ID NO: 1368975 - DNA, 12 bp, Homo sapiens
aaaatacatgaa

SEQ ID NO: 1368976 - DNA, 13 bp, Homo sapiens
aaaatacatgaag

SEQ ID NO: 1368977 - DNA, 21 bp, Homo sapiens
aaaatactatttaagatgtga

SEQ ID NO: 1368978 - DNA, 12 bp, Homo sapiens
aaaatagaaaca

SEQ ID NO: 1368979 - DNA, 21 bp, Homo sapiens
aaaatagaaattttgtaagaa

SEQ ID NO: 1368980 - DNA, 16 bp, Homo sapiens
aaaatataaacaaaga

SEQ ID NO: 1368981 - DNA, 14 bp, Homo sapiens
aaaatatatatcta

SEQ ID NO: 1368982 - DNA, 12 bp, Homo sapiens
aaaatatatctt

SEQ ID NO: 1368983 - DNA, 16 bp, Homo sapiens
aaaatattttcctgcc

SEQ ID NO: 1368984 - DNA, 23 bp, Homo sapiens
aaaatattttctctgtacttttc

SEQ ID NO: 1368985 - DNA, 12 bp, Homo sapiens
aaaatattttga

SEQ ID NO: 1368986 - DNA, 17 bp, Homo sapiens
aaaatcccccagcactt

SEQ ID NO: 1368987 - DNA, 22 bp, Homo sapiens
aaaatcccttacctcggtgcct

SEQ ID NO: 1368988 - DNA, 23 bp, Homo sapiens
aaaatctaagcagcttattgttt

SEQ ID NO: 1368989 - DNA, 16 bp, Homo sapiens
aaaatctgagggaaat

SEQ ID NO: 1368990 - DNA, 16 bp, Homo sapiens
aaaatcttttgaagca

SEQ ID NO: 1368991 - DNA, 11 bp, Homo sapiens
aaaatgaagaa

SEQ ID NO: 1368992 - DNA, 14 bp, Homo sapiens
aaaatgaatatcta

SEQ ID NO: 1368993 - DNA, 18 bp, Homo sapiens
aaaatgaatatctattaa

SEQ ID NO: 1368994 - DNA, 23 bp, Homo sapiens
aaaatgagctcgcatttgtcaat

SEQ ID NO: 1368995 - DNA, 14 bp, Homo sapiens
aaaatggaataaaa

SEQ ID NO: 1368996 - DNA, 19 bp, Homo sapiens
aaaatgtaatttaaatgaa

SEQ ID NO: 1368997 - DNA, 14 bp, Homo sapiens
aaaatgtcaaaagt

SEQ ID NO: 1368998 - DNA, 21 bp, Homo sapiens
aaaatgtcaaaagtagaactt

SEQ ID NO: 1368999 - DNA, 23 bp, Homo sapiens
aaaatgtccagtaagatcactgt

SEQ ID NO: 1369000 - DNA, 11 bp, Homo sapiens
aaaatgtctgt

SEQ ID NO: 1369001 - DNA, 18 bp, Homo sapiens
aaaatgtctgtaataata

SEQ ID NO: 1369002 - DNA, 14 bp, Homo sapiens
aaaattcatttcta

SEQ ID NO: 1369003 - DNA, 13 bp, Homo sapiens
aaaattgttattt

SEQ ID NO: 1369004 - DNA, 13 bp, Homo sapiens
aaaatttagaaca

SEQ ID NO: 1369005 - DNA, 12 bp, Homo sapiens
aaaatttgaagt

SEQ ID NO: 1369006 - DNA, 22 bp, Homo sapiens
aaaattttgtatgttaaagaga

SEQ ID NO: 1369007 - DNA, 13 bp, Homo sapiens
aaacaaaatgaag

SEQ ID NO: 1369008 - DNA, 15 bp, Homo sapiens
aaacaaaatttgact

SEQ ID NO: 1369009 - DNA, 19 bp, Homo sapiens
aaacaagcaagttctgaga

SEQ ID NO: 1369010 - DNA, 19 bp, Homo sapiens
aaacaccaacatgttggga

SEQ ID NO: 1369011 - DNA, 14 bp, Homo sapiens
aaacaccttctata

SEQ ID NO: 1369012 - DNA, 18 bp, Homo sapiens
aaacacgttttaaggact

SEQ ID NO: 1369013 - DNA, 11 bp, Homo sapiens
aaacaggcagt

SEQ ID NO: 1369014 - DNA, 21 bp, Homo sapiens
aaacaggcagttggccagaga

SEQ ID NO: 1369015 - DNA, 22 bp, Homo sapiens
aaacagtttttattaaaacatg

SEQ ID NO: 1369016 - DNA, 16 bp, Homo sapiens
aaacatcattcctttt

SEQ ID NO: 1369017 - DNA, 21 bp, Homo sapiens
aaacatgttaatgacaatatt

SEQ ID NO: 1369018 - DNA, 12 bp, Homo sapiens
aaacatttgctg

SEQ ID NO: 1369019 - DNA, 17 bp, Homo sapiens
aaaccaccaaaaacaaa

SEQ ID NO: 1369020 - DNA, 22 bp, Homo sapiens
aaaccacttaaacgaagagttc

SEQ ID NO: 1369021 - DNA, 22 bp, Homo sapiens
aaaccatgtagcagtgagtcat

SEQ ID NO: 1369022 - DNA, 17 bp, Homo sapiens
aaaccccaaacagtgac

SEQ ID NO: 1369023 - DNA, 21 bp, Homo sapiens
aaacccgggaacctccccagc

SEQ ID NO: 1369024 - DNA, 15 bp, Homo sapiens
aaaccgccaaggctg

SEQ ID NO: 1369025 - DNA, 18 bp, Homo sapiens
aaacctaccctcagtgag

SEQ ID NO: 1369026 - DNA, 19 bp, Homo sapiens
aaacgggaacatgccccct

SEQ ID NO: 1369027 - DNA, 20 bp, Homo sapiens
aaacgggaacatgccccctg

SEQ ID NO: 1369028 - DNA, 13 bp, Homo sapiens
aaactataaaaca

SEQ ID NO: 1369029 - DNA, 20 bp, Homo sapiens
aaactctatcggagaacatg

SEQ ID NO: 1369030 - DNA, 22 bp, Homo sapiens
aaactctatcggagaacatgaa

SEQ ID NO: 1369031 - DNA, 21 bp, Homo sapiens
aaactgaagcagcctctcccc

SEQ ID NO: 1369032 - DNA, 22 bp, Homo sapiens
aaactgaagcagcctctcccca

SEQ ID NO: 1369033 - DNA, 16 bp, Homo sapiens
aaactgtgttgccaca

SEQ ID NO: 1369034 - DNA, 21 bp, Homo sapiens
aaacttaaatgttattatctg

SEQ ID NO: 1369035 - DNA, 20 bp, Homo sapiens
aaacttcagaagcaaacaat

SEQ ID NO: 1369036 - DNA, 24 bp, Homo sapiens
aaacttggctcgaatctctgtgcc

SEQ ID NO: 1369037 - DNA, 23 bp, Homo sapiens
aaacttggtgacttgatccacta

SEQ ID NO: 1369038 - DNA, 16 bp, Homo sapiens
aaacttgtttcactga

SEQ ID NO: 1369039 - DNA, 17 bp, Homo sapiens
aaacttgtttcactgaa

SEQ ID NO: 1369040 - DNA, 13 bp, Homo sapiens
aaactttaatata

SEQ ID NO: 1369041 - DNA, 20 bp, Homo sapiens
aaactttgggaaaacatgtt

SEQ ID NO: 1369042 - DNA, 15 bp, Homo sapiens
aaagaaaaaaatgtc

SEQ ID NO: 1369043 - DNA, 19 bp, Homo sapiens
aaagaaaaaaatgtcaaaa

SEQ ID NO: 1369044 - DNA, 12 bp, Homo sapiens
aaagaaagtggt

SEQ ID NO: 1369045 - DNA, 23 bp, Homo sapiens
aaagaaagtggtcttaagaaatg

SEQ ID NO: 1369046 - DNA, 17 bp, Homo sapiens
aatgactttattattta

SEQ ID NO: 1369047 - DNA, 15 bp, Homo sapiens
aatgagcctggcaag

SEQ ID NO: 1369048 - DNA, 16 bp, Homo sapiens
aatgatactgatggtg

SEQ ID NO: 1369049 - DNA, 21 bp, Homo sapiens
acaagctgcaccctcaggcag

SEQ ID NO: 1369050 - DNA, 19 bp, Homo sapiens
acaagcttcagtaagttat

SEQ ID NO: 1369051 - DNA, 17 bp, Homo sapiens
acaagtagttctgtatt

SEQ ID NO: 1369052 - DNA, 18 bp, Homo sapiens
acaagtagttctgtattt

SEQ ID NO: 1369053 - DNA, 20 bp, Homo sapiens
acaagtagttctgtatttga

SEQ ID NO: 1369054 - DNA, 18 bp, Homo sapiens
acaatattgattgggaaa

SEQ ID NO: 1369055 - DNA, 14 bp, Homo sapiens
acaatcaaaggaaa

SEQ ID NO: 1369056 - DNA, 19 bp, Homo sapiens
acaatcaaaggaaaatagt

SEQ ID NO: 1369057 - DNA, 19 bp, Homo sapiens
acaatccacgcttctccgg

SEQ ID NO: 1369058 - DNA, 21 bp, Homo sapiens
acaatgaagttgaaaatcata

SEQ ID NO: 1369059 - DNA, 18 bp, Homo sapiens
acaatggaccctttttgt

SEQ ID NO: 1369060 - DNA, 19 bp, Homo sapiens
acaatgtgaaaagaaaaat

SEQ ID NO: 1369061 - DNA, 15 bp, Homo sapiens
acaattctgttttta

SEQ ID NO: 1369062 - DNA, 21 bp, Homo sapiens
acaattctgtttttaatgcta

SEQ ID NO: 1369063 - DNA, 22 bp, Homo sapiens
acaattggtaaaactcactgtg

SEQ ID NO: 1369064 - DNA, 23 bp, Homo sapiens
acaattggtaaaactcactgtga

SEQ ID NO: 1369065 - DNA, 12 bp, Homo sapiens
acaattttaaga

SEQ ID NO: 1369066 - DNA, 22 bp, Homo sapiens
acacaaatgctcaaagaaatct

SEQ ID NO: 1369067 - DNA, 14 bp, Homo sapiens
acacacacatatac

SEQ ID NO: 1369068 - DNA, 14 bp, Homo sapiens
acacagaaacactg

SEQ ID NO: 1369069 - DNA, 17 bp, Homo sapiens
acacagaaacactgcct

SEQ ID NO: 1369070 - DNA, 22 bp, Homo sapiens
acacagcagaggcccagatatt

SEQ ID NO: 1369071 - DNA, 14 bp, Homo sapiens
acacagcctgggcc

SEQ ID NO: 1369072 - DNA, 18 bp, Homo sapiens
acacagcctgggccccag

SEQ ID NO: 1369073 - DNA, 22 bp, Homo sapiens
acacattacaaagttaaaattg

SEQ ID NO: 1369074 - DNA, 19 bp, Homo sapiens
acacatttgctactgttgt

SEQ ID NO: 1369075 - DNA, 20 bp, Homo sapiens
acaccaatcttactttgtaa

SEQ ID NO: 1369076 - DNA, 23 bp, Homo sapiens
acaccaatcttactttgtaaatt

SEQ ID NO: 1369077 - DNA, 19 bp, Homo sapiens
acacccaaagctgagcctg

SEQ ID NO: 1369078 - DNA, 23 bp, Homo sapiens
acacctggctgaggttcctctgc

SEQ ID NO: 1369079 - DNA, 14 bp, Homo sapiens
acacgttttaagga

SEQ ID NO: 1369080 - DNA, 16 bp, Homo sapiens
acacgttttaaggact

SEQ ID NO: 1369081 - DNA, 17 bp, Homo sapiens
acactaacgaaatatca

SEQ ID NO: 1369082 - DNA, 17 bp, Homo sapiens
acactgaaagttttgta

SEQ ID NO: 1369083 - DNA, 20 bp, Homo sapiens
acactgaaagttttgtaaaa

SEQ ID NO: 1369084 - DNA, 23 bp, Homo sapiens
acactgaaagttttgtaaaagaa

SEQ ID NO: 1369085 - DNA, 22 bp, Homo sapiens
acactgcactcttaagcttccg

SEQ ID NO: 1369086 - DNA, 20 bp, Homo sapiens
acactgcctgccttaagtga

SEQ ID NO: 1369087 - DNA, 20 bp, Homo sapiens
acactggcaatggtagtttc

SEQ ID NO: 1369088 - DNA, 21 bp, Homo sapiens
acactggcaatggtagtttct

SEQ ID NO: 1369089 - DNA, 17 bp, Homo sapiens
acactgttgataaaaac

SEQ ID NO: 1369090 - DNA, 18 bp, Homo sapiens
acagaaacactgcctttt

SEQ ID NO: 1369091 - DNA, 17 bp, Homo sapiens
acagaaatggaaagcag

SEQ ID NO: 1369092 - DNA, 19 bp, Homo sapiens
acagaaattgtatattgta

SEQ ID NO: 1369093 - DNA, 15 bp, Homo sapiens
acagaatatttttat

SEQ ID NO: 1369094 - DNA, 16 bp, Homo sapiens
acagaatatttttata

SEQ ID NO: 1369095 - DNA, 23 bp, Homo sapiens
acagaatatttttatatttcctt

SEQ ID NO: 1369096 - DNA, 20 bp, Homo sapiens
acagacacgagccacctcac

SEQ ID NO: 1369097 - DNA, 22 bp, Homo sapiens
acagacactaacgaaatatcaa

SEQ ID NO: 1369098 - DNA, 19 bp, Homo sapiens
acagagtagccaggttctg

SEQ ID NO: 1369099 - DNA, 18 bp, Homo sapiens
acagagtcaaggcctgct

SEQ ID NO: 1369100 - DNA, 16 bp, Homo sapiens
acagatacctccaacc

SEQ ID NO: 1369101 - DNA, 21 bp, Homo sapiens
acagatggaaaaactgaggct

SEQ ID NO: 1369102 - DNA, 20 bp, Homo sapiens
acagattctttcagttcttt

SEQ ID NO: 1369103 - DNA, 16 bp, Homo sapiens
acagccaaaggctggc

SEQ ID NO: 1369104 - DNA, 13 bp, Homo sapiens
acagcctcttttt

SEQ ID NO: 1369105 - DNA, 16 bp, Homo sapiens
acagcgagggcagctg

SEQ ID NO: 1369106 - DNA, 15 bp, Homo sapiens
acagcggaggtgtgg

SEQ ID NO: 1369107 - DNA, 15 bp, Homo sapiens
acagcgtccctggcg

SEQ ID NO: 1369108 - DNA, 21 bp, Homo sapiens
acagctaattctactcacagt

SEQ ID NO: 1369109 - DNA, 14 bp, Homo sapiens
acagctcattaaac

SEQ ID NO: 1369110 - DNA, 17 bp, Homo sapiens
acagcttgacctgaggc

SEQ ID NO: 1369111 - DNA, 16 bp, Homo sapiens
acagcttgagccgggc

SEQ ID NO: 1369112 - DNA, 18 bp, Homo sapiens
acaggagacaaaagagca

SEQ ID NO: 1369113 - DNA, 22 bp, Homo sapiens
acagggataaggcctgtggggg

SEQ ID NO: 1369114 - DNA, 13 bp, Homo sapiens
acaggtcctgatt

SEQ ID NO: 1369115 - DNA, 21 bp, Homo sapiens
acagtatcccacatccaactc

SEQ ID NO: 1369116 - DNA, 16 bp, Homo sapiens
acagtgaagttttact

SEQ ID NO: 1369117 - DNA, 21 bp, Homo sapiens
acagtgcagagccttctcaga

SEQ ID NO: 1369118 - DNA, 23 bp, Homo sapiens
acagtggtggcaacattcattgc

SEQ ID NO: 1369119 - DNA, 19 bp, Homo sapiens
acagtgtatgtagaagcat

SEQ ID NO: 1369120 - DNA, 14 bp, Homo sapiens
acagtgtgtaaaca

SEQ ID NO: 1369121 - DNA, 15 bp, Homo sapiens
acagttgaaaaacag

SEQ ID NO: 1369122 - DNA, 16 bp, Homo sapiens
acagttgaaaaacagc

SEQ ID NO: 1369123 - DNA, 13 bp, Homo sapiens
acagttgtattta

SEQ ID NO: 1369124 - DNA, 14 bp, Homo sapiens
acagtttttcctgg

SEQ ID NO: 1369125 - DNA, 16 bp, Homo sapiens
acataacataaatttt

SEQ ID NO: 1369126 - DNA, 21 bp, Homo sapiens
acatacaaatgcatctttgat

SEQ ID NO: 1369127 - DNA, 15 bp, Homo sapiens
acatacatgtcacat

SEQ ID NO: 1369128 - DNA, 18 bp, Homo sapiens
acatacgatttaaggtat

SEQ ID NO: 1369129 - DNA, 12 bp, Homo sapiens
acatagaaatgg

SEQ ID NO: 1369130 - DNA, 22 bp, Homo sapiens
acatagaaatggaaattttgct

SEQ ID NO: 1369131 - DNA, 13 bp, Homo sapiens
acatagtgaaaat

SEQ ID NO: 1369132 - DNA, 18 bp, Homo sapiens
acatagtgaaaattgttt

SEQ ID NO: 1369133 - DNA, 20 bp, Homo sapiens
acatatacacgaatagacat

SEQ ID NO: 1369134 - DNA, 14 bp, Homo sapiens
acatatatattaca

SEQ ID NO: 1369135 - DNA, 18 bp, Homo sapiens
acatatggatgttactct

SEQ ID NO: 1369136 - DNA, 19 bp, Homo sapiens
acatcaaactcaatgcttt

SEQ ID NO: 1369137 - DNA, 18 bp, Homo sapiens
acatcacagggtgggcct

SEQ ID NO: 1369138 - DNA, 21 bp, Homo sapiens
acatcattcctttttatttat

SEQ ID NO: 1369139 - DNA, 19 bp, Homo sapiens
acatccaactccagcaact

SEQ ID NO: 1369140 - DNA, 21 bp, Homo sapiens
acatccagagctttgtcgtat

SEQ ID NO: 1369141 - DNA, 16 bp, Homo sapiens
acatccgcgtgtgcct

SEQ ID NO: 1369142 - DNA, 23 bp, Homo sapiens
acatccgcgtgtgcctgtgtgcg

SEQ ID NO: 1369143 - DNA, 18 bp, Homo sapiens
acatctgacctggcatct

SEQ ID NO: 1369144 - DNA, 21 bp, Homo sapiens
acatctgaggttttatttcat

SEQ ID NO: 1369145 - DNA, 23 bp, Homo sapiens
acatctgaggttttatttcattt

SEQ ID NO: 1369146 - DNA, 12 bp, Homo sapiens
acatctgcctta

SEQ ID NO: 1369147 - DNA, 19 bp, Homo sapiens
acatcttgaatccttccat

SEQ ID NO: 1369148 - DNA, 18 bp, Homo sapiens
acatgaagaatagaaaca

SEQ ID NO: 1369149 - DNA, 16 bp, Homo sapiens
acatgaagcttcatgc

SEQ ID NO: 1369150 - DNA, 20 bp, Homo sapiens
acatgaagcttcatgcactt

SEQ ID NO: 1369151 - DNA, 18 bp, Homo sapiens
acatgaatcaaaagtgcc

SEQ ID NO: 1369152 - DNA, 21 bp, Homo sapiens
acatgaatcaaaagtgcctca

SEQ ID NO: 1369153 - DNA, 23 bp, Homo sapiens
acatgagatgtgtggactgtggc

SEQ ID NO: 1369154 - DNA, 18 bp, Homo sapiens
acatgaggaactgtagat

SEQ ID NO: 1369155 - DNA, 22 bp, Homo sapiens
acatgagtagataatttcaggg

SEQ ID NO: 1369156 - DNA, 18 bp, Homo sapiens
acatgcatataatgaata

SEQ ID NO: 1369157 - DNA, 17 bp, Homo sapiens
acatggtctgtcaatga

SEQ ID NO: 1369158 - DNA, 17 bp, Homo sapiens
acatgtccagcaccttg

SEQ ID NO: 1369159 - DNA, 20 bp, Homo sapiens
acatgttaatgacaatattc

SEQ ID NO: 1369160 - DNA, 13 bp, Homo sapiens
acatgtttataaa

SEQ ID NO: 1369161 - DNA, 11 bp, Homo sapiens
acatgtttcct

SEQ ID NO: 1369162 - DNA, 14 bp, Homo sapiens
acattagagaacat

SEQ ID NO: 1369163 - DNA, 14 bp, Homo sapiens
acattatttatatg

SEQ ID NO: 1369164 - DNA, 23 bp, Homo sapiens
acattcttggcttaatcattttc

SEQ ID NO: 1369165 - DNA, 12 bp, Homo sapiens
acattgaagaat

SEQ ID NO: 1369166 - DNA, 20 bp, Homo sapiens
acattgaagtaatgaatttt

SEQ ID NO: 1369167 - DNA, 22 bp, Homo sapiens
acattgtctcctatatatttct

SEQ ID NO: 1369168 - DNA, 23 bp, Homo sapiens
aatacacatagcatgtaatggta

SEQ ID NO: 1369169 - DNA, 14 bp, Homo sapiens
aatacatagtgaaa

SEQ ID NO: 1369170 - DNA, 16 bp, Homo sapiens
aatacatagtgaaaat

SEQ ID NO: 1369171 - DNA, 19 bp, Homo sapiens
aatacatgaagcttcatgc

SEQ ID NO: 1369172 - DNA, 18 bp, Homo sapiens
aatacatgccacatcaaa

SEQ ID NO: 1369173 - DNA, 14 bp, Homo sapiens
aatactatttaaga

SEQ ID NO: 1369174 - DNA, 15 bp, Homo sapiens
aatactatttaagat

SEQ ID NO: 1369175 - DNA, 13 bp, Homo sapiens
aaagaatgactat

SEQ ID NO: 1369176 - DNA, 14 bp, Homo sapiens
aaagaatttagtat

SEQ ID NO: 1369177 - DNA, 13 bp, Homo sapiens
aaagacactgcct

SEQ ID NO: 1369178 - DNA, 17 bp, Homo sapiens
aaagactggttttctgc

SEQ ID NO: 1369179 - DNA, 20 bp, Homo sapiens
aaagagaatgagtccttgat

SEQ ID NO: 1369180 - DNA, 15 bp, Homo sapiens
aaagagcccttgcct

SEQ ID NO: 1369181 - DNA, 18 bp, Homo sapiens
aaagagcccttgcctccc

SEQ ID NO: 1369182 - DNA, 19 bp, Homo sapiens
aaagaggcaccaggaagcc

SEQ ID NO: 1369183 - DNA, 20 bp, Homo sapiens
aaagaggctgcccctctcac

SEQ ID NO: 1369184 - DNA, 17 bp, Homo sapiens
aaagatagacaggtcct

SEQ ID NO: 1369185 - DNA, 16 bp, Homo sapiens
aaagcaatagaaacaa

SEQ ID NO: 1369186 - DNA, 15 bp, Homo sapiens
aaagcagtatttttc

SEQ ID NO: 1369187 - DNA, 17 bp, Homo sapiens
aaagcatgaaatgtgaa

SEQ ID NO: 1369188 - DNA, 16 bp, Homo sapiens
aaagcctaatcacagt

SEQ ID NO: 1369189 - DNA, 20 bp, Homo sapiens
aaagctataaagcagtattt

SEQ ID NO: 1369190 - DNA, 15 bp, Homo sapiens
aaagctgagcctgca

SEQ ID NO: 1369191 - DNA, 21 bp, Homo sapiens
aaagcttggattaaatacata

SEQ ID NO: 1369192 - DNA, 16 bp, Homo sapiens
aaaggaaagaaaacat

SEQ ID NO: 1369193 - DNA, 17 bp, Homo sapiens
aaaggagagctagcagc

SEQ ID NO: 1369194 - DNA, 21 bp, Homo sapiens
aaaggagagctagcagcaggg

SEQ ID NO: 1369195 - DNA, 14 bp, Homo sapiens
aaaggataaagaag

SEQ ID NO: 1369196 - DNA, 13 bp, Homo sapiens
aaaggcctcttgt

SEQ ID NO: 1369197 - DNA, 14 bp, Homo sapiens
aaagggaattatga

SEQ ID NO: 1369198 - DNA, 19 bp, Homo sapiens
aaaggggagagcctgctgg

SEQ ID NO: 1369199 - DNA, 16 bp, Homo sapiens
aaaggtaatgtgtgga

SEQ ID NO: 1369200 - DNA, 20 bp, Homo sapiens
aaaggtattatacatgtgat

SEQ ID NO: 1369201 - DNA, 20 bp, Homo sapiens
aaaggtgagtttgagctgcc

SEQ ID NO: 1369202 - DNA, 22 bp, Homo sapiens
aaaggtgagtttgagctgcctt

SEQ ID NO: 1369203 - DNA, 19 bp, Homo sapiens
aaaggtggattttgtttaa

SEQ ID NO: 1369204 - DNA, 18 bp, Homo sapiens
aaagtaactcatttgtta

SEQ ID NO: 1369205 - DNA, 20 bp, Homo sapiens
aaagtaactcatttgttaaa

SEQ ID NO: 1369206 - DNA, 16 bp, Homo sapiens
aaagtaactgtgagaa

SEQ ID NO: 1369207 - DNA, 15 bp, Homo sapiens
aaagtagaactttgt

SEQ ID NO: 1369208 - DNA, 18 bp, Homo sapiens
aaagtagaactttgtata

SEQ ID NO: 1369209 - DNA, 23 bp, Homo sapiens
aaagtagaactttgtatagttat

SEQ ID NO: 1369210 - DNA, 22 bp, Homo sapiens
aaagtattcttctcttcctttt

SEQ ID NO: 1369211 - DNA, 13 bp, Homo sapiens
aaagtgaagcaaa

SEQ ID NO: 1369212 - DNA, 14 bp, Homo sapiens
aaagtgcatttttg

SEQ ID NO: 1369213 - DNA, 13 bp, Homo sapiens
aaagtgccaaaga

SEQ ID NO: 1369214 - DNA, 21 bp, Homo sapiens
aaagtgccaaagaaagtggtc

SEQ ID NO: 1369215 - DNA, 18 bp, Homo sapiens
aaagtgtgtatatatttt

SEQ ID NO: 1369216 - DNA, 19 bp, Homo sapiens
aaagtgtgtatatattttg

SEQ ID NO: 1369217 - DNA, 10 bp, Homo sapiens
aaagtttccg

SEQ ID NO: 1369218 - DNA, 16 bp, Homo sapiens
aaagtttgcttagaaa

SEQ ID NO: 1369219 - DNA, 15 bp, Homo sapiens
aaataaaaatggata

SEQ ID NO: 1369220 - DNA, 23 bp, Homo sapiens
aaataaaatgaaaattgtattat

SEQ ID NO: 1369221 - DNA, 13 bp, Homo sapiens
aaataaaccactg

SEQ ID NO: 1369222 - DNA, 14 bp, Homo sapiens
aaataaagaagtat

SEQ ID NO: 1369223 - DNA, 15 bp, Homo sapiens
aaataaagagccata

SEQ ID NO: 1369224 - DNA, 14 bp, Homo sapiens
aaataaataatttt

SEQ ID NO: 1369225 - DNA, 16 bp, Homo sapiens
aaataagaaataatgc

SEQ ID NO: 1369226 - DNA, 22 bp, Homo sapiens
aaataaggatttttctcttatt

SEQ ID NO: 1369227 - DNA, 12 bp, Homo sapiens
aaataagtattt

SEQ ID NO: 1369228 - DNA, 14 bp, Homo sapiens
aaataagtatttat

SEQ ID NO: 1369229 - DNA, 22 bp, Homo sapiens
aaataagtatttataatagcaa

SEQ ID NO: 1369230 - DNA, 19 bp, Homo sapiens
aaataatgaatacatttcc

SEQ ID NO: 1369231 - DNA, 20 bp, Homo sapiens
aaataatgctacaattttaa

SEQ ID NO: 1369232 - DNA, 22 bp, Homo sapiens
aaataattatataactgtattt

SEQ ID NO: 1369233 - DNA, 19 bp, Homo sapiens
aaatacaacttaaataata

SEQ ID NO: 1369234 - DNA, 12 bp, Homo sapiens
aaatacatgaag

SEQ ID NO: 1369235 - DNA, 22 bp, Homo sapiens
aaatactatttaagatgtgaaa

SEQ ID NO: 1369236 - DNA, 12 bp, Homo sapiens
aaatagaaacat

SEQ ID NO: 1369237 - DNA, 16 bp, Homo sapiens
aaatagaaccactatg

SEQ ID NO: 1369238 - DNA, 15 bp, Homo sapiens
aaatagatataaatt

SEQ ID NO: 1369239 - DNA, 22 bp, Homo sapiens
aaatagatgctgtgtatatggt

SEQ ID NO: 1369240 - DNA, 13 bp, Homo sapiens
aaataggaaacaa

SEQ ID NO: 1369241 - DNA, 16 bp, Homo sapiens
aaataggaaacaagtg

SEQ ID NO: 1369242 - DNA, 14 bp, Homo sapiens
aaataggattttta

SEQ ID NO: 1369243 - DNA, 16 bp, Homo sapiens
aaatagtatgaaaatg

SEQ ID NO: 1369244 - DNA, 23 bp, Homo sapiens
aaatagtctctttaaaaggaaag

SEQ ID NO: 1369245 - DNA, 12 bp, Homo sapiens
aaatagtttatt

SEQ ID NO: 1369246 - DNA, 20 bp, Homo sapiens
aaatagtttattttaaaaca

SEQ ID NO: 1369247 - DNA, 22 bp, Homo sapiens
aaatataaacaaagattcatga

SEQ ID NO: 1369248 - DNA, 14 bp, Homo sapiens
aaatataacacatt

SEQ ID NO: 1369249 - DNA, 13 bp, Homo sapiens
aaatatatacatt

SEQ ID NO: 1369250 - DNA, 22 bp, Homo sapiens
aaatatatatctatctatttga

SEQ ID NO: 1369251 - DNA, 13 bp, Homo sapiens
aaatatgttttta

SEQ ID NO: 1369252 - DNA, 19 bp, Homo sapiens
aaatattaggcttaaaaac

SEQ ID NO: 1369253 - DNA, 19 bp, Homo sapiens
aaatattcctttgcatatt

SEQ ID NO: 1369254 - DNA, 17 bp, Homo sapiens
aaatattgttgacaact

SEQ ID NO: 1369255 - DNA, 22 bp, Homo sapiens
aaatattgtttctgcattcatt

SEQ ID NO: 1369256 - DNA, 12 bp, Homo sapiens
aaatatttatct

SEQ ID NO: 1369257 - DNA, 12 bp, Homo sapiens
aaatattttcta

SEQ ID NO: 1369258 - DNA, 15 bp, Homo sapiens
aaatattttctattt

SEQ ID NO: 1369259 - DNA, 12 bp, Homo sapiens
aaatattttctc

SEQ ID NO: 1369260 - DNA, 15 bp, Homo sapiens
aaatattttgaatca

SEQ ID NO: 1369261 - DNA, 14 bp, Homo sapiens
aaatcaaagtgcta

SEQ ID NO: 1369262 - DNA, 16 bp, Homo sapiens
aaatcagagacaaaat

SEQ ID NO: 1369263 - DNA, 21 bp, Homo sapiens
aaatcagccaagttttataat

SEQ ID NO: 1369264 - DNA, 23 bp, Homo sapiens
aaatcagcctgctccagctgttc

SEQ ID NO: 1369265 - DNA, 23 bp, Homo sapiens
aaatcatgttgatcatgtacttt

SEQ ID NO: 1369266 - DNA, 17 bp, Homo sapiens
aaatctaaatctattta

SEQ ID NO: 1369267 - DNA, 20 bp, Homo sapiens
aaatctaaatctatttatta

SEQ ID NO: 1369268 - DNA, 12 bp, Homo sapiens
aaatctatttat

SEQ ID NO: 1369269 - DNA, 17 bp, Homo sapiens
aaatctatttattaata

SEQ ID NO: 1369270 - DNA, 22 bp, Homo sapiens
aaatctatttattaatatttaa

SEQ ID NO: 1369271 - DNA, 23 bp, Homo sapiens
aaatcttaatgttcctcaaagct

SEQ ID NO: 1369272 - DNA, 21 bp, Homo sapiens
aaatgaaaacagtgtgtaaac

SEQ ID NO: 1369273 - DNA, 12 bp, Homo sapiens
aaatgaaaattg

SEQ ID NO: 1369274 - DNA, 13 bp, Homo sapiens
aaatgaaaattgt

SEQ ID NO: 1369275 - DNA, 14 bp, Homo sapiens
aaatgaaagaaaat

SEQ ID NO: 1369276 - DNA, 16 bp, Homo sapiens
aaatgaatatctatta

SEQ ID NO: 1369277 - DNA, 19 bp, Homo sapiens
aaatgaatatctattaata

SEQ ID NO: 1369278 - DNA, 20 bp, Homo sapiens
aaatgactttattatttatt

SEQ ID NO: 1369279 - DNA, 19 bp, Homo sapiens
aaatgagcctggcaagaat

SEQ ID NO: 1369280 - DNA, 22 bp, Homo sapiens
aaatgaggaggatgctaaaaat

SEQ ID NO: 1369281 - DNA, 19 bp, Homo sapiens
aaatgcaaaaactctttga

SEQ ID NO: 1369282 - DNA, 18 bp, Homo sapiens
aaatgcatctttgatgtg

SEQ ID NO: 1369283 - DNA, 20 bp, Homo sapiens
aaatgcatctttgatgtgtt

SEQ ID NO: 1369284 - DNA, 13 bp, Homo sapiens
aaatgcccagctt

SEQ ID NO: 1369285 - DNA, 13 bp, Homo sapiens
aaatgccctcttc

SEQ ID NO: 1369286 - DNA, 13 bp, Homo sapiens
aaatgctccccac

SEQ ID NO: 1369287 - DNA, 14 bp, Homo sapiens
aaatggaaattttg

SEQ ID NO: 1369288 - DNA, 20 bp, Homo sapiens
aaatggaggatctctaaaga

SEQ ID NO: 1369289 - DNA, 11 bp, Homo sapiens
aaatggcctca

SEQ ID NO: 1369290 - DNA, 22 bp, Homo sapiens
aaatgtaaactcagcatcaaaa

SEQ ID NO: 1369291 - DNA, 19 bp, Homo sapiens
aaatgtaatttaaatgaaa

SEQ ID NO: 1369292 - DNA, 17 bp, Homo sapiens
aaatgtaggtcctcaga

SEQ ID NO: 1369293 - DNA, 14 bp, Homo sapiens
aaatgtataaactt

SEQ ID NO: 1369294 - DNA, 13 bp, Homo sapiens
aaatgtataaata

SEQ ID NO: 1369295 - DNA, 15 bp, Homo sapiens
aaatgtataaatata

SEQ ID NO: 1369296 - DNA, 13 bp, Homo sapiens
agaattgaaggtt

SEQ ID NO: 1369297 - DNA, 14 bp, Homo sapiens
agaattgaaggttt

SEQ ID NO: 1369298 - DNA, 15 bp, Homo sapiens
agaattgaaggtttt

SEQ ID NO: 1369299 - DNA, 12 bp, Homo sapiens
agaatttaaaga

SEQ ID NO: 1369300 - DNA, 13 bp, Homo sapiens
agaatttaaagaa

SEQ ID NO: 1369301 - DNA, 19 bp, Homo sapiens
agaatttagtattatcaaa

SEQ ID NO: 1369302 - DNA, 14 bp, Homo sapiens
agacacctggttgc

SEQ ID NO: 1369303 - DNA, 13 bp, Homo sapiens
agacactgcctgg

SEQ ID NO: 1369304 - DNA, 17 bp, Homo sapiens
agacactgttgataaaa

SEQ ID NO: 1369305 - DNA, 18 bp, Homo sapiens
agacactgttgataaaaa

SEQ ID NO: 1369306 - DNA, 22 bp, Homo sapiens
agacagatacctccaaccctgc

SEQ ID NO: 1369307 - DNA, 18 bp, Homo sapiens
agacagccaaaggctggc

SEQ ID NO: 1369308 - DNA, 15 bp, Homo sapiens
agacagcttttctca

SEQ ID NO: 1369309 - DNA, 20 bp, Homo sapiens
agacaggcaggtgatctgct

SEQ ID NO: 1369310 - DNA, 19 bp, Homo sapiens
agacattttaaaaaatggt

SEQ ID NO: 1369311 - DNA, 20 bp, Homo sapiens
agaccacgcccgtcctgcct

SEQ ID NO: 1369312 - DNA, 21 bp, Homo sapiens
agaccacgcccgtcctgcctg

SEQ ID NO: 1369313 - DNA, 14 bp, Homo sapiens
agaccctcttgccc

SEQ ID NO: 1369314 - DNA, 15 bp, Homo sapiens
agaccctcttgccca

SEQ ID NO: 1369315 - DNA, 19 bp, Homo sapiens
agaccctgggtgggctctg

SEQ ID NO: 1369316 - DNA, 15 bp, Homo sapiens
agaccgatcggcggc

SEQ ID NO: 1369317 - DNA, 18 bp, Homo sapiens
agaccgtgaagatacttt

SEQ ID NO: 1369318 - DNA, 20 bp, Homo sapiens
agaccgtgaagatactttgt

SEQ ID NO: 1369319 - DNA, 21 bp, Homo sapiens
agaccgtgaagatactttgta

SEQ ID NO: 1369320 - DNA, 21 bp, Homo sapiens
agacctggaagaacaggcctc

SEQ ID NO: 1369321 - DNA, 18 bp, Homo sapiens
agaccttgttacttctga

SEQ ID NO: 1369322 - DNA, 19 bp, Homo sapiens
agaccttgttacttctgag

SEQ ID NO: 1369323 - DNA, 21 bp, Homo sapiens
agacggtgttttgccatgttg

SEQ ID NO: 1369324 - DNA, 16 bp, Homo sapiens
agacggtttccaggga

SEQ ID NO: 1369325 - DNA, 19 bp, Homo sapiens
agacggtttccagggaggg

SEQ ID NO: 1369326 - DNA, 17 bp, Homo sapiens
agactagcaatctcttc

SEQ ID NO: 1369327 - DNA, 14 bp, Homo sapiens
agactatttttaga

SEQ ID NO: 1369328 - DNA, 18 bp, Homo sapiens
agactcagagctctctct

SEQ ID NO: 1369329 - DNA, 23 bp, Homo sapiens
agactggcttttattaatgcact

SEQ ID NO: 1369330 - DNA, 18 bp, Homo sapiens
agactggttttctgccaa

SEQ ID NO: 1369331 - DNA, 17 bp, Homo sapiens
agactgtagatatgtat

SEQ ID NO: 1369332 - DNA, 17 bp, Homo sapiens
agactgttaaatgaaac

SEQ ID NO: 1369333 - DNA, 23 bp, Homo sapiens
agacttacagggataaggcctgt

SEQ ID NO: 1369334 - DNA, 16 bp, Homo sapiens
agacttagggcaccag

SEQ ID NO: 1369335 - DNA, 14 bp, Homo sapiens
agacttccttgaga

SEQ ID NO: 1369336 - DNA, 12 bp, Homo sapiens
agacttgaaaag

SEQ ID NO: 1369337 - DNA, 19 bp, Homo sapiens
agacttgaaaagagacagg

SEQ ID NO: 1369338 - DNA, 21 bp, Homo sapiens
agacttgaaaagagacaggca

SEQ ID NO: 1369339 - DNA, 11 bp, Homo sapiens
agactttgatg

SEQ ID NO: 1369340 - DNA, 14 bp, Homo sapiens
agactttgatgtca

SEQ ID NO: 1369341 - DNA, 18 bp, Homo sapiens
agactttgatgtcagcag

SEQ ID NO: 1369342 - DNA, 10 bp, Homo sapiens
agagaatgag

SEQ ID NO: 1369343 - DNA, 18 bp, Homo sapiens
agagaatgagtccttgat

SEQ ID NO: 1369344 - DNA, 13 bp, Homo sapiens
agagacaggcagg

SEQ ID NO: 1369345 - DNA, 24 bp, Homo sapiens
agagacatctttgggcctgtccct

SEQ ID NO: 1369346 - DNA, 15 bp, Homo sapiens
agagacggtgttttg

SEQ ID NO: 1369347 - DNA, 15 bp, Homo sapiens
agagagagagagaga

SEQ ID NO: 1369348 - DNA, 14 bp, Homo sapiens
agagagagaggaca

SEQ ID NO: 1369349 - DNA, 15 bp, Homo sapiens
agagatccaaagact

SEQ ID NO: 1369350 - DNA, 16 bp, Homo sapiens
agagatccaaagactc

SEQ ID NO: 1369351 - DNA, 16 bp, Homo sapiens
agagattgtggtttca

SEQ ID NO: 1369352 - DNA, 12 bp, Homo sapiens
agagatttctca

SEQ ID NO: 1369353 - DNA, 19 bp, Homo sapiens
agagcagtggtaagaatag

SEQ ID NO: 1369354 - DNA, 12 bp, Homo sapiens
agagccagcttg

SEQ ID NO: 1369355 - DNA, 15 bp, Homo sapiens
agagccatacataaa

SEQ ID NO: 1369356 - DNA, 16 bp, Homo sapiens
agagccatacataaaa

SEQ ID NO: 1369357 - DNA, 14 bp, Homo sapiens
agagccttaaaaca

SEQ ID NO: 1369358 - DNA, 15 bp, Homo sapiens
agagccttaaaacat

SEQ ID NO: 1369359 - DNA, 16 bp, Homo sapiens
agagccttaaaacatc

SEQ ID NO: 1369360 - DNA, 13 bp, Homo sapiens
agagccttctcag

SEQ ID NO: 1369361 - DNA, 13 bp, Homo sapiens
agagctctctcta

SEQ ID NO: 1369362 - DNA, 14 bp, Homo sapiens
agagctctctctac

SEQ ID NO: 1369363 - DNA, 12 bp, Homo sapiens
agagctggctct

SEQ ID NO: 1369364 - DNA, 13 bp, Homo sapiens
agagctggctctg

SEQ ID NO: 1369365 - DNA, 16 bp, Homo sapiens
agagctggctctgagc

SEQ ID NO: 1369366 - DNA, 16 bp, Homo sapiens
agaggaaggagaggag

SEQ ID NO: 1369367 - DNA, 17 bp, Homo sapiens
agaggaatcctggcagc

SEQ ID NO: 1369368 - DNA, 15 bp, Homo sapiens
agaggaccagggcct

SEQ ID NO: 1369369 - DNA, 13 bp, Homo sapiens
agaggagaggggc

SEQ ID NO: 1369370 - DNA, 14 bp, Homo sapiens
agaggagccttttt

SEQ ID NO: 1369371 - DNA, 18 bp, Homo sapiens
agaggcaactgcattggc

SEQ ID NO: 1369372 - DNA, 13 bp, Homo sapiens
agaggccagaggc

SEQ ID NO: 1369373 - DNA, 14 bp, Homo sapiens
agaggcccccagcc

SEQ ID NO: 1369374 - DNA, 20 bp, Homo sapiens
agaggcccccagcccagggc

SEQ ID NO: 1369375 - DNA, 16 bp, Homo sapiens
agaggctagcttctgc

SEQ ID NO: 1369376 - DNA, 16 bp, Homo sapiens
agaggctgcccctctc

SEQ ID NO: 1369377 - DNA, 12 bp, Homo sapiens
agaggcttctcc

SEQ ID NO: 1369378 - DNA, 19 bp, Homo sapiens
agaggcttctccgccagcc

SEQ ID NO: 1369379 - DNA, 22 bp, Homo sapiens
agaggcttctccgccagcctcc

SEQ ID NO: 1369380 - DNA, 14 bp, Homo sapiens
agaggcttgtttac

SEQ ID NO: 1369381 - DNA, 19 bp, Homo sapiens
agaggcttgtttacctttc

SEQ ID NO: 1369382 - DNA, 22 bp, Homo sapiens
agagggaggtcactggaaaggg

SEQ ID NO: 1369383 - DNA, 13 bp, Homo sapiens
agagggcttcctc

SEQ ID NO: 1369384 - DNA, 12 bp, Homo sapiens
agagggggtgga

SEQ ID NO: 1369385 - DNA, 14 bp, Homo sapiens
agaggtaccctggg

SEQ ID NO: 1369386 - DNA, 15 bp, Homo sapiens
agaggtaccctgggt

SEQ ID NO: 1369387 - DNA, 17 bp, Homo sapiens
agaggtaccctgggtgt

SEQ ID NO: 1369388 - DNA, 16 bp, Homo sapiens
agaggtattaaaacta

SEQ ID NO: 1369389 - DNA, 13 bp, Homo sapiens
agagtacactgcc

SEQ ID NO: 1369390 - DNA, 16 bp, Homo sapiens
agagtcaaggcctgct

SEQ ID NO: 1369391 - DNA, 21 bp, Homo sapiens
agagtctaatagtctttgcca

SEQ ID NO: 1369392 - DNA, 14 bp, Homo sapiens
agagtctgagggct

SEQ ID NO: 1369393 - DNA, 22 bp, Homo sapiens
agagtgatagtcttttgctttt

SEQ ID NO: 1369394 - DNA, 21 bp, Homo sapiens
agagtggtgggggaaggctgt

SEQ ID NO: 1369395 - DNA, 23 bp, Homo sapiens
agagttttatagcctggactgct

SEQ ID NO: 1369396 - DNA, 20 bp, Homo sapiens
agatacctccaaccctgccg

SEQ ID NO: 1369397 - DNA, 22 bp, Homo sapiens
agatacttggggggctgaggtg

SEQ ID NO: 1369398 - DNA, 12 bp, Homo sapiens
agatactttgta

SEQ ID NO: 1369399 - DNA, 22 bp, Homo sapiens
agatactttgtattgtcctatt

SEQ ID NO: 1369400 - DNA, 19 bp, Homo sapiens
agatatactggaacccttt

SEQ ID NO: 1369401 - DNA, 20 bp, Homo sapiens
agatattgaggccaagaata

SEQ ID NO: 1369402 - DNA, 16 bp, Homo sapiens
agatcaaaaaggctta

SEQ ID NO: 1369403 - DNA, 17 bp, Homo sapiens
agatcactgtttagatt

SEQ ID NO: 1369404 - DNA, 15 bp, Homo sapiens
agatcagcctgggca

SEQ ID NO: 1369405 - DNA, 13 bp, Homo sapiens
agatcatagtttt

SEQ ID NO: 1369406 - DNA, 22 bp, Homo sapiens
agatcatagttttatttatatt

SEQ ID NO: 1369407 - DNA, 23 bp, Homo sapiens
agatcatagttttatttatattt

SEQ ID NO: 1369408 - DNA, 12 bp, Homo sapiens
agatccaaagac

SEQ ID NO: 1369409 - DNA, 19 bp, Homo sapiens
agatccatttccattgctt

SEQ ID NO: 1369410 - DNA, 23 bp, Homo sapiens
agatcccatgggttgtgtgttta

SEQ ID NO: 1369411 - DNA, 12 bp, Homo sapiens
agatcctcctgc

SEQ ID NO: 1369412 - DNA, 16 bp, Homo sapiens
agatcgagaccatcct

SEQ ID NO: 1369413 - DNA, 17 bp, Homo sapiens
agatcgagaccatcctg

SEQ ID NO: 1369414 - DNA, 21 bp, Homo sapiens
agatcgagaccatcctggcta

SEQ ID NO: 1369415 - DNA, 22 bp, Homo sapiens
agatctcggtttgccaaaattc

SEQ ID NO: 1369416 - DNA, 19 bp, Homo sapiens
agatctttcagaaatataa

SEQ ID NO: 1369417 - DNA, 21 bp, Homo sapiens
agatctttcagaaatataaca

SEQ ID NO: 1369418 - DNA, 23 bp, Homo sapiens
agatgcacttaagttagcctcca

SEQ ID NO: 1369419 - DNA, 20 bp, Homo sapiens
agatgcgtcccaagatgttg

SEQ ID NO: 1369420 - DNA, 18 bp, Homo sapiens
agatgctgtgtatatggt

SEQ ID NO: 1369421 - DNA, 16 bp, Homo sapiens
agatgcttctcactgc

SEQ ID NO: 1369422 - DNA, 18 bp, Homo sapiens
agatgcttctcactgcca

SEQ ID NO: 1369423 - DNA, 14 bp, Homo sapiens
agatgtgaattatt

SEQ ID NO: 1369424 - DNA, 20 bp, Homo sapiens
agatgtgaattattgacact

SEQ ID NO: 1369425 - DNA, 21 bp, Homo sapiens
agatgtgaattattgacactg

SEQ ID NO: 1369426 - DNA, 22 bp, Homo sapiens
agatgtgaattattgacactga

SEQ ID NO: 1369427 - DNA, 16 bp, Homo sapiens
agatgtggatttggca

SEQ ID NO: 1369428 - DNA, 16 bp, Homo sapiens
agatgtggctactgac

SEQ ID NO: 1369429 - DNA, 19 bp, Homo sapiens
agatgtgtggactgtggca

SEQ ID NO: 1369430 - DNA, 15 bp, Homo sapiens
agatgttagatattt

SEQ ID NO: 1369431 - DNA, 23 bp, Homo sapiens
agatgttgatttttactgtgttt

SEQ ID NO: 1369432 - DNA, 14 bp, Homo sapiens
agatgttgccatgt

SEQ ID NO: 1369433 - DNA, 18 bp, Homo sapiens
agatgttgccatgtgttt

SEQ ID NO: 1369434 - DNA, 14 bp, Homo sapiens
agatgtttccagac

SEQ ID NO: 1369435 - DNA, 21 bp, Homo sapiens
agatgtttccagacttccttg

SEQ ID NO: 1369436 - DNA, 16 bp, Homo sapiens
agattaaacttcatat

SEQ ID NO: 1369437 - DNA, 13 bp, Homo sapiens
agattctcaaagg

SEQ ID NO: 1369438 - DNA, 16 bp, Homo sapiens
agattcttctgtgttt

SEQ ID NO: 1369439 - DNA, 20 bp, Homo sapiens
agattctttcagttctttgg

SEQ ID NO: 1369440 - DNA, 19 bp, Homo sapiens
agattgactaactcaaata

SEQ ID NO: 1369441 - DNA, 18 bp, Homo sapiens
agattgatatctataaaa

SEQ ID NO: 1369442 - DNA, 21 bp, Homo sapiens
agattgatatctataaaatag

SEQ ID NO: 1369443 - DNA, 19 bp, Homo sapiens
agatttattttttggactt

SEQ ID NO: 1369444 - DNA, 15 bp, Homo sapiens
agatttctgaggaaa

SEQ ID NO: 1369445 - DNA, 18 bp, Homo sapiens
agatttgccatagagtac

SEQ ID NO: 1369446 - DNA, 20 bp, Homo sapiens
agattttcctcttgtgattt

SEQ ID NO: 1369447 - DNA, 22 bp, Homo sapiens
agattttcttttgccttttgca

SEQ ID NO: 1369448 - DNA, 23 bp, Homo sapiens
agcaaaaaaaaaaaaaagcatct

SEQ ID NO: 1369449 - DNA, 15 bp, Homo sapiens
agcaaaataaaacat

SEQ ID NO: 1369450 - DNA, 19 bp, Homo sapiens
agcaaactaacttgacttt

SEQ ID NO: 1369451 - DNA, 20 bp, Homo sapiens
agcaaatcagaaacttgtga

SEQ ID NO: 1369452 - DNA, 14 bp, Homo sapiens
agcaaatgcaaaaa

SEQ ID NO: 1369453 - DNA, 19 bp, Homo sapiens
agcaaattctgtttttcta

SEQ ID NO: 1369454 - DNA, 13 bp, Homo sapiens
agcaacaaagaaa

SEQ ID NO: 1369455 - DNA, 18 bp, Homo sapiens
agcaacacagcctgggcc

SEQ ID NO: 1369456 - DNA, 21 bp, Homo sapiens
agcaacacagcctgggcccca

SEQ ID NO: 1369457 - DNA, 18 bp, Homo sapiens
agcaacgatcacaaatga

SEQ ID NO: 1369458 - DNA, 21 bp, Homo sapiens
agcaacgatcacaaatgactt

SEQ ID NO: 1369459 - DNA, 22 bp, Homo sapiens
agcaacgatcacaaatgacttt

SEQ ID NO: 1369460 - DNA, 16 bp, Homo sapiens
agcaacttcttctcca

SEQ ID NO: 1369461 - DNA, 13 bp, Homo sapiens
agcaagtaaaaag

SEQ ID NO: 1369462 - DNA, 16 bp, Homo sapiens
agcaagtgagaccctg

SEQ ID NO: 1369463 - DNA, 20 bp, Homo sapiens
agcaagtgagaccctgtctc

SEQ ID NO: 1369464 - DNA, 21 bp, Homo sapiens
agcaagtgtgaatactgcttg

SEQ ID NO: 1369465 - DNA, 23 bp, Homo sapiens
agcaagtgtgaatactgcttgaa

SEQ ID NO: 1369466 - DNA, 20 bp, Homo sapiens
agcaagttctgagagccagg

SEQ ID NO: 1369467 - DNA, 15 bp, Homo sapiens
agcaatctcttcatt

SEQ ID NO: 1369468 - DNA, 21 bp, Homo sapiens
agcacaccaatcttactttgt

SEQ ID NO: 1369469 - DNA, 14 bp, Homo sapiens
agcacagaatattt

SEQ ID NO: 1369470 - DNA, 18 bp, Homo sapiens
agcacagcttgacctgag

SEQ ID NO: 1369471 - DNA, 14 bp, Homo sapiens
agcaccgaggggcc

SEQ ID NO: 1369472 - DNA, 18 bp, Homo sapiens
agcaccgaggggcctttg

SEQ ID NO: 1369473 - DNA, 18 bp, Homo sapiens
agcaccttgtgcctgggg

SEQ ID NO: 1369474 - DNA, 21 bp, Homo sapiens
agcactcctcggtactcccat

SEQ ID NO: 1369475 - DNA, 20 bp, Homo sapiens
agcactcctgcttaatcttc

SEQ ID NO: 1369476 - DNA, 12 bp, Homo sapiens
agcactgggctc

SEQ ID NO: 1369477 - DNA, 21 bp, Homo sapiens
agcactgggctcccgggcccc

SEQ ID NO: 1369478 - DNA, 22 bp, Homo sapiens
agcactttgggaggccaaggtg

SEQ ID NO: 1369479 - DNA, 23 bp, Homo sapiens
agcactttgggaggccaaggtgg

SEQ ID NO: 1369480 - DNA, 16 bp, Homo sapiens
agcagaggaccagggc

SEQ ID NO: 1369481 - DNA, 18 bp, Homo sapiens
agcagaggaccagggcct

SEQ ID NO: 1369482 - DNA, 15 bp, Homo sapiens
agcagagttttcatt

SEQ ID NO: 1369483 - DNA, 20 bp, Homo sapiens
agcagcaaattttcagcatt

SEQ ID NO: 1369484 - DNA, 13 bp, Homo sapiens
agcagcacctcct

SEQ ID NO: 1369485 - DNA, 16 bp, Homo sapiens
agcagcagggagggct

SEQ ID NO: 1369486 - DNA, 13 bp, Homo sapiens
agcagcaggtgat

SEQ ID NO: 1369487 - DNA, 20 bp, Homo sapiens
agcagcctctccccaggtcc

SEQ ID NO: 1369488 - DNA, 20 bp, Homo sapiens
agcaggcacgggtggtcccc

SEQ ID NO: 1369489 - DNA, 16 bp, Homo sapiens
agcagtcgtgcctgtg

SEQ ID NO: 1369490 - DNA, 21 bp, Homo sapiens
agcagttacaaaaaccttccc

SEQ ID NO: 1369491 - DNA, 22 bp, Homo sapiens
agcagttgctggtaaaatgaag

SEQ ID NO: 1369492 - DNA, 16 bp, Homo sapiens
agcataatttaaaaat

SEQ ID NO: 1369493 - DNA, 20 bp, Homo sapiens
agcataatttaaaaatatat

SEQ ID NO: 1369494 - DNA, 17 bp, Homo sapiens
agcatcaaaatatttca

SEQ ID NO: 1369495 - DNA, 14 bp, Homo sapiens
agcatcacttaaaa

SEQ ID NO: 1369496 - DNA, 17 bp, Homo sapiens
agcatcacttaaaacac

SEQ ID NO: 1369497 - DNA, 14 bp, Homo sapiens
agcatcggcctagg

SEQ ID NO: 1369498 - DNA, 19 bp, Homo sapiens
agcatcggcctagggcccc

SEQ ID NO: 1369499 - DNA, 21 bp, Homo sapiens
agcatcggcctagggccccca

SEQ ID NO: 1369500 - DNA, 15 bp, Homo sapiens
agcatctatctcatc

SEQ ID NO: 1369501 - DNA, 16 bp, Homo sapiens
agcatgaaatgtgaat

SEQ ID NO: 1369502 - DNA, 16 bp, Homo sapiens
agcattccagcccctc

SEQ ID NO: 1369503 - DNA, 19 bp, Homo sapiens
agcattccagcccctctgg

SEQ ID NO: 1369504 - DNA, 20 bp, Homo sapiens
agcattccagcccctctggt

SEQ ID NO: 1369505 - DNA, 12 bp, Homo sapiens
agcatttttcaa

SEQ ID NO: 1369506 - DNA, 13 bp, Homo sapiens
agcatttttcaat

SEQ ID NO: 1369507 - DNA, 23 bp, Homo sapiens
agccaaaatgtgagtggttgaat

SEQ ID NO: 1369508 - DNA, 12 bp, Homo sapiens
agccaaagaaaa

SEQ ID NO: 1369509 - DNA, 13 bp, Homo sapiens
agccaaagaaaaa

SEQ ID NO: 1369510 - DNA, 20 bp, Homo sapiens
agccaagattttcctcttgt

SEQ ID NO: 1369511 - DNA, 16 bp, Homo sapiens
agccaagggaaagggg

SEQ ID NO: 1369512 - DNA, 20 bp, Homo sapiens
agccaagggaaaggggtgct

SEQ ID NO: 1369513 - DNA, 13 bp, Homo sapiens
agccaagtggggt

SEQ ID NO: 1369514 - DNA, 23 bp, Homo sapiens
agccaagtgtggtagagtgtgcc

SEQ ID NO: 1369515 - DNA, 16 bp, Homo sapiens
agccaatgtctcctcc

SEQ ID NO: 1369516 - DNA, 14 bp, Homo sapiens
agccagaggctggg

SEQ ID NO: 1369517 - DNA, 15 bp, Homo sapiens
agccagaggctgggt

SEQ ID NO: 1369518 - DNA, 13 bp, Homo sapiens
agccagcacctgg

SEQ ID NO: 1369519 - DNA, 23 bp, Homo sapiens
agccagcacctggcatcgcacca

SEQ ID NO: 1369520 - DNA, 16 bp, Homo sapiens
agccagcccctcttcc

SEQ ID NO: 1369521 - DNA, 16 bp, Homo sapiens
agccagcgcctccctc

SEQ ID NO: 1369522 - DNA, 21 bp, Homo sapiens
agccagcgcctccctccaccc

SEQ ID NO: 1369523 - DNA, 22 bp, Homo sapiens
agccagcgcctccctccacccc

SEQ ID NO: 1369524 - DNA, 14 bp, Homo sapiens
agccagctccctct

SEQ ID NO: 1369525 - DNA, 17 bp, Homo sapiens
agccagctccctctatt

SEQ ID NO: 1369526 - DNA, 12 bp, Homo sapiens
agccagcttggg

SEQ ID NO: 1369527 - DNA, 18 bp, Homo sapiens
agccaggctcactcacag

SEQ ID NO: 1369528 - DNA, 23 bp, Homo sapiens
agccatctaaagtaaaaagggaa

SEQ ID NO: 1369529 - DNA, 21 bp, Homo sapiens
agccatgccagctggcctttg

SEQ ID NO: 1369530 - DNA, 21 bp, Homo sapiens
agccatgccgtctgccggacc

SEQ ID NO: 1369531 - DNA, 15 bp, Homo sapiens
agcccacccctcaac

SEQ ID NO: 1369532 - DNA, 23 bp, Homo sapiens
agcccacccctcaacacctctgc

SEQ ID NO: 1369533 - DNA, 13 bp, Homo sapiens
agcccaccctgct

SEQ ID NO: 1369534 - DNA, 13 bp, Homo sapiens
agcccagccctcc

SEQ ID NO: 1369535 - DNA, 14 bp, Homo sapiens
agcccagggctcct

SEQ ID NO: 1369536 - DNA, 15 bp, Homo sapiens
agccccactgccagc

SEQ ID NO: 1369537 - DNA, 16 bp, Homo sapiens
agccccactgccagca

SEQ ID NO: 1369538 - DNA, 13 bp, Homo sapiens
acctccccagcct

SEQ ID NO: 1369539 - DNA, 17 bp, Homo sapiens
acctcgccctctccttt

SEQ ID NO: 1369540 - DNA, 17 bp, Homo sapiens
acctcggtgccttcctc

SEQ ID NO: 1369541 - DNA, 19 bp, Homo sapiens
acctcggtgccttcctctt

SEQ ID NO: 1369542 - DNA, 14 bp, Homo sapiens
acctctctctctgg

SEQ ID NO: 1369543 - DNA, 16 bp, Homo sapiens
acctctgcacaagctg

SEQ ID NO: 1369544 - DNA, 16 bp, Homo sapiens
acctgactaagaaatt

SEQ ID NO: 1369545 - DNA, 16 bp, Homo sapiens
agctcatctgcaaaag

SEQ ID NO: 1369546 - DNA, 13 bp, Homo sapiens
agctccactctgc

SEQ ID NO: 1369547 - DNA, 18 bp, Homo sapiens
agctccactctgcttctc

SEQ ID NO: 1369548 - DNA, 21 bp, Homo sapiens
agctccagggaatccaagcct

SEQ ID NO: 1369549 - DNA, 21 bp, Homo sapiens
agctccccgcttctgcctgca

SEQ ID NO: 1369550 - DNA, 12 bp, Homo sapiens
agctcctgtggc

SEQ ID NO: 1369551 - DNA, 16 bp, Homo sapiens
agctcctgtggcccca

SEQ ID NO: 1369552 - DNA, 16 bp, Homo sapiens
agctcggggagcctta

SEQ ID NO: 1369553 - DNA, 15 bp, Homo sapiens
agctcggtacccggg

SEQ ID NO: 1369554 - DNA, 22 bp, Homo sapiens
agctcggtacccggggcccagg

SEQ ID NO: 1369555 - DNA, 16 bp, Homo sapiens
agctctctcctccctt

SEQ ID NO: 1369556 - DNA, 16 bp, Homo sapiens
agctctgaaatcttcc

SEQ ID NO: 1369557 - DNA, 21 bp, Homo sapiens
agctctgaccacttgaggcct

SEQ ID NO: 1369558 - DNA, 19 bp, Homo sapiens
agctctggaggggaggggg

SEQ ID NO: 1369559 - DNA, 18 bp, Homo sapiens
agctgaagaattgaaaag

SEQ ID NO: 1369560 - DNA, 16 bp, Homo sapiens
agctgagcctgcaggg

SEQ ID NO: 1369561 - DNA, 17 bp, Homo sapiens
agctgagcctgcaggga

SEQ ID NO: 1369562 - DNA, 16 bp, Homo sapiens
agctgcaaatctgatg

SEQ ID NO: 1369563 - DNA, 17 bp, Homo sapiens
agctgcaccctcaggca

SEQ ID NO: 1369564 - DNA, 22 bp, Homo sapiens
agctgcaccctcaggcaggtgg

SEQ ID NO: 1369565 - DNA, 19 bp, Homo sapiens
agctgcagagatttctcat

SEQ ID NO: 1369566 - DNA, 19 bp, Homo sapiens
agctgccatcgctgtgatg

SEQ ID NO: 1369567 - DNA, 15 bp, Homo sapiens
agctgccatggctag

SEQ ID NO: 1369568 - DNA, 10 bp, Homo sapiens
agctgccttc

SEQ ID NO: 1369569 - DNA, 16 bp, Homo sapiens
agctgccttccctagc

SEQ ID NO: 1369570 - DNA, 18 bp, Homo sapiens
agctgccttccctagctt

SEQ ID NO: 1369571 - DNA, 16 bp, Homo sapiens
agctgccttggctcag

SEQ ID NO: 1369572 - DNA, 17 bp, Homo sapiens
agctgcgcttgcttttc

SEQ ID NO: 1369573 - DNA, 19 bp, Homo sapiens
agctgctatccccatctcc

SEQ ID NO: 1369574 - DNA, 21 bp, Homo sapiens
agctgctatccccatctccct

SEQ ID NO: 1369575 - DNA, 23 bp, Homo sapiens
agctgctatccccatctccctgc

SEQ ID NO: 1369576 - DNA, 19 bp, Homo sapiens
agctgctatttattttcct

SEQ ID NO: 1369577 - DNA, 20 bp, Homo sapiens
agctggcttacactggcaat

SEQ ID NO: 1369578 - DNA, 14 bp, Homo sapiens
agctgggcaggttg

SEQ ID NO: 1369579 - DNA, 11 bp, Homo sapiens
agctgggcccg

SEQ ID NO: 1369580 - DNA, 22 bp, Homo sapiens
agctgtggtcaaggctacagat

SEQ ID NO: 1369581 - DNA, 20 bp, Homo sapiens
agcttaaaggggctagagtg

SEQ ID NO: 1369582 - DNA, 14 bp, Homo sapiens
agcttaatgctaca

SEQ ID NO: 1369583 - DNA, 16 bp, Homo sapiens
agcttcagttgcttgt

SEQ ID NO: 1369584 - DNA, 14 bp, Homo sapiens
agcttgacctgagg

SEQ ID NO: 1369585 - DNA, 20 bp, Homo sapiens
agcttgacctgaggctgtgg

SEQ ID NO: 1369586 - DNA, 21 bp, Homo sapiens
agcttgagccgggcccctggg

SEQ ID NO: 1369587 - DNA, 16 bp, Homo sapiens
agcttggattaaatac

SEQ ID NO: 1369588 - DNA, 17 bp, Homo sapiens
agcttggattaaataca

SEQ ID NO: 1369589 - DNA, 18 bp, Homo sapiens
aggcccccacttgcctct

SEQ ID NO: 1369590 - DNA, 14 bp, Homo sapiens
aggcccccagccca

SEQ ID NO: 1369591 - DNA, 18 bp, Homo sapiens
aggcccccagcccagggc

SEQ ID NO: 1369592 - DNA, 23 bp, Homo sapiens
aggcccccagcccagggctcctg

SEQ ID NO: 1369593 - DNA, 15 bp, Homo sapiens
aggccctggcctccc

SEQ ID NO: 1369594 - DNA, 23 bp, Homo sapiens
aggccctggcctcccctgccacc

SEQ ID NO: 1369595 - DNA, 18 bp, Homo sapiens
aggccgcgcgtccagctg

SEQ ID NO: 1369596 - DNA, 20 bp, Homo sapiens
aggccggcagccccagcctg

SEQ ID NO: 1369597 - DNA, 21 bp, Homo sapiens
aggccggcagccccagcctgc

SEQ ID NO: 1369598 - DNA, 16 bp, Homo sapiens
aggcctaccccgcaga

SEQ ID NO: 1369599 - DNA, 21 bp, Homo sapiens
aggcctatttcatcacaagaa

SEQ ID NO: 1369600 - DNA, 21 bp, Homo sapiens
aggcctctccatttgctcttc

SEQ ID NO: 1369601 - DNA, 16 bp, Homo sapiens
aggcctgatctgccca

SEQ ID NO: 1369602 - DNA, 18 bp, Homo sapiens
aggcctgcctcccacttc

SEQ ID NO: 1369603 - DNA, 21 bp, Homo sapiens
aggcctgcgaccctgggggca

SEQ ID NO: 1369604 - DNA, 12 bp, Homo sapiens
aggcctggggac

SEQ ID NO: 1369605 - DNA, 17 bp, Homo sapiens
aggctatgtataaaata

SEQ ID NO: 1369606 - DNA, 20 bp, Homo sapiens
aggctatgtataaaatacat

SEQ ID NO: 1369607 - DNA, 21 bp, Homo sapiens
aggctatgtataaaatacata

SEQ ID NO: 1369608 - DNA, 14 bp, Homo sapiens
aggctcactgccag

SEQ ID NO: 1369609 - DNA, 16 bp, Homo sapiens
aggctcactgccaggc

SEQ ID NO: 1369610 - DNA, 14 bp, Homo sapiens
aggctgaaaacaat

SEQ ID NO: 1369611 - DNA, 19 bp, Homo sapiens
aggctgaggcaggagaatg

SEQ ID NO: 1369612 - DNA, 17 bp, Homo sapiens
aggctgcagtgagccga

SEQ ID NO: 1369613 - DNA, 12 bp, Homo sapiens
aggctgcccctc

SEQ ID NO: 1369614 - DNA, 17 bp, Homo sapiens
aggctgcccctctcacc

SEQ ID NO: 1369615 - DNA, 21 bp, Homo sapiens
aggctggccagtccaggctgc

SEQ ID NO: 1369616 - DNA, 17 bp, Homo sapiens
aggctggcgagagtctg

SEQ ID NO: 1369617 - DNA, 22 bp, Homo sapiens
aggctggcgagagtctggccct

SEQ ID NO: 1369618 - DNA, 14 bp, Homo sapiens
aggcttaaaaactg

SEQ ID NO: 1369619 - DNA, 14 bp, Homo sapiens
aggcttagtttgtg

SEQ ID NO: 1369620 - DNA, 17 bp, Homo sapiens
aggcttctccgccagcc

SEQ ID NO: 1369621 - DNA, 20 bp, Homo sapiens
aggcttctccgccagcctcc

SEQ ID NO: 1369622 - DNA, 23 bp, Homo sapiens
aggcttctccgccagcctcctct

SEQ ID NO: 1369623 - DNA, 13 bp, Homo sapiens
aggcttgaagctg

SEQ ID NO: 1369624 - DNA, 22 bp, Homo sapiens
aggcttgtttacctttctctct

SEQ ID NO: 1369625 - DNA, 23 bp, Homo sapiens
aggctttcccacttcccaccctg

SEQ ID NO: 1369626 - DNA, 22 bp, Homo sapiens
aggctttctgttgccatggtga

SEQ ID NO: 1369627 - DNA, 18 bp, Homo sapiens
aggctttggtaactgcgg

SEQ ID NO: 1369628 - DNA, 14 bp, Homo sapiens
agggaaaaatatat

SEQ ID NO: 1369629 - DNA, 12 bp, Homo sapiens
agggaaagaaaa

SEQ ID NO: 1369630 - DNA, 15 bp, Homo sapiens
agggaaagttttttt

SEQ ID NO: 1369631 - DNA, 17 bp, Homo sapiens
agggaagggtttctcta

SEQ ID NO: 1369632 - DNA, 16 bp, Homo sapiens
agggaatccaagcctc

SEQ ID NO: 1369633 - DNA, 22 bp, Homo sapiens
agggaatccaagcctccacagc

SEQ ID NO: 1369634 - DNA, 18 bp, Homo sapiens
agggacacacagcctagc

SEQ ID NO: 1369635 - DNA, 15 bp, Homo sapiens
agggaccctttgggg

SEQ ID NO: 1369636 - DNA, 22 bp, Homo sapiens
agggactacccatagacatgaa

SEQ ID NO: 1369637 - DNA, 22 bp, Homo sapiens
agtgtagaaaagaactggaaac

SEQ ID NO: 1369638 - DNA, 15 bp, Homo sapiens
agtgtataataagaa

SEQ ID NO: 1369639 - DNA, 17 bp, Homo sapiens
agtgtataatataaaaa

SEQ ID NO: 1369640 - DNA, 17 bp, Homo sapiens
agtgtatgtagaagcat

SEQ ID NO: 1369641 - DNA, 22 bp, Homo sapiens
agtgtcccccaggttccgaaga

SEQ ID NO: 1369642 - DNA, 13 bp, Homo sapiens
agtgtgaatactg

SEQ ID NO: 1369643 - DNA, 20 bp, Homo sapiens
agtgtgcctgaagtcccaga

SEQ ID NO: 1369644 - DNA, 13 bp, Homo sapiens
agtgtggccaggc

SEQ ID NO: 1369645 - DNA, 14 bp, Homo sapiens
agtgtggccaggct

SEQ ID NO: 1369646 - DNA, 12 bp, Homo sapiens
agtgtgtaaaca

SEQ ID NO: 1369647 - DNA, 18 bp, Homo sapiens
agtgtgtatatattttgt

SEQ ID NO: 1369648 - DNA, 14 bp, Homo sapiens
agtgttatatgaac

SEQ ID NO: 1369649 - DNA, 20 bp, Homo sapiens
agtgttatatgaacatacaa

SEQ ID NO: 1369650 - DNA, 21 bp, Homo sapiens
agtgtttcgcgggtaactggg

SEQ ID NO: 1369651 - DNA, 11 bp, Homo sapiens
agtgtttcttt

SEQ ID NO: 1369652 - DNA, 13 bp, Homo sapiens
agtgttttgcaag

SEQ ID NO: 1369653 - DNA, 19 bp, Homo sapiens
agtgtttttttatttctac

SEQ ID NO: 1369654 - DNA, 21 bp, Homo sapiens
agttaaaagaatgtaaaatat

SEQ ID NO: 1369655 - DNA, 21 bp, Homo sapiens
agttactgccggtttgaaaat

SEQ ID NO: 1369656 - DNA, 16 bp, Homo sapiens
agttactgtgtaaact

SEQ ID NO: 1369657 - DNA, 18 bp, Homo sapiens
agttagctgaagaattga

SEQ ID NO: 1369658 - DNA, 22 bp, Homo sapiens
agttagtttgtatatattatta

SEQ ID NO: 1369659 - DNA, 12 bp, Homo sapiens
agttataagaag

SEQ ID NO: 1369660 - DNA, 18 bp, Homo sapiens
agttatctttgaatatgt

SEQ ID NO: 1369661 - DNA, 14 bp, Homo sapiens
agttattttctaca

SEQ ID NO: 1369662 - DNA, 23 bp, Homo sapiens
agttattttctacagtggtttta

SEQ ID NO: 1369663 - DNA, 19 bp, Homo sapiens
agttcatcagagttatggt

SEQ ID NO: 1369664 - DNA, 17 bp, Homo sapiens
agttcatcgattttcta

SEQ ID NO: 1369665 - DNA, 23 bp, Homo sapiens
agttcctcattagcattttgcta

SEQ ID NO: 1369666 - DNA, 16 bp, Homo sapiens
agttctactcaggctg

SEQ ID NO: 1369667 - DNA, 13 bp, Homo sapiens
agttctgtatttg

SEQ ID NO: 1369668 - DNA, 18 bp, Homo sapiens
agttctgtatttgaaagt

SEQ ID NO: 1369669 - DNA, 22 bp, Homo sapiens
agttctgtatttgaaagtgcct

SEQ ID NO: 1369670 - DNA, 20 bp, Homo sapiens
agttcttatgaggaggggag

SEQ ID NO: 1369671 - DNA, 19 bp, Homo sapiens
agttctttgttcatagccc

SEQ ID NO: 1369672 - DNA, 19 bp, Homo sapiens
agttgaaaattcatagtaa

SEQ ID NO: 1369673 - DNA, 14 bp, Homo sapiens
agttgattcagctc

SEQ ID NO: 1369674 - DNA, 15 bp, Homo sapiens
agttgattcagctct

SEQ ID NO: 1369675 - DNA, 18 bp, Homo sapiens
agttgattcagctctgca

SEQ ID NO: 1369676 - DNA, 18 bp, Homo sapiens
agttgcaattgaattaaa

SEQ ID NO: 1369677 - DNA, 19 bp, Homo sapiens
agttgcaattgaattaaat

SEQ ID NO: 1369678 - DNA, 20 bp, Homo sapiens
agttgcaattgaattaaatt

SEQ ID NO: 1369679 - DNA, 14 bp, Homo sapiens
agttgcatcagaaa

SEQ ID NO: 1369680 - DNA, 16 bp, Homo sapiens
agttggccagagagcc

SEQ ID NO: 1369681 - DNA, 15 bp, Homo sapiens
agttgggtgtctcct

SEQ ID NO: 1369682 - DNA, 18 bp, Homo sapiens
agttgtaaataatttatt

SEQ ID NO: 1369683 - DNA, 22 bp, Homo sapiens
agttgtaaataatttatttaat

SEQ ID NO: 1369684 - DNA, 19 bp, Homo sapiens
agttgtatttaacagaaat

SEQ ID NO: 1369685 - DNA, 22 bp, Homo sapiens
agttgtatttaacagaaattgt

SEQ ID NO: 1369686 - DNA, 13 bp, Homo sapiens
agttgtcaggtta

SEQ ID NO: 1369687 - DNA, 17 bp, Homo sapiens
agttgtttttgtatatt

SEQ ID NO: 1369688 - DNA, 16 bp, Homo sapiens
agtttattttaaaaca

SEQ ID NO: 1369689 - DNA, 17 bp, Homo sapiens
agtttccgtgcgtggca

SEQ ID NO: 1369690 - DNA, 20 bp, Homo sapiens
agtttccgtgcgtggcactc

SEQ ID NO: 1369691 - DNA, 21 bp, Homo sapiens
agtttctgtggttggctggga

SEQ ID NO: 1369692 - DNA, 20 bp, Homo sapiens
agtttctttattttgtgtaa

SEQ ID NO: 1369693 - DNA, 19 bp, Homo sapiens
agtttgagatcagcctggg

SEQ ID NO: 1369694 - DNA, 21 bp, Homo sapiens
atatcaaattaattgtgtgaa

SEQ ID NO: 1369695 - DNA, 16 bp, Homo sapiens
atatcagtgacagttg

SEQ ID NO: 1369696 - DNA, 14 bp, Homo sapiens
atatcctgtgactg

SEQ ID NO: 1369697 - DNA, 20 bp, Homo sapiens
atatcctgtgactgtctcac

SEQ ID NO: 1369698 - DNA, 17 bp, Homo sapiens
atatcgacttgtttttg

SEQ ID NO: 1369699 - DNA, 13 bp, Homo sapiens
atatctataaaat

SEQ ID NO: 1369700 - DNA, 17 bp, Homo sapiens
atatctatatatataat

SEQ ID NO: 1369701 - DNA, 18 bp, Homo sapiens
atatctatatatataatt

SEQ ID NO: 1369702 - DNA, 12 bp, Homo sapiens
atatctattaat

SEQ ID NO: 1369703 - DNA, 14 bp, Homo sapiens
atatctattaatat

SEQ ID NO: 1369704 - DNA, 14 bp, Homo sapiens
atatctctatttga

SEQ ID NO: 1369705 - DNA, 12 bp, Homo sapiens
atatctgcaaaa

SEQ ID NO: 1369706 - DNA, 20 bp, Homo sapiens
atatgaaaaaaatgcatttt

SEQ ID NO: 1369707 - DNA, 16 bp, Homo sapiens
atatgaaaatacaact

SEQ ID NO: 1369708 - DNA, 18 bp, Homo sapiens
atatgaacatacaaatgc

SEQ ID NO: 1369709 - DNA, 19 bp, Homo sapiens
atatgaacatacaaatgca

SEQ ID NO: 1369710 - DNA, 17 bp, Homo sapiens
atatgattaaaaatatc

SEQ ID NO: 1369711 - DNA, 14 bp, Homo sapiens
atatgctttattaa

SEQ ID NO: 1369712 - DNA, 15 bp, Homo sapiens
atatggaattttgca

SEQ ID NO: 1369713 - DNA, 12 bp, Homo sapiens
atatggatgtta

SEQ ID NO: 1369714 - DNA, 23 bp, Homo sapiens
atatggatgttactctcttgcac

SEQ ID NO: 1369715 - DNA, 16 bp, Homo sapiens
atatggggaatatatt

SEQ ID NO: 1369716 - DNA, 23 bp, Homo sapiens
atatgggttagatgttgccatgt

SEQ ID NO: 1369717 - DNA, 20 bp, Homo sapiens
atatgtaatctctaggaagt

SEQ ID NO: 1369718 - DNA, 19 bp, Homo sapiens
atatgtatgtgtttagaat

SEQ ID NO: 1369719 - DNA, 21 bp, Homo sapiens
atatgtatgtgtttagaattg

SEQ ID NO: 1369720 - DNA, 22 bp, Homo sapiens
atatgtatgtgtttagaattga

SEQ ID NO: 1369721 - DNA, 17 bp, Homo sapiens
atatgtattatttataa

SEQ ID NO: 1369722 - DNA, 22 bp, Homo sapiens
atatgtattatttataattcct

SEQ ID NO: 1369723 - DNA, 13 bp, Homo sapiens
atatgtattcttt

SEQ ID NO: 1369724 - DNA, 14 bp, Homo sapiens
atatgtattctttt

SEQ ID NO: 1369725 - DNA, 22 bp, Homo sapiens
atatgtgtatgcacagtaaaaa

SEQ ID NO: 1369726 - DNA, 15 bp, Homo sapiens
atattactgacattt

SEQ ID NO: 1369727 - DNA, 19 bp, Homo sapiens
atattataaaggataaaga

SEQ ID NO: 1369728 - DNA, 23 bp, Homo sapiens
atattataaaggataaagaagga

SEQ ID NO: 1369729 - DNA, 19 bp, Homo sapiens
atattcagggtaaatagga

SEQ ID NO: 1369730 - DNA, 20 bp, Homo sapiens
atattcagggtaaataggaa

SEQ ID NO: 1369731 - DNA, 15 bp, Homo sapiens
atattccagatcttt

SEQ ID NO: 1369732 - DNA, 19 bp, Homo sapiens
atattgaggccaagaatat

SEQ ID NO: 1369733 - DNA, 22 bp, Homo sapiens
atattgaggccaagaatattgc

SEQ ID NO: 1369734 - DNA, 15 bp, Homo sapiens
atattgattgggaaa

SEQ ID NO: 1369735 - DNA, 19 bp, Homo sapiens
atattgattgggaaaacat

SEQ ID NO: 1369736 - DNA, 15 bp, Homo sapiens
atattggttttatga

SEQ ID NO: 1369737 - DNA, 19 bp, Homo sapiens
atattggttttatgatgac

SEQ ID NO: 1369738 - DNA, 13 bp, Homo sapiens
atattgttgacaa

SEQ ID NO: 1369739 - DNA, 15 bp, Homo sapiens
atatttattaaattt

SEQ ID NO: 1369740 - DNA, 13 bp, Homo sapiens
atatttattgact

SEQ ID NO: 1369741 - DNA, 21 bp, Homo sapiens
atatttcccatttgtgccaga

SEQ ID NO: 1369742 - DNA, 18 bp, Homo sapiens
atatttcctttatgtgaa

SEQ ID NO: 1369743 - DNA, 21 bp, Homo sapiens
atatttcctttatgtgaattt

SEQ ID NO: 1369744 - DNA, 20 bp, Homo sapiens
atatttgaattttaaatcta

SEQ ID NO: 1369745 - DNA, 14 bp, Homo sapiens
atatttgatttatt

SEQ ID NO: 1369746 - DNA, 16 bp, Homo sapiens
atatttgatttattaa

SEQ ID NO: 1369747 - DNA, 18 bp, Homo sapiens
atatttgatttattaact

SEQ ID NO: 1369748 - DNA, 17 bp, Homo sapiens
atatttgcaaagtgtat

SEQ ID NO: 1369749 - DNA, 16 bp, Homo sapiens
atatttgtaaagctat

SEQ ID NO: 1369750 - DNA, 16 bp, Homo sapiens
atattttaacctgcat

SEQ ID NO: 1369751 - DNA, 14 bp, Homo sapiens
atattttatattac

SEQ ID NO: 1369752 - DNA, 14 bp, Homo sapiens
atattttatggtta

SEQ ID NO: 1369753 - DNA, 20 bp, Homo sapiens
atattttatgtgagagaaag

SEQ ID NO: 1369754 - DNA, 16 bp, Homo sapiens
atattttattactgtt

SEQ ID NO: 1369755 - DNA, 13 bp, Homo sapiens
atattttctctgt

SEQ ID NO: 1369756 - DNA, 18 bp, Homo sapiens
atattttctctgtacttt

SEQ ID NO: 1369757 - DNA, 13 bp, Homo sapiens
atattttctgttt

SEQ ID NO: 1369758 - DNA, 13 bp, Homo sapiens
atattttgtgtga

SEQ ID NO: 1369759 - DNA, 18 bp, Homo sapiens
atatttttatatttcctt

SEQ ID NO: 1369760 - DNA, 12 bp, Homo sapiens
atcaaaaaggct

SEQ ID NO: 1369761 - DNA, 13 bp, Homo sapiens
atcaaaaaggctt

SEQ ID NO: 1369762 - DNA, 23 bp, Homo sapiens
atcaaaaaggcttataaaacaga

SEQ ID NO: 1369763 - DNA, 15 bp, Homo sapiens
atcaaacctttgagt

SEQ ID NO: 1369764 - DNA, 20 bp, Homo sapiens
atcaaagaggttttaaaaaa

SEQ ID NO: 1369765 - DNA, 11 bp, Homo sapiens
atcaaagtgct

SEQ ID NO: 1369766 - DNA, 17 bp, Homo sapiens
atcaaataagtatttat

SEQ ID NO: 1369767 - DNA, 18 bp, Homo sapiens
atcaaataagtatttata

SEQ ID NO: 1369768 - DNA, 19 bp, Homo sapiens
atcaaataagtatttataa

SEQ ID NO: 1369769 - DNA, 17 bp, Homo sapiens
atcaacaataaaatttt

SEQ ID NO: 1369770 - DNA, 22 bp, Homo sapiens
atcaacttagtcaataagaaaa

SEQ ID NO: 1369771 - DNA, 21 bp, Homo sapiens
atcaagaagactttaggaatg

SEQ ID NO: 1369772 - DNA, 15 bp, Homo sapiens
atcaagagccttaaa

SEQ ID NO: 1369773 - DNA, 16 bp, Homo sapiens
atcaagggaagaacta

SEQ ID NO: 1369774 - DNA, 18 bp, Homo sapiens
atcaagggaagaactatt

SEQ ID NO: 1369775 - DNA, 19 bp, Homo sapiens
atcaaggttataatttttt

SEQ ID NO: 1369776 - DNA, 23 bp, Homo sapiens
atcaaggttataattttttttaa

SEQ ID NO: 1369777 - DNA, 15 bp, Homo sapiens
atcaatcaaataagt

SEQ ID NO: 1369778 - DNA, 13 bp, Homo sapiens
atcaatcctgatt

SEQ ID NO: 1369779 - DNA, 21 bp, Homo sapiens
atcacagcctctgaaaaccaa

SEQ ID NO: 1369780 - DNA, 21 bp, Homo sapiens
atcacagggtgggcctcggcc

SEQ ID NO: 1369781 - DNA, 17 bp, Homo sapiens
atcacagtttttcctgg

SEQ ID NO: 1369782 - DNA, 16 bp, Homo sapiens
atcaccgactgaaaat

SEQ ID NO: 1369783 - DNA, 19 bp, Homo sapiens
atcactgccacactctcca

SEQ ID NO: 1369784 - DNA, 15 bp, Homo sapiens
atcactgtgtatatt

SEQ ID NO: 1369785 - DNA, 20 bp, Homo sapiens
atcactgtgtatatttgatt

SEQ ID NO: 1369786 - DNA, 14 bp, Homo sapiens
atcactgtttagat

SEQ ID NO: 1369787 - DNA, 18 bp, Homo sapiens
atcactgtttagatttgc

SEQ ID NO: 1369788 - DNA, 12 bp, Homo sapiens
atcacttaaaac

SEQ ID NO: 1369789 - DNA, 22 bp, Homo sapiens
atcagagatgcaccaccaagcc

SEQ ID NO: 1369790 - DNA, 17 bp, Homo sapiens
atcagcctgctccagct

SEQ ID NO: 1369791 - DNA, 18 bp, Homo sapiens
atcagcctgctccagctg

SEQ ID NO: 1369792 - DNA, 22 bp, Homo sapiens
atcaggaatattttccaaagag

SEQ ID NO: 1369793 - DNA, 15 bp, Homo sapiens
atcaggggagaaaaa

SEQ ID NO: 1369794 - DNA, 15 bp, Homo sapiens
atcagtaaccccctt

SEQ ID NO: 1369795 - DNA, 22 bp, Homo sapiens
atcataggcaccttttactgtg

SEQ ID NO: 1369796 - DNA, 14 bp, Homo sapiens
atcatagttttatt

SEQ ID NO: 1369797 - DNA, 23 bp, Homo sapiens
atcatagttttatttatatttat

SEQ ID NO: 1369798 - DNA, 12 bp, Homo sapiens
atcatgcaaaat

SEQ ID NO: 1369799 - DNA, 12 bp, Homo sapiens
atcattcaagtg

SEQ ID NO: 1369800 - DNA, 16 bp, Homo sapiens
atcattcagaaatgtt

SEQ ID NO: 1369801 - DNA, 14 bp, Homo sapiens
atcattccttttta

SEQ ID NO: 1369802 - DNA, 15 bp, Homo sapiens
atcattcctttttat

SEQ ID NO: 1369803 - DNA, 20 bp, Homo sapiens
atcattcctttttatttata

SEQ ID NO: 1369804 - DNA, 18 bp, Homo sapiens
atcattcttactaaaaag

SEQ ID NO: 1369805 - DNA, 23 bp, Homo sapiens
atcattcttactaaaaagtataa

SEQ ID NO: 1369806 - DNA, 22 bp, Homo sapiens
atcattgtacatagcatgttta

SEQ ID NO: 1369807 - DNA, 22 bp, Homo sapiens
atccaaatttttttttaaagca

SEQ ID NO: 1369808 - DNA, 16 bp, Homo sapiens
atccaactccagcaac

SEQ ID NO: 1369809 - DNA, 19 bp, Homo sapiens
atccaagcctccacagcga

SEQ ID NO: 1369810 - DNA, 20 bp, Homo sapiens
atccaatgggtttttccctg

SEQ ID NO: 1369811 - DNA, 12 bp, Homo sapiens
atccagaaaact

SEQ ID NO: 1369812 - DNA, 15 bp, Homo sapiens
atccagaaaactgtg

SEQ ID NO: 1369813 - DNA, 22 bp, Homo sapiens
atccagaggcaaacggaggcaa

SEQ ID NO: 1369814 - DNA, 14 bp, Homo sapiens
atccagatgtggct

SEQ ID NO: 1369815 - DNA, 19 bp, Homo sapiens
atccagccggaggccagag

SEQ ID NO: 1369816 - DNA, 17 bp, Homo sapiens
atccagctgcctattga

SEQ ID NO: 1369817 - DNA, 19 bp, Homo sapiens
atccagtgacctctctctc

SEQ ID NO: 1369818 - DNA, 21 bp, Homo sapiens
atccagtgacctctctctctg

SEQ ID NO: 1369819 - DNA, 17 bp, Homo sapiens
atccatttccattgctt

SEQ ID NO: 1369820 - DNA, 13 bp, Homo sapiens
atcccacatccaa

SEQ ID NO: 1369821 - DNA, 22 bp, Homo sapiens
atcccacatccaactccagcaa

SEQ ID NO: 1369822 - DNA, 19 bp, Homo sapiens
atcccactaatgcaaactg

SEQ ID NO: 1369823 - DNA, 20 bp, Homo sapiens
atcccactaatgcaaactgg

SEQ ID NO: 1369824 - DNA, 15 bp, Homo sapiens
atcccattccaggca

SEQ ID NO: 1369825 - DNA, 22 bp, Homo sapiens
atccccagggggcatgaccaga

SEQ ID NO: 1369826 - DNA, 13 bp, Homo sapiens
atccccatctccc

SEQ ID NO: 1369827 - DNA, 19 bp, Homo sapiens
atccccatctccctgcctg

SEQ ID NO: 1369828 - DNA, 20 bp, Homo sapiens
atccccatctccctgcctgg

SEQ ID NO: 1369829 - DNA, 17 bp, Homo sapiens
atccccccatcttgctt

SEQ ID NO: 1369830 - DNA, 20 bp, Homo sapiens
atccccccatcttgcttccc

SEQ ID NO: 1369831 - DNA, 18 bp, Homo sapiens
atccccgcctggccagga

SEQ ID NO: 1369832 - DNA, 20 bp, Homo sapiens
atccccgcctggccaggagc

SEQ ID NO: 1369833 - DNA, 13 bp, Homo sapiens
atcccctaaaata

SEQ ID NO: 1369834 - DNA, 15 bp, Homo sapiens
atcccgttttcccca

SEQ ID NO: 1369835 - DNA, 15 bp, Homo sapiens
atccctctcctaact

SEQ ID NO: 1369836 - DNA, 14 bp, Homo sapiens
atccctttattacc

SEQ ID NO: 1369837 - DNA, 22 bp, Homo sapiens
atccctttttcataaattattt

SEQ ID NO: 1369838 - DNA, 20 bp, Homo sapiens
atcctaatttctcctccctt

SEQ ID NO: 1369839 - DNA, 16 bp, Homo sapiens
atcctaggcatttgct

SEQ ID NO: 1369840 - DNA, 11 bp, Homo sapiens
atcctcctgca

SEQ ID NO: 1369841 - DNA, 17 bp, Homo sapiens
atcctgattcctctcta

SEQ ID NO: 1369842 - DNA, 11 bp, Homo sapiens
atcctggcagc

SEQ ID NO: 1369843 - DNA, 15 bp, Homo sapiens
atcctggcagcccag

SEQ ID NO: 1369844 - DNA, 11 bp, Homo sapiens
atcctgtgact

SEQ ID NO: 1369845 - DNA, 17 bp, Homo sapiens
atcctttaaaatttaaa

SEQ ID NO: 1369846 - DNA, 19 bp, Homo sapiens
atcctttgttttctgacta

SEQ ID NO: 1369847 - DNA, 21 bp, Homo sapiens
atcctttgttttctgactaat

SEQ ID NO: 1369848 - DNA, 23 bp, Homo sapiens
atcctttgttttctgactaatta

SEQ ID NO: 1369849 - DNA, 23 bp, Homo sapiens
atcgtgaagaagcctgtaacact

SEQ ID NO: 1369850 - DNA, 14 bp, Homo sapiens
atcgtgctactgca

SEQ ID NO: 1369851 - DNA, 13 bp, Homo sapiens
atctaaatctatt

SEQ ID NO: 1369852 - DNA, 22 bp, Homo sapiens
atctaatatatatgaataaagt

SEQ ID NO: 1369853 - DNA, 14 bp, Homo sapiens
atctactgcattta

SEQ ID NO: 1369854 - DNA, 17 bp, Homo sapiens
atctaggggagccttga

SEQ ID NO: 1369855 - DNA, 12 bp, Homo sapiens
atctataaaata

SEQ ID NO: 1369856 - DNA, 16 bp, Homo sapiens
atctatagaaagctat

SEQ ID NO: 1369857 - DNA, 16 bp, Homo sapiens
atctatctagttctaa

SEQ ID NO: 1369858 - DNA, 18 bp, Homo sapiens
atctattaatatatgtat

SEQ ID NO: 1369859 - DNA, 19 bp, Homo sapiens
atctatttattaatattta

SEQ ID NO: 1369860 - DNA, 22 bp, Homo sapiens
atctcaataaagtgctttaaaa

SEQ ID NO: 1369861 - DNA, 16 bp, Homo sapiens
atctcagggcctggtc

SEQ ID NO: 1369862 - DNA, 15 bp, Homo sapiens
atctcatctatctca

SEQ ID NO: 1369863 - DNA, 18 bp, Homo sapiens
atctccacaacctcttcc

SEQ ID NO: 1369864 - DNA, 20 bp, Homo sapiens
atctcccctcagctcggctc

SEQ ID NO: 1369865 - DNA, 14 bp, Homo sapiens
atctccctgcctgg

SEQ ID NO: 1369866 - DNA, 20 bp, Homo sapiens
atctccctgcctggccccca

SEQ ID NO: 1369867 - DNA, 16 bp, Homo sapiens
atctccggctcccagc

SEQ ID NO: 1369868 - DNA, 21 bp, Homo sapiens
atctccggctcccagcctcag

SEQ ID NO: 1369869 - DNA, 22 bp, Homo sapiens
atctccggctcccagcctcagc

SEQ ID NO: 1369870 - DNA, 17 bp, Homo sapiens
atctcctgacagaaggt

SEQ ID NO: 1369871 - DNA, 14 bp, Homo sapiens
atctctcctggcct

SEQ ID NO: 1369872 - DNA, 13 bp, Homo sapiens
atctctgtgcctt

SEQ ID NO: 1369873 - DNA, 15 bp, Homo sapiens
atctcttgagcctgg

SEQ ID NO: 1369874 - DNA, 15 bp, Homo sapiens
atctctttttgtttg

SEQ ID NO: 1369875 - DNA, 16 bp, Homo sapiens
atctctttttgtttgc

SEQ ID NO: 1369876 - DNA, 14 bp, Homo sapiens
atctgagggaaatg

SEQ ID NO: 1369877 - DNA, 15 bp, Homo sapiens
atctgagggaaatgt

SEQ ID NO: 1369878 - DNA, 21 bp, Homo sapiens
atctgagggaaatgttttgta

SEQ ID NO: 1369879 - DNA, 22 bp, Homo sapiens
atctgagggaaatgttttgtaa

SEQ ID NO: 1369880 - DNA, 23 bp, Homo sapiens
atctgagggaaatgttttgtaaa

SEQ ID NO: 1369881 - DNA, 13 bp, Homo sapiens
ataatactgaacc

SEQ ID NO: 1369882 - DNA, 16 bp, Homo sapiens
ataatactgaaccact

SEQ ID NO: 1369883 - DNA, 13 bp, Homo sapiens
ataatagaaatgt

SEQ ID NO: 1369884 - DNA, 21 bp, Homo sapiens
ataatagcaacttttgtgtaa

SEQ ID NO: 1369885 - DNA, 13 bp, Homo sapiens
ataatataaaaaa

SEQ ID NO: 1369886 - DNA, 22 bp, Homo sapiens
ataatattgtttggtaaatgtt

SEQ ID NO: 1369887 - DNA, 16 bp, Homo sapiens
ataatcaagagcctta

SEQ ID NO: 1369888 - DNA, 17 bp, Homo sapiens
ataatcaagagccttaa

SEQ ID NO: 1369889 - DNA, 21 bp, Homo sapiens
ataatcttgtttctgaaaaga

SEQ ID NO: 1369890 - DNA, 15 bp, Homo sapiens
ataatgctacaattt

SEQ ID NO: 1369891 - DNA, 17 bp, Homo sapiens
ataatgtccatatgcta

SEQ ID NO: 1369892 - DNA, 15 bp, Homo sapiens
ataattatataactg

SEQ ID NO: 1369893 - DNA, 17 bp, Homo sapiens
ataattatataactgta

SEQ ID NO: 1369894 - DNA, 14 bp, Homo sapiens
ataattctttttta

SEQ ID NO: 1369895 - DNA, 19 bp, Homo sapiens
ataattcttttttattaat

SEQ ID NO: 1369896 - DNA, 21 bp, Homo sapiens
ataattcttttttattaatca

SEQ ID NO: 1369897 - DNA, 15 bp, Homo sapiens
ataattgaagtgtat

SEQ ID NO: 1369898 - DNA, 19 bp, Homo sapiens
ataattgtacaaaattaag

SEQ ID NO: 1369899 - DNA, 24 bp, Homo sapiens
ataattgtacaaaattaagcaaat

SEQ ID NO: 1369900 - DNA, 23 bp, Homo sapiens
ataattgttctcagaatccctta

SEQ ID NO: 1369901 - DNA, 17 bp, Homo sapiens
ataatttaaaaatatat

SEQ ID NO: 1369902 - DNA, 22 bp, Homo sapiens
ataattttttttaaaatagaaa

SEQ ID NO: 1369903 - DNA, 13 bp, Homo sapiens
atacaaaaagaaa

SEQ ID NO: 1369904 - DNA, 20 bp, Homo sapiens
atacaaatgcatctttgatg

SEQ ID NO: 1369905 - DNA, 21 bp, Homo sapiens
atacaaatgcatctttgatgt

SEQ ID NO: 1369906 - DNA, 12 bp, Homo sapiens
atacaaggtata

SEQ ID NO: 1369907 - DNA, 17 bp, Homo sapiens
atacaatgaacacttat

SEQ ID NO: 1369908 - DNA, 22 bp, Homo sapiens
atacacatttgctactgttgta

SEQ ID NO: 1369909 - DNA, 15 bp, Homo sapiens
atacactttgttgca

SEQ ID NO: 1369910 - DNA, 17 bp, Homo sapiens
atacactttgttgcaag

SEQ ID NO: 1369911 - DNA, 18 bp, Homo sapiens
atacatagtgaaaattgt

SEQ ID NO: 1369912 - DNA, 22 bp, Homo sapiens
atacatgaagaatagaaacaag

SEQ ID NO: 1369913 - DNA, 15 bp, Homo sapiens
atacatgcatataat

SEQ ID NO: 1369914 - DNA, 20 bp, Homo sapiens
atacatgcatataatgaata

SEQ ID NO: 1369915 - DNA, 22 bp, Homo sapiens
atacatgtaattctaccaaggt

SEQ ID NO: 1369916 - DNA, 23 bp, Homo sapiens
atacatgtcacatttagctgtgc

SEQ ID NO: 1369917 - DNA, 16 bp, Homo sapiens
atacatgtgatacatt

SEQ ID NO: 1369918 - DNA, 18 bp, Homo sapiens
atacatgtgatacatttt

SEQ ID NO: 1369919 - DNA, 13 bp, Homo sapiens
ataccaaacatgc

SEQ ID NO: 1369920 - DNA, 13 bp, Homo sapiens
ataccacatcaaa

SEQ ID NO: 1369921 - DNA, 13 bp, Homo sapiens
atacgatttaagg

SEQ ID NO: 1369922 - DNA, 20 bp, Homo sapiens
atactatttaagatgtgaaa

SEQ ID NO: 1369923 - DNA, 21 bp, Homo sapiens
atactatttaagatgtgaaaa

SEQ ID NO: 1369924 - DNA, 12 bp, Homo sapiens
atactccttccc

SEQ ID NO: 1369925 - DNA, 19 bp, Homo sapiens
atactgaaccacttgtaga

SEQ ID NO: 1369926 - DNA, 20 bp, Homo sapiens
atactgaaggaaaaacacaa

SEQ ID NO: 1369927 - DNA, 14 bp, Homo sapiens
atactgatggaatt

SEQ ID NO: 1369928 - DNA, 20 bp, Homo sapiens
atactgcgactttctgcctg

SEQ ID NO: 1369929 - DNA, 19 bp, Homo sapiens
atactgcttgaataaacac

SEQ ID NO: 1369930 - DNA, 21 bp, Homo sapiens
atacttacctagtgaaacttt

SEQ ID NO: 1369931 - DNA, 14 bp, Homo sapiens
atactttgtattgt

SEQ ID NO: 1369932 - DNA, 23 bp, Homo sapiens
atagaaatggaaattttgctatc

SEQ ID NO: 1369933 - DNA, 15 bp, Homo sapiens
atagaaatgtaggtc

SEQ ID NO: 1369934 - DNA, 18 bp, Homo sapiens
atagaaattttgtaagaa

SEQ ID NO: 1369935 - DNA, 14 bp, Homo sapiens
atagacacatacat

SEQ ID NO: 1369936 - DNA, 13 bp, Homo sapiens
atagacatgaaag

SEQ ID NO: 1369937 - DNA, 19 bp, Homo sapiens
atagaggctagcttctgct

SEQ ID NO: 1369938 - DNA, 22 bp, Homo sapiens
atagaggcttctccgccagcct

SEQ ID NO: 1369939 - DNA, 14 bp, Homo sapiens
atagagtacactgc

SEQ ID NO: 1369940 - DNA, 23 bp, Homo sapiens
atagagtgtagtttacagaaaaa

SEQ ID NO: 1369941 - DNA, 18 bp, Homo sapiens
atagatgctgtgtatatg

SEQ ID NO: 1369942 - DNA, 15 bp, Homo sapiens
atagattttataaga

SEQ ID NO: 1369943 - DNA, 24 bp, Homo sapiens
atgacgtacaagtagttctgtatt

SEQ ID NO: 1369944 - DNA, 22 bp, Homo sapiens
atgactatataatttatttcca

SEQ ID NO: 1369945 - DNA, 17 bp, Homo sapiens
atgactttattatttat

SEQ ID NO: 1369946 - DNA, 16 bp, Homo sapiens
atgagagcataattta

SEQ ID NO: 1369947 - DNA, 20 bp, Homo sapiens
atgagatttttaaaaaatat

SEQ ID NO: 1369948 - DNA, 12 bp, Homo sapiens
atgagcctggca

SEQ ID NO: 1369949 - DNA, 14 bp, Homo sapiens
atgagcctggcaag

SEQ ID NO: 1369950 - DNA, 21 bp, Homo sapiens
atgagctcgcatttgtcaatg

SEQ ID NO: 1369951 - DNA, 21 bp, Homo sapiens
atgaggaactgtagatgatgt

SEQ ID NO: 1369952 - DNA, 14 bp, Homo sapiens
atgaggaggggagg

SEQ ID NO: 1369953 - DNA, 17 bp, Homo sapiens
atgaggaggggagggta

SEQ ID NO: 1369954 - DNA, 14 bp, Homo sapiens
atgaggagggtggg

SEQ ID NO: 1369955 - DNA, 14 bp, Homo sapiens
atgaggtgggaggt

SEQ ID NO: 1369956 - DNA, 22 bp, Homo sapiens
atgaggtgggaggtggaagaag

SEQ ID NO: 1369957 - DNA, 13 bp, Homo sapiens
atgagtagccagg

SEQ ID NO: 1369958 - DNA, 22 bp, Homo sapiens
atgagtcactatgggatgagaa

SEQ ID NO: 1369959 - DNA, 14 bp, Homo sapiens
atgatggttcacgt

SEQ ID NO: 1369960 - DNA, 14 bp, Homo sapiens
atgattaaaaatat

SEQ ID NO: 1369961 - DNA, 17 bp, Homo sapiens
atgattaaaaatatcaa

SEQ ID NO: 1369962 - DNA, 19 bp, Homo sapiens
atgattaaccacttcagct

SEQ ID NO: 1369963 - DNA, 20 bp, Homo sapiens
atgattaaccacttcagctg

SEQ ID NO: 1369964 - DNA, 21 bp, Homo sapiens
atgattaaccacttcagctga

SEQ ID NO: 1369965 - DNA, 14 bp, Homo sapiens
atgattagcaagtt

SEQ ID NO: 1369966 - DNA, 23 bp, Homo sapiens
atgattagcaagttacagtgatg

SEQ ID NO: 1369967 - DNA, 17 bp, Homo sapiens
atgcaaaaactctttga

SEQ ID NO: 1369968 - DNA, 17 bp, Homo sapiens
atgcaaaatatgtttaa

SEQ ID NO: 1369969 - DNA, 21 bp, Homo sapiens
atgcaaatgagctctgaaatc

SEQ ID NO: 1369970 - DNA, 21 bp, Homo sapiens
atgcaaccaagtcacacgctt

SEQ ID NO: 1369971 - DNA, 23 bp, Homo sapiens
atgcaagcagaggaccagggcct

SEQ ID NO: 1369972 - DNA, 14 bp, Homo sapiens
atgcaataaaattt

SEQ ID NO: 1369973 - DNA, 19 bp, Homo sapiens
atgcacttaaagaagtatt

SEQ ID NO: 1369974 - DNA, 16 bp, Homo sapiens
atgcaggctcccctga

SEQ ID NO: 1369975 - DNA, 20 bp, Homo sapiens
atgcagttagctgaagaatt

SEQ ID NO: 1369976 - DNA, 17 bp, Homo sapiens
atgcatcatttcaggag

SEQ ID NO: 1369977 - DNA, 12 bp, Homo sapiens
atgcatctttga

SEQ ID NO: 1369978 - DNA, 18 bp, Homo sapiens
atgccacatcaaaccttt

SEQ ID NO: 1369979 - DNA, 14 bp, Homo sapiens
atgccaccctagcc

SEQ ID NO: 1369980 - DNA, 15 bp, Homo sapiens
atgccactgccttcg

SEQ ID NO: 1369981 - DNA, 18 bp, Homo sapiens
atgccactgccttcgctt

SEQ ID NO: 1369982 - DNA, 12 bp, Homo sapiens
atgccacttcct

SEQ ID NO: 1369983 - DNA, 15 bp, Homo sapiens
atgcccaccccctgc

SEQ ID NO: 1369984 - DNA, 21 bp, Homo sapiens
atgcctcactaatttttgtat

SEQ ID NO: 1369985 - DNA, 13 bp, Homo sapiens
atgcgccccctcc

SEQ ID NO: 1369986 - DNA, 18 bp, Homo sapiens
atgcgccccctccgccct

SEQ ID NO: 1369987 - DNA, 19 bp, Homo sapiens
atgctaccccactatgaca

SEQ ID NO: 1369988 - DNA, 12 bp, Homo sapiens
atgctatttctg

SEQ ID NO: 1369989 - DNA, 14 bp, Homo sapiens
atgctcaaagaaat

SEQ ID NO: 1369990 - DNA, 15 bp, Homo sapiens
atgctcaaagaaatc

SEQ ID NO: 1369991 - DNA, 16 bp, Homo sapiens
atgctcaaagaaatct

SEQ ID NO: 1369992 - DNA, 17 bp, Homo sapiens
atgctcaaagaaatcta

SEQ ID NO: 1369993 - DNA, 13 bp, Homo sapiens
atgctcatctgct

SEQ ID NO: 1369994 - DNA, 14 bp, Homo sapiens
atgctcatctgctg

SEQ ID NO: 1369995 - DNA, 16 bp, Homo sapiens
atgctcatctgctggt

SEQ ID NO: 1369996 - DNA, 21 bp, Homo sapiens
atgctccagcaacacagcctg

SEQ ID NO: 1369997 - DNA, 14 bp, Homo sapiens
atgctccccacagc

SEQ ID NO: 1369998 - DNA, 18 bp, Homo sapiens
atgctgaggcctgggccg

SEQ ID NO: 1369999 - DNA, 16 bp, Homo sapiens
atgctgggactcagcc

SEQ ID NO: 1370000 - DNA, 17 bp, Homo sapiens
atgctgtgctatgaatt

SEQ ID NO: 1370001 - DNA, 23 bp, Homo sapiens
atgctgtgtatatggtatatata

SEQ ID NO: 1370002 - DNA, 14 bp, Homo sapiens
atgcttcttctcaa

SEQ ID NO: 1370003 - DNA, 22 bp, Homo sapiens
atgctttattaatgttttcaaa

SEQ ID NO: 1370004 - DNA, 18 bp, Homo sapiens
atgctttatttgtaaatt

SEQ ID NO: 1370005 - DNA, 23 bp, Homo sapiens
atggaaagcagagttttcattaa

SEQ ID NO: 1370006 - DNA, 19 bp, Homo sapiens
atggaaatcagccaagttt

SEQ ID NO: 1370007 - DNA, 20 bp, Homo sapiens
atggaagaggaaaaggctgg

SEQ ID NO: 1370008 - DNA, 15 bp, Homo sapiens
atggaagttttccta

SEQ ID NO: 1370009 - DNA, 13 bp, Homo sapiens
atggaataaaagg

SEQ ID NO: 1370010 - DNA, 13 bp, Homo sapiens
atggactatctgt

SEQ ID NO: 1370011 - DNA, 21 bp, Homo sapiens
atggactatctgtctggtggc

SEQ ID NO: 1370012 - DNA, 22 bp, Homo sapiens
atggactatctgtctggtggcc

SEQ ID NO: 1370013 - DNA, 15 bp, Homo sapiens
atggagccagctccc

SEQ ID NO: 1370014 - DNA, 18 bp, Homo sapiens
atggagccagctccctct

SEQ ID NO: 1370015 - DNA, 18 bp, Homo sapiens
atggaggaagaactgaaa

SEQ ID NO: 1370016 - DNA, 20 bp, Homo sapiens
atggaggaagaactgaaagg

SEQ ID NO: 1370017 - DNA, 16 bp, Homo sapiens
tagccctcccactttg

SEQ ID NO: 1370018 - DNA, 13 bp, Homo sapiens
tagcctgatgaga

SEQ ID NO: 1370019 - DNA, 17 bp, Homo sapiens
tagcgatctctcctggc

SEQ ID NO: 1370020 - DNA, 13 bp, Homo sapiens
tagctcctgtggc

SEQ ID NO: 1370021 - DNA, 14 bp, Homo sapiens
tagctcctgtggcc

SEQ ID NO: 1370022 - DNA, 16 bp, Homo sapiens
tagctcctgtggcccc

SEQ ID NO: 1370023 - DNA, 20 bp, Homo sapiens
tagctcctgtggccccaccc

SEQ ID NO: 1370024 - DNA, 17 bp, Homo sapiens
tagctgaagaattgaaa

SEQ ID NO: 1370025 - DNA, 22 bp, Homo sapiens
tagctgaagaattgaaaagttt

SEQ ID NO: 1370026 - DNA, 16 bp, Homo sapiens
tagcttctgcttttct

SEQ ID NO: 1370027 - DNA, 17 bp, Homo sapiens
tagcttgcagaactgta

SEQ ID NO: 1370028 - DNA, 13 bp, Homo sapiens
taggaaacaagtg

SEQ ID NO: 1370029 - DNA, 20 bp, Homo sapiens
taggaagtcaatatgtggaa

SEQ ID NO: 1370030 - DNA, 17 bp, Homo sapiens
taggaatcattcagaaa

SEQ ID NO: 1370031 - DNA, 18 bp, Homo sapiens
taggaccaagcatcttgg

SEQ ID NO: 1370032 - DNA, 22 bp, Homo sapiens
taggaccaagcatcttgggggg

SEQ ID NO: 1370033 - DNA, 19 bp, Homo sapiens
taggacctttccaccacag

SEQ ID NO: 1370034 - DNA, 17 bp, Homo sapiens
taggagaaccaaatctg

SEQ ID NO: 1370035 - DNA, 23 bp, Homo sapiens
taggagacttgccagagccgggc

SEQ ID NO: 1370036 - DNA, 18 bp, Homo sapiens
taggagctgccttggctc

SEQ ID NO: 1370037 - DNA, 19 bp, Homo sapiens
taggagtggtgatttgaaa

SEQ ID NO: 1370038 - DNA, 19 bp, Homo sapiens
taggatagctaactgtaaa

SEQ ID NO: 1370039 - DNA, 13 bp, Homo sapiens
taggattttcaca

SEQ ID NO: 1370040 - DNA, 22 bp, Homo sapiens
taggattttcacattcttggct

SEQ ID NO: 1370041 - DNA, 13 bp, Homo sapiens
taggatttttaga

SEQ ID NO: 1370042 - DNA, 17 bp, Homo sapiens
taggcaccttttactgt

SEQ ID NO: 1370043 - DNA, 17 bp, Homo sapiens
taggctctgcctgacag

SEQ ID NO: 1370044 - DNA, 15 bp, Homo sapiens
tagggagtattctaa

SEQ ID NO: 1370045 - DNA, 18 bp, Homo sapiens
taggggaaggagaagtaa

SEQ ID NO: 1370046 - DNA, 15 bp, Homo sapiens
taggtcctcagaaag

SEQ ID NO: 1370047 - DNA, 11 bp, Homo sapiens
tagtaagcata

SEQ ID NO: 1370048 - DNA, 15 bp, Homo sapiens
tagtaagcatagaaa

SEQ ID NO: 1370049 - DNA, 18 bp, Homo sapiens
tagtatttatttatgtac

SEQ ID NO: 1370050 - DNA, 18 bp, Homo sapiens
tagtcaccagagacttta

SEQ ID NO: 1370051 - DNA, 11 bp, Homo sapiens
tagtcctgtga

SEQ ID NO: 1370052 - DNA, 13 bp, Homo sapiens
tagtctaagacta

SEQ ID NO: 1370053 - DNA, 17 bp, Homo sapiens
tagtctaagactatata

SEQ ID NO: 1370054 - DNA, 19 bp, Homo sapiens
tagtgatgatggttcacgt

SEQ ID NO: 1370055 - DNA, 21 bp, Homo sapiens
tagtgtacatttctataaata

SEQ ID NO: 1370056 - DNA, 16 bp, Homo sapiens
tagtgttatatgaaca

SEQ ID NO: 1370057 - DNA, 23 bp, Homo sapiens
tagtgtttttttatttctactgt

SEQ ID NO: 1370058 - DNA, 20 bp, Homo sapiens
tagttaaatgttacctctga

SEQ ID NO: 1370059 - DNA, 17 bp, Homo sapiens
tagttactgtgtaaact

SEQ ID NO: 1370060 - DNA, 15 bp, Homo sapiens
tagttatgtaaataa

SEQ ID NO: 1370061 - DNA, 19 bp, Homo sapiens
tagttatgtaaataattct

SEQ ID NO: 1370062 - DNA, 14 bp, Homo sapiens
tagttctgtatttg

SEQ ID NO: 1370063 - DNA, 19 bp, Homo sapiens
tagttctgtatttgaaagt

SEQ ID NO: 1370064 - DNA, 15 bp, Homo sapiens
tagttctttaaactg

SEQ ID NO: 1370065 - DNA, 21 bp, Homo sapiens
tagttgaatacttgaaccata

SEQ ID NO: 1370066 - DNA, 14 bp, Homo sapiens
tagttgcaattgaa

SEQ ID NO: 1370067 - DNA, 13 bp, Homo sapiens
tagtttacagaaa

SEQ ID NO: 1370068 - DNA, 17 bp, Homo sapiens
tagtttattttaaaaca

SEQ ID NO: 1370069 - DNA, 12 bp, Homo sapiens
tagtttctttat

SEQ ID NO: 1370070 - DNA, 22 bp, Homo sapiens
tagtttctttattttgtgtaaa

SEQ ID NO: 1370071 - DNA, 16 bp, Homo sapiens
tagtttggcatttgca

SEQ ID NO: 1370072 - DNA, 21 bp, Homo sapiens
tagttttatttatatttattg

SEQ ID NO: 1370073 - DNA, 21 bp, Homo sapiens
tataaaacagagtaatcttgt

SEQ ID NO: 1370074 - DNA, 18 bp, Homo sapiens
tataaaatataaacaaag

SEQ ID NO: 1370075 - DNA, 16 bp, Homo sapiens
tataaacagaaatgga

SEQ ID NO: 1370076 - DNA, 14 bp, Homo sapiens
tataaatccagtga

SEQ ID NO: 1370077 - DNA, 13 bp, Homo sapiens
tataacacatttt

SEQ ID NO: 1370078 - DNA, 23 bp, Homo sapiens
tataacacatttttttgcatgca

SEQ ID NO: 1370079 - DNA, 19 bp, Homo sapiens
tataacatatatggaagag

SEQ ID NO: 1370080 - DNA, 23 bp, Homo sapiens
tataactgtatttgaaataagaa

SEQ ID NO: 1370081 - DNA, 17 bp, Homo sapiens
tataatagcaacttttg

SEQ ID NO: 1370082 - DNA, 22 bp, Homo sapiens
tataatataaaaaattttaaaa

SEQ ID NO: 1370083 - DNA, 16 bp, Homo sapiens
tataatgaataaatca

SEQ ID NO: 1370084 - DNA, 22 bp, Homo sapiens
tatacaaacctaccaaaatgga

SEQ ID NO: 1370085 - DNA, 22 bp, Homo sapiens
tatacagtatagatttttgggt

SEQ ID NO: 1370086 - DNA, 15 bp, Homo sapiens
tatacatgtgataca

SEQ ID NO: 1370087 - DNA, 20 bp, Homo sapiens
tatactgaaggaaaaacaca

SEQ ID NO: 1370088 - DNA, 15 bp, Homo sapiens
tatagcatcacttaa

SEQ ID NO: 1370089 - DNA, 16 bp, Homo sapiens
tatagcatgaaataaa

SEQ ID NO: 1370090 - DNA, 21 bp, Homo sapiens
tatagcctatggcagaaaaaa

SEQ ID NO: 1370091 - DNA, 21 bp, Homo sapiens
tatagctgagactacaagtgt

SEQ ID NO: 1370092 - DNA, 13 bp, Homo sapiens
tataggctatttt

SEQ ID NO: 1370093 - DNA, 16 bp, Homo sapiens
tatagtctaagactat

SEQ ID NO: 1370094 - DNA, 20 bp, Homo sapiens
tatagtctaagactatatat

SEQ ID NO: 1370095 - DNA, 16 bp, Homo sapiens
tatagttatgtaaata

SEQ ID NO: 1370096 - DNA, 14 bp, Homo sapiens
tatataacatatat

SEQ ID NO: 1370097 - DNA, 18 bp, Homo sapiens
tatataacatatatggaa

SEQ ID NO: 1370098 - DNA, 23 bp, Homo sapiens
tatataggctattttctaaagac

SEQ ID NO: 1370099 - DNA, 13 bp, Homo sapiens
tatatataaaacg

SEQ ID NO: 1370100 - DNA, 13 bp, Homo sapiens
tatatataaatgt

SEQ ID NO: 1370101 - DNA, 15 bp, Homo sapiens
tatatataaatgtat

SEQ ID NO: 1370102 - DNA, 16 bp, Homo sapiens
tatatataacatatat

SEQ ID NO: 1370103 - DNA, 13 bp, Homo sapiens
tatatatatataa

SEQ ID NO: 1370104 - DNA, 20 bp, Homo sapiens
tatatatctatctatttgag

SEQ ID NO: 1370105 - DNA, 17 bp, Homo sapiens
tatatcctgtgactgtc

SEQ ID NO: 1370106 - DNA, 14 bp, Homo sapiens
tatatctatctatt

SEQ ID NO: 1370107 - DNA, 14 bp, Homo sapiens
tatatctctatttg

SEQ ID NO: 1370108 - DNA, 15 bp, Homo sapiens
tatatctctatttga

SEQ ID NO: 1370109 - DNA, 13 bp, Homo sapiens
tatatctgcaaaa

SEQ ID NO: 1370110 - DNA, 13 bp, Homo sapiens
tatatctggcctc

SEQ ID NO: 1370111 - DNA, 18 bp, Homo sapiens
tatatgctttattaatgt

SEQ ID NO: 1370112 - DNA, 17 bp, Homo sapiens
tatatggaagaggaaaa

SEQ ID NO: 1370113 - DNA, 14 bp, Homo sapiens
tatatgtactgttt

SEQ ID NO: 1370114 - DNA, 16 bp, Homo sapiens
tatatgtatgtgttta

SEQ ID NO: 1370115 - DNA, 12 bp, Homo sapiens
tatattctttca

SEQ ID NO: 1370116 - DNA, 22 bp, Homo sapiens
tatattgaacttttgtactgaa

SEQ ID NO: 1370117 - DNA, 23 bp, Homo sapiens
tatattggttttatgatgacgta

SEQ ID NO: 1370118 - DNA, 11 bp, Homo sapiens
tatatttcctt

SEQ ID NO: 1370119 - DNA, 22 bp, Homo sapiens
tatatttgatttattaacttaa

SEQ ID NO: 1370120 - DNA, 13 bp, Homo sapiens
tatattttgtcat

SEQ ID NO: 1370121 - DNA, 14 bp, Homo sapiens
tatcaaaatagtct

SEQ ID NO: 1370122 - DNA, 20 bp, Homo sapiens
tatcaaagtcattaaagaca

SEQ ID NO: 1370123 - DNA, 15 bp, Homo sapiens
tatcaaattaattgt

SEQ ID NO: 1370124 - DNA, 19 bp, Homo sapiens
tatcaaattaattgtgtga

SEQ ID NO: 1370125 - DNA, 20 bp, Homo sapiens
tatcaaattaattgtgtgaa

SEQ ID NO: 1370126 - DNA, 9 bp, Homo sapiens
tatcagtag

SEQ ID NO: 1370127 - DNA, 16 bp, Homo sapiens
gagccggccccaggct

SEQ ID NO: 1370128 - DNA, 15 bp, Homo sapiens
gagccgggcccctgg

SEQ ID NO: 1370129 - DNA, 16 bp, Homo sapiens
gagccgggcccctggg

SEQ ID NO: 1370130 - DNA, 13 bp, Homo sapiens
gagcctgcaggga

SEQ ID NO: 1370131 - DNA, 19 bp, Homo sapiens
tatcatatatttaatctta

SEQ ID NO: 1370132 - DNA, 13 bp, Homo sapiens
tatcatgcaaaat

SEQ ID NO: 1370133 - DNA, 14 bp, Homo sapiens
tatcatgcaaaata

SEQ ID NO: 1370134 - DNA, 12 bp, Homo sapiens
tatcatgtatgg

SEQ ID NO: 1370135 - DNA, 13 bp, Homo sapiens
tatcattcaagtg

SEQ ID NO: 1370136 - DNA, 16 bp, Homo sapiens
tatccacatgaaaata

SEQ ID NO: 1370137 - DNA, 18 bp, Homo sapiens
tatccacatgaaaataaa

SEQ ID NO: 1370138 - DNA, 16 bp, Homo sapiens
tatcccacatccaact

SEQ ID NO: 1370139 - DNA, 18 bp, Homo sapiens
tccagggaatccaagcct

SEQ ID NO: 1370140 - DNA, 22 bp, Homo sapiens
tccagggaggggccggccctgt

SEQ ID NO: 1370141 - DNA, 21 bp, Homo sapiens
tccaggggctgcttcctcctg

SEQ ID NO: 1370142 - DNA, 22 bp, Homo sapiens
tccaggggctgcttcctcctgg

SEQ ID NO: 1370143 - DNA, 14 bp, Homo sapiens
tccaggtgcagagg

SEQ ID NO: 1370144 - DNA, 15 bp, Homo sapiens
tccaggtgcagaggt

SEQ ID NO: 1370145 - DNA, 20 bp, Homo sapiens
tccagtaagatcactgttta

SEQ ID NO: 1370146 - DNA, 14 bp, Homo sapiens
tccagtataaccag

SEQ ID NO: 1370147 - DNA, 17 bp, Homo sapiens
tccagtgacctctctct

SEQ ID NO: 1370148 - DNA, 23 bp, Homo sapiens
tccagtgtctataaaagaaacac

SEQ ID NO: 1370149 - DNA, 18 bp, Homo sapiens
tccagtgtgggcttgacc

SEQ ID NO: 1370150 - DNA, 19 bp, Homo sapiens
tccagtgtgggcttgacca

SEQ ID NO: 1370151 - DNA, 21 bp, Homo sapiens
tccagttcatcgattttctat

SEQ ID NO: 1370152 - DNA, 13 bp, Homo sapiens
tccataaacatga

SEQ ID NO: 1370153 - DNA, 12 bp, Homo sapiens
tccatccctcta

SEQ ID NO: 1370154 - DNA, 23 bp, Homo sapiens
tccatccctctaatgagactgac

SEQ ID NO: 1370155 - DNA, 15 bp, Homo sapiens
tccatgaaggcagag

SEQ ID NO: 1370156 - DNA, 15 bp, Homo sapiens
tccatgcgctcaggg

SEQ ID NO: 1370157 - DNA, 16 bp, Homo sapiens
tccatgcgctcagggc

SEQ ID NO: 1370158 - DNA, 15 bp, Homo sapiens
tccatttccattgct

SEQ ID NO: 1370159 - DNA, 14 bp, Homo sapiens
tccatttcccctct

SEQ ID NO: 1370160 - DNA, 13 bp, Homo sapiens
tccatttgagaaa

SEQ ID NO: 1370161 - DNA, 14 bp, Homo sapiens
tcccaaaaaactac

SEQ ID NO: 1370162 - DNA, 20 bp, Homo sapiens
tcccaaaccacgcctcttga

SEQ ID NO: 1370163 - DNA, 17 bp, Homo sapiens
tcccacacccaaagctg

SEQ ID NO: 1370164 - DNA, 13 bp, Homo sapiens
tcccacaccccaa

SEQ ID NO: 1370165 - DNA, 22 bp, Homo sapiens
tcccacatccaactccagcaac

SEQ ID NO: 1370166 - DNA, 23 bp, Homo sapiens
tcccacatccaactccagcaact

SEQ ID NO: 1370167 - DNA, 12 bp, Homo sapiens
tcccacccccag

SEQ ID NO: 1370168 - DNA, 13 bp, Homo sapiens
tcccacccccagc

SEQ ID NO: 1370169 - DNA, 15 bp, Homo sapiens
tcccacccccagccc

SEQ ID NO: 1370170 - DNA, 15 bp, Homo sapiens
tcccacttctgccag

SEQ ID NO: 1370171 - DNA, 18 bp, Homo sapiens
tcccagcactttgggagg

SEQ ID NO: 1370172 - DNA, 18 bp, Homo sapiens
tcccaggagcctgcccag

SEQ ID NO: 1370173 - DNA, 18 bp, Homo sapiens
tcccaggggtctccctgg

SEQ ID NO: 1370174 - DNA, 21 bp, Homo sapiens
tcccaggggtctccctggctc

SEQ ID NO: 1370175 - DNA, 22 bp, Homo sapiens
tcccaggggtctccctggctcc

SEQ ID NO: 1370176 - DNA, 21 bp, Homo sapiens
tcccaggtaccagctgcgctt

SEQ ID NO: 1370177 - DNA, 16 bp, Homo sapiens
tcccatagtccctgcc

SEQ ID NO: 1370178 - DNA, 16 bp, Homo sapiens
tcccatttgtgccaga

SEQ ID NO: 1370179 - DNA, 18 bp, Homo sapiens
tccccaaatcaatacact

SEQ ID NO: 1370180 - DNA, 18 bp, Homo sapiens
tccccacagcgtccctgg

SEQ ID NO: 1370181 - DNA, 14 bp, Homo sapiens
tccccacccctgcc

SEQ ID NO: 1370182 - DNA, 16 bp, Homo sapiens
tccccacccctgcccc

SEQ ID NO: 1370183 - DNA, 22 bp, Homo sapiens
tccccacccctgcccccagccc

SEQ ID NO: 1370184 - DNA, 12 bp, Homo sapiens
tccccaccctga

SEQ ID NO: 1370185 - DNA, 14 bp, Homo sapiens
tccccacctccagg

SEQ ID NO: 1370186 - DNA, 14 bp, Homo sapiens
tccccagcctgcgc

SEQ ID NO: 1370187 - DNA, 17 bp, Homo sapiens
tccccagcctgcgcctg

SEQ ID NO: 1370188 - DNA, 23 bp, Homo sapiens
tccccaggtccagctctggaggg

SEQ ID NO: 1370189 - DNA, 15 bp, Homo sapiens
tccccatctccctgc

SEQ ID NO: 1370190 - DNA, 19 bp, Homo sapiens
tccccatctccctgcctgg

SEQ ID NO: 1370191 - DNA, 22 bp, Homo sapiens
tccccatctccctgcctggccc

SEQ ID NO: 1370192 - DNA, 13 bp, Homo sapiens
tccccatggagcc

SEQ ID NO: 1370193 - DNA, 15 bp, Homo sapiens
tccccatggagccag

SEQ ID NO: 1370194 - DNA, 16 bp, Homo sapiens
tccccatggagccagc

SEQ ID NO: 1370195 - DNA, 16 bp, Homo sapiens
tccccatttcccatct

SEQ ID NO: 1370196 - DNA, 17 bp, Homo sapiens
tccccatttcccatctg

SEQ ID NO: 1370197 - DNA, 20 bp, Homo sapiens
tccccatttcccatctgcac

SEQ ID NO: 1370198 - DNA, 20 bp, Homo sapiens
tcccccacctcggtcactcc

SEQ ID NO: 1370199 - DNA, 20 bp, Homo sapiens
tcccccagccatgccagctg

SEQ ID NO: 1370200 - DNA, 18 bp, Homo sapiens
tccccccccaacctttcc

SEQ ID NO: 1370201 - DNA, 15 bp, Homo sapiens
tccccgcctggccag

SEQ ID NO: 1370202 - DNA, 17 bp, Homo sapiens
tccccgcctggccagga

SEQ ID NO: 1370203 - DNA, 15 bp, Homo sapiens
tccccgctgctgtgc

SEQ ID NO: 1370204 - DNA, 17 bp, Homo sapiens
tccccgctgctgtgcaa

SEQ ID NO: 1370205 - DNA, 15 bp, Homo sapiens
tccccggagggctgc

SEQ ID NO: 1370206 - DNA, 16 bp, Homo sapiens
tcccgttttccccatg

SEQ ID NO: 1370207 - DNA, 19 bp, Homo sapiens
tcccgttttccccatgaca

SEQ ID NO: 1370208 - DNA, 23 bp, Homo sapiens
tccctaatctatggtcgggagac

SEQ ID NO: 1370209 - DNA, 15 bp, Homo sapiens
tccctagcagcccac

SEQ ID NO: 1370210 - DNA, 22 bp, Homo sapiens
tccctagctttagaccctgggt

SEQ ID NO: 1370211 - DNA, 16 bp, Homo sapiens
tccctattagagaaga

SEQ ID NO: 1370212 - DNA, 18 bp, Homo sapiens
tccctattagagaagaga

SEQ ID NO: 1370213 - DNA, 12 bp, Homo sapiens
tccctcaccccc

SEQ ID NO: 1370214 - DNA, 15 bp, Homo sapiens
tccctcaccccctcc

SEQ ID NO: 1370215 - DNA, 20 bp, Homo sapiens
tccctcaccccctcccaccc

SEQ ID NO: 1370216 - DNA, 11 bp, Homo sapiens
tccctccaccc

SEQ ID NO: 1370217 - DNA, 14 bp, Homo sapiens
tccctccaccccag

SEQ ID NO: 1370218 - DNA, 15 bp, Homo sapiens
tccctccaccccagg

SEQ ID NO: 1370219 - DNA, 17 bp, Homo sapiens
tccctccaccccaggac

SEQ ID NO: 1370220 - DNA, 13 bp, Homo sapiens
tccctctatttat

SEQ ID NO: 1370221 - DNA, 15 bp, Homo sapiens
tccctctgcccctcc

SEQ ID NO: 1370222 - DNA, 22 bp, Homo sapiens
tccctgcagatgccaccctagc

SEQ ID NO: 1370223 - DNA, 23 bp, Homo sapiens
tccctgcagatgccaccctagcc

SEQ ID NO: 1370224 - DNA, 12 bp, Homo sapiens
tccctgcctggc

SEQ ID NO: 1370225 - DNA, 15 bp, Homo sapiens
tccctgcgcctttcc

SEQ ID NO: 1370226 - DNA, 12 bp, Homo sapiens
tccctggctccc

SEQ ID NO: 1370227 - DNA, 17 bp, Homo sapiens
tccctggctccctcctc

SEQ ID NO: 1370228 - DNA, 17 bp, Homo sapiens
tcccttaacagttgtat

SEQ ID NO: 1370229 - DNA, 17 bp, Homo sapiens
tcccttccagatggtca

SEQ ID NO: 1370230 - DNA, 17 bp, Homo sapiens
tcccttccttttccctg

SEQ ID NO: 1370231 - DNA, 20 bp, Homo sapiens
tcccttgaaactttgggaaa

SEQ ID NO: 1370232 - DNA, 15 bp, Homo sapiens
tcccttgagggctgc

SEQ ID NO: 1370233 - DNA, 17 bp, Homo sapiens
tcccttgagggctgcag

SEQ ID NO: 1370234 - DNA, 23 bp, Homo sapiens
tcccttgctggccccagccctgc

SEQ ID NO: 1370235 - DNA, 14 bp, Homo sapiens
tcccttgcttgcct

SEQ ID NO: 1370236 - DNA, 21 bp, Homo sapiens
tcccttgcttgcctgcagggc

SEQ ID NO: 1370237 - DNA, 22 bp, Homo sapiens
tccctttccaaatgcccagctt

SEQ ID NO: 1370238 - DNA, 20 bp, Homo sapiens
tccctttttcataaattatt

SEQ ID NO: 1370239 - DNA, 15 bp, Homo sapiens
tccgactgctttgga

SEQ ID NO: 1370240 - DNA, 12 bp, Homo sapiens
tccgcaggactt

SEQ ID NO: 1370241 - DNA, 13 bp, Homo sapiens
tccgccagcctcc

SEQ ID NO: 1370242 - DNA, 14 bp, Homo sapiens
tccgccctgccact

SEQ ID NO: 1370243 - DNA, 19 bp, Homo sapiens
tccgcgtgtgcctgtgtgc

SEQ ID NO: 1370244 - DNA, 19 bp, Homo sapiens
tccgctgccagccttgagc

SEQ ID NO: 1370245 - DNA, 19 bp, Homo sapiens
tccggaaactagtgtacat

SEQ ID NO: 1370246 - DNA, 18 bp, Homo sapiens
tccggctcccagcctcag

SEQ ID NO: 1370247 - DNA, 21 bp, Homo sapiens
tccggctcccagcctcagcgc

SEQ ID NO: 1370248 - DNA, 18 bp, Homo sapiens
tccgtgaaaacggagctg

SEQ ID NO: 1370249 - DNA, 18 bp, Homo sapiens
tcctaaagagagtatttt

SEQ ID NO: 1370250 - DNA, 19 bp, Homo sapiens
tcctacacttgagagaaaa

SEQ ID NO: 1370251 - DNA, 14 bp, Homo sapiens
tcctacccttttct

SEQ ID NO: 1370252 - DNA, 16 bp, Homo sapiens
tcctagaaattcccca

SEQ ID NO: 1370253 - DNA, 20 bp, Homo sapiens
tcctagaggccctttgctgt

SEQ ID NO: 1370254 - DNA, 21 bp, Homo sapiens
tcctagaggccctttgctgtc

SEQ ID NO: 1370255 - DNA, 21 bp, Homo sapiens
tcctagcttgggaggcttccc

SEQ ID NO: 1370256 - DNA, 14 bp, Homo sapiens
tcctaggcatttgc

SEQ ID NO: 1370257 - DNA, 15 bp, Homo sapiens
tcctatatatttcta

SEQ ID NO: 1370258 - DNA, 16 bp, Homo sapiens
tcctatatatttctat

SEQ ID NO: 1370259 - DNA, 17 bp, Homo sapiens
tcctatatatttctatt

SEQ ID NO: 1370260 - DNA, 17 bp, Homo sapiens
gttactgggccctgagt

SEQ ID NO: 1370261 - DNA, 13 bp, Homo sapiens
gttagacagccaa

SEQ ID NO: 1370262 - DNA, 15 bp, Homo sapiens
gttagctcctgtggc

SEQ ID NO: 1370263 - DNA, 13 bp, Homo sapiens
gttagtggcaccg

SEQ ID NO: 1370264 - DNA, 16 bp, Homo sapiens
gttagtttgtatatat

SEQ ID NO: 1370265 - DNA, 17 bp, Homo sapiens
gttagtttgtatatatt

SEQ ID NO: 1370266 - DNA, 23 bp, Homo sapiens
gttataattttttttaaaataga

SEQ ID NO: 1370267 - DNA, 15 bp, Homo sapiens
gttatgtaaataatt

SEQ ID NO: 1370268 - DNA, 22 bp, Homo sapiens
gttattatctgggcttatatct

SEQ ID NO: 1370269 - DNA, 22 bp, Homo sapiens
gttattcaacagcaagtgtgaa

SEQ ID NO: 1370270 - DNA, 16 bp, Homo sapiens
gttattgcagtttatc

SEQ ID NO: 1370271 - DNA, 23 bp, Homo sapiens
gttattgcagtttatcattcaag

SEQ ID NO: 1370272 - DNA, 12 bp, Homo sapiens
gttattttctac

SEQ ID NO: 1370273 - DNA, 18 bp, Homo sapiens
gttcaaggtcactgtttc

SEQ ID NO: 1370274 - DNA, 21 bp, Homo sapiens
gttcaaggtcactgtttcctg

SEQ ID NO: 1370275 - DNA, 18 bp, Homo sapiens
gttcagtattatgtagtt

SEQ ID NO: 1370276 - DNA, 21 bp, Homo sapiens
gttcatcatccagatgtggct

SEQ ID NO: 1370277 - DNA, 15 bp, Homo sapiens
gttcattcttcagat

SEQ ID NO: 1370278 - DNA, 15 bp, Homo sapiens
gttccaccccaagag

SEQ ID NO: 1370279 - DNA, 21 bp, Homo sapiens
gttccagggtccctctgtgta

SEQ ID NO: 1370280 - DNA, 21 bp, Homo sapiens
gttcccttgaaactttgggaa

SEQ ID NO: 1370281 - DNA, 22 bp, Homo sapiens
gttcctcattagcattttgcta

SEQ ID NO: 1370282 - DNA, 13 bp, Homo sapiens
gttcctctgcctg

SEQ ID NO: 1370283 - DNA, 23 bp, Homo sapiens
gttcctctgctcaccgcccatca

SEQ ID NO: 1370284 - DNA, 17 bp, Homo sapiens
gttcctgtccctgcgcc

SEQ ID NO: 1370285 - DNA, 22 bp, Homo sapiens
gttctaacagtgaagttttact

SEQ ID NO: 1370286 - DNA, 23 bp, Homo sapiens
gttctcagaatcccttaacagtt

SEQ ID NO: 1370287 - DNA, 18 bp, Homo sapiens
gttctccgttagctcctg

SEQ ID NO: 1370288 - DNA, 15 bp, Homo sapiens
gttctctcttctcca

SEQ ID NO: 1370289 - DNA, 20 bp, Homo sapiens
gttctggggggacccagtgc

SEQ ID NO: 1370290 - DNA, 18 bp, Homo sapiens
gttctgtggttcctctgc

SEQ ID NO: 1370291 - DNA, 20 bp, Homo sapiens
gttcttggcaataaattttg

SEQ ID NO: 1370292 - DNA, 21 bp, Homo sapiens
gttcttggcaataaattttga

SEQ ID NO: 1370293 - DNA, 14 bp, Homo sapiens
gttctttaaactgt

SEQ ID NO: 1370294 - DNA, 14 bp, Homo sapiens
gttgacaactgtga

SEQ ID NO: 1370295 - DNA, 16 bp, Homo sapiens
gttgacaactgtgact

SEQ ID NO: 1370296 - DNA, 14 bp, Homo sapiens
gttgagcaagcagt

SEQ ID NO: 1370297 - DNA, 12 bp, Homo sapiens
gttgagctatga

SEQ ID NO: 1370298 - DNA, 15 bp, Homo sapiens
gttgagctatgactt

SEQ ID NO: 1370299 - DNA, 15 bp, Homo sapiens
gttgagtctgtacta

SEQ ID NO: 1370300 - DNA, 12 bp, Homo sapiens
gttgataaatcc

SEQ ID NO: 1370301 - DNA, 23 bp, Homo sapiens
gttgattcggtatccccccatct

SEQ ID NO: 1370302 - DNA, 14 bp, Homo sapiens
gttgcaagatgtga

SEQ ID NO: 1370303 - DNA, 17 bp, Homo sapiens
gttgcaagatgtgaatt

SEQ ID NO: 1370304 - DNA, 15 bp, Homo sapiens
gttgccaagctccaa

SEQ ID NO: 1370305 - DNA, 19 bp, Homo sapiens
gttgccacagtagaactgt

SEQ ID NO: 1370306 - DNA, 13 bp, Homo sapiens
gttgcgggacaga

SEQ ID NO: 1370307 - DNA, 17 bp, Homo sapiens
gttgctatttttgtaaa

SEQ ID NO: 1370308 - DNA, 12 bp, Homo sapiens
gttgctggtaaa

SEQ ID NO: 1370309 - DNA, 16 bp, Homo sapiens
gttgctggtaaaatga

SEQ ID NO: 1370310 - DNA, 23 bp, Homo sapiens
gttgggaatgaggaaaattctta

SEQ ID NO: 1370311 - DNA, 15 bp, Homo sapiens
gttgtacttaaatgg

SEQ ID NO: 1370312 - DNA, 12 bp, Homo sapiens
gttgtcagctga

SEQ ID NO: 1370313 - DNA, 16 bp, Homo sapiens
gttgtctggcaaggac

SEQ ID NO: 1370314 - DNA, 19 bp, Homo sapiens
gttgttcttggcaataaat

SEQ ID NO: 1370315 - DNA, 15 bp, Homo sapiens
gttgtttataataaa

SEQ ID NO: 1370316 - DNA, 18 bp, Homo sapiens
gttgtttataataaaaat

SEQ ID NO: 1370317 - DNA, 14 bp, Homo sapiens
gttgtttttgtata

SEQ ID NO: 1370318 - DNA, 21 bp, Homo sapiens
gtttaaaatgtaatttaaatg

SEQ ID NO: 1370319 - DNA, 15 bp, Homo sapiens
gtttaatattgagaa

SEQ ID NO: 1370320 - DNA, 16 bp, Homo sapiens
cctccaccaccctttc

SEQ ID NO: 1370321 - DNA, 21 bp, Homo sapiens
cctccagaactcactggggcc

SEQ ID NO: 1370322 - DNA, 22 bp, Homo sapiens
cctccagaactcactggggcct

SEQ ID NO: 1370323 - DNA, 16 bp, Homo sapiens
cctccaggcctgcctc

SEQ ID NO: 1370324 - DNA, 15 bp, Homo sapiens
cctccaggtgcagag

SEQ ID NO: 1370325 - DNA, 18 bp, Homo sapiens
cctccaggtgcagaggta

SEQ ID NO: 1370326 - DNA, 16 bp, Homo sapiens
cctccatttgagaaaa

SEQ ID NO: 1370327 - DNA, 18 bp, Homo sapiens
cctcccacacccaaagct

SEQ ID NO: 1370328 - DNA, 15 bp, Homo sapiens
cctcccacccccagc

SEQ ID NO: 1370329 - DNA, 19 bp, Homo sapiens
cctcccactttgctgttcc

SEQ ID NO: 1370330 - DNA, 17 bp, Homo sapiens
cctcccaggaagcccag

SEQ ID NO: 1370331 - DNA, 22 bp, Homo sapiens
cctccccagcattccagcccct

SEQ ID NO: 1370332 - DNA, 12 bp, Homo sapiens
cctccccagcct

SEQ ID NO: 1370333 - DNA, 16 bp, Homo sapiens
cctccccagcctgcgc

SEQ ID NO: 1370334 - DNA, 16 bp, Homo sapiens
cctccccatggagcca

SEQ ID NO: 1370335 - DNA, 14 bp, Homo sapiens
cctccccatttccc

SEQ ID NO: 1370336 - DNA, 21 bp, Homo sapiens
cctccccatttcccatctgca

SEQ ID NO: 1370337 - DNA, 22 bp, Homo sapiens
cctccccatttcccatctgcac

SEQ ID NO: 1370338 - DNA, 13 bp, Homo sapiens
cctcccctgccac

SEQ ID NO: 1370339 - DNA, 20 bp, Homo sapiens
cctccctccaccccaggacg

SEQ ID NO: 1370340 - DNA, 22 bp, Homo sapiens
cctcccttccttttccctgctt

SEQ ID NO: 1370341 - DNA, 19 bp, Homo sapiens
cctccgagagggagagaga

SEQ ID NO: 1370342 - DNA, 18 bp, Homo sapiens
cctccgccctgccactca

SEQ ID NO: 1370343 - DNA, 13 bp, Homo sapiens
cctcctcacctca

SEQ ID NO: 1370344 - DNA, 15 bp, Homo sapiens
cctcctcacctcatg

SEQ ID NO: 1370345 - DNA, 22 bp, Homo sapiens
cctcctcacctcatgcccaccc

SEQ ID NO: 1370346 - DNA, 15 bp, Homo sapiens
cctcctccaggcctg

SEQ ID NO: 1370347 - DNA, 19 bp, Homo sapiens
cctcctctcccatccttga

SEQ ID NO: 1370348 - DNA, 20 bp, Homo sapiens
cctcctctggacggcaggct

SEQ ID NO: 1370349 - DNA, 22 bp, Homo sapiens
cctcctgaaccgcacagctcag

SEQ ID NO: 1370350 - DNA, 13 bp, Homo sapiens
cctccttcagaca

SEQ ID NO: 1370351 - DNA, 22 bp, Homo sapiens
cctcgccggaccctctaacctc

SEQ ID NO: 1370352 - DNA, 15 bp, Homo sapiens
cctcggtactcccat

SEQ ID NO: 1370353 - DNA, 16 bp, Homo sapiens
cctcggtgccttcctc

SEQ ID NO: 1370354 - DNA, 14 bp, Homo sapiens
cctcggtgtggaga

SEQ ID NO: 1370355 - DNA, 18 bp, Homo sapiens
cctcggtgtggagaagcg

SEQ ID NO: 1370356 - DNA, 15 bp, Homo sapiens
cctctaatgagactg

SEQ ID NO: 1370357 - DNA, 16 bp, Homo sapiens
cctctagaagccaagg

SEQ ID NO: 1370358 - DNA, 18 bp, Homo sapiens
cctctagaagccaaggga

SEQ ID NO: 1370359 - DNA, 14 bp, Homo sapiens
cctctcagtgccct

SEQ ID NO: 1370360 - DNA, 16 bp, Homo sapiens
cctctccagcctcagc

SEQ ID NO: 1370361 - DNA, 20 bp, Homo sapiens
cctctccagcctcagccccc

SEQ ID NO: 1370362 - DNA, 22 bp, Homo sapiens
cctctccagcctcagccccctg

SEQ ID NO: 1370363 - DNA, 21 bp, Homo sapiens
cctctccccaggtccagctct

SEQ ID NO: 1370364 - DNA, 20 bp, Homo sapiens
cctctcctactcggctctgc

SEQ ID NO: 1370365 - DNA, 15 bp, Homo sapiens
cctctgaacttgcct

SEQ ID NO: 1370366 - DNA, 17 bp, Homo sapiens
cctctgcacaagctgca

SEQ ID NO: 1370367 - DNA, 19 bp, Homo sapiens
cctctgcacaagctgcacc

SEQ ID NO: 1370368 - DNA, 20 bp, Homo sapiens
cctctgcacaagctgcaccc

SEQ ID NO: 1370369 - DNA, 11 bp, Homo sapiens
cctctgcctgc

SEQ ID NO: 1370370 - DNA, 23 bp, Homo sapiens
cctctgcctttgcaccacgggac

SEQ ID NO: 1370371 - DNA, 19 bp, Homo sapiens
cctctgcgtctatcctgtg

SEQ ID NO: 1370372 - DNA, 18 bp, Homo sapiens
cctctgctcaccgcccat

SEQ ID NO: 1370373 - DNA, 22 bp, Homo sapiens
cctctggacggcaggctcactg

SEQ ID NO: 1370374 - DNA, 17 bp, Homo sapiens
cctctggtcgctcctgc

SEQ ID NO: 1370375 - DNA, 20 bp, Homo sapiens
cctctggtcgctcctgccca

SEQ ID NO: 1370376 - DNA, 20 bp, Homo sapiens
cctctgtcttcagcaccctc

SEQ ID NO: 1370377 - DNA, 14 bp, Homo sapiens
cctcttagaaaaac

SEQ ID NO: 1370378 - DNA, 14 bp, Homo sapiens
cctgaaagccctga

SEQ ID NO: 1370379 - DNA, 17 bp, Homo sapiens
ctggctgctgcccccac

SEQ ID NO: 1370380 - DNA, 14 bp, Homo sapiens
ctggcttacactgg

SEQ ID NO: 1370381 - DNA, 21 bp, Homo sapiens
ctggcttcaccatcaatcctg

SEQ ID NO: 1370382 - DNA, 23 bp, Homo sapiens
ctggcttttattaatgcactttc

SEQ ID NO: 1370383 - DNA, 17 bp, Homo sapiens
ctgggagctccactctg

SEQ ID NO: 1370384 - DNA, 21 bp, Homo sapiens
ctgggagctccactctgcttc

SEQ ID NO: 1370385 - DNA, 16 bp, Homo sapiens
ctgggaggagggagag

SEQ ID NO: 1370386 - DNA, 20 bp, Homo sapiens
ctgggaggagggagagggag

SEQ ID NO: 1370387 - DNA, 20 bp, Homo sapiens
ctgggaggccctgagacagg

SEQ ID NO: 1370388 - DNA, 19 bp, Homo sapiens
ctgggaggtcaaggctgca

SEQ ID NO: 1370389 - DNA, 16 bp, Homo sapiens
ctgggcagctgtccct

SEQ ID NO: 1370390 - DNA, 22 bp, Homo sapiens
ctgggccatgtccaaagaggct

SEQ ID NO: 1370391 - DNA, 21 bp, Homo sapiens
ctgggcccgacatggctccgg

SEQ ID NO: 1370392 - DNA, 11 bp, Homo sapiens
ctgggccctgg

SEQ ID NO: 1370393 - DNA, 13 bp, Homo sapiens
ctgggccctgggc

SEQ ID NO: 1370394 - DNA, 21 bp, Homo sapiens
ctgggctcccgggccccacag

SEQ ID NO: 1370395 - DNA, 22 bp, Homo sapiens
ctgggcttatatctggcctctg

SEQ ID NO: 1370396 - DNA, 14 bp, Homo sapiens
ctgggcttggcctg

SEQ ID NO: 1370397 - DNA, 16 bp, Homo sapiens
ctgggcttggcctgct

SEQ ID NO: 1370398 - DNA, 13 bp, Homo sapiens
ctggggaaggaag

SEQ ID NO: 1370399 - DNA, 14 bp, Homo sapiens
ctggggatccccgc

SEQ ID NO: 1370400 - DNA, 20 bp, Homo sapiens
ctggggatccccgcctggcc

SEQ ID NO: 1370401 - DNA, 23 bp, Homo sapiens
ctggggatccccgcctggccagg

SEQ ID NO: 1370402 - DNA, 14 bp, Homo sapiens
ctggggcaggctgg

SEQ ID NO: 1370403 - DNA, 17 bp, Homo sapiens
ctggggcaggctgggcc

SEQ ID NO: 1370404 - DNA, 22 bp, Homo sapiens
ctggggcctagcgatctctcct

SEQ ID NO: 1370405 - DNA, 11 bp, Homo sapiens
ctggggcctcc

SEQ ID NO: 1370406 - DNA, 20 bp, Homo sapiens
ctggggctgaggctgaggca

SEQ ID NO: 1370407 - DNA, 14 bp, Homo sapiens
ctgggggcacagga

SEQ ID NO: 1370408 - DNA, 18 bp, Homo sapiens
ctggggggacccagtgca

SEQ ID NO: 1370409 - DNA, 14 bp, Homo sapiens
ctggggttgagggc

SEQ ID NO: 1370410 - DNA, 17 bp, Homo sapiens
ctgggtaggaaagagga

SEQ ID NO: 1370411 - DNA, 14 bp, Homo sapiens
ctgggtccttcctg

SEQ ID NO: 1370412 - DNA, 15 bp, Homo sapiens
ctgggtccttcctga

SEQ ID NO: 1370413 - DNA, 21 bp, Homo sapiens
ctgggtggcaccagcagcctg

SEQ ID NO: 1370414 - DNA, 14 bp, Homo sapiens
ctgggtgggctctg

SEQ ID NO: 1370415 - DNA, 15 bp, Homo sapiens
ctgggtgggctctgt

SEQ ID NO: 1370416 - DNA, 20 bp, Homo sapiens
ctgggtgtccccgctgctgt

SEQ ID NO: 1370417 - DNA, 13 bp, Homo sapiens
ctggtaaaatgaa

SEQ ID NO: 1370418 - DNA, 22 bp, Homo sapiens
ctggtaaaatgaagaatttaaa

SEQ ID NO: 1370419 - DNA, 18 bp, Homo sapiens
ctggtaggaccaagcatc

SEQ ID NO: 1370420 - DNA, 19 bp, Homo sapiens
ctggtccgtgggacggtgc

SEQ ID NO: 1370421 - DNA, 18 bp, Homo sapiens
ctggtctttgagctccca

SEQ ID NO: 1370422 - DNA, 14 bp, Homo sapiens
ctggtgctgctgct

SEQ ID NO: 1370423 - DNA, 20 bp, Homo sapiens
ctggtggagaactctggctt

SEQ ID NO: 1370424 - DNA, 22 bp, Homo sapiens
ctggttccagggtccctctgtg

SEQ ID NO: 1370425 - DNA, 13 bp, Homo sapiens
ctggttctcaatg

SEQ ID NO: 1370426 - DNA, 12 bp, Homo sapiens
ctggttgcatgg

SEQ ID NO: 1370427 - DNA, 14 bp, Homo sapiens
ctgtaaatatgttt

SEQ ID NO: 1370428 - DNA, 17 bp, Homo sapiens
ctgtaacactcctctgc

SEQ ID NO: 1370429 - DNA, 14 bp, Homo sapiens
ctgtaatcccagca

SEQ ID NO: 1370430 - DNA, 14 bp, Homo sapiens
ctgtaatcccagct

SEQ ID NO: 1370431 - DNA, 19 bp, Homo sapiens
ctgtaatcccagctactcg

SEQ ID NO: 1370432 - DNA, 20 bp, Homo sapiens
ctgtaatcgccctactattc

SEQ ID NO: 1370433 - DNA, 17 bp, Homo sapiens
ctgtactttctatttta

SEQ ID NO: 1370434 - DNA, 15 bp, Homo sapiens
ctgtagagtgggagc

SEQ ID NO: 1370435 - DNA, 20 bp, Homo sapiens
ctgtagatatgtattctttt

SEQ ID NO: 1370436 - DNA, 13 bp, Homo sapiens
ctgtagatgatgt

SEQ ID NO: 1370437 - DNA, 21 bp, Homo sapiens
ctgtagctataatgagcatgt

SEQ ID NO: 1370438 - DNA, 14 bp, Homo sapiens
ctgtagctgccatg

SEQ ID NO: 1370439 - DNA, 22 bp, Homo sapiens
ctgtagtcccagctactcggga

SEQ ID NO: 1370440 - DNA, 16 bp, Homo sapiens
ctgtatatttgtaaag

SEQ ID NO: 1370441 - DNA, 13 bp, Homo sapiens
ctgtatttgaaag

SEQ ID NO: 1370442 - DNA, 14 bp, Homo sapiens
ctgtatttgaaagt

SEQ ID NO: 1370443 - DNA, 16 bp, Homo sapiens
ctgtatttgaaagtgc

SEQ ID NO: 1370444 - DNA, 17 bp, Homo sapiens
ctgtatttgaaagtgcc

SEQ ID NO: 1370445 - DNA, 20 bp, Homo sapiens
ctgtatttgaaagtgccttt

SEQ ID NO: 1370446 - DNA, 19 bp, Homo sapiens
ctgtcaatgggacctgtgg

SEQ ID NO: 1370447 - DNA, 14 bp, Homo sapiens
ctgtccacgcgtgc

SEQ ID NO: 1370448 - DNA, 19 bp, Homo sapiens
ctgtccacgcgtgccgtgg

SEQ ID NO: 1370449 - DNA, 18 bp, Homo sapiens
ctgtccctgcgcctttcc

SEQ ID NO: 1370450 - DNA, 17 bp, Homo sapiens
ctgtcccttgcttgcct

SEQ ID NO: 1370451 - DNA, 23 bp, Homo sapiens
ctgtcccttgcttgcctgcaggg

SEQ ID NO: 1370452 - DNA, 15 bp, Homo sapiens
ctgtccgagctttga

SEQ ID NO: 1370453 - DNA, 14 bp, Homo sapiens
ctgtcctgtcctgc

SEQ ID NO: 1370454 - DNA, 15 bp, Homo sapiens
ctgtctaaagtgtat

SEQ ID NO: 1370455 - DNA, 18 bp, Homo sapiens
ctgtctcaaaaaaagaaa

SEQ ID NO: 1370456 - DNA, 13 bp, Homo sapiens
ctgtctggtggcc

SEQ ID NO: 1370457 - DNA, 23 bp, Homo sapiens
ctgtctggtggccccgtttctgg

SEQ ID NO: 1370458 - DNA, 19 bp, Homo sapiens
ctgtgaacagagagaccct

SEQ ID NO: 1370459 - DNA, 16 bp, Homo sapiens
ctgtgacatggtgcct

SEQ ID NO: 1370460 - DNA, 19 bp, Homo sapiens
ctgtgacatggtgcctgag

SEQ ID NO: 1370461 - DNA, 20 bp, Homo sapiens
ctgtgatcaatatttttata

SEQ ID NO: 1370462 - DNA, 14 bp, Homo sapiens
ctgtgatgagctga

SEQ ID NO: 1370463 - DNA, 19 bp, Homo sapiens
ctgtgcaacggtctcctga

SEQ ID NO: 1370464 - DNA, 17 bp, Homo sapiens
ctgtgcacacccacctt

SEQ ID NO: 1370465 - DNA, 14 bp, Homo sapiens
ctgtgccctcctga

SEQ ID NO: 1370466 - DNA, 19 bp, Homo sapiens
ctgtgcctccctccccagt

SEQ ID NO: 1370467 - DNA, 21 bp, Homo sapiens
ctgtgcctccctccccagtgc

SEQ ID NO: 1370468 - DNA, 13 bp, Homo sapiens
ctgtgctatgaat

SEQ ID NO: 1370469 - DNA, 18 bp, Homo sapiens
ctgtgctgccctgaagaa

SEQ ID NO: 1370470 - DNA, 21 bp, Homo sapiens
ctgtggactgaccttgtaaaa

SEQ ID NO: 1370471 - DNA, 15 bp, Homo sapiens
ctgtggcacttgcct

SEQ ID NO: 1370472 - DNA, 16 bp, Homo sapiens
ctgtggcacttgcctg

SEQ ID NO: 1370473 - DNA, 21 bp, Homo sapiens
ctgtggcacttgcctgggtca

SEQ ID NO: 1370474 - DNA, 17 bp, Homo sapiens
ctgtggccccaccctgg

SEQ ID NO: 1370475 - DNA, 15 bp, Homo sapiens
ctgtggctagtgaca

SEQ ID NO: 1370476 - DNA, 16 bp, Homo sapiens
ctgtggctccaggcca

SEQ ID NO: 1370477 - DNA, 16 bp, Homo sapiens
ctgtggttcctctgct

SEQ ID NO: 1370478 - DNA, 19 bp, Homo sapiens
ctgtggttggctgggaaat

SEQ ID NO: 1370479 - DNA, 11 bp, Homo sapiens
ctgtgtaaact

SEQ ID NO: 1370480 - DNA, 21 bp, Homo sapiens
ctgtgtaaactcatctgaaat

SEQ ID NO: 1370481 - DNA, 15 bp, Homo sapiens
ctgtgtatatttgat

SEQ ID NO: 1370482 - DNA, 20 bp, Homo sapiens
ctgtgtatatttgatttatt

SEQ ID NO: 1370483 - DNA, 15 bp, Homo sapiens
ctgtgtatttgcttt

SEQ ID NO: 1370484 - DNA, 20 bp, Homo sapiens
ctgtgtcagcatagaagtaa

SEQ ID NO: 1370485 - DNA, 19 bp, Homo sapiens
ctgtgtccatgcgctcagg

SEQ ID NO: 1370486 - DNA, 22 bp, Homo sapiens
ctgtgtccatgcgctcagggcc

SEQ ID NO: 1370487 - DNA, 22 bp, Homo sapiens
ctgtgtgtcccaggcagggaga

SEQ ID NO: 1370488 - DNA, 21 bp, Homo sapiens
ctgtgtgtgtgtgtgtgcgtg

SEQ ID NO: 1370489 - DNA, 16 bp, Homo sapiens
ctgtgttgccaagctc

SEQ ID NO: 1370490 - DNA, 21 bp, Homo sapiens
ctgtgttgccaagctccaagc

SEQ ID NO: 1370491 - DNA, 23 bp, Homo sapiens
ctgtgttgccacagtagaactgt

SEQ ID NO: 1370492 - DNA, 18 bp, Homo sapiens
ctgtgttggtgtggccca

SEQ ID NO: 1370493 - DNA, 16 bp, Homo sapiens
ctgtgtttataaaata

SEQ ID NO: 1370494 - DNA, 17 bp, Homo sapiens
ctgttactgtcttcagt

SEQ ID NO: 1370495 - DNA, 18 bp, Homo sapiens
ctgttcagctggttgagg

SEQ ID NO: 1370496 - DNA, 13 bp, Homo sapiens
ctgttcggaaggg

SEQ ID NO: 1370497 - DNA, 20 bp, Homo sapiens
ctgttctgtggttcctctgc

SEQ ID NO: 1370498 - DNA, 15 bp, Homo sapiens
ctgttgataaatcca

SEQ ID NO: 1370499 - DNA, 18 bp, Homo sapiens
ctgttgataaatccatca

SEQ ID NO: 1370500 - DNA, 16 bp, Homo sapiens
ctgttggcaggctggc

SEQ ID NO: 1370501 - DNA, 18 bp, Homo sapiens
ctgtttattacttccatg

SEQ ID NO: 1370502 - DNA, 19 bp, Homo sapiens
ctgtttcctgacattgtct

SEQ ID NO: 1370503 - DNA, 20 bp, Homo sapiens
ctgtttcctgacattgtctc

SEQ ID NO: 1370504 - DNA, 16 bp, Homo sapiens
ctgtttcctgggcacg

SEQ ID NO: 1370505 - DNA, 20 bp, Homo sapiens
ctgtttctcttgagctggcc

SEQ ID NO: 1370506 - DNA, 16 bp, Homo sapiens
ctgtttgtcctgagat

SEQ ID NO: 1370507 - DNA, 22 bp, Homo sapiens
ctgtttgtcctgagatggaaaa

SEQ ID NO: 1370508 - DNA, 21 bp, Homo sapiens
cttaaaaccaaagagggcttc

SEQ ID NO: 1370509 - DNA, 22 bp, Homo sapiens
cttaaaataatgaatacatttc

SEQ ID NO: 1370510 - DNA, 21 bp, Homo sapiens
cttaaataataaacagtggaa

SEQ ID NO: 1370511 - DNA, 16 bp, Homo sapiens
cttaaatttaatacca

SEQ ID NO: 1370512 - DNA, 21 bp, Homo sapiens
cttgagttgattcagctctgc

SEQ ID NO: 1370513 - DNA, 18 bp, Homo sapiens
cttgagttgtttttgtat

SEQ ID NO: 1370514 - DNA, 23 bp, Homo sapiens
cttgagttgtttttgtatattgg

SEQ ID NO: 1370515 - DNA, 16 bp, Homo sapiens
cttgagtttgtcgctc

SEQ ID NO: 1370516 - DNA, 21 bp, Homo sapiens
cttgagtttgtcgctcatgtg

SEQ ID NO: 1370517 - DNA, 15 bp, Homo sapiens
cttgatacattcaaa

SEQ ID NO: 1370518 - DNA, 22 bp, Homo sapiens
cttgatacattcaaatttgtct

SEQ ID NO: 1370519 - DNA, 17 bp, Homo sapiens
cttgatgtttggggtct

SEQ ID NO: 1370520 - DNA, 16 bp, Homo sapiens
cttgcaagcatgcttg

SEQ ID NO: 1370521 - DNA, 21 bp, Homo sapiens
cttttaccttttttttttctt

SEQ ID NO: 1370522 - DNA, 16 bp, Homo sapiens
cttttactggttgcat

SEQ ID NO: 1370523 - DNA, 21 bp, Homo sapiens
cttttactggttgcatggaaa

SEQ ID NO: 1370524 - DNA, 22 bp, Homo sapiens
cttttactggttgcatggaaat

SEQ ID NO: 1370525 - DNA, 12 bp, Homo sapiens
cttttactgtga

SEQ ID NO: 1370526 - DNA, 24 bp, Homo sapiens
cttttatctattctgagaaaacaa

SEQ ID NO: 1370527 - DNA, 19 bp, Homo sapiens
cttttattaatgcactttc

SEQ ID NO: 1370528 - DNA, 16 bp, Homo sapiens
cttttcagggctggct

SEQ ID NO: 1370529 - DNA, 20 bp, Homo sapiens
cttttcagggctggctcctg

SEQ ID NO: 1370530 - DNA, 18 bp, Homo sapiens
cttttccctgcttccagg

SEQ ID NO: 1370531 - DNA, 15 bp, Homo sapiens
cttttcgcctttcct

SEQ ID NO: 1370532 - DNA, 14 bp, Homo sapiens
cttttctggcaccg

SEQ ID NO: 1370533 - DNA, 15 bp, Homo sapiens
cttttctggcaccgc

SEQ ID NO: 1370534 - DNA, 23 bp, Homo sapiens
cttttggcaatgactcaaagtct

SEQ ID NO: 1370535 - DNA, 17 bp, Homo sapiens
cttttgtgtaatgaaaa

SEQ ID NO: 1370536 - DNA, 12 bp, Homo sapiens
cttttgtttggt

SEQ ID NO: 1370537 - DNA, 15 bp, Homo sapiens
cttttgtttggtaaa

SEQ ID NO: 1370538 - DNA, 18 bp, Homo sapiens
cttttgtttggtaaatgt

SEQ ID NO: 1370539 - DNA, 13 bp, Homo sapiens
ctttttattaaaa

SEQ ID NO: 1370540 - DNA, 16 bp, Homo sapiens
ctttttattaaaatat

SEQ ID NO: 1370541 - DNA, 13 bp, Homo sapiens
ctttttatttata

SEQ ID NO: 1370542 - DNA, 14 bp, Homo sapiens
ctttttatttatat

SEQ ID NO: 1370543 - DNA, 19 bp, Homo sapiens
ctttttatttatatgtact

SEQ ID NO: 1370544 - DNA, 18 bp, Homo sapiens
ctttttatttatatgtat

SEQ ID NO: 1370545 - DNA, 17 bp, Homo sapiens
ctttttcaggagaatta

SEQ ID NO: 1370546 - DNA, 18 bp, Homo sapiens
ctttttcataaattattt

SEQ ID NO: 1370547 - DNA, 17 bp, Homo sapiens
ctttttgttgtaaaaca

SEQ ID NO: 1370548 - DNA, 18 bp, Homo sapiens
cttttttaaatattttct

SEQ ID NO: 1370549 - DNA, 13 bp, Homo sapiens
cttttttattaat

SEQ ID NO: 1370550 - DNA, 20 bp, Homo sapiens
cttttttattaatcactgtg

SEQ ID NO: 1370551 - DNA, 14 bp, Homo sapiens
cttttttcaaaatc

SEQ ID NO: 1370552 - DNA, 17 bp, Homo sapiens
ctttttttgtatgtgtg

SEQ ID NO: 1370553 - DNA, 13 bp, Homo sapiens
gaaaaaaaattat

SEQ ID NO: 1370554 - DNA, 20 bp, Homo sapiens
gaaaaaaatactatttaaga

SEQ ID NO: 1370555 - DNA, 11 bp, Homo sapiens
gaaaaagaaaa

SEQ ID NO: 1370556 - DNA, 16 bp, Homo sapiens
gaaaaatgctccccac

SEQ ID NO: 1370557 - DNA, 16 bp, Homo sapiens
gaaaaattggggagga

SEQ ID NO: 1370558 - DNA, 19 bp, Homo sapiens
gaaaaattggggaggaggg

SEQ ID NO: 1370559 - DNA, 14 bp, Homo sapiens
gaaaacatgttaat

SEQ ID NO: 1370560 - DNA, 13 bp, Homo sapiens
gaaaacggagctg

SEQ ID NO: 1370561 - DNA, 14 bp, Homo sapiens
gaaaacggagctga

SEQ ID NO: 1370562 - DNA, 15 bp, Homo sapiens
gaaaactgtgatttc

SEQ ID NO: 1370563 - DNA, 19 bp, Homo sapiens
gaaaactgtgttgccacag

SEQ ID NO: 1370564 - DNA, 16 bp, Homo sapiens
gaaaacttcagaagca

SEQ ID NO: 1370565 - DNA, 13 bp, Homo sapiens
gaaaagagacagg

SEQ ID NO: 1370566 - DNA, 18 bp, Homo sapiens
gaaaagagacaggcaggt

SEQ ID NO: 1370567 - DNA, 16 bp, Homo sapiens
gaaaagcagacatttt

SEQ ID NO: 1370568 - DNA, 22 bp, Homo sapiens
gaaaatattgttttacaatagt

SEQ ID NO: 1370569 - DNA, 16 bp, Homo sapiens
gaaaatcagcctgctc

SEQ ID NO: 1370570 - DNA, 22 bp, Homo sapiens
gaaaatcagcctgctccagctg

SEQ ID NO: 1370571 - DNA, 20 bp, Homo sapiens
gaaaatgaatatctattaat

SEQ ID NO: 1370572 - DNA, 17 bp, Homo sapiens
gaaaatgtctgtaataa

SEQ ID NO: 1370573 - DNA, 17 bp, Homo sapiens
gaaacaagtgaaagcat

SEQ ID NO: 1370574 - DNA, 13 bp, Homo sapiens
gaaacactgcctt

SEQ ID NO: 1370575 - DNA, 16 bp, Homo sapiens
gaaacatctcaataaa

SEQ ID NO: 1370576 - DNA, 21 bp, Homo sapiens
gaaaccgagtagaaaatgtga

SEQ ID NO: 1370577 - DNA, 13 bp, Homo sapiens
gaaactaaagcaa

SEQ ID NO: 1370578 - DNA, 21 bp, Homo sapiens
gaaactcacactcccctaggg

SEQ ID NO: 1370579 - DNA, 17 bp, Homo sapiens
gaaactccacatctgcc

SEQ ID NO: 1370580 - DNA, 18 bp, Homo sapiens
gaaactccacatctgcct

SEQ ID NO: 1370581 - DNA, 19 bp, Homo sapiens
gaaactccacatctgcctt

SEQ ID NO: 1370582 - DNA, 18 bp, Homo sapiens
gaaacttgtttcactgaa

SEQ ID NO: 1370583 - DNA, 12 bp, Homo sapiens
gaaacttttatc

SEQ ID NO: 1370584 - DNA, 13 bp, Homo sapiens
gaaagacactgcc

SEQ ID NO: 1370585 - DNA, 21 bp, Homo sapiens
gaaagccctgagctttctgct

SEQ ID NO: 1370586 - DNA, 22 bp, Homo sapiens
gaaagccctgagctttctgcta

SEQ ID NO: 1370587 - DNA, 15 bp, Homo sapiens
gaaaggggagagcct

SEQ ID NO: 1370588 - DNA, 14 bp, Homo sapiens
gaaaggggtgcttt

SEQ ID NO: 1370589 - DNA, 15 bp, Homo sapiens
gaaaggggtgctttt

SEQ ID NO: 1370590 - DNA, 22 bp, Homo sapiens
gaaaggtgagtttgagctgcct

SEQ ID NO: 1370591 - DNA, 19 bp, Homo sapiens
gaaagtgaagcaaatcaga

SEQ ID NO: 1370592 - DNA, 13 bp, Homo sapiens
gaaagtgcatttt

SEQ ID NO: 1370593 - DNA, 23 bp, Homo sapiens
gaaagtgtgtgtagttttacttt

SEQ ID NO: 1370594 - DNA, 13 bp, Homo sapiens
gaaagttttgtaa

SEQ ID NO: 1370595 - DNA, 20 bp, Homo sapiens
gaaagttttgtaaaagaaat

SEQ ID NO: 1370596 - DNA, 19 bp, Homo sapiens
gaaagtttttttttattat

SEQ ID NO: 1370597 - DNA, 16 bp, Homo sapiens
gaaataaaatatatct

SEQ ID NO: 1370598 - DNA, 17 bp, Homo sapiens
gaaataaagtttgctta

SEQ ID NO: 1370599 - DNA, 16 bp, Homo sapiens
gaaataatagaaatgt

SEQ ID NO: 1370600 - DNA, 18 bp, Homo sapiens
gaaataggaaacaagtga

SEQ ID NO: 1370601 - DNA, 22 bp, Homo sapiens
gaaatattaagcatgttttgtt

SEQ ID NO: 1370602 - DNA, 16 bp, Homo sapiens
gaaatcaaagtgctat

SEQ ID NO: 1370603 - DNA, 17 bp, Homo sapiens
gaaatccggagaagctg

SEQ ID NO: 1370604 - DNA, 23 bp, Homo sapiens
gaaatgaaaacagtgtgtaaaca

SEQ ID NO: 1370605 - DNA, 23 bp, Homo sapiens
gaaatgttacaaaaataaactat

SEQ ID NO: 1370606 - DNA, 19 bp, Homo sapiens
gaaatgttttgtaaacatt

SEQ ID NO: 1370607 - DNA, 21 bp, Homo sapiens
gaaattgacacaagtggacct

SEQ ID NO: 1370608 - DNA, 18 bp, Homo sapiens
gaaattgctttgtattgt

SEQ ID NO: 1370609 - DNA, 19 bp, Homo sapiens
gaaattgtatattgtaatt

SEQ ID NO: 1370610 - DNA, 21 bp, Homo sapiens
gaaattttcaagagtctaata

SEQ ID NO: 1370611 - DNA, 13 bp, Homo sapiens
gaaattttgctat

SEQ ID NO: 1370612 - DNA, 13 bp, Homo sapiens
gaaattttgtaag

SEQ ID NO: 1370613 - DNA, 17 bp, Homo sapiens
gaaattttgtaagaagg

SEQ ID NO: 1370614 - DNA, 21 bp, Homo sapiens
gaacaagttgagctatgactt

SEQ ID NO: 1370615 - DNA, 12 bp, Homo sapiens
gaacaatgaagt

SEQ ID NO: 1370616 - DNA, 11 bp, Homo sapiens
gaacaggacta

SEQ ID NO: 1370617 - DNA, 21 bp, Homo sapiens
gaacaggtttttttgtttgtt

SEQ ID NO: 1370618 - DNA, 15 bp, Homo sapiens
gaacatacaaatgca

SEQ ID NO: 1370619 - DNA, 17 bp, Homo sapiens
gaacatacaaatgcatc

SEQ ID NO: 1370620 - DNA, 23 bp, Homo sapiens
gaacatacaaatgcatctttgat

SEQ ID NO: 1370621 - DNA, 14 bp, Homo sapiens
gaacatgccccctg

SEQ ID NO: 1370622 - DNA, 14 bp, Homo sapiens
gaaccacttgtaga

SEQ ID NO: 1370623 - DNA, 15 bp, Homo sapiens
gaaccacttgtagat

SEQ ID NO: 1370624 - DNA, 13 bp, Homo sapiens
gaaccataaattc

SEQ ID NO: 1370625 - DNA, 13 bp, Homo sapiens
gaaccgcacagct

SEQ ID NO: 1370626 - DNA, 16 bp, Homo sapiens
gaaccgcacagctcag

SEQ ID NO: 1370627 - DNA, 17 bp, Homo sapiens
gaaccgcacagctcagg

SEQ ID NO: 1370628 - DNA, 12 bp, Homo sapiens
gaacctgtgtcc

SEQ ID NO: 1370629 - DNA, 13 bp, Homo sapiens
gaaccttggcctg

SEQ ID NO: 1370630 - DNA, 17 bp, Homo sapiens
gaaccttggcctgggcc

SEQ ID NO: 1370631 - DNA, 20 bp, Homo sapiens
gaactattgtgctcagagac

SEQ ID NO: 1370632 - DNA, 23 bp, Homo sapiens
gaactccaggccctcctctccca

SEQ ID NO: 1370633 - DNA, 18 bp, Homo sapiens
gaactcgcgctcagtaaa

SEQ ID NO: 1370634 - DNA, 19 bp, Homo sapiens
gaactcttctcattacttg

SEQ ID NO: 1370635 - DNA, 22 bp, Homo sapiens
gaactgaaaggcttttcaacca

SEQ ID NO: 1370636 - DNA, 14 bp, Homo sapiens
gaactgcaggccct

SEQ ID NO: 1370637 - DNA, 18 bp, Homo sapiens
gaactgcaggccctggcc

SEQ ID NO: 1370638 - DNA, 19 bp, Homo sapiens
gaactgcaggccctggcct

SEQ ID NO: 1370639 - DNA, 17 bp, Homo sapiens
gaacttgaatgtgtcag

SEQ ID NO: 1370640 - DNA, 15 bp, Homo sapiens
gaacttggaagcaca

SEQ ID NO: 1370641 - DNA, 15 bp, Homo sapiens
gaactttgtatagtt

SEQ ID NO: 1370642 - DNA, 22 bp, Homo sapiens
gccactttacccacctagaaca

SEQ ID NO: 1370643 - DNA, 21 bp, Homo sapiens
gccagagagcctggtgctgct

SEQ ID NO: 1370644 - DNA, 17 bp, Homo sapiens
gccagaggaatcctggc

SEQ ID NO: 1370645 - DNA, 22 bp, Homo sapiens
gccagaggaatcctggcagccc

SEQ ID NO: 1370646 - DNA, 15 bp, Homo sapiens
gccagaggcccccag

SEQ ID NO: 1370647 - DNA, 16 bp, Homo sapiens
gccagaggcccccagc

SEQ ID NO: 1370648 - DNA, 13 bp, Homo sapiens
gccagaggctggg

SEQ ID NO: 1370649 - DNA, 15 bp, Homo sapiens
gccagatttgtcttt

SEQ ID NO: 1370650 - DNA, 16 bp, Homo sapiens
gccagatttgtctttt

SEQ ID NO: 1370651 - DNA, 20 bp, Homo sapiens
gccagatttgtctttttgtt

SEQ ID NO: 1370652 - DNA, 14 bp, Homo sapiens
gccagcacctggca

SEQ ID NO: 1370653 - DNA, 15 bp, Homo sapiens
gccagcagcagcagg

SEQ ID NO: 1370654 - DNA, 18 bp, Homo sapiens
gccagcctccgagaggga

SEQ ID NO: 1370655 - DNA, 17 bp, Homo sapiens
gccagcctcctctggac

SEQ ID NO: 1370656 - DNA, 18 bp, Homo sapiens
gccagccttgagccctgg

SEQ ID NO: 1370657 - DNA, 20 bp, Homo sapiens
gccagccttgagccctggct

SEQ ID NO: 1370658 - DNA, 22 bp, Homo sapiens
gccagccttgagccctggctgt

SEQ ID NO: 1370659 - DNA, 20 bp, Homo sapiens
gccagcgcctccctccaccc

SEQ ID NO: 1370660 - DNA, 22 bp, Homo sapiens
gccagcgcctccctccacccca

SEQ ID NO: 1370661 - DNA, 13 bp, Homo sapiens
gccagctccctct

SEQ ID NO: 1370662 - DNA, 18 bp, Homo sapiens
gccagctgacatcttgaa

SEQ ID NO: 1370663 - DNA, 13 bp, Homo sapiens
gccagctggcctt

SEQ ID NO: 1370664 - DNA, 18 bp, Homo sapiens
gccagctggcctttgtaa

SEQ ID NO: 1370665 - DNA, 18 bp, Homo sapiens
gccagcttggggccacca

SEQ ID NO: 1370666 - DNA, 22 bp, Homo sapiens
gccaggacatgcaataaaattt

SEQ ID NO: 1370667 - DNA, 14 bp, Homo sapiens
gccaggcaggggtg

SEQ ID NO: 1370668 - DNA, 15 bp, Homo sapiens
gccaggccagcctcc

SEQ ID NO: 1370669 - DNA, 22 bp, Homo sapiens
gccaggctcactcacagagtca

SEQ ID NO: 1370670 - DNA, 14 bp, Homo sapiens
gccaggctgcctgg

SEQ ID NO: 1370671 - DNA, 21 bp, Homo sapiens
gccaggggaaaatcagcctgc

SEQ ID NO: 1370672 - DNA, 17 bp, Homo sapiens
gccatagagtacactgc

SEQ ID NO: 1370673 - DNA, 22 bp, Homo sapiens
gccatagagtacactgcctgcc

SEQ ID NO: 1370674 - DNA, 15 bp, Homo sapiens
gccatctagccagcc

SEQ ID NO: 1370675 - DNA, 23 bp, Homo sapiens
gccatctagccagcccctcttcc

SEQ ID NO: 1370676 - DNA, 13 bp, Homo sapiens
gccatctgtagct

SEQ ID NO: 1370677 - DNA, 16 bp, Homo sapiens
gccatgaagggaccct

SEQ ID NO: 1370678 - DNA, 14 bp, Homo sapiens
gccatgccagctgg

SEQ ID NO: 1370679 - DNA, 15 bp, Homo sapiens
gccatgccagctggc

SEQ ID NO: 1370680 - DNA, 16 bp, Homo sapiens
gccatgccagctggcc

SEQ ID NO: 1370681 - DNA, 14 bp, Homo sapiens
gccatgctcctggc

SEQ ID NO: 1370682 - DNA, 14 bp, Homo sapiens
gccatgctgaggcc

SEQ ID NO: 1370683 - DNA, 18 bp, Homo sapiens
gccatgctgaggcctggg

SEQ ID NO: 1370684 - DNA, 15 bp, Homo sapiens
gccatgtatgaagcc

SEQ ID NO: 1370685 - DNA, 14 bp, Homo sapiens
gccatgtccaaaga

SEQ ID NO: 1370686 - DNA, 18 bp, Homo sapiens
gccatgtccaaagaggct

SEQ ID NO: 1370687 - DNA, 23 bp, Homo sapiens
gccatgtggaaggcaagccaggc

SEQ ID NO: 1370688 - DNA, 16 bp, Homo sapiens
gccatttatttattga

SEQ ID NO: 1370689 - DNA, 17 bp, Homo sapiens
gccatttgcaataacag

SEQ ID NO: 1370690 - DNA, 22 bp, Homo sapiens
gccatttgcaataacagctgca

SEQ ID NO: 1370691 - DNA, 15 bp, Homo sapiens
gcccaccccctgccc

SEQ ID NO: 1370692 - DNA, 16 bp, Homo sapiens
gcccaccccctgccct

SEQ ID NO: 1370693 - DNA, 18 bp, Homo sapiens
gcccacccggtgggaccc

SEQ ID NO: 1370694 - DNA, 19 bp, Homo sapiens
gcccaccctgctgctggtg

SEQ ID NO: 1370695 - DNA, 16 bp, Homo sapiens
gcccagaataagttat

SEQ ID NO: 1370696 - DNA, 23 bp, Homo sapiens
gcccagaataagttattgcagtt

SEQ ID NO: 1370697 - DNA, 17 bp, Homo sapiens
gcccagaatactgatgg

SEQ ID NO: 1370698 - DNA, 12 bp, Homo sapiens
gcccagagactt

SEQ ID NO: 1370699 - DNA, 14 bp, Homo sapiens
gcccaggagcctca

SEQ ID NO: 1370700 - DNA, 23 bp, Homo sapiens
gcccagggcaagctccgcaggac

SEQ ID NO: 1370701 - DNA, 16 bp, Homo sapiens
gcccagggctcctgca

SEQ ID NO: 1370702 - DNA, 15 bp, Homo sapiens
gcccagtagaccttg

SEQ ID NO: 1370703 - DNA, 11 bp, Homo sapiens
gcccagtgcat

SEQ ID NO: 1370704 - DNA, 14 bp, Homo sapiens
gcccagtgcatggt

SEQ ID NO: 1370705 - DNA, 14 bp, Homo sapiens
gcccatcctgacca

SEQ ID NO: 1370706 - DNA, 15 bp, Homo sapiens
gcccatcctgaccag

SEQ ID NO: 1370707 - DNA, 16 bp, Homo sapiens
gcccatcctgaccagc

SEQ ID NO: 1370708 - DNA, 19 bp, Homo sapiens
gccccaatccctttattac

SEQ ID NO: 1370709 - DNA, 20 bp, Homo sapiens
gccccaccctgggccctggg

SEQ ID NO: 1370710 - DNA, 20 bp, Homo sapiens
gccccactcccttgctggcc

SEQ ID NO: 1370711 - DNA, 16 bp, Homo sapiens
gccccactgccagcag

SEQ ID NO: 1370712 - DNA, 20 bp, Homo sapiens
gccccagcacagcttgacct

SEQ ID NO: 1370713 - DNA, 11 bp, Homo sapiens
gccccagcctg

SEQ ID NO: 1370714 - DNA, 13 bp, Homo sapiens
gccccagcctgct

SEQ ID NO: 1370715 - DNA, 19 bp, Homo sapiens
gccccaggctcgtggactg

SEQ ID NO: 1370716 - DNA, 17 bp, Homo sapiens
gccccatctcccctcag

SEQ ID NO: 1370717 - DNA, 20 bp, Homo sapiens
gccccatctcccctcagctc

SEQ ID NO: 1370718 - DNA, 21 bp, Homo sapiens
gccccatctcccctcagctcg

SEQ ID NO: 1370719 - DNA, 19 bp, Homo sapiens
gcccccaacctcagggctc

SEQ ID NO: 1370720 - DNA, 22 bp, Homo sapiens
gcccccaccccggggaccctgt

SEQ ID NO: 1370721 - DNA, 16 bp, Homo sapiens
gcccccacttgcctct

SEQ ID NO: 1370722 - DNA, 22 bp, Homo sapiens
gcccccagcccagggctcctgc

SEQ ID NO: 1370723 - DNA, 17 bp, Homo sapiens
gcccccagtccccaccc

SEQ ID NO: 1370724 - DNA, 20 bp, Homo sapiens
gccccctccgccctgccact

SEQ ID NO: 1370725 - DNA, 18 bp, Homo sapiens
gccccctgcttcagtccc

SEQ ID NO: 1370726 - DNA, 14 bp, Homo sapiens
gccccctggcctct

SEQ ID NO: 1370727 - DNA, 15 bp, Homo sapiens
gccccctggcctctg

SEQ ID NO: 1370728 - DNA, 16 bp, Homo sapiens
gccccctggcctctgt

SEQ ID NO: 1370729 - DNA, 17 bp, Homo sapiens
gccccctggcctctgtg

SEQ ID NO: 1370730 - DNA, 13 bp, Homo sapiens
gccccgactccag

SEQ ID NO: 1370731 - DNA, 15 bp, Homo sapiens
gccccgactccagcc

SEQ ID NO: 1370732 - DNA, 21 bp, Homo sapiens
gccccgcccccagtccccacc

SEQ ID NO: 1370733 - DNA, 13 bp, Homo sapiens
gcccctcccccag

SEQ ID NO: 1370734 - DNA, 11 bp, Homo sapiens
gcccctgggct

SEQ ID NO: 1370735 - DNA, 18 bp, Homo sapiens
gcccctgggcttggcctg

SEQ ID NO: 1370736 - DNA, 21 bp, Homo sapiens
gcccctgggcttggcctgctg

SEQ ID NO: 1370737 - DNA, 22 bp, Homo sapiens
gcccctgggcttggcctgctgt

SEQ ID NO: 1370738 - DNA, 16 bp, Homo sapiens
gcccgacatggctccg

SEQ ID NO: 1370739 - DNA, 13 bp, Homo sapiens
gcccgtcctgcct

SEQ ID NO: 1370740 - DNA, 14 bp, Homo sapiens
gcccgtcctgcctg

SEQ ID NO: 1370741 - DNA, 21 bp, Homo sapiens
gccttcgcttcttgcctctgt

SEQ ID NO: 1370742 - DNA, 15 bp, Homo sapiens
gccttcttttgatta

SEQ ID NO: 1370743 - DNA, 22 bp, Homo sapiens
gccttcttttgattatgttttt

SEQ ID NO: 1370744 - DNA, 15 bp, Homo sapiens
gccttgagttccagt

SEQ ID NO: 1370745 - DNA, 16 bp, Homo sapiens
gcctttgcagctcaga

SEQ ID NO: 1370746 - DNA, 13 bp, Homo sapiens
gcctttggcttca

SEQ ID NO: 1370747 - DNA, 17 bp, Homo sapiens
gcctttgtaagtgcagg

SEQ ID NO: 1370748 - DNA, 22 bp, Homo sapiens
gcctttttaaaacacatgtttt

SEQ ID NO: 1370749 - DNA, 19 bp, Homo sapiens
gcgaagaccctcttgccca

SEQ ID NO: 1370750 - DNA, 17 bp, Homo sapiens
gcgactttctgcctgga

SEQ ID NO: 1370751 - DNA, 18 bp, Homo sapiens
gcgatctctccactgtgc

SEQ ID NO: 1370752 - DNA, 16 bp, Homo sapiens
gcgatctctcctggcc

SEQ ID NO: 1370753 - DNA, 21 bp, Homo sapiens
gcgccccctccgccctgccac

SEQ ID NO: 1370754 - DNA, 22 bp, Homo sapiens
gcgcccctagccggttcctgtc

SEQ ID NO: 1370755 - DNA, 12 bp, Homo sapiens
gcgccctttccc

SEQ ID NO: 1370756 - DNA, 18 bp, Homo sapiens
gcgccctttccccgacgc

SEQ ID NO: 1370757 - DNA, 22 bp, Homo sapiens
gcgccgtctccaggggctgctt

SEQ ID NO: 1370758 - DNA, 14 bp, Homo sapiens
gcgcctccctccac

SEQ ID NO: 1370759 - DNA, 18 bp, Homo sapiens
gcgcctccctccacccca

SEQ ID NO: 1370760 - DNA, 16 bp, Homo sapiens
gcgcctgctgcatgcc

SEQ ID NO: 1370761 - DNA, 14 bp, Homo sapiens
gcgcgcccctagcc

SEQ ID NO: 1370762 - DNA, 17 bp, Homo sapiens
gcgcggacgtgctgggc

SEQ ID NO: 1370763 - DNA, 20 bp, Homo sapiens
gcgcggtggcgggcacctgt

SEQ ID NO: 1370764 - DNA, 15 bp, Homo sapiens
gcgcggtggctcacg

SEQ ID NO: 1370765 - DNA, 19 bp, Homo sapiens
gccaagaatattgcaaaat

SEQ ID NO: 1370766 - DNA, 15 bp, Homo sapiens
gccaagattttcctc

SEQ ID NO: 1370767 - DNA, 23 bp, Homo sapiens
gccaagattttcctcttgtgatt

SEQ ID NO: 1370768 - DNA, 19 bp, Homo sapiens
gccaagggaacctgtgtcc

SEQ ID NO: 1370769 - DNA, 14 bp, Homo sapiens
gccaaggtgggagg

SEQ ID NO: 1370770 - DNA, 20 bp, Homo sapiens
gccaagtggggtgctgggag

SEQ ID NO: 1370771 - DNA, 23 bp, Homo sapiens
gccaagtggggtgctgggaggag

SEQ ID NO: 1370772 - DNA, 12 bp, Homo sapiens
gccacaggaccc

SEQ ID NO: 1370773 - DNA, 15 bp, Homo sapiens
gccacatcaaacctt

SEQ ID NO: 1370774 - DNA, 16 bp, Homo sapiens
gccacatcaaaccttt

SEQ ID NO: 1370775 - DNA, 19 bp, Homo sapiens
gccaccaaagctgcccact

SEQ ID NO: 1370776 - DNA, 12 bp, Homo sapiens
gccaccaggcca

SEQ ID NO: 1370777 - DNA, 18 bp, Homo sapiens
gccaccaggccacctccc

SEQ ID NO: 1370778 - DNA, 17 bp, Homo sapiens
gccacccaggaggcagg

SEQ ID NO: 1370779 - DNA, 22 bp, Homo sapiens
gccaccctagccaatgtctcct

SEQ ID NO: 1370780 - DNA, 18 bp, Homo sapiens
gccactcactaggccccc

SEQ ID NO: 1370781 - DNA, 14 bp, Homo sapiens
gccactcatttcat

SEQ ID NO: 1370782 - DNA, 18 bp, Homo sapiens
gccactcatttcatctca

SEQ ID NO: 1370783 - DNA, 15 bp, Homo sapiens
ggtccagctctggag

SEQ ID NO: 1370784 - DNA, 14 bp, Homo sapiens
ggtccctctgtgta

SEQ ID NO: 1370785 - DNA, 13 bp, Homo sapiens
ggtccgtgggacg

SEQ ID NO: 1370786 - DNA, 21 bp, Homo sapiens
ggtcctaaggcatctatctgt

SEQ ID NO: 1370787 - DNA, 22 bp, Homo sapiens
ggtcctagaggccctttgctgt

SEQ ID NO: 1370788 - DNA, 15 bp, Homo sapiens
ggtcctctggagccc

SEQ ID NO: 1370789 - DNA, 20 bp, Homo sapiens
ggtcggtaggttcagccaag

SEQ ID NO: 1370790 - DNA, 12 bp, Homo sapiens
ggtctccctggc

SEQ ID NO: 1370791 - DNA, 15 bp, Homo sapiens
ggtctccctggctcc

SEQ ID NO: 1370792 - DNA, 20 bp, Homo sapiens
ggtctcttcttggggcccag

SEQ ID NO: 1370793 - DNA, 21 bp, Homo sapiens
ggtctcttcttggggcccagt

SEQ ID NO: 1370794 - DNA, 18 bp, Homo sapiens
ggtctgttggcaggctgg

SEQ ID NO: 1370795 - DNA, 19 bp, Homo sapiens
ggtctgttggcaggctggc

SEQ ID NO: 1370796 - DNA, 23 bp, Homo sapiens
ggtcttaagaaatgtataaactt

SEQ ID NO: 1370797 - DNA, 21 bp, Homo sapiens
ggtcttgaactcctggactca

SEQ ID NO: 1370798 - DNA, 20 bp, Homo sapiens
ggtctttcagtactttttta

SEQ ID NO: 1370799 - DNA, 16 bp, Homo sapiens
ggtgagggttggcgct

SEQ ID NO: 1370800 - DNA, 18 bp, Homo sapiens
ggtgagtccattctccca

SEQ ID NO: 1370801 - DNA, 20 bp, Homo sapiens
ggtgagtttgagctgccttc

SEQ ID NO: 1370802 - DNA, 11 bp, Homo sapiens
ggtgcagaggt

SEQ ID NO: 1370803 - DNA, 22 bp, Homo sapiens
ggtgcagaggtaccctgggtgt

SEQ ID NO: 1370804 - DNA, 14 bp, Homo sapiens
ggtgcccaagccag

SEQ ID NO: 1370805 - DNA, 20 bp, Homo sapiens
ggtgctgggaggagggagag

SEQ ID NO: 1370806 - DNA, 14 bp, Homo sapiens
ggtgctgtgaggga

SEQ ID NO: 1370807 - DNA, 17 bp, Homo sapiens
ggtgctgtgagggaggg

SEQ ID NO: 1370808 - DNA, 20 bp, Homo sapiens
ggtggaagggtagagaggcg

SEQ ID NO: 1370809 - DNA, 14 bp, Homo sapiens
ggtggcaccagcag

SEQ ID NO: 1370810 - DNA, 20 bp, Homo sapiens
ggtggcaccagcagcctgga

SEQ ID NO: 1370811 - DNA, 13 bp, Homo sapiens
ggtggccacagcg

SEQ ID NO: 1370812 - DNA, 20 bp, Homo sapiens
ggtggccgctgagtggcagg

SEQ ID NO: 1370813 - DNA, 11 bp, Homo sapiens
ggtgggacccc

SEQ ID NO: 1370814 - DNA, 14 bp, Homo sapiens
ggtgggctggactt

SEQ ID NO: 1370815 - DNA, 16 bp, Homo sapiens
ggtggtctgttggcag

SEQ ID NO: 1370816 - DNA, 21 bp, Homo sapiens
ggtggtctgttggcaggctgg

SEQ ID NO: 1370817 - DNA, 20 bp, Homo sapiens
ggtgtcttgggcagagctgg

SEQ ID NO: 1370818 - DNA, 14 bp, Homo sapiens
ggtgtggagaagcg

SEQ ID NO: 1370819 - DNA, 23 bp, Homo sapiens
ggtgtggagaagcggctggcagc

SEQ ID NO: 1370820 - DNA, 13 bp, Homo sapiens
ggtgtttgaaaat

SEQ ID NO: 1370821 - DNA, 14 bp, Homo sapiens
ggtgtttgaaaata

SEQ ID NO: 1370822 - DNA, 20 bp, Homo sapiens
ggtgtttgaaaatagtttat

SEQ ID NO: 1370823 - DNA, 17 bp, Homo sapiens
ggttacttcttctctta

SEQ ID NO: 1370824 - DNA, 13 bp, Homo sapiens
ggttatggagagg

SEQ ID NO: 1370825 - DNA, 21 bp, Homo sapiens
ggttcccttgagggctgcagt

SEQ ID NO: 1370826 - DNA, 15 bp, Homo sapiens
ggttcctctgcctgc

SEQ ID NO: 1370827 - DNA, 17 bp, Homo sapiens
ggttcctctgcctgccc

SEQ ID NO: 1370828 - DNA, 12 bp, Homo sapiens
ggttctcaatga

SEQ ID NO: 1370829 - DNA, 13 bp, Homo sapiens
ggttctcaatgaa

SEQ ID NO: 1370830 - DNA, 13 bp, Homo sapiens
ggttgaggtttca

SEQ ID NO: 1370831 - DNA, 13 bp, Homo sapiens
ggttggtgggggc

SEQ ID NO: 1370832 - DNA, 14 bp, Homo sapiens
ggttgtgcactgtt

SEQ ID NO: 1370833 - DNA, 13 bp, Homo sapiens
ggtttaagctgtt

SEQ ID NO: 1370834 - DNA, 12 bp, Homo sapiens
ggtttccaggga

SEQ ID NO: 1370835 - DNA, 22 bp, Homo sapiens
ggtttctctgtggctccaggcc

SEQ ID NO: 1370836 - DNA, 12 bp, Homo sapiens
ggtttgagaaat

SEQ ID NO: 1370837 - DNA, 20 bp, Homo sapiens
ggttttgtaatttgtttgaa

SEQ ID NO: 1370838 - DNA, 15 bp, Homo sapiens
gtaaaatattttgaa

SEQ ID NO: 1370839 - DNA, 16 bp, Homo sapiens
gtaaacttctgcaaca

SEQ ID NO: 1370840 - DNA, 15 bp, Homo sapiens
gtaaagactggcttt

SEQ ID NO: 1370841 - DNA, 18 bp, Homo sapiens
gtaaagactggttttctg

SEQ ID NO: 1370842 - DNA, 21 bp, Homo sapiens
gtaaagcccatttttaaaata

SEQ ID NO: 1370843 - DNA, 23 bp, Homo sapiens
gtaaagctatttatgggcccctg

SEQ ID NO: 1370844 - DNA, 23 bp, Homo sapiens
gtaaagtatgtattatttacatt

SEQ ID NO: 1370845 - DNA, 15 bp, Homo sapiens
gtaaagttaaaagaa

SEQ ID NO: 1370846 - DNA, 23 bp, Homo sapiens
gtaaagtttccgtgcgtggcact

SEQ ID NO: 1370847 - DNA, 14 bp, Homo sapiens
gtaaataaaccact

SEQ ID NO: 1370848 - DNA, 11 bp, Homo sapiens
gtaaatgtttc

SEQ ID NO: 1370849 - DNA, 14 bp, Homo sapiens
gtaaatgtttcttt

SEQ ID NO: 1370850 - DNA, 13 bp, Homo sapiens
gtaaattctgatt

SEQ ID NO: 1370851 - DNA, 14 bp, Homo sapiens
gtaaattctgattt

SEQ ID NO: 1370852 - DNA, 20 bp, Homo sapiens
gtaacactagggccttggaa

SEQ ID NO: 1370853 - DNA, 15 bp, Homo sapiens
gtaacactcctctgc

SEQ ID NO: 1370854 - DNA, 13 bp, Homo sapiens
gtaacattcatgt

SEQ ID NO: 1370855 - DNA, 12 bp, Homo sapiens
gtccccacccct

SEQ ID NO: 1370856 - DNA, 15 bp, Homo sapiens
gtccccacccctgcc

SEQ ID NO: 1370857 - DNA, 17 bp, Homo sapiens
gtccccacccctgcccc

SEQ ID NO: 1370858 - DNA, 14 bp, Homo sapiens
gtccctctgtgtat

SEQ ID NO: 1370859 - DNA, 21 bp, Homo sapiens
gtccctgcgcctttccttttc

SEQ ID NO: 1370860 - DNA, 13 bp, Homo sapiens
gtccgagctttga

SEQ ID NO: 1370861 - DNA, 19 bp, Homo sapiens
gtcctagaggccctttgct

SEQ ID NO: 1370862 - DNA, 22 bp, Homo sapiens
gtcctagaggccctttgctgtc

SEQ ID NO: 1370863 - DNA, 14 bp, Homo sapiens
gtcctagtaagaag

SEQ ID NO: 1370864 - DNA, 17 bp, Homo sapiens
gtcctagtaagaagaca

SEQ ID NO: 1370865 - DNA, 17 bp, Homo sapiens
gtcctcctcacctcatg

SEQ ID NO: 1370866 - DNA, 13 bp, Homo sapiens
gtcctctggagcc

SEQ ID NO: 1370867 - DNA, 15 bp, Homo sapiens
gtcctgcctgtggcg

SEQ ID NO: 1370868 - DNA, 22 bp, Homo sapiens
gtcctgcctgtggcgccgtctc

SEQ ID NO: 1370869 - DNA, 15 bp, Homo sapiens
gtccttcctgaaact

SEQ ID NO: 1370870 - DNA, 19 bp, Homo sapiens
gtccttgagtgctcttgct

SEQ ID NO: 1370871 - DNA, 11 bp, Homo sapiens
gtcgctcctgc

SEQ ID NO: 1370872 - DNA, 18 bp, Homo sapiens
gtcggctgaccatgctca

SEQ ID NO: 1370873 - DNA, 13 bp, Homo sapiens
gtcgtgcctgtgt

SEQ ID NO: 1370874 - DNA, 17 bp, Homo sapiens
gtcgtgcctgtgtccat

SEQ ID NO: 1370875 - DNA, 17 bp, Homo sapiens
gtctcaaaaaaagaaaa

SEQ ID NO: 1370876 - DNA, 13 bp, Homo sapiens
gtctcacccatgc

SEQ ID NO: 1370877 - DNA, 23 bp, Homo sapiens
gtctcacccatgcaagcagagga

SEQ ID NO: 1370878 - DNA, 21 bp, Homo sapiens
gtctccaggggctgcttcctc

SEQ ID NO: 1370879 - DNA, 22 bp, Homo sapiens
gtctccaggggctgcttcctcc

SEQ ID NO: 1370880 - DNA, 12 bp, Homo sapiens
gtctccctggct

SEQ ID NO: 1370881 - DNA, 14 bp, Homo sapiens
gtctcctccccttc

SEQ ID NO: 1370882 - DNA, 18 bp, Homo sapiens
gtctctcttctcagagtg

SEQ ID NO: 1370883 - DNA, 20 bp, Homo sapiens
gtctcttcttggggcccagt

SEQ ID NO: 1370884 - DNA, 21 bp, Homo sapiens
gtctcttcttggggcccagtg

SEQ ID NO: 1370885 - DNA, 20 bp, Homo sapiens
gtctgagggcttgtagttct

SEQ ID NO: 1370886 - DNA, 20 bp, Homo sapiens
gtctggtggccccgtttctg

SEQ ID NO: 1370887 - DNA, 16 bp, Homo sapiens
gtctgtctttcctgaa

SEQ ID NO: 1370888 - DNA, 20 bp, Homo sapiens
gtctgtctttcctgaaccat

SEQ ID NO: 1370889 - DNA, 14 bp, Homo sapiens
gtctgttggcaggc

SEQ ID NO: 1370890 - DNA, 16 bp, Homo sapiens
gtctgttggcaggctg

SEQ ID NO: 1370891 - DNA, 21 bp, Homo sapiens
gtcttaaaaagtggaaaaata

SEQ ID NO: 1370892 - DNA, 17 bp, Homo sapiens
gtcttaagaaatgtata

SEQ ID NO: 1370893 - DNA, 21 bp, Homo sapiens
gtcttaagaaatgtataaact

SEQ ID NO: 1370894 - DNA, 16 bp, Homo sapiens
gtcttcagtaagccgt

SEQ ID NO: 1370895 - DNA, 23 bp, Homo sapiens
gtcttcctcaaaataaagaagta

SEQ ID NO: 1370896 - DNA, 15 bp, Homo sapiens
gtcttggatatatag

SEQ ID NO: 1370897 - DNA, 22 bp, Homo sapiens
gtcttgggcagagctggctctg

SEQ ID NO: 1370898 - DNA, 22 bp, Homo sapiens
gtctttcagtacttttttaaat

SEQ ID NO: 1370899 - DNA, 19 bp, Homo sapiens
gtctttcatggctgctgtt

SEQ ID NO: 1370900 - DNA, 16 bp, Homo sapiens
gtctttctcaaagaaa

SEQ ID NO: 1370901 - DNA, 23 bp, Homo sapiens
gtctttctcaaagaaatattaag

SEQ ID NO: 1370902 - DNA, 12 bp, Homo sapiens
gtcttttgcttt

SEQ ID NO: 1370903 - DNA, 13 bp, Homo sapiens
gtcttttgctttt

SEQ ID NO: 1370904 - DNA, 14 bp, Homo sapiens
gtcttttgcttttg

SEQ ID NO: 1370905 - DNA, 16 bp, Homo sapiens
gtcttttgcttttggc

SEQ ID NO: 1370906 - DNA, 14 bp, Homo sapiens
gtcttttttttcct

SEQ ID NO: 1370907 - DNA, 14 bp, Homo sapiens
gtgaaaagaaaaat

SEQ ID NO: 1370908 - DNA, 14 bp, Homo sapiens
ccatgtagccccct

SEQ ID NO: 1370909 - DNA, 13 bp, Homo sapiens
ccatgtccaaaga

SEQ ID NO: 1370910 - DNA, 18 bp, Homo sapiens
ccatgtccaaagaggctg

SEQ ID NO: 1370911 - DNA, 22 bp, Homo sapiens
ccatgtgatggacactccaggg

SEQ ID NO: 1370912 - DNA, 22 bp, Homo sapiens
ccattacagaggtattaaaact

SEQ ID NO: 1370913 - DNA, 20 bp, Homo sapiens
ccattccaggcagcctctgt

SEQ ID NO: 1370914 - DNA, 21 bp, Homo sapiens
ccattccaggcagcctctgtc

SEQ ID NO: 1370915 - DNA, 20 bp, Homo sapiens
ccattcgtacataatactga

SEQ ID NO: 1370916 - DNA, 22 bp, Homo sapiens
ccattctcccaggtaccagctg

SEQ ID NO: 1370917 - DNA, 12 bp, Homo sapiens
ccattctgactc

SEQ ID NO: 1370918 - DNA, 15 bp, Homo sapiens
ccatttccattgctt

SEQ ID NO: 1370919 - DNA, 14 bp, Homo sapiens
ccatttcccatctg

SEQ ID NO: 1370920 - DNA, 15 bp, Homo sapiens
ccatttcccatctgc

SEQ ID NO: 1370921 - DNA, 18 bp, Homo sapiens
ccatttcccatctgcacc

SEQ ID NO: 1370922 - DNA, 22 bp, Homo sapiens
ccatttgccaattttcctactc

SEQ ID NO: 1370923 - DNA, 19 bp, Homo sapiens
ccatttgctcttcagatgc

SEQ ID NO: 1370924 - DNA, 14 bp, Homo sapiens
ccatttgtgccaga

SEQ ID NO: 1370925 - DNA, 16 bp, Homo sapiens
ccatttgtgccagagg

SEQ ID NO: 1370926 - DNA, 23 bp, Homo sapiens
cccaaactgttgattattagcca

SEQ ID NO: 1370927 - DNA, 18 bp, Homo sapiens
cccaaagctgagcctgca

SEQ ID NO: 1370928 - DNA, 16 bp, Homo sapiens
cccaaatcaatacact

SEQ ID NO: 1370929 - DNA, 18 bp, Homo sapiens
cccaaccccaagccagcc

SEQ ID NO: 1370930 - DNA, 20 bp, Homo sapiens
cccaaccctatctcctgaca

SEQ ID NO: 1370931 - DNA, 15 bp, Homo sapiens
cccaacctcagggct

SEQ ID NO: 1370932 - DNA, 19 bp, Homo sapiens
cccaacctcagggctccca

SEQ ID NO: 1370933 - DNA, 20 bp, Homo sapiens
cccaacctcagggctcccag

SEQ ID NO: 1370934 - DNA, 15 bp, Homo sapiens
cccaacctttccctc

SEQ ID NO: 1370935 - DNA, 20 bp, Homo sapiens
cccaacctttccctcacccc

SEQ ID NO: 1370936 - DNA, 14 bp, Homo sapiens
cccaagaatgcaag

SEQ ID NO: 1370937 - DNA, 17 bp, Homo sapiens
cccaatccctttattac

SEQ ID NO: 1370938 - DNA, 21 bp, Homo sapiens
cccacaaaggagagctagcag

SEQ ID NO: 1370939 - DNA, 21 bp, Homo sapiens
cccacagtctccggcctctcc

SEQ ID NO: 1370940 - DNA, 15 bp, Homo sapiens
cccacagttgctcta

SEQ ID NO: 1370941 - DNA, 19 bp, Homo sapiens
cccacatccaactccagca

SEQ ID NO: 1370942 - DNA, 14 bp, Homo sapiens
cccacatgtccagc

SEQ ID NO: 1370943 - DNA, 16 bp, Homo sapiens
cccacccccagccccg

SEQ ID NO: 1370944 - DNA, 13 bp, Homo sapiens
cccaccccctgcc

SEQ ID NO: 1370945 - DNA, 14 bp, Homo sapiens
cccaccccctgccc

SEQ ID NO: 1370946 - DNA, 13 bp, Homo sapiens
cccaccccgggga

SEQ ID NO: 1370947 - DNA, 21 bp, Homo sapiens
cccaccccggggaccctgtga

SEQ ID NO: 1370948 - DNA, 12 bp, Homo sapiens
cccacccctgcc

SEQ ID NO: 1370949 - DNA, 14 bp, Homo sapiens
cccaccctgggccc

SEQ ID NO: 1370950 - DNA, 16 bp, Homo sapiens
cccaccggtccagctg

SEQ ID NO: 1370951 - DNA, 17 bp, Homo sapiens
cccaccggtccagctgg

SEQ ID NO: 1370952 - DNA, 17 bp, Homo sapiens
cccacctcggtcactcc

SEQ ID NO: 1370953 - DNA, 20 bp, Homo sapiens
cccacgactgcccggcaggg

SEQ ID NO: 1370954 - DNA, 17 bp, Homo sapiens
cccactaatgcaaactg

SEQ ID NO: 1370955 - DNA, 13 bp, Homo sapiens
cccactgccagca

SEQ ID NO: 1370956 - DNA, 15 bp, Homo sapiens
cccactgccagcagc

SEQ ID NO: 1370957 - DNA, 21 bp, Homo sapiens
cccactgccagcagcagcagg

SEQ ID NO: 1370958 - DNA, 23 bp, Homo sapiens
cccactgtttctcttgagctggc

SEQ ID NO: 1370959 - DNA, 14 bp, Homo sapiens
cccacttgcctctt

SEQ ID NO: 1370960 - DNA, 15 bp, Homo sapiens
cccacttgcctcttc

SEQ ID NO: 1370961 - DNA, 22 bp, Homo sapiens
cccactttgctgttccttactt

SEQ ID NO: 1370962 - DNA, 22 bp, Homo sapiens
cccagaataagttattgcagtt

SEQ ID NO: 1370963 - DNA, 11 bp, Homo sapiens
cccagagactt

SEQ ID NO: 1370964 - DNA, 19 bp, Homo sapiens
cccagagactttgtagatc

SEQ ID NO: 1370965 - DNA, 19 bp, Homo sapiens
cccagcattccagcccctc

SEQ ID NO: 1370966 - DNA, 17 bp, Homo sapiens
cccagccatgccagctg

SEQ ID NO: 1370967 - DNA, 18 bp, Homo sapiens
cccagccatgccagctgg

SEQ ID NO: 1370968 - DNA, 22 bp, Homo sapiens
cccagccatgccagctggcctt

SEQ ID NO: 1370969 - DNA, 17 bp, Homo sapiens
cccagccccgactccag

SEQ ID NO: 1370970 - DNA, 19 bp, Homo sapiens
cccagccccgactccagcc

SEQ ID NO: 1370971 - DNA, 15 bp, Homo sapiens
cccagccctgctggg

SEQ ID NO: 1370972 - DNA, 18 bp, Homo sapiens
cccagcctgcgcctgctg

SEQ ID NO: 1370973 - DNA, 22 bp, Homo sapiens
cccagcctgcgcctgctgcatg

SEQ ID NO: 1370974 - DNA, 12 bp, Homo sapiens
cccagcctgcta

SEQ ID NO: 1370975 - DNA, 14 bp, Homo sapiens
cccagcctgctagc

SEQ ID NO: 1370976 - DNA, 15 bp, Homo sapiens
cccagcctgctagct

SEQ ID NO: 1370977 - DNA, 17 bp, Homo sapiens
cccagctacttgggagg

SEQ ID NO: 1370978 - DNA, 23 bp, Homo sapiens
cccaggacgccactcatttcatc

SEQ ID NO: 1370979 - DNA, 17 bp, Homo sapiens
cccaggagcctgcccag

SEQ ID NO: 1370980 - DNA, 21 bp, Homo sapiens
cccaggaggcagggaggcagc

SEQ ID NO: 1370981 - DNA, 23 bp, Homo sapiens
cccaggaggcagggaggcagccg

SEQ ID NO: 1370982 - DNA, 18 bp, Homo sapiens
cccagggcaagctccgca

SEQ ID NO: 1370983 - DNA, 19 bp, Homo sapiens
cccagggggcatgaccaga

SEQ ID NO: 1370984 - DNA, 20 bp, Homo sapiens
ccccagcccagggctcctgc

SEQ ID NO: 1370985 - DNA, 13 bp, Homo sapiens
ccccagccccggg

SEQ ID NO: 1370986 - DNA, 16 bp, Homo sapiens
ccccagccctgctggg

SEQ ID NO: 1370987 - DNA, 12 bp, Homo sapiens
ccccagcctgcg

SEQ ID NO: 1370988 - DNA, 18 bp, Homo sapiens
ccccagcctgcgcctgct

SEQ ID NO: 1370989 - DNA, 19 bp, Homo sapiens
ccccagcctgcgcctgctg

SEQ ID NO: 1370990 - DNA, 15 bp, Homo sapiens
ccccaggctcgtgga

SEQ ID NO: 1370991 - DNA, 21 bp, Homo sapiens
ccccagttcctcccaggaagc

SEQ ID NO: 1370992 - DNA, 17 bp, Homo sapiens
ccccatctccctgcctg

SEQ ID NO: 1370993 - DNA, 16 bp, Homo sapiens
ccccatttcccatctg

SEQ ID NO: 1370994 - DNA, 19 bp, Homo sapiens
ccccatttcccatctgcac

SEQ ID NO: 1370995 - DNA, 19 bp, Homo sapiens
cccccaaagatagacaggt

SEQ ID NO: 1370996 - DNA, 24 bp, Homo sapiens
cccccaaagatagacaggtcctga

SEQ ID NO: 1370997 - DNA, 15 bp, Homo sapiens
cccccaacctcaggg

SEQ ID NO: 1370998 - DNA, 15 bp, Homo sapiens
cccccagtccccacc

SEQ ID NO: 1370999 - DNA, 20 bp, Homo sapiens
cccccagtccccacccctgc

SEQ ID NO: 1371000 - DNA, 16 bp, Homo sapiens
ccccctcccaccccca

SEQ ID NO: 1371001 - DNA, 13 bp, Homo sapiens
ccccctgccctgc

SEQ ID NO: 1371002 - DNA, 18 bp, Homo sapiens
ccccctgcttcagtccct

SEQ ID NO: 1371003 - DNA, 15 bp, Homo sapiens
ccccctggcctctgt

SEQ ID NO: 1371004 - DNA, 22 bp, Homo sapiens
ccccctggcctctgtgccttct

SEQ ID NO: 1371005 - DNA, 17 bp, Homo sapiens
ccccgactccagccagc

SEQ ID NO: 1371006 - DNA, 18 bp, Homo sapiens
ccccgactccagccagcg

SEQ ID NO: 1371007 - DNA, 12 bp, Homo sapiens
ccccgcccccag

SEQ ID NO: 1371008 - DNA, 16 bp, Homo sapiens
ccccgcccccagtccc

SEQ ID NO: 1371009 - DNA, 16 bp, Homo sapiens
ccccgcctggccagga

SEQ ID NO: 1371010 - DNA, 14 bp, Homo sapiens
ccccgcttctgcct

SEQ ID NO: 1371011 - DNA, 17 bp, Homo sapiens
ccccggggaccctgtga

SEQ ID NO: 1371012 - DNA, 13 bp, Homo sapiens
ccccgtggggcag

SEQ ID NO: 1371013 - DNA, 21 bp, Homo sapiens
cccctaaaagcactcctgctt

SEQ ID NO: 1371014 - DNA, 14 bp, Homo sapiens
cccctcagctcggc

SEQ ID NO: 1371015 - DNA, 18 bp, Homo sapiens
cccctccgccctgccact

SEQ ID NO: 1371016 - DNA, 13 bp, Homo sapiens
cccctccttcaga

SEQ ID NO: 1371017 - DNA, 18 bp, Homo sapiens
cccctctgcacccagaac

SEQ ID NO: 1371018 - DNA, 19 bp, Homo sapiens
cccctctgcacccagaaca

SEQ ID NO: 1371019 - DNA, 19 bp, Homo sapiens
cccctctggtcgctcctgc

SEQ ID NO: 1371020 - DNA, 12 bp, Homo sapiens
cccctgccctgc

SEQ ID NO: 1371021 - DNA, 16 bp, Homo sapiens
cccctggccgcgctcc

SEQ ID NO: 1371022 - DNA, 18 bp, Homo sapiens
cccctgggcttggcctgc

SEQ ID NO: 1371023 - DNA, 22 bp, Homo sapiens
cccctgggcttggcctgctgtg

SEQ ID NO: 1371024 - DNA, 19 bp, Homo sapiens
ccccttcctcttgtctgat

SEQ ID NO: 1371025 - DNA, 12 bp, Homo sapiens
cccgacatggct

SEQ ID NO: 1371026 - DNA, 20 bp, Homo sapiens
cccgactccagccagcgcct

SEQ ID NO: 1371027 - DNA, 13 bp, Homo sapiens
cccgcagagcgcg

SEQ ID NO: 1371028 - DNA, 22 bp, Homo sapiens
cccgcagagcgcgcccctagcc

SEQ ID NO: 1371029 - DNA, 16 bp, Homo sapiens
cccgcctggccaggag

SEQ ID NO: 1371030 - DNA, 16 bp, Homo sapiens
cccggctgcagaggcc

SEQ ID NO: 1371031 - DNA, 20 bp, Homo sapiens
cccggcttcctttcccaagc

SEQ ID NO: 1371032 - DNA, 23 bp, Homo sapiens
cccgggaacctccccagcctgcg

SEQ ID NO: 1371033 - DNA, 16 bp, Homo sapiens
cccggggcccagggca

SEQ ID NO: 1371034 - DNA, 16 bp, Homo sapiens
cccggggtggccacag

SEQ ID NO: 1371035 - DNA, 14 bp, Homo sapiens
cccgtcctgcctgt

SEQ ID NO: 1371036 - DNA, 22 bp, Homo sapiens
cccgtggggcagggagctgggc

SEQ ID NO: 1371037 - DNA, 17 bp, Homo sapiens
ccctaaccccttccaga

SEQ ID NO: 1371038 - DNA, 13 bp, Homo sapiens
ccctaaggtccta

SEQ ID NO: 1371039 - DNA, 22 bp, Homo sapiens
ccctaatctatggtcgggagac

SEQ ID NO: 1371040 - DNA, 23 bp, Homo sapiens
ccctactattcagtggcgagaaa

SEQ ID NO: 1371041 - DNA, 15 bp, Homo sapiens
ccctactccctgcag

SEQ ID NO: 1371042 - DNA, 16 bp, Homo sapiens
ccctactccctgcaga

SEQ ID NO: 1371043 - DNA, 19 bp, Homo sapiens
ccctactccctgcagatgc

SEQ ID NO: 1371044 - DNA, 21 bp, Homo sapiens
ccctactccctgcagatgcca

SEQ ID NO: 1371045 - DNA, 23 bp, Homo sapiens
ccctagcagcccaccctgctgct

SEQ ID NO: 1371046 - DNA, 13 bp, Homo sapiens
ccctatctcctga

SEQ ID NO: 1371047 - DNA, 18 bp, Homo sapiens
ccctattagagaagagat

SEQ ID NO: 1371048 - DNA, 15 bp, Homo sapiens
ccctcccacccccag

SEQ ID NO: 1371049 - DNA, 16 bp, Homo sapiens
ccctcccacccccagc

SEQ ID NO: 1371050 - DNA, 20 bp, Homo sapiens
ccctcccacccccagccccg

SEQ ID NO: 1371051 - DNA, 14 bp, Homo sapiens
ccctccgccctgcc

SEQ ID NO: 1371052 - DNA, 15 bp, Homo sapiens
ccctcctccaggcct

SEQ ID NO: 1371053 - DNA, 12 bp, Homo sapiens
ccctccttcaga

SEQ ID NO: 1371054 - DNA, 16 bp, Homo sapiens
ccctcggtgggagcca

SEQ ID NO: 1371055 - DNA, 19 bp, Homo sapiens
ccctctaacctcgccctct

SEQ ID NO: 1371056 - DNA, 19 bp, Homo sapiens
catcagttttgtttactca

SEQ ID NO: 1371057 - DNA, 12 bp, Homo sapiens
catcatgcatgt

SEQ ID NO: 1371058 - DNA, 20 bp, Homo sapiens
catcattcctttttatttat

SEQ ID NO: 1371059 - DNA, 15 bp, Homo sapiens
catccaactccagca

SEQ ID NO: 1371060 - DNA, 18 bp, Homo sapiens
catccacaataaccaaga

SEQ ID NO: 1371061 - DNA, 17 bp, Homo sapiens
catccagactcagagct

SEQ ID NO: 1371062 - DNA, 14 bp, Homo sapiens
catccagatgtggc

SEQ ID NO: 1371063 - DNA, 15 bp, Homo sapiens
catccagatgtggct

SEQ ID NO: 1371064 - DNA, 23 bp, Homo sapiens
catccagtctcccaacttgtatt

SEQ ID NO: 1371065 - DNA, 23 bp, Homo sapiens
catccctaccgacccagggttcc

SEQ ID NO: 1371066 - DNA, 14 bp, Homo sapiens
catcctaccctttt

SEQ ID NO: 1371067 - DNA, 20 bp, Homo sapiens
catcctcctcccacccggct

SEQ ID NO: 1371068 - DNA, 23 bp, Homo sapiens
catcctgtgccactaaactacat

SEQ ID NO: 1371069 - DNA, 19 bp, Homo sapiens
catcgcaccattctgactc

SEQ ID NO: 1371070 - DNA, 15 bp, Homo sapiens
catcgccacaaactc

SEQ ID NO: 1371071 - DNA, 21 bp, Homo sapiens
catctaattctctgtggaatg

SEQ ID NO: 1371072 - DNA, 15 bp, Homo sapiens
catctaattctgatt

SEQ ID NO: 1371073 - DNA, 13 bp, Homo sapiens
catctatctagtt

SEQ ID NO: 1371074 - DNA, 20 bp, Homo sapiens
catctatctcatctatctca

SEQ ID NO: 1371075 - DNA, 23 bp, Homo sapiens
catctcatttaagggaaaaatat

SEQ ID NO: 1371076 - DNA, 21 bp, Homo sapiens
catctcccctcagctcggctc

SEQ ID NO: 1371077 - DNA, 17 bp, Homo sapiens
catctccctgcctggcc

SEQ ID NO: 1371078 - DNA, 18 bp, Homo sapiens
catctccctgcctggccc

SEQ ID NO: 1371079 - DNA, 14 bp, Homo sapiens
catctgaaatgtta

SEQ ID NO: 1371080 - DNA, 15 bp, Homo sapiens
catctgaggttttat

SEQ ID NO: 1371081 - DNA, 12 bp, Homo sapiens
catctgcaaaag

SEQ ID NO: 1371082 - DNA, 23 bp, Homo sapiens
catctgcaaaaggcctcttgtaa

SEQ ID NO: 1371083 - DNA, 21 bp, Homo sapiens
ccaaagctgagcctgcaggga

SEQ ID NO: 1371084 - DNA, 13 bp, Homo sapiens
ccaaagctgccca

SEQ ID NO: 1371085 - DNA, 14 bp, Homo sapiens
ccaaaggaaaatgt

SEQ ID NO: 1371086 - DNA, 20 bp, Homo sapiens
ccaaaggaaaatgtctgtaa

SEQ ID NO: 1371087 - DNA, 21 bp, Homo sapiens
ccaaagtgccggtgagaccca

SEQ ID NO: 1371088 - DNA, 20 bp, Homo sapiens
ccaaatattaggcttaaaaa

SEQ ID NO: 1371089 - DNA, 20 bp, Homo sapiens
ccaacctcagggctcccagg

SEQ ID NO: 1371090 - DNA, 16 bp, Homo sapiens
ccaacctttccctcac

SEQ ID NO: 1371091 - DNA, 16 bp, Homo sapiens
ccaactatttattgac

SEQ ID NO: 1371092 - DNA, 23 bp, Homo sapiens
ccaactatttattgactctgggt

SEQ ID NO: 1371093 - DNA, 21 bp, Homo sapiens
ccaagaaagctcactgtagct

SEQ ID NO: 1371094 - DNA, 18 bp, Homo sapiens
ccaagaagcagtggcctt

SEQ ID NO: 1371095 - DNA, 16 bp, Homo sapiens
ccaagaatattgcaaa

SEQ ID NO: 1371096 - DNA, 21 bp, Homo sapiens
ccaagaatattgcaaaataca

SEQ ID NO: 1371097 - DNA, 17 bp, Homo sapiens
ccaagatttaaatgcca

SEQ ID NO: 1371098 - DNA, 16 bp, Homo sapiens
ccaagattttcctctt

SEQ ID NO: 1371099 - DNA, 22 bp, Homo sapiens
ccaagcatcttgggggggtggc

SEQ ID NO: 1371100 - DNA, 15 bp, Homo sapiens
ccaagcctccacagc

SEQ ID NO: 1371101 - DNA, 19 bp, Homo sapiens
ccaagcctccacagcgagg

SEQ ID NO: 1371102 - DNA, 20 bp, Homo sapiens
ccaagcctccacagcgaggg

SEQ ID NO: 1371103 - DNA, 17 bp, Homo sapiens
ccaagctccaagcccca

SEQ ID NO: 1371104 - DNA, 14 bp, Homo sapiens
ccaaggctggcagg

SEQ ID NO: 1371105 - DNA, 17 bp, Homo sapiens
ccaagggaaaggggtgc

SEQ ID NO: 1371106 - DNA, 16 bp, Homo sapiens
ccaagggaacctgtgt

SEQ ID NO: 1371107 - DNA, 18 bp, Homo sapiens
ccaaggtgggaggattgc

SEQ ID NO: 1371108 - DNA, 20 bp, Homo sapiens
ccaagtaactgggattacag

SEQ ID NO: 1371109 - DNA, 15 bp, Homo sapiens
ccaatcttactttgt

SEQ ID NO: 1371110 - DNA, 15 bp, Homo sapiens
ccacaacctcttccc

SEQ ID NO: 1371111 - DNA, 15 bp, Homo sapiens
ccacacagaatgcaa

SEQ ID NO: 1371112 - DNA, 19 bp, Homo sapiens
ccacaccccaacacttcca

SEQ ID NO: 1371113 - DNA, 21 bp, Homo sapiens
ccacaccccaacacttccagc

SEQ ID NO: 1371114 - DNA, 17 bp, Homo sapiens
ccacacttgaaaccttt

SEQ ID NO: 1371115 - DNA, 15 bp, Homo sapiens
ccacagcgagggcag

SEQ ID NO: 1371116 - DNA, 21 bp, Homo sapiens
ccacagcgagggcagctgcta

SEQ ID NO: 1371117 - DNA, 13 bp, Homo sapiens
ccacagcgccagc

SEQ ID NO: 1371118 - DNA, 24 bp, Homo sapiens
ccacagcgccagcctcagactgga

SEQ ID NO: 1371119 - DNA, 16 bp, Homo sapiens
ccacagcgtccctggc

SEQ ID NO: 1371120 - DNA, 21 bp, Homo sapiens
ccacagcgtccctggcgcagg

SEQ ID NO: 1371121 - DNA, 14 bp, Homo sapiens
ccacatcaaacctt

SEQ ID NO: 1371122 - DNA, 13 bp, Homo sapiens
ccacatctgcctt

SEQ ID NO: 1371123 - DNA, 14 bp, Homo sapiens
ccacatctgcctta

SEQ ID NO: 1371124 - DNA, 20 bp, Homo sapiens
ccaccacagccagcacctgg

SEQ ID NO: 1371125 - DNA, 18 bp, Homo sapiens
ccaccagcatcacctgcc

SEQ ID NO: 1371126 - DNA, 13 bp, Homo sapiens
ccaccaggccacc

SEQ ID NO: 1371127 - DNA, 21 bp, Homo sapiens
ccaccaggccacctccccagc

SEQ ID NO: 1371128 - DNA, 19 bp, Homo sapiens
ccacccaaccctatctcct

SEQ ID NO: 1371129 - DNA, 14 bp, Homo sapiens
ccaccccctgccct

SEQ ID NO: 1371130 - DNA, 19 bp, Homo sapiens
ccaccccggccccctgccc

SEQ ID NO: 1371131 - DNA, 18 bp, Homo sapiens
ccaccccggggaccctgt

SEQ ID NO: 1371132 - DNA, 13 bp, Homo sapiens
ccacccctgcccc

SEQ ID NO: 1371133 - DNA, 22 bp, Homo sapiens
ccacccctgcccccagccccgg

SEQ ID NO: 1371134 - DNA, 16 bp, Homo sapiens
ccaccctgaaagccct

SEQ ID NO: 1371135 - DNA, 13 bp, Homo sapiens
ccaccctgggccc

SEQ ID NO: 1371136 - DNA, 22 bp, Homo sapiens
ccaccctgggccctgggctgga

SEQ ID NO: 1371137 - DNA, 15 bp, Homo sapiens
ccaccggtccagctg

SEQ ID NO: 1371138 - DNA, 13 bp, Homo sapiens
ccaccgtggagga

SEQ ID NO: 1371139 - DNA, 14 bp, Homo sapiens
ccacctagaacact

SEQ ID NO: 1371140 - DNA, 19 bp, Homo sapiens
ccacctcacctagcctgat

SEQ ID NO: 1371141 - DNA, 19 bp, Homo sapiens
ccacctcggtcactccaac

SEQ ID NO: 1371142 - DNA, 21 bp, Homo sapiens
ccacgaatttctgtgccctcc

SEQ ID NO: 1371143 - DNA, 21 bp, Homo sapiens
ccacgcccgtcctgcctgtgg

SEQ ID NO: 1371144 - DNA, 19 bp, Homo sapiens
ccacgcctcttgaccaggc

SEQ ID NO: 1371145 - DNA, 20 bp, Homo sapiens
ccacgggacatcacagggtg

SEQ ID NO: 1371146 - DNA, 21 bp, Homo sapiens
ccacgttggagaagcccgtgt

SEQ ID NO: 1371147 - DNA, 12 bp, Homo sapiens
ccactaaaaata

SEQ ID NO: 1371148 - DNA, 13 bp, Homo sapiens
ccactaaaaatat

SEQ ID NO: 1371149 - DNA, 14 bp, Homo sapiens
ccactaaaaatatt

SEQ ID NO: 1371150 - DNA, 17 bp, Homo sapiens
ccactacacctggctga

SEQ ID NO: 1371151 - DNA, 18 bp, Homo sapiens
ccactcccttgctggccc

SEQ ID NO: 1371152 - DNA, 20 bp, Homo sapiens
ccactcccttgctggcccca

SEQ ID NO: 1371153 - DNA, 23 bp, Homo sapiens
ccactccgagaggtgggccagtc

SEQ ID NO: 1371154 - DNA, 18 bp, Homo sapiens
ccactcgtgcatccctga

SEQ ID NO: 1371155 - DNA, 14 bp, Homo sapiens
ccactctgcttctc

SEQ ID NO: 1371156 - DNA, 13 bp, Homo sapiens
ccactgccagcag

SEQ ID NO: 1371157 - DNA, 17 bp, Homo sapiens
ccactgccagcagcagc

SEQ ID NO: 1371158 - DNA, 11 bp, Homo sapiens
ccactgggagg

SEQ ID NO: 1371159 - DNA, 20 bp, Homo sapiens
ccactggtccccaacaatgt

SEQ ID NO: 1371160 - DNA, 14 bp, Homo sapiens
ccactgtgaagaga

SEQ ID NO: 1371161 - DNA, 18 bp, Homo sapiens
ccactgtttctcttgagc

SEQ ID NO: 1371162 - DNA, 13 bp, Homo sapiens
ccacttcactgcg

SEQ ID NO: 1371163 - DNA, 14 bp, Homo sapiens
ccacttcagctgac

SEQ ID NO: 1371164 - DNA, 15 bp, Homo sapiens
ccacttcccaccctg

SEQ ID NO: 1371165 - DNA, 13 bp, Homo sapiens
ccacttcctttta

SEQ ID NO: 1371166 - DNA, 18 bp, Homo sapiens
ccacttgaggcctgatct

SEQ ID NO: 1371167 - DNA, 16 bp, Homo sapiens
ccacttgcctcttcct

SEQ ID NO: 1371168 - DNA, 12 bp, Homo sapiens
ccacttgtagat

SEQ ID NO: 1371169 - DNA, 20 bp, Homo sapiens
ccacttgtagatttgatttt

SEQ ID NO: 1371170 - DNA, 13 bp, Homo sapiens
ccagcccagggct

SEQ ID NO: 1371171 - DNA, 15 bp, Homo sapiens
ccagcccagggctcc

SEQ ID NO: 1371172 - DNA, 19 bp, Homo sapiens
ccagccccgactccagcca

SEQ ID NO: 1371173 - DNA, 21 bp, Homo sapiens
ccagccccgactccagccagc

SEQ ID NO: 1371174 - DNA, 22 bp, Homo sapiens
ccagccccgactccagccagcg

SEQ ID NO: 1371175 - DNA, 17 bp, Homo sapiens
ccagccccggggtgagt

SEQ ID NO: 1371176 - DNA, 13 bp, Homo sapiens
ccagcccctctgg

SEQ ID NO: 1371177 - DNA, 17 bp, Homo sapiens
ccagcccctctggtcgc

SEQ ID NO: 1371178 - DNA, 15 bp, Homo sapiens
ccagcccctcttccc

SEQ ID NO: 1371179 - DNA, 22 bp, Homo sapiens
ccagcccggccgctccaccagc

SEQ ID NO: 1371180 - DNA, 14 bp, Homo sapiens
ccagccctccccat

SEQ ID NO: 1371181 - DNA, 20 bp, Homo sapiens
ccagccctccccatggagcc

SEQ ID NO: 1371182 - DNA, 19 bp, Homo sapiens
ccagccctgctggggatcc

SEQ ID NO: 1371183 - DNA, 20 bp, Homo sapiens
ccagccctgctggggatccc

SEQ ID NO: 1371184 - DNA, 22 bp, Homo sapiens
ccagccctgctggggatccccg

SEQ ID NO: 1371185 - DNA, 14 bp, Homo sapiens
ccagccgccatgct

SEQ ID NO: 1371186 - DNA, 11 bp, Homo sapiens
ccagcctccct

SEQ ID NO: 1371187 - DNA, 14 bp, Homo sapiens
ccagcctcctctgg

SEQ ID NO: 1371188 - DNA, 15 bp, Homo sapiens
ccagcctcctctgga

SEQ ID NO: 1371189 - DNA, 13 bp, Homo sapiens
ccagcctgcgcct

SEQ ID NO: 1371190 - DNA, 16 bp, Homo sapiens
ccagcctgcgcctgct

SEQ ID NO: 1371191 - DNA, 17 bp, Homo sapiens
ccagcctgcgcctgctg

SEQ ID NO: 1371192 - DNA, 21 bp, Homo sapiens
ccagcctgctagctagctcaa

SEQ ID NO: 1371193 - DNA, 19 bp, Homo sapiens
ccagcgatctctccactgt

SEQ ID NO: 1371194 - DNA, 18 bp, Homo sapiens
ccagcgcctccctccacc

SEQ ID NO: 1371195 - DNA, 23 bp, Homo sapiens
ccagcgcctccctccaccccagg

SEQ ID NO: 1371196 - DNA, 15 bp, Homo sapiens
ccagctacttgggag

SEQ ID NO: 1371197 - DNA, 19 bp, Homo sapiens
ccagctacttgggaggctg

SEQ ID NO: 1371198 - DNA, 16 bp, Homo sapiens
ccagctccctctattt

SEQ ID NO: 1371199 - DNA, 21 bp, Homo sapiens
ccagctgcccttccgcagtgt

SEQ ID NO: 1371200 - DNA, 17 bp, Homo sapiens
ccagctgcgcttgcttt

SEQ ID NO: 1371201 - DNA, 18 bp, Homo sapiens
ccagctgcgcttgctttt

SEQ ID NO: 1371202 - DNA, 22 bp, Homo sapiens
ccagctgctccgaggacccagg

SEQ ID NO: 1371203 - DNA, 12 bp, Homo sapiens
ccagctggcctg

SEQ ID NO: 1371204 - DNA, 13 bp, Homo sapiens
ccagctggccttt

SEQ ID NO: 1371205 - DNA, 14 bp, Homo sapiens
ccagctggcctttg

SEQ ID NO: 1371206 - DNA, 16 bp, Homo sapiens
ccagctgttcagctgg

SEQ ID NO: 1371207 - DNA, 19 bp, Homo sapiens
ccagcttaaaggggctaga

SEQ ID NO: 1371208 - DNA, 16 bp, Homo sapiens
ccagcttatctcaggg

SEQ ID NO: 1371209 - DNA, 19 bp, Homo sapiens
ccagcttggggccaccaaa

SEQ ID NO: 1371210 - DNA, 21 bp, Homo sapiens
ccagcttggggccaccaaagc

SEQ ID NO: 1371211 - DNA, 22 bp, Homo sapiens
ccagcttggggccaccaaagct

SEQ ID NO: 1371212 - DNA, 22 bp, Homo sapiens
ccaggaaactccacatctgcct

SEQ ID NO: 1371213 - DNA, 18 bp, Homo sapiens
ccaggaacagcaaatgca

SEQ ID NO: 1371214 - DNA, 11 bp, Homo sapiens
ccaggaagccg

SEQ ID NO: 1371215 - DNA, 20 bp, Homo sapiens
ccaggacgccactcatttca

SEQ ID NO: 1371216 - DNA, 21 bp, Homo sapiens
ccaggacgccactcatttcat

SEQ ID NO: 1371217 - DNA, 23 bp, Homo sapiens
ccaggacgccactcatttcatct

SEQ ID NO: 1371218 - DNA, 13 bp, Homo sapiens
ccaggagcctcac

SEQ ID NO: 1371219 - DNA, 20 bp, Homo sapiens
ccaggaggcagggaggcagc

SEQ ID NO: 1371220 - DNA, 21 bp, Homo sapiens
ccaggatcccaagcctcctgc

SEQ ID NO: 1371221 - DNA, 22 bp, Homo sapiens
ccaggatcccaagcctcctgct

SEQ ID NO: 1371222 - DNA, 16 bp, Homo sapiens
ccaggcacctcttcct

SEQ ID NO: 1371223 - DNA, 23 bp, Homo sapiens
ccaggcagcctctgtcaggcctt

SEQ ID NO: 1371224 - DNA, 15 bp, Homo sapiens
ccaggcaggggtggg

SEQ ID NO: 1371225 - DNA, 21 bp, Homo sapiens
ccaggcaggggtgggggtgga

SEQ ID NO: 1371226 - DNA, 13 bp, Homo sapiens
ccaggccacctcc

SEQ ID NO: 1371227 - DNA, 13 bp, Homo sapiens
ccaggccagcctc

SEQ ID NO: 1371228 - DNA, 18 bp, Homo sapiens
ccaggccctcctctccca

SEQ ID NO: 1371229 - DNA, 13 bp, Homo sapiens
ccaggcctgcctc

SEQ ID NO: 1371230 - DNA, 17 bp, Homo sapiens
ccaggctcactcacaga

SEQ ID NO: 1371231 - DNA, 18 bp, Homo sapiens
ccaggctcgtggactgag

SEQ ID NO: 1371232 - DNA, 21 bp, Homo sapiens
ccaggctcgtggactgagtgg

SEQ ID NO: 1371233 - DNA, 14 bp, Homo sapiens
ccaggctgccgtgg

SEQ ID NO: 1371234 - DNA, 18 bp, Homo sapiens
ccaggctgccgtggggcc

SEQ ID NO: 1371235 - DNA, 23 bp, Homo sapiens
ccaggctgcctcccttgtggcag

SEQ ID NO: 1371236 - DNA, 17 bp, Homo sapiens
ccagggaatccaagcct

SEQ ID NO: 1371237 - DNA, 13 bp, Homo sapiens
ccagggagccttt

SEQ ID NO: 1371238 - DNA, 18 bp, Homo sapiens
ccagggagcctttggttc

SEQ ID NO: 1371239 - DNA, 23 bp, Homo sapiens
ccagggaggggccggccctgtgt

SEQ ID NO: 1371240 - DNA, 13 bp, Homo sapiens
ccagggccctcgg

SEQ ID NO: 1371241 - DNA, 21 bp, Homo sapiens
ccagggccttttctggcaccg

SEQ ID NO: 1371242 - DNA, 20 bp, Homo sapiens
ccaggggaaaatcagcctgc

SEQ ID NO: 1371243 - DNA, 21 bp, Homo sapiens
ccaggggaaaatcagcctgct

SEQ ID NO: 1371244 - DNA, 20 bp, Homo sapiens
ccaggggctgcttcctcctg

SEQ ID NO: 1371245 - DNA, 21 bp, Homo sapiens
ccaggggctgcttcctcctgg

SEQ ID NO: 1371246 - DNA, 13 bp, Homo sapiens
ccaggggtttctc

SEQ ID NO: 1371247 - DNA, 18 bp, Homo sapiens
ccagggtccctctgtgta

SEQ ID NO: 1371248 - DNA, 15 bp, Homo sapiens
ccaggtaccagctgc

SEQ ID NO: 1371249 - DNA, 23 bp, Homo sapiens
ccaggtaccagctgcgcttgctt

SEQ ID NO: 1371250 - DNA, 20 bp, Homo sapiens
ccaggtgcagaggtaccctg

SEQ ID NO: 1371251 - DNA, 14 bp, Homo sapiens
cagcctcctctgga

SEQ ID NO: 1371252 - DNA, 23 bp, Homo sapiens
cagcctctccccaggtccagctc

SEQ ID NO: 1371253 - DNA, 17 bp, Homo sapiens
cagcctctgaaaaccaa

SEQ ID NO: 1371254 - DNA, 14 bp, Homo sapiens
cagcctgccccgga

SEQ ID NO: 1371255 - DNA, 13 bp, Homo sapiens
cagcctgcgcctg

SEQ ID NO: 1371256 - DNA, 15 bp, Homo sapiens
cagcctgcgcctgct

SEQ ID NO: 1371257 - DNA, 21 bp, Homo sapiens
cagcctgcgcctgctgcatgc

SEQ ID NO: 1371258 - DNA, 16 bp, Homo sapiens
cagcctgctagctagc

SEQ ID NO: 1371259 - DNA, 17 bp, Homo sapiens
cagcctgctccagctgt

SEQ ID NO: 1371260 - DNA, 19 bp, Homo sapiens
cagcctgctccagctgttc

SEQ ID NO: 1371261 - DNA, 16 bp, Homo sapiens
cagcctgggcaatgtg

SEQ ID NO: 1371262 - DNA, 12 bp, Homo sapiens
cagcctgggccc

SEQ ID NO: 1371263 - DNA, 16 bp, Homo sapiens
cagccttgagccctgg

SEQ ID NO: 1371264 - DNA, 15 bp, Homo sapiens
cagcgagggcagctg

SEQ ID NO: 1371265 - DNA, 12 bp, Homo sapiens
cagcgcctccct

SEQ ID NO: 1371266 - DNA, 16 bp, Homo sapiens
cagcgcctccctccac

SEQ ID NO: 1371267 - DNA, 18 bp, Homo sapiens
cagcgcctccctccaccc

SEQ ID NO: 1371268 - DNA, 21 bp, Homo sapiens
cagcgcctccctccaccccag

SEQ ID NO: 1371269 - DNA, 17 bp, Homo sapiens
cagcgcggccctcccga

SEQ ID NO: 1371270 - DNA, 16 bp, Homo sapiens
cagcgtggctctaaaa

SEQ ID NO: 1371271 - DNA, 22 bp, Homo sapiens
cagctaattctactcacagtgc

SEQ ID NO: 1371272 - DNA, 16 bp, Homo sapiens
cagctacacagagctt

SEQ ID NO: 1371273 - DNA, 19 bp, Homo sapiens
cagctacttgggaggctga

SEQ ID NO: 1371274 - DNA, 14 bp, Homo sapiens
cagctcattaaact

SEQ ID NO: 1371275 - DNA, 14 bp, Homo sapiens
cagctcggctcagc

SEQ ID NO: 1371276 - DNA, 16 bp, Homo sapiens
cagctcggtacccggg

SEQ ID NO: 1371277 - DNA, 16 bp, Homo sapiens
cagctctgcaagaatt

SEQ ID NO: 1371278 - DNA, 19 bp, Homo sapiens
cagctctgccgtctctgga

SEQ ID NO: 1371279 - DNA, 22 bp, Homo sapiens
cagctctgccgtctctggagcg

SEQ ID NO: 1371280 - DNA, 11 bp, Homo sapiens
cagctctggag

SEQ ID NO: 1371281 - DNA, 21 bp, Homo sapiens
cagctgacttttctgtccgag

SEQ ID NO: 1371282 - DNA, 18 bp, Homo sapiens
cagctgcaattccctgga

SEQ ID NO: 1371283 - DNA, 19 bp, Homo sapiens
cagctgcgcttgcttttct

SEQ ID NO: 1371284 - DNA, 22 bp, Homo sapiens
cagctgctatttattttcctaa

SEQ ID NO: 1371285 - DNA, 23 bp, Homo sapiens
cagctgctccgaggacccaggaa

SEQ ID NO: 1371286 - DNA, 14 bp, Homo sapiens
cagctggcctggac

SEQ ID NO: 1371287 - DNA, 16 bp, Homo sapiens
cagctggcctttgtaa

SEQ ID NO: 1371288 - DNA, 15 bp, Homo sapiens
cagctgttcagctgg

SEQ ID NO: 1371289 - DNA, 17 bp, Homo sapiens
cagcttgacctgaggct

SEQ ID NO: 1371290 - DNA, 21 bp, Homo sapiens
cagcttgacctgaggctgtgg

SEQ ID NO: 1371291 - DNA, 23 bp, Homo sapiens
cagcttgacctgaggctgtggtc

SEQ ID NO: 1371292 - DNA, 14 bp, Homo sapiens
cagcttgagccggg

SEQ ID NO: 1371293 - DNA, 21 bp, Homo sapiens
cagctttcatctttgtggatg

SEQ ID NO: 1371294 - DNA, 20 bp, Homo sapiens
cagctttcatgattagcaag

SEQ ID NO: 1371295 - DNA, 19 bp, Homo sapiens
cagctttgagaagccttca

SEQ ID NO: 1371296 - DNA, 12 bp, Homo sapiens
cagctttgtttg

SEQ ID NO: 1371297 - DNA, 23 bp, Homo sapiens
cagctttgtttgttgtcagctga

SEQ ID NO: 1371298 - DNA, 16 bp, Homo sapiens
caggaaagtggccaag

SEQ ID NO: 1371299 - DNA, 18 bp, Homo sapiens
caggaagcccaggagcct

SEQ ID NO: 1371300 - DNA, 15 bp, Homo sapiens
caggacatgcaataa

SEQ ID NO: 1371301 - DNA, 21 bp, Homo sapiens
caggacatgcaataaaattta

SEQ ID NO: 1371302 - DNA, 13 bp, Homo sapiens
caggacctcaggt

SEQ ID NO: 1371303 - DNA, 18 bp, Homo sapiens
caggacgccactcatttc

SEQ ID NO: 1371304 - DNA, 20 bp, Homo sapiens
caggacgccactcatttcat

SEQ ID NO: 1371305 - DNA, 19 bp, Homo sapiens
caggaggatcacttgagtc

SEQ ID NO: 1371306 - DNA, 23 bp, Homo sapiens
caggaggcaggcatggccctggg

SEQ ID NO: 1371307 - DNA, 22 bp, Homo sapiens
caggaggcgcccttggcttctg

SEQ ID NO: 1371308 - DNA, 14 bp, Homo sapiens
caggagtccacttt

SEQ ID NO: 1371309 - DNA, 17 bp, Homo sapiens
caggcaaagaaaatgaa

SEQ ID NO: 1371310 - DNA, 15 bp, Homo sapiens
caggcacctcttcct

SEQ ID NO: 1371311 - DNA, 13 bp, Homo sapiens
caggcagcctctg

SEQ ID NO: 1371312 - DNA, 17 bp, Homo sapiens
caggcagcctctgtcag

SEQ ID NO: 1371313 - DNA, 21 bp, Homo sapiens
caggcaggggtgggggtggag

SEQ ID NO: 1371314 - DNA, 22 bp, Homo sapiens
caggcaggggtgggggtggagg

SEQ ID NO: 1371315 - DNA, 15 bp, Homo sapiens
caggcaggtgggatg

SEQ ID NO: 1371316 - DNA, 17 bp, Homo sapiens
caggcatggtggcccac

SEQ ID NO: 1371317 - DNA, 19 bp, Homo sapiens
caggccacctccccagcat

SEQ ID NO: 1371318 - DNA, 11 bp, Homo sapiens
caggccagcct

SEQ ID NO: 1371319 - DNA, 16 bp, Homo sapiens
caggccagcctccgag

SEQ ID NO: 1371320 - DNA, 23 bp, Homo sapiens
caggccagcctccgagagggaga

SEQ ID NO: 1371321 - DNA, 16 bp, Homo sapiens
caggccattctgccgc

SEQ ID NO: 1371322 - DNA, 15 bp, Homo sapiens
caggccctggcctcc

SEQ ID NO: 1371323 - DNA, 20 bp, Homo sapiens
caggccctggcctcccctgc

SEQ ID NO: 1371324 - DNA, 17 bp, Homo sapiens
caggcctctccatttgc

SEQ ID NO: 1371325 - DNA, 18 bp, Homo sapiens
caggctcactgccaggcc

SEQ ID NO: 1371326 - DNA, 21 bp, Homo sapiens
caggctcactgccaggccagc

SEQ ID NO: 1371327 - DNA, 22 bp, Homo sapiens
caggctcactgccaggccagcc

SEQ ID NO: 1371328 - DNA, 24 bp, Homo sapiens
caggctcccaggagcctgcccagc

SEQ ID NO: 1371329 - DNA, 14 bp, Homo sapiens
caggctggccagtc

SEQ ID NO: 1371330 - DNA, 10 bp, Homo sapiens
caggctgggc

SEQ ID NO: 1371331 - DNA, 13 bp, Homo sapiens
caggctttcccac

SEQ ID NO: 1371332 - DNA, 22 bp, Homo sapiens
cagggaagccccacatgtccag

SEQ ID NO: 1371333 - DNA, 14 bp, Homo sapiens
cagggaatccaagc

SEQ ID NO: 1371334 - DNA, 18 bp, Homo sapiens
cagggaatccaagcctcc

SEQ ID NO: 1371335 - DNA, 21 bp, Homo sapiens
cagggagacggtttccaggga

SEQ ID NO: 1371336 - DNA, 23 bp, Homo sapiens
cagggagacggtttccagggagg

SEQ ID NO: 1371337 - DNA, 13 bp, Homo sapiens
cagggaggcagcc

SEQ ID NO: 1371338 - DNA, 21 bp, Homo sapiens
cagggaggcagccgccccatc

SEQ ID NO: 1371339 - DNA, 12 bp, Homo sapiens
cagggaggggcc

SEQ ID NO: 1371340 - DNA, 13 bp, Homo sapiens
cagggcaagctcc

SEQ ID NO: 1371341 - DNA, 15 bp, Homo sapiens
cagggcaagctccgc

SEQ ID NO: 1371342 - DNA, 18 bp, Homo sapiens
cagggccatgctgaggcc

SEQ ID NO: 1371343 - DNA, 21 bp, Homo sapiens
cagggccatgctgaggcctgg

SEQ ID NO: 1371344 - DNA, 23 bp, Homo sapiens
cagggccatgctgaggcctgggc

SEQ ID NO: 1371345 - DNA, 23 bp, Homo sapiens
cagggccgaccagaggagccttt

SEQ ID NO: 1371346 - DNA, 12 bp, Homo sapiens
cagggctcccag

SEQ ID NO: 1371347 - DNA, 21 bp, Homo sapiens
cagggctgctgggggcaactg

SEQ ID NO: 1371348 - DNA, 20 bp, Homo sapiens
caggggaaaatcagcctgct

SEQ ID NO: 1371349 - DNA, 22 bp, Homo sapiens
caggggacaggagtccactttg

SEQ ID NO: 1371350 - DNA, 15 bp, Homo sapiens
caggggcctggagat

SEQ ID NO: 1371351 - DNA, 16 bp, Homo sapiens
caggggctgcttcctc

SEQ ID NO: 1371352 - DNA, 20 bp, Homo sapiens
caggggctgcttcctcctgg

SEQ ID NO: 1371353 - DNA, 17 bp, Homo sapiens
cagggggcatgaccaga

SEQ ID NO: 1371354 - DNA, 14 bp, Homo sapiens
caggggtctccctg

SEQ ID NO: 1371355 - DNA, 23 bp, Homo sapiens
cagggtatggactatctgtctgg

SEQ ID NO: 1371356 - DNA, 21 bp, Homo sapiens
cagggtattccagagtgggga

SEQ ID NO: 1371357 - DNA, 16 bp, Homo sapiens
cagggtccctctgtgt

SEQ ID NO: 1371358 - DNA, 15 bp, Homo sapiens
cagggtgcagcccaa

SEQ ID NO: 1371359 - DNA, 19 bp, Homo sapiens
cagggttcccgcggggctg

SEQ ID NO: 1371360 - DNA, 13 bp, Homo sapiens
caggtaccagctg

SEQ ID NO: 1371361 - DNA, 15 bp, Homo sapiens
caggtaccagctgcg

SEQ ID NO: 1371362 - DNA, 14 bp, Homo sapiens
caggtccagctctg

SEQ ID NO: 1371363 - DNA, 16 bp, Homo sapiens
caggtccagctctgga

SEQ ID NO: 1371364 - DNA, 21 bp, Homo sapiens
caggtgagaagcagaggaagg

SEQ ID NO: 1371365 - DNA, 23 bp, Homo sapiens
caggtgcagaggtaccctgggtg

SEQ ID NO: 1371366 - DNA, 22 bp, Homo sapiens
caggtgctggagcactgggctc

SEQ ID NO: 1371367 - DNA, 18 bp, Homo sapiens
caggtggttatggagagg

SEQ ID NO: 1371368 - DNA, 20 bp, Homo sapiens
caggttctccgttagctcct

SEQ ID NO: 1371369 - DNA, 21 bp, Homo sapiens
caggttctccgttagctcctg

SEQ ID NO: 1371370 - DNA, 14 bp, Homo sapiens
caggtttaagctgt

SEQ ID NO: 1371371 - DNA, 18 bp, Homo sapiens
cagaagttagtttgtata

SEQ ID NO: 1371372 - DNA, 19 bp, Homo sapiens
cagaagttagtttgtatat

SEQ ID NO: 1371373 - DNA, 23 bp, Homo sapiens
cagaagtttgagatcagcctggg

SEQ ID NO: 1371374 - DNA, 18 bp, Homo sapiens
cagaataagttattgcag

SEQ ID NO: 1371375 - DNA, 23 bp, Homo sapiens
cagaataagttattgcagtttat

SEQ ID NO: 1371376 - DNA, 21 bp, Homo sapiens
cagaatatttttatatttcct

SEQ ID NO: 1371377 - DNA, 20 bp, Homo sapiens
cagaatgcaaccaagtcaca

SEQ ID NO: 1371378 - DNA, 21 bp, Homo sapiens
cagaatgcaaccaagtcacac

SEQ ID NO: 1371379 - DNA, 18 bp, Homo sapiens
cagaatgctgcaggactt

SEQ ID NO: 1371380 - DNA, 13 bp, Homo sapiens
cagaatgtaagtg

SEQ ID NO: 1371381 - DNA, 21 bp, Homo sapiens
cagaatgtaagtgggcccacc

SEQ ID NO: 1371382 - DNA, 23 bp, Homo sapiens
cagaatgtaagtgggcccacccg

SEQ ID NO: 1371383 - DNA, 20 bp, Homo sapiens
cagacaataaaccctcagag

SEQ ID NO: 1371384 - DNA, 23 bp, Homo sapiens
cagacaataaaccctcagagcct

SEQ ID NO: 1371385 - DNA, 14 bp, Homo sapiens
cagacaccctcaac

SEQ ID NO: 1371386 - DNA, 21 bp, Homo sapiens
cagacaccctcaacctcttct

SEQ ID NO: 1371387 - DNA, 20 bp, Homo sapiens
cagacagaacttgaatgtgt

SEQ ID NO: 1371388 - DNA, 20 bp, Homo sapiens
cagacatctgaggttttatt

SEQ ID NO: 1371389 - DNA, 22 bp, Homo sapiens
cagaccacgcccgtcctgcctg

SEQ ID NO: 1371390 - DNA, 21 bp, Homo sapiens
cagacctggaagaacaggcct

SEQ ID NO: 1371391 - DNA, 16 bp, Homo sapiens
cagactcagagctctc

SEQ ID NO: 1371392 - DNA, 20 bp, Homo sapiens
cagactcagagctctctcta

SEQ ID NO: 1371393 - DNA, 16 bp, Homo sapiens
cagactggggcatcct

SEQ ID NO: 1371394 - DNA, 22 bp, Homo sapiens
cagactggggcatcctgtgcca

SEQ ID NO: 1371395 - DNA, 24 bp, Homo sapiens
cagacttccttgagacacggagcc

SEQ ID NO: 1371396 - DNA, 14 bp, Homo sapiens
cagacttggctcag

SEQ ID NO: 1371397 - DNA, 20 bp, Homo sapiens
cagagaaaaatgctccccac

SEQ ID NO: 1371398 - DNA, 21 bp, Homo sapiens
cagagacactgttgataaaaa

SEQ ID NO: 1371399 - DNA, 22 bp, Homo sapiens
cagagacactgttgataaaaac

SEQ ID NO: 1371400 - DNA, 16 bp, Homo sapiens
cagagacagatacctc

SEQ ID NO: 1371401 - DNA, 14 bp, Homo sapiens
cagagactttgtag

SEQ ID NO: 1371402 - DNA, 20 bp, Homo sapiens
cagagagcctggtgctgctg

SEQ ID NO: 1371403 - DNA, 19 bp, Homo sapiens
cagagaggaaattctccac

SEQ ID NO: 1371404 - DNA, 16 bp, Homo sapiens
cagagatttctcattg

SEQ ID NO: 1371405 - DNA, 15 bp, Homo sapiens
cagagccttctcaga

SEQ ID NO: 1371406 - DNA, 16 bp, Homo sapiens
cagagccttctcagaa

SEQ ID NO: 1371407 - DNA, 19 bp, Homo sapiens
cagagccttctcagaagca

SEQ ID NO: 1371408 - DNA, 20 bp, Homo sapiens
cagagccttctcagaagcac

SEQ ID NO: 1371409 - DNA, 21 bp, Homo sapiens
cagagccttctcagaagcaca

SEQ ID NO: 1371410 - DNA, 17 bp, Homo sapiens
cagagcgcgcccctagc

SEQ ID NO: 1371411 - DNA, 12 bp, Homo sapiens
cagagctctctc

SEQ ID NO: 1371412 - DNA, 17 bp, Homo sapiens
cagagctctctctacag

SEQ ID NO: 1371413 - DNA, 13 bp, Homo sapiens
cagagctggctct

SEQ ID NO: 1371414 - DNA, 15 bp, Homo sapiens
cagagctttggtctg

SEQ ID NO: 1371415 - DNA, 20 bp, Homo sapiens
cagagctttggtctgtgtgt

SEQ ID NO: 1371416 - DNA, 16 bp, Homo sapiens
cagaggaatcctggca

SEQ ID NO: 1371417 - DNA, 16 bp, Homo sapiens
cagaggaccagggcct

SEQ ID NO: 1371418 - DNA, 15 bp, Homo sapiens
cagaggagccttttt

SEQ ID NO: 1371419 - DNA, 23 bp, Homo sapiens
cagaggcccccagcccagggctc

SEQ ID NO: 1371420 - DNA, 24 bp, Homo sapiens
cagaggcccccagcccagggctcc

SEQ ID NO: 1371421 - DNA, 12 bp, Homo sapiens
cagaggctgggt

SEQ ID NO: 1371422 - DNA, 14 bp, Homo sapiens
cagaggctgggttc

SEQ ID NO: 1371423 - DNA, 17 bp, Homo sapiens
cagaggtaccctgggtg

SEQ ID NO: 1371424 - DNA, 18 bp, Homo sapiens
cagaggtaccctgggtgt

SEQ ID NO: 1371425 - DNA, 18 bp, Homo sapiens
cagaggttgtgcactgtt

SEQ ID NO: 1371426 - DNA, 15 bp, Homo sapiens
cagagtcagccagga

SEQ ID NO: 1371427 - DNA, 15 bp, Homo sapiens
cagagtggtggggga

SEQ ID NO: 1371428 - DNA, 19 bp, Homo sapiens
cagatacctccaaccctgc

SEQ ID NO: 1371429 - DNA, 20 bp, Homo sapiens
cagatacctccaaccctgcc

SEQ ID NO: 1371430 - DNA, 21 bp, Homo sapiens
cagatacctccaaccctgccg

SEQ ID NO: 1371431 - DNA, 13 bp, Homo sapiens
cagatcactgcca

SEQ ID NO: 1371432 - DNA, 14 bp, Homo sapiens
cagatcactgccac

SEQ ID NO: 1371433 - DNA, 17 bp, Homo sapiens
cagatctttcagaaata

SEQ ID NO: 1371434 - DNA, 22 bp, Homo sapiens
cagatgtcctaatggtgatgca

SEQ ID NO: 1371435 - DNA, 19 bp, Homo sapiens
cagatgtggctactgacat

SEQ ID NO: 1371436 - DNA, 17 bp, Homo sapiens
cagatgttagatatttt

SEQ ID NO: 1371437 - DNA, 15 bp, Homo sapiens
cagatgtttccagac

SEQ ID NO: 1371438 - DNA, 16 bp, Homo sapiens
cagatgtttccagact

SEQ ID NO: 1371439 - DNA, 23 bp, Homo sapiens
cagatgtttccagacttccttga

SEQ ID NO: 1371440 - DNA, 14 bp, Homo sapiens
cagattaaacttca

SEQ ID NO: 1371441 - DNA, 16 bp, Homo sapiens
cagattgcctgtttct

SEQ ID NO: 1371442 - DNA, 15 bp, Homo sapiens
cagatttctgaggaa

SEQ ID NO: 1371443 - DNA, 24 bp, Homo sapiens
cagatttgtctttttgttgtaaaa

SEQ ID NO: 1371444 - DNA, 19 bp, Homo sapiens
cagattttacagagcgcac

SEQ ID NO: 1371445 - DNA, 14 bp, Homo sapiens
cagcaaaggaaact

SEQ ID NO: 1371446 - DNA, 13 bp, Homo sapiens
cagcaaattttca

SEQ ID NO: 1371447 - DNA, 16 bp, Homo sapiens
cagcaacacagcctgg

SEQ ID NO: 1371448 - DNA, 20 bp, Homo sapiens
cagcaacgatcacaaatgac

SEQ ID NO: 1371449 - DNA, 22 bp, Homo sapiens
cagcaacgatcacaaatgactt

SEQ ID NO: 1371450 - DNA, 20 bp, Homo sapiens
cagcaacggcacagctaatt

SEQ ID NO: 1371451 - DNA, 22 bp, Homo sapiens
cagcaacttcttctccatccct

SEQ ID NO: 1371452 - DNA, 18 bp, Homo sapiens
cagcaccgaggggccttt

SEQ ID NO: 1371453 - DNA, 15 bp, Homo sapiens
cagcacctcagcctg

SEQ ID NO: 1371454 - DNA, 17 bp, Homo sapiens
cagcaccttgtgcctgg

SEQ ID NO: 1371455 - DNA, 20 bp, Homo sapiens
cagcaccttgtgcctggggt

SEQ ID NO: 1371456 - DNA, 22 bp, Homo sapiens
cagcagaggcccagatattaga

SEQ ID NO: 1371457 - DNA, 13 bp, Homo sapiens
cagcagcagcagg

SEQ ID NO: 1371458 - DNA, 13 bp, Homo sapiens
cagcagcaggtga

SEQ ID NO: 1371459 - DNA, 14 bp, Homo sapiens
cagcagcctggacc

SEQ ID NO: 1371460 - DNA, 20 bp, Homo sapiens
cagcagggagggcttctgcc

SEQ ID NO: 1371461 - DNA, 23 bp, Homo sapiens
cagcaggtgattggaccaggcca

SEQ ID NO: 1371462 - DNA, 17 bp, Homo sapiens
cagcatagaagtaactt

SEQ ID NO: 1371463 - DNA, 17 bp, Homo sapiens
cagcatcacctgcctgt

SEQ ID NO: 1371464 - DNA, 21 bp, Homo sapiens
cagccaaagcctcctccagcc

SEQ ID NO: 1371465 - DNA, 16 bp, Homo sapiens
cagccaagattttcct

SEQ ID NO: 1371466 - DNA, 16 bp, Homo sapiens
cagccactccccggca

SEQ ID NO: 1371467 - DNA, 12 bp, Homo sapiens
cagccagcacct

SEQ ID NO: 1371468 - DNA, 13 bp, Homo sapiens
cagccagcacctg

SEQ ID NO: 1371469 - DNA, 14 bp, Homo sapiens
cagccagcacctgg

SEQ ID NO: 1371470 - DNA, 19 bp, Homo sapiens
cagccagcgcctccctcca

SEQ ID NO: 1371471 - DNA, 22 bp, Homo sapiens
cagccagcgcctccctccaccc

SEQ ID NO: 1371472 - DNA, 17 bp, Homo sapiens
cagcccagagactttgt

SEQ ID NO: 1371473 - DNA, 16 bp, Homo sapiens
cagcccagggctcctg

SEQ ID NO: 1371474 - DNA, 17 bp, Homo sapiens
cagcccagggctcctgc

SEQ ID NO: 1371475 - DNA, 18 bp, Homo sapiens
cagcccagggctcctgca

SEQ ID NO: 1371476 - DNA, 14 bp, Homo sapiens
cagccccactgcca

SEQ ID NO: 1371477 - DNA, 16 bp, Homo sapiens
cagccccactgccagc

SEQ ID NO: 1371478 - DNA, 18 bp, Homo sapiens
cagccccactgccagcag

SEQ ID NO: 1371479 - DNA, 19 bp, Homo sapiens
cagccccactgccagcagc

SEQ ID NO: 1371480 - DNA, 12 bp, Homo sapiens
cagccccagcct

SEQ ID NO: 1371481 - DNA, 17 bp, Homo sapiens
cagccccagcctgctag

SEQ ID NO: 1371482 - DNA, 18 bp, Homo sapiens
cagccccagcctgctagc

SEQ ID NO: 1371483 - DNA, 19 bp, Homo sapiens
cagccccctaaaagcactc

SEQ ID NO: 1371484 - DNA, 16 bp, Homo sapiens
cagccccctgcttcag

SEQ ID NO: 1371485 - DNA, 16 bp, Homo sapiens
cagccccgactccagc

SEQ ID NO: 1371486 - DNA, 20 bp, Homo sapiens
cagccccgactccagccagc

SEQ ID NO: 1371487 - DNA, 12 bp, Homo sapiens
cagccctgctgg

SEQ ID NO: 1371488 - DNA, 15 bp, Homo sapiens
cagccctgctgggga

SEQ ID NO: 1371489 - DNA, 17 bp, Homo sapiens
cagcctccgagagggag

SEQ ID NO: 1371490 - DNA, 19 bp, Homo sapiens
cagcctccgagagggagag

SEQ ID NO: 1371491 - DNA, 18 bp, Homo sapiens
cacccctgcccccagccc

SEQ ID NO: 1371492 - DNA, 21 bp, Homo sapiens
caccccttctctcctccccaa

SEQ ID NO: 1371493 - DNA, 21 bp, Homo sapiens
cacccggtgggacccccgtgg

SEQ ID NO: 1371494 - DNA, 12 bp, Homo sapiens
caccctgggccc

SEQ ID NO: 1371495 - DNA, 14 bp, Homo sapiens
caccctgggccctg

SEQ ID NO: 1371496 - DNA, 22 bp, Homo sapiens
caccctgggccctgggctggaa

SEQ ID NO: 1371497 - DNA, 15 bp, Homo sapiens
caccgactgaaaata

SEQ ID NO: 1371498 - DNA, 14 bp, Homo sapiens
caccgaggggcctt

SEQ ID NO: 1371499 - DNA, 16 bp, Homo sapiens
caccgaggggcctttg

SEQ ID NO: 1371500 - DNA, 14 bp, Homo sapiens
caccgcccatcagg

SEQ ID NO: 1371501 - DNA, 22 bp, Homo sapiens
caccgcctccccacctccaggc

SEQ ID NO: 1371502 - DNA, 19 bp, Homo sapiens
caccgcgggtgtgggaaag

SEQ ID NO: 1371503 - DNA, 14 bp, Homo sapiens
cacctcagcctgca

SEQ ID NO: 1371504 - DNA, 12 bp, Homo sapiens
cacctcatgccc

SEQ ID NO: 1371505 - DNA, 14 bp, Homo sapiens
cacctcatgcccac

SEQ ID NO: 1371506 - DNA, 21 bp, Homo sapiens
cacctcatgcccaccccctgc

SEQ ID NO: 1371507 - DNA, 20 bp, Homo sapiens
cacctggctgaggttcctct

SEQ ID NO: 1371508 - DNA, 23 bp, Homo sapiens
cacctggctgaggttcctctgcc

SEQ ID NO: 1371509 - DNA, 22 bp, Homo sapiens
cacctgtagcacttactggtag

SEQ ID NO: 1371510 - DNA, 16 bp, Homo sapiens
cacctgtagtcccagc

SEQ ID NO: 1371511 - DNA, 21 bp, Homo sapiens
caccttctatagcatcactta

SEQ ID NO: 1371512 - DNA, 16 bp, Homo sapiens
caccttggacatcctc

SEQ ID NO: 1371513 - DNA, 18 bp, Homo sapiens
caccttggacatcctcct

SEQ ID NO: 1371514 - DNA, 13 bp, Homo sapiens
caccttgtgcctg

SEQ ID NO: 1371515 - DNA, 16 bp, Homo sapiens
caccttgtgcctgggg

SEQ ID NO: 1371516 - DNA, 17 bp, Homo sapiens
caccttgtgcctggggt

SEQ ID NO: 1371517 - DNA, 18 bp, Homo sapiens
caccttgtgcctggggtg

SEQ ID NO: 1371518 - DNA, 15 bp, Homo sapiens
cacgaggtcaggaga

SEQ ID NO: 1371519 - DNA, 14 bp, Homo sapiens
cacgcccgtcctgc

SEQ ID NO: 1371520 - DNA, 16 bp, Homo sapiens
cacgcctgtaatccca

SEQ ID NO: 1371521 - DNA, 23 bp, Homo sapiens
cacggaggcatcctacccttttc

SEQ ID NO: 1371522 - DNA, 17 bp, Homo sapiens
cacgttggggtgattta

SEQ ID NO: 1371523 - DNA, 13 bp, Homo sapiens
cacgttttaagga

SEQ ID NO: 1371524 - DNA, 14 bp, Homo sapiens
cacgttttaaggac

SEQ ID NO: 1371525 - DNA, 22 bp, Homo sapiens
cactaaaaatattgtttctgca

SEQ ID NO: 1371526 - DNA, 16 bp, Homo sapiens
cactaaagcatgaaat

SEQ ID NO: 1371527 - DNA, 13 bp, Homo sapiens
cactaaatcagag

SEQ ID NO: 1371528 - DNA, 14 bp, Homo sapiens
cactaactcaccag

SEQ ID NO: 1371529 - DNA, 23 bp, Homo sapiens
cactaattggtacttttaaaaac

SEQ ID NO: 1371530 - DNA, 15 bp, Homo sapiens
cactaatttttgtat

SEQ ID NO: 1371531 - DNA, 18 bp, Homo sapiens
cactaatttttgtattat

SEQ ID NO: 1371532 - DNA, 19 bp, Homo sapiens
cactaatttttgtattatt

SEQ ID NO: 1371533 - DNA, 16 bp, Homo sapiens
cactacaccttgcctt

SEQ ID NO: 1371534 - DNA, 18 bp, Homo sapiens
cactacagtattactctt

SEQ ID NO: 1371535 - DNA, 23 bp, Homo sapiens
cactaggcccccacttgcctctt

SEQ ID NO: 1371536 - DNA, 23 bp, Homo sapiens
cactcacagagtcaaggcctgct

SEQ ID NO: 1371537 - DNA, 13 bp, Homo sapiens
cactcatttcatc

SEQ ID NO: 1371538 - DNA, 16 bp, Homo sapiens
cactcatttcatctca

SEQ ID NO: 1371539 - DNA, 18 bp, Homo sapiens
cactcatttcatctcatt

SEQ ID NO: 1371540 - DNA, 22 bp, Homo sapiens
cactcatttcatctcatttaag

SEQ ID NO: 1371541 - DNA, 22 bp, Homo sapiens
cactccacataaggggtttagt

SEQ ID NO: 1371542 - DNA, 16 bp, Homo sapiens
cactccagcctgggcg

SEQ ID NO: 1371543 - DNA, 16 bp, Homo sapiens
cactccagcctgggtg

SEQ ID NO: 1371544 - DNA, 21 bp, Homo sapiens
cactccagggacacacagcct

SEQ ID NO: 1371545 - DNA, 19 bp, Homo sapiens
cactccgagaggtgggcca

SEQ ID NO: 1371546 - DNA, 21 bp, Homo sapiens
cactcctgcttaatcttcaaa

SEQ ID NO: 1371547 - DNA, 20 bp, Homo sapiens
cactcgggtttctctgtggc

SEQ ID NO: 1371548 - DNA, 21 bp, Homo sapiens
cactcgggtttctctgtggct

SEQ ID NO: 1371549 - DNA, 15 bp, Homo sapiens
cactcgtgtgtttct

SEQ ID NO: 1371550 - DNA, 18 bp, Homo sapiens
cactctaagtcatgtatg

SEQ ID NO: 1371551 - DNA, 15 bp, Homo sapiens
cactctgcttctctg

SEQ ID NO: 1371552 - DNA, 18 bp, Homo sapiens
cactctgcttctctgact

SEQ ID NO: 1371553 - DNA, 17 bp, Homo sapiens
cactgaaagttttgtaa

SEQ ID NO: 1371554 - DNA, 19 bp, Homo sapiens
cactgaaagttttgtaaaa

SEQ ID NO: 1371555 - DNA, 23 bp, Homo sapiens
cactgaaagttttgtaaaagaaa

SEQ ID NO: 1371556 - DNA, 13 bp, Homo sapiens
cactgcaacctcc

SEQ ID NO: 1371557 - DNA, 18 bp, Homo sapiens
cactgcactccagcctgg

SEQ ID NO: 1371558 - DNA, 19 bp, Homo sapiens
cactgcactccagcctggg

SEQ ID NO: 1371559 - DNA, 20 bp, Homo sapiens
cactgcactccagcctgggt

SEQ ID NO: 1371560 - DNA, 20 bp, Homo sapiens
cactgccagcagcagcaggt

SEQ ID NO: 1371561 - DNA, 22 bp, Homo sapiens
cactgccagcagcagcaggtga

SEQ ID NO: 1371562 - DNA, 16 bp, Homo sapiens
cactgcctgccttaag

SEQ ID NO: 1371563 - DNA, 20 bp, Homo sapiens
cactgcctgccttaagtgag

SEQ ID NO: 1371564 - DNA, 11 bp, Homo sapiens
cactgcctggg

SEQ ID NO: 1371565 - DNA, 21 bp, Homo sapiens
cactgccttcgcttcttgcct

SEQ ID NO: 1371566 - DNA, 23 bp, Homo sapiens
cactgccttcgcttcttgcctct

SEQ ID NO: 1371567 - DNA, 16 bp, Homo sapiens
cactggaaaggggaga

SEQ ID NO: 1371568 - DNA, 17 bp, Homo sapiens
cactggaccccagcaag

SEQ ID NO: 1371569 - DNA, 20 bp, Homo sapiens
cactggaggttgaagccaag

SEQ ID NO: 1371570 - DNA, 15 bp, Homo sapiens
cactgggctcccggg

SEQ ID NO: 1371571 - DNA, 13 bp, Homo sapiens
cactgtgaagaga

SEQ ID NO: 1371572 - DNA, 19 bp, Homo sapiens
cactgtgatcaatattttt

SEQ ID NO: 1371573 - DNA, 21 bp, Homo sapiens
cactgtgtatatttgatttat

SEQ ID NO: 1371574 - DNA, 20 bp, Homo sapiens
cactgtttagatttgccata

SEQ ID NO: 1371575 - DNA, 22 bp, Homo sapiens
cactgtttctcttgagctggcc

SEQ ID NO: 1371576 - DNA, 21 bp, Homo sapiens
cacttaaacgaagagttccct

SEQ ID NO: 1371577 - DNA, 15 bp, Homo sapiens
cacttaaagaagtat

SEQ ID NO: 1371578 - DNA, 16 bp, Homo sapiens
cacttaaagaagtatt

SEQ ID NO: 1371579 - DNA, 18 bp, Homo sapiens
cacttaaagaagtatttt

SEQ ID NO: 1371580 - DNA, 15 bp, Homo sapiens
cacttactggtagga

SEQ ID NO: 1371581 - DNA, 16 bp, Homo sapiens
cacttacttgcttatt

SEQ ID NO: 1371582 - DNA, 12 bp, Homo sapiens
cacttcagctga

SEQ ID NO: 1371583 - DNA, 19 bp, Homo sapiens
cacttcatgtaaagtgtca

SEQ ID NO: 1371584 - DNA, 14 bp, Homo sapiens
cacttcccaccctg

SEQ ID NO: 1371585 - DNA, 23 bp, Homo sapiens
cacttcgcaccggagtgtctgga

SEQ ID NO: 1371586 - DNA, 21 bp, Homo sapiens
cacttcgggaggtcgaggcag

SEQ ID NO: 1371587 - DNA, 23 bp, Homo sapiens
cacttcgggaggtcgaggcagga

SEQ ID NO: 1371588 - DNA, 19 bp, Homo sapiens
cacttctaagaaaagccta

SEQ ID NO: 1371589 - DNA, 19 bp, Homo sapiens
cacttgaagccatctaaag

SEQ ID NO: 1371590 - DNA, 14 bp, Homo sapiens
cacttgaggcctga

SEQ ID NO: 1371591 - DNA, 13 bp, Homo sapiens
cacttgcctcttc

SEQ ID NO: 1371592 - DNA, 13 bp, Homo sapiens
cacttgcctgggt

SEQ ID NO: 1371593 - DNA, 14 bp, Homo sapiens
cacttgtagatttg

SEQ ID NO: 1371594 - DNA, 16 bp, Homo sapiens
cacttgtagatttgat

SEQ ID NO: 1371595 - DNA, 17 bp, Homo sapiens
cacttgtgattatttat

SEQ ID NO: 1371596 - DNA, 15 bp, Homo sapiens
cactttgttgcaaga

SEQ ID NO: 1371597 - DNA, 23 bp, Homo sapiens
cactttgttgcaagatgtgaatt

SEQ ID NO: 1371598 - DNA, 14 bp, Homo sapiens
cactttttatgcta

SEQ ID NO: 1371599 - DNA, 21 bp, Homo sapiens
cagaaaaaaagagtgaaaaag

SEQ ID NO: 1371600 - DNA, 20 bp, Homo sapiens
cagaaaaaatgtctgtaaat

SEQ ID NO: 1371601 - DNA, 21 bp, Homo sapiens
cagaaaaagaaatgaacataa

SEQ ID NO: 1371602 - DNA, 14 bp, Homo sapiens
cagaaaatgaaaaa

SEQ ID NO: 1371603 - DNA, 14 bp, Homo sapiens
cagaaacactgcct

SEQ ID NO: 1371604 - DNA, 19 bp, Homo sapiens
cagaaacactgccttttta

SEQ ID NO: 1371605 - DNA, 21 bp, Homo sapiens
cagaaatataacacatttttt

SEQ ID NO: 1371606 - DNA, 21 bp, Homo sapiens
cagaaattgtatattgtaatt

SEQ ID NO: 1371607 - DNA, 17 bp, Homo sapiens
cagaacagtggtggcaa

SEQ ID NO: 1371608 - DNA, 13 bp, Homo sapiens
cagaactacttct

SEQ ID NO: 1371609 - DNA, 20 bp, Homo sapiens
cagaagtcacacattacaaa

SEQ ID NO: 1371610 - DNA, 16 bp, Homo sapiens
cagaagttagtttgta

SEQ ID NO: 1371611 - DNA, 23 bp, Homo sapiens
atttttttgaactcttctcatta

SEQ ID NO: 1371612 - DNA, 15 bp, Homo sapiens
atttttttgtaataa

SEQ ID NO: 1371613 - DNA, 22 bp, Homo sapiens
attttttttaaaatagaaattt

SEQ ID NO: 1371614 - DNA, 16 bp, Homo sapiens
attttttttaaagaaa

SEQ ID NO: 1371615 - DNA, 22 bp, Homo sapiens
attttttttaattgtatttttg

SEQ ID NO: 1371616 - DNA, 15 bp, Homo sapiens
atttttttttctaag

SEQ ID NO: 1371617 - DNA, 18 bp, Homo sapiens
atttttttttctaagaga

SEQ ID NO: 1371618 - DNA, 18 bp, Homo sapiens
atttttttttttaatcta

SEQ ID NO: 1371619 - DNA, 21 bp, Homo sapiens
caaaaaaaatttagccgggcg

SEQ ID NO: 1371620 - DNA, 15 bp, Homo sapiens
caaaaaatgttttaa

SEQ ID NO: 1371621 - DNA, 16 bp, Homo sapiens
caaaaaatgttttaaa

SEQ ID NO: 1371622 - DNA, 15 bp, Homo sapiens
caaaaagaaatgatg

SEQ ID NO: 1371623 - DNA, 13 bp, Homo sapiens
caaaaaggcagga

SEQ ID NO: 1371624 - DNA, 17 bp, Homo sapiens
caaaaattagccgggcg

SEQ ID NO: 1371625 - DNA, 16 bp, Homo sapiens
caaaagatgcttctca

SEQ ID NO: 1371626 - DNA, 18 bp, Homo sapiens
caaaagatgcttctcact

SEQ ID NO: 1371627 - DNA, 17 bp, Homo sapiens
caaaagcgcttttcctt

SEQ ID NO: 1371628 - DNA, 15 bp, Homo sapiens
caaaagctgggcagg

SEQ ID NO: 1371629 - DNA, 13 bp, Homo sapiens
caaaaggaagtct

SEQ ID NO: 1371630 - DNA, 19 bp, Homo sapiens
caaaagtagaactttgtat

SEQ ID NO: 1371631 - DNA, 21 bp, Homo sapiens
caaaagtagaactttgtatag

SEQ ID NO: 1371632 - DNA, 15 bp, Homo sapiens
caaaatatttcccat

SEQ ID NO: 1371633 - DNA, 23 bp, Homo sapiens
caaaatgtaggcttagtttgtgt

SEQ ID NO: 1371634 - DNA, 16 bp, Homo sapiens
caaaattaaggtgttt

SEQ ID NO: 1371635 - DNA, 19 bp, Homo sapiens
caaaattaaggtgtttgaa

SEQ ID NO: 1371636 - DNA, 14 bp, Homo sapiens
caaaatttgactaa

SEQ ID NO: 1371637 - DNA, 15 bp, Homo sapiens
caaaccttatctcca

SEQ ID NO: 1371638 - DNA, 21 bp, Homo sapiens
caaaccttatctccacaacct

SEQ ID NO: 1371639 - DNA, 18 bp, Homo sapiens
caaacctttattttagaa

SEQ ID NO: 1371640 - DNA, 23 bp, Homo sapiens
caaacgctaaagagcccttgcct

SEQ ID NO: 1371641 - DNA, 17 bp, Homo sapiens
caaactgaagcagcctc

SEQ ID NO: 1371642 - DNA, 12 bp, Homo sapiens
caaagaggctgc

SEQ ID NO: 1371643 - DNA, 13 bp, Homo sapiens
caaagaggctgcc

SEQ ID NO: 1371644 - DNA, 17 bp, Homo sapiens
caaagatagacaggtcc

SEQ ID NO: 1371645 - DNA, 13 bp, Homo sapiens
caaagatttaatc

SEQ ID NO: 1371646 - DNA, 17 bp, Homo sapiens
caaagctgagcctgcag

SEQ ID NO: 1371647 - DNA, 22 bp, Homo sapiens
caaagctgagcctgcagggaag

SEQ ID NO: 1371648 - DNA, 24 bp, Homo sapiens
caaagctgagcctgcagggaagcc

SEQ ID NO: 1371649 - DNA, 16 bp, Homo sapiens
caaagctggctcacct

SEQ ID NO: 1371650 - DNA, 20 bp, Homo sapiens
caaagcttggattaaataca

SEQ ID NO: 1371651 - DNA, 18 bp, Homo sapiens
caaaggaaactttgcaga

SEQ ID NO: 1371652 - DNA, 17 bp, Homo sapiens
caaaggaaggtggatgg

SEQ ID NO: 1371653 - DNA, 18 bp, Homo sapiens
caaaggagcgagcatgtc

SEQ ID NO: 1371654 - DNA, 21 bp, Homo sapiens
caaaggcattataaaaagaat

SEQ ID NO: 1371655 - DNA, 21 bp, Homo sapiens
caaagggcctgcccagacaag

SEQ ID NO: 1371656 - DNA, 23 bp, Homo sapiens
caaagtctgctctcatataagac

SEQ ID NO: 1371657 - DNA, 16 bp, Homo sapiens
caaagtgccaaagaaa

SEQ ID NO: 1371658 - DNA, 22 bp, Homo sapiens
caaagtgctattacgaagttca

SEQ ID NO: 1371659 - DNA, 19 bp, Homo sapiens
caaagtttgacaggaacct

SEQ ID NO: 1371660 - DNA, 23 bp, Homo sapiens
caaataaagagagaacaggacta

SEQ ID NO: 1371661 - DNA, 18 bp, Homo sapiens
caaatattgttgacaact

SEQ ID NO: 1371662 - DNA, 14 bp, Homo sapiens
caaatcaatacact

SEQ ID NO: 1371663 - DNA, 17 bp, Homo sapiens
caaatcaatacactagt

SEQ ID NO: 1371664 - DNA, 16 bp, Homo sapiens
caaatctgatggcctt

SEQ ID NO: 1371665 - DNA, 17 bp, Homo sapiens
caaatgactttattatt

SEQ ID NO: 1371666 - DNA, 18 bp, Homo sapiens
caaatgactttattattt

SEQ ID NO: 1371667 - DNA, 15 bp, Homo sapiens
caaatgcatctttga

SEQ ID NO: 1371668 - DNA, 22 bp, Homo sapiens
caaatgcatctttgatgtgttg

SEQ ID NO: 1371669 - DNA, 16 bp, Homo sapiens
caaattaattgtgtga

SEQ ID NO: 1371670 - DNA, 19 bp, Homo sapiens
caaattaattgtgtgaact

SEQ ID NO: 1371671 - DNA, 20 bp, Homo sapiens
caaattaattgtgtgaactt

SEQ ID NO: 1371672 - DNA, 13 bp, Homo sapiens
caaattatcttga

SEQ ID NO: 1371673 - DNA, 15 bp, Homo sapiens
caaattttttgactt

SEQ ID NO: 1371674 - DNA, 23 bp, Homo sapiens
caaattttttgactttttttgta

SEQ ID NO: 1371675 - DNA, 12 bp, Homo sapiens
caacaaagaaat

SEQ ID NO: 1371676 - DNA, 22 bp, Homo sapiens
caacaaatattcactggcccct

SEQ ID NO: 1371677 - DNA, 18 bp, Homo sapiens
caacaatgtgaggggtcc

SEQ ID NO: 1371678 - DNA, 14 bp, Homo sapiens
caacaattggtaaa

SEQ ID NO: 1371679 - DNA, 18 bp, Homo sapiens
caacaattggtaaaactc

SEQ ID NO: 1371680 - DNA, 19 bp, Homo sapiens
caacaattggtaaaactca

SEQ ID NO: 1371681 - DNA, 24 bp, Homo sapiens
caacacttccagcatttagctggc

SEQ ID NO: 1371682 - DNA, 22 bp, Homo sapiens
caacatgttgggaaacttggct

SEQ ID NO: 1371683 - DNA, 23 bp, Homo sapiens
caacatgttgggaaacttggctc

SEQ ID NO: 1371684 - DNA, 21 bp, Homo sapiens
caaccactaagaattcaaact

SEQ ID NO: 1371685 - DNA, 12 bp, Homo sapiens
caaccagacctg

SEQ ID NO: 1371686 - DNA, 19 bp, Homo sapiens
caaccaggcacctcttcct

SEQ ID NO: 1371687 - DNA, 22 bp, Homo sapiens
caaccatgtcatttcagaagtt

SEQ ID NO: 1371688 - DNA, 17 bp, Homo sapiens
caaccccaagccagccc

SEQ ID NO: 1371689 - DNA, 22 bp, Homo sapiens
caaccctatctcctgacagaag

SEQ ID NO: 1371690 - DNA, 14 bp, Homo sapiens
caacctcagggctc

SEQ ID NO: 1371691 - DNA, 18 bp, Homo sapiens
caacctcagggctcccag

SEQ ID NO: 1371692 - DNA, 20 bp, Homo sapiens
caacctcagggctcccaggg

SEQ ID NO: 1371693 - DNA, 18 bp, Homo sapiens
caacctcttctggctcaa

SEQ ID NO: 1371694 - DNA, 19 bp, Homo sapiens
caacctttccctcaccccc

SEQ ID NO: 1371695 - DNA, 20 bp, Homo sapiens
caacgatcacaaatgacttt

SEQ ID NO: 1371696 - DNA, 17 bp, Homo sapiens
caactaaaatttgaagt

SEQ ID NO: 1371697 - DNA, 12 bp, Homo sapiens
caactgtgactg

SEQ ID NO: 1371698 - DNA, 22 bp, Homo sapiens
caacttctgcctcccatgctta

SEQ ID NO: 1371699 - DNA, 23 bp, Homo sapiens
caacttgtattaaagacagaggc

SEQ ID NO: 1371700 - DNA, 22 bp, Homo sapiens
caactttgtaaaaatcttttga

SEQ ID NO: 1371701 - DNA, 20 bp, Homo sapiens
caagaaagctcactgtagct

SEQ ID NO: 1371702 - DNA, 18 bp, Homo sapiens
caagaagcagtggcctta

SEQ ID NO: 1371703 - DNA, 15 bp, Homo sapiens
caagaatattgcaaa

SEQ ID NO: 1371704 - DNA, 20 bp, Homo sapiens
caagaatattgcaaaataca

SEQ ID NO: 1371705 - DNA, 16 bp, Homo sapiens
caagaccgatcggcgg

SEQ ID NO: 1371706 - DNA, 24 bp, Homo sapiens
caagagaactcgcgctcagtaaac

SEQ ID NO: 1371707 - DNA, 16 bp, Homo sapiens
caagagatgggaatga

SEQ ID NO: 1371708 - DNA, 12 bp, Homo sapiens
caagagccttaa

SEQ ID NO: 1371709 - DNA, 15 bp, Homo sapiens
caagagccttaaaac

SEQ ID NO: 1371710 - DNA, 12 bp, Homo sapiens
caagaggaatga

SEQ ID NO: 1371711 - DNA, 18 bp, Homo sapiens
caagagggggtggagggg

SEQ ID NO: 1371712 - DNA, 13 bp, Homo sapiens
caagatgtgaatt

SEQ ID NO: 1371713 - DNA, 14 bp, Homo sapiens
caagatgtgaatta

SEQ ID NO: 1371714 - DNA, 18 bp, Homo sapiens
caagatgtgaattattga

SEQ ID NO: 1371715 - DNA, 19 bp, Homo sapiens
caagatgttgatttttact

SEQ ID NO: 1371716 - DNA, 18 bp, Homo sapiens
caagattttcctcttgtg

SEQ ID NO: 1371717 - DNA, 16 bp, Homo sapiens
caagattttttaattg

SEQ ID NO: 1371718 - DNA, 14 bp, Homo sapiens
caagcagaggacca

SEQ ID NO: 1371719 - DNA, 18 bp, Homo sapiens
caagcagaggaccagggc

SEQ ID NO: 1371720 - DNA, 19 bp, Homo sapiens
caagcagaggaccagggcc

SEQ ID NO: 1371721 - DNA, 21 bp, Homo sapiens
caagcagaggaccagggcctt

SEQ ID NO: 1371722 - DNA, 21 bp, Homo sapiens
caagcatcttgggggggtggc

SEQ ID NO: 1371723 - DNA, 22 bp, Homo sapiens
caagccaagggaacctgtgtcc

SEQ ID NO: 1371724 - DNA, 13 bp, Homo sapiens
caagccaggctca

SEQ ID NO: 1371725 - DNA, 13 bp, Homo sapiens
caagcctccacag

SEQ ID NO: 1371726 - DNA, 16 bp, Homo sapiens
caagctccgcaggact

SEQ ID NO: 1371727 - DNA, 17 bp, Homo sapiens
caagctccgcaggactt

SEQ ID NO: 1371728 - DNA, 16 bp, Homo sapiens
caaggcctgctccctg

SEQ ID NO: 1371729 - DNA, 14 bp, Homo sapiens
caaggctatgtgat

SEQ ID NO: 1371730 - DNA, 12 bp, Homo sapiens
caagggaaaggg

SEQ ID NO: 1371731 - DNA, 20 bp, Homo sapiens
atgtataaaatacatagtga

SEQ ID NO: 1371732 - DNA, 22 bp, Homo sapiens
atgtataaaatacatagtgaaa

SEQ ID NO: 1371733 - DNA, 16 bp, Homo sapiens
atgtataaatatacag

SEQ ID NO: 1371734 - DNA, 17 bp, Homo sapiens
atgtataaatatacagt

SEQ ID NO: 1371735 - DNA, 18 bp, Homo sapiens
atgtatgtgtttagaatt

SEQ ID NO: 1371736 - DNA, 14 bp, Homo sapiens
atgtatgtttctct

SEQ ID NO: 1371737 - DNA, 15 bp, Homo sapiens
atgtcaaaagtagaa

SEQ ID NO: 1371738 - DNA, 20 bp, Homo sapiens
atgtcaaaagtagaactttg

SEQ ID NO: 1371739 - DNA, 21 bp, Homo sapiens
atgtcaaacatgagatgtgtg

SEQ ID NO: 1371740 - DNA, 16 bp, Homo sapiens
atgtcaagtaccaaaa

SEQ ID NO: 1371741 - DNA, 16 bp, Homo sapiens
atgtcaatttctgtgt

SEQ ID NO: 1371742 - DNA, 17 bp, Homo sapiens
atgtcatttcagaagtt

SEQ ID NO: 1371743 - DNA, 22 bp, Homo sapiens
atgtccaaagaggctgcccctc

SEQ ID NO: 1371744 - DNA, 20 bp, Homo sapiens
atgtccagtaagatcactgt

SEQ ID NO: 1371745 - DNA, 16 bp, Homo sapiens
atgtcctaatggtgat

SEQ ID NO: 1371746 - DNA, 22 bp, Homo sapiens
atgtctttttattaaaatattt

SEQ ID NO: 1371747 - DNA, 20 bp, Homo sapiens
atgtgaattattgacactga

SEQ ID NO: 1371748 - DNA, 17 bp, Homo sapiens
atgtgaatttttaagct

SEQ ID NO: 1371749 - DNA, 19 bp, Homo sapiens
atgtgaatttttaagctgc

SEQ ID NO: 1371750 - DNA, 21 bp, Homo sapiens
atgtgaatttttaagctgcaa

SEQ ID NO: 1371751 - DNA, 21 bp, Homo sapiens
atgtgacaattttgtacaaat

SEQ ID NO: 1371752 - DNA, 21 bp, Homo sapiens
atgtgacattaacaaataaaa

SEQ ID NO: 1371753 - DNA, 12 bp, Homo sapiens
atgtgaccctcc

SEQ ID NO: 1371754 - DNA, 14 bp, Homo sapiens
atgtgaccctccaa

SEQ ID NO: 1371755 - DNA, 14 bp, Homo sapiens
atgtgagaagccag

SEQ ID NO: 1371756 - DNA, 19 bp, Homo sapiens
atgtgaggggtccctagca

SEQ ID NO: 1371757 - DNA, 19 bp, Homo sapiens
atgtgagtggttgaatatg

SEQ ID NO: 1371758 - DNA, 22 bp, Homo sapiens
atgtgatacattttttaagctt

SEQ ID NO: 1371759 - DNA, 18 bp, Homo sapiens
atgtgatggacactccag

SEQ ID NO: 1371760 - DNA, 18 bp, Homo sapiens
atgtgcaaaaccttttac

SEQ ID NO: 1371761 - DNA, 21 bp, Homo sapiens
atgtgcaaaaccttttactgg

SEQ ID NO: 1371762 - DNA, 16 bp, Homo sapiens
atgtgcatagtttctt

SEQ ID NO: 1371763 - DNA, 20 bp, Homo sapiens
atgtggcctttgaattctgt

SEQ ID NO: 1371764 - DNA, 13 bp, Homo sapiens
atgtggctggaag

SEQ ID NO: 1371765 - DNA, 14 bp, Homo sapiens
atgtggctggaaga

SEQ ID NO: 1371766 - DNA, 17 bp, Homo sapiens
atgtgggatattgaatg

SEQ ID NO: 1371767 - DNA, 19 bp, Homo sapiens
atgtgggatattgaatgtt

SEQ ID NO: 1371768 - DNA, 14 bp, Homo sapiens
atgtgtgttttttc

SEQ ID NO: 1371769 - DNA, 12 bp, Homo sapiens
atgtgtttagaa

SEQ ID NO: 1371770 - DNA, 20 bp, Homo sapiens
atgttacaagtttatatata

SEQ ID NO: 1371771 - DNA, 14 bp, Homo sapiens
atgttacctctgaa

SEQ ID NO: 1371772 - DNA, 17 bp, Homo sapiens
atgttactctcttgcac

SEQ ID NO: 1371773 - DNA, 14 bp, Homo sapiens
atgttagagtaatg

SEQ ID NO: 1371774 - DNA, 15 bp, Homo sapiens
atgttattagatgtt

SEQ ID NO: 1371775 - DNA, 16 bp, Homo sapiens
atgttcagattattgg

SEQ ID NO: 1371776 - DNA, 20 bp, Homo sapiens
atgttgggaaacttggctcg

SEQ ID NO: 1371777 - DNA, 12 bp, Homo sapiens
atgttgggactg

SEQ ID NO: 1371778 - DNA, 19 bp, Homo sapiens
atgttgtagtgtcccccac

SEQ ID NO: 1371779 - DNA, 23 bp, Homo sapiens
atgtttatatctgcaaaaaacct

SEQ ID NO: 1371780 - DNA, 20 bp, Homo sapiens
atgtttcctctagttctttg

SEQ ID NO: 1371781 - DNA, 18 bp, Homo sapiens
atgtttgaatttttctct

SEQ ID NO: 1371782 - DNA, 17 bp, Homo sapiens
atgtttggcatgtaaat

SEQ ID NO: 1371783 - DNA, 15 bp, Homo sapiens
atgtttttatacaaa

SEQ ID NO: 1371784 - DNA, 16 bp, Homo sapiens
attaaaaaagagacat

SEQ ID NO: 1371785 - DNA, 12 bp, Homo sapiens
attaaaatattt

SEQ ID NO: 1371786 - DNA, 14 bp, Homo sapiens
attaaaatatttca

SEQ ID NO: 1371787 - DNA, 19 bp, Homo sapiens
attaaatacatatggatgt

SEQ ID NO: 1371788 - DNA, 14 bp, Homo sapiens
attaaattctgagc

SEQ ID NO: 1371789 - DNA, 14 bp, Homo sapiens
attaagcaaatgtt

SEQ ID NO: 1371790 - DNA, 20 bp, Homo sapiens
attaatatatgtattattta

SEQ ID NO: 1371791 - DNA, 12 bp, Homo sapiens
attaatatttaa

SEQ ID NO: 1371792 - DNA, 12 bp, Homo sapiens
attaatcactgt

SEQ ID NO: 1371793 - DNA, 17 bp, Homo sapiens
attaatcactgtgtata

SEQ ID NO: 1371794 - DNA, 18 bp, Homo sapiens
attaatcactgtgtatat

SEQ ID NO: 1371795 - DNA, 21 bp, Homo sapiens
attaatcactgtgtatatttg

SEQ ID NO: 1371796 - DNA, 22 bp, Homo sapiens
attaatcactgtgtatatttga

SEQ ID NO: 1371797 - DNA, 17 bp, Homo sapiens
attaatgttttcaaaag

SEQ ID NO: 1371798 - DNA, 18 bp, Homo sapiens
attaattgtgtgaacttg

SEQ ID NO: 1371799 - DNA, 20 bp, Homo sapiens
attaattgtgtgaacttgga

SEQ ID NO: 1371800 - DNA, 21 bp, Homo sapiens
attaattgtgtgaacttggaa

SEQ ID NO: 1371801 - DNA, 15 bp, Homo sapiens
attaatttgcatctg

SEQ ID NO: 1371802 - DNA, 21 bp, Homo sapiens
attaatttgcatctgaaatag

SEQ ID NO: 1371803 - DNA, 13 bp, Homo sapiens
attacaaaaacaa

SEQ ID NO: 1371804 - DNA, 13 bp, Homo sapiens
attacaaagttaa

SEQ ID NO: 1371805 - DNA, 14 bp, Homo sapiens
attacaattttatc

SEQ ID NO: 1371806 - DNA, 21 bp, Homo sapiens
attacagaggtattaaaacta

SEQ ID NO: 1371807 - DNA, 16 bp, Homo sapiens
attacatgtaatttga

SEQ ID NO: 1371808 - DNA, 19 bp, Homo sapiens
attacattgctttttcttg

SEQ ID NO: 1371809 - DNA, 18 bp, Homo sapiens
attacatttatttatcca

SEQ ID NO: 1371810 - DNA, 21 bp, Homo sapiens
attaccccctccttcagacac

SEQ ID NO: 1371811 - DNA, 17 bp, Homo sapiens
attacgaagttcaagat

SEQ ID NO: 1371812 - DNA, 15 bp, Homo sapiens
attactgacatttct

SEQ ID NO: 1371813 - DNA, 15 bp, Homo sapiens
attactgccttgaaa

SEQ ID NO: 1371814 - DNA, 16 bp, Homo sapiens
attacttccatgaatt

SEQ ID NO: 1371815 - DNA, 15 bp, Homo sapiens
attacttgttgccta

SEQ ID NO: 1371816 - DNA, 17 bp, Homo sapiens
attacttgttgcctata

SEQ ID NO: 1371817 - DNA, 15 bp, Homo sapiens
attagaagacaacag

SEQ ID NO: 1371818 - DNA, 14 bp, Homo sapiens
attagagaacatcc

SEQ ID NO: 1371819 - DNA, 23 bp, Homo sapiens
attaggtgatcccgttttcccca

SEQ ID NO: 1371820 - DNA, 19 bp, Homo sapiens
attagtgttatatgaacat

SEQ ID NO: 1371821 - DNA, 19 bp, Homo sapiens
attataataaatatataca

SEQ ID NO: 1371822 - DNA, 18 bp, Homo sapiens
attataatcttataattg

SEQ ID NO: 1371823 - DNA, 22 bp, Homo sapiens
attatacatgtgatacattttt

SEQ ID NO: 1371824 - DNA, 17 bp, Homo sapiens
attatataactgtattt

SEQ ID NO: 1371825 - DNA, 22 bp, Homo sapiens
attatcaaagggataaagaaaa

SEQ ID NO: 1371826 - DNA, 20 bp, Homo sapiens
attatcttgatacattcaaa

SEQ ID NO: 1371827 - DNA, 23 bp, Homo sapiens
attatcttgatacattcaaattt

SEQ ID NO: 1371828 - DNA, 15 bp, Homo sapiens
attatggaaaactgt

SEQ ID NO: 1371829 - DNA, 22 bp, Homo sapiens
attattatcaggggagaaaaat

SEQ ID NO: 1371830 - DNA, 12 bp, Homo sapiens
attattctctgc

SEQ ID NO: 1371831 - DNA, 15 bp, Homo sapiens
attattgacactgaa

SEQ ID NO: 1371832 - DNA, 14 bp, Homo sapiens
attatttaagacta

SEQ ID NO: 1371833 - DNA, 13 bp, Homo sapiens
attatttatatgg

SEQ ID NO: 1371834 - DNA, 15 bp, Homo sapiens
attatttgattattt

SEQ ID NO: 1371835 - DNA, 19 bp, Homo sapiens
attatttgattatttaaga

SEQ ID NO: 1371836 - DNA, 14 bp, Homo sapiens
attatttgcatgtt

SEQ ID NO: 1371837 - DNA, 17 bp, Homo sapiens
attatttgcatgttatg

SEQ ID NO: 1371838 - DNA, 19 bp, Homo sapiens
attatttttttaaaatttt

SEQ ID NO: 1371839 - DNA, 15 bp, Homo sapiens
attcaactttgtaaa

SEQ ID NO: 1371840 - DNA, 12 bp, Homo sapiens
attcactcccac

SEQ ID NO: 1371841 - DNA, 13 bp, Homo sapiens
attcactcccaca

SEQ ID NO: 1371842 - DNA, 15 bp, Homo sapiens
attcagacatctgag

SEQ ID NO: 1371843 - DNA, 18 bp, Homo sapiens
attcagtaactgtcaggc

SEQ ID NO: 1371844 - DNA, 17 bp, Homo sapiens
attcatctgtctatatt

SEQ ID NO: 1371845 - DNA, 18 bp, Homo sapiens
attcatctgtctatattt

SEQ ID NO: 1371846 - DNA, 12 bp, Homo sapiens
attcatttctaa

SEQ ID NO: 1371847 - DNA, 16 bp, Homo sapiens
attccactacacctgg

SEQ ID NO: 1371848 - DNA, 17 bp, Homo sapiens
attccactacacctggc

SEQ ID NO: 1371849 - DNA, 18 bp, Homo sapiens
attccactacacctggct

SEQ ID NO: 1371850 - DNA, 13 bp, Homo sapiens
atttcaaaatata

SEQ ID NO: 1371851 - DNA, 19 bp, Homo sapiens
atttcaaagttttgttgta

SEQ ID NO: 1371852 - DNA, 18 bp, Homo sapiens
atttcagaaaatgaaaaa

SEQ ID NO: 1371853 - DNA, 12 bp, Homo sapiens
atttcagaagtt

SEQ ID NO: 1371854 - DNA, 19 bp, Homo sapiens
atttcagaagttagtttgt

SEQ ID NO: 1371855 - DNA, 15 bp, Homo sapiens
atttcagggtgcagc

SEQ ID NO: 1371856 - DNA, 19 bp, Homo sapiens
atttcatcacaagaacaca

SEQ ID NO: 1371857 - DNA, 14 bp, Homo sapiens
atttcccatctgca

SEQ ID NO: 1371858 - DNA, 15 bp, Homo sapiens
atttcccatctgcac

SEQ ID NO: 1371859 - DNA, 22 bp, Homo sapiens
atttcccatttgtgccagagga

SEQ ID NO: 1371860 - DNA, 23 bp, Homo sapiens
atttcccctctgcacccagaaca

SEQ ID NO: 1371861 - DNA, 17 bp, Homo sapiens
atttcctttttgacact

SEQ ID NO: 1371862 - DNA, 19 bp, Homo sapiens
atttcctttttgacactga

SEQ ID NO: 1371863 - DNA, 14 bp, Homo sapiens
atttctagaaacaa

SEQ ID NO: 1371864 - DNA, 14 bp, Homo sapiens
atttctataaatag

SEQ ID NO: 1371865 - DNA, 17 bp, Homo sapiens
atttctcattgactttt

SEQ ID NO: 1371866 - DNA, 14 bp, Homo sapiens
atttctcctccctt

SEQ ID NO: 1371867 - DNA, 16 bp, Homo sapiens
atttcttatgtgacat

SEQ ID NO: 1371868 - DNA, 21 bp, Homo sapiens
atttcttatgtgacattaaca

SEQ ID NO: 1371869 - DNA, 15 bp, Homo sapiens
atttcttcagggctg

SEQ ID NO: 1371870 - DNA, 16 bp, Homo sapiens
atttctttttttcctt

SEQ ID NO: 1371871 - DNA, 15 bp, Homo sapiens
atttgaaaaatataa

SEQ ID NO: 1371872 - DNA, 19 bp, Homo sapiens
atttgaacaatgaagttga

SEQ ID NO: 1371873 - DNA, 20 bp, Homo sapiens
atttgaacaatgaagttgaa

SEQ ID NO: 1371874 - DNA, 14 bp, Homo sapiens
atttgaagggtctt

SEQ ID NO: 1371875 - DNA, 17 bp, Homo sapiens
atttgactaattttaca

SEQ ID NO: 1371876 - DNA, 23 bp, Homo sapiens
atttgagaatagacccttactag

SEQ ID NO: 1371877 - DNA, 18 bp, Homo sapiens
atttgattgggatgaatg

SEQ ID NO: 1371878 - DNA, 16 bp, Homo sapiens
atttgcaataacagct

SEQ ID NO: 1371879 - DNA, 19 bp, Homo sapiens
atttgcaataacagctgca

SEQ ID NO: 1371880 - DNA, 15 bp, Homo sapiens
atttgcatctgaaat

SEQ ID NO: 1371881 - DNA, 12 bp, Homo sapiens
atttgcatgtta

SEQ ID NO: 1371882 - DNA, 13 bp, Homo sapiens
atttgcatgttat

SEQ ID NO: 1371883 - DNA, 15 bp, Homo sapiens
atttgccatagagta

SEQ ID NO: 1371884 - DNA, 13 bp, Homo sapiens
atttgtaaattta

SEQ ID NO: 1371885 - DNA, 16 bp, Homo sapiens
atttgtaaatttagtg

SEQ ID NO: 1371886 - DNA, 20 bp, Homo sapiens
atttgtaaatttagtgtttt

SEQ ID NO: 1371887 - DNA, 14 bp, Homo sapiens
atttgtgccagagg

SEQ ID NO: 1371888 - DNA, 14 bp, Homo sapiens
atttgttaaaatta

SEQ ID NO: 1371889 - DNA, 11 bp, Homo sapiens
atttgttgcat

SEQ ID NO: 1371890 - DNA, 13 bp, Homo sapiens
attttaaaacaat

SEQ ID NO: 1371891 - DNA, 22 bp, Homo sapiens
attttaaaatctgagggaaatg

SEQ ID NO: 1371892 - DNA, 17 bp, Homo sapiens
attttaaagtgcaaaag

SEQ ID NO: 1371893 - DNA, 19 bp, Homo sapiens
attttaacttaactgaaat

SEQ ID NO: 1371894 - DNA, 15 bp, Homo sapiens
attttacacagaaac

SEQ ID NO: 1371895 - DNA, 18 bp, Homo sapiens
attttacacagaaacact

SEQ ID NO: 1371896 - DNA, 13 bp, Homo sapiens
attttacagagcg

SEQ ID NO: 1371897 - DNA, 18 bp, Homo sapiens
attttacagctcattaaa

SEQ ID NO: 1371898 - DNA, 17 bp, Homo sapiens
attttacctagctaatt

SEQ ID NO: 1371899 - DNA, 19 bp, Homo sapiens
attttacctagctaattat

SEQ ID NO: 1371900 - DNA, 22 bp, Homo sapiens
attttacctagctaattattta

SEQ ID NO: 1371901 - DNA, 12 bp, Homo sapiens
attttcaagtaa

SEQ ID NO: 1371902 - DNA, 13 bp, Homo sapiens
attttcagagccg

SEQ ID NO: 1371903 - DNA, 19 bp, Homo sapiens
attttcagcattaagctgt

SEQ ID NO: 1371904 - DNA, 17 bp, Homo sapiens
attttcatgaaaatacc

SEQ ID NO: 1371905 - DNA, 20 bp, Homo sapiens
attttcatgaaaataccatt

SEQ ID NO: 1371906 - DNA, 21 bp, Homo sapiens
attttcatgaaaataccattt

SEQ ID NO: 1371907 - DNA, 17 bp, Homo sapiens
attttccaaatgtaata

SEQ ID NO: 1371908 - DNA, 21 bp, Homo sapiens
attttccatttttatttcaaa

SEQ ID NO: 1371909 - DNA, 15 bp, Homo sapiens
attttcctcttgtga

SEQ ID NO: 1371910 - DNA, 16 bp, Homo sapiens
attttctattttaaga

SEQ ID NO: 1371911 - DNA, 14 bp, Homo sapiens
attttctctgtact

SEQ ID NO: 1371912 - DNA, 17 bp, Homo sapiens
attttctctgtactttt

SEQ ID NO: 1371913 - DNA, 17 bp, Homo sapiens
attttgaaaagtaatat

SEQ ID NO: 1371914 - DNA, 21 bp, Homo sapiens
attttgaaaagtaatatttat

SEQ ID NO: 1371915 - DNA, 11 bp, Homo sapiens
attttgaatca

SEQ ID NO: 1371916 - DNA, 14 bp, Homo sapiens
attttgaatcaata

SEQ ID NO: 1371917 - DNA, 19 bp, Homo sapiens
attttgctatcaacaataa

SEQ ID NO: 1371918 - DNA, 19 bp, Homo sapiens
attttggagattataataa

SEQ ID NO: 1371919 - DNA, 12 bp, Homo sapiens
attttgtaagaa

SEQ ID NO: 1371920 - DNA, 17 bp, Homo sapiens
attttgtaagaaggcaa

SEQ ID NO: 1371921 - DNA, 10 bp, Homo sapiens
attttgtatg

SEQ ID NO: 1371922 - DNA, 19 bp, Homo sapiens
atttttaaaaaatattttc

SEQ ID NO: 1371923 - DNA, 23 bp, Homo sapiens
atttttaaaaaatattttctctg

SEQ ID NO: 1371924 - DNA, 23 bp, Homo sapiens
atttttagaataagaatttgcat

SEQ ID NO: 1371925 - DNA, 24 bp, Homo sapiens
atttttagaataagaatttgcata

SEQ ID NO: 1371926 - DNA, 13 bp, Homo sapiens
atttttatagcaa

SEQ ID NO: 1371927 - DNA, 13 bp, Homo sapiens
atttttatatcat

SEQ ID NO: 1371928 - DNA, 17 bp, Homo sapiens
atttttatatcatgcaa

SEQ ID NO: 1371929 - DNA, 22 bp, Homo sapiens
atttttatatcatgcaaaatat

SEQ ID NO: 1371930 - DNA, 14 bp, Homo sapiens
atttttatatttcc

SEQ ID NO: 1371931 - DNA, 17 bp, Homo sapiens
atttttatatttccttt

SEQ ID NO: 1371932 - DNA, 14 bp, Homo sapiens
atttttatttcaaa

SEQ ID NO: 1371933 - DNA, 20 bp, Homo sapiens
atttttcaatagcacatatg

SEQ ID NO: 1371934 - DNA, 18 bp, Homo sapiens
atttttcaatatattgaa

SEQ ID NO: 1371935 - DNA, 15 bp, Homo sapiens
atttttcataaacaa

SEQ ID NO: 1371936 - DNA, 10 bp, Homo sapiens
atttttctct

SEQ ID NO: 1371937 - DNA, 19 bp, Homo sapiens
atttttgcaataccaagta

SEQ ID NO: 1371938 - DNA, 19 bp, Homo sapiens
atttttgtaaatgtgtaca

SEQ ID NO: 1371939 - DNA, 12 bp, Homo sapiens
atttttgttgtt

SEQ ID NO: 1371940 - DNA, 21 bp, Homo sapiens
attttttaagcttcagttgct

SEQ ID NO: 1371941 - DNA, 14 bp, Homo sapiens
attttttaattgtt

SEQ ID NO: 1371942 - DNA, 16 bp, Homo sapiens
attttttgaaaagcag

SEQ ID NO: 1371943 - DNA, 23 bp, Homo sapiens
attttttgactttttttgtatgt

SEQ ID NO: 1371944 - DNA, 13 bp, Homo sapiens
atttttttctatt

SEQ ID NO: 1371945 - DNA, 21 bp, Homo sapiens
atttttttgaactcttctcat

SEQ ID NO: 1371946 - DNA, 17 bp, Homo sapiens
caagggctgtcattgca

SEQ ID NO: 1371947 - DNA, 14 bp, Homo sapiens
caaggtataataaa

SEQ ID NO: 1371948 - DNA, 20 bp, Homo sapiens
caaggtcactgtttcctggg

SEQ ID NO: 1371949 - DNA, 17 bp, Homo sapiens
caaggttataatttttt

SEQ ID NO: 1371950 - DNA, 13 bp, Homo sapiens
caagtagttctgt

SEQ ID NO: 1371951 - DNA, 21 bp, Homo sapiens
caagtagttctgtatttgaaa

SEQ ID NO: 1371952 - DNA, 13 bp, Homo sapiens
caagtcaagtgaa

SEQ ID NO: 1371953 - DNA, 15 bp, Homo sapiens
caagtcagctccagc

SEQ ID NO: 1371954 - DNA, 13 bp, Homo sapiens
caagtgaaattat

SEQ ID NO: 1371955 - DNA, 14 bp, Homo sapiens
caagtgagaccctg

SEQ ID NO: 1371956 - DNA, 15 bp, Homo sapiens
caagtgagaccctgt

SEQ ID NO: 1371957 - DNA, 19 bp, Homo sapiens
caagtgagaccctgtctca

SEQ ID NO: 1371958 - DNA, 21 bp, Homo sapiens
caagtggaccttaggccttcc

SEQ ID NO: 1371959 - DNA, 23 bp, Homo sapiens
caagtggaccttaggccttcctc

SEQ ID NO: 1371960 - DNA, 16 bp, Homo sapiens
caagtgtaaaatattt

SEQ ID NO: 1371961 - DNA, 16 bp, Homo sapiens
caagtgtgaatactgc

SEQ ID NO: 1371962 - DNA, 14 bp, Homo sapiens
caataaaatttaaa

SEQ ID NO: 1371963 - DNA, 20 bp, Homo sapiens
caataaaatttaaaaaataa

SEQ ID NO: 1371964 - DNA, 20 bp, Homo sapiens
caataaaatttttttaaagt

SEQ ID NO: 1371965 - DNA, 19 bp, Homo sapiens
caataaaccctcagagcct

SEQ ID NO: 1371966 - DNA, 13 bp, Homo sapiens
caataaagcttgt

SEQ ID NO: 1371967 - DNA, 17 bp, Homo sapiens
caataaagcttgttgac

SEQ ID NO: 1371968 - DNA, 22 bp, Homo sapiens
caataaattttgaaaagtaata

SEQ ID NO: 1371969 - DNA, 13 bp, Homo sapiens
caataacagctgc

SEQ ID NO: 1371970 - DNA, 17 bp, Homo sapiens
caatagcacatatggaa

SEQ ID NO: 1371971 - DNA, 15 bp, Homo sapiens
caataggctgttccc

SEQ ID NO: 1371972 - DNA, 17 bp, Homo sapiens
caatatctaatatatat

SEQ ID NO: 1371973 - DNA, 16 bp, Homo sapiens
caatattgattgggaa

SEQ ID NO: 1371974 - DNA, 17 bp, Homo sapiens
caatattgattgggaaa

SEQ ID NO: 1371975 - DNA, 19 bp, Homo sapiens
caatatttgaattttaaat

SEQ ID NO: 1371976 - DNA, 16 bp, Homo sapiens
caatatttgttactgt

SEQ ID NO: 1371977 - DNA, 16 bp, Homo sapiens
caatatttttatatca

SEQ ID NO: 1371978 - DNA, 23 bp, Homo sapiens
caatatttttatatcatgcaaaa

SEQ ID NO: 1371979 - DNA, 23 bp, Homo sapiens
caatcaaataagtatttataata

SEQ ID NO: 1371980 - DNA, 18 bp, Homo sapiens
caatcaaggttataattt

SEQ ID NO: 1371981 - DNA, 21 bp, Homo sapiens
caatcctgattcctctctaag

SEQ ID NO: 1371982 - DNA, 19 bp, Homo sapiens
caatctattgcttcaccat

SEQ ID NO: 1371983 - DNA, 15 bp, Homo sapiens
caatctcttcattat

SEQ ID NO: 1371984 - DNA, 22 bp, Homo sapiens
caatctcttcattattctctgc

SEQ ID NO: 1371985 - DNA, 14 bp, Homo sapiens
caatcttactttgt

SEQ ID NO: 1371986 - DNA, 19 bp, Homo sapiens
caatcttactttgtaaatt

SEQ ID NO: 1371987 - DNA, 23 bp, Homo sapiens
caatcttactttgtaaattctga

SEQ ID NO: 1371988 - DNA, 21 bp, Homo sapiens
caatgaagttgaaaatcatag

SEQ ID NO: 1371989 - DNA, 13 bp, Homo sapiens
caatgagagcata

SEQ ID NO: 1371990 - DNA, 20 bp, Homo sapiens
caatgatcaccgactgaaaa

SEQ ID NO: 1371991 - DNA, 22 bp, Homo sapiens
caatgattgttaatttacagct

SEQ ID NO: 1371992 - DNA, 14 bp, Homo sapiens
caatgctgatttgg

SEQ ID NO: 1371993 - DNA, 21 bp, Homo sapiens
caatgctgatttggtgaccaa

SEQ ID NO: 1371994 - DNA, 18 bp, Homo sapiens
caatgcttctagagtttt

SEQ ID NO: 1371995 - DNA, 17 bp, Homo sapiens
caatgctttatttgtaa

SEQ ID NO: 1371996 - DNA, 15 bp, Homo sapiens
caatgtgataaaacc

SEQ ID NO: 1371997 - DNA, 14 bp, Homo sapiens
caatgttctctctt

SEQ ID NO: 1371998 - DNA, 16 bp, Homo sapiens
caattctagtcatata

SEQ ID NO: 1371999 - DNA, 23 bp, Homo sapiens
caattctgtttttaatgctattt

SEQ ID NO: 1372000 - DNA, 16 bp, Homo sapiens
caattgtcacttttta

SEQ ID NO: 1372001 - DNA, 13 bp, Homo sapiens
caattgtcttttt

SEQ ID NO: 1372002 - DNA, 22 bp, Homo sapiens
caatttctgtgttgccaagctc

SEQ ID NO: 1372003 - DNA, 14 bp, Homo sapiens
cacaaatgacttta

SEQ ID NO: 1372004 - DNA, 15 bp, Homo sapiens
cacaaatgactttat

SEQ ID NO: 1372005 - DNA, 17 bp, Homo sapiens
cacaagctgcaccctca

SEQ ID NO: 1372006 - DNA, 23 bp, Homo sapiens
cacaagctgcaccctcaggcagg

SEQ ID NO: 1372007 - DNA, 11 bp, Homo sapiens
cacacacctgt

SEQ ID NO: 1372008 - DNA, 15 bp, Homo sapiens
cacacagcagcagtt

SEQ ID NO: 1372009 - DNA, 21 bp, Homo sapiens
cacaccaatcttactttgtaa

SEQ ID NO: 1372010 - DNA, 23 bp, Homo sapiens
cacaccaatcttactttgtaaat

SEQ ID NO: 1372011 - DNA, 22 bp, Homo sapiens
cacacccaaagctgagcctgca

SEQ ID NO: 1372012 - DNA, 15 bp, Homo sapiens
cacactggttctcaa

SEQ ID NO: 1372013 - DNA, 16 bp, Homo sapiens
cacactggttctcaat

SEQ ID NO: 1372014 - DNA, 11 bp, Homo sapiens
cacagaaacac

SEQ ID NO: 1372015 - DNA, 15 bp, Homo sapiens
cacagaaacactgcc

SEQ ID NO: 1372016 - DNA, 20 bp, Homo sapiens
cacagaaacactgccttttt

SEQ ID NO: 1372017 - DNA, 16 bp, Homo sapiens
cacagaatatttttat

SEQ ID NO: 1372018 - DNA, 12 bp, Homo sapiens
cacagaatgcaa

SEQ ID NO: 1372019 - DNA, 23 bp, Homo sapiens
cacagagcaagagataagtcttt

SEQ ID NO: 1372020 - DNA, 22 bp, Homo sapiens
cacagagctttggtctgtgtgt

SEQ ID NO: 1372021 - DNA, 16 bp, Homo sapiens
cacagagtcaaggcct

SEQ ID NO: 1372022 - DNA, 22 bp, Homo sapiens
cacagcaacgatcacaaatgac

SEQ ID NO: 1372023 - DNA, 20 bp, Homo sapiens
cacagcctagcacagcagct

SEQ ID NO: 1372024 - DNA, 11 bp, Homo sapiens
cacagcctctg

SEQ ID NO: 1372025 - DNA, 12 bp, Homo sapiens
cacagcctgggc

SEQ ID NO: 1372026 - DNA, 21 bp, Homo sapiens
cacagcctgggccccagctcg

SEQ ID NO: 1372027 - DNA, 19 bp, Homo sapiens
cacagcgagggcagctgct

SEQ ID NO: 1372028 - DNA, 21 bp, Homo sapiens
cacagcggaggtgtggagccg

SEQ ID NO: 1372029 - DNA, 14 bp, Homo sapiens
cacagcgtccctgg

SEQ ID NO: 1372030 - DNA, 15 bp, Homo sapiens
cacagcgtccctggc

SEQ ID NO: 1372031 - DNA, 16 bp, Homo sapiens
cacagcgtccctggcg

SEQ ID NO: 1372032 - DNA, 22 bp, Homo sapiens
cacagcgtccctggcgcaggtg

SEQ ID NO: 1372033 - DNA, 15 bp, Homo sapiens
cacaggaccctcgcc

SEQ ID NO: 1372034 - DNA, 21 bp, Homo sapiens
cacaggaggcaggcatggccc

SEQ ID NO: 1372035 - DNA, 18 bp, Homo sapiens
cacagtctccggcctctc

SEQ ID NO: 1372036 - DNA, 17 bp, Homo sapiens
cacagtttttcctggaa

SEQ ID NO: 1372037 - DNA, 14 bp, Homo sapiens
cacatcaaataaga

SEQ ID NO: 1372038 - DNA, 18 bp, Homo sapiens
cacatcaaataagaaata

SEQ ID NO: 1372039 - DNA, 23 bp, Homo sapiens
cacatccgcgtgtgcctgtgtgc

SEQ ID NO: 1372040 - DNA, 13 bp, Homo sapiens
cacatctgcctta

SEQ ID NO: 1372041 - DNA, 20 bp, Homo sapiens
cacatgactcgggggtgggg

SEQ ID NO: 1372042 - DNA, 13 bp, Homo sapiens
cacattgaagaat

SEQ ID NO: 1372043 - DNA, 23 bp, Homo sapiens
cacattgaagaatgttagagtaa

SEQ ID NO: 1372044 - DNA, 21 bp, Homo sapiens
cacatttgctactgttgtaag

SEQ ID NO: 1372045 - DNA, 17 bp, Homo sapiens
caccaatcttactttgt

SEQ ID NO: 1372046 - DNA, 14 bp, Homo sapiens
caccacccctacca

SEQ ID NO: 1372047 - DNA, 22 bp, Homo sapiens
caccagcccatcgccacaaact

SEQ ID NO: 1372048 - DNA, 12 bp, Homo sapiens
caccagccccac

SEQ ID NO: 1372049 - DNA, 20 bp, Homo sapiens
caccagccccactgccagca

SEQ ID NO: 1372050 - DNA, 15 bp, Homo sapiens
caccaggccacctcc

SEQ ID NO: 1372051 - DNA, 22 bp, Homo sapiens
caccaggccacctccccagcat

SEQ ID NO: 1372052 - DNA, 15 bp, Homo sapiens
caccatcaatcctga

SEQ ID NO: 1372053 - DNA, 16 bp, Homo sapiens
cacccaaagctgagcc

SEQ ID NO: 1372054 - DNA, 22 bp, Homo sapiens
cacccaaccctatctcctgaca

SEQ ID NO: 1372055 - DNA, 11 bp, Homo sapiens
caccccaggac

SEQ ID NO: 1372056 - DNA, 18 bp, Homo sapiens
caccccaggacgccactc

SEQ ID NO: 1372057 - DNA, 21 bp, Homo sapiens
cacccccagccccgactccag

SEQ ID NO: 1372058 - DNA, 23 bp, Homo sapiens
cacccccagccccgactccagcc

SEQ ID NO: 1372059 - DNA, 15 bp, Homo sapiens
caccccctcccaccc

SEQ ID NO: 1372060 - DNA, 16 bp, Homo sapiens
caccccctcccacccc

SEQ ID NO: 1372061 - DNA, 13 bp, Homo sapiens
caccccctgccct

SEQ ID NO: 1372062 - DNA, 14 bp, Homo sapiens
caccccctgccctg

SEQ ID NO: 1372063 - DNA, 17 bp, Homo sapiens
caccccctgccctgcac

SEQ ID NO: 1372064 - DNA, 20 bp, Homo sapiens
caccccggggaccctgtgac

SEQ ID NO: 1372065 - DNA, 20 bp, Homo sapiens
cacccctcaacacctctgca

SEQ ID NO: 1372066 - DNA, 22 bp, Homo sapiens
aaaaatataaaattatgagatt

SEQ ID NO: 1372067 - DNA, 14 bp, Homo sapiens
aaaaatatcaaatt

SEQ ID NO: 1372068 - DNA, 16 bp, Homo sapiens
aaaaatatcaaattaa

SEQ ID NO: 1372069 - DNA, 23 bp, Homo sapiens
aaaaatattgtttctgcattcat

SEQ ID NO: 1372070 - DNA, 13 bp, Homo sapiens
aaaaatattttct

SEQ ID NO: 1372071 - DNA, 22 bp, Homo sapiens
aaaaatattttctctgtacttt

SEQ ID NO: 1372072 - DNA, 17 bp, Homo sapiens
aaaacaataggatgggc

SEQ ID NO: 1372073 - DNA, 16 bp, Homo sapiens
aaaacacatgttttta

SEQ ID NO: 1372074 - DNA, 21 bp, Homo sapiens
aaaacatcattcctttttatt

SEQ ID NO: 1372075 - DNA, 14 bp, Homo sapiens
ttgagctatgactt

SEQ ID NO: 1372076 - DNA, 22 bp, Homo sapiens
ttgagctcccacttctgccaga

SEQ ID NO: 1372077 - DNA, 11 bp, Homo sapiens
ttgagctgcct

SEQ ID NO: 1372078 - DNA, 15 bp, Homo sapiens
ttgagctgccttccc

SEQ ID NO: 1372079 - DNA, 21 bp, Homo sapiens
ttgaggccaagaatattgcaa

SEQ ID NO: 1372080 - DNA, 14 bp, Homo sapiens
ttgagggctgcagt

SEQ ID NO: 1372081 - DNA, 15 bp, Homo sapiens
ttgagggctgcagtt

SEQ ID NO: 1372082 - DNA, 13 bp, Homo sapiens
ttgagtattgttt

SEQ ID NO: 1372083 - DNA, 14 bp, Homo sapiens
ttgagtattgttta

SEQ ID NO: 1372084 - DNA, 22 bp, Homo sapiens
ttgagtattgtttaaaatgtaa

SEQ ID NO: 1372085 - DNA, 17 bp, Homo sapiens
ttgagtctgtactaaac

SEQ ID NO: 1372086 - DNA, 17 bp, Homo sapiens
ttgatacattcaaattt

SEQ ID NO: 1372087 - DNA, 21 bp, Homo sapiens
ttgatacattcaaatttgtct

SEQ ID NO: 1372088 - DNA, 21 bp, Homo sapiens
ttgatgatacaatgaacactt

SEQ ID NO: 1372089 - DNA, 12 bp, Homo sapiens
ttgatggctgcg

SEQ ID NO: 1372090 - DNA, 12 bp, Homo sapiens
ttgatgtcagca

SEQ ID NO: 1372091 - DNA, 16 bp, Homo sapiens
ttgattcagctctgca

SEQ ID NO: 1372092 - DNA, 19 bp, Homo sapiens
ttgattgggaaaacatttg

SEQ ID NO: 1372093 - DNA, 21 bp, Homo sapiens
ttgattggtgattaggtggtg

SEQ ID NO: 1372094 - DNA, 23 bp, Homo sapiens
ttcctgtccctgcgcctttcctt

SEQ ID NO: 1372095 - DNA, 19 bp, Homo sapiens
ttcctgttcagtaataaaa

SEQ ID NO: 1372096 - DNA, 20 bp, Homo sapiens
ttccttgagttgattcagct

SEQ ID NO: 1372097 - DNA, 20 bp, Homo sapiens
ttccttgtagcgactaaact

SEQ ID NO: 1372098 - DNA, 14 bp, Homo sapiens
ttcctttcccaagc

SEQ ID NO: 1372099 - DNA, 17 bp, Homo sapiens
ttccttttccctgcttc

SEQ ID NO: 1372100 - DNA, 18 bp, Homo sapiens
ttcctttttatttatatg

SEQ ID NO: 1372101 - DNA, 20 bp, Homo sapiens
ttcctttttatttatatgta

SEQ ID NO: 1372102 - DNA, 15 bp, Homo sapiens
ttcctttttgacact

SEQ ID NO: 1372103 - DNA, 18 bp, Homo sapiens
ttcctttttgacactgaa

SEQ ID NO: 1372104 - DNA, 22 bp, Homo sapiens
ttcgaaacctgggattcaggaa

SEQ ID NO: 1372105 - DNA, 19 bp, Homo sapiens
ttcgcgggtaactggggtt

SEQ ID NO: 1372106 - DNA, 22 bp, Homo sapiens
ttcgcgggtaactggggttgag

SEQ ID NO: 1372107 - DNA, 18 bp, Homo sapiens
ttcgtacataatactgaa

SEQ ID NO: 1372108 - DNA, 16 bp, Homo sapiens
ttctaagaaaagccta

SEQ ID NO: 1372109 - DNA, 21 bp, Homo sapiens
ttctaccacacagcagcagtt

SEQ ID NO: 1372110 - DNA, 20 bp, Homo sapiens
ttctaccggctttgccatgt

SEQ ID NO: 1372111 - DNA, 23 bp, Homo sapiens
ttctactgtcaaatgatgtgcaa

SEQ ID NO: 1372112 - DNA, 21 bp, Homo sapiens
ttctataaaactctgcatgta

SEQ ID NO: 1372113 - DNA, 17 bp, Homo sapiens
ttctataaatagatgct

SEQ ID NO: 1372114 - DNA, 19 bp, Homo sapiens
ttctatagcatcacttaaa

SEQ ID NO: 1372115 - DNA, 15 bp, Homo sapiens
ttctatcctctgtaa

SEQ ID NO: 1372116 - DNA, 18 bp, Homo sapiens
ttctattatggaaaactg

SEQ ID NO: 1372117 - DNA, 22 bp, Homo sapiens
ttctattttaagactgatttta

SEQ ID NO: 1372118 - DNA, 18 bp, Homo sapiens
tggcaataaattttgaaa

SEQ ID NO: 1372119 - DNA, 13 bp, Homo sapiens
tggcacacagcag

SEQ ID NO: 1372120 - DNA, 16 bp, Homo sapiens
tggcaccgcctcccca

SEQ ID NO: 1372121 - DNA, 14 bp, Homo sapiens
tggcactcgctgta

SEQ ID NO: 1372122 - DNA, 16 bp, Homo sapiens
tggcactggaccccag

SEQ ID NO: 1372123 - DNA, 15 bp, Homo sapiens
tggcactggatgcag

SEQ ID NO: 1372124 - DNA, 11 bp, Homo sapiens
tggcagcccag

SEQ ID NO: 1372125 - DNA, 12 bp, Homo sapiens
tggcagcccaga

SEQ ID NO: 1372126 - DNA, 18 bp, Homo sapiens
tggcaggggacaggagtc

SEQ ID NO: 1372127 - DNA, 15 bp, Homo sapiens
tggcataaattgcat

SEQ ID NO: 1372128 - DNA, 21 bp, Homo sapiens
tggcatcgcaccattctgact

SEQ ID NO: 1372129 - DNA, 17 bp, Homo sapiens
tggcatgtaaatgtaaa

SEQ ID NO: 1372130 - DNA, 13 bp, Homo sapiens
tggccacagcgcc

SEQ ID NO: 1372131 - DNA, 18 bp, Homo sapiens
tggccacagcgccagcct

SEQ ID NO: 1372132 - DNA, 18 bp, Homo sapiens
tggccactccgagaggtg

SEQ ID NO: 1372133 - DNA, 13 bp, Homo sapiens
tggccagagagcc

SEQ ID NO: 1372134 - DNA, 12 bp, Homo sapiens
tggccaggagca

SEQ ID NO: 1372135 - DNA, 13 bp, Homo sapiens
tggccccaccctg

SEQ ID NO: 1372136 - DNA, 22 bp, Homo sapiens
tggccccaccctgggccctggg

SEQ ID NO: 1372137 - DNA, 16 bp, Homo sapiens
tggccccagccctgct

SEQ ID NO: 1372138 - DNA, 21 bp, Homo sapiens
tggccccagccctgctgggga

SEQ ID NO: 1372139 - DNA, 16 bp, Homo sapiens
tggccccgtttctggt

SEQ ID NO: 1372140 - DNA, 13 bp, Homo sapiens
tggccctagactc

SEQ ID NO: 1372141 - DNA, 16 bp, Homo sapiens
tggccgcgctccgggc

SEQ ID NO: 1372142 - DNA, 13 bp, Homo sapiens
tggcctcatgtgg

SEQ ID NO: 1372143 - DNA, 19 bp, Homo sapiens
tggcctcatgtggctggaa

SEQ ID NO: 1372144 - DNA, 15 bp, Homo sapiens
tggcctcccctgcca

SEQ ID NO: 1372145 - DNA, 13 bp, Homo sapiens
tggcctctctagc

SEQ ID NO: 1372146 - DNA, 11 bp, Homo sapiens
tggcctgctgt

SEQ ID NO: 1372147 - DNA, 12 bp, Homo sapiens
tggcctgctgtg

SEQ ID NO: 1372148 - DNA, 16 bp, Homo sapiens
tggcctgtggctgtcg

SEQ ID NO: 1372149 - DNA, 20 bp, Homo sapiens
tggccttgtcctcagccagt

SEQ ID NO: 1372150 - DNA, 17 bp, Homo sapiens
tggcctttgtaagtgca

SEQ ID NO: 1372151 - DNA, 18 bp, Homo sapiens
tggcgccgtctccagggg

SEQ ID NO: 1372152 - DNA, 14 bp, Homo sapiens
tggcggccccagca

SEQ ID NO: 1372153 - DNA, 13 bp, Homo sapiens
tggctatcctgat

SEQ ID NO: 1372154 - DNA, 14 bp, Homo sapiens
tggctatcctgatt

SEQ ID NO: 1372155 - DNA, 18 bp, Homo sapiens
tggctcagacatgttttc

SEQ ID NO: 1372156 - DNA, 15 bp, Homo sapiens
tggctccaggccaaa

SEQ ID NO: 1372157 - DNA, 15 bp, Homo sapiens
tggctccggcctctg

SEQ ID NO: 1372158 - DNA, 19 bp, Homo sapiens
tggctccggcctctgcctt

SEQ ID NO: 1372159 - DNA, 20 bp, Homo sapiens
tggctcgaatctctgtgcct

SEQ ID NO: 1372160 - DNA, 19 bp, Homo sapiens
tggctctgagcgcctccat

SEQ ID NO: 1372161 - DNA, 16 bp, Homo sapiens
tggctgaaattctcct

SEQ ID NO: 1372162 - DNA, 19 bp, Homo sapiens
tggctgaaattctcctgga

SEQ ID NO: 1372163 - DNA, 20 bp, Homo sapiens
tggctgaaattctcctggag

SEQ ID NO: 1372164 - DNA, 21 bp, Homo sapiens
tggctgaaattctcctggagg

SEQ ID NO: 1372165 - DNA, 21 bp, Homo sapiens
tggctgaggttcctctgcctg

SEQ ID NO: 1372166 - DNA, 16 bp, Homo sapiens
tggctgctgcccccac

SEQ ID NO: 1372167 - DNA, 14 bp, Homo sapiens
tggctgctgttgct

SEQ ID NO: 1372168 - DNA, 21 bp, Homo sapiens
tggctggaagatcctgcgggt

SEQ ID NO: 1372169 - DNA, 16 bp, Homo sapiens
tggctgtaatcatttg

SEQ ID NO: 1372170 - DNA, 18 bp, Homo sapiens
tggctgtcaatgggacct

SEQ ID NO: 1372171 - DNA, 14 bp, Homo sapiens
tggcttctgtgatg

SEQ ID NO: 1372172 - DNA, 17 bp, Homo sapiens
tggcttctgtgatgagc

SEQ ID NO: 1372173 - DNA, 21 bp, Homo sapiens
tggcttctgtgatgagctgat

SEQ ID NO: 1372174 - DNA, 22 bp, Homo sapiens
tggcttctgtgatgagctgatc

SEQ ID NO: 1372175 - DNA, 13 bp, Homo sapiens
tggcttgtctata

SEQ ID NO: 1372176 - DNA, 12 bp, Homo sapiens
tggcttgttcat

SEQ ID NO: 1372177 - DNA, 22 bp, Homo sapiens
tggcttgttcatcatccagatg

SEQ ID NO: 1372178 - DNA, 23 bp, Homo sapiens
tgggaaagcgcggacgtgctggg

SEQ ID NO: 1372179 - DNA, 22 bp, Homo sapiens
tgggaagcccatcctgaccagc

SEQ ID NO: 1372180 - DNA, 16 bp, Homo sapiens
tgggaatgaggaaaat

SEQ ID NO: 1372181 - DNA, 14 bp, Homo sapiens
tgggaatgaggtgg

SEQ ID NO: 1372182 - DNA, 17 bp, Homo sapiens
tgggaatgaggtgggag

SEQ ID NO: 1372183 - DNA, 14 bp, Homo sapiens
tgggacccccgtgg

SEQ ID NO: 1372184 - DNA, 22 bp, Homo sapiens
tgggacccccgtggggcaggga

SEQ ID NO: 1372185 - DNA, 19 bp, Homo sapiens
tgggacctgccaggcaggg

SEQ ID NO: 1372186 - DNA, 18 bp, Homo sapiens
tgtggcctcttctgagct

SEQ ID NO: 1372187 - DNA, 11 bp, Homo sapiens
tgtggcctgca

SEQ ID NO: 1372188 - DNA, 17 bp, Homo sapiens
tgtggcctgcacagtga

SEQ ID NO: 1372189 - DNA, 19 bp, Homo sapiens
tgtggcgccgtctccaggg

SEQ ID NO: 1372190 - DNA, 16 bp, Homo sapiens
tgtgggcttgaccagg

SEQ ID NO: 1372191 - DNA, 13 bp, Homo sapiens
tgtggttcctctg

SEQ ID NO: 1372192 - DNA, 18 bp, Homo sapiens
tgtggtttactagcagga

SEQ ID NO: 1372193 - DNA, 12 bp, Homo sapiens
tgtggtttcatt

SEQ ID NO: 1372194 - DNA, 20 bp, Homo sapiens
tgtgtaaacaaaatgaagct

SEQ ID NO: 1372195 - DNA, 13 bp, Homo sapiens
tgtgtaatgaaaa

SEQ ID NO: 1372196 - DNA, 13 bp, Homo sapiens
tgtgtatatggta

SEQ ID NO: 1372197 - DNA, 15 bp, Homo sapiens
tgtgtatatttgatt

SEQ ID NO: 1372198 - DNA, 20 bp, Homo sapiens
tgtgtccatgcgctcagggc

SEQ ID NO: 1372199 - DNA, 23 bp, Homo sapiens
tgtgtggattgcctctgaaaagt

SEQ ID NO: 1372200 - DNA, 11 bp, Homo sapiens
tgtgtggcctg

SEQ ID NO: 1372201 - DNA, 14 bp, Homo sapiens
tgtgtggtagaaac

SEQ ID NO: 1372202 - DNA, 16 bp, Homo sapiens
tgtgtgtcccaggcag

SEQ ID NO: 1372203 - DNA, 19 bp, Homo sapiens
tgtgtgtcccaggcaggga

SEQ ID NO: 1372204 - DNA, 16 bp, Homo sapiens
tgtgtgtgacaattct

SEQ ID NO: 1372205 - DNA, 14 bp, Homo sapiens
tgtgtgtgtgtgca

SEQ ID NO: 1372206 - DNA, 14 bp, Homo sapiens
tgtgttaatttaag

SEQ ID NO: 1372207 - DNA, 19 bp, Homo sapiens
tgtgttgtctcttgagttt

SEQ ID NO: 1372208 - DNA, 18 bp, Homo sapiens
tgtgtttagaattgaagg

SEQ ID NO: 1372209 - DNA, 14 bp, Homo sapiens
tgtgtttatttcac

SEQ ID NO: 1372210 - DNA, 15 bp, Homo sapiens
tgttaaaagttttat

SEQ ID NO: 1372211 - DNA, 19 bp, Homo sapiens
tgttaatggatttcagaag

SEQ ID NO: 1372212 - DNA, 19 bp, Homo sapiens
tgttacaagtttatatata

SEQ ID NO: 1372213 - DNA, 14 bp, Homo sapiens
tgttacctctgaat

SEQ ID NO: 1372214 - DNA, 15 bp, Homo sapiens
tgttactgggccctg

SEQ ID NO: 1372215 - DNA, 15 bp, Homo sapiens
tgttactgtcttcag

SEQ ID NO: 1372216 - DNA, 21 bp, Homo sapiens
tgttaggattttcacattctt

SEQ ID NO: 1372217 - DNA, 15 bp, Homo sapiens
tgttatatgaacata

SEQ ID NO: 1372218 - DNA, 13 bp, Homo sapiens
tgttatcaaaata

SEQ ID NO: 1372219 - DNA, 17 bp, Homo sapiens
tgttatgtttaataagc

SEQ ID NO: 1372220 - DNA, 18 bp, Homo sapiens
tgttattttctgttgaag

SEQ ID NO: 1372221 - DNA, 16 bp, Homo sapiens
tgttcacaatatattt

SEQ ID NO: 1372222 - DNA, 20 bp, Homo sapiens
tgttcatagcccagtagacc

SEQ ID NO: 1372223 - DNA, 16 bp, Homo sapiens
tgttcatcatccagat

SEQ ID NO: 1372224 - DNA, 21 bp, Homo sapiens
tgttcggaaggggttcctcaa

SEQ ID NO: 1372225 - DNA, 20 bp, Homo sapiens
tgtagcaaccttctgcattc

SEQ ID NO: 1372226 - DNA, 19 bp, Homo sapiens
tgtagcacttactggtagg

SEQ ID NO: 1372227 - DNA, 22 bp, Homo sapiens
tgtagcagtgagtcatatctta

SEQ ID NO: 1372228 - DNA, 13 bp, Homo sapiens
tgtaggagacttg

SEQ ID NO: 1372229 - DNA, 22 bp, Homo sapiens
tgtaggagacttgccagagccg

SEQ ID NO: 1372230 - DNA, 14 bp, Homo sapiens
tgtaggtaagactg

SEQ ID NO: 1372231 - DNA, 14 bp, Homo sapiens
tgtagttctttaaa

SEQ ID NO: 1372232 - DNA, 17 bp, Homo sapiens
tgtagttctttaaactg

SEQ ID NO: 1372233 - DNA, 14 bp, Homo sapiens
tgtataaaatacat

SEQ ID NO: 1372234 - DNA, 14 bp, Homo sapiens
tgtataaatataca

SEQ ID NO: 1372235 - DNA, 19 bp, Homo sapiens
tgtataaatatacagtata

SEQ ID NO: 1372236 - DNA, 13 bp, Homo sapiens
tgtataatataaa

SEQ ID NO: 1372237 - DNA, 19 bp, Homo sapiens
tgtatagttatgtaaataa

SEQ ID NO: 1372238 - DNA, 14 bp, Homo sapiens
tgtatattggtttt

SEQ ID NO: 1372239 - DNA, 13 bp, Homo sapiens
tgtatattgtaat

SEQ ID NO: 1372240 - DNA, 14 bp, Homo sapiens
tgtatatttgattt

SEQ ID NO: 1372241 - DNA, 18 bp, Homo sapiens
tgtatcctggaacaatat

SEQ ID NO: 1372242 - DNA, 20 bp, Homo sapiens
tgtatgaaaaattggggagg

SEQ ID NO: 1372243 - DNA, 21 bp, Homo sapiens
tgtatgaaaaattggggagga

SEQ ID NO: 1372244 - DNA, 13 bp, Homo sapiens
tgtatgaaaacat

SEQ ID NO: 1372245 - DNA, 16 bp, Homo sapiens
tgtatgagtagccagg

SEQ ID NO: 1372246 - DNA, 15 bp, Homo sapiens
tgtatgtagaagcat

SEQ ID NO: 1372247 - DNA, 12 bp, Homo sapiens
tgtatgtgttta

SEQ ID NO: 1372248 - DNA, 15 bp, Homo sapiens
tgtatgttaaagaga

SEQ ID NO: 1372249 - DNA, 21 bp, Homo sapiens
tgtattatttacatttaatag

SEQ ID NO: 1372250 - DNA, 18 bp, Homo sapiens
tgtattcttttctcagtg

SEQ ID NO: 1372251 - DNA, 14 bp, Homo sapiens
tgtatttaacagaa

SEQ ID NO: 1372252 - DNA, 15 bp, Homo sapiens
tgtatttaacagaaa

SEQ ID NO: 1372253 - DNA, 17 bp, Homo sapiens
tgtatttgaaataagaa

SEQ ID NO: 1372254 - DNA, 14 bp, Homo sapiens
tgtattttgattat

SEQ ID NO: 1372255 - DNA, 17 bp, Homo sapiens
tgtcaaaagtagaactt

SEQ ID NO: 1372256 - DNA, 17 bp, Homo sapiens
tgtcaaatgatgtgcaa

SEQ ID NO: 1372257 - DNA, 19 bp, Homo sapiens
tgtcaaatgatgtgcaaaa

SEQ ID NO: 1372258 - DNA, 14 bp, Homo sapiens
tgtcacgaatatgg

SEQ ID NO: 1372259 - DNA, 23 bp, Homo sapiens
tgtcactcattgctgagcctctg

SEQ ID NO: 1372260 - DNA, 12 bp, Homo sapiens
tgtcacttttta

SEQ ID NO: 1372261 - DNA, 17 bp, Homo sapiens
tgtcagaagtgcagaat

SEQ ID NO: 1372262 - DNA, 21 bp, Homo sapiens
tgtcagacagaacttgaatgt

SEQ ID NO: 1372263 - DNA, 20 bp, Homo sapiens
tgtcagcagttgctggtaaa

SEQ ID NO: 1372264 - DNA, 19 bp, Homo sapiens
tgtcagctgaacctgggta

SEQ ID NO: 1372265 - DNA, 11 bp, Homo sapiens
tgtcaggcctt

SEQ ID NO: 1372266 - DNA, 19 bp, Homo sapiens
tgtcaggccttcagggttc

SEQ ID NO: 1372267 - DNA, 15 bp, Homo sapiens
tgtcaggttatttat

SEQ ID NO: 1372268 - DNA, 14 bp, Homo sapiens
tgtcagttttcata

SEQ ID NO: 1372269 - DNA, 22 bp, Homo sapiens
tgtcattcagagtcagccagga

SEQ ID NO: 1372270 - DNA, 17 bp, Homo sapiens
tgtccaaacgtcctctt

SEQ ID NO: 1372271 - DNA, 19 bp, Homo sapiens
tgtccaaagaggctgcccc

SEQ ID NO: 1372272 - DNA, 12 bp, Homo sapiens
tgtccagcacct

SEQ ID NO: 1372273 - DNA, 19 bp, Homo sapiens
tgtccagcaccttgtgcct

SEQ ID NO: 1372274 - DNA, 16 bp, Homo sapiens
tgtccagtaagatcac

SEQ ID NO: 1372275 - DNA, 22 bp, Homo sapiens
tgtccagtaagatcactgttta

SEQ ID NO: 1372276 - DNA, 20 bp, Homo sapiens
tgtccatacactttgttgca

SEQ ID NO: 1372277 - DNA, 17 bp, Homo sapiens
tgtcccaggcagggaga

SEQ ID NO: 1372278 - DNA, 16 bp, Homo sapiens
tgtccccgcagccctg

SEQ ID NO: 1372279 - DNA, 18 bp, Homo sapiens
tgtccccgctgctgtgca

SEQ ID NO: 1372280 - DNA, 13 bp, Homo sapiens
tgtccgagctttg

SEQ ID NO: 1372281 - DNA, 18 bp, Homo sapiens
tgtcctaatggtgatgca

SEQ ID NO: 1372282 - DNA, 11 bp, Homo sapiens
tgtcctgtcct

SEQ ID NO: 1372283 - DNA, 14 bp, Homo sapiens
tgtcgctcatgtgt

SEQ ID NO: 1372284 - DNA, 22 bp, Homo sapiens
tgtcgctcatgtgtgcaacagg

SEQ ID NO: 1372285 - DNA, 16 bp, Homo sapiens
tgtctaaacaatgctg

SEQ ID NO: 1372286 - DNA, 22 bp, Homo sapiens
tgtctaaacaatgctgatttgg

SEQ ID NO: 1372287 - DNA, 23 bp, Homo sapiens
tgtctaaagtgtattttcagagc

SEQ ID NO: 1372288 - DNA, 19 bp, Homo sapiens
tgtctaggattttggatgt

SEQ ID NO: 1372289 - DNA, 15 bp, Homo sapiens
tgtctataaaagaaa

SEQ ID NO: 1372290 - DNA, 16 bp, Homo sapiens
tgtctataaaagaaac

SEQ ID NO: 1372291 - DNA, 21 bp, Homo sapiens
tgtctccttaagctgcagaga

SEQ ID NO: 1372292 - DNA, 16 bp, Homo sapiens
tgtctgggtttgagaa

SEQ ID NO: 1372293 - DNA, 14 bp, Homo sapiens
tgtctggtggcccc

SEQ ID NO: 1372294 - DNA, 14 bp, Homo sapiens
tgtctggttaaaaa

SEQ ID NO: 1372295 - DNA, 16 bp, Homo sapiens
tgtctggttaaaaaat

SEQ ID NO: 1372296 - DNA, 12 bp, Homo sapiens
tgtctgtaaata

SEQ ID NO: 1372297 - DNA, 19 bp, Homo sapiens
tgtctgtgaacagagagac

SEQ ID NO: 1372298 - DNA, 13 bp, Homo sapiens
tgtcttgggcaga

SEQ ID NO: 1372299 - DNA, 15 bp, Homo sapiens
tgtctttttgttgta

SEQ ID NO: 1372300 - DNA, 23 bp, Homo sapiens
tgtgaaaagaaaaatgagcctgg

SEQ ID NO: 1372301 - DNA, 14 bp, Homo sapiens
tgtgaaaatgtgtt

SEQ ID NO: 1372302 - DNA, 15 bp, Homo sapiens
tgtgaacagagagac

SEQ ID NO: 1372303 - DNA, 15 bp, Homo sapiens
tgtgaacttggaagc

SEQ ID NO: 1372304 - DNA, 18 bp, Homo sapiens
tgtgaacttggaagcaca

SEQ ID NO: 1372305 - DNA, 14 bp, Homo sapiens
tgtgaagagaacca

SEQ ID NO: 1372306 - DNA, 12 bp, Homo sapiens
tgtgaataaatt

SEQ ID NO: 1372307 - DNA, 16 bp, Homo sapiens
tgtgaattattgacac

SEQ ID NO: 1372308 - DNA, 21 bp, Homo sapiens
tgtgaattattgacactgaac

SEQ ID NO: 1372309 - DNA, 22 bp, Homo sapiens
tgtgaatttttaagctgcaaat

SEQ ID NO: 1372310 - DNA, 15 bp, Homo sapiens
tgtgacaattctgtt

SEQ ID NO: 1372311 - DNA, 22 bp, Homo sapiens
tgtgacatggtgcctgagaggc

SEQ ID NO: 1372312 - DNA, 20 bp, Homo sapiens
tgtgactgtacccaaatgga

SEQ ID NO: 1372313 - DNA, 23 bp, Homo sapiens
tgtgagaagtgaatgctgggact

SEQ ID NO: 1372314 - DNA, 14 bp, Homo sapiens
tgtgatgagctgat

SEQ ID NO: 1372315 - DNA, 19 bp, Homo sapiens
tgtgatttctttaaaagaa

SEQ ID NO: 1372316 - DNA, 21 bp, Homo sapiens
tgtgatttctttaaaagaatg

SEQ ID NO: 1372317 - DNA, 20 bp, Homo sapiens
tgtgcaaaaccttttactgg

SEQ ID NO: 1372318 - DNA, 21 bp, Homo sapiens
tgtgcaacggtctcctgactg

SEQ ID NO: 1372319 - DNA, 21 bp, Homo sapiens
tgtgcacatccgcgtgtgcct

SEQ ID NO: 1372320 - DNA, 22 bp, Homo sapiens
tgtgcacatccgcgtgtgcctg

SEQ ID NO: 1372321 - DNA, 15 bp, Homo sapiens
tgtgcatagtttctt

SEQ ID NO: 1372322 - DNA, 21 bp, Homo sapiens
tgtgccactaaactacattgt

SEQ ID NO: 1372323 - DNA, 20 bp, Homo sapiens
tgtgccagaggaatcctggc

SEQ ID NO: 1372324 - DNA, 21 bp, Homo sapiens
tgtgccagaggaatcctggca

SEQ ID NO: 1372325 - DNA, 23 bp, Homo sapiens
tgtgccagaggaatcctggcagc

SEQ ID NO: 1372326 - DNA, 21 bp, Homo sapiens
tgtgcccagaatactgatgga

SEQ ID NO: 1372327 - DNA, 13 bp, Homo sapiens
tgtgccctcctga

SEQ ID NO: 1372328 - DNA, 17 bp, Homo sapiens
tgtgccctcctgaccca

SEQ ID NO: 1372329 - DNA, 23 bp, Homo sapiens
tgtgccctcctgacccattgctg

SEQ ID NO: 1372330 - DNA, 14 bp, Homo sapiens
tgtgccttcgtctt

SEQ ID NO: 1372331 - DNA, 16 bp, Homo sapiens
tgtgccttcttttgat

SEQ ID NO: 1372332 - DNA, 15 bp, Homo sapiens
tgtgctcagagacac

SEQ ID NO: 1372333 - DNA, 10 bp, Homo sapiens
tgtgctggga

SEQ ID NO: 1372334 - DNA, 21 bp, Homo sapiens
tgtgctgggagctccactctg

SEQ ID NO: 1372335 - DNA, 12 bp, Homo sapiens
tgtgctgtgtgt

SEQ ID NO: 1372336 - DNA, 23 bp, Homo sapiens
tgtgcttcacagtagagccagct

SEQ ID NO: 1372337 - DNA, 22 bp, Homo sapiens
tgtggaaggcaagccaggctca

SEQ ID NO: 1372338 - DNA, 23 bp, Homo sapiens
tgtggactgtggcacttgcctgg

SEQ ID NO: 1372339 - DNA, 12 bp, Homo sapiens
tgtggagaagcg

SEQ ID NO: 1372340 - DNA, 19 bp, Homo sapiens
tgtggagccgaggcctacc

SEQ ID NO: 1372341 - DNA, 20 bp, Homo sapiens
tgtggagccgaggcctaccc

SEQ ID NO: 1372342 - DNA, 15 bp, Homo sapiens
tgtggcacttgcctg

SEQ ID NO: 1372343 - DNA, 12 bp, Homo sapiens
tgtggccaggct

SEQ ID NO: 1372344 - DNA, 19 bp, Homo sapiens
tgtggccccaccctgggcc

SEQ ID NO: 1372345 - DNA, 23 bp, Homo sapiens
tgtggccccaccctgggccctgg

SEQ ID NO: 1372346 - DNA, 18 bp, Homo sapiens
tgggacctgtggctgtcg

SEQ ID NO: 1372347 - DNA, 13 bp, Homo sapiens
tgggacggcggca

SEQ ID NO: 1372348 - DNA, 23 bp, Homo sapiens
tgggacgggatggttctggctgt

SEQ ID NO: 1372349 - DNA, 13 bp, Homo sapiens
tgggactcagcct

SEQ ID NO: 1372350 - DNA, 18 bp, Homo sapiens
tgggactcgtggctgtca

SEQ ID NO: 1372351 - DNA, 14 bp, Homo sapiens
tgggaggagggaga

SEQ ID NO: 1372352 - DNA, 19 bp, Homo sapiens
tgggaggagggagagggag

SEQ ID NO: 1372353 - DNA, 18 bp, Homo sapiens
tgggaggatctcttgagc

SEQ ID NO: 1372354 - DNA, 18 bp, Homo sapiens
tgggaggattgcttgagc

SEQ ID NO: 1372355 - DNA, 22 bp, Homo sapiens
tgggaggattgcttgagctcag

SEQ ID NO: 1372356 - DNA, 14 bp, Homo sapiens
tgggaggctgaggc

SEQ ID NO: 1372357 - DNA, 15 bp, Homo sapiens
tgggaggctgaggca

SEQ ID NO: 1372358 - DNA, 17 bp, Homo sapiens
tgggaggtcaaggctgc

SEQ ID NO: 1372359 - DNA, 23 bp, Homo sapiens
tgggaggtcaaggctgcagtgag

SEQ ID NO: 1372360 - DNA, 20 bp, Homo sapiens
tgggagtactctcatcacta

SEQ ID NO: 1372361 - DNA, 20 bp, Homo sapiens
tgggagtttttatgagaaac

SEQ ID NO: 1372362 - DNA, 18 bp, Homo sapiens
tgggatattgaatgttaa

SEQ ID NO: 1372363 - DNA, 16 bp, Homo sapiens
tgggatgaaactaaag

SEQ ID NO: 1372364 - DNA, 16 bp, Homo sapiens
tgggcagagctggctc

SEQ ID NO: 1372365 - DNA, 15 bp, Homo sapiens
tgggcattgccatgt

SEQ ID NO: 1372366 - DNA, 14 bp, Homo sapiens
tgggccctgggctg

SEQ ID NO: 1372367 - DNA, 13 bp, Homo sapiens
tgggccgctgcca

SEQ ID NO: 1372368 - DNA, 15 bp, Homo sapiens
tgggcctcggcccct

SEQ ID NO: 1372369 - DNA, 19 bp, Homo sapiens
tgggcctcggcccctccca

SEQ ID NO: 1372370 - DNA, 21 bp, Homo sapiens
tgggctgaccccggtggcggc

SEQ ID NO: 1372371 - DNA, 23 bp, Homo sapiens
tgggctggacttctacctgccct

SEQ ID NO: 1372372 - DNA, 13 bp, Homo sapiens
tgggcttatatct

SEQ ID NO: 1372373 - DNA, 22 bp, Homo sapiens
tgggcttatatctggcctctgc

SEQ ID NO: 1372374 - DNA, 14 bp, Homo sapiens
tgggcttgaccagg

SEQ ID NO: 1372375 - DNA, 15 bp, Homo sapiens
tgggcttggcctgct

SEQ ID NO: 1372376 - DNA, 19 bp, Homo sapiens
tgggcttggcctgctgtga

SEQ ID NO: 1372377 - DNA, 17 bp, Homo sapiens
tggggaaaggaggtggg

SEQ ID NO: 1372378 - DNA, 21 bp, Homo sapiens
tggggatccccgcctggccag

SEQ ID NO: 1372379 - DNA, 15 bp, Homo sapiens
tggggcaggctgggc

SEQ ID NO: 1372380 - DNA, 18 bp, Homo sapiens
tggggcaggctgggccat

SEQ ID NO: 1372381 - DNA, 20 bp, Homo sapiens
tggggcaggctgggccatgt

SEQ ID NO: 1372382 - DNA, 12 bp, Homo sapiens
tggggcagggag

SEQ ID NO: 1372383 - DNA, 17 bp, Homo sapiens
tggggcatcctgtgcca

SEQ ID NO: 1372384 - DNA, 21 bp, Homo sapiens
tggggccaccaaagctgccca

SEQ ID NO: 1372385 - DNA, 22 bp, Homo sapiens
tggggcccagtgcatggtggcc

SEQ ID NO: 1372386 - DNA, 22 bp, Homo sapiens
tggggcctagcgatctctcctg

SEQ ID NO: 1372387 - DNA, 14 bp, Homo sapiens
tggggcctccagaa

SEQ ID NO: 1372388 - DNA, 20 bp, Homo sapiens
tgggggatcacagcctctga

SEQ ID NO: 1372389 - DNA, 15 bp, Homo sapiens
tggggggcattgagt

SEQ ID NO: 1372390 - DNA, 19 bp, Homo sapiens
tggggggctgaggtgggag

SEQ ID NO: 1372391 - DNA, 12 bp, Homo sapiens
tggggttttgta

SEQ ID NO: 1372392 - DNA, 16 bp, Homo sapiens
tgggtaactagggaag

SEQ ID NO: 1372393 - DNA, 20 bp, Homo sapiens
tgggtggcaccagcagcctg

SEQ ID NO: 1372394 - DNA, 14 bp, Homo sapiens
tgggttcctcctct

SEQ ID NO: 1372395 - DNA, 14 bp, Homo sapiens
tgggtttgagaaat

SEQ ID NO: 1372396 - DNA, 15 bp, Homo sapiens
tggtaaaatgaagaa

SEQ ID NO: 1372397 - DNA, 13 bp, Homo sapiens
tggtaaatgtttc

SEQ ID NO: 1372398 - DNA, 21 bp, Homo sapiens
tggtaatcccctaaaataaca

SEQ ID NO: 1372399 - DNA, 20 bp, Homo sapiens
tggtacaacggaggcctgcg

SEQ ID NO: 1372400 - DNA, 21 bp, Homo sapiens
tggtaccaatcatgaatcttt

SEQ ID NO: 1372401 - DNA, 16 bp, Homo sapiens
tggtaggaccaagcat

SEQ ID NO: 1372402 - DNA, 22 bp, Homo sapiens
tggtaggaccaagcatcttggg

SEQ ID NO: 1372403 - DNA, 14 bp, Homo sapiens
tggtagtttctgtg

SEQ ID NO: 1372404 - DNA, 20 bp, Homo sapiens
tggtcacgtttggtgcttct

SEQ ID NO: 1372405 - DNA, 22 bp, Homo sapiens
tggtccctccagaaccaccccg

SEQ ID NO: 1372406 - DNA, 21 bp, Homo sapiens
tggtcctagaggccctttgct

SEQ ID NO: 1372407 - DNA, 19 bp, Homo sapiens
tggtctcttcttggggccc

SEQ ID NO: 1372408 - DNA, 18 bp, Homo sapiens
tggtctgttggcaggctg

SEQ ID NO: 1372409 - DNA, 11 bp, Homo sapiens
tggtctttgag

SEQ ID NO: 1372410 - DNA, 20 bp, Homo sapiens
tggtgatttgaaaaatataa

SEQ ID NO: 1372411 - DNA, 14 bp, Homo sapiens
tggtgcctgagagg

SEQ ID NO: 1372412 - DNA, 15 bp, Homo sapiens
tggtgcctgagaggc

SEQ ID NO: 1372413 - DNA, 17 bp, Homo sapiens
tggtgcctgagaggcag

SEQ ID NO: 1372414 - DNA, 18 bp, Homo sapiens
tggtgcctgagaggcagg

SEQ ID NO: 1372415 - DNA, 19 bp, Homo sapiens
tggtgcttccaaatattgt

SEQ ID NO: 1372416 - DNA, 23 bp, Homo sapiens
tggtgcttctcagatttctgagg

SEQ ID NO: 1372417 - DNA, 19 bp, Homo sapiens
tggtggcaacattcattgc

SEQ ID NO: 1372418 - DNA, 18 bp, Homo sapiens
tggtgggggcctcggtgt

SEQ ID NO: 1372419 - DNA, 14 bp, Homo sapiens
tggtggtagagaag

SEQ ID NO: 1372420 - DNA, 15 bp, Homo sapiens
tggtggtctgttggc

SEQ ID NO: 1372421 - DNA, 15 bp, Homo sapiens
tggttacttcttctc

SEQ ID NO: 1372422 - DNA, 21 bp, Homo sapiens
tggttacttcttctcttagat

SEQ ID NO: 1372423 - DNA, 12 bp, Homo sapiens
tggttctggcca

SEQ ID NO: 1372424 - DNA, 11 bp, Homo sapiens
tggttgcatgg

SEQ ID NO: 1372425 - DNA, 20 bp, Homo sapiens
tggttgtgtgtccccttgca

SEQ ID NO: 1372426 - DNA, 22 bp, Homo sapiens
tggtttcctccatttgagaaaa

SEQ ID NO: 1372427 - DNA, 21 bp, Homo sapiens
tggttttctgccaatgaccaa

SEQ ID NO: 1372428 - DNA, 23 bp, Homo sapiens
tggtttttaaaaaactgctgact

SEQ ID NO: 1372429 - DNA, 14 bp, Homo sapiens
tgtaaaaaaaccac

SEQ ID NO: 1372430 - DNA, 23 bp, Homo sapiens
tgtaaaaaaaccaccaaaaacaa

SEQ ID NO: 1372431 - DNA, 16 bp, Homo sapiens
tgtaaaaatcttttga

SEQ ID NO: 1372432 - DNA, 21 bp, Homo sapiens
tgtaaaatattttgaatcaat

SEQ ID NO: 1372433 - DNA, 18 bp, Homo sapiens
tgtaaacagcctcttttt

SEQ ID NO: 1372434 - DNA, 22 bp, Homo sapiens
tgtaaactcatctgaaatgtta

SEQ ID NO: 1372435 - DNA, 19 bp, Homo sapiens
tgtaaagtatgtattattt

SEQ ID NO: 1372436 - DNA, 15 bp, Homo sapiens
tgtaaataatttatt

SEQ ID NO: 1372437 - DNA, 21 bp, Homo sapiens
tgtaaatacacatagcatgta

SEQ ID NO: 1372438 - DNA, 18 bp, Homo sapiens
tgtaaatatttatttatg

SEQ ID NO: 1372439 - DNA, 15 bp, Homo sapiens
tgtaaatgtaaactc

SEQ ID NO: 1372440 - DNA, 15 bp, Homo sapiens
tgtaaattctgattt

SEQ ID NO: 1372441 - DNA, 19 bp, Homo sapiens
tgtaaattctgatttcttt

SEQ ID NO: 1372442 - DNA, 20 bp, Homo sapiens
tgtaacttccaaataaataa

SEQ ID NO: 1372443 - DNA, 17 bp, Homo sapiens
tgtaagaaggcaatatt

SEQ ID NO: 1372444 - DNA, 22 bp, Homo sapiens
tgtaagcatactttgtaaatag

SEQ ID NO: 1372445 - DNA, 14 bp, Homo sapiens
tgtaagtgggccca

SEQ ID NO: 1372446 - DNA, 18 bp, Homo sapiens
tgtaatgaaaatgaatat

SEQ ID NO: 1372447 - DNA, 17 bp, Homo sapiens
tgtaattacttattgta

SEQ ID NO: 1372448 - DNA, 16 bp, Homo sapiens
tgtaatttaaatgaaa

SEQ ID NO: 1372449 - DNA, 14 bp, Homo sapiens
tgtaatttgtttga

SEQ ID NO: 1372450 - DNA, 11 bp, Homo sapiens
tgtacaaaagc

SEQ ID NO: 1372451 - DNA, 15 bp, Homo sapiens
tgtacaaaagcaatg

SEQ ID NO: 1372452 - DNA, 24 bp, Homo sapiens
tgtacaaaattaagcaaatgttaa

SEQ ID NO: 1372453 - DNA, 14 bp, Homo sapiens
tgtacagattcttt

SEQ ID NO: 1372454 - DNA, 17 bp, Homo sapiens
tgtacagtagattttcc

SEQ ID NO: 1372455 - DNA, 18 bp, Homo sapiens
tgtacatacgatttaagg

SEQ ID NO: 1372456 - DNA, 18 bp, Homo sapiens
tgtacatttctataaata

SEQ ID NO: 1372457 - DNA, 22 bp, Homo sapiens
tgtacgacgtcagatgtttaaa

SEQ ID NO: 1372458 - DNA, 22 bp, Homo sapiens
tgtacttaaatggtaataagca

SEQ ID NO: 1372459 - DNA, 12 bp, Homo sapiens
tgtacttttcat

SEQ ID NO: 1372460 - DNA, 13 bp, Homo sapiens
tgtacttttcatt

SEQ ID NO: 1372461 - DNA, 17 bp, Homo sapiens
tgtacttttcattctct

SEQ ID NO: 1372462 - DNA, 13 bp, Homo sapiens
tgtagagtgggag

SEQ ID NO: 1372463 - DNA, 15 bp, Homo sapiens
tgtagatgatgtatt

SEQ ID NO: 1372464 - DNA, 12 bp, Homo sapiens
tgtagatttgat

SEQ ID NO: 1372465 - DNA, 22 bp, Homo sapiens
tgtagcaaaattcttaagtatg

SEQ ID NO: 1372466 - DNA, 17 bp, Homo sapiens
tgctgactgttttctct

SEQ ID NO: 1372467 - DNA, 17 bp, Homo sapiens
tgctgagcctctgctcc

SEQ ID NO: 1372468 - DNA, 13 bp, Homo sapiens
tgctgaggcctgg

SEQ ID NO: 1372469 - DNA, 19 bp, Homo sapiens
tgctgagtctgttctggta

SEQ ID NO: 1372470 - DNA, 23 bp, Homo sapiens
tgctgcagcaccgaggggccttt

SEQ ID NO: 1372471 - DNA, 18 bp, Homo sapiens
tgctgcatgccctctcag

SEQ ID NO: 1372472 - DNA, 19 bp, Homo sapiens
tgctgcatgccctctcagg

SEQ ID NO: 1372473 - DNA, 19 bp, Homo sapiens
tgctgccattacagaggta

SEQ ID NO: 1372474 - DNA, 20 bp, Homo sapiens
tgctgcccccaccccgggga

SEQ ID NO: 1372475 - DNA, 17 bp, Homo sapiens
tgctgctgcctctttcc

SEQ ID NO: 1372476 - DNA, 18 bp, Homo sapiens
tgctgctggtgcacagcc

SEQ ID NO: 1372477 - DNA, 19 bp, Homo sapiens
tgctgcttgaggcaactca

SEQ ID NO: 1372478 - DNA, 16 bp, Homo sapiens
tgctggccccagccct

SEQ ID NO: 1372479 - DNA, 18 bp, Homo sapiens
tgctggccccagccctgc

SEQ ID NO: 1372480 - DNA, 20 bp, Homo sapiens
tgctggccccagccctgctg

SEQ ID NO: 1372481 - DNA, 21 bp, Homo sapiens
tgctggccccagccctgctgg

SEQ ID NO: 1372482 - DNA, 22 bp, Homo sapiens
tgctggccccagccctgctggg

SEQ ID NO: 1372483 - DNA, 16 bp, Homo sapiens
tgctgggactcagcct

SEQ ID NO: 1372484 - DNA, 18 bp, Homo sapiens
tgctgggactcagccttc

SEQ ID NO: 1372485 - DNA, 16 bp, Homo sapiens
tgctgggagctccact

SEQ ID NO: 1372486 - DNA, 21 bp, Homo sapiens
tgctgggagctccactctgct

SEQ ID NO: 1372487 - DNA, 22 bp, Homo sapiens
tgctgggagctccactctgctt

SEQ ID NO: 1372488 - DNA, 17 bp, Homo sapiens
tgctgggaggagggaga

SEQ ID NO: 1372489 - DNA, 19 bp, Homo sapiens
tgctgggcattttcccaga

SEQ ID NO: 1372490 - DNA, 19 bp, Homo sapiens
tgctggggtcaaggcagta

SEQ ID NO: 1372491 - DNA, 17 bp, Homo sapiens
tgctggtaaaatgaaga

SEQ ID NO: 1372492 - DNA, 23 bp, Homo sapiens
tgctgtacacatatttgaagggt

SEQ ID NO: 1372493 - DNA, 22 bp, Homo sapiens
tgctgtatatggaattctttta

SEQ ID NO: 1372494 - DNA, 17 bp, Homo sapiens
tgctgtgagggagggga

SEQ ID NO: 1372495 - DNA, 21 bp, Homo sapiens
tgctgtgtgtcccaggcaggg

SEQ ID NO: 1372496 - DNA, 23 bp, Homo sapiens
tgctgtgtgtcccaggcagggag

SEQ ID NO: 1372497 - DNA, 18 bp, Homo sapiens
tgctgttgtccaactatt

SEQ ID NO: 1372498 - DNA, 23 bp, Homo sapiens
tgctgttgtccaactatttattg

SEQ ID NO: 1372499 - DNA, 16 bp, Homo sapiens
tgcttaaatttcttat

SEQ ID NO: 1372500 - DNA, 15 bp, Homo sapiens
tgcttaataaattgt

SEQ ID NO: 1372501 - DNA, 20 bp, Homo sapiens
tgcttaatcttcaaagcctt

SEQ ID NO: 1372502 - DNA, 21 bp, Homo sapiens
tgcttaatcttcaaagccttc

SEQ ID NO: 1372503 - DNA, 17 bp, Homo sapiens
tgcttattatgtaggta

SEQ ID NO: 1372504 - DNA, 22 bp, Homo sapiens
tgcttcacagtagagccagctt

SEQ ID NO: 1372505 - DNA, 19 bp, Homo sapiens
tgcttccaggaaactccac

SEQ ID NO: 1372506 - DNA, 15 bp, Homo sapiens
tgcttcctcctggaa

SEQ ID NO: 1372507 - DNA, 12 bp, Homo sapiens
tgcttctcactg

SEQ ID NO: 1372508 - DNA, 12 bp, Homo sapiens
tgcttctctgac

SEQ ID NO: 1372509 - DNA, 12 bp, Homo sapiens
tgcttctgccac

SEQ ID NO: 1372510 - DNA, 12 bp, Homo sapiens
tgcttgaataaa

SEQ ID NO: 1372511 - DNA, 21 bp, Homo sapiens
tgcttgaggcaactcatctta

SEQ ID NO: 1372512 - DNA, 18 bp, Homo sapiens
tgcttgcctgcagggcca

SEQ ID NO: 1372513 - DNA, 22 bp, Homo sapiens
tgcttggaacatactgttcact

SEQ ID NO: 1372514 - DNA, 15 bp, Homo sapiens
tgcttgtcttctggt

SEQ ID NO: 1372515 - DNA, 22 bp, Homo sapiens
tgcttgtcttctggtactttct

SEQ ID NO: 1372516 - DNA, 18 bp, Homo sapiens
tgctttaccttttcaggg

SEQ ID NO: 1372517 - DNA, 19 bp, Homo sapiens
tgctttagacttgaaaaga

SEQ ID NO: 1372518 - DNA, 17 bp, Homo sapiens
tgctttattaatgtttt

SEQ ID NO: 1372519 - DNA, 16 bp, Homo sapiens
tgctttatttgtaaat

SEQ ID NO: 1372520 - DNA, 16 bp, Homo sapiens
tgctttcagaagtgcc

SEQ ID NO: 1372521 - DNA, 18 bp, Homo sapiens
tgctttgaataaatgtgt

SEQ ID NO: 1372522 - DNA, 18 bp, Homo sapiens
tgctttggacctaaatgg

SEQ ID NO: 1372523 - DNA, 21 bp, Homo sapiens
tgctttggacctaaatggcct

SEQ ID NO: 1372524 - DNA, 22 bp, Homo sapiens
tgctttggacctaaatggcctc

SEQ ID NO: 1372525 - DNA, 16 bp, Homo sapiens
tgctttgtagagtttt

SEQ ID NO: 1372526 - DNA, 22 bp, Homo sapiens
tgctttgtagagttttgtcatt

SEQ ID NO: 1372527 - DNA, 12 bp, Homo sapiens
tatttattgact

SEQ ID NO: 1372528 - DNA, 15 bp, Homo sapiens
tatttattgactctt

SEQ ID NO: 1372529 - DNA, 21 bp, Homo sapiens
tatttattgactcttgagttg

SEQ ID NO: 1372530 - DNA, 18 bp, Homo sapiens
tatttatttatgtacttt

SEQ ID NO: 1372531 - DNA, 20 bp, Homo sapiens
tatttattttttttaattgt

SEQ ID NO: 1372532 - DNA, 14 bp, Homo sapiens
tatttccactaaaa

SEQ ID NO: 1372533 - DNA, 15 bp, Homo sapiens
tatttccactaaaaa

SEQ ID NO: 1372534 - DNA, 21 bp, Homo sapiens
tatttcccatttgtgccagag

SEQ ID NO: 1372535 - DNA, 17 bp, Homo sapiens
tatttcctttatgtgaa

SEQ ID NO: 1372536 - DNA, 11 bp, Homo sapiens
tatttctactg

SEQ ID NO: 1372537 - DNA, 14 bp, Homo sapiens
tatttgaaagtgcc

SEQ ID NO: 1372538 - DNA, 16 bp, Homo sapiens
tatttgaacaatgaag

SEQ ID NO: 1372539 - DNA, 18 bp, Homo sapiens
tatttgaacaatgaagtt

SEQ ID NO: 1372540 - DNA, 18 bp, Homo sapiens
tatttgaattttaaatct

SEQ ID NO: 1372541 - DNA, 21 bp, Homo sapiens
tatttgaattttaaatctaaa

SEQ ID NO: 1372542 - DNA, 13 bp, Homo sapiens
tatttgattattt

SEQ ID NO: 1372543 - DNA, 13 bp, Homo sapiens
tatttgatttatt

SEQ ID NO: 1372544 - DNA, 19 bp, Homo sapiens
tatttgatttattaactta

SEQ ID NO: 1372545 - DNA, 11 bp, Homo sapiens
tatttgcatgt

SEQ ID NO: 1372546 - DNA, 15 bp, Homo sapiens
tatttgcatgttatg

SEQ ID NO: 1372547 - DNA, 18 bp, Homo sapiens
tatttgcatgttatgttt

SEQ ID NO: 1372548 - DNA, 14 bp, Homo sapiens
tattttaaaaatat

SEQ ID NO: 1372549 - DNA, 14 bp, Homo sapiens
tattttacacagaa

SEQ ID NO: 1372550 - DNA, 18 bp, Homo sapiens
tattttacagctcattaa

SEQ ID NO: 1372551 - DNA, 20 bp, Homo sapiens
tattttcatgaaaataccat

SEQ ID NO: 1372552 - DNA, 12 bp, Homo sapiens
tattttcctaaa

SEQ ID NO: 1372553 - DNA, 16 bp, Homo sapiens
tattttcctaaagaga

SEQ ID NO: 1372554 - DNA, 14 bp, Homo sapiens
tattttctacgttt

SEQ ID NO: 1372555 - DNA, 20 bp, Homo sapiens
tattttctacgtttctttaa

SEQ ID NO: 1372556 - DNA, 15 bp, Homo sapiens
tattttgtgtgaaat

SEQ ID NO: 1372557 - DNA, 20 bp, Homo sapiens
tatttttagaataagaattt

SEQ ID NO: 1372558 - DNA, 17 bp, Homo sapiens
tatttttatacaaacct

SEQ ID NO: 1372559 - DNA, 19 bp, Homo sapiens
tatttttatatcatgcaaa

SEQ ID NO: 1372560 - DNA, 22 bp, Homo sapiens
tatttttcactctaagtcatgt

SEQ ID NO: 1372561 - DNA, 13 bp, Homo sapiens
tatttttgttgtt

SEQ ID NO: 1372562 - DNA, 11 bp, Homo sapiens
tattttttcaa

SEQ ID NO: 1372563 - DNA, 13 bp, Homo sapiens
tattttttgaaaa

SEQ ID NO: 1372564 - DNA, 16 bp, Homo sapiens
tatttttttaaaattt

SEQ ID NO: 1372565 - DNA, 13 bp, Homo sapiens
tatttttttgaac

SEQ ID NO: 1372566 - DNA, 15 bp, Homo sapiens
tattttttttaaaga

SEQ ID NO: 1372567 - DNA, 18 bp, Homo sapiens
tattttttttaattgtat

SEQ ID NO: 1372568 - DNA, 21 bp, Homo sapiens
tattttttttttcttcttggg

SEQ ID NO: 1372569 - DNA, 15 bp, Homo sapiens
tcaaaaaaagaaaaa

SEQ ID NO: 1372570 - DNA, 21 bp, Homo sapiens
tcaaaaaggcttataaaacag

SEQ ID NO: 1372571 - DNA, 20 bp, Homo sapiens
tcaaaaggtattatacatgt

SEQ ID NO: 1372572 - DNA, 12 bp, Homo sapiens
tcaaaagtgcct

SEQ ID NO: 1372573 - DNA, 16 bp, Homo sapiens
tcaaaagtgcctcaag

SEQ ID NO: 1372574 - DNA, 17 bp, Homo sapiens
tcaaaataaagaagtat

SEQ ID NO: 1372575 - DNA, 16 bp, Homo sapiens
tcaaactcaatgcttt

SEQ ID NO: 1372576 - DNA, 23 bp, Homo sapiens
tcaaactcaatgctttatttgta

SEQ ID NO: 1372577 - DNA, 19 bp, Homo sapiens
tcaaactggggcctccaga

SEQ ID NO: 1372578 - DNA, 23 bp, Homo sapiens
tcaaagacctggggctgctgtga

SEQ ID NO: 1372579 - DNA, 20 bp, Homo sapiens
tcaaaggagcgagcatgtcg

SEQ ID NO: 1372580 - DNA, 17 bp, Homo sapiens
tcaaagggataaagaaa

SEQ ID NO: 1372581 - DNA, 18 bp, Homo sapiens
tcaaagtcattaaagaca

SEQ ID NO: 1372582 - DNA, 15 bp, Homo sapiens
tcaaagttgaaaatt

SEQ ID NO: 1372583 - DNA, 17 bp, Homo sapiens
tcaaagttgaaaattca

SEQ ID NO: 1372584 - DNA, 13 bp, Homo sapiens
tcaaagttttgtt

SEQ ID NO: 1372585 - DNA, 20 bp, Homo sapiens
tcaaataagtatttataata

SEQ ID NO: 1372586 - DNA, 14 bp, Homo sapiens
tcaaatacacattt

SEQ ID NO: 1372587 - DNA, 16 bp, Homo sapiens
tcaaattaattgtgtg

SEQ ID NO: 1372588 - DNA, 17 bp, Homo sapiens
tcaaattaattgtgtga

SEQ ID NO: 1372589 - DNA, 15 bp, Homo sapiens
tcaacagcaagtgtg

SEQ ID NO: 1372590 - DNA, 16 bp, Homo sapiens
tcaacagcaagtgtga

SEQ ID NO: 1372591 - DNA, 17 bp, Homo sapiens
tcaacctcttctggctc

SEQ ID NO: 1372592 - DNA, 18 bp, Homo sapiens
tcaacctcttctggctca

SEQ ID NO: 1372593 - DNA, 23 bp, Homo sapiens
tcaactgtcttcctcaaaataaa

SEQ ID NO: 1372594 - DNA, 18 bp, Homo sapiens
tcaagagccttaaaacat

SEQ ID NO: 1372595 - DNA, 22 bp, Homo sapiens
tcaagaggaatgaaaaaagctt

SEQ ID NO: 1372596 - DNA, 19 bp, Homo sapiens
tcaagatcaaaaaggctta

SEQ ID NO: 1372597 - DNA, 13 bp, Homo sapiens
tcaaggcctgctc

SEQ ID NO: 1372598 - DNA, 18 bp, Homo sapiens
tcaaggtcactgtttcct

SEQ ID NO: 1372599 - DNA, 23 bp, Homo sapiens
tcaagtgaaaaaggaggaagaga

SEQ ID NO: 1372600 - DNA, 18 bp, Homo sapiens
tcaataatatattttctg

SEQ ID NO: 1372601 - DNA, 18 bp, Homo sapiens
tcaatacactagttgttt

SEQ ID NO: 1372602 - DNA, 16 bp, Homo sapiens
tcaatagatctccagc

SEQ ID NO: 1372603 - DNA, 13 bp, Homo sapiens
tcaatatctaata

SEQ ID NO: 1372604 - DNA, 15 bp, Homo sapiens
tcaatatctaatata

SEQ ID NO: 1372605 - DNA, 19 bp, Homo sapiens
tcaatatctaatatatatg

SEQ ID NO: 1372606 - DNA, 21 bp, Homo sapiens
tcaatcctaatttctcctccc

SEQ ID NO: 1372607 - DNA, 20 bp, Homo sapiens
tcaatcctgattcctctcta

SEQ ID NO: 1372608 - DNA, 16 bp, Homo sapiens
tcaatctgtttttcat

SEQ ID NO: 1372609 - DNA, 22 bp, Homo sapiens
tcaatgaaaaatagtgtctttg

SEQ ID NO: 1372610 - DNA, 16 bp, Homo sapiens
tcaatgaaccataaat

SEQ ID NO: 1372611 - DNA, 18 bp, Homo sapiens
tcaatgctttatttgtaa

SEQ ID NO: 1372612 - DNA, 16 bp, Homo sapiens
tcaatgggacctgtgg

SEQ ID NO: 1372613 - DNA, 15 bp, Homo sapiens
tcaatgtcaagtacc

SEQ ID NO: 1372614 - DNA, 20 bp, Homo sapiens
tcaattagtaacattcatgt

SEQ ID NO: 1372615 - DNA, 13 bp, Homo sapiens
tcacaaatgactt

SEQ ID NO: 1372616 - DNA, 19 bp, Homo sapiens
tcacaacttgatggctgcg

SEQ ID NO: 1372617 - DNA, 19 bp, Homo sapiens
tcacactggttctcaatga

SEQ ID NO: 1372618 - DNA, 12 bp, Homo sapiens
tcacagagtcaa

SEQ ID NO: 1372619 - DNA, 17 bp, Homo sapiens
tcacagagtcaaggcct

SEQ ID NO: 1372620 - DNA, 21 bp, Homo sapiens
tcacagagtcaaggcctgctc

SEQ ID NO: 1372621 - DNA, 17 bp, Homo sapiens
tcacagtagagccagct

SEQ ID NO: 1372622 - DNA, 18 bp, Homo sapiens
tcacagtagagccagctt

SEQ ID NO: 1372623 - DNA, 19 bp, Homo sapiens
tcacagtagagccagcttg

SEQ ID NO: 1372624 - DNA, 15 bp, Homo sapiens
tcacagtttttcctg

SEQ ID NO: 1372625 - DNA, 12 bp, Homo sapiens
tcaccaccaccc

SEQ ID NO: 1372626 - DNA, 24 bp, Homo sapiens
tcaccagccccactgccagcagca

SEQ ID NO: 1372627 - DNA, 15 bp, Homo sapiens
tcaccatcaatcctg

SEQ ID NO: 1372628 - DNA, 18 bp, Homo sapiens
tgatacattttttaagct

SEQ ID NO: 1372629 - DNA, 14 bp, Homo sapiens
tgataccagctgga

SEQ ID NO: 1372630 - DNA, 16 bp, Homo sapiens
tgatagcattgtaagc

SEQ ID NO: 1372631 - DNA, 20 bp, Homo sapiens
tgatatatgagactttatgt

SEQ ID NO: 1372632 - DNA, 23 bp, Homo sapiens
tgatatctataaaatagatataa

SEQ ID NO: 1372633 - DNA, 21 bp, Homo sapiens
tgatattccccccacttaaga

SEQ ID NO: 1372634 - DNA, 21 bp, Homo sapiens
tgatcaatatttttatatcat

SEQ ID NO: 1372635 - DNA, 14 bp, Homo sapiens
tgatcatgtacttt

SEQ ID NO: 1372636 - DNA, 15 bp, Homo sapiens
tgatcatgtactttt

SEQ ID NO: 1372637 - DNA, 17 bp, Homo sapiens
tgatcatgtacttttta

SEQ ID NO: 1372638 - DNA, 17 bp, Homo sapiens
tgatcccgttttcccca

SEQ ID NO: 1372639 - DNA, 20 bp, Homo sapiens
tgatcccgttttccccatga

SEQ ID NO: 1372640 - DNA, 17 bp, Homo sapiens
tgatcccttgagatatg

SEQ ID NO: 1372641 - DNA, 19 bp, Homo sapiens
tgatcccttgagatatgga

SEQ ID NO: 1372642 - DNA, 18 bp, Homo sapiens
tgatgacaataaagcttg

SEQ ID NO: 1372643 - DNA, 21 bp, Homo sapiens
tgatgacgtacaagtagttct

SEQ ID NO: 1372644 - DNA, 22 bp, Homo sapiens
tgatgacgtacaagtagttctg

SEQ ID NO: 1372645 - DNA, 16 bp, Homo sapiens
tgatgaggtatttttt

SEQ ID NO: 1372646 - DNA, 20 bp, Homo sapiens
tgatgatcctaggcatttgc

SEQ ID NO: 1372647 - DNA, 14 bp, Homo sapiens
tgatggaaccttaa

SEQ ID NO: 1372648 - DNA, 15 bp, Homo sapiens
tgatggagtgtgagc

SEQ ID NO: 1372649 - DNA, 19 bp, Homo sapiens
tgatggccttaatttcctt

SEQ ID NO: 1372650 - DNA, 20 bp, Homo sapiens
tgatggtgtggcctgtggct

SEQ ID NO: 1372651 - DNA, 18 bp, Homo sapiens
tgatgtcaatttctgtgt

SEQ ID NO: 1372652 - DNA, 19 bp, Homo sapiens
tgatgtcaatttctgtgtt

SEQ ID NO: 1372653 - DNA, 23 bp, Homo sapiens
tgatgtcaatttctgtgttgcca

SEQ ID NO: 1372654 - DNA, 19 bp, Homo sapiens
tgatgtggccctggctgcc

SEQ ID NO: 1372655 - DNA, 15 bp, Homo sapiens
tgattaaaaatatca

SEQ ID NO: 1372656 - DNA, 19 bp, Homo sapiens
tgattaaccacttcagctg

SEQ ID NO: 1372657 - DNA, 19 bp, Homo sapiens
tgattatttgcatgttatg

SEQ ID NO: 1372658 - DNA, 21 bp, Homo sapiens
tgattattttttttttcttct

SEQ ID NO: 1372659 - DNA, 14 bp, Homo sapiens
tgattcagtcacat

SEQ ID NO: 1372660 - DNA, 15 bp, Homo sapiens
tgattcagtcacatg

SEQ ID NO: 1372661 - DNA, 19 bp, Homo sapiens
tgattccactacacctggc

SEQ ID NO: 1372662 - DNA, 17 bp, Homo sapiens
tgattccttttttcaaa

SEQ ID NO: 1372663 - DNA, 17 bp, Homo sapiens
tgattctggctttaagc

SEQ ID NO: 1372664 - DNA, 17 bp, Homo sapiens
tgattggaccaggccat

SEQ ID NO: 1372665 - DNA, 17 bp, Homo sapiens
tgattgggaaaacattt

SEQ ID NO: 1372666 - DNA, 12 bp, Homo sapiens
tgatttattaac

SEQ ID NO: 1372667 - DNA, 20 bp, Homo sapiens
tgatttcaaagttttgttgt

SEQ ID NO: 1372668 - DNA, 18 bp, Homo sapiens
tgatttctttaaaagaat

SEQ ID NO: 1372669 - DNA, 20 bp, Homo sapiens
tgatttctttaaaagaatga

SEQ ID NO: 1372670 - DNA, 19 bp, Homo sapiens
tgatttggtgaccaactgt

SEQ ID NO: 1372671 - DNA, 20 bp, Homo sapiens
tgatttttttttttaatcta

SEQ ID NO: 1372672 - DNA, 17 bp, Homo sapiens
tgcaaaaccttttactg

SEQ ID NO: 1372673 - DNA, 15 bp, Homo sapiens
tgcaaaatacatgaa

SEQ ID NO: 1372674 - DNA, 21 bp, Homo sapiens
tgcaaatgagctctgaaatct

SEQ ID NO: 1372675 - DNA, 15 bp, Homo sapiens
tgcaacaagcatgca

SEQ ID NO: 1372676 - DNA, 16 bp, Homo sapiens
tgcaaccaagtcacac

SEQ ID NO: 1372677 - DNA, 17 bp, Homo sapiens
tgcaaccaagtcacacg

SEQ ID NO: 1372678 - DNA, 12 bp, Homo sapiens
tgcaaccaggaa

SEQ ID NO: 1372679 - DNA, 22 bp, Homo sapiens
tgcaacggtctcctgactggtg

SEQ ID NO: 1372680 - DNA, 16 bp, Homo sapiens
taggaacatatgaaaa

SEQ ID NO: 1372681 - DNA, 17 bp, Homo sapiens
taggaccaagcatcttg

SEQ ID NO: 1372682 - DNA, 20 bp, Homo sapiens
taggagaaccaaatctggaa

SEQ ID NO: 1372683 - DNA, 22 bp, Homo sapiens
taggagttaacccctgcgctct

SEQ ID NO: 1372684 - DNA, 21 bp, Homo sapiens
taggatagctaactgtaaatc

SEQ ID NO: 1372685 - DNA, 22 bp, Homo sapiens
taggattttggatgttgagagg

SEQ ID NO: 1372686 - DNA, 18 bp, Homo sapiens
taggcaccttttactgtg

SEQ ID NO: 1372687 - DNA, 14 bp, Homo sapiens
taggcatgtaaaca

SEQ ID NO: 1372688 - DNA, 16 bp, Homo sapiens
taggcatttgctgaat

SEQ ID NO: 1372689 - DNA, 20 bp, Homo sapiens
taggcatttgctgaatacag

SEQ ID NO: 1372690 - DNA, 21 bp, Homo sapiens
taggcccccacttgcctcttc

SEQ ID NO: 1372691 - DNA, 21 bp, Homo sapiens
taggccttcctctctccagat

SEQ ID NO: 1372692 - DNA, 23 bp, Homo sapiens
taggccttcctctctccagatgt

SEQ ID NO: 1372693 - DNA, 20 bp, Homo sapiens
taggctattttctaaagact

SEQ ID NO: 1372694 - DNA, 20 bp, Homo sapiens
tagggaaaaaccagcgtgtg

SEQ ID NO: 1372695 - DNA, 21 bp, Homo sapiens
tagggaaaaaccagcgtgtga

SEQ ID NO: 1372696 - DNA, 19 bp, Homo sapiens
tagggactacccatagaca

SEQ ID NO: 1372697 - DNA, 20 bp, Homo sapiens
tagggactacccatagacat

SEQ ID NO: 1372698 - DNA, 15 bp, Homo sapiens
tagggtcggaaccca

SEQ ID NO: 1372699 - DNA, 17 bp, Homo sapiens
taggtgtgggggaagca

SEQ ID NO: 1372700 - DNA, 15 bp, Homo sapiens
taggttcagccaagg

SEQ ID NO: 1372701 - DNA, 22 bp, Homo sapiens
tagtaagattgatatctataaa

SEQ ID NO: 1372702 - DNA, 20 bp, Homo sapiens
tagtaatttctttttttcct

SEQ ID NO: 1372703 - DNA, 16 bp, Homo sapiens
tagtatctatatgact

SEQ ID NO: 1372704 - DNA, 16 bp, Homo sapiens
tagtatttatttatgt

SEQ ID NO: 1372705 - DNA, 15 bp, Homo sapiens
tagtcaataagaaaa

SEQ ID NO: 1372706 - DNA, 15 bp, Homo sapiens
tagtcaccagagact

SEQ ID NO: 1372707 - DNA, 23 bp, Homo sapiens
tagtcccagctacttgggaggct

SEQ ID NO: 1372708 - DNA, 16 bp, Homo sapiens
tagtccctgccacgaa

SEQ ID NO: 1372709 - DNA, 12 bp, Homo sapiens
tagtcctgtgaa

SEQ ID NO: 1372710 - DNA, 18 bp, Homo sapiens
tagtctttgccagtcatt

SEQ ID NO: 1372711 - DNA, 13 bp, Homo sapiens
tagtgaaactttt

SEQ ID NO: 1372712 - DNA, 19 bp, Homo sapiens
tagtgaaacttttctagaa

SEQ ID NO: 1372713 - DNA, 14 bp, Homo sapiens
tagtgtcactgctt

SEQ ID NO: 1372714 - DNA, 18 bp, Homo sapiens
tagtgttatatgaacata

SEQ ID NO: 1372715 - DNA, 22 bp, Homo sapiens
tagtgttatatgaacatacaaa

SEQ ID NO: 1372716 - DNA, 15 bp, Homo sapiens
tagttactgtgtaaa

SEQ ID NO: 1372717 - DNA, 21 bp, Homo sapiens
tagttactgtgtaaactcatc

SEQ ID NO: 1372718 - DNA, 20 bp, Homo sapiens
tagttatgtaaataattctt

SEQ ID NO: 1372719 - DNA, 19 bp, Homo sapiens
tagttcaatatttgttact

SEQ ID NO: 1372720 - DNA, 20 bp, Homo sapiens
tagttcctcattagcatttt

SEQ ID NO: 1372721 - DNA, 18 bp, Homo sapiens
tagttctgagctgccagt

SEQ ID NO: 1372722 - DNA, 12 bp, Homo sapiens
tagttctgtatt

SEQ ID NO: 1372723 - DNA, 13 bp, Homo sapiens
tagttgaatactt

SEQ ID NO: 1372724 - DNA, 15 bp, Homo sapiens
tagttgaatacttga

SEQ ID NO: 1372725 - DNA, 16 bp, Homo sapiens
tagttgcaattgaatt

SEQ ID NO: 1372726 - DNA, 13 bp, Homo sapiens
tagttgctatttt

SEQ ID NO: 1372727 - DNA, 19 bp, Homo sapiens
tagttgctatttttgtaaa

SEQ ID NO: 1372728 - DNA, 19 bp, Homo sapiens
tagtttgtgtgttgtctct

SEQ ID NO: 1372729 - DNA, 13 bp, Homo sapiens
tagttttgtcaaa

SEQ ID NO: 1372730 - DNA, 10 bp, Homo sapiens
tataaaacaa

SEQ ID NO: 1372731 - DNA, 17 bp, Homo sapiens
tataaacagaaatggaa

SEQ ID NO: 1372732 - DNA, 16 bp, Homo sapiens
tataaaggataaagaa

SEQ ID NO: 1372733 - DNA, 14 bp, Homo sapiens
tataaatgtataaa

SEQ ID NO: 1372734 - DNA, 20 bp, Homo sapiens
tataaatgtataaatataca

SEQ ID NO: 1372735 - DNA, 13 bp, Homo sapiens
tataactgtattt

SEQ ID NO: 1372736 - DNA, 18 bp, Homo sapiens
tataagccaaaattaagg

SEQ ID NO: 1372737 - DNA, 23 bp, Homo sapiens
tataagccaaaattaaggtgttt

SEQ ID NO: 1372738 - DNA, 16 bp, Homo sapiens
tataaggaaagcaata

SEQ ID NO: 1372739 - DNA, 14 bp, Homo sapiens
tataagtgaagtga

SEQ ID NO: 1372740 - DNA, 12 bp, Homo sapiens
tataataaaaat

SEQ ID NO: 1372741 - DNA, 12 bp, Homo sapiens
tataataaatat

SEQ ID NO: 1372742 - DNA, 19 bp, Homo sapiens
tataatccttaaatcttaa

SEQ ID NO: 1372743 - DNA, 16 bp, Homo sapiens
tataatcttataattg

SEQ ID NO: 1372744 - DNA, 13 bp, Homo sapiens
tataatgaataaa

SEQ ID NO: 1372745 - DNA, 15 bp, Homo sapiens
tataatgaataaatc

SEQ ID NO: 1372746 - DNA, 22 bp, Homo sapiens
tataattcctatatcctgtgac

SEQ ID NO: 1372747 - DNA, 23 bp, Homo sapiens
tataattgtacaaaattaagcaa

SEQ ID NO: 1372748 - DNA, 21 bp, Homo sapiens
tataattgttctcagaatccc

SEQ ID NO: 1372749 - DNA, 14 bp, Homo sapiens
tatacaaaataaga

SEQ ID NO: 1372750 - DNA, 21 bp, Homo sapiens
tatacaaaataagaacgagga

SEQ ID NO: 1372751 - DNA, 21 bp, Homo sapiens
tatacacgaatagacatcaaa

SEQ ID NO: 1372752 - DNA, 17 bp, Homo sapiens
tataccagcaatatatc

SEQ ID NO: 1372753 - DNA, 23 bp, Homo sapiens
tatagaaaaataaaaatctcttt

SEQ ID NO: 1372754 - DNA, 16 bp, Homo sapiens
tatagcaacaacaatt

SEQ ID NO: 1372755 - DNA, 18 bp, Homo sapiens
tatagcatcacttaaaac

SEQ ID NO: 1372756 - DNA, 20 bp, Homo sapiens
tatagcctatggcagaaaaa

SEQ ID NO: 1372757 - DNA, 14 bp, Homo sapiens
tatagcctggactg

SEQ ID NO: 1372758 - DNA, 15 bp, Homo sapiens
tatagcttgcagaac

SEQ ID NO: 1372759 - DNA, 19 bp, Homo sapiens
tatagtctaagactatata

SEQ ID NO: 1372760 - DNA, 13 bp, Homo sapiens
tatataaatgtat

SEQ ID NO: 1372761 - DNA, 18 bp, Homo sapiens
tatatacaaaaagaaaat

SEQ ID NO: 1372762 - DNA, 14 bp, Homo sapiens
tatataggctattt

SEQ ID NO: 1372763 - DNA, 18 bp, Homo sapiens
tatataggctattttcta

SEQ ID NO: 1372764 - DNA, 15 bp, Homo sapiens
tatatatacatatat

SEQ ID NO: 1372765 - DNA, 11 bp, Homo sapiens
tatatatataa

SEQ ID NO: 1372766 - DNA, 21 bp, Homo sapiens
tatatatgtgtatgcacagta

SEQ ID NO: 1372767 - DNA, 13 bp, Homo sapiens
tatatatttctat

SEQ ID NO: 1372768 - DNA, 23 bp, Homo sapiens
tatatattttgtgtgaaattgca

SEQ ID NO: 1372769 - DNA, 14 bp, Homo sapiens
tatatcatgcaaaa

SEQ ID NO: 1372770 - DNA, 17 bp, Homo sapiens
tatatctatctatttga

SEQ ID NO: 1372771 - DNA, 22 bp, Homo sapiens
tatatggtatatatacatatat

SEQ ID NO: 1372772 - DNA, 15 bp, Homo sapiens
tatatgtatgtgttt

SEQ ID NO: 1372773 - DNA, 16 bp, Homo sapiens
tatatgtattatttat

SEQ ID NO: 1372774 - DNA, 18 bp, Homo sapiens
tatattaaaaaagagaca

SEQ ID NO: 1372775 - DNA, 16 bp, Homo sapiens
tatattactgacattt

SEQ ID NO: 1372776 - DNA, 23 bp, Homo sapiens
tatattactgacatttcttctag

SEQ ID NO: 1372777 - DNA, 16 bp, Homo sapiens
tatattctttcaaagg

SEQ ID NO: 1372778 - DNA, 12 bp, Homo sapiens
tatattgaactt

SEQ ID NO: 1372779 - DNA, 16 bp, Homo sapiens
tatattggttttatga

SEQ ID NO: 1372780 - DNA, 19 bp, Homo sapiens
tatattggttttatgatga

SEQ ID NO: 1372781 - DNA, 14 bp, Homo sapiens
tatatttcctttat

SEQ ID NO: 1372782 - DNA, 16 bp, Homo sapiens
tatatttcctttatgt

SEQ ID NO: 1372783 - DNA, 19 bp, Homo sapiens
tatatttcctttatgtgaa

SEQ ID NO: 1372784 - DNA, 20 bp, Homo sapiens
tatatttcctttatgtgaat

SEQ ID NO: 1372785 - DNA, 22 bp, Homo sapiens
tatatttcctttatgtgaattt

SEQ ID NO: 1372786 - DNA, 13 bp, Homo sapiens
tatatttctatta

SEQ ID NO: 1372787 - DNA, 16 bp, Homo sapiens
tatatttgatttatta

SEQ ID NO: 1372788 - DNA, 15 bp, Homo sapiens
tatatttgtaaagct

SEQ ID NO: 1372789 - DNA, 15 bp, Homo sapiens
tatattttatattac

SEQ ID NO: 1372790 - DNA, 17 bp, Homo sapiens
tacataaaagaaataaa

SEQ ID NO: 1372791 - DNA, 19 bp, Homo sapiens
tacatacgatttaaggtat

SEQ ID NO: 1372792 - DNA, 20 bp, Homo sapiens
tacatataaaatgtaattac

SEQ ID NO: 1372793 - DNA, 20 bp, Homo sapiens
tacatcttttcaacaagtaa

SEQ ID NO: 1372794 - DNA, 19 bp, Homo sapiens
tacatgaggaactgtagat

SEQ ID NO: 1372795 - DNA, 20 bp, Homo sapiens
tacatgaggaactgtagatg

SEQ ID NO: 1372796 - DNA, 17 bp, Homo sapiens
tacatgtgatacatttt

SEQ ID NO: 1372797 - DNA, 13 bp, Homo sapiens
tacatgtttataa

SEQ ID NO: 1372798 - DNA, 17 bp, Homo sapiens
tacatgtttataaatct

SEQ ID NO: 1372799 - DNA, 17 bp, Homo sapiens
tacatttatttatccag

SEQ ID NO: 1372800 - DNA, 19 bp, Homo sapiens
tacatttgggagtttttat

SEQ ID NO: 1372801 - DNA, 18 bp, Homo sapiens
taccaaggtcttcttaat

SEQ ID NO: 1372802 - DNA, 15 bp, Homo sapiens
tacccatagacatga

SEQ ID NO: 1372803 - DNA, 16 bp, Homo sapiens
tacccatagacatgaa

SEQ ID NO: 1372804 - DNA, 18 bp, Homo sapiens
tacccatagacatgaaag

SEQ ID NO: 1372805 - DNA, 18 bp, Homo sapiens
tacccggggcccagggca

SEQ ID NO: 1372806 - DNA, 16 bp, Homo sapiens
tacctagtgaaacttt

SEQ ID NO: 1372807 - DNA, 22 bp, Homo sapiens
tacctagtgaaacttttctaga

SEQ ID NO: 1372808 - DNA, 17 bp, Homo sapiens
tacctccaaccctgccg

SEQ ID NO: 1372809 - DNA, 21 bp, Homo sapiens
tacctgatttcttcagggctg

SEQ ID NO: 1372810 - DNA, 20 bp, Homo sapiens
tacctgtatacagtgcagag

SEQ ID NO: 1372811 - DNA, 14 bp, Homo sapiens
taccttatcttaca

SEQ ID NO: 1372812 - DNA, 15 bp, Homo sapiens
tacctttcaaagctt

SEQ ID NO: 1372813 - DNA, 23 bp, Homo sapiens
tacgtttctttaaccttgtataa

SEQ ID NO: 1372814 - DNA, 19 bp, Homo sapiens
tactaaaaagtataaaata

SEQ ID NO: 1372815 - DNA, 19 bp, Homo sapiens
tactaaacagtaagatatc

SEQ ID NO: 1372816 - DNA, 22 bp, Homo sapiens
tactactttgttaggattttca

SEQ ID NO: 1372817 - DNA, 23 bp, Homo sapiens
tactaggaagaacgttttttcct

SEQ ID NO: 1372818 - DNA, 17 bp, Homo sapiens
tactatccagttactgc

SEQ ID NO: 1372819 - DNA, 19 bp, Homo sapiens
tactattcaggtaacacta

SEQ ID NO: 1372820 - DNA, 12 bp, Homo sapiens
tactatttaaga

SEQ ID NO: 1372821 - DNA, 19 bp, Homo sapiens
tactatttaagatgtgaaa

SEQ ID NO: 1372822 - DNA, 13 bp, Homo sapiens
tactccctgcaga

SEQ ID NO: 1372823 - DNA, 21 bp, Homo sapiens
tactctccttgagtgtatgag

SEQ ID NO: 1372824 - DNA, 17 bp, Homo sapiens
tactgaaccacttgtag

SEQ ID NO: 1372825 - DNA, 19 bp, Homo sapiens
tactgaaccacttgtagat

SEQ ID NO: 1372826 - DNA, 12 bp, Homo sapiens
tactgaaggaaa

SEQ ID NO: 1372827 - DNA, 14 bp, Homo sapiens
tactgatggaattt

SEQ ID NO: 1372828 - DNA, 18 bp, Homo sapiens
tactggatttgttgttct

SEQ ID NO: 1372829 - DNA, 18 bp, Homo sapiens
tactggcttacctcctca

SEQ ID NO: 1372830 - DNA, 14 bp, Homo sapiens
tactgtcaaatgat

SEQ ID NO: 1372831 - DNA, 16 bp, Homo sapiens
tactgtcaaatgatgt

SEQ ID NO: 1372832 - DNA, 21 bp, Homo sapiens
tactgtcaaatgatgtgcaaa

SEQ ID NO: 1372833 - DNA, 13 bp, Homo sapiens
tactgtgtaaact

SEQ ID NO: 1372834 - DNA, 19 bp, Homo sapiens
tactgtgtctcatggattt

SEQ ID NO: 1372835 - DNA, 18 bp, Homo sapiens
tactgtgttttataaaat

SEQ ID NO: 1372836 - DNA, 17 bp, Homo sapiens
tactgttactgggccct

SEQ ID NO: 1372837 - DNA, 16 bp, Homo sapiens
tactgttgtaagaatt

SEQ ID NO: 1372838 - DNA, 22 bp, Homo sapiens
tactgttgtaagaattctgatt

SEQ ID NO: 1372839 - DNA, 18 bp, Homo sapiens
tacttacctagtgaaact

SEQ ID NO: 1372840 - DNA, 22 bp, Homo sapiens
tacttcttttttcaaaagaaag

SEQ ID NO: 1372841 - DNA, 16 bp, Homo sapiens
tacttgaaccataaaa

SEQ ID NO: 1372842 - DNA, 20 bp, Homo sapiens
tacttgaaccataaaatgtc

SEQ ID NO: 1372843 - DNA, 19 bp, Homo sapiens
tacttgctttaccttttca

SEQ ID NO: 1372844 - DNA, 23 bp, Homo sapiens
tacttgctttaccttttcagggc

SEQ ID NO: 1372845 - DNA, 12 bp, Homo sapiens
tacttgggaggc

SEQ ID NO: 1372846 - DNA, 14 bp, Homo sapiens
tactttgtaaattc

SEQ ID NO: 1372847 - DNA, 18 bp, Homo sapiens
tactttgtaaattctgat

SEQ ID NO: 1372848 - DNA, 19 bp, Homo sapiens
tactttgtaaattctgatt

SEQ ID NO: 1372849 - DNA, 12 bp, Homo sapiens
tactttgtattg

SEQ ID NO: 1372850 - DNA, 16 bp, Homo sapiens
tactttgtattgtcct

SEQ ID NO: 1372851 - DNA, 15 bp, Homo sapiens
tagaaaaaaaattat

SEQ ID NO: 1372852 - DNA, 18 bp, Homo sapiens
tagaaaatgtgaccctcc

SEQ ID NO: 1372853 - DNA, 20 bp, Homo sapiens
tagaaaatgtgaccctccaa

SEQ ID NO: 1372854 - DNA, 17 bp, Homo sapiens
tagaaattttgtaagaa

SEQ ID NO: 1372855 - DNA, 18 bp, Homo sapiens
tagaaattttgtaagaag

SEQ ID NO: 1372856 - DNA, 22 bp, Homo sapiens
tagaaattttgtaagaaggcaa

SEQ ID NO: 1372857 - DNA, 16 bp, Homo sapiens
tagaaccactatgaag

SEQ ID NO: 1372858 - DNA, 16 bp, Homo sapiens
tagaactccaggccct

SEQ ID NO: 1372859 - DNA, 15 bp, Homo sapiens
tagaactgtctgtga

SEQ ID NO: 1372860 - DNA, 13 bp, Homo sapiens
tagaactttgtat

SEQ ID NO: 1372861 - DNA, 22 bp, Homo sapiens
tagaagagagaggttgaaaaac

SEQ ID NO: 1372862 - DNA, 19 bp, Homo sapiens
tagaataagaatttgcata

SEQ ID NO: 1372863 - DNA, 13 bp, Homo sapiens
tagaatccctgtg

SEQ ID NO: 1372864 - DNA, 15 bp, Homo sapiens
tagaatccctgtgtt

SEQ ID NO: 1372865 - DNA, 16 bp, Homo sapiens
tagaatccctgtgtta

SEQ ID NO: 1372866 - DNA, 21 bp, Homo sapiens
tagaattaaaaaagcatactt

SEQ ID NO: 1372867 - DNA, 22 bp, Homo sapiens
tagaattatttttcactctaag

SEQ ID NO: 1372868 - DNA, 16 bp, Homo sapiens
tagaattgaaggtttt

SEQ ID NO: 1372869 - DNA, 19 bp, Homo sapiens
tagaattgaaggtttttga

SEQ ID NO: 1372870 - DNA, 18 bp, Homo sapiens
tagacagccaaaggctgg

SEQ ID NO: 1372871 - DNA, 20 bp, Homo sapiens
tagacagccaaaggctggcg

SEQ ID NO: 1372872 - DNA, 23 bp, Homo sapiens
tagacagcttttctcaactgggt

SEQ ID NO: 1372873 - DNA, 14 bp, Homo sapiens
tagacatcaaactc

SEQ ID NO: 1372874 - DNA, 11 bp, Homo sapiens
tagacatgaaa

SEQ ID NO: 1372875 - DNA, 20 bp, Homo sapiens
tagactcggggtgcttcctt

SEQ ID NO: 1372876 - DNA, 18 bp, Homo sapiens
tagacttgaaaagagaca

SEQ ID NO: 1372877 - DNA, 20 bp, Homo sapiens
tagacttgaaaagagacagg

SEQ ID NO: 1372878 - DNA, 13 bp, Homo sapiens
tagagaagcaagt

SEQ ID NO: 1372879 - DNA, 22 bp, Homo sapiens
tagagaggacaatactggggtt

SEQ ID NO: 1372880 - DNA, 13 bp, Homo sapiens
tagagccagcttg

SEQ ID NO: 1372881 - DNA, 20 bp, Homo sapiens
tagaggcttctccgccagcc

SEQ ID NO: 1372882 - DNA, 22 bp, Homo sapiens
tagaggcttctccgccagcctc

SEQ ID NO: 1372883 - DNA, 22 bp, Homo sapiens
tagagggacggccaagaatgta

SEQ ID NO: 1372884 - DNA, 17 bp, Homo sapiens
tagagtaatgaaatgga

SEQ ID NO: 1372885 - DNA, 22 bp, Homo sapiens
tagagtacactgcctgccttaa

SEQ ID NO: 1372886 - DNA, 15 bp, Homo sapiens
tagagtctgagggct

SEQ ID NO: 1372887 - DNA, 17 bp, Homo sapiens
tagagtgtagactgtgg

SEQ ID NO: 1372888 - DNA, 15 bp, Homo sapiens
tagataatattgttt

SEQ ID NO: 1372889 - DNA, 23 bp, Homo sapiens
tagatataaatttttaagagaaa

SEQ ID NO: 1372890 - DNA, 15 bp, Homo sapiens
tagatgttgccatgt

SEQ ID NO: 1372891 - DNA, 21 bp, Homo sapiens
tagatttgccatagagtacac

SEQ ID NO: 1372892 - DNA, 12 bp, Homo sapiens
tagattttccaa

SEQ ID NO: 1372893 - DNA, 19 bp, Homo sapiens
tagcaaaataaaacatagc

SEQ ID NO: 1372894 - DNA, 14 bp, Homo sapiens
tagcatactggctt

SEQ ID NO: 1372895 - DNA, 15 bp, Homo sapiens
tagcatgaaataaaa

SEQ ID NO: 1372896 - DNA, 22 bp, Homo sapiens
tagcatgtttatatctgcaaaa

SEQ ID NO: 1372897 - DNA, 15 bp, Homo sapiens
tagccagatttgtct

SEQ ID NO: 1372898 - DNA, 14 bp, Homo sapiens
tagcccaaaaccaa

SEQ ID NO: 1372899 - DNA, 17 bp, Homo sapiens
tagccccctggcctctg

SEQ ID NO: 1372900 - DNA, 18 bp, Homo sapiens
tagccccctggcctctgt

SEQ ID NO: 1372901 - DNA, 13 bp, Homo sapiens
tagccctcccact

SEQ ID NO: 1372902 - DNA, 17 bp, Homo sapiens
tagccctcccactttgc

SEQ ID NO: 1372903 - DNA, 16 bp, Homo sapiens
tagccggttcctgtcc

SEQ ID NO: 1372904 - DNA, 15 bp, Homo sapiens
agaatactgatggaa

SEQ ID NO: 1372905 - DNA, 21 bp, Homo sapiens
agaatatcctttaaaatttaa

SEQ ID NO: 1372906 - DNA, 16 bp, Homo sapiens
agaatattgcaaaata

SEQ ID NO: 1372907 - DNA, 18 bp, Homo sapiens
agaatattgcaaaataca

SEQ ID NO: 1372908 - DNA, 19 bp, Homo sapiens
agaatattgcaaaatacat

SEQ ID NO: 1372909 - DNA, 21 bp, Homo sapiens
agaatattgcaaaatacatga

SEQ ID NO: 1372910 - DNA, 15 bp, Homo sapiens
agaatccctgtgtta

SEQ ID NO: 1372911 - DNA, 16 bp, Homo sapiens
agaatgaaagctgttc

SEQ ID NO: 1372912 - DNA, 21 bp, Homo sapiens
agaatgagtccttgatttcaa

SEQ ID NO: 1372913 - DNA, 15 bp, Homo sapiens
agaatgcaaccaagt

SEQ ID NO: 1372914 - DNA, 21 bp, Homo sapiens
agaatgtacgtccagcctgcc

SEQ ID NO: 1372915 - DNA, 21 bp, Homo sapiens
agaattaagccctaaggtcct

SEQ ID NO: 1372916 - DNA, 16 bp, Homo sapiens
agaattgaaggttttt

SEQ ID NO: 1372917 - DNA, 14 bp, Homo sapiens
agaatttagtatta

SEQ ID NO: 1372918 - DNA, 17 bp, Homo sapiens
agaatttgcatacttac

SEQ ID NO: 1372919 - DNA, 12 bp, Homo sapiens
agacaaatattc

SEQ ID NO: 1372920 - DNA, 20 bp, Homo sapiens
agacaagattttttaattgt

SEQ ID NO: 1372921 - DNA, 22 bp, Homo sapiens
agacaagattttttaattgttt

SEQ ID NO: 1372922 - DNA, 12 bp, Homo sapiens
agacaataaacc

SEQ ID NO: 1372923 - DNA, 17 bp, Homo sapiens
agacaataaaccctcag

SEQ ID NO: 1372924 - DNA, 22 bp, Homo sapiens
agacaataaaccctcagagcct

SEQ ID NO: 1372925 - DNA, 16 bp, Homo sapiens
agacactgcctgggct

SEQ ID NO: 1372926 - DNA, 14 bp, Homo sapiens
agacactgttgata

SEQ ID NO: 1372927 - DNA, 19 bp, Homo sapiens
agacactgttgataaaaac

SEQ ID NO: 1372928 - DNA, 15 bp, Homo sapiens
agacagagaggactg

SEQ ID NO: 1372929 - DNA, 20 bp, Homo sapiens
agacagagaggactgtaggg

SEQ ID NO: 1372930 - DNA, 18 bp, Homo sapiens
agacagcttttctcaact

SEQ ID NO: 1372931 - DNA, 15 bp, Homo sapiens
agacaggagacaaaa

SEQ ID NO: 1372932 - DNA, 17 bp, Homo sapiens
agacagtgtatgtagaa

SEQ ID NO: 1372933 - DNA, 23 bp, Homo sapiens
agacagtgtatgtagaagcatga

SEQ ID NO: 1372934 - DNA, 22 bp, Homo sapiens
agacatactccttccatcaaat

SEQ ID NO: 1372935 - DNA, 19 bp, Homo sapiens
agacatctgaggttttatt

SEQ ID NO: 1372936 - DNA, 18 bp, Homo sapiens
agacatgttttccgtgaa

SEQ ID NO: 1372937 - DNA, 19 bp, Homo sapiens
agaccacgcccgtcctgcc

SEQ ID NO: 1372938 - DNA, 15 bp, Homo sapiens
agaccagattaaact

SEQ ID NO: 1372939 - DNA, 15 bp, Homo sapiens
agaccatcctggcta

SEQ ID NO: 1372940 - DNA, 21 bp, Homo sapiens
agaccccggcttcctttccca

SEQ ID NO: 1372941 - DNA, 19 bp, Homo sapiens
agaccctcttgcccatcct

SEQ ID NO: 1372942 - DNA, 20 bp, Homo sapiens
agaccctcttgcccatcctg

SEQ ID NO: 1372943 - DNA, 17 bp, Homo sapiens
agaccctgggtgggctc

SEQ ID NO: 1372944 - DNA, 20 bp, Homo sapiens
agaccctgggtgggctctgt

SEQ ID NO: 1372945 - DNA, 13 bp, Homo sapiens
taaaacccaagtg

SEQ ID NO: 1372946 - DNA, 17 bp, Homo sapiens
taaaagttgcattttaa

SEQ ID NO: 1372947 - DNA, 19 bp, Homo sapiens
taaaagttttatatgcttt

SEQ ID NO: 1372948 - DNA, 17 bp, Homo sapiens
taaaataaaatgaaaat

SEQ ID NO: 1372949 - DNA, 19 bp, Homo sapiens
taaaataaaatgaaaattg

SEQ ID NO: 1372950 - DNA, 17 bp, Homo sapiens
taaaataaggatttttc

SEQ ID NO: 1372951 - DNA, 19 bp, Homo sapiens
taaaataattatataactg

SEQ ID NO: 1372952 - DNA, 19 bp, Homo sapiens
taaaatacatagtgaaaat

SEQ ID NO: 1372953 - DNA, 16 bp, Homo sapiens
taaaatagtatgaaaa

SEQ ID NO: 1372954 - DNA, 23 bp, Homo sapiens
taaaatattgttgaacacttgaa

SEQ ID NO: 1372955 - DNA, 12 bp, Homo sapiens
taaaatcatgaa

SEQ ID NO: 1372956 - DNA, 15 bp, Homo sapiens
taaaatcctgtgcaa

SEQ ID NO: 1372957 - DNA, 17 bp, Homo sapiens
taaaatctgagggaaat

SEQ ID NO: 1372958 - DNA, 22 bp, Homo sapiens
taaaatctgagggaaatgtttt

SEQ ID NO: 1372959 - DNA, 15 bp, Homo sapiens
taaaatgaaaattgt

SEQ ID NO: 1372960 - DNA, 16 bp, Homo sapiens
taaaatgaaaattgta

SEQ ID NO: 1372961 - DNA, 15 bp, Homo sapiens
taaaatgcaatgtaa

SEQ ID NO: 1372962 - DNA, 17 bp, Homo sapiens
taaaatgtaatttaaat

SEQ ID NO: 1372963 - DNA, 20 bp, Homo sapiens
taaaatgtaatttaaatgaa

SEQ ID NO: 1372964 - DNA, 14 bp, Homo sapiens
taaaatttgttgca

SEQ ID NO: 1372965 - DNA, 15 bp, Homo sapiens
taaaatttgttgcat

SEQ ID NO: 1372966 - DNA, 16 bp, Homo sapiens
taaacaaaatgaagct

SEQ ID NO: 1372967 - DNA, 17 bp, Homo sapiens
taaacactcaccttcta

SEQ ID NO: 1372968 - DNA, 13 bp, Homo sapiens
taaaccctcagag

SEQ ID NO: 1372969 - DNA, 21 bp, Homo sapiens
taaacctaggacttccgagct

SEQ ID NO: 1372970 - DNA, 18 bp, Homo sapiens
taaactcatctgaaatgt

SEQ ID NO: 1372971 - DNA, 23 bp, Homo sapiens
taaacttctgcaacaagcatgca

SEQ ID NO: 1372972 - DNA, 14 bp, Homo sapiens
taaagaaaaaaatg

SEQ ID NO: 1372973 - DNA, 20 bp, Homo sapiens
taaagaaaaatatcttggcc

SEQ ID NO: 1372974 - DNA, 16 bp, Homo sapiens
taaagaaaagatgaaa

SEQ ID NO: 1372975 - DNA, 14 bp, Homo sapiens
taaagaagtatttt

SEQ ID NO: 1372976 - DNA, 19 bp, Homo sapiens
taaagaatatgacttttta

SEQ ID NO: 1372977 - DNA, 19 bp, Homo sapiens
taaagaccctcctattcta

SEQ ID NO: 1372978 - DNA, 15 bp, Homo sapiens
taaagactggctttt

SEQ ID NO: 1372979 - DNA, 19 bp, Homo sapiens
taaagactggttttctgcc

SEQ ID NO: 1372980 - DNA, 16 bp, Homo sapiens
taaagagcccttgcct

SEQ ID NO: 1372981 - DNA, 17 bp, Homo sapiens
taaagagcccttgcctc

SEQ ID NO: 1372982 - DNA, 14 bp, Homo sapiens
taaagcaatagaaa

SEQ ID NO: 1372983 - DNA, 13 bp, Homo sapiens
taaagcagtattt

SEQ ID NO: 1372984 - DNA, 20 bp, Homo sapiens
taaagcatgaaatgtgaatt

SEQ ID NO: 1372985 - DNA, 15 bp, Homo sapiens
taaagctaaggacct

SEQ ID NO: 1372986 - DNA, 20 bp, Homo sapiens
taaagcttgttgactcagct

SEQ ID NO: 1372987 - DNA, 18 bp, Homo sapiens
taaagtattcttctcttc

SEQ ID NO: 1372988 - DNA, 17 bp, Homo sapiens
taaagtttgcttagaaa

SEQ ID NO: 1372989 - DNA, 14 bp, Homo sapiens
taaataaaaactaa

SEQ ID NO: 1372990 - DNA, 14 bp, Homo sapiens
taaataaaatttgt

SEQ ID NO: 1372991 - DNA, 14 bp, Homo sapiens
taaataaaccactg

SEQ ID NO: 1372992 - DNA, 12 bp, Homo sapiens
taaataattctt

SEQ ID NO: 1372993 - DNA, 14 bp, Homo sapiens
taaataatttattt

SEQ ID NO: 1372994 - DNA, 17 bp, Homo sapiens
taaataatttatttaat

SEQ ID NO: 1372995 - DNA, 16 bp, Homo sapiens
taaatacatatggatg

SEQ ID NO: 1372996 - DNA, 16 bp, Homo sapiens
taaatacatgcatata

SEQ ID NO: 1372997 - DNA, 23 bp, Homo sapiens
taaataggaatcattcagaaatg

SEQ ID NO: 1372998 - DNA, 16 bp, Homo sapiens
taaatattttctattt

SEQ ID NO: 1372999 - DNA, 14 bp, Homo sapiens
taaatctaaatcta

SEQ ID NO: 1373000 - DNA, 16 bp, Homo sapiens
taaatctatttattaa

SEQ ID NO: 1373001 - DNA, 20 bp, Homo sapiens
taaatctatttattaatatt

SEQ ID NO: 1373002 - DNA, 15 bp, Homo sapiens
taaatcttaatgttc

SEQ ID NO: 1373003 - DNA, 17 bp, Homo sapiens
taaatcttaatgttcct

SEQ ID NO: 1373004 - DNA, 19 bp, Homo sapiens
taaatcttaatgttcctca

SEQ ID NO: 1373005 - DNA, 15 bp, Homo sapiens
taaatgccatagaaa

SEQ ID NO: 1373006 - DNA, 23 bp, Homo sapiens
taaatggcctcatgtggctggaa

SEQ ID NO: 1373007 - DNA, 12 bp, Homo sapiens
taaatgtaaact

SEQ ID NO: 1373008 - DNA, 17 bp, Homo sapiens
taaatgttacctctgaa

SEQ ID NO: 1373009 - DNA, 13 bp, Homo sapiens
taaatgttattat

SEQ ID NO: 1373010 - DNA, 21 bp, Homo sapiens
taaatgtttcttttaaagacc

SEQ ID NO: 1373011 - DNA, 13 bp, Homo sapiens
taaattacaattt

SEQ ID NO: 1373012 - DNA, 23 bp, Homo sapiens
taaattacaattttatctgtttc

SEQ ID NO: 1373013 - DNA, 17 bp, Homo sapiens
taaattaggaataaata

SEQ ID NO: 1373014 - DNA, 10 bp, Homo sapiens
taaattattt

SEQ ID NO: 1373015 - DNA, 13 bp, Homo sapiens
taaattatttatg

SEQ ID NO: 1373016 - DNA, 23 bp, Homo sapiens
taaattatttgattatttaagac

SEQ ID NO: 1373017 - DNA, 13 bp, Homo sapiens
taaattctgattt

SEQ ID NO: 1373018 - DNA, 16 bp, Homo sapiens
taaattctgatttctt

SEQ ID NO: 1373019 - DNA, 21 bp, Homo sapiens
taaatttcactactagattga

SEQ ID NO: 1373020 - DNA, 16 bp, Homo sapiens
taaatttcttatgtga

SEQ ID NO: 1373021 - DNA, 22 bp, Homo sapiens
taaatttcttatgtgacattaa

SEQ ID NO: 1373022 - DNA, 13 bp, Homo sapiens
taaatttttaaga

SEQ ID NO: 1373023 - DNA, 22 bp, Homo sapiens
taaatttttttgtatgaaaaca

SEQ ID NO: 1373024 - DNA, 13 bp, Homo sapiens
taacaaagacaaa

SEQ ID NO: 1373025 - DNA, 19 bp, Homo sapiens
taacacatttttttgcatg

SEQ ID NO: 1373026 - DNA, 21 bp, Homo sapiens
taacacatttttttgcatgca

SEQ ID NO: 1373027 - DNA, 18 bp, Homo sapiens
taacaccatgattaacca

SEQ ID NO: 1373028 - DNA, 13 bp, Homo sapiens
taacagaaattgt

SEQ ID NO: 1373029 - DNA, 23 bp, Homo sapiens
taacagttgtatttaacagaaat

SEQ ID NO: 1373030 - DNA, 12 bp, Homo sapiens
taacataaattt

SEQ ID NO: 1373031 - DNA, 12 bp, Homo sapiens
taacattattta

SEQ ID NO: 1373032 - DNA, 16 bp, Homo sapiens
taacccataattgaag

SEQ ID NO: 1373033 - DNA, 14 bp, Homo sapiens
taacctcgccctct

SEQ ID NO: 1373034 - DNA, 17 bp, Homo sapiens
taacctcgccctctcct

SEQ ID NO: 1373035 - DNA, 13 bp, Homo sapiens
taaccttgtataa

SEQ ID NO: 1373036 - DNA, 20 bp, Homo sapiens
taactcaaatacacatttgc

SEQ ID NO: 1373037 - DNA, 21 bp, Homo sapiens
taactcaaatacacatttgct

SEQ ID NO: 1373038 - DNA, 21 bp, Homo sapiens
taactcaccagccccactgcc

SEQ ID NO: 1373039 - DNA, 15 bp, Homo sapiens
taactccccacccca

SEQ ID NO: 1373040 - DNA, 16 bp, Homo sapiens
taactgcatttttaga

SEQ ID NO: 1373041 - DNA, 13 bp, Homo sapiens
taactgtaaatca

SEQ ID NO: 1373042 - DNA, 21 bp, Homo sapiens
taactgtcaggctgaaaacaa

SEQ ID NO: 1373043 - DNA, 22 bp, Homo sapiens
taactgtcaggctgaaaacaat

SEQ ID NO: 1373044 - DNA, 16 bp, Homo sapiens
taacttaactgaaatg

SEQ ID NO: 1373045 - DNA, 19 bp, Homo sapiens
taacttgcttaaatttctt

SEQ ID NO: 1373046 - DNA, 21 bp, Homo sapiens
taagaaaatatattctttcaa

SEQ ID NO: 1373047 - DNA, 23 bp, Homo sapiens
taagaaaatatattctttcaaag

SEQ ID NO: 1373048 - DNA, 24 bp, Homo sapiens
taagaaacttatttctcatatcaa

SEQ ID NO: 1373049 - DNA, 15 bp, Homo sapiens
taagaacgaggattt

SEQ ID NO: 1373050 - DNA, 14 bp, Homo sapiens
taagaattcaaact

SEQ ID NO: 1373051 - DNA, 22 bp, Homo sapiens
taagaattcaaactggggcctc

SEQ ID NO: 1373052 - DNA, 15 bp, Homo sapiens
taagaattcagacat

SEQ ID NO: 1373053 - DNA, 20 bp, Homo sapiens
taagaattctgattgatttg

SEQ ID NO: 1373054 - DNA, 14 bp, Homo sapiens
taagaatttgcata

SEQ ID NO: 1373055 - DNA, 18 bp, Homo sapiens
taagaatttgcatactta

SEQ ID NO: 1373056 - DNA, 15 bp, Homo sapiens
taagatagtgtaact

SEQ ID NO: 1373057 - DNA, 20 bp, Homo sapiens
taagatagtgtaacttgctt

SEQ ID NO: 1373058 - DNA, 12 bp, Homo sapiens
taagatcactgt

SEQ ID NO: 1373059 - DNA, 15 bp, Homo sapiens
taagatcactgttta

SEQ ID NO: 1373060 - DNA, 16 bp, Homo sapiens
aaagcatttttcaata

SEQ ID NO: 1373061 - DNA, 10 bp, Homo sapiens
aaagccttcc

SEQ ID NO: 1373062 - DNA, 19 bp, Homo sapiens
aaagctagtcaacagtacc

SEQ ID NO: 1373063 - DNA, 20 bp, Homo sapiens
aaagctcctggggcgtccag

SEQ ID NO: 1373064 - DNA, 13 bp, Homo sapiens
aaagctgagcctg

SEQ ID NO: 1373065 - DNA, 14 bp, Homo sapiens
aaagctgttccttg

SEQ ID NO: 1373066 - DNA, 11 bp, Homo sapiens
aaagcttcccc

SEQ ID NO: 1373067 - DNA, 19 bp, Homo sapiens
aaagcttggattaaataca

SEQ ID NO: 1373068 - DNA, 18 bp, Homo sapiens
aaagcttggttctgtgaa

SEQ ID NO: 1373069 - DNA, 15 bp, Homo sapiens
aaaggaaagaaaaca

SEQ ID NO: 1373070 - DNA, 17 bp, Homo sapiens
aaaggaacattgtgtct

SEQ ID NO: 1373071 - DNA, 13 bp, Homo sapiens
aaaggagagcatc

SEQ ID NO: 1373072 - DNA, 22 bp, Homo sapiens
aaaggataaagaaggatgatgt

SEQ ID NO: 1373073 - DNA, 21 bp, Homo sapiens
aaaggatagtaagcatagaaa

SEQ ID NO: 1373074 - DNA, 14 bp, Homo sapiens
aaaggcttataaaa

SEQ ID NO: 1373075 - DNA, 13 bp, Homo sapiens
aagttaaaattgt

SEQ ID NO: 1373076 - DNA, 17 bp, Homo sapiens
aagttagtttgtatata

SEQ ID NO: 1373077 - DNA, 15 bp, Homo sapiens
aagttattgcagttt

SEQ ID NO: 1373078 - DNA, 11 bp, Homo sapiens
aagttcttatg

SEQ ID NO: 1373079 - DNA, 19 bp, Homo sapiens
aagttcttatgaggagggg

SEQ ID NO: 1373080 - DNA, 20 bp, Homo sapiens
aagttcttatgaggagggga

SEQ ID NO: 1373081 - DNA, 15 bp, Homo sapiens
aagttgaaaatcata

SEQ ID NO: 1373082 - DNA, 21 bp, Homo sapiens
aagttgaaaatcataggcacc

SEQ ID NO: 1373083 - DNA, 18 bp, Homo sapiens
aagttgagctatgactta

SEQ ID NO: 1373084 - DNA, 22 bp, Homo sapiens
aagttgcagatgttagatattt

SEQ ID NO: 1373085 - DNA, 14 bp, Homo sapiens
aagttgtaaagtat

SEQ ID NO: 1373086 - DNA, 17 bp, Homo sapiens
aagttgtaaagtatgta

SEQ ID NO: 1373087 - DNA, 18 bp, Homo sapiens
aagtttacaatcaaagga

SEQ ID NO: 1373088 - DNA, 15 bp, Homo sapiens
aagtttgcttagaaa

SEQ ID NO: 1373089 - DNA, 13 bp, Homo sapiens
aagttttatatgc

SEQ ID NO: 1373090 - DNA, 15 bp, Homo sapiens
aagttttgacaagct

SEQ ID NO: 1373091 - DNA, 12 bp, Homo sapiens
aagttttgttgt

SEQ ID NO: 1373092 - DNA, 23 bp, Homo sapiens
aagtttttttgctgctgcctctt

SEQ ID NO: 1373093 - DNA, 20 bp, Homo sapiens
aataaaaatatattttcaac

SEQ ID NO: 1373094 - DNA, 19 bp, Homo sapiens
aataaaatgaaaattgtat

SEQ ID NO: 1373095 - DNA, 12 bp, Homo sapiens
aataaaatttaa

SEQ ID NO: 1373096 - DNA, 14 bp, Homo sapiens
aataaaatttgttg

SEQ ID NO: 1373097 - DNA, 13 bp, Homo sapiens
aataaactttaat

SEQ ID NO: 1373098 - DNA, 16 bp, Homo sapiens
aataaataattttcat

SEQ ID NO: 1373099 - DNA, 21 bp, Homo sapiens
aataaatcattcttactaaaa

SEQ ID NO: 1373100 - DNA, 15 bp, Homo sapiens
aataaattttgaaaa

SEQ ID NO: 1373101 - DNA, 13 bp, Homo sapiens
aataacagctgca

SEQ ID NO: 1373102 - DNA, 18 bp, Homo sapiens
aataaccctttggttttt

SEQ ID NO: 1373103 - DNA, 20 bp, Homo sapiens
aataactggaacaaattatt

SEQ ID NO: 1373104 - DNA, 15 bp, Homo sapiens
aataactgtgtactg

SEQ ID NO: 1373105 - DNA, 19 bp, Homo sapiens
aataagcactgtaaacttc

SEQ ID NO: 1373106 - DNA, 23 bp, Homo sapiens
aataagctagttgaatacttgaa

SEQ ID NO: 1373107 - DNA, 14 bp, Homo sapiens
aataaggatttttc

SEQ ID NO: 1373108 - DNA, 21 bp, Homo sapiens
aataagtgtgtggtagaaaca

SEQ ID NO: 1373109 - DNA, 11 bp, Homo sapiens
aataatcaaga

SEQ ID NO: 1373110 - DNA, 15 bp, Homo sapiens
aataatcaagagcct

SEQ ID NO: 1373111 - DNA, 14 bp, Homo sapiens
aataatcttgtttc

SEQ ID NO: 1373112 - DNA, 18 bp, Homo sapiens
aatacaacttaaataata

SEQ ID NO: 1373113 - DNA, 16 bp, Homo sapiens
aaattacaattttatc

SEQ ID NO: 1373114 - DNA, 16 bp, Homo sapiens
aaattaggaataaata

SEQ ID NO: 1373115 - DNA, 16 bp, Homo sapiens
aaattatcaatatcta

SEQ ID NO: 1373116 - DNA, 15 bp, Homo sapiens
aaattcaactttgta

SEQ ID NO: 1373117 - DNA, 16 bp, Homo sapiens
aaattcatttctaatt

SEQ ID NO: 1373118 - DNA, 11 bp, Homo sapiens
aaattcctgta

SEQ ID NO: 1373119 - DNA, 16 bp, Homo sapiens
aaattctcctggaggt

SEQ ID NO: 1373120 - DNA, 12 bp, Homo sapiens
aaattctgattt

SEQ ID NO: 1373121 - DNA, 16 bp, Homo sapiens
aaattctgatttcttt

SEQ ID NO: 1373122 - DNA, 17 bp, Homo sapiens
aaattctgatttctttt

SEQ ID NO: 1373123 - DNA, 15 bp, Homo sapiens
aaattgcatactttg

SEQ ID NO: 1373124 - DNA, 17 bp, Homo sapiens
aaattgcatactttgta

SEQ ID NO: 1373125 - DNA, 23 bp, Homo sapiens
aaattgcatactttgtattttga

SEQ ID NO: 1373126 - DNA, 19 bp, Homo sapiens
aaattgttatcaaaatagt

SEQ ID NO: 1373127 - DNA, 15 bp, Homo sapiens
aaattgtttagtgat

SEQ ID NO: 1373128 - DNA, 13 bp, Homo sapiens
aaatttaaaaaat

SEQ ID NO: 1373129 - DNA, 16 bp, Homo sapiens
aaatttaaaaaataaa

SEQ ID NO: 1373130 - DNA, 12 bp, Homo sapiens
aaatttagaaca

SEQ ID NO: 1373131 - DNA, 15 bp, Homo sapiens
aaatttcttatgtga

SEQ ID NO: 1373132 - DNA, 21 bp, Homo sapiens
aaatttgtctggttaaaaaat

SEQ ID NO: 1373133 - DNA, 13 bp, Homo sapiens
aaatttgttgcat

SEQ ID NO: 1373134 - DNA, 19 bp, Homo sapiens
acttaaatggtaataagca

SEQ ID NO: 1373135 - DNA, 20 bp, Homo sapiens
acttaacatagccaaaatgt

SEQ ID NO: 1373136 - DNA, 15 bp, Homo sapiens
acttaataactgtgt

SEQ ID NO: 1373137 - DNA, 17 bp, Homo sapiens
acttaataactgtgtac

SEQ ID NO: 1373138 - DNA, 22 bp, Homo sapiens
acttagaatccctgtgttaatt

SEQ ID NO: 1373139 - DNA, 15 bp, Homo sapiens
acttaggtgtggggg

SEQ ID NO: 1373140 - DNA, 23 bp, Homo sapiens
acttataagtgaagtgatactat

SEQ ID NO: 1373141 - DNA, 16 bp, Homo sapiens
acttcaaagcaagctg

SEQ ID NO: 1373142 - DNA, 11 bp, Homo sapiens
acttcagctga

SEQ ID NO: 1373143 - DNA, 16 bp, Homo sapiens
acttcagctgactttt

SEQ ID NO: 1373144 - DNA, 13 bp, Homo sapiens
acttcccaccctg

SEQ ID NO: 1373145 - DNA, 17 bp, Homo sapiens
acttcccaccctgcccc

SEQ ID NO: 1373146 - DNA, 14 bp, Homo sapiens
acttccttgagaca

SEQ ID NO: 1373147 - DNA, 14 bp, Homo sapiens
acttctacctgccc

SEQ ID NO: 1373148 - DNA, 16 bp, Homo sapiens
acttctacctgccctc

SEQ ID NO: 1373149 - DNA, 24 bp, Homo sapiens
acttctgcaacaagcatgcagctt

SEQ ID NO: 1373150 - DNA, 19 bp, Homo sapiens
acttctgccagatgtccta

SEQ ID NO: 1373151 - DNA, 16 bp, Homo sapiens
acttctgcctggagac

SEQ ID NO: 1373152 - DNA, 14 bp, Homo sapiens
acttcttctccatc

SEQ ID NO: 1373153 - DNA, 17 bp, Homo sapiens
acttcttctccatccct

SEQ ID NO: 1373154 - DNA, 13 bp, Homo sapiens
acttcttctctta

SEQ ID NO: 1373155 - DNA, 11 bp, Homo sapiens
acttgaaaaga

SEQ ID NO: 1373156 - DNA, 16 bp, Homo sapiens
acttgaaccataaaat

SEQ ID NO: 1373157 - DNA, 20 bp, Homo sapiens
acttgaagccatctaaagta

SEQ ID NO: 1373158 - DNA, 15 bp, Homo sapiens
acttgaatgtgtcag

SEQ ID NO: 1373159 - DNA, 13 bp, Homo sapiens
acttgaggcctga

SEQ ID NO: 1373160 - DNA, 16 bp, Homo sapiens
acttgcttaaatttct

SEQ ID NO: 1373161 - DNA, 16 bp, Homo sapiens
acttgcttatttgaca

SEQ ID NO: 1373162 - DNA, 23 bp, Homo sapiens
acttggaagcacaccaatcttac

SEQ ID NO: 1373163 - DNA, 13 bp, Homo sapiens
acttggttttatg

SEQ ID NO: 1373164 - DNA, 13 bp, Homo sapiens
acttgtagatttg

SEQ ID NO: 1373165 - DNA, 14 bp, Homo sapiens
acttgtagatttga

SEQ ID NO: 1373166 - DNA, 15 bp, Homo sapiens
acttgtagatttgat

SEQ ID NO: 1373167 - DNA, 16 bp, Homo sapiens
acttgtagatttgatt

SEQ ID NO: 1373168 - DNA, 10 bp, Homo sapiens
acttgtgttt

SEQ ID NO: 1373169 - DNA, 16 bp, Homo sapiens
acttgttgcctataag

SEQ ID NO: 1373170 - DNA, 14 bp, Homo sapiens
actttacagaaatg

SEQ ID NO: 1373171 - DNA, 18 bp, Homo sapiens
actttacccacctagaac

SEQ ID NO: 1373172 - DNA, 18 bp, Homo sapiens
actttctgttatgggctt

SEQ ID NO: 1373173 - DNA, 17 bp, Homo sapiens
actttgatgtcagcagt

SEQ ID NO: 1373174 - DNA, 19 bp, Homo sapiens
actttgctgttccttactt

SEQ ID NO: 1373175 - DNA, 14 bp, Homo sapiens
actttgggggagga

SEQ ID NO: 1373176 - DNA, 17 bp, Homo sapiens
actttgtaaattctgat

SEQ ID NO: 1373177 - DNA, 21 bp, Homo sapiens
actttgtaaattctgatttct

SEQ ID NO: 1373178 - DNA, 17 bp, Homo sapiens
actttgtacatttggga

SEQ ID NO: 1373179 - DNA, 12 bp, Homo sapiens
actttgtatagt

SEQ ID NO: 1373180 - DNA, 17 bp, Homo sapiens
actttgtatagttatgt

SEQ ID NO: 1373181 - DNA, 16 bp, Homo sapiens
aactccacatctgcct

SEQ ID NO: 1373182 - DNA, 13 bp, Homo sapiens
aactccagcaact

SEQ ID NO: 1373183 - DNA, 15 bp, Homo sapiens
aactctgcatgtaga

SEQ ID NO: 1373184 - DNA, 18 bp, Homo sapiens
aactgaagcagcctctcc

SEQ ID NO: 1373185 - DNA, 23 bp, Homo sapiens
aactgagtattaatatctgagga

SEQ ID NO: 1373186 - DNA, 16 bp, Homo sapiens
aactgcaggccctggc

SEQ ID NO: 1373187 - DNA, 17 bp, Homo sapiens
aactgcaggccctggcc

SEQ ID NO: 1373188 - DNA, 21 bp, Homo sapiens
aactgctgactgttttctctt

SEQ ID NO: 1373189 - DNA, 23 bp, Homo sapiens
aactgctgactgttttctcttga

SEQ ID NO: 1373190 - DNA, 22 bp, Homo sapiens
aactgcttcccttactttgctg

SEQ ID NO: 1373191 - DNA, 19 bp, Homo sapiens
aactggtcaccatgaaact

SEQ ID NO: 1373192 - DNA, 15 bp, Homo sapiens
aactgtagaaatgat

SEQ ID NO: 1373193 - DNA, 16 bp, Homo sapiens
aactgtagaaatgatg

SEQ ID NO: 1373194 - DNA, 21 bp, Homo sapiens
aactgtcaggctgaaaacaat

SEQ ID NO: 1373195 - DNA, 16 bp, Homo sapiens
aactgtcctgtcctgc

SEQ ID NO: 1373196 - DNA, 20 bp, Homo sapiens
aactgtcgtgtcatactcga

SEQ ID NO: 1373197 - DNA, 14 bp, Homo sapiens
aactgtcttcctca

SEQ ID NO: 1373198 - DNA, 16 bp, Homo sapiens
aactgtgatttcagga

SEQ ID NO: 1373199 - DNA, 18 bp, Homo sapiens
aactgttgtagaagacaa

SEQ ID NO: 1373200 - DNA, 19 bp, Homo sapiens
aactgttgtagaagacaaa

SEQ ID NO: 1373201 - DNA, 14 bp, Homo sapiens
aacttaaataataa

SEQ ID NO: 1373202 - DNA, 21 bp, Homo sapiens
aacttaaatgttattatctgg

SEQ ID NO: 1373203 - DNA, 13 bp, Homo sapiens
aacttaactgaaa

SEQ ID NO: 1373204 - DNA, 23 bp, Homo sapiens
aacttccaaataaataattttca

SEQ ID NO: 1373205 - DNA, 21 bp, Homo sapiens
aacttcttctccatccctcta

SEQ ID NO: 1373206 - DNA, 19 bp, Homo sapiens
aacttgcttaaatttctta

SEQ ID NO: 1373207 - DNA, 16 bp, Homo sapiens
accctcttcctgtgat

SEQ ID NO: 1373208 - DNA, 17 bp, Homo sapiens
accctcttcctgtgatc

SEQ ID NO: 1373209 - DNA, 19 bp, Homo sapiens
accctcttcctgtgatcca

SEQ ID NO: 1373210 - DNA, 20 bp, Homo sapiens
accctcttcctgtgatccac

SEQ ID NO: 1373211 - DNA, 22 bp, Homo sapiens
accctcttgcccatcctgactg

SEQ ID NO: 1373212 - DNA, 10 bp, Homo sapiens
accctgcccc

SEQ ID NO: 1373213 - DNA, 14 bp, Homo sapiens
accctgctgagtct

SEQ ID NO: 1373214 - DNA, 16 bp, Homo sapiens
accctgctgctggtgc

SEQ ID NO: 1373215 - DNA, 17 bp, Homo sapiens
accctgggccctgggct

SEQ ID NO: 1373216 - DNA, 14 bp, Homo sapiens
accctgggggcaca

SEQ ID NO: 1373217 - DNA, 19 bp, Homo sapiens
accctgggtgggctctgtg

SEQ ID NO: 1373218 - DNA, 20 bp, Homo sapiens
accctttcccccttctctta

SEQ ID NO: 1373219 - DNA, 13 bp, Homo sapiens
accctttgggggt

SEQ ID NO: 1373220 - DNA, 21 bp, Homo sapiens
accctttggtttttttcttct

SEQ ID NO: 1373221 - DNA, 17 bp, Homo sapiens
acccttttaaagttgat

SEQ ID NO: 1373222 - DNA, 15 bp, Homo sapiens
accgaataaatgttt

SEQ ID NO: 1373223 - DNA, 18 bp, Homo sapiens
accgagtagaaaatgtga

SEQ ID NO: 1373224 - DNA, 18 bp, Homo sapiens
accgcacagctcaggagg

SEQ ID NO: 1373225 - DNA, 11 bp, Homo sapiens
accgcccatca

SEQ ID NO: 1373226 - DNA, 16 bp, Homo sapiens
accgcccctggccgcg

SEQ ID NO: 1373227 - DNA, 18 bp, Homo sapiens
accgcgggtgtgggaaag

SEQ ID NO: 1373228 - DNA, 19 bp, Homo sapiens
accgcgggtgtgggaaagc

SEQ ID NO: 1373229 - DNA, 12 bp, Homo sapiens
accggcaggtgc

SEQ ID NO: 1373230 - DNA, 15 bp, Homo sapiens
accgggccctgggtt

SEQ ID NO: 1373231 - DNA, 19 bp, Homo sapiens
accgggccctgggttcctc

SEQ ID NO: 1373232 - DNA, 21 bp, Homo sapiens
accgggtcttgattcagtcac

SEQ ID NO: 1373233 - DNA, 23 bp, Homo sapiens
accgggtcttgattcagtcacat

SEQ ID NO: 1373234 - DNA, 23 bp, Homo sapiens
accggtccagctggcctggacag

SEQ ID NO: 1373235 - DNA, 20 bp, Homo sapiens
acctagtgaaacttttctag

SEQ ID NO: 1373236 - DNA, 16 bp, Homo sapiens
acctatttccagaaat

SEQ ID NO: 1373237 - DNA, 13 bp, Homo sapiens
acctcagggctcc

SEQ ID NO: 1373238 - DNA, 18 bp, Homo sapiens
acctcagttattacatgt

SEQ ID NO: 1373239 - DNA, 21 bp, Homo sapiens
acctcatgcccaccccctgcc

SEQ ID NO: 1373240 - DNA, 23 bp, Homo sapiens
acctcatgcccaccccctgccct

SEQ ID NO: 1373241 - DNA, 15 bp, Homo sapiens
acctccaaccctgcc

SEQ ID NO: 1373242 - DNA, 19 bp, Homo sapiens
acctccacacccgtgagaa

SEQ ID NO: 1373243 - DNA, 20 bp, Homo sapiens
acctcccacaaaggagagct

SEQ ID NO: 1373244 - DNA, 14 bp, Homo sapiens
acctccccagcctg

SEQ ID NO: 1373245 - DNA, 15 bp, Homo sapiens
acctccccagcctgc

SEQ ID NO: 1373246 - DNA, 16 bp, Homo sapiens
acctccccagcctgcg

SEQ ID NO: 1373247 - DNA, 17 bp, Homo sapiens
acctccccagcctgcgc

SEQ ID NO: 1373248 - DNA, 15 bp, Homo sapiens
acctcgccctctcct

SEQ ID NO: 1373249 - DNA, 18 bp, Homo sapiens
acctctgcacaagctgca

SEQ ID NO: 1373250 - DNA, 21 bp, Homo sapiens
acctgaagtttttttgctgct

SEQ ID NO: 1373251 - DNA, 13 bp, Homo sapiens
acctgccaggcag

SEQ ID NO: 1373252 - DNA, 15 bp, Homo sapiens
acctgccaggcaggg

SEQ ID NO: 1373253 - DNA, 20 bp, Homo sapiens
acctggaagaacaggcctct

SEQ ID NO: 1373254 - DNA, 23 bp, Homo sapiens
acctggaagaacaggcctctcca

SEQ ID NO: 1373255 - DNA, 19 bp, Homo sapiens
acctggggctgctgtgaag

SEQ ID NO: 1373256 - DNA, 20 bp, Homo sapiens
acctgtatatttgtaaagct

SEQ ID NO: 1373257 - DNA, 18 bp, Homo sapiens
acctgtatttaaaaatag

SEQ ID NO: 1373258 - DNA, 23 bp, Homo sapiens
acctgtatttaaaaatagaaaca

SEQ ID NO: 1373259 - DNA, 19 bp, Homo sapiens
accttaagtaatcatctaa

SEQ ID NO: 1373260 - DNA, 13 bp, Homo sapiens
accttactaatta

SEQ ID NO: 1373261 - DNA, 14 bp, Homo sapiens
accttaggccttcc

SEQ ID NO: 1373262 - DNA, 16 bp, Homo sapiens
accttaggccttcctc

SEQ ID NO: 1373263 - DNA, 18 bp, Homo sapiens
accttaggccttcctctc

SEQ ID NO: 1373264 - DNA, 17 bp, Homo sapiens
aattaaggtgtttgaaa

SEQ ID NO: 1373265 - DNA, 18 bp, Homo sapiens
aattaaggtgtttgaaaa

SEQ ID NO: 1373266 - DNA, 15 bp, Homo sapiens
aattagccaagtgtg

SEQ ID NO: 1373267 - DNA, 20 bp, Homo sapiens
aattaggcaaggctatgtga

SEQ ID NO: 1373268 - DNA, 18 bp, Homo sapiens
aattatcttgatacattc

SEQ ID NO: 1373269 - DNA, 19 bp, Homo sapiens
aattatcttgatacattca

SEQ ID NO: 1373270 - DNA, 16 bp, Homo sapiens
aattattgacactgaa

SEQ ID NO: 1373271 - DNA, 19 bp, Homo sapiens
aattattgacactgaactt

SEQ ID NO: 1373272 - DNA, 14 bp, Homo sapiens
aattatttgattat

SEQ ID NO: 1373273 - DNA, 20 bp, Homo sapiens
aattcaaactggggcctcca

SEQ ID NO: 1373274 - DNA, 16 bp, Homo sapiens
aattcaactttgtaaa

SEQ ID NO: 1373275 - DNA, 22 bp, Homo sapiens
aattcaactttgtaaaaatctt

SEQ ID NO: 1373276 - DNA, 13 bp, Homo sapiens
aattcactcccac

SEQ ID NO: 1373277 - DNA, 23 bp, Homo sapiens
aattcactcccacacccaagaag

SEQ ID NO: 1373278 - DNA, 22 bp, Homo sapiens
aattcagacatctgaggtttta

SEQ ID NO: 1373279 - DNA, 18 bp, Homo sapiens
aattcatagtaagattga

SEQ ID NO: 1373280 - DNA, 13 bp, Homo sapiens
aattcatttctaa

SEQ ID NO: 1373281 - DNA, 14 bp, Homo sapiens
aattctccactgtg

SEQ ID NO: 1373282 - DNA, 20 bp, Homo sapiens
aattctctgtggaatgaata

SEQ ID NO: 1373283 - DNA, 23 bp, Homo sapiens
aattctgattctggctttaagcc

SEQ ID NO: 1373284 - DNA, 13 bp, Homo sapiens
aattctgatttct

SEQ ID NO: 1373285 - DNA, 14 bp, Homo sapiens
aattctgatttctt

SEQ ID NO: 1373286 - DNA, 16 bp, Homo sapiens
aattctgatttctttt

SEQ ID NO: 1373287 - DNA, 14 bp, Homo sapiens
aattctgtttttct

SEQ ID NO: 1373288 - DNA, 18 bp, Homo sapiens
aattcttttttattaatc

SEQ ID NO: 1373289 - DNA, 16 bp, Homo sapiens
aattgaaggtttttga

SEQ ID NO: 1373290 - DNA, 21 bp, Homo sapiens
aattggtaaaactcactgtga

SEQ ID NO: 1373291 - DNA, 23 bp, Homo sapiens
aattggtacttttaaaaacataa

SEQ ID NO: 1373292 - DNA, 12 bp, Homo sapiens
aattgtacaaaa

SEQ ID NO: 1373293 - DNA, 14 bp, Homo sapiens
aattgtatattgta

SEQ ID NO: 1373294 - DNA, 11 bp, Homo sapiens
aattgtatttt

SEQ ID NO: 1373295 - DNA, 12 bp, Homo sapiens
aattgtattttt

SEQ ID NO: 1373296 - DNA, 19 bp, Homo sapiens
aattgtcactttttatgct

SEQ ID NO: 1373297 - DNA, 12 bp, Homo sapiens
aattgtgaaaaa

SEQ ID NO: 1373298 - DNA, 11 bp, Homo sapiens
aattgtggcta

SEQ ID NO: 1373299 - DNA, 15 bp, Homo sapiens
aattgtgtgaacttg

SEQ ID NO: 1373300 - DNA, 13 bp, Homo sapiens
aattgtttaaaaa

SEQ ID NO: 1373301 - DNA, 12 bp, Homo sapiens
aatttaaatgaa

SEQ ID NO: 1373302 - DNA, 12 bp, Homo sapiens
aatttaagtttt

SEQ ID NO: 1373303 - DNA, 20 bp, Homo sapiens
aatttaataccagatacctt

SEQ ID NO: 1373304 - DNA, 16 bp, Homo sapiens
aatttacctgatttct

SEQ ID NO: 1373305 - DNA, 15 bp, Homo sapiens
aatttacttgttttg

SEQ ID NO: 1373306 - DNA, 13 bp, Homo sapiens
aatttagtgtttt

SEQ ID NO: 1373307 - DNA, 18 bp, Homo sapiens
aatttcctttttgacact

SEQ ID NO: 1373308 - DNA, 19 bp, Homo sapiens
aatttcctttttgacactg

SEQ ID NO: 1373309 - DNA, 20 bp, Homo sapiens
aatttctgtgccctcctgac

SEQ ID NO: 1373310 - DNA, 16 bp, Homo sapiens
aatttcttatgtgaca

SEQ ID NO: 1373311 - DNA, 23 bp, Homo sapiens
acactgcctttttatttatatgt

SEQ ID NO: 1373312 - DNA, 21 bp, Homo sapiens
acactgctgctccagtgcagg

SEQ ID NO: 1373313 - DNA, 15 bp, Homo sapiens
acactggttctcaat

SEQ ID NO: 1373314 - DNA, 18 bp, Homo sapiens
acactggttctcaatgaa

SEQ ID NO: 1373315 - DNA, 19 bp, Homo sapiens
acactggttctcaatgaaa

SEQ ID NO: 1373316 - DNA, 20 bp, Homo sapiens
acacttcttacgcaatgctt

SEQ ID NO: 1373317 - DNA, 14 bp, Homo sapiens
acacttgaaacctt

SEQ ID NO: 1373318 - DNA, 12 bp, Homo sapiens
acagaaacactg

SEQ ID NO: 1373319 - DNA, 13 bp, Homo sapiens
acagaaacactgc

SEQ ID NO: 1373320 - DNA, 20 bp, Homo sapiens
acagaaagagactccgtctc

SEQ ID NO: 1373321 - DNA, 16 bp, Homo sapiens
acagaaattgtatatt

SEQ ID NO: 1373322 - DNA, 23 bp, Homo sapiens
acagaaattgtatattgtaattt

SEQ ID NO: 1373323 - DNA, 19 bp, Homo sapiens
acagaatcttccttttatt

SEQ ID NO: 1373324 - DNA, 17 bp, Homo sapiens
acagactatttttagat

SEQ ID NO: 1373325 - DNA, 15 bp, Homo sapiens
acagagtcaaggcct

SEQ ID NO: 1373326 - DNA, 13 bp, Homo sapiens
acagatacctcca

SEQ ID NO: 1373327 - DNA, 19 bp, Homo sapiens
acagatacctccaaccctg

SEQ ID NO: 1373328 - DNA, 21 bp, Homo sapiens
acagatacctccaaccctgcc

SEQ ID NO: 1373329 - DNA, 19 bp, Homo sapiens
acagatggaaaaactgagg

SEQ ID NO: 1373330 - DNA, 19 bp, Homo sapiens
acagattctttcagttctt

SEQ ID NO: 1373331 - DNA, 16 bp, Homo sapiens
acagcaaatgcaaaaa

SEQ ID NO: 1373332 - DNA, 22 bp, Homo sapiens
acagcaacgatcacaaatgact

SEQ ID NO: 1373333 - DNA, 13 bp, Homo sapiens
acagccagcacct

SEQ ID NO: 1373334 - DNA, 16 bp, Homo sapiens
acagccagcacctggc

SEQ ID NO: 1373335 - DNA, 12 bp, Homo sapiens
acagcctgggcc

SEQ ID NO: 1373336 - DNA, 15 bp, Homo sapiens
acagcctgggcccca

SEQ ID NO: 1373337 - DNA, 18 bp, Homo sapiens
acagcctgggccccagct

SEQ ID NO: 1373338 - DNA, 14 bp, Homo sapiens
acagcgagggcagc

SEQ ID NO: 1373339 - DNA, 15 bp, Homo sapiens
acagcgagggcagct

SEQ ID NO: 1373340 - DNA, 18 bp, Homo sapiens
acagcgccagcctcagac

SEQ ID NO: 1373341 - DNA, 18 bp, Homo sapiens
acagctgcaattccctgg

SEQ ID NO: 1373342 - DNA, 19 bp, Homo sapiens
acagcttgacctgaggctg

SEQ ID NO: 1373343 - DNA, 21 bp, Homo sapiens
acagcttgacctgaggctgtg

SEQ ID NO: 1373344 - DNA, 22 bp, Homo sapiens
acagcttgacctgaggctgtgg

SEQ ID NO: 1373345 - DNA, 23 bp, Homo sapiens
acagcttgacctgaggctgtggt

SEQ ID NO: 1373346 - DNA, 21 bp, Homo sapiens
acagcttgagccgggcccctg

SEQ ID NO: 1373347 - DNA, 14 bp, Homo sapiens
acaggagacctggc

SEQ ID NO: 1373348 - DNA, 16 bp, Homo sapiens
acaggcatgtgtcacc

SEQ ID NO: 1373349 - DNA, 19 bp, Homo sapiens
acaggcatgtgtcaccatg

SEQ ID NO: 1373350 - DNA, 23 bp, Homo sapiens
acaggcctctccatttgctcttc

SEQ ID NO: 1373351 - DNA, 18 bp, Homo sapiens
acagggataaggcctgtg

SEQ ID NO: 1373352 - DNA, 20 bp, Homo sapiens
acagtaccctggttgtgtgt

SEQ ID NO: 1373353 - DNA, 13 bp, Homo sapiens
acagtagaactgt

SEQ ID NO: 1373354 - DNA, 13 bp, Homo sapiens
acagtagagccag

SEQ ID NO: 1373355 - DNA, 15 bp, Homo sapiens
acagtatcccacatc

SEQ ID NO: 1373356 - DNA, 13 bp, Homo sapiens
acagtgtatgtag

SEQ ID NO: 1373357 - DNA, 15 bp, Homo sapiens
acagtgtcccccagg

SEQ ID NO: 1373358 - DNA, 17 bp, Homo sapiens
acagtgtgtaaacaaaa

SEQ ID NO: 1373359 - DNA, 18 bp, Homo sapiens
acagtgtgtaaacaaaat

SEQ ID NO: 1373360 - DNA, 19 bp, Homo sapiens
acagttgctctatgctttc

SEQ ID NO: 1373361 - DNA, 12 bp, Homo sapiens
acagttgtattt

SEQ ID NO: 1373362 - DNA, 14 bp, Homo sapiens
acagttttcagaaa

SEQ ID NO: 1373363 - DNA, 18 bp, Homo sapiens
aagctgcccactgtttct

SEQ ID NO: 1373364 - DNA, 13 bp, Homo sapiens
aagctgggcaggt

SEQ ID NO: 1373365 - DNA, 21 bp, Homo sapiens
aagcttcatgcacttaaagaa

SEQ ID NO: 1373366 - DNA, 22 bp, Homo sapiens
aagcttcatgcacttaaagaag

SEQ ID NO: 1373367 - DNA, 17 bp, Homo sapiens
aagcttggttctgtgaa

SEQ ID NO: 1373368 - DNA, 20 bp, Homo sapiens
aaggaaaaacacaagcaaaa

SEQ ID NO: 1373369 - DNA, 16 bp, Homo sapiens
aaggaaaactacctgt

SEQ ID NO: 1373370 - DNA, 23 bp, Homo sapiens
aaggaaaactacctgtatttaaa

SEQ ID NO: 1373371 - DNA, 12 bp, Homo sapiens
aaggaaagaaaa

SEQ ID NO: 1373372 - DNA, 15 bp, Homo sapiens
aaggaaagaaaacat

SEQ ID NO: 1373373 - DNA, 13 bp, Homo sapiens
aaggaaagcaata

SEQ ID NO: 1373374 - DNA, 20 bp, Homo sapiens
aaggaagcactctgtatatt

SEQ ID NO: 1373375 - DNA, 18 bp, Homo sapiens
aaggaaggtggatggccc

SEQ ID NO: 1373376 - DNA, 13 bp, Homo sapiens
tatttcatcacaa

SEQ ID NO: 1373377 - DNA, 16 bp, Homo sapiens
tatttcctttatgtga

SEQ ID NO: 1373378 - DNA, 12 bp, Homo sapiens
tatttctactgt

SEQ ID NO: 1373379 - DNA, 16 bp, Homo sapiens
tatttctactgtcaaa

SEQ ID NO: 1373380 - DNA, 14 bp, Homo sapiens
tatttctattatta

SEQ ID NO: 1373381 - DNA, 16 bp, Homo sapiens
tcagaaacttgtgaag

SEQ ID NO: 1373382 - DNA, 17 bp, Homo sapiens
tcagaaacttgtgaagt

SEQ ID NO: 1373383 - DNA, 18 bp, Homo sapiens
tcagaagcacagaatatt

SEQ ID NO: 1373384 - DNA, 16 bp, Homo sapiens
tcagacagaacttgaa

SEQ ID NO: 1373385 - DNA, 22 bp, Homo sapiens
tcagacagagaggactgtaggg

SEQ ID NO: 1373386 - DNA, 12 bp, Homo sapiens
tcagagacagat

SEQ ID NO: 1373387 - DNA, 18 bp, Homo sapiens
tcagagatgaacatctaa

SEQ ID NO: 1373388 - DNA, 16 bp, Homo sapiens
tcagatgccacttcta

SEQ ID NO: 1373389 - DNA, 15 bp, Homo sapiens
tcagatgtttaaaac

SEQ ID NO: 1373390 - DNA, 23 bp, Homo sapiens
tcagccaaggttttataaggctg

SEQ ID NO: 1373391 - DNA, 14 bp, Homo sapiens
tcagccaagtttta

SEQ ID NO: 1373392 - DNA, 15 bp, Homo sapiens
tcagccaagttttat

SEQ ID NO: 1373393 - DNA, 13 bp, Homo sapiens
tcagccaggacca

SEQ ID NO: 1373394 - DNA, 16 bp, Homo sapiens
tcagccccctgcttca

SEQ ID NO: 1373395 - DNA, 23 bp, Homo sapiens
tcagccgtgtaaccatggaccca

SEQ ID NO: 1373396 - DNA, 16 bp, Homo sapiens
tcagcctgctccagct

SEQ ID NO: 1373397 - DNA, 22 bp, Homo sapiens
tcagctccagggaatccaagcc

SEQ ID NO: 1373398 - DNA, 13 bp, Homo sapiens
tcagctcggctca

SEQ ID NO: 1373399 - DNA, 18 bp, Homo sapiens
tcagctcggggagcctta

SEQ ID NO: 1373400 - DNA, 12 bp, Homo sapiens
tcaggaggcgcc

SEQ ID NO: 1373401 - DNA, 16 bp, Homo sapiens
tcaggcaaagaaaatg

SEQ ID NO: 1373402 - DNA, 12 bp, Homo sapiens
tcaggctcccag

SEQ ID NO: 1373403 - DNA, 16 bp, Homo sapiens
tcaggctgaaaacaat

SEQ ID NO: 1373404 - DNA, 14 bp, Homo sapiens
tcagggccatgctg

SEQ ID NO: 1373405 - DNA, 23 bp, Homo sapiens
tcaggggtgtgcggcctttggct

SEQ ID NO: 1373406 - DNA, 23 bp, Homo sapiens
tcagggtggtctcttcttggggc

SEQ ID NO: 1373407 - DNA, 19 bp, Homo sapiens
tcaggtagttgcaattgaa

SEQ ID NO: 1373408 - DNA, 21 bp, Homo sapiens
tcaggtgagaagcagaggaag

SEQ ID NO: 1373409 - DNA, 22 bp, Homo sapiens
tcagtaacccccttaaatttaa

SEQ ID NO: 1373410 - DNA, 13 bp, Homo sapiens
tcagtaagccgtg

SEQ ID NO: 1373411 - DNA, 18 bp, Homo sapiens
tcagtaggactccttatt

SEQ ID NO: 1373412 - DNA, 19 bp, Homo sapiens
tcagtagtttaaaagttct

SEQ ID NO: 1373413 - DNA, 20 bp, Homo sapiens
tcagtattagatgcacttaa

SEQ ID NO: 1373414 - DNA, 17 bp, Homo sapiens
tcagtattatgtagttg

SEQ ID NO: 1373415 - DNA, 17 bp, Homo sapiens
tcagtcacatggcatgg

SEQ ID NO: 1373416 - DNA, 14 bp, Homo sapiens
tcagtgccctccag

SEQ ID NO: 1373417 - DNA, 17 bp, Homo sapiens
tcagtgggttaacatca

SEQ ID NO: 1373418 - DNA, 20 bp, Homo sapiens
tcagtgggttaacatcagtt

SEQ ID NO: 1373419 - DNA, 23 bp, Homo sapiens
tcagtgggttaacatcagttttg

SEQ ID NO: 1373420 - DNA, 17 bp, Homo sapiens
tcagtgtttttgtgaat

SEQ ID NO: 1373421 - DNA, 19 bp, Homo sapiens
tcagttcattgtggtcctt

SEQ ID NO: 1373422 - DNA, 14 bp, Homo sapiens
tcagtttgttggaa

SEQ ID NO: 1373423 - DNA, 11 bp, Homo sapiens
tcataaattat

SEQ ID NO: 1373424 - DNA, 17 bp, Homo sapiens
tcatactcgagtctgag

SEQ ID NO: 1373425 - DNA, 15 bp, Homo sapiens
tcatagttaaatgtt

SEQ ID NO: 1373426 - DNA, 14 bp, Homo sapiens
tcatagttactgtg

SEQ ID NO: 1373427 - DNA, 16 bp, Homo sapiens
tcatagttttatttat

SEQ ID NO: 1373428 - DNA, 17 bp, Homo sapiens
tcatataccagcaatat

SEQ ID NO: 1373429 - DNA, 21 bp, Homo sapiens
tcatatcaacttagtcaataa

SEQ ID NO: 1373430 - DNA, 12 bp, Homo sapiens
tcatatgaaaaa

SEQ ID NO: 1373431 - DNA, 13 bp, Homo sapiens
tcatcaatcaaat

SEQ ID NO: 1373432 - DNA, 21 bp, Homo sapiens
tcatcaatcaaataagtattt

SEQ ID NO: 1373433 - DNA, 15 bp, Homo sapiens
tcatcacaagaacac

SEQ ID NO: 1373434 - DNA, 23 bp, Homo sapiens
tcatcacaagaacacacacatat

SEQ ID NO: 1373435 - DNA, 23 bp, Homo sapiens
tcatcacatttctatgccaaaca

SEQ ID NO: 1373436 - DNA, 20 bp, Homo sapiens
tcatccagatgtggctactg

SEQ ID NO: 1373437 - DNA, 17 bp, Homo sapiens
tcatcccattccaggca

SEQ ID NO: 1373438 - DNA, 23 bp, Homo sapiens
tcatcccattccaggcagcctct

SEQ ID NO: 1373439 - DNA, 19 bp, Homo sapiens
tcatctaagtcagtaccca

SEQ ID NO: 1373440 - DNA, 14 bp, Homo sapiens
tcatctcatttaag

SEQ ID NO: 1373441 - DNA, 14 bp, Homo sapiens
tcatctgctggtcc

SEQ ID NO: 1373442 - DNA, 16 bp, Homo sapiens
tcatgaaaataccatt

SEQ ID NO: 1373443 - DNA, 16 bp, Homo sapiens
tcatgattagcaagtt

SEQ ID NO: 1373444 - DNA, 16 bp, Homo sapiens
tcatgcccaccccctg

SEQ ID NO: 1373445 - DNA, 18 bp, Homo sapiens
tcatgcccaccccctgcc

SEQ ID NO: 1373446 - DNA, 22 bp, Homo sapiens
tcatgcccaccccctgccctgc

SEQ ID NO: 1373447 - DNA, 23 bp, Homo sapiens
tcatgcccaccccctgccctgca

SEQ ID NO: 1373448 - DNA, 23 bp, Homo sapiens
tcatgtaaattttgtatgaaaaa

SEQ ID NO: 1373449 - DNA, 12 bp, Homo sapiens
tcatgtatgttt

SEQ ID NO: 1373450 - DNA, 13 bp, Homo sapiens
tcatgtggctgga

SEQ ID NO: 1373451 - DNA, 16 bp, Homo sapiens
tcatgtggctggaaga

SEQ ID NO: 1373452 - DNA, 21 bp, Homo sapiens
tcatgtggctggaagatcctg

SEQ ID NO: 1373453 - DNA, 19 bp, Homo sapiens
tcatgttgatcatgtactt

SEQ ID NO: 1373454 - DNA, 14 bp, Homo sapiens
tcattattctctgc

SEQ ID NO: 1373455 - DNA, 13 bp, Homo sapiens
tcattcagaaatg

SEQ ID NO: 1373456 - DNA, 20 bp, Homo sapiens
tcattcagagtcagccagga

SEQ ID NO: 1373457 - DNA, 22 bp, Homo sapiens
tcattcagagtcagccaggacc

SEQ ID NO: 1373458 - DNA, 20 bp, Homo sapiens
tcattcttactaaaaagtat

SEQ ID NO: 1373459 - DNA, 11 bp, Homo sapiens
tcattgacttt

SEQ ID NO: 1373460 - DNA, 12 bp, Homo sapiens
tcattgactttt

SEQ ID NO: 1373461 - DNA, 19 bp, Homo sapiens
tcattgccaagggcccaaa

SEQ ID NO: 1373462 - DNA, 15 bp, Homo sapiens
tcattgctgagcctc

SEQ ID NO: 1373463 - DNA, 23 bp, Homo sapiens
tcatttaagggaaaaatatatat

SEQ ID NO: 1373464 - DNA, 18 bp, Homo sapiens
tcatttgtttacatttga

SEQ ID NO: 1373465 - DNA, 15 bp, Homo sapiens
tccaaaccttatctc

SEQ ID NO: 1373466 - DNA, 17 bp, Homo sapiens
tccaaagactcttggga

SEQ ID NO: 1373467 - DNA, 20 bp, Homo sapiens
tccaaatggagaagctgcag

SEQ ID NO: 1373468 - DNA, 21 bp, Homo sapiens
tccaaccctgccgtcaccacc

SEQ ID NO: 1373469 - DNA, 13 bp, Homo sapiens
tccaactccagca

SEQ ID NO: 1373470 - DNA, 14 bp, Homo sapiens
tccaactccagcaa

SEQ ID NO: 1373471 - DNA, 18 bp, Homo sapiens
tccaactcccttaaaata

SEQ ID NO: 1373472 - DNA, 21 bp, Homo sapiens
tccaagcctccacagcgaggg

SEQ ID NO: 1373473 - DNA, 16 bp, Homo sapiens
tccacacagaatgcaa

SEQ ID NO: 1373474 - DNA, 20 bp, Homo sapiens
tccacagcgagggcagctgc

SEQ ID NO: 1373475 - DNA, 21 bp, Homo sapiens
tccacagcgagggcagctgct

SEQ ID NO: 1373476 - DNA, 15 bp, Homo sapiens
tccacatctgcctta

SEQ ID NO: 1373477 - DNA, 12 bp, Homo sapiens
tccaccagcatc

SEQ ID NO: 1373478 - DNA, 14 bp, Homo sapiens
tccactgtgcacac

SEQ ID NO: 1373479 - DNA, 16 bp, Homo sapiens
tccactgtgctttcag

SEQ ID NO: 1373480 - DNA, 19 bp, Homo sapiens
tccactttgtttcgtgggg

SEQ ID NO: 1373481 - DNA, 23 bp, Homo sapiens
tccactttgtttcgtggggaggt

SEQ ID NO: 1373482 - DNA, 18 bp, Homo sapiens
tccagactcagagctctc

SEQ ID NO: 1373483 - DNA, 16 bp, Homo sapiens
tccagatcactgccac

SEQ ID NO: 1373484 - DNA, 13 bp, Homo sapiens
tccagatgtggct

SEQ ID NO: 1373485 - DNA, 17 bp, Homo sapiens
tccagcaacacagcctg

SEQ ID NO: 1373486 - DNA, 21 bp, Homo sapiens
tccagcaacacagcctgggcc

SEQ ID NO: 1373487 - DNA, 20 bp, Homo sapiens
tccagcaacttcttctccat

SEQ ID NO: 1373488 - DNA, 21 bp, Homo sapiens
tccagcaccttgtgcctgggg

SEQ ID NO: 1373489 - DNA, 20 bp, Homo sapiens
tccagcatttagctggccac

SEQ ID NO: 1373490 - DNA, 10 bp, Homo sapiens
tccagccagc

SEQ ID NO: 1373491 - DNA, 12 bp, Homo sapiens
tccagccagcgc

SEQ ID NO: 1373492 - DNA, 21 bp, Homo sapiens
tccagccagcgcctccctcca

SEQ ID NO: 1373493 - DNA, 15 bp, Homo sapiens
tccagcccctctggt

SEQ ID NO: 1373494 - DNA, 16 bp, Homo sapiens
tccagcctgccccgga

SEQ ID NO: 1373495 - DNA, 11 bp, Homo sapiens
tccagcctggg

SEQ ID NO: 1373496 - DNA, 13 bp, Homo sapiens
tccagctctggag

SEQ ID NO: 1373497 - DNA, 11 bp, Homo sapiens
tccagctggcc

SEQ ID NO: 1373498 - DNA, 13 bp, Homo sapiens
tccagctggcctg

SEQ ID NO: 1373499 - DNA, 17 bp, Homo sapiens
tccagctgttcagctgg

SEQ ID NO: 1373500 - DNA, 19 bp, Homo sapiens
tctaaatctatttattaat

SEQ ID NO: 1373501 - DNA, 16 bp, Homo sapiens
tctaagactatatata

SEQ ID NO: 1373502 - DNA, 21 bp, Homo sapiens
tctaagtcagtacccaccacc

SEQ ID NO: 1373503 - DNA, 15 bp, Homo sapiens
tctaagtcatgtatg

SEQ ID NO: 1373504 - DNA, 18 bp, Homo sapiens
tctaagtgggcattgcca

SEQ ID NO: 1373505 - DNA, 12 bp, Homo sapiens
tctaatagtctt

SEQ ID NO: 1373506 - DNA, 19 bp, Homo sapiens
tctaatatatatgaataaa

SEQ ID NO: 1373507 - DNA, 19 bp, Homo sapiens
tctaatctagatatcgact

SEQ ID NO: 1373508 - DNA, 20 bp, Homo sapiens
tctaatctagatatcgactt

SEQ ID NO: 1373509 - DNA, 18 bp, Homo sapiens
tctaattaaccttactaa

SEQ ID NO: 1373510 - DNA, 20 bp, Homo sapiens
tctacatgaggaactgtaga

SEQ ID NO: 1373511 - DNA, 21 bp, Homo sapiens
tctaccctcttagaaaaacca

SEQ ID NO: 1373512 - DNA, 17 bp, Homo sapiens
tctagaagccaagggaa

SEQ ID NO: 1373513 - DNA, 20 bp, Homo sapiens
tctagaagccaagggaaagg

SEQ ID NO: 1373514 - DNA, 23 bp, Homo sapiens
tctagaagccaagggaaaggggt

SEQ ID NO: 1373515 - DNA, 17 bp, Homo sapiens
tctagaattatttttca

SEQ ID NO: 1373516 - DNA, 22 bp, Homo sapiens
tctagggaaaaaccagcgtgtg

SEQ ID NO: 1373517 - DNA, 13 bp, Homo sapiens
tctagttttgtca

SEQ ID NO: 1373518 - DNA, 12 bp, Homo sapiens
tctataaaactc

SEQ ID NO: 1373519 - DNA, 19 bp, Homo sapiens
tctataaaatagatataaa

SEQ ID NO: 1373520 - DNA, 17 bp, Homo sapiens
tctatagcatcacttaa

SEQ ID NO: 1373521 - DNA, 20 bp, Homo sapiens
tctatagcatcacttaaaac

SEQ ID NO: 1373522 - DNA, 15 bp, Homo sapiens
tctatctatttgagg

SEQ ID NO: 1373523 - DNA, 12 bp, Homo sapiens
tctatctcatct

SEQ ID NO: 1373524 - DNA, 17 bp, Homo sapiens
tctattatggaaaactg

SEQ ID NO: 1373525 - DNA, 16 bp, Homo sapiens
tctattatttttataa

SEQ ID NO: 1373526 - DNA, 16 bp, Homo sapiens
tctattgcttcaccat

SEQ ID NO: 1373527 - DNA, 12 bp, Homo sapiens
tctattttaaga

SEQ ID NO: 1373528 - DNA, 13 bp, Homo sapiens
tctcaatgaaaaa

SEQ ID NO: 1373529 - DNA, 14 bp, Homo sapiens
tctcaatgaaaaat

SEQ ID NO: 1373530 - DNA, 23 bp, Homo sapiens
tctcacactggttctcaatgaaa

SEQ ID NO: 1373531 - DNA, 17 bp, Homo sapiens
tctcacagctatgcaaa

SEQ ID NO: 1373532 - DNA, 22 bp, Homo sapiens
tctcacccatgcaagcagagga

SEQ ID NO: 1373533 - DNA, 23 bp, Homo sapiens
tctcacccatgcaagcagaggac

SEQ ID NO: 1373534 - DNA, 12 bp, Homo sapiens
tctcacctcagc

SEQ ID NO: 1373535 - DNA, 12 bp, Homo sapiens
tctcagaagcac

SEQ ID NO: 1373536 - DNA, 16 bp, Homo sapiens
tctcagaagcacagaa

SEQ ID NO: 1373537 - DNA, 16 bp, Homo sapiens
tctcagtgccctccag

SEQ ID NO: 1373538 - DNA, 13 bp, Homo sapiens
tctcagtgttggt

SEQ ID NO: 1373539 - DNA, 23 bp, Homo sapiens
tctcattaatactctttatttat

SEQ ID NO: 1373540 - DNA, 18 bp, Homo sapiens
tctcatttaagggaaaaa

SEQ ID NO: 1373541 - DNA, 21 bp, Homo sapiens
tctccactgtgcacacccacc

SEQ ID NO: 1373542 - DNA, 22 bp, Homo sapiens
tctccaggggctgcttcctcct

SEQ ID NO: 1373543 - DNA, 19 bp, Homo sapiens
tctccattgtgcctaagtc

SEQ ID NO: 1373544 - DNA, 23 bp, Homo sapiens
tctccatttgctcttcagatgcc

SEQ ID NO: 1373545 - DNA, 15 bp, Homo sapiens
tctccccaggtccag

SEQ ID NO: 1373546 - DNA, 14 bp, Homo sapiens
tctcccctcagctc

SEQ ID NO: 1373547 - DNA, 15 bp, Homo sapiens
tctccctagctcctc

SEQ ID NO: 1373548 - DNA, 20 bp, Homo sapiens
tctccgccagcctcctctgg

SEQ ID NO: 1373549 - DNA, 21 bp, Homo sapiens
tctccggctcccagcctcagc

SEQ ID NO: 1373550 - DNA, 22 bp, Homo sapiens
tctccggctcccagcctcagcg

SEQ ID NO: 1373551 - DNA, 16 bp, Homo sapiens
tctccggggccatttg

SEQ ID NO: 1373552 - DNA, 16 bp, Homo sapiens
tctccgttagctcctg

SEQ ID NO: 1373553 - DNA, 18 bp, Homo sapiens
tctccgttagctcctgtg

SEQ ID NO: 1373554 - DNA, 19 bp, Homo sapiens
tctccgttagctcctgtgg

SEQ ID NO: 1373555 - DNA, 14 bp, Homo sapiens
tctcctccccttcc

SEQ ID NO: 1373556 - DNA, 15 bp, Homo sapiens
tctcctgactggtgc

SEQ ID NO: 1373557 - DNA, 19 bp, Homo sapiens
tctcctggcctatccgctg

SEQ ID NO: 1373558 - DNA, 21 bp, Homo sapiens
tctcctggcctatccgctgcc

SEQ ID NO: 1373559 - DNA, 20 bp, Homo sapiens
tctccttaagctgcagagat

SEQ ID NO: 1373560 - DNA, 20 bp, Homo sapiens
tctctaagtgggcattgcca

SEQ ID NO: 1373561 - DNA, 13 bp, Homo sapiens
tctctagcacaat

SEQ ID NO: 1373562 - DNA, 14 bp, Homo sapiens
tctctattaaaatg

SEQ ID NO: 1373563 - DNA, 13 bp, Homo sapiens
tctctatttgaga

SEQ ID NO: 1373564 - DNA, 11 bp, Homo sapiens
tctctcctggc

SEQ ID NO: 1373565 - DNA, 16 bp, Homo sapiens
tctctgtacttttcat

SEQ ID NO: 1373566 - DNA, 19 bp, Homo sapiens
tctctgtcacccttgtcct

SEQ ID NO: 1373567 - DNA, 18 bp, Homo sapiens
tctctgtggctccaggcc

SEQ ID NO: 1373568 - DNA, 17 bp, Homo sapiens
tctcttctcagagtggt

SEQ ID NO: 1373569 - DNA, 19 bp, Homo sapiens
tctcttctcagagtggtgg

SEQ ID NO: 1373570 - DNA, 13 bp, Homo sapiens
tctcttgagcctg

SEQ ID NO: 1373571 - DNA, 18 bp, Homo sapiens
tctcttgagcctgggagg

SEQ ID NO: 1373572 - DNA, 14 bp, Homo sapiens
tctcttgagtttgt

SEQ ID NO: 1373573 - DNA, 19 bp, Homo sapiens
tctctttaaaaggaaagaa

SEQ ID NO: 1373574 - DNA, 19 bp, Homo sapiens
tctctttgattatttgcat

SEQ ID NO: 1373575 - DNA, 14 bp, Homo sapiens
tctctttttgtttg

SEQ ID NO: 1373576 - DNA, 18 bp, Homo sapiens
tctgaaataggaaacaag

SEQ ID NO: 1373577 - DNA, 20 bp, Homo sapiens
tctgaaatgttacaaaaata

SEQ ID NO: 1373578 - DNA, 12 bp, Homo sapiens
tctgaacttgcc

SEQ ID NO: 1373579 - DNA, 13 bp, Homo sapiens
tctgactaattag

SEQ ID NO: 1373580 - DNA, 14 bp, Homo sapiens
tctgagaaaacaag

SEQ ID NO: 1373581 - DNA, 14 bp, Homo sapiens
tctgagctgccagt

SEQ ID NO: 1373582 - DNA, 17 bp, Homo sapiens
tctgagcttacgtagtt

SEQ ID NO: 1373583 - DNA, 17 bp, Homo sapiens
tctgaggccgttgctga

SEQ ID NO: 1373584 - DNA, 14 bp, Homo sapiens
tcacttgatgatac

SEQ ID NO: 1373585 - DNA, 18 bp, Homo sapiens
tcagaaaatgaaaaatct

SEQ ID NO: 1373586 - DNA, 15 bp, Homo sapiens
tcagaaacttgtgaa

SEQ ID NO: 1373587 - DNA, 19 bp, Homo sapiens
tcagaaagctttattttga

SEQ ID NO: 1373588 - DNA, 20 bp, Homo sapiens
tcagaaatataacacatttt

SEQ ID NO: 1373589 - DNA, 15 bp, Homo sapiens
tcagaaggagctaca

SEQ ID NO: 1373590 - DNA, 13 bp, Homo sapiens
tcagaagggctat

SEQ ID NO: 1373591 - DNA, 17 bp, Homo sapiens
tcagaagttagtttgta

SEQ ID NO: 1373592 - DNA, 18 bp, Homo sapiens
tcagaatcccttaacagt

SEQ ID NO: 1373593 - DNA, 15 bp, Homo sapiens
tcagacaccctcaac

SEQ ID NO: 1373594 - DNA, 17 bp, Homo sapiens
tcagacaccctcaacct

SEQ ID NO: 1373595 - DNA, 22 bp, Homo sapiens
tcagacaccctcaacctcttct

SEQ ID NO: 1373596 - DNA, 23 bp, Homo sapiens
tcagacaccctcaacctcttctg

SEQ ID NO: 1373597 - DNA, 15 bp, Homo sapiens
tcagacagaacttga

SEQ ID NO: 1373598 - DNA, 23 bp, Homo sapiens
tcagacagaacttgaatgtgtca

SEQ ID NO: 1373599 - DNA, 15 bp, Homo sapiens
tcagacatgttttcc

SEQ ID NO: 1373600 - DNA, 13 bp, Homo sapiens
tcagcagttgctg

SEQ ID NO: 1373601 - DNA, 14 bp, Homo sapiens
tcagcagttgctgg

SEQ ID NO: 1373602 - DNA, 16 bp, Homo sapiens
tcagcagttgctggta

SEQ ID NO: 1373603 - DNA, 20 bp, Homo sapiens
tcagcagttgctggtaaaat

SEQ ID NO: 1373604 - DNA, 23 bp, Homo sapiens
tcagcagttgctggtaaaatgaa

SEQ ID NO: 1373605 - DNA, 13 bp, Homo sapiens
tcagcatgaaaat

SEQ ID NO: 1373606 - DNA, 16 bp, Homo sapiens
tcagccaagttttata

SEQ ID NO: 1373607 - DNA, 12 bp, Homo sapiens
tcagcctgcaca

SEQ ID NO: 1373608 - DNA, 16 bp, Homo sapiens
tcagctcaatgcagtt

SEQ ID NO: 1373609 - DNA, 15 bp, Homo sapiens
tcagctgaacctggg

SEQ ID NO: 1373610 - DNA, 16 bp, Homo sapiens
tcagctgaacctgggt

SEQ ID NO: 1373611 - DNA, 15 bp, Homo sapiens
tcagctgctccctgg

SEQ ID NO: 1373612 - DNA, 19 bp, Homo sapiens
tcagctgctccctggcatt

SEQ ID NO: 1373613 - DNA, 22 bp, Homo sapiens
tcagctttgagaagccttcagc

SEQ ID NO: 1373614 - DNA, 14 bp, Homo sapiens
tcaggaggcgccct

SEQ ID NO: 1373615 - DNA, 21 bp, Homo sapiens
tcaggccggcagccccagcct

SEQ ID NO: 1373616 - DNA, 22 bp, Homo sapiens
tcaggccggcagccccagcctg

SEQ ID NO: 1373617 - DNA, 19 bp, Homo sapiens
tcagggccatgctgaggcc

SEQ ID NO: 1373618 - DNA, 14 bp, Homo sapiens
tcagggctcccagg

SEQ ID NO: 1373619 - DNA, 16 bp, Homo sapiens
tcagggctcccagggg

SEQ ID NO: 1373620 - DNA, 19 bp, Homo sapiens
tcagggctggctcctgatc

SEQ ID NO: 1373621 - DNA, 14 bp, Homo sapiens
tcaggggagaaaaa

SEQ ID NO: 1373622 - DNA, 12 bp, Homo sapiens
tcaggggtgtgc

SEQ ID NO: 1373623 - DNA, 15 bp, Homo sapiens
tcaggtgagaagcag

SEQ ID NO: 1373624 - DNA, 16 bp, Homo sapiens
tcaggtgagaagcaga

SEQ ID NO: 1373625 - DNA, 21 bp, Homo sapiens
tcagtaaacgggaacatgccc

SEQ ID NO: 1373626 - DNA, 22 bp, Homo sapiens
tcagtaaacgggaacatgcccc

SEQ ID NO: 1373627 - DNA, 21 bp, Homo sapiens
tcagtaacccccttaaattta

SEQ ID NO: 1373628 - DNA, 23 bp, Homo sapiens
tcagtaagttatctttgaatatg

SEQ ID NO: 1373629 - DNA, 23 bp, Homo sapiens
tcagtaggtgcccagaataagtt

SEQ ID NO: 1373630 - DNA, 18 bp, Homo sapiens
tcagtcccttccccatgc

SEQ ID NO: 1373631 - DNA, 14 bp, Homo sapiens
tcagtgcatttgtg

SEQ ID NO: 1373632 - DNA, 15 bp, Homo sapiens
tcagtgttggtatat

SEQ ID NO: 1373633 - DNA, 23 bp, Homo sapiens
tcagttgagcttcatataccagc

SEQ ID NO: 1373634 - DNA, 15 bp, Homo sapiens
tcagttgcttgtctt

SEQ ID NO: 1373635 - DNA, 15 bp, Homo sapiens
tcagtttgttggaaa

SEQ ID NO: 1373636 - DNA, 16 bp, Homo sapiens
tcagtttgttggaaag

SEQ ID NO: 1373637 - DNA, 13 bp, Homo sapiens
tcataaattattt

SEQ ID NO: 1373638 - DNA, 19 bp, Homo sapiens
tcataacatccagagcttt

SEQ ID NO: 1373639 - DNA, 20 bp, Homo sapiens
tcatagtatccatattttat

SEQ ID NO: 1373640 - DNA, 15 bp, Homo sapiens
tcatagttactgtgt

SEQ ID NO: 1373641 - DNA, 20 bp, Homo sapiens
tcatagttactgtgtaaact

SEQ ID NO: 1373642 - DNA, 22 bp, Homo sapiens
tcatagttactgtgtaaactca

SEQ ID NO: 1373643 - DNA, 21 bp, Homo sapiens
tcatagttctgagctgccagt

SEQ ID NO: 1373644 - DNA, 15 bp, Homo sapiens
tcatagttttattta

SEQ ID NO: 1373645 - DNA, 17 bp, Homo sapiens
tcatagttttatttata

SEQ ID NO: 1373646 - DNA, 16 bp, Homo sapiens
tcatataccagcaata

SEQ ID NO: 1373647 - DNA, 20 bp, Homo sapiens
tcatatattaaacatccaca

SEQ ID NO: 1373648 - DNA, 18 bp, Homo sapiens
tcatcactacagtattac

SEQ ID NO: 1373649 - DNA, 17 bp, Homo sapiens
tcatcatccagatgtgg

SEQ ID NO: 1373650 - DNA, 20 bp, Homo sapiens
tcatccagactcagagctct

SEQ ID NO: 1373651 - DNA, 16 bp, Homo sapiens
tcatcccattccaggc

SEQ ID NO: 1373652 - DNA, 20 bp, Homo sapiens
tcatcccattccaggcagcc

SEQ ID NO: 1373653 - DNA, 15 bp, Homo sapiens
tcatctgaaatgtta

SEQ ID NO: 1373654 - DNA, 13 bp, Homo sapiens
tcatctgctggtc

SEQ ID NO: 1373655 - DNA, 20 bp, Homo sapiens
tcatctggagttctcaaaga

SEQ ID NO: 1373656 - DNA, 20 bp, Homo sapiens
tcatctgtctatattttatt

SEQ ID NO: 1373657 - DNA, 14 bp, Homo sapiens
tcatgaaaatacca

SEQ ID NO: 1373658 - DNA, 17 bp, Homo sapiens
tcatgaaacttgtttca

SEQ ID NO: 1373659 - DNA, 13 bp, Homo sapiens
tcatgcaaaatat

SEQ ID NO: 1373660 - DNA, 16 bp, Homo sapiens
tcatgcacttaaagaa

SEQ ID NO: 1373661 - DNA, 17 bp, Homo sapiens
tcatgcacttaaagaag

SEQ ID NO: 1373662 - DNA, 17 bp, Homo sapiens
tcatgcatgtcaaacat

SEQ ID NO: 1373663 - DNA, 15 bp, Homo sapiens
tcatgcccaccccct

SEQ ID NO: 1373664 - DNA, 20 bp, Homo sapiens
tcatgcccaccccctgccct

SEQ ID NO: 1373665 - DNA, 15 bp, Homo sapiens
tcatgtaaaacagaa

SEQ ID NO: 1373666 - DNA, 16 bp, Homo sapiens
tcatgtaaattttgta

SEQ ID NO: 1373667 - DNA, 17 bp, Homo sapiens
tcatgtaaattttgtat

SEQ ID NO: 1373668 - DNA, 13 bp, Homo sapiens
tcatgtacttttt

SEQ ID NO: 1373669 - DNA, 15 bp, Homo sapiens
tcatgtactttttag

SEQ ID NO: 1373670 - DNA, 16 bp, Homo sapiens
tcatgtatgtttctct

SEQ ID NO: 1373671 - DNA, 15 bp, Homo sapiens
tcatgtatttgagca

SEQ ID NO: 1373672 - DNA, 20 bp, Homo sapiens
tcatgtgtgcaacagggtat

SEQ ID NO: 1373673 - DNA, 16 bp, Homo sapiens
tcattaaactttttta

SEQ ID NO: 1373674 - DNA, 17 bp, Homo sapiens
tcattaaacttttttaa

SEQ ID NO: 1373675 - DNA, 15 bp, Homo sapiens
tcattaaagacagga

SEQ ID NO: 1373676 - DNA, 18 bp, Homo sapiens
tcattcctttttatttat

SEQ ID NO: 1373677 - DNA, 14 bp, Homo sapiens
tcattgacttttat

SEQ ID NO: 1373678 - DNA, 16 bp, Homo sapiens
tcattgacttttataa

SEQ ID NO: 1373679 - DNA, 20 bp, Homo sapiens
tctgggacctgccaggcagg

SEQ ID NO: 1373680 - DNA, 21 bp, Homo sapiens
tctgggacctgccaggcaggg

SEQ ID NO: 1373681 - DNA, 20 bp, Homo sapiens
tctggggaaagacactgcct

SEQ ID NO: 1373682 - DNA, 19 bp, Homo sapiens
tctggggcaggctgggcca

SEQ ID NO: 1373683 - DNA, 20 bp, Homo sapiens
tctggggcaggctgggccat

SEQ ID NO: 1373684 - DNA, 20 bp, Homo sapiens
tctggggggacccagtgcag

SEQ ID NO: 1373685 - DNA, 15 bp, Homo sapiens
tctgggtccttcctg

SEQ ID NO: 1373686 - DNA, 16 bp, Homo sapiens
tctgggtttgagaaat

SEQ ID NO: 1373687 - DNA, 15 bp, Homo sapiens
tctggtcgctcctgc

SEQ ID NO: 1373688 - DNA, 14 bp, Homo sapiens
tctggtctcgaact

SEQ ID NO: 1373689 - DNA, 16 bp, Homo sapiens
tctggtggtctgttgg

SEQ ID NO: 1373690 - DNA, 12 bp, Homo sapiens
tctggttccagg

SEQ ID NO: 1373691 - DNA, 16 bp, Homo sapiens
tctgtaaatatgtttt

SEQ ID NO: 1373692 - DNA, 14 bp, Homo sapiens
tctgtacttttcat

SEQ ID NO: 1373693 - DNA, 20 bp, Homo sapiens
tctgtagctataatgagcat

SEQ ID NO: 1373694 - DNA, 12 bp, Homo sapiens
tctgtatttgaa

SEQ ID NO: 1373695 - DNA, 15 bp, Homo sapiens
tctgtatttgaaagt

SEQ ID NO: 1373696 - DNA, 17 bp, Homo sapiens
tctgtctggtggccccg

SEQ ID NO: 1373697 - DNA, 19 bp, Homo sapiens
tctgtgagaaggtttattg

SEQ ID NO: 1373698 - DNA, 14 bp, Homo sapiens
tctgtgatgagctg

SEQ ID NO: 1373699 - DNA, 16 bp, Homo sapiens
tctgtgccttcgtctt

SEQ ID NO: 1373700 - DNA, 12 bp, Homo sapiens
tctgtgctgtgt

SEQ ID NO: 1373701 - DNA, 18 bp, Homo sapiens
tctgtggttcctctgctc

SEQ ID NO: 1373702 - DNA, 12 bp, Homo sapiens
tctgtggttggc

SEQ ID NO: 1373703 - DNA, 14 bp, Homo sapiens
tctgtggttggctg

SEQ ID NO: 1373704 - DNA, 18 bp, Homo sapiens
tctgtgtgtcagttttca

SEQ ID NO: 1373705 - DNA, 14 bp, Homo sapiens
tctgtgttgccaag

SEQ ID NO: 1373706 - DNA, 12 bp, Homo sapiens
tctgttgaagtt

SEQ ID NO: 1373707 - DNA, 15 bp, Homo sapiens
tctgttggcaggctg

SEQ ID NO: 1373708 - DNA, 18 bp, Homo sapiens
tctgttggcaggctggcc

SEQ ID NO: 1373709 - DNA, 20 bp, Homo sapiens
tctgttggcaggctggccag

SEQ ID NO: 1373710 - DNA, 14 bp, Homo sapiens
tctgttgtgtgtca

SEQ ID NO: 1373711 - DNA, 18 bp, Homo sapiens
tcttaaagtattcttctc

SEQ ID NO: 1373712 - DNA, 16 bp, Homo sapiens
tcttaaggacaaagtg

SEQ ID NO: 1373713 - DNA, 19 bp, Homo sapiens
tcttaatatgttcttttaa

SEQ ID NO: 1373714 - DNA, 21 bp, Homo sapiens
tcttaatgttcctcaaagctt

SEQ ID NO: 1373715 - DNA, 21 bp, Homo sapiens
tcttacaatattgattgggaa

SEQ ID NO: 1373716 - DNA, 17 bp, Homo sapiens
tcttactaaaaagtata

SEQ ID NO: 1373717 - DNA, 15 bp, Homo sapiens
tcttactttgtaaat

SEQ ID NO: 1373718 - DNA, 13 bp, Homo sapiens
tcttagattctta

SEQ ID NO: 1373719 - DNA, 23 bp, Homo sapiens
tcttaggttggcaaaaaggcagg

SEQ ID NO: 1373720 - DNA, 21 bp, Homo sapiens
tcttataaagtggaagtatgt

SEQ ID NO: 1373721 - DNA, 13 bp, Homo sapiens
tcttatgtgacat

SEQ ID NO: 1373722 - DNA, 19 bp, Homo sapiens
tcttatgtgacattaacaa

SEQ ID NO: 1373723 - DNA, 14 bp, Homo sapiens
tcttcagagaaatc

SEQ ID NO: 1373724 - DNA, 14 bp, Homo sapiens
tcttcagatgccac

SEQ ID NO: 1373725 - DNA, 17 bp, Homo sapiens
tcttcattattctctgc

SEQ ID NO: 1373726 - DNA, 19 bp, Homo sapiens
tcttccctacagttgaaaa

SEQ ID NO: 1373727 - DNA, 22 bp, Homo sapiens
tcttccctacagttgaaaaaca

SEQ ID NO: 1373728 - DNA, 17 bp, Homo sapiens
tcttcctatccctctcc

SEQ ID NO: 1373729 - DNA, 19 bp, Homo sapiens
tcttcctatccctctccta

SEQ ID NO: 1373730 - DNA, 15 bp, Homo sapiens
tcttccttgatgttt

SEQ ID NO: 1373731 - DNA, 12 bp, Homo sapiens
tcttctaaatgg

SEQ ID NO: 1373732 - DNA, 19 bp, Homo sapiens
tcttctagtgatgatggtt

SEQ ID NO: 1373733 - DNA, 18 bp, Homo sapiens
tcttctggggcaggctgg

SEQ ID NO: 1373734 - DNA, 22 bp, Homo sapiens
tcttctgtatttttttttctaa

SEQ ID NO: 1373735 - DNA, 20 bp, Homo sapiens
tcttcttggggcccagtgca

SEQ ID NO: 1373736 - DNA, 16 bp, Homo sapiens
tcttgaatccttccat

SEQ ID NO: 1373737 - DNA, 12 bp, Homo sapiens
tcttgagctggc

SEQ ID NO: 1373738 - DNA, 13 bp, Homo sapiens
tcttgagtttgtc

SEQ ID NO: 1373739 - DNA, 22 bp, Homo sapiens
tcttgagtttgtcgctcatgtg

SEQ ID NO: 1373740 - DNA, 13 bp, Homo sapiens
tcttgatacattc

SEQ ID NO: 1373741 - DNA, 22 bp, Homo sapiens
tcttgcaccaaattatcttgat

SEQ ID NO: 1373742 - DNA, 15 bp, Homo sapiens
tcttgcctccaggtg

SEQ ID NO: 1373743 - DNA, 17 bp, Homo sapiens
tcttgcctccaggtgca

SEQ ID NO: 1373744 - DNA, 19 bp, Homo sapiens
tcttgcctccaggtgcaga

SEQ ID NO: 1373745 - DNA, 12 bp, Homo sapiens
tcttgcctctgt

SEQ ID NO: 1373746 - DNA, 19 bp, Homo sapiens
tcttgcctctgtgctgtgt

SEQ ID NO: 1373747 - DNA, 23 bp, Homo sapiens
tcttgcttccctaatctatggtc

SEQ ID NO: 1373748 - DNA, 13 bp, Homo sapiens
tcttggccagcca

SEQ ID NO: 1373749 - DNA, 16 bp, Homo sapiens
tcttggcttaatcatt

SEQ ID NO: 1373750 - DNA, 18 bp, Homo sapiens
tcttggcttaatcatttt

SEQ ID NO: 1373751 - DNA, 19 bp, Homo sapiens
tcttggcttaatcattttc

SEQ ID NO: 1373752 - DNA, 18 bp, Homo sapiens
tcttggggcccagtgcat

SEQ ID NO: 1373753 - DNA, 20 bp, Homo sapiens
tcttgggggggtggccgctg

SEQ ID NO: 1373754 - DNA, 15 bp, Homo sapiens
tcttgtaaagactgg

SEQ ID NO: 1373755 - DNA, 16 bp, Homo sapiens
tcttgtctgatttctt

SEQ ID NO: 1373756 - DNA, 21 bp, Homo sapiens
tcttgttgctcaaaaaatgag

SEQ ID NO: 1373757 - DNA, 16 bp, Homo sapiens
tctttaaaagaatgac

SEQ ID NO: 1373758 - DNA, 15 bp, Homo sapiens
ggcacttgcctgggt

SEQ ID NO: 1373759 - DNA, 16 bp, Homo sapiens
ggcacttgcctgggtc

SEQ ID NO: 1373760 - DNA, 21 bp, Homo sapiens
ggcagcccagagactttgtag

SEQ ID NO: 1373761 - DNA, 22 bp, Homo sapiens
ggcagcccagagactttgtaga

SEQ ID NO: 1373762 - DNA, 14 bp, Homo sapiens
ggcagccccagcct

SEQ ID NO: 1373763 - DNA, 19 bp, Homo sapiens
ggcagccccagcctgctag

SEQ ID NO: 1373764 - DNA, 18 bp, Homo sapiens
ggcaggaggatcacttga

SEQ ID NO: 1373765 - DNA, 15 bp, Homo sapiens
ggcaggcatggccct

SEQ ID NO: 1373766 - DNA, 20 bp, Homo sapiens
ggcaggcatggccctgggcg

SEQ ID NO: 1373767 - DNA, 22 bp, Homo sapiens
ggcaggctcactgccaggccag

SEQ ID NO: 1373768 - DNA, 12 bp, Homo sapiens
ggcaggctggcc

SEQ ID NO: 1373769 - DNA, 12 bp, Homo sapiens
ggcaggctgggc

SEQ ID NO: 1373770 - DNA, 15 bp, Homo sapiens
ggcaggctgggccat

SEQ ID NO: 1373771 - DNA, 16 bp, Homo sapiens
ggcaggctgggccatg

SEQ ID NO: 1373772 - DNA, 16 bp, Homo sapiens
ggcaggggcctggaga

SEQ ID NO: 1373773 - DNA, 16 bp, Homo sapiens
ggcaggggctggaggg

SEQ ID NO: 1373774 - DNA, 14 bp, Homo sapiens
ggcaggggtggggg

SEQ ID NO: 1373775 - DNA, 15 bp, Homo sapiens
ggcaggttggtgggg

SEQ ID NO: 1373776 - DNA, 21 bp, Homo sapiens
ggcagtagaactccaggccct

SEQ ID NO: 1373777 - DNA, 12 bp, Homo sapiens
ggcataaagtaa

SEQ ID NO: 1373778 - DNA, 16 bp, Homo sapiens
ggcatagaggcttctc

SEQ ID NO: 1373779 - DNA, 22 bp, Homo sapiens
ggcatagaggcttctccgccag

SEQ ID NO: 1373780 - DNA, 13 bp, Homo sapiens
ggcatcatgcatg

SEQ ID NO: 1373781 - DNA, 11 bp, Homo sapiens
ggcatgtaaat

SEQ ID NO: 1373782 - DNA, 21 bp, Homo sapiens
ggcatgtaaatgtaaactcag

SEQ ID NO: 1373783 - DNA, 23 bp, Homo sapiens
ggccaaagtgccggtgagaccca

SEQ ID NO: 1373784 - DNA, 17 bp, Homo sapiens
ggccaagaatattgcaa

SEQ ID NO: 1373785 - DNA, 21 bp, Homo sapiens
ggccaagaatgtacgtccagc

SEQ ID NO: 1373786 - DNA, 13 bp, Homo sapiens
ggccaaggtggga

SEQ ID NO: 1373787 - DNA, 17 bp, Homo sapiens
ggccacagcgccagcct

SEQ ID NO: 1373788 - DNA, 23 bp, Homo sapiens
ggccacgtgggcaaacaggcagt

SEQ ID NO: 1373789 - DNA, 13 bp, Homo sapiens
ggccactccgaga

SEQ ID NO: 1373790 - DNA, 21 bp, Homo sapiens
ggccagagagcctggtgctgc

SEQ ID NO: 1373791 - DNA, 23 bp, Homo sapiens
ggccagagagcctggtgctgctg

SEQ ID NO: 1373792 - DNA, 19 bp, Homo sapiens
ggccagaggcccccagccc

SEQ ID NO: 1373793 - DNA, 21 bp, Homo sapiens
ggccagaggcccccagcccag

SEQ ID NO: 1373794 - DNA, 20 bp, Homo sapiens
ggccagcctccgagagggag

SEQ ID NO: 1373795 - DNA, 22 bp, Homo sapiens
ggccagcctccgagagggagag

SEQ ID NO: 1373796 - DNA, 13 bp, Homo sapiens
ggccagcgtggct

SEQ ID NO: 1373797 - DNA, 20 bp, Homo sapiens
ggccagtccaccctgcctgc

SEQ ID NO: 1373798 - DNA, 14 bp, Homo sapiens
ggccagtccaggct

SEQ ID NO: 1373799 - DNA, 13 bp, Homo sapiens
ggccatgctgagg

SEQ ID NO: 1373800 - DNA, 16 bp, Homo sapiens
ggccatgtccaaagag

SEQ ID NO: 1373801 - DNA, 22 bp, Homo sapiens
ggccatgtccaaagaggctgcc

SEQ ID NO: 1373802 - DNA, 23 bp, Homo sapiens
ggccatgtccaaagaggctgccc

SEQ ID NO: 1373803 - DNA, 14 bp, Homo sapiens
ggccatttgcaata

SEQ ID NO: 1373804 - DNA, 21 bp, Homo sapiens
ggccatttgcaataacagctg

SEQ ID NO: 1373805 - DNA, 20 bp, Homo sapiens
ggcccacccggtgggacccc

SEQ ID NO: 1373806 - DNA, 15 bp, Homo sapiens
ggcccagtgcatggt

SEQ ID NO: 1373807 - DNA, 18 bp, Homo sapiens
ggcccatagcagccagtt

SEQ ID NO: 1373808 - DNA, 20 bp, Homo sapiens
ggccccagcacctcagcctg

SEQ ID NO: 1373809 - DNA, 21 bp, Homo sapiens
ggccccagccctgctggggat

SEQ ID NO: 1373810 - DNA, 22 bp, Homo sapiens
ggccccagccctgctggggatc

SEQ ID NO: 1373811 - DNA, 15 bp, Homo sapiens
ggcccccacttgcct

SEQ ID NO: 1373812 - DNA, 14 bp, Homo sapiens
ggcccccagcccag

SEQ ID NO: 1373813 - DNA, 17 bp, Homo sapiens
ggcccccagcccagggc

SEQ ID NO: 1373814 - DNA, 13 bp, Homo sapiens
ggcccctggcact

SEQ ID NO: 1373815 - DNA, 21 bp, Homo sapiens
ggcccctgggcttggcctgct

SEQ ID NO: 1373816 - DNA, 23 bp, Homo sapiens
ggcccctgggcttggcctgctgt

SEQ ID NO: 1373817 - DNA, 17 bp, Homo sapiens
ggcccgcgccacaggac

SEQ ID NO: 1373818 - DNA, 19 bp, Homo sapiens
ggccctgagtctgggcagc

SEQ ID NO: 1373819 - DNA, 17 bp, Homo sapiens
ggccctggcctcccctg

SEQ ID NO: 1373820 - DNA, 13 bp, Homo sapiens
ggccctgggctgg

SEQ ID NO: 1373821 - DNA, 15 bp, Homo sapiens
ggccctgggctggaa

SEQ ID NO: 1373822 - DNA, 12 bp, Homo sapiens
ggccgaggcggg

SEQ ID NO: 1373823 - DNA, 14 bp, Homo sapiens
ggccgaggcgggtg

SEQ ID NO: 1373824 - DNA, 14 bp, Homo sapiens
ggccgccgcctctt

SEQ ID NO: 1373825 - DNA, 16 bp, Homo sapiens
ggccgcgccctttccc

SEQ ID NO: 1373826 - DNA, 12 bp, Homo sapiens
ggccggccctgt

SEQ ID NO: 1373827 - DNA, 16 bp, Homo sapiens
ggccgtatctccggct

SEQ ID NO: 1373828 - DNA, 21 bp, Homo sapiens
ggccgtatctccggctcccag

SEQ ID NO: 1373829 - DNA, 20 bp, Homo sapiens
ggcctacagctttgatccct

SEQ ID NO: 1373830 - DNA, 19 bp, Homo sapiens
ggcctagcgatctctcctg

SEQ ID NO: 1373831 - DNA, 23 bp, Homo sapiens
ggcctagcgatctctcctggcct

SEQ ID NO: 1373832 - DNA, 14 bp, Homo sapiens
ggcctatttcatca

SEQ ID NO: 1373833 - DNA, 17 bp, Homo sapiens
ggcctcatgtggctgga

SEQ ID NO: 1373834 - DNA, 19 bp, Homo sapiens
ggcctcatgtggctggaag

SEQ ID NO: 1373835 - DNA, 17 bp, Homo sapiens
ggcctcccctgccacca

SEQ ID NO: 1373836 - DNA, 22 bp, Homo sapiens
ggcctcccctgccaccaggcca

SEQ ID NO: 1373837 - DNA, 15 bp, Homo sapiens
ggcctctccatttgc

SEQ ID NO: 1373838 - DNA, 20 bp, Homo sapiens
ggcctctccatttgctcttc

SEQ ID NO: 1373839 - DNA, 16 bp, Homo sapiens
ggcctgcgaccctggg

SEQ ID NO: 1373840 - DNA, 13 bp, Homo sapiens
ggccttaatttcc

SEQ ID NO: 1373841 - DNA, 15 bp, Homo sapiens
ggccttaatttcctt

SEQ ID NO: 1373842 - DNA, 17 bp, Homo sapiens
ggccttaatttcctttt

SEQ ID NO: 1373843 - DNA, 19 bp, Homo sapiens
ggccttgtcctcagccagt

SEQ ID NO: 1373844 - DNA, 17 bp, Homo sapiens
ggccttttctggcaccg

SEQ ID NO: 1373845 - DNA, 20 bp, Homo sapiens
ggcgacagagcgagactccg

SEQ ID NO: 1373846 - DNA, 21 bp, Homo sapiens
ggcgaccaccgcccctggccg

SEQ ID NO: 1373847 - DNA, 15 bp, Homo sapiens
ggcgcaggtgggctg

SEQ ID NO: 1373848 - DNA, 16 bp, Homo sapiens
ggcgcaggtgggctgg

SEQ ID NO: 1373849 - DNA, 17 bp, Homo sapiens
ggcggcaggggcctgga

SEQ ID NO: 1373850 - DNA, 14 bp, Homo sapiens
ggcgtacaggctgg

SEQ ID NO: 1373851 - DNA, 17 bp, Homo sapiens
ggcgtggagggaggccc

SEQ ID NO: 1373852 - DNA, 16 bp, Homo sapiens
ggcgtggcccaaggct

SEQ ID NO: 1373853 - DNA, 18 bp, Homo sapiens
ggcgtgggagccagcctc

SEQ ID NO: 1373854 - DNA, 22 bp, Homo sapiens
ggctagggagacgccatgtgat

SEQ ID NO: 1373855 - DNA, 17 bp, Homo sapiens
ggctatgtataaaatac

SEQ ID NO: 1373856 - DNA, 18 bp, Homo sapiens
ggctcacacacctgtagc

SEQ ID NO: 1373857 - DNA, 13 bp, Homo sapiens
ggctcactgccag

SEQ ID NO: 1373858 - DNA, 14 bp, Homo sapiens
ggctcactgccagg

SEQ ID NO: 1373859 - DNA, 19 bp, Homo sapiens
ggctcactgccaggccagc

SEQ ID NO: 1373860 - DNA, 22 bp, Homo sapiens
ggctcactgccaggccagcctc

SEQ ID NO: 1373861 - DNA, 21 bp, Homo sapiens
ggctcagctcggggagcctta

SEQ ID NO: 1373862 - DNA, 13 bp, Homo sapiens
ggctcccagcctc

SEQ ID NO: 1373863 - DNA, 23 bp, Homo sapiens
ggctcccaggggtctccctggct

SEQ ID NO: 1373864 - DNA, 15 bp, Homo sapiens
ggctccggcctctgc

SEQ ID NO: 1373865 - DNA, 13 bp, Homo sapiens
ggctcgaatctct

SEQ ID NO: 1373866 - DNA, 18 bp, Homo sapiens
ggctcgaatctctgtgcc

SEQ ID NO: 1373867 - DNA, 20 bp, Homo sapiens
ggctcgaatctctgtgcctt

SEQ ID NO: 1373868 - DNA, 19 bp, Homo sapiens
ggctcgtggactgagtggg

SEQ ID NO: 1373869 - DNA, 14 bp, Homo sapiens
ggctctgagcgcct

SEQ ID NO: 1373870 - DNA, 13 bp, Homo sapiens
ggctgaaaacaat

SEQ ID NO: 1373871 - DNA, 16 bp, Homo sapiens
ggctgaaattctcctg

SEQ ID NO: 1373872 - DNA, 17 bp, Homo sapiens
ggctgaaattctcctgg

SEQ ID NO: 1373873 - DNA, 19 bp, Homo sapiens
ggctgaaattctcctggag

SEQ ID NO: 1373874 - DNA, 15 bp, Homo sapiens
ggctgaggtgggagg

SEQ ID NO: 1373875 - DNA, 16 bp, Homo sapiens
ggctgaggttcctctg

SEQ ID NO: 1373876 - DNA, 19 bp, Homo sapiens
ggctgaggttcctctgcct

SEQ ID NO: 1373877 - DNA, 23 bp, Homo sapiens
ggctgaggttcctctgcctgccc

SEQ ID NO: 1373878 - DNA, 24 bp, Homo sapiens
ggctgatgtcaatttctgtgttgc

SEQ ID NO: 1373879 - DNA, 18 bp, Homo sapiens
ggctgcagaggccagagg

SEQ ID NO: 1373880 - DNA, 19 bp, Homo sapiens
ggctgcagaggccagaggc

SEQ ID NO: 1373881 - DNA, 17 bp, Homo sapiens
ggctgcagttctactca

SEQ ID NO: 1373882 - DNA, 19 bp, Homo sapiens
ggctgcggcgtacaggctg

SEQ ID NO: 1373883 - DNA, 18 bp, Homo sapiens
ggctgctgcccccacccc

SEQ ID NO: 1373884 - DNA, 15 bp, Homo sapiens
ggctgcttcctcctg

SEQ ID NO: 1373885 - DNA, 17 bp, Homo sapiens
ggctgcttcctcctgga

SEQ ID NO: 1373886 - DNA, 18 bp, Homo sapiens
ggctgcttcctcctggaa

SEQ ID NO: 1373887 - DNA, 19 bp, Homo sapiens
ggctgcttcctcctggaaa

SEQ ID NO: 1373888 - DNA, 22 bp, Homo sapiens
ggctggccagtccaggctgccg

SEQ ID NO: 1373889 - DNA, 11 bp, Homo sapiens
ggctgggaaat

SEQ ID NO: 1373890 - DNA, 17 bp, Homo sapiens
ggctgggccatgtccaa

SEQ ID NO: 1373891 - DNA, 20 bp, Homo sapiens
ggctgggccatgtccaaaga

SEQ ID NO: 1373892 - DNA, 19 bp, Homo sapiens
ggctgggtggcaccagcag

SEQ ID NO: 1373893 - DNA, 20 bp, Homo sapiens
ggctggtacaacggaggcct

SEQ ID NO: 1373894 - DNA, 22 bp, Homo sapiens
ggctggtggagaactctggctt

SEQ ID NO: 1373895 - DNA, 23 bp, Homo sapiens
ggctgtcaatgggacctgtggct

SEQ ID NO: 1373896 - DNA, 18 bp, Homo sapiens
ggctgtcagtatgacatt

SEQ ID NO: 1373897 - DNA, 15 bp, Homo sapiens
ggctgtggtcacagc

SEQ ID NO: 1373898 - DNA, 14 bp, Homo sapiens
ggctgtgttggtgt

SEQ ID NO: 1373899 - DNA, 14 bp, Homo sapiens
ggcttaatcatttt

SEQ ID NO: 1373900 - DNA, 22 bp, Homo sapiens
ggcttagtttgtgtgttgtctc

SEQ ID NO: 1373901 - DNA, 16 bp, Homo sapiens
ggcttctgtgcccaga

SEQ ID NO: 1373902 - DNA, 13 bp, Homo sapiens
ggcttgaagccaa

SEQ ID NO: 1373903 - DNA, 13 bp, Homo sapiens
ggcttggcctgct

SEQ ID NO: 1373904 - DNA, 14 bp, Homo sapiens
ggcttggcctgctg

SEQ ID NO: 1373905 - DNA, 16 bp, Homo sapiens
ggcttgtagttcttta

SEQ ID NO: 1373906 - DNA, 22 bp, Homo sapiens
ggcttgtctatactccttccct

SEQ ID NO: 1373907 - DNA, 14 bp, Homo sapiens
ggctttctggggcc

SEQ ID NO: 1373908 - DNA, 15 bp, Homo sapiens
ggctttctgttgcca

SEQ ID NO: 1373909 - DNA, 17 bp, Homo sapiens
ggctttgccattgtgaa

SEQ ID NO: 1373910 - DNA, 13 bp, Homo sapiens
gggaaaatcagcc

SEQ ID NO: 1373911 - DNA, 23 bp, Homo sapiens
gggaaaatcagcctgctccagct

SEQ ID NO: 1373912 - DNA, 18 bp, Homo sapiens
gggaaagacactgcctgg

SEQ ID NO: 1373913 - DNA, 14 bp, Homo sapiens
gggaacatgccccc

SEQ ID NO: 1373914 - DNA, 19 bp, Homo sapiens
gggaacctccccagcctgc

SEQ ID NO: 1373915 - DNA, 16 bp, Homo sapiens
gggaagagatccaaag

SEQ ID NO: 1373916 - DNA, 17 bp, Homo sapiens
gggaagagatccaaaga

SEQ ID NO: 1373917 - DNA, 13 bp, Homo sapiens
gggacaagggatt

SEQ ID NO: 1373918 - DNA, 22 bp, Homo sapiens
gggacagagtagccaggttctg

SEQ ID NO: 1373919 - DNA, 19 bp, Homo sapiens
gggaccaccctgagccggc

SEQ ID NO: 1373920 - DNA, 15 bp, Homo sapiens
gggacccagtgcaga

SEQ ID NO: 1373921 - DNA, 23 bp, Homo sapiens
gggacccccgtggggcagggagc

SEQ ID NO: 1373922 - DNA, 18 bp, Homo sapiens
gggacctgccaggcaggg

SEQ ID NO: 1373923 - DNA, 19 bp, Homo sapiens
gggacctgccaggcagggg

SEQ ID NO: 1373924 - DNA, 20 bp, Homo sapiens
gggactacccatagacatga

SEQ ID NO: 1373925 - DNA, 22 bp, Homo sapiens
gggactcagccttcagacagag

SEQ ID NO: 1373926 - DNA, 20 bp, Homo sapiens
gggagacggtttccagggag

SEQ ID NO: 1373927 - DNA, 22 bp, Homo sapiens
gggagccaaaatctcaagaaat

SEQ ID NO: 1373928 - DNA, 18 bp, Homo sapiens
gggagccttagccgccca

SEQ ID NO: 1373929 - DNA, 13 bp, Homo sapiens
gggagcggaggtt

SEQ ID NO: 1373930 - DNA, 19 bp, Homo sapiens
gggagctgggcccgacatg

SEQ ID NO: 1373931 - DNA, 23 bp, Homo sapiens
gggaggatctcttgagcctggga

SEQ ID NO: 1373932 - DNA, 20 bp, Homo sapiens
gggaggcggagcttgcagtg

SEQ ID NO: 1373933 - DNA, 19 bp, Homo sapiens
gggaggctgaggcaggaga

SEQ ID NO: 1373934 - DNA, 13 bp, Homo sapiens
gggaggcttcccc

SEQ ID NO: 1373935 - DNA, 15 bp, Homo sapiens
gggagggggatccga

SEQ ID NO: 1373936 - DNA, 18 bp, Homo sapiens
gggaggtcaaggctgcag

SEQ ID NO: 1373937 - DNA, 15 bp, Homo sapiens
gggaggtcactggaa

SEQ ID NO: 1373938 - DNA, 19 bp, Homo sapiens
gggatccccgcctggccag

SEQ ID NO: 1373939 - DNA, 22 bp, Homo sapiens
gggatccccgcctggccaggag

SEQ ID NO: 1373940 - DNA, 19 bp, Homo sapiens
gggattctggttccagggt

SEQ ID NO: 1373941 - DNA, 18 bp, Homo sapiens
gggcacaggaggcaggca

SEQ ID NO: 1373942 - DNA, 15 bp, Homo sapiens
gggcagctgtccctt

SEQ ID NO: 1373943 - DNA, 15 bp, Homo sapiens
gggcaggctgggcca

SEQ ID NO: 1373944 - DNA, 17 bp, Homo sapiens
gggccatgctgaggcct

SEQ ID NO: 1373945 - DNA, 16 bp, Homo sapiens
gggccatgtccaaaga

SEQ ID NO: 1373946 - DNA, 17 bp, Homo sapiens
gggccatgtccaaagag

SEQ ID NO: 1373947 - DNA, 21 bp, Homo sapiens
gggccatgtccaaagaggctg

SEQ ID NO: 1373948 - DNA, 14 bp, Homo sapiens
gggccatttgcaat

SEQ ID NO: 1373949 - DNA, 11 bp, Homo sapiens
gggccccagct

SEQ ID NO: 1373950 - DNA, 14 bp, Homo sapiens
gggcccctgggctt

SEQ ID NO: 1373951 - DNA, 14 bp, Homo sapiens
gggccctgagtctg

SEQ ID NO: 1373952 - DNA, 15 bp, Homo sapiens
gggccctgggctgga

SEQ ID NO: 1373953 - DNA, 13 bp, Homo sapiens
gggccgaccagag

SEQ ID NO: 1373954 - DNA, 17 bp, Homo sapiens
gggccgccgcctctttc

SEQ ID NO: 1373955 - DNA, 16 bp, Homo sapiens
gggccgtatctccggc

SEQ ID NO: 1373956 - DNA, 20 bp, Homo sapiens
gggccgtatctccggctccc

SEQ ID NO: 1373957 - DNA, 20 bp, Homo sapiens
gggcctagcgatctctcctg

SEQ ID NO: 1373958 - DNA, 18 bp, Homo sapiens
gggcctggtcgttttcaa

SEQ ID NO: 1373959 - DNA, 10 bp, Homo sapiens
gggctcagca

SEQ ID NO: 1373960 - DNA, 18 bp, Homo sapiens
gggctcagcaaaagatgc

SEQ ID NO: 1373961 - DNA, 18 bp, Homo sapiens
gggctcctgcacttactt

SEQ ID NO: 1373962 - DNA, 16 bp, Homo sapiens
gggctctgtgcagtca

SEQ ID NO: 1373963 - DNA, 18 bp, Homo sapiens
gggctgcttcctcctgga

SEQ ID NO: 1373964 - DNA, 20 bp, Homo sapiens
gggctgcttcctcctggaaa

SEQ ID NO: 1373965 - DNA, 14 bp, Homo sapiens
gggcttatatctgg

SEQ ID NO: 1373966 - DNA, 17 bp, Homo sapiens
gggcttgaagccaaaga

SEQ ID NO: 1373967 - DNA, 17 bp, Homo sapiens
gggcttgtagttcttta

SEQ ID NO: 1373968 - DNA, 12 bp, Homo sapiens
ggggaatctaag

SEQ ID NO: 1373969 - DNA, 13 bp, Homo sapiens
ggggacccagtgc

SEQ ID NO: 1373970 - DNA, 21 bp, Homo sapiens
ggggacccagtgcagaatgta

SEQ ID NO: 1373971 - DNA, 11 bp, Homo sapiens
ggggaccctgt

SEQ ID NO: 1373972 - DNA, 16 bp, Homo sapiens
ggggagagcctgctgg

SEQ ID NO: 1373973 - DNA, 18 bp, Homo sapiens
ggggagagcctgctggca

SEQ ID NO: 1373974 - DNA, 15 bp, Homo sapiens
ggggagggattctgg

SEQ ID NO: 1373975 - DNA, 15 bp, Homo sapiens
ggggagggggatccg

SEQ ID NO: 1373976 - DNA, 22 bp, Homo sapiens
ggggatccccgcctggccagga

SEQ ID NO: 1373977 - DNA, 14 bp, Homo sapiens
ggggcaggctgggc

SEQ ID NO: 1373978 - DNA, 16 bp, Homo sapiens
ggggcaggctgggcca

SEQ ID NO: 1373979 - DNA, 19 bp, Homo sapiens
ggggcagggagctgggccc

SEQ ID NO: 1373980 - DNA, 17 bp, Homo sapiens
ggggcatgaccagatgc

SEQ ID NO: 1373981 - DNA, 14 bp, Homo sapiens
ggggccaccaaagc

SEQ ID NO: 1373982 - DNA, 19 bp, Homo sapiens
ggggcccagggcaagctcc

SEQ ID NO: 1373983 - DNA, 12 bp, Homo sapiens
ggggcccagtgc

SEQ ID NO: 1373984 - DNA, 21 bp, Homo sapiens
ggggccgggcgcggtggctca

SEQ ID NO: 1373985 - DNA, 19 bp, Homo sapiens
ggggcctggagatcctcct

SEQ ID NO: 1373986 - DNA, 19 bp, Homo sapiens
ggggcgtggagggaggccc

SEQ ID NO: 1373987 - DNA, 16 bp, Homo sapiens
ggggctgcttcctcct

SEQ ID NO: 1373988 - DNA, 17 bp, Homo sapiens
ggggctggcactgactg

SEQ ID NO: 1373989 - DNA, 22 bp, Homo sapiens
ggggcttagggtcggaacccaa

SEQ ID NO: 1373990 - DNA, 15 bp, Homo sapiens
gtacataatactgaa

SEQ ID NO: 1373991 - DNA, 21 bp, Homo sapiens
gtacatttctataaatagatg

SEQ ID NO: 1373992 - DNA, 17 bp, Homo sapiens
gtacccggggcccaggg

SEQ ID NO: 1373993 - DNA, 19 bp, Homo sapiens
gtacgacgtcagatgttta

SEQ ID NO: 1373994 - DNA, 21 bp, Homo sapiens
gtactctcatcactacagtat

SEQ ID NO: 1373995 - DNA, 22 bp, Homo sapiens
gtactgttcggaaggggttcct

SEQ ID NO: 1373996 - DNA, 15 bp, Homo sapiens
gtacttggcctttgg

SEQ ID NO: 1373997 - DNA, 21 bp, Homo sapiens
gtactttctgttatgggcttt

SEQ ID NO: 1373998 - DNA, 17 bp, Homo sapiens
gtacttttaaaaacata

SEQ ID NO: 1373999 - DNA, 23 bp, Homo sapiens
gtacttttattttacacagaaac

SEQ ID NO: 1374000 - DNA, 21 bp, Homo sapiens
gtacttttcattctcttttaa

SEQ ID NO: 1374001 - DNA, 20 bp, Homo sapiens
gtacttttttaaatattttc

SEQ ID NO: 1374002 - DNA, 17 bp, Homo sapiens
gtagaaaatgtgaccct

SEQ ID NO: 1374003 - DNA, 14 bp, Homo sapiens
gtagaaatgatgat

SEQ ID NO: 1374004 - DNA, 16 bp, Homo sapiens
gtagaactgtctgtga

SEQ ID NO: 1374005 - DNA, 20 bp, Homo sapiens
gtagagtgtagactgtggct

SEQ ID NO: 1374006 - DNA, 15 bp, Homo sapiens
gtagagtgtgcctga

SEQ ID NO: 1374007 - DNA, 17 bp, Homo sapiens
gtagatatgtattcttt

SEQ ID NO: 1374008 - DNA, 12 bp, Homo sapiens
gtagatttgatt

SEQ ID NO: 1374009 - DNA, 14 bp, Homo sapiens
gtagattttccaaa

SEQ ID NO: 1374010 - DNA, 14 bp, Homo sapiens
gtagccctcccact

SEQ ID NO: 1374011 - DNA, 14 bp, Homo sapiens
gtaggagctgcctt

SEQ ID NO: 1374012 - DNA, 17 bp, Homo sapiens
gtaggagggtgggaagg

SEQ ID NO: 1374013 - DNA, 13 bp, Homo sapiens
gtaggtaagactg

SEQ ID NO: 1374014 - DNA, 17 bp, Homo sapiens
gtaggttcagccaaggt

SEQ ID NO: 1374015 - DNA, 15 bp, Homo sapiens
gtagttctgtatttg

SEQ ID NO: 1374016 - DNA, 13 bp, Homo sapiens
gtataataaaatt

SEQ ID NO: 1374017 - DNA, 14 bp, Homo sapiens
gtataataaaatta

SEQ ID NO: 1374018 - DNA, 12 bp, Homo sapiens
gtataataggct

SEQ ID NO: 1374019 - DNA, 20 bp, Homo sapiens
gtatagcatgaaataaaata

SEQ ID NO: 1374020 - DNA, 21 bp, Homo sapiens
gtatagcctatggcagaaaaa

SEQ ID NO: 1374021 - DNA, 23 bp, Homo sapiens
gtatagcctatggcagaaaaaat

SEQ ID NO: 1374022 - DNA, 13 bp, Homo sapiens
gtatatattttgt

SEQ ID NO: 1374023 - DNA, 19 bp, Homo sapiens
gtatattaaaaaagagaca

SEQ ID NO: 1374024 - DNA, 18 bp, Homo sapiens
gtatatttgatttattaa

SEQ ID NO: 1374025 - DNA, 22 bp, Homo sapiens
gtatctagagcttaatgctaca

SEQ ID NO: 1374026 - DNA, 13 bp, Homo sapiens
gtatgaaaacatg

SEQ ID NO: 1374027 - DNA, 20 bp, Homo sapiens
gtatgaaaacatggaacagt

SEQ ID NO: 1374028 - DNA, 21 bp, Homo sapiens
gtatggctttatttttttgaa

SEQ ID NO: 1374029 - DNA, 15 bp, Homo sapiens
gtatgtgggatattg

SEQ ID NO: 1374030 - DNA, 20 bp, Homo sapiens
gtatgtgggatattgaatgt

SEQ ID NO: 1374031 - DNA, 16 bp, Homo sapiens
gtatgtggttttgtaa

SEQ ID NO: 1374032 - DNA, 13 bp, Homo sapiens
gtatgtgtttaga

SEQ ID NO: 1374033 - DNA, 22 bp, Homo sapiens
gtatgtgtttagaattgaaggt

SEQ ID NO: 1374034 - DNA, 18 bp, Homo sapiens
gtatgttaaagagaatga

SEQ ID NO: 1374035 - DNA, 16 bp, Homo sapiens
gtattatcaaagggat

SEQ ID NO: 1374036 - DNA, 22 bp, Homo sapiens
gtattatcaaagggataaagaa

SEQ ID NO: 1374037 - DNA, 16 bp, Homo sapiens
gtattatttacattta

SEQ ID NO: 1374038 - DNA, 16 bp, Homo sapiens
gtattcttctcttcct

SEQ ID NO: 1374039 - DNA, 22 bp, Homo sapiens
gtattcttctcttccttttatc

SEQ ID NO: 1374040 - DNA, 21 bp, Homo sapiens
gtattgtcctattagtgttat

SEQ ID NO: 1374041 - DNA, 18 bp, Homo sapiens
gtattgtttaaaatgtaa

SEQ ID NO: 1374042 - DNA, 17 bp, Homo sapiens
gtatttaaaaatagaaa

SEQ ID NO: 1374043 - DNA, 19 bp, Homo sapiens
gtatttaaaaatagaaaca

SEQ ID NO: 1374044 - DNA, 20 bp, Homo sapiens
gtatttaacagaaattgtat

SEQ ID NO: 1374045 - DNA, 12 bp, Homo sapiens
gtatttataata

SEQ ID NO: 1374046 - DNA, 19 bp, Homo sapiens
gtattttcatgaaaatacc

SEQ ID NO: 1374047 - DNA, 19 bp, Homo sapiens
gtattttgtttttgtctta

SEQ ID NO: 1374048 - DNA, 16 bp, Homo sapiens
gtcaaaagtagaactt

SEQ ID NO: 1374049 - DNA, 20 bp, Homo sapiens
gtcaaactgtagaaatgatg

SEQ ID NO: 1374050 - DNA, 15 bp, Homo sapiens
gtcaaagttgaaaat

SEQ ID NO: 1374051 - DNA, 17 bp, Homo sapiens
gtcaaatgatgtgcaaa

SEQ ID NO: 1374052 - DNA, 16 bp, Homo sapiens
gtcaaggcctgctccc

SEQ ID NO: 1374053 - DNA, 22 bp, Homo sapiens
gtcaagggctgtcattgcacat

SEQ ID NO: 1374054 - DNA, 15 bp, Homo sapiens
gtcaagtgaaaaagg

SEQ ID NO: 1374055 - DNA, 18 bp, Homo sapiens
gtcaagttgtcaggttat

SEQ ID NO: 1374056 - DNA, 13 bp, Homo sapiens
gtcaatggcttgt

SEQ ID NO: 1374057 - DNA, 19 bp, Homo sapiens
gtcaatgggacctgtggct

SEQ ID NO: 1374058 - DNA, 19 bp, Homo sapiens
gtcacacattacaaagtta

SEQ ID NO: 1374059 - DNA, 13 bp, Homo sapiens
gtcaccaccaccc

SEQ ID NO: 1374060 - DNA, 15 bp, Homo sapiens
gtcaccaccacccct

SEQ ID NO: 1374061 - DNA, 13 bp, Homo sapiens
gtcaccagagact

SEQ ID NO: 1374062 - DNA, 21 bp, Homo sapiens
gtcacccaaaccggcaggtgc

SEQ ID NO: 1374063 - DNA, 14 bp, Homo sapiens
gtcactcattgctg

SEQ ID NO: 1374064 - DNA, 18 bp, Homo sapiens
gtcactcattgctgagcc

SEQ ID NO: 1374065 - DNA, 22 bp, Homo sapiens
gtcactcattgctgagcctctg

SEQ ID NO: 1374066 - DNA, 23 bp, Homo sapiens
gtcactcattgctgagcctctgc

SEQ ID NO: 1374067 - DNA, 24 bp, Homo sapiens
gtcactcattgctgagcctctgct

SEQ ID NO: 1374068 - DNA, 23 bp, Homo sapiens
gtcactggaaaggggagagcctg

SEQ ID NO: 1374069 - DNA, 14 bp, Homo sapiens
gtcactgtttcctg

SEQ ID NO: 1374070 - DNA, 14 bp, Homo sapiens
gtcagcagttgctg

SEQ ID NO: 1374071 - DNA, 11 bp, Homo sapiens
gtcagttttca

SEQ ID NO: 1374072 - DNA, 22 bp, Homo sapiens
gtcatatcaaataaagagagaa

SEQ ID NO: 1374073 - DNA, 18 bp, Homo sapiens
gtcatccagactcagagc

SEQ ID NO: 1374074 - DNA, 12 bp, Homo sapiens
gtcattaaactg

SEQ ID NO: 1374075 - DNA, 13 bp, Homo sapiens
gtcattaaactgg

SEQ ID NO: 1374076 - DNA, 20 bp, Homo sapiens
gtcattcagagtcagccagg

SEQ ID NO: 1374077 - DNA, 19 bp, Homo sapiens
gtccaaagaggctgcccct

SEQ ID NO: 1374078 - DNA, 19 bp, Homo sapiens
gtccacgcgtgccgtggca

SEQ ID NO: 1374079 - DNA, 16 bp, Homo sapiens
gtccagctctggaggg

SEQ ID NO: 1374080 - DNA, 19 bp, Homo sapiens
gtccagctgcccttccgca

SEQ ID NO: 1374081 - DNA, 13 bp, Homo sapiens
gtccagctggcct

SEQ ID NO: 1374082 - DNA, 19 bp, Homo sapiens
gtccagctggcctggacag

SEQ ID NO: 1374083 - DNA, 14 bp, Homo sapiens
gtccagtaagatca

SEQ ID NO: 1374084 - DNA, 19 bp, Homo sapiens
gtccagtaagatcactgtt

SEQ ID NO: 1374085 - DNA, 20 bp, Homo sapiens
gtccagtaagatcactgttt

SEQ ID NO: 1374086 - DNA, 15 bp, Homo sapiens
gtccagtgtttcttt

SEQ ID NO: 1374087 - DNA, 12 bp, Homo sapiens
gtcccagtgccg

SEQ ID NO: 1374088 - DNA, 17 bp, Homo sapiens
gtcccatagtccctgcc

SEQ ID NO: 1374089 - DNA, 18 bp, Homo sapiens
gtcccatagtccctgcca

SEQ ID NO: 1374090 - DNA, 14 bp, Homo sapiens
gtccccgctgctgt

SEQ ID NO: 1374091 - DNA, 15 bp, Homo sapiens
gtccctatgcatatc

SEQ ID NO: 1374092 - DNA, 11 bp, Homo sapiens
gtccctctgtg

SEQ ID NO: 1374093 - DNA, 20 bp, Homo sapiens
gtcccttccccatgcttcct

SEQ ID NO: 1374094 - DNA, 21 bp, Homo sapiens
gtcctaatggtgatgcagtct

SEQ ID NO: 1374095 - DNA, 23 bp, Homo sapiens
gtcctagaaattccccaccctga

SEQ ID NO: 1374096 - DNA, 20 bp, Homo sapiens
gtcctagaggccctttgctg

SEQ ID NO: 1374097 - DNA, 23 bp, Homo sapiens
gtcctagcttgggaggcttcccc

SEQ ID NO: 1374098 - DNA, 17 bp, Homo sapiens
gtcctattagtgttata

SEQ ID NO: 1374099 - DNA, 20 bp, Homo sapiens
gtcctattagtgttatatga

SEQ ID NO: 1374100 - DNA, 22 bp, Homo sapiens
gtcctattagtgttatatgaac

SEQ ID NO: 1374101 - DNA, 21 bp, Homo sapiens
gtcctcctcacctcatgccca

SEQ ID NO: 1374102 - DNA, 17 bp, Homo sapiens
gtcctgcctgcaatatt

SEQ ID NO: 1374103 - DNA, 21 bp, Homo sapiens
gtcctgctcattatgccactt

SEQ ID NO: 1374104 - DNA, 22 bp, Homo sapiens
gtcctggcgcctggcagtccgt

SEQ ID NO: 1374105 - DNA, 16 bp, Homo sapiens
gtccttgatttcaaag

SEQ ID NO: 1374106 - DNA, 12 bp, Homo sapiens
gtcgaggcagga

SEQ ID NO: 1374107 - DNA, 18 bp, Homo sapiens
gtcgtgcctgtgtccatg

SEQ ID NO: 1374108 - DNA, 21 bp, Homo sapiens
gtcgtggggtgtgctgggagc

SEQ ID NO: 1374109 - DNA, 17 bp, Homo sapiens
gtctataaaagaaacac

SEQ ID NO: 1374110 - DNA, 19 bp, Homo sapiens
aaaattgaacaaagactac

SEQ ID NO: 1374111 - DNA, 20 bp, Homo sapiens
aaaattgagttgcacttatt

SEQ ID NO: 1374112 - DNA, 16 bp, Homo sapiens
aaaattgtttagtgat

SEQ ID NO: 1374113 - DNA, 18 bp, Homo sapiens
aaaattttgtatgttaaa

SEQ ID NO: 1374114 - DNA, 12 bp, Homo sapiens
aaacaaaatttg

SEQ ID NO: 1374115 - DNA, 17 bp, Homo sapiens
aaacaaaatttgactaa

SEQ ID NO: 1374116 - DNA, 15 bp, Homo sapiens
aaacaaccatgtcat

SEQ ID NO: 1374117 - DNA, 18 bp, Homo sapiens
aaacaatggagtattctc

SEQ ID NO: 1374118 - DNA, 19 bp, Homo sapiens
aaacacaaacgggctcagc

SEQ ID NO: 1374119 - DNA, 17 bp, Homo sapiens
aaacacgttttaaggac

SEQ ID NO: 1374120 - DNA, 22 bp, Homo sapiens
aaacactgcctttttatttata

SEQ ID NO: 1374121 - DNA, 17 bp, Homo sapiens
aaacagagtaatcttgt

SEQ ID NO: 1374122 - DNA, 18 bp, Homo sapiens
aaacagagtaatcttgtt

SEQ ID NO: 1374123 - DNA, 17 bp, Homo sapiens
aaacagtgtgtaaacaa

SEQ ID NO: 1374124 - DNA, 17 bp, Homo sapiens
aaacataacataaattt

SEQ ID NO: 1374125 - DNA, 14 bp, Homo sapiens
aaacatagaaatgg

SEQ ID NO: 1374126 - DNA, 21 bp, Homo sapiens
aaacatagaaatggaaatttt

SEQ ID NO: 1374127 - DNA, 18 bp, Homo sapiens
aaacatcattccttttta

SEQ ID NO: 1374128 - DNA, 21 bp, Homo sapiens
aaacatcattcctttttattt

SEQ ID NO: 1374129 - DNA, 16 bp, Homo sapiens
aaacatgttaatgaca

SEQ ID NO: 1374130 - DNA, 16 bp, Homo sapiens
aaacattgaagtaatg

SEQ ID NO: 1374131 - DNA, 12 bp, Homo sapiens
aaacatttattt

SEQ ID NO: 1374132 - DNA, 23 bp, Homo sapiens
aaacatttattttttttaaagaa

SEQ ID NO: 1374133 - DNA, 21 bp, Homo sapiens
aaaccaaagagggcttcctct

SEQ ID NO: 1374134 - DNA, 14 bp, Homo sapiens
aaaccctcagagcc

SEQ ID NO: 1374135 - DNA, 16 bp, Homo sapiens
aaaccgaataaatgtt

SEQ ID NO: 1374136 - DNA, 11 bp, Homo sapiens
aaacctaggtc

SEQ ID NO: 1374137 - DNA, 18 bp, Homo sapiens
aaacctgggattcaggaa

SEQ ID NO: 1374138 - DNA, 21 bp, Homo sapiens
aaacctgggattcaggaatgt

SEQ ID NO: 1374139 - DNA, 15 bp, Homo sapiens
aaacgggctcagcaa

SEQ ID NO: 1374140 - DNA, 20 bp, Homo sapiens
aaactaaagcaatagaaaca

SEQ ID NO: 1374141 - DNA, 13 bp, Homo sapiens
aaactaaatttca

SEQ ID NO: 1374142 - DNA, 15 bp, Homo sapiens
aaactacatattgta

SEQ ID NO: 1374143 - DNA, 21 bp, Homo sapiens
aaactacctgtatttaaaaat

SEQ ID NO: 1374144 - DNA, 22 bp, Homo sapiens
aaactcactgtgatcaatattt

SEQ ID NO: 1374145 - DNA, 17 bp, Homo sapiens
aaactcaggcaaagaaa

SEQ ID NO: 1374146 - DNA, 16 bp, Homo sapiens
aaactcatctgaaatg

SEQ ID NO: 1374147 - DNA, 17 bp, Homo sapiens
aaactccacatctgcct

SEQ ID NO: 1374148 - DNA, 18 bp, Homo sapiens
aaactccacatctgcctt

SEQ ID NO: 1374149 - DNA, 19 bp, Homo sapiens
aaactccacatctgcctta

SEQ ID NO: 1374150 - DNA, 12 bp, Homo sapiens
aaactcttaaaa

SEQ ID NO: 1374151 - DNA, 15 bp, Homo sapiens
aaactgtagaaatga

SEQ ID NO: 1374152 - DNA, 14 bp, Homo sapiens
aaactgtgttgcca

SEQ ID NO: 1374153 - DNA, 17 bp, Homo sapiens
aaacttaaatgttatta

SEQ ID NO: 1374154 - DNA, 13 bp, Homo sapiens
aaagaaataaacc

SEQ ID NO: 1374155 - DNA, 15 bp, Homo sapiens
aaagaatatgacttt

SEQ ID NO: 1374156 - DNA, 16 bp, Homo sapiens
aaagacagtgtatgta

SEQ ID NO: 1374157 - DNA, 22 bp, Homo sapiens
aaagacctggggctgctgtgaa

SEQ ID NO: 1374158 - DNA, 18 bp, Homo sapiens
aaagactttaaaagtgat

SEQ ID NO: 1374159 - DNA, 14 bp, Homo sapiens
aaagaggctgcccc

SEQ ID NO: 1374160 - DNA, 22 bp, Homo sapiens
aaagaggctgcccctctcacca

SEQ ID NO: 1374161 - DNA, 19 bp, Homo sapiens
aaagagggcttcctctaga

SEQ ID NO: 1374162 - DNA, 11 bp, Homo sapiens
aaagaggtttt

SEQ ID NO: 1374163 - DNA, 19 bp, Homo sapiens
aaagatgcttctcactgcc

SEQ ID NO: 1374164 - DNA, 15 bp, Homo sapiens
aaagcaacaaagaaa

SEQ ID NO: 1374165 - DNA, 17 bp, Homo sapiens
aaagcaataaatgaatg

SEQ ID NO: 1374166 - DNA, 12 bp, Homo sapiens
aaagcaatagaa

SEQ ID NO: 1374167 - DNA, 13 bp, Homo sapiens
aaagcaatagaaa

SEQ ID NO: 1374168 - DNA, 16 bp, Homo sapiens
aaagcagtatttttct

SEQ ID NO: 1374169 - DNA, 11 bp, Homo sapiens
aaagcattttt

SEQ ID NO: 1374170 - DNA, 13 bp, Homo sapiens
aaagcatttttca

SEQ ID NO: 1374171 - DNA, 16 bp, Homo sapiens
aaagcctcctccagcc

SEQ ID NO: 1374172 - DNA, 18 bp, Homo sapiens
aaagctatttatgggccc

SEQ ID NO: 1374173 - DNA, 14 bp, Homo sapiens
aaagctctgaccac

SEQ ID NO: 1374174 - DNA, 22 bp, Homo sapiens
aaagctgcccactgtttctctt

SEQ ID NO: 1374175 - DNA, 20 bp, Homo sapiens
aaagcttggattaaatacat

SEQ ID NO: 1374176 - DNA, 18 bp, Homo sapiens
aaaggaaaatagtaatgt

SEQ ID NO: 1374177 - DNA, 16 bp, Homo sapiens
aaaggaaaatgtctgt

SEQ ID NO: 1374178 - DNA, 15 bp, Homo sapiens
aaaggaagcactctg

SEQ ID NO: 1374179 - DNA, 15 bp, Homo sapiens
aaaggagagcatcgg

SEQ ID NO: 1374180 - DNA, 21 bp, Homo sapiens
aaaggcctcttgtaaagactg

SEQ ID NO: 1374181 - DNA, 13 bp, Homo sapiens
aaaggcgctgaga

SEQ ID NO: 1374182 - DNA, 23 bp, Homo sapiens
aaaggctgtgctgccctgaagaa

SEQ ID NO: 1374183 - DNA, 17 bp, Homo sapiens
aaaggcttgaagctgtg

SEQ ID NO: 1374184 - DNA, 23 bp, Homo sapiens
aaagggcccacagtgacttttgc

SEQ ID NO: 1374185 - DNA, 21 bp, Homo sapiens
aaaggtgagtttgagctgcct

SEQ ID NO: 1374186 - DNA, 18 bp, Homo sapiens
aaagtaatatttattaaa

SEQ ID NO: 1374187 - DNA, 16 bp, Homo sapiens
aaagtagaactttgta

SEQ ID NO: 1374188 - DNA, 16 bp, Homo sapiens
aaagtatgtattattt

SEQ ID NO: 1374189 - DNA, 17 bp, Homo sapiens
aaagtatgtattattta

SEQ ID NO: 1374190 - DNA, 12 bp, Homo sapiens
aaagtattcttc

SEQ ID NO: 1374191 - DNA, 23 bp, Homo sapiens
aaagtctgctctcatataagaca

SEQ ID NO: 1374192 - DNA, 16 bp, Homo sapiens
aaagtctgtctttcct

SEQ ID NO: 1374193 - DNA, 18 bp, Homo sapiens
aaagtcttttttttcctg

SEQ ID NO: 1374194 - DNA, 23 bp, Homo sapiens
aaagtgaagcaaatcagaaactt

SEQ ID NO: 1374195 - DNA, 14 bp, Homo sapiens
aaagtgccaaagaa

SEQ ID NO: 1374196 - DNA, 19 bp, Homo sapiens
aaagtggccaagaagcagt

SEQ ID NO: 1374197 - DNA, 20 bp, Homo sapiens
aaagtgtgtatatattttgt

SEQ ID NO: 1374198 - DNA, 16 bp, Homo sapiens
aaagttaaacattgaa

SEQ ID NO: 1374199 - DNA, 14 bp, Homo sapiens
aaataaaatatatc

SEQ ID NO: 1374200 - DNA, 15 bp, Homo sapiens
aaataaaatgaaaat

SEQ ID NO: 1374201 - DNA, 18 bp, Homo sapiens
aaataaaatttgttgcat

SEQ ID NO: 1374202 - DNA, 22 bp, Homo sapiens
aaataaaccaaaggaaaatgtc

SEQ ID NO: 1374203 - DNA, 11 bp, Homo sapiens
aaataaagaag

SEQ ID NO: 1374204 - DNA, 13 bp, Homo sapiens
aaataaagaagta

SEQ ID NO: 1374205 - DNA, 20 bp, Homo sapiens
aaataaagtttgcttagaaa

SEQ ID NO: 1374206 - DNA, 11 bp, Homo sapiens
aaataaataat

SEQ ID NO: 1374207 - DNA, 12 bp, Homo sapiens
aaataacagtat

SEQ ID NO: 1374208 - DNA, 15 bp, Homo sapiens
aaataacccataatt

SEQ ID NO: 1374209 - DNA, 20 bp, Homo sapiens
aaataagccccctcaactac

SEQ ID NO: 1374210 - DNA, 13 bp, Homo sapiens
aaataatgctaca

SEQ ID NO: 1374211 - DNA, 19 bp, Homo sapiens
aaataatgctacaatttta

SEQ ID NO: 1374212 - DNA, 23 bp, Homo sapiens
aaataattatataactgtatttg

SEQ ID NO: 1374213 - DNA, 13 bp, Homo sapiens
aaataattctttt

SEQ ID NO: 1374214 - DNA, 14 bp, Homo sapiens
aaataattcttttt

SEQ ID NO: 1374215 - DNA, 18 bp, Homo sapiens
aaataattcttttttatt

SEQ ID NO: 1374216 - DNA, 19 bp, Homo sapiens
aaataattcttttttatta

SEQ ID NO: 1374217 - DNA, 21 bp, Homo sapiens
aaataattcttttttattaat

SEQ ID NO: 1374218 - DNA, 12 bp, Homo sapiens
aaatacacattt

SEQ ID NO: 1374219 - DNA, 15 bp, Homo sapiens
aaatacacatttgct

SEQ ID NO: 1374220 - DNA, 15 bp, Homo sapiens
aaatacatagtgaaa

SEQ ID NO: 1374221 - DNA, 17 bp, Homo sapiens
aaatacatagtgaaaat

SEQ ID NO: 1374222 - DNA, 19 bp, Homo sapiens
aaatacatgcatataatga

SEQ ID NO: 1374223 - DNA, 23 bp, Homo sapiens
aaatacatgccacatcaaacctt

SEQ ID NO: 1374224 - DNA, 15 bp, Homo sapiens
aaatactatttaaga

SEQ ID NO: 1374225 - DNA, 16 bp, Homo sapiens
aaatactatttaagat

SEQ ID NO: 1374226 - DNA, 18 bp, Homo sapiens
aaatactatttaagatgt

SEQ ID NO: 1374227 - DNA, 14 bp, Homo sapiens
aaatagaaattttg

SEQ ID NO: 1374228 - DNA, 19 bp, Homo sapiens
aaatagaaattttgtaaga

SEQ ID NO: 1374229 - DNA, 19 bp, Homo sapiens
aagatgaaaggcaggccta

SEQ ID NO: 1374230 - DNA, 17 bp, Homo sapiens
aagatgactgtgttgta

SEQ ID NO: 1374231 - DNA, 13 bp, Homo sapiens
aagatgatcattt

SEQ ID NO: 1374232 - DNA, 17 bp, Homo sapiens
aagatgcttctcactgc

SEQ ID NO: 1374233 - DNA, 11 bp, Homo sapiens
aagatgtgaat

SEQ ID NO: 1374234 - DNA, 15 bp, Homo sapiens
aagatgtgaattatt

SEQ ID NO: 1374235 - DNA, 22 bp, Homo sapiens
aagatgttgatttttactgtgt

SEQ ID NO: 1374236 - DNA, 12 bp, Homo sapiens
aagatttatgtt

SEQ ID NO: 1374237 - DNA, 19 bp, Homo sapiens
aagattttcctcttgtgat

SEQ ID NO: 1374238 - DNA, 19 bp, Homo sapiens
aagcaaatgttaaaagttt

SEQ ID NO: 1374239 - DNA, 19 bp, Homo sapiens
aagcaagtaaaaaggctaa

SEQ ID NO: 1374240 - DNA, 14 bp, Homo sapiens
aagcaataaatgaa

SEQ ID NO: 1374241 - DNA, 12 bp, Homo sapiens
aagcaatagaaa

SEQ ID NO: 1374242 - DNA, 13 bp, Homo sapiens
aagcaatagaaac

SEQ ID NO: 1374243 - DNA, 15 bp, Homo sapiens
aagcaatagaaacaa

SEQ ID NO: 1374244 - DNA, 17 bp, Homo sapiens
aagcaatattttggagt

SEQ ID NO: 1374245 - DNA, 19 bp, Homo sapiens
aagcacaccaatcttactt

SEQ ID NO: 1374246 - DNA, 20 bp, Homo sapiens
aagcacagtctgatgacaca

SEQ ID NO: 1374247 - DNA, 23 bp, Homo sapiens
aagcactacaccttgccttgctg

SEQ ID NO: 1374248 - DNA, 15 bp, Homo sapiens
aagcagagttttcat

SEQ ID NO: 1374249 - DNA, 17 bp, Homo sapiens
aagcagtatttttcttg

SEQ ID NO: 1374250 - DNA, 18 bp, Homo sapiens
aagcagtcgtgcctgtgt

SEQ ID NO: 1374251 - DNA, 21 bp, Homo sapiens
aagcatgcttgtgaaaatgtg

SEQ ID NO: 1374252 - DNA, 18 bp, Homo sapiens
aagcatttttcaatatat

SEQ ID NO: 1374253 - DNA, 15 bp, Homo sapiens
aagccaaagaaaaat

SEQ ID NO: 1374254 - DNA, 21 bp, Homo sapiens
aagccaaagaaaaataaccct

SEQ ID NO: 1374255 - DNA, 18 bp, Homo sapiens
aagccaagggaacctgtg

SEQ ID NO: 1374256 - DNA, 19 bp, Homo sapiens
aagccaagggaacctgtgt

SEQ ID NO: 1374257 - DNA, 13 bp, Homo sapiens
aagccaagtgggg

SEQ ID NO: 1374258 - DNA, 16 bp, Homo sapiens
aagccagcccggccgc

SEQ ID NO: 1374259 - DNA, 19 bp, Homo sapiens
aagccaggctcactcacag

SEQ ID NO: 1374260 - DNA, 22 bp, Homo sapiens
aagccaggctcactcacagagt

SEQ ID NO: 1374261 - DNA, 22 bp, Homo sapiens
aagccattctcctgcctcagcc

SEQ ID NO: 1374262 - DNA, 18 bp, Homo sapiens
aagcccatcctgaccagc

SEQ ID NO: 1374263 - DNA, 20 bp, Homo sapiens
aagcccatcctgaccagctg

SEQ ID NO: 1374264 - DNA, 17 bp, Homo sapiens
aagccgagagccttttg

SEQ ID NO: 1374265 - DNA, 22 bp, Homo sapiens
aagccggggaagagatccaaag

SEQ ID NO: 1374266 - DNA, 23 bp, Homo sapiens
aagcctccacagcgagggcagct

SEQ ID NO: 1374267 - DNA, 17 bp, Homo sapiens
aagccttcagctccagg

SEQ ID NO: 1374268 - DNA, 23 bp, Homo sapiens
aagcgcttttccttggcattccg

SEQ ID NO: 1374269 - DNA, 22 bp, Homo sapiens
aagctactagcaaaataaaaca

SEQ ID NO: 1374270 - DNA, 17 bp, Homo sapiens
aagctagtcaacagtac

SEQ ID NO: 1374271 - DNA, 13 bp, Homo sapiens
aagctagttgaat

SEQ ID NO: 1374272 - DNA, 18 bp, Homo sapiens
aagctattcacattgtta

SEQ ID NO: 1374273 - DNA, 18 bp, Homo sapiens
aagctatttatgggcccc

SEQ ID NO: 1374274 - DNA, 16 bp, Homo sapiens
aagctctgaccacttg

SEQ ID NO: 1374275 - DNA, 15 bp, Homo sapiens
aagctgcaaatctga

SEQ ID NO: 1374276 - DNA, 19 bp, Homo sapiens
aagctgcaaatctgatggc

SEQ ID NO: 1374277 - DNA, 17 bp, Homo sapiens
aagctgcagagatttct

SEQ ID NO: 1374278 - DNA, 23 bp, Homo sapiens
aagctgcagagatttctcattga

SEQ ID NO: 1374279 - DNA, 11 bp, Homo sapiens
aagctgggcag

SEQ ID NO: 1374280 - DNA, 18 bp, Homo sapiens
aagctgttactgtcttca

SEQ ID NO: 1374281 - DNA, 10 bp, Homo sapiens
aagcttagaa

SEQ ID NO: 1374282 - DNA, 11 bp, Homo sapiens
aagcttagaac

SEQ ID NO: 1374283 - DNA, 15 bp, Homo sapiens
aagcttcagttgctt

SEQ ID NO: 1374284 - DNA, 18 bp, Homo sapiens
aagcttggattaaataca

SEQ ID NO: 1374285 - DNA, 21 bp, Homo sapiens
aagcttggttctgtgaacaag

SEQ ID NO: 1374286 - DNA, 22 bp, Homo sapiens
aagctttactggggctggggaa

SEQ ID NO: 1374287 - DNA, 20 bp, Homo sapiens
aaggaaagcaataaatgaat

SEQ ID NO: 1374288 - DNA, 13 bp, Homo sapiens
aaggaaattttac

SEQ ID NO: 1374289 - DNA, 12 bp, Homo sapiens
aaggaaggtgga

SEQ ID NO: 1374290 - DNA, 14 bp, Homo sapiens
aaggacaaagtgcc

SEQ ID NO: 1374291 - DNA, 14 bp, Homo sapiens
aaggactttgtaca

SEQ ID NO: 1374292 - DNA, 20 bp, Homo sapiens
aaggatagtaagcatagaaa

SEQ ID NO: 1374293 - DNA, 22 bp, Homo sapiens
aaggatatttactacttttgca

SEQ ID NO: 1374294 - DNA, 12 bp, Homo sapiens
aaggatttttct

SEQ ID NO: 1374295 - DNA, 13 bp, Homo sapiens
aaggcaagagggg

SEQ ID NO: 1374296 - DNA, 11 bp, Homo sapiens
aaggcaagcca

SEQ ID NO: 1374297 - DNA, 15 bp, Homo sapiens
aaggcaagccaggct

SEQ ID NO: 1374298 - DNA, 15 bp, Homo sapiens
aaggcaggcctattt

SEQ ID NO: 1374299 - DNA, 17 bp, Homo sapiens
aaggcaggcctatttca

SEQ ID NO: 1374300 - DNA, 19 bp, Homo sapiens
aaggcattataaaaagaat

SEQ ID NO: 1374301 - DNA, 20 bp, Homo sapiens
aaggcctcttgtaaagactg

SEQ ID NO: 1374302 - DNA, 13 bp, Homo sapiens
aaggctggcaggt

SEQ ID NO: 1374303 - DNA, 19 bp, Homo sapiens
aaggctgggggaagaagct

SEQ ID NO: 1374304 - DNA, 22 bp, Homo sapiens
aaggctggtacaacggaggcct

SEQ ID NO: 1374305 - DNA, 14 bp, Homo sapiens
aaggcttataaaac

SEQ ID NO: 1374306 - DNA, 15 bp, Homo sapiens
aaggcttataaaaca

SEQ ID NO: 1374307 - DNA, 16 bp, Homo sapiens
aaggcttataaaacag

SEQ ID NO: 1374308 - DNA, 14 bp, Homo sapiens
aagggaagaaactg

SEQ ID NO: 1374309 - DNA, 12 bp, Homo sapiens
aagggagaagaa

SEQ ID NO: 1374310 - DNA, 21 bp, Homo sapiens
aagggccagcgtggctctaaa
